United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 2

SEQ ID NO: 32351 - RNA, 22 nt, Pseudomonas aeruginosa PA01
ggugaucgcguagggcaguugg

SEQ ID NO: 32352 - RNA, 22 nt, Pseudomonas aeruginosa PA01
ggugauguucugccugauggac

SEQ ID NO: 32353 - RNA, 22 nt, Pseudomonas aeruginosa PA01
ggugcacguugagguuggugac

SEQ ID NO: 32354 - RNA, 22 nt, Pseudomonas aeruginosa PA01
ggugccgccggccggcggugcc

SEQ ID NO: 32355 - RNA, 22 nt, Pseudomonas aeruginosa PA01
ggugcgcaccgucgagggcgag

SEQ ID NO: 32356 - RNA, 22 nt, Pseudomonas aeruginosa PA01
ggugcgguuggccgccggcuug

SEQ ID NO: 32357 - RNA, 22 nt, Pseudomonas aeruginosa PA01
ggugcguucgcccggaagcggu

SEQ ID NO: 32358 - RNA, 22 nt, Pseudomonas aeruginosa PA01
ggugcugaucagccugcgccgg

SEQ ID NO: 32359 - RNA, 22 nt, Pseudomonas aeruginosa PA01
ggugcugcuguucaugucgacg

SEQ ID NO: 32360 - RNA, 22 nt, Pseudomonas aeruginosa PA01
ggugcuggcaucgcggcgcacg

SEQ ID NO: 32361 - RNA, 22 nt, Pseudomonas aeruginosa PA01
gguggcaggaugcgcagacugg

SEQ ID NO: 32362 - RNA, 22 nt, Pseudomonas aeruginosa PA01
ggugggauugcccugcaaggcu

SEQ ID NO: 32363 - RNA, 22 nt, Pseudomonas aeruginosa PA01
gguggugcugucggugaucgac

SEQ ID NO: 32364 - RNA, 22 nt, Pseudomonas aeruginosa PA01
ggugucgcgcagggugcugagc

SEQ ID NO: 32365 - RNA, 22 nt, Pseudomonas aeruginosa PA01
gguguggcacagggcugccgag

SEQ ID NO: 32366 - RNA, 22 nt, Pseudomonas aeruginosa PA01
gguugaacagcggcuggccggc

SEQ ID NO: 32367 - RNA, 22 nt, Pseudomonas aeruginosa PA01
gguuggacuggaggaacgcccc

SEQ ID NO: 32368 - RNA, 22 nt, Pseudomonas aeruginosa PA01
gguuggugccggucucgcgggc

SEQ ID NO: 32369 - RNA, 22 nt, Pseudomonas aeruginosa PA01
gguugucuguugcugccugaca

SEQ ID NO: 32370 - RNA, 22 nt, Pseudomonas aeruginosa PA01
guguuuuccgggccggcggccg

SEQ ID NO: 32371 - RNA, 22 nt, Pseudomonas aeruginosa PA01
guucacucuuugucuggcccug

SEQ ID NO: 32372 - RNA, 22 nt, Pseudomonas aeruginosa PA01
guuccggacgggcucggcgagg

SEQ ID NO: 32373 - RNA, 22 nt, Pseudomonas aeruginosa PA01
guucgccuggacgucaaggacu

SEQ ID NO: 32374 - RNA, 22 nt, Pseudomonas aeruginosa PA01
guucgcugccagcgcggccuga

SEQ ID NO: 32375 - RNA, 22 nt, Pseudomonas aeruginosa PA01
guucggcauucuccaggcgcgc

SEQ ID NO: 32376 - RNA, 22 nt, Pseudomonas aeruginosa PA01
guugagcaggugcucguugugc

SEQ ID NO: 32377 - RNA, 22 nt, Pseudomonas aeruginosa PA01
guugaucacuccgcugccgcgc

SEQ ID NO: 32378 - RNA, 22 nt, Pseudomonas aeruginosa PA01
guugaugucguagcucaccagc

SEQ ID NO: 32379 - RNA, 22 nt, Pseudomonas aeruginosa PA01
guugccgaucacgcugucaugg

SEQ ID NO: 32380 - RNA, 22 nt, Pseudomonas aeruginosa PA01
guugcggaucgucguagccgag

SEQ ID NO: 32381 - RNA, 22 nt, Pseudomonas aeruginosa PA01
guugcuugcccuugaucugcuu

SEQ ID NO: 32382 - RNA, 22 nt, Pseudomonas aeruginosa PA01
guuggccaggucgccggcggca

SEQ ID NO: 32383 - RNA, 22 nt, Pseudomonas aeruginosa PA01
guuggugcaugggguucucccg

SEQ ID NO: 32384 - RNA, 22 nt, Pseudomonas aeruginosa PA01
guuuucgcugcgcaggcugucc

SEQ ID NO: 32385 - RNA, 22 nt, Pseudomonas aeruginosa PA01
uaaccgcaggcgguuauucgcc

SEQ ID NO: 32386 - RNA, 23 nt, Pseudomonas aeruginosa PA01
uaagccgggccgcccugcagagc

SEQ ID NO: 32387 - RNA, 22 nt, Pseudomonas aeruginosa PA01
uacaugaucaggccgcaaccga

SEQ ID NO: 32388 - RNA, 22 nt, Pseudomonas aeruginosa PA01
uacccggccugccuugccgucg

SEQ ID NO: 32389 - RNA, 22 nt, Pseudomonas aeruginosa PA01
uaccggcgaguuccgcgcguuc

SEQ ID NO: 32390 - RNA, 22 nt, Pseudomonas aeruginosa PA01
uaccuguugcaggaaggcgaug

SEQ ID NO: 32391 - RNA, 22 nt, Pseudomonas aeruginosa PA01
uacgaccaggguggccuggccg

SEQ ID NO: 32392 - RNA, 22 nt, Pseudomonas aeruginosa PA01
uacgccgaucccagccugaccg

SEQ ID NO: 32393 - RNA, 22 nt, Pseudomonas aeruginosa PA01
uacggcggcgacacccucuggg

SEQ ID NO: 32394 - RNA, 22 nt, Pseudomonas aeruginosa PA01
uacuacaugcucucgcccugga

SEQ ID NO: 32395 - RNA, 21 nt, Pseudomonas aeruginosa PA01
uacuacugcuucuacugcgac

SEQ ID NO: 32396 - RNA, 22 nt, Pseudomonas aeruginosa PA01
uacucggcguaggcgccgccgu

SEQ ID NO: 32397 - RNA, 22 nt, Pseudomonas aeruginosa PA01
uaggcgaagaagccgcgcuccu

SEQ ID NO: 32398 - RNA, 22 nt, Pseudomonas aeruginosa PA01
uaggcgcuggccagcagggugu

SEQ ID NO: 32399 - RNA, 22 nt, Pseudomonas aeruginosa PA01
uagggagacgcgcccgcagccg

SEQ ID NO: 32400 - RNA, 22 nt, Pseudomonas aeruginosa PA01
uagguggcgcuguuggcggcgc

SEQ ID NO: 32401 - RNA, 22 nt, Pseudomonas aeruginosa PA01
uaucaguuugaaguguaucugg

SEQ ID NO: 32402 - RNA, 22 nt, Pseudomonas aeruginosa PA01
uaucgacgccagacuuccagcu

SEQ ID NO: 32403 - RNA, 20 nt, Pseudomonas aeruginosa PA01
uaucgccguugcugccgagc

SEQ ID NO: 32404 - RNA, 22 nt, Pseudomonas aeruginosa PA01
uauggugcaccgcgugcagccg

SEQ ID NO: 32405 - RNA, 22 nt, Pseudomonas aeruginosa PA01
ucaacgaugcuugugcuugcgg

SEQ ID NO: 32406 - RNA, 22 nt, Pseudomonas aeruginosa PA01
ucaagaccuggaccgcgaugga

SEQ ID NO: 32407 - RNA, 22 nt, Pseudomonas aeruginosa PA01
ucaccgcggaacggccgaugcg

SEQ ID NO: 32408 - RNA, 22 nt, Pseudomonas aeruginosa PA01
ucaccgcguucaguugcucggc

SEQ ID NO: 32409 - RNA, 22 nt, Pseudomonas aeruginosa PA01
ucaccguucugcucgaggaggc

SEQ ID NO: 32410 - RNA, 22 nt, Pseudomonas aeruginosa PA01
ucacgccguucagggucagguu

SEQ ID NO: 32411 - RNA, 22 nt, Pseudomonas aeruginosa PA01
ucacgcuugaacugcaugcggu

SEQ ID NO: 32412 - RNA, 20 nt, Pseudomonas aeruginosa PA01
ucagcaggcucagcggcugc

SEQ ID NO: 32413 - RNA, 22 nt, Pseudomonas aeruginosa PA01
ucaggcgcggagugaucucgcc

SEQ ID NO: 32414 - RNA, 22 nt, Pseudomonas aeruginosa PA01
ucaggcguugcgcgauggucgc

SEQ ID NO: 32415 - RNA, 22 nt, Pseudomonas aeruginosa PA01
ucaggcuauaaggcccgaugua

SEQ ID NO: 32416 - RNA, 22 nt, Pseudomonas aeruginosa PA01
ucaggucgacggucucggugug

SEQ ID NO: 32417 - RNA, 22 nt, Pseudomonas aeruginosa PA01
ucaguugggcguugccggacca

SEQ ID NO: 32418 - RNA, 22 nt, Pseudomonas aeruginosa PA01
ucaguuuggucaggcuggccgg

SEQ ID NO: 32419 - RNA, 19 nt, Pseudomonas aeruginosa PA01
ucaucccuuccaccacguu

SEQ ID NO: 32420 - RNA, 22 nt, Pseudomonas aeruginosa PA01
ucaucgcugccaguggguacgc

SEQ ID NO: 32421 - RNA, 22 nt, Pseudomonas aeruginosa PA01
uccaccaccagcaggccggcgg

SEQ ID NO: 32422 - RNA, 21 nt, Pseudomonas aeruginosa PA01
uccaccaguucgaacagcggc

SEQ ID NO: 32423 - RNA, 21 nt, Pseudomonas aeruginosa PA01
uccacggcgguuucuaccggc

SEQ ID NO: 32424 - RNA, 19 nt, Pseudomonas aeruginosa PA01
uccagcgccgggccggugc

SEQ ID NO: 32425 - RNA, 22 nt, Pseudomonas aeruginosa PA01
uccagcuuaucgccgggaccca

SEQ ID NO: 32426 - RNA, 22 nt, Pseudomonas aeruginosa PA01
uccaucagcagcaggcgcggcc

SEQ ID NO: 32427 - RNA, 22 nt, Pseudomonas aeruginosa PA01
uccaucggcgacucgaucgccg

SEQ ID NO: 32428 - RNA, 22 nt, Pseudomonas aeruginosa PA01
ucccaagggucuucuucacugg

SEQ ID NO: 32429 - RNA, 22 nt, Pseudomonas aeruginosa PA01
ucccgccggugaccaguuacgu

SEQ ID NO: 32430 - RNA, 22 nt, Pseudomonas aeruginosa PA01
ucccggacaccgauuuaggcga

SEQ ID NO: 32431 - RNA, 23 nt, Pseudomonas aeruginosa PA01
ucccuccuugcagccggcggcgc

SEQ ID NO: 32432 - RNA, 22 nt, Pseudomonas aeruginosa PA01
uccgauccagcaggggcgccgg

SEQ ID NO: 32433 - RNA, 22 nt, Pseudomonas aeruginosa PA01
uccgcacagugccgucgcugcc

SEQ ID NO: 32434 - RNA, 22 nt, Pseudomonas aeruginosa PA01
uccgccagcucaccggcaccac

SEQ ID NO: 32435 - RNA, 17 nt, Pseudomonas aeruginosa PA01
uccgccggacagguuga

SEQ ID NO: 32436 - RNA, 22 nt, Pseudomonas aeruginosa PA01
uccgccggcgacagcaguucgg

SEQ ID NO: 32437 - RNA, 22 nt, Pseudomonas aeruginosa PA01
uccgccggcggguugcgccaga

SEQ ID NO: 32438 - RNA, 22 nt, Pseudomonas aeruginosa PA01
uccgcgagcugucggcuuccau

SEQ ID NO: 32439 - RNA, 22 nt, Pseudomonas aeruginosa PA01
uccggcaggcagcccgcccuuc

SEQ ID NO: 32440 - RNA, 21 nt, Pseudomonas aeruginosa PA01
uccggcccguaguugcgcacg

SEQ ID NO: 32441 - RNA, 22 nt, Pseudomonas aeruginosa PA01
uccgugguacaccgcaucgaag

SEQ ID NO: 32442 - RNA, 22 nt, Pseudomonas aeruginosa PA01
uccguggucggccuggucuuca

SEQ ID NO: 32443 - RNA, 19 nt, Pseudomonas aeruginosa PA01
uccuccacguggcgccgcu

SEQ ID NO: 32444 - RNA, 22 nt, Pseudomonas aeruginosa PA01
uccucgaccaccgccagcagcu

SEQ ID NO: 32445 - RNA, 22 nt, Pseudomonas aeruginosa PA01
uccucuggcuguucgccagcgg

SEQ ID NO: 32446 - RNA, 22 nt, Pseudomonas aeruginosa PA01
uccugcucggccucgcccgagg

SEQ ID NO: 32447 - RNA, 22 nt, Pseudomonas aeruginosa PA01
uccuggcgggugccgcgcuggc

SEQ ID NO: 32448 - RNA, 22 nt, Pseudomonas aeruginosa PA01
uccuggcgguucagcgcgauca

SEQ ID NO: 32449 - RNA, 22 nt, Pseudomonas aeruginosa PA01
ucgaaaauagcuuagucgauug

SEQ ID NO: 32450 - RNA, 22 nt, Pseudomonas aeruginosa PA01
ucgacacgccgccgggauucgc

SEQ ID NO: 32451 - RNA, 22 nt, Pseudomonas aeruginosa PA01
ucgaccugguccuugagacugg

SEQ ID NO: 32452 - RNA, 22 nt, Pseudomonas aeruginosa PA01
ucgacgaaggcccgggcgcucc

SEQ ID NO: 32453 - RNA, 22 nt, Pseudomonas aeruginosa PA01
ucugcugcugcaacuggucgau

SEQ ID NO: 32454 - RNA, 22 nt, Pseudomonas aeruginosa PA01
ucugcugggauaccgcgaucuc

SEQ ID NO: 32455 - RNA, 22 nt, Pseudomonas aeruginosa PA01
ucuggcagaacaggcgcccgcc

SEQ ID NO: 32456 - RNA, 22 nt, Pseudomonas aeruginosa PA01
ucugggacgggugcugaagacc

SEQ ID NO: 32457 - RNA, 22 nt, Pseudomonas aeruginosa PA01
ucuuagcaggcgcacuaggaug

SEQ ID NO: 32458 - RNA, 23 nt, Pseudomonas aeruginosa PA01
ucuugcccuucuucucgacgguc

SEQ ID NO: 32459 - RNA, 22 nt, Pseudomonas aeruginosa PA01
ucuugccggcgaucagguaggc

SEQ ID NO: 32460 - RNA, 22 nt, Pseudomonas aeruginosa PA01
ucuugcgcuuguccuggaagau

SEQ ID NO: 32461 - RNA, 22 nt, Pseudomonas aeruginosa PA01
ucuugcggcagguagucgaaga

SEQ ID NO: 32462 - RNA, 22 nt, Pseudomonas aeruginosa PA01
ucuuggcggugaugcggguguu

SEQ ID NO: 32463 - RNA, 20 nt, Pseudomonas aeruginosa PA01
ugaagcugcgcaacagcgcc

SEQ ID NO: 32464 - RNA, 22 nt, Pseudomonas aeruginosa PA01
ugaccagcaaggcgccgauauc

SEQ ID NO: 32465 - RNA, 22 nt, Pseudomonas aeruginosa PA01
ugacccugaugccggucgccgc

SEQ ID NO: 32466 - RNA, 22 nt, Pseudomonas aeruginosa PA01
ugaccgccagcugguaggugcc

SEQ ID NO: 32467 - RNA, 22 nt, Pseudomonas aeruginosa PA01
ugagcauugccugagugcgcgu

SEQ ID NO: 32468 - RNA, 22 nt, Pseudomonas aeruginosa PA01
ugagccgagcgcucagcgccga

SEQ ID NO: 32469 - RNA, 22 nt, Pseudomonas aeruginosa PA01
ugagcgccugcucgcggcugau

SEQ ID NO: 32470 - RNA, 22 nt, Pseudomonas aeruginosa PA01
ugagcgccugcugcgcaccacc

SEQ ID NO: 32471 - RNA, 21 nt, Pseudomonas aeruginosa PA01
ugagcgugcuggagaaccgcc

SEQ ID NO: 32472 - RNA, 22 nt, Pseudomonas aeruginosa PA01
ugagcuaucucgaacaacucca

SEQ ID NO: 32473 - RNA, 22 nt, Pseudomonas aeruginosa PA01
ugagcuugcgcaggcguuccca

SEQ ID NO: 32474 - RNA, 22 nt, Pseudomonas aeruginosa PA01
ugaggaagcgcacgcaggcguc

SEQ ID NO: 32475 - RNA, 22 nt, Pseudomonas aeruginosa PA01
ugaguucaacgcauccaccuuc

SEQ ID NO: 32476 - RNA, 22 nt, Pseudomonas aeruginosa PA01
ugaucgauuccagcgccucggc

SEQ ID NO: 32477 - RNA, 22 nt, Pseudomonas aeruginosa PA01
ugaucgucgcccugcgcggccg

SEQ ID NO: 32478 - RNA, 18 nt, Pseudomonas aeruginosa PA01
ugaugcaguguccgcagu

SEQ ID NO: 32479 - RNA, 22 nt, Pseudomonas aeruginosa PA01
ugaugccugucacauguuggca

SEQ ID NO: 32480 - RNA, 22 nt, Pseudomonas aeruginosa PA01
ugaugugcgccuugagcugcuc

SEQ ID NO: 32481 - RNA, 22 nt, Pseudomonas aeruginosa PA01
ugcaacagcccgcagccccugg

SEQ ID NO: 32482 - RNA, 22 nt, Pseudomonas aeruginosa PA01
ugcagcacggccugguuguccc

SEQ ID NO: 32483 - RNA, 22 nt, Pseudomonas aeruginosa PA01
ugcagcaugaucuuggcguccc

SEQ ID NO: 32484 - RNA, 22 nt, Pseudomonas aeruginosa PA01
ugcagcggaucgagcaggccga

SEQ ID NO: 32485 - RNA, 22 nt, Pseudomonas aeruginosa PA01
ugcagguggugcgcuucuucga

SEQ ID NO: 32486 - RNA, 22 nt, Pseudomonas aeruginosa PA01
ugcagucgaccugggcgggcau

SEQ ID NO: 32487 - RNA, 22 nt, Pseudomonas aeruginosa PA01
ugcagucgcgcgcugacccgca

SEQ ID NO: 32488 - RNA, 22 nt, Pseudomonas aeruginosa PA01
ugcaguugcucgccgcgguagc

SEQ ID NO: 32489 - RNA, 22 nt, Pseudomonas aeruginosa PA01
ugccagguccgugacucguggc

SEQ ID NO: 32490 - RNA, 20 nt, Pseudomonas aeruginosa PA01
ugccaggugauagccggcca

SEQ ID NO: 32491 - RNA, 22 nt, Pseudomonas aeruginosa PA01
ugccagucgcggccgcucuggg

SEQ ID NO: 32492 - RNA, 22 nt, Pseudomonas aeruginosa PA01
ugccaucgaccuugccggcgcu

SEQ ID NO: 32493 - RNA, 22 nt, Pseudomonas aeruginosa PA01
ugccccagaggucgcgcgauuc

SEQ ID NO: 32494 - RNA, 22 nt, Pseudomonas aeruginosa PA01
ugcccgacacaccgcuggcuuu

SEQ ID NO: 32495 - RNA, 22 nt, Pseudomonas aeruginosa PA01
ugcccggcgacccgcgcggagg

SEQ ID NO: 32496 - RNA, 22 nt, Pseudomonas aeruginosa PA01
ugccgaccucaucagguaugcg

SEQ ID NO: 32497 - RNA, 22 nt, Pseudomonas aeruginosa PA01
ugccgaggaacagccaggcgug

SEQ ID NO: 32498 - RNA, 22 nt, Pseudomonas aeruginosa PA01
ugccgaucgccaccgccuggcc

SEQ ID NO: 32499 - RNA, 22 nt, Pseudomonas aeruginosa PA01
ugccgcuggagcaguugcucgg

SEQ ID NO: 32500 - RNA, 22 nt, Pseudomonas aeruginosa PA01
ugccgcuggaguacuuguagca

SEQ ID NO: 32501 - RNA, 21 nt, Pseudomonas aeruginosa PA01
ugccggccgccaggugcagga

SEQ ID NO: 32502 - RNA, 22 nt, Pseudomonas aeruginosa PA01
ugccgguguuaagaacccugcu

SEQ ID NO: 32503 - RNA, 22 nt, Pseudomonas aeruginosa PA01
ugccgguguugaucucgccgau

SEQ ID NO: 32504 - RNA, 22 nt, Pseudomonas aeruginosa PA01
ugccgucguagugcucuuccac

SEQ ID NO: 32505 - RNA, 22 nt, Pseudomonas aeruginosa PA01
ugccgugcuugaugaugccgcc

SEQ ID NO: 32506 - RNA, 22 nt, Pseudomonas aeruginosa PA01
ugccguuggcacaugcucaggc

SEQ ID NO: 32507 - RNA, 22 nt, Pseudomonas aeruginosa PA01
ugccuucucgcugguaucggug

SEQ ID NO: 32508 - RNA, 23 nt, Pseudomonas aeruginosa PA01
ugccuucucggcccaggccgagu

SEQ ID NO: 32509 - RNA, 22 nt, Pseudomonas aeruginosa PA01
ugcgaugccgguacgcaugagc

SEQ ID NO: 32510 - RNA, 22 nt, Pseudomonas aeruginosa PA01
ugcgcaggauccgcgacagcag

SEQ ID NO: 32511 - RNA, 22 nt, Pseudomonas aeruginosa PA01
ugcgccaggcgcugguggccag

SEQ ID NO: 32512 - RNA, 22 nt, Pseudomonas aeruginosa PA01
ugcgccccugguucucgaugaa

SEQ ID NO: 32513 - RNA, 22 nt, Pseudomonas aeruginosa PA01
ugcgcccgagcaggcgugccga

SEQ ID NO: 32514 - RNA, 23 nt, Pseudomonas aeruginosa PA01
ugcgccgaguacgcccagcggca

SEQ ID NO: 32515 - RNA, 22 nt, Pseudomonas aeruginosa PA01
ugcgccgcgaugccagcacccu

SEQ ID NO: 32516 - RNA, 22 nt, Pseudomonas aeruginosa PA01
ugcgccguuucgacgaugcucg

SEQ ID NO: 32517 - RNA, 22 nt, Pseudomonas aeruginosa PA01
ugcgccugaagacccgcgaugg

SEQ ID NO: 32518 - RNA, 20 nt, Pseudomonas aeruginosa PA01
ugcgccuggacaaguacgcc

SEQ ID NO: 32519 - RNA, 22 nt, Pseudomonas aeruginosa PA01
ugcgcggcguuuccucgccgaa

SEQ ID NO: 32520 - RNA, 22 nt, Pseudomonas aeruginosa PA01
ugcgcgguugcgguuggcucau

SEQ ID NO: 32521 - RNA, 22 nt, Pseudomonas aeruginosa PA01
ugcgcugggcguggucggcgac

SEQ ID NO: 32522 - RNA, 22 nt, Pseudomonas aeruginosa PA01
ugcggcaauggacaugcucggc

SEQ ID NO: 32523 - RNA, 22 nt, Pseudomonas aeruginosa PA01
ugcggccagugcggcuucaucg

SEQ ID NO: 32524 - RNA, 22 nt, Pseudomonas aeruginosa PA01
ugcggccgaggucgagguugcg

SEQ ID NO: 32525 - RNA, 18 nt, Pseudomonas aeruginosa PA01
ugcggcucgaccaucggc

SEQ ID NO: 32526 - RNA, 22 nt, Pseudomonas aeruginosa PA01
ugcggcucuucagcccggagag

SEQ ID NO: 32527 - RNA, 22 nt, Pseudomonas aeruginosa PA01
ugcggcuuggugucauucaugc

SEQ ID NO: 32528 - RNA, 22 nt, Pseudomonas aeruginosa PA01
ugcgggaucuucgacucgaugu

SEQ ID NO: 32529 - RNA, 22 nt, Pseudomonas aeruginosa PA01
ugcgguccucggugaucagcgc

SEQ ID NO: 32530 - RNA, 22 nt, Pseudomonas aeruginosa PA01
ugcguacggcauccagccccuu

SEQ ID NO: 32531 - RNA, 22 nt, Pseudomonas aeruginosa PA01
ugcguggucaacuggucggcgc

SEQ ID NO: 32532 - RNA, 22 nt, Pseudomonas aeruginosa PA01
ugcuaccaucgccgcgaaacac

SEQ ID NO: 32533 - RNA, 22 nt, Pseudomonas aeruginosa PA01
ugcucagggggcgcugguuucg

SEQ ID NO: 32534 - RNA, 22 nt, Pseudomonas aeruginosa PA01
ugcuccagcgacucgucggggc

SEQ ID NO: 32535 - RNA, 22 nt, Pseudomonas aeruginosa PA01
ugcuccaggucugcgugccccc

SEQ ID NO: 32536 - RNA, 22 nt, Pseudomonas aeruginosa PA01
ugugccgugcucuucgcccaug

SEQ ID NO: 32537 - RNA, 22 nt, Pseudomonas aeruginosa PA01
ugugcgacacccugauccuucg

SEQ ID NO: 32538 - RNA, 22 nt, Pseudomonas aeruginosa PA01
ugugcuugucggucauggcugu

SEQ ID NO: 32539 - RNA, 22 nt, Pseudomonas aeruginosa PA01
uguuccagcgcgacggcgagga

SEQ ID NO: 32540 - RNA, 22 nt, Pseudomonas aeruginosa PA01
uguucgaacgccaggucgaggc

SEQ ID NO: 32541 - RNA, 21 nt, Pseudomonas aeruginosa PA01
uguucgccgagugggucccgg

SEQ ID NO: 32542 - RNA, 22 nt, Pseudomonas aeruginosa PA01
uguugcugucuucgccggugcu

SEQ ID NO: 32543 - RNA, 22 nt, Pseudomonas aeruginosa PA01
uuaccugaagaagauccgcccg

SEQ ID NO: 32544 - RNA, 22 nt, Pseudomonas aeruginosa PA01
uucaccuggacuucuggggcag

SEQ ID NO: 32545 - RNA, 22 nt, Pseudomonas aeruginosa PA01
uucagcagcagcuucagguauu

SEQ ID NO: 32546 - RNA, 22 nt, Pseudomonas aeruginosa PA01
uucaggucgaugucgccgaugu

SEQ ID NO: 32547 - RNA, 22 nt, Pseudomonas aeruginosa PA01
uucaguucgagcaucgucuggc

SEQ ID NO: 32548 - RNA, 22 nt, Pseudomonas aeruginosa PA01
uuccaccggcaggcguucgcgc

SEQ ID NO: 32549 - RNA, 20 nt, Pseudomonas aeruginosa PA01
uuccagcgucucgccgacgc

SEQ ID NO: 32550 - RNA, 22 nt, Pseudomonas aeruginosa PA01
uuccaguuggcggcguugcagc

SEQ ID NO: 32551 - RNA, 22 nt, Pseudomonas aeruginosa PA01
uuccgccagcaggauguagagc

SEQ ID NO: 32552 - RNA, 22 nt, Pseudomonas aeruginosa PA01
uuccuccaguugccggcgcgaa

SEQ ID NO: 32553 - RNA, 22 nt, Pseudomonas aeruginosa PA01
uuccugcucguccugguacucc

SEQ ID NO: 32554 - RNA, 22 nt, Pseudomonas aeruginosa PA01
uuccuggggcacugccgcgacg

SEQ ID NO: 32555 - RNA, 22 nt, Pseudomonas aeruginosa PA01
uucgaggugcuugauccagucc

SEQ ID NO: 32556 - RNA, 22 nt, Pseudomonas aeruginosa PA01
uucgaguggaccagcgguagcg

SEQ ID NO: 32557 - RNA, 22 nt, Pseudomonas aeruginosa PA01
uucgccaagcugcugcccuggc

SEQ ID NO: 32558 - RNA, 22 nt, Pseudomonas aeruginosa PA01
uucgccauggacccggaguucg

SEQ ID NO: 32559 - RNA, 22 nt, Pseudomonas aeruginosa PA01
uucgccgacaugccggcggagu

SEQ ID NO: 32560 - RNA, 22 nt, Pseudomonas aeruginosa PA01
uucgccgucgaacagccgcuuc

SEQ ID NO: 32561 - RNA, 22 nt, Pseudomonas aeruginosa PA01
uucggcauccagcggcuccacc

SEQ ID NO: 32562 - RNA, 22 nt, Pseudomonas aeruginosa PA01
uucggcauggaccaggucgaag

SEQ ID NO: 32563 - RNA, 22 nt, Pseudomonas aeruginosa PA01
uucggccgggccuccgcggcga

SEQ ID NO: 32564 - RNA, 22 nt, Pseudomonas aeruginosa PA01
uucggcgagaaguacggcgacc

SEQ ID NO: 32565 - RNA, 22 nt, Pseudomonas aeruginosa PA01
uucggcgagcgcggcgagguga

SEQ ID NO: 32566 - RNA, 22 nt, Pseudomonas aeruginosa PA01
uucgguggaguuggccuccagc

SEQ ID NO: 32567 - RNA, 22 nt, Pseudomonas aeruginosa PA01
uucgucgagggcucgggcgcag

SEQ ID NO: 32568 - RNA, 22 nt, Pseudomonas aeruginosa PA01
uucgucgagggguuugacgaaa

SEQ ID NO: 32569 - RNA, 22 nt, Pseudomonas aeruginosa PA01
uucucgggcuggugaccaaccu

SEQ ID NO: 32570 - RNA, 22 nt, Pseudomonas aeruginosa PA01
uucugcgcgugcagcaccggca

SEQ ID NO: 32571 - RNA, 22 nt, Pseudomonas aeruginosa PA01
uucugggcacugcuuucggcgc

SEQ ID NO: 32572 - RNA, 22 nt, Pseudomonas aeruginosa PA01
uucuguuccaggagcgguacca

SEQ ID NO: 32573 - RNA, 22 nt, Pseudomonas aeruginosa PA01
uucuucagcuugaucacgucga

SEQ ID NO: 32574 - RNA, 21 nt, Pseudomonas aeruginosa PA01
uugagcaggcgcaucgcgcug

SEQ ID NO: 32575 - RNA, 22 nt, Pseudomonas aeruginosa PA01
uugagcagggcgcgaucguaca

SEQ ID NO: 32576 - RNA, 22 nt, Pseudomonas aeruginosa PA01
uugaucgcauccagcacgcgga

SEQ ID NO: 32577 - RNA, 22 nt, Pseudomonas aeruginosa PA01
uugcaugaacggcgugccguuc

SEQ ID NO: 32578 - RNA, 22 nt, Pseudomonas aeruginosa PA01
uugcccgugcgcauccugccua

SEQ ID NO: 32579 - RNA, 22 nt, Pseudomonas aeruginosa PA01
uugccgcgcaggcagauaccgu

SEQ ID NO: 32580 - RNA, 22 nt, Pseudomonas aeruginosa PA01
uugccggucggguugaugugga

SEQ ID NO: 32581 - RNA, 22 nt, Pseudomonas aeruginosa PA01
uugcgccaggucggcggcgacc

SEQ ID NO: 32582 - RNA, 22 nt, Pseudomonas aeruginosa PA01
uugcgcggcuccgccaguucgu

SEQ ID NO: 32583 - RNA, 22 nt, Pseudomonas aeruginosa PA01
uugcggcgaugcucggcgaugg

SEQ ID NO: 32584 - RNA, 22 nt, Pseudomonas aeruginosa PA01
uugcgggugcgcucgguucagg

SEQ ID NO: 32585 - RNA, 22 nt, Pseudomonas aeruginosa PA01
uugcuauggcaucgucggcgac

SEQ ID NO: 32586 - RNA, 22 nt, Pseudomonas aeruginosa PA01
uugcucggguucgacgccugcg

SEQ ID NO: 32587 - RNA, 22 nt, Pseudomonas aeruginosa PA01
uugcugaaggauaugcguggaa

SEQ ID NO: 32588 - RNA, 22 nt, Pseudomonas aeruginosa PA01
uuggccagcagcagcgggccca

SEQ ID NO: 32589 - RNA, 21 nt, Pseudomonas aeruginosa PA01
uuggccgaagucggcgcccug

SEQ ID NO: 32590 - RNA, 22 nt, Pseudomonas aeruginosa PA01
uuggccgccagcagcaacugcu

SEQ ID NO: 32591 - RNA, 22 nt, Pseudomonas aeruginosa PA01
uuggccucgacgccggcgugcg

SEQ ID NO: 32592 - RNA, 22 nt, Pseudomonas aeruginosa PA01
uuggcgaucugguaguagcgau

SEQ ID NO: 32593 - RNA, 21 nt, Pseudomonas aeruginosa PA01
uuggcuacuccuggaccggcc

SEQ ID NO: 32594 - RNA, 22 nt, Pseudomonas aeruginosa PA01
uugggcaaagucugccgcacua

SEQ ID NO: 32595 - RNA, 22 nt, Pseudomonas aeruginosa PA01
uugggcugguaguaggcuucga

SEQ ID NO: 32596 - RNA, 22 nt, Pseudomonas aeruginosa PA01
uugucgaggggauugcugaccg

SEQ ID NO: 32597 - RNA, 22 nt, Pseudomonas aeruginosa PA01
uugucgaugugccgcgagccgc

SEQ ID NO: 32598 - RNA, 20 nt, Pseudomonas aeruginosa PA01
uugucgcgccuguuggcgcc

SEQ ID NO: 32599 - RNA, 22 nt, Pseudomonas aeruginosa PA01
uugucgcggcagcccuuggcga

SEQ ID NO: 32600 - RNA, 22 nt, Pseudomonas aeruginosa PA01
uuguugcuggccaguuggccgg

SEQ ID NO: 32601 - RNA, 22 nt, Pseudomonas aeruginosa PA01
uuuacucuucgucgucgccggg

SEQ ID NO: 32602 - RNA, 22 nt, Pseudomonas aeruginosa PA01
uuuccaagcuggacgccggcgu

SEQ ID NO: 32603 - RNA, 22 nt, Pseudomonas aeruginosa PA01
uuuccucgaugucgccgcccuu

SEQ ID NO: 32604 - RNA, 22 nt, Pseudomonas aeruginosa PA01
uuucgacauggccgccggcagc

SEQ ID NO: 32605 - RNA, 22 nt, Pseudomonas aeruginosa PA01
uuucgccguggauuaacaggau

SEQ ID NO: 32606 - RNA, 22 nt, Pseudomonas aeruginosa PA01
uuucggcccugcaguucgccca

SEQ ID NO: 32607 - RNA, 22 nt, Pseudomonas aeruginosa PA01
uuucucgcuggcgcggcugcuc

SEQ ID NO: 32608 - RNA, 22 nt, Pseudomonas aeruginosa PA01
uuucuucaaccagggcgagguc

SEQ ID NO: 32609 - RNA, 22 nt, Pseudomonas aeruginosa PA01
uuucuucccggccaggccgaga

SEQ ID NO: 32610 - RNA, 22 nt, Pseudomonas aeruginosa PA01
uuugcgccauucgcuggacagc

SEQ ID NO: 32611 - RNA, 22 nt, Pseudomonas aeruginosa PA01
uuuggcgaagcggcuauuggcc

SEQ ID NO: 32612 - RNA, 22 nt, Pseudomonas aeruginosa PA01
aaaaacccaugccuugcgggca

SEQ ID NO: 32613 - RNA, 22 nt, Pseudomonas aeruginosa PA01
aaacugaggaaagcgaaccugu

SEQ ID NO: 32614 - RNA, 22 nt, Pseudomonas aeruginosa PA01
aacaggucgguuuccagguggg

SEQ ID NO: 32615 - RNA, 22 nt, Pseudomonas aeruginosa PA01
aaccccggcgcgcuggagcgcc

SEQ ID NO: 32616 - RNA, 22 nt, Pseudomonas aeruginosa PA01
aaccccugguaguggugcugga

SEQ ID NO: 32617 - RNA, 22 nt, Pseudomonas aeruginosa PA01
aaccgcgcucgaacaccggcuu

SEQ ID NO: 32618 - RNA, 22 nt, Pseudomonas aeruginosa PA01
aaccgcgugcgccagccguuca

SEQ ID NO: 32619 - RNA, 22 nt, Pseudomonas aeruginosa PA01
aaccuucugaccgggugcggcg

SEQ ID NO: 32620 - RNA, 22 nt, Pseudomonas aeruginosa PA01
aacgacuaucugcuggcgcugc

SEQ ID NO: 32621 - RNA, 22 nt, Pseudomonas aeruginosa PA01
aacgccaggcgcuggcuuucgu

SEQ ID NO: 32622 - RNA, 22 nt, Pseudomonas aeruginosa PA01
aacggcgagcaaugaaaaaggc

SEQ ID NO: 32623 - RNA, 22 nt, Pseudomonas aeruginosa PA01
aacggguagucgagcggcucgg

SEQ ID NO: 32624 - RNA, 22 nt, Pseudomonas aeruginosa PA01
aacugaacaauauguugucgcc

SEQ ID NO: 32625 - RNA, 22 nt, Pseudomonas aeruginosa PA01
aacugagucucggcaaucauag

SEQ ID NO: 32626 - RNA, 23 nt, Pseudomonas aeruginosa PA01
aacugccguccuccagcuccagc

SEQ ID NO: 32627 - RNA, 20 nt, Pseudomonas aeruginosa PA01
aagaugucgccggccgguug

SEQ ID NO: 32628 - RNA, 22 nt, Pseudomonas aeruginosa PA01
aagcaguucgacguggccgagg

SEQ ID NO: 32629 - RNA, 22 nt, Pseudomonas aeruginosa PA01
aagcgaucggcgcggcugaucg

SEQ ID NO: 32630 - RNA, 22 nt, Pseudomonas aeruginosa PA01
aagcgcggugaccaccacgaag

SEQ ID NO: 32631 - RNA, 22 nt, Pseudomonas aeruginosa PA01
aagcgcuugguugagaagaggg

SEQ ID NO: 32632 - RNA, 22 nt, Pseudomonas aeruginosa PA01
aagcggacccgcgccaggcugc

SEQ ID NO: 32633 - RNA, 22 nt, Pseudomonas aeruginosa PA01
aagcggagaacaucgucggcgg

SEQ ID NO: 32634 - RNA, 22 nt, Pseudomonas aeruginosa PA01
aagcgggucuugaguaccgaca

SEQ ID NO: 32635 - RNA, 22 nt, Pseudomonas aeruginosa PA01
aagcugggucaggaccuuggug

SEQ ID NO: 32636 - RNA, 21 nt, Pseudomonas aeruginosa PA01
aagcuucucgggcgggccggc

SEQ ID NO: 32637 - RNA, 22 nt, Pseudomonas aeruginosa PA01
aaggacggcagcgcgcugguca

SEQ ID NO: 32638 - RNA, 22 nt, Pseudomonas aeruginosa PA01
aaggacgguuucgacgccuucc

SEQ ID NO: 32639 - RNA, 20 nt, Pseudomonas aeruginosa PA01
aaggcauggguuuuucgucg

SEQ ID NO: 32640 - RNA, 22 nt, Pseudomonas aeruginosa PA01
aaggccggccugguggcugcca

SEQ ID NO: 32641 - RNA, 22 nt, Pseudomonas aeruginosa PA01
aaggccuggcgcuggcccagca

SEQ ID NO: 32642 - RNA, 22 nt, Pseudomonas aeruginosa PA01
aaggcgaugcgccagaucagcg

SEQ ID NO: 32643 - RNA, 22 nt, Pseudomonas aeruginosa PA01
aaggcgaugcucuccggcguca

SEQ ID NO: 32644 - RNA, 22 nt, Pseudomonas aeruginosa PA01
aaggcgccgagggcguuuucca

SEQ ID NO: 32645 - RNA, 22 nt, Pseudomonas aeruginosa PA01
aaggcuaucuguucggccgccc

SEQ ID NO: 32646 - RNA, 22 nt, Pseudomonas aeruginosa PA01
aaggucgaggaguggguguacg

SEQ ID NO: 32647 - RNA, 22 nt, Pseudomonas aeruginosa PA01
aagucgcgcucgaccuccugga

SEQ ID NO: 32648 - RNA, 22 nt, Pseudomonas aeruginosa PA01
aauacccggaaguggugccgcc

SEQ ID NO: 32649 - RNA, 22 nt, Pseudomonas aeruginosa PA01
aauaccgccacaggcgguaucc

SEQ ID NO: 32650 - RNA, 22 nt, Pseudomonas aeruginosa PA01
aauagcggcuuuucgaugcgca

SEQ ID NO: 32651 - RNA, 22 nt, Pseudomonas aeruginosa PA01
aaucgcgcucccagagguggcu

SEQ ID NO: 32652 - RNA, 22 nt, Pseudomonas aeruginosa PA01
aaugggcguggauaucggcaug

SEQ ID NO: 32653 - RNA, 22 nt, Pseudomonas aeruginosa PA01
acaaggccgcgaugcgcccgcc

SEQ ID NO: 32654 - RNA, 22 nt, Pseudomonas aeruginosa PA01
acaccgugcgccagcugcucaa

SEQ ID NO: 32655 - RNA, 22 nt, Pseudomonas aeruginosa PA01
acagcggcuuggucagcaucca

SEQ ID NO: 32656 - RNA, 22 nt, Pseudomonas aeruginosa PA01
acagggcguguuccguggcagc

SEQ ID NO: 32657 - RNA, 22 nt, Pseudomonas aeruginosa PA01
acagguugaggacgauggcgac

SEQ ID NO: 32658 - RNA, 22 nt, Pseudomonas aeruginosa PA01
acauggacgcgauccucgacca

SEQ ID NO: 32659 - RNA, 21 nt, Pseudomonas aeruginosa PA01
accacccugcccuggcgaucc

SEQ ID NO: 32660 - RNA, 22 nt, Pseudomonas aeruginosa PA01
accacgagaccgaccagcaggc

SEQ ID NO: 32661 - RNA, 22 nt, Pseudomonas aeruginosa PA01
accacggcgaucaugcgcuggc

SEQ ID NO: 32662 - RNA, 20 nt, Pseudomonas aeruginosa PA01
accaggcgcggaucuccgcc

SEQ ID NO: 32663 - RNA, 22 nt, Pseudomonas aeruginosa PA01
accagggcggcgcgguuuuccu

SEQ ID NO: 32664 - RNA, 22 nt, Pseudomonas aeruginosa PA01
accaguugauccaugccggcga

SEQ ID NO: 32665 - RNA, 16 nt, Pseudomonas aeruginosa PA01
accccgaggucggcga

SEQ ID NO: 32666 - RNA, 22 nt, Pseudomonas aeruginosa PA01
acccgcgaacagccagcggcgc

SEQ ID NO: 32667 - RNA, 22 nt, Pseudomonas aeruginosa PA01
acccggaccgaggucaaguaag

SEQ ID NO: 32668 - RNA, 19 nt, Pseudomonas aeruginosa PA01
acccgucuggccaggcguu

SEQ ID NO: 32669 - RNA, 22 nt, Pseudomonas aeruginosa PA01
acccugcccaaggugacccucg

SEQ ID NO: 32670 - RNA, 22 nt, Pseudomonas aeruginosa PA01
accgacgaucagugcgcggcug

SEQ ID NO: 32671 - RNA, 22 nt, Pseudomonas aeruginosa PA01
accgaguuggccgggaucgccg

SEQ ID NO: 32672 - RNA, 22 nt, Pseudomonas aeruginosa PA01
accgccaagguggaagagggcg

SEQ ID NO: 32673 - RNA, 22 nt, Pseudomonas aeruginosa PA01
accgcggugacaucggugccgg

SEQ ID NO: 32674 - RNA, 22 nt, Pseudomonas aeruginosa PA01
accggcagaccaucggcggcua

SEQ ID NO: 32675 - RNA, 22 nt, Pseudomonas aeruginosa PA01
accggcuuccacuacgcugaaa

SEQ ID NO: 32676 - RNA, 22 nt, Pseudomonas aeruginosa PA01
accggcuucggcggccuucugc

SEQ ID NO: 32677 - RNA, 22 nt, Pseudomonas aeruginosa PA01
accgggaucuucgcauugcgua

SEQ ID NO: 32678 - RNA, 22 nt, Pseudomonas aeruginosa PA01
accggugcaucgucuauccgcg

SEQ ID NO: 32679 - RNA, 22 nt, Pseudomonas aeruginosa PA01
accucgaucagcgcgacgauca

SEQ ID NO: 32680 - RNA, 20 nt, Pseudomonas aeruginosa PA01
accucgguggccaccacggc

SEQ ID NO: 32681 - RNA, 22 nt, Pseudomonas aeruginosa PA01
accugaccgccaugcgcuauuc

SEQ ID NO: 32682 - RNA, 22 nt, Pseudomonas aeruginosa PA01
accugacuuuccaguagggaga

SEQ ID NO: 32683 - RNA, 22 nt, Pseudomonas aeruginosa PA01
accugcucagcgacggcgcugc

SEQ ID NO: 32684 - RNA, 22 nt, Pseudomonas aeruginosa PA01
accuggcgcgggucgccuacca

SEQ ID NO: 32685 - RNA, 22 nt, Pseudomonas aeruginosa PA01
accuggcugcucaacucggcga

SEQ ID NO: 32686 - RNA, 22 nt, Pseudomonas aeruginosa PA01
accuggucgggggcgcuggccg

SEQ ID NO: 32687 - RNA, 22 nt, Pseudomonas aeruginosa PA01
accuuggcgcgacugucgagca

SEQ ID NO: 32688 - RNA, 22 nt, Pseudomonas aeruginosa PA01
accuuucccgcgaaccgcucgc

SEQ ID NO: 32689 - RNA, 22 nt, Pseudomonas aeruginosa PA01
acgagcugcaacgugccgggcg

SEQ ID NO: 32690 - RNA, 22 nt, Pseudomonas aeruginosa PA01
acgcaugguuaacggagaucga

SEQ ID NO: 32691 - RNA, 22 nt, Pseudomonas aeruginosa PA01
acgcccucgcucgacgagacgg

SEQ ID NO: 32692 - RNA, 22 nt, Pseudomonas aeruginosa PA01
acgccgcuggcgaucaccgggu

SEQ ID NO: 32693 - RNA, 22 nt, Pseudomonas aeruginosa PA01
acgccgcuggcgguauggcugc

SEQ ID NO: 32694 - RNA, 22 nt, Pseudomonas aeruginosa PA01
acgcgagggccgccugcugguu

SEQ ID NO: 32695 - RNA, 22 nt, Pseudomonas aeruginosa PA01
acgcgcugaacgacgaagugcg

SEQ ID NO: 32696 - RNA, 22 nt, Pseudomonas aeruginosa PA01
acgcucauuccaggagaguccc

SEQ ID NO: 32697 - RNA, 22 nt, Pseudomonas aeruginosa PA01
acgcugacgaacugugcgccgc

SEQ ID NO: 32698 - RNA, 22 nt, Pseudomonas aeruginosa PA01
acgcugccuuccaggccgucgc

SEQ ID NO: 32699 - RNA, 22 nt, Pseudomonas aeruginosa PA01
acgcuucagcucgcccuggugc

SEQ ID NO: 32700 - RNA, 22 nt, Pseudomonas aeruginosa PA01
acgcuuccauuccgcagcaccc

SEQ ID NO: 32701 - RNA, 22 nt, Pseudomonas aeruginosa PA01
acggaacaguucgguggccccg

SEQ ID NO: 32702 - RNA, 22 nt, Pseudomonas aeruginosa PA01
acggaagcgauccgugccuggu

SEQ ID NO: 32703 - RNA, 22 nt, Pseudomonas aeruginosa PA01
acggacaggcagcgcuucgcag

SEQ ID NO: 32704 - RNA, 22 nt, Pseudomonas aeruginosa PA01
acggcaggcagaggucuguuac

SEQ ID NO: 32705 - RNA, 22 nt, Pseudomonas aeruginosa PA01
acggcgaaggugccgcugcccu

SEQ ID NO: 32706 - RNA, 22 nt, Pseudomonas aeruginosa PA01
acggcggcagcuugcguugggc

SEQ ID NO: 32707 - RNA, 22 nt, Pseudomonas aeruginosa PA01
ccgccgccgaccaugaacaucg

SEQ ID NO: 32708 - RNA, 22 nt, Pseudomonas aeruginosa PA01
ccgccuaucgagccggcaagcc

SEQ ID NO: 32709 - RNA, 22 nt, Pseudomonas aeruginosa PA01
ccgcgaugccuuccagcaggcu

SEQ ID NO: 32710 - RNA, 21 nt, Pseudomonas aeruginosa PA01
ccgcgccuggaccgcgccggg

SEQ ID NO: 32711 - RNA, 22 nt, Pseudomonas aeruginosa PA01
ccgcgccuucgucgccggugaa

SEQ ID NO: 32712 - RNA, 22 nt, Pseudomonas aeruginosa PA01
ccgcgggucaucgaguccagcg

SEQ ID NO: 32713 - RNA, 17 nt, Pseudomonas aeruginosa PA01
ccgcuacgcccaggagu

SEQ ID NO: 32714 - RNA, 21 nt, Pseudomonas aeruginosa PA01
ccgcucgccguggaaggcugc

SEQ ID NO: 32715 - RNA, 22 nt, Pseudomonas aeruginosa PA01
ccgcuggugaccggcaucguca

SEQ ID NO: 32716 - RNA, 22 nt, Pseudomonas aeruginosa PA01
ccgcugugcucgccgcccauca

SEQ ID NO: 32717 - RNA, 22 nt, Pseudomonas aeruginosa PA01
ccggagcgcccgggccuucguc

SEQ ID NO: 32718 - RNA, 22 nt, Pseudomonas aeruginosa PA01
ccggaugggcgccgccgcagaa

SEQ ID NO: 32719 - RNA, 22 nt, Pseudomonas aeruginosa PA01
ccggauuugcugguagccuugg

SEQ ID NO: 32720 - RNA, 20 nt, Pseudomonas aeruginosa PA01
ccggcagacagucaggccgg

SEQ ID NO: 32721 - RNA, 22 nt, Pseudomonas aeruginosa PA01
ccggcagccgccugcacaucga

SEQ ID NO: 32722 - RNA, 20 nt, Pseudomonas aeruginosa PA01
ccggccgaagugcucgcggu

SEQ ID NO: 32723 - RNA, 22 nt, Pseudomonas aeruginosa PA01
ccggccugucuucugccggaca

SEQ ID NO: 32724 - RNA, 22 nt, Pseudomonas aeruginosa PA01
ccggccuuggccagcggcgcac

SEQ ID NO: 32725 - RNA, 23 nt, Pseudomonas aeruginosa PA01
ccggcgacacccucuacgugguc

SEQ ID NO: 32726 - RNA, 22 nt, Pseudomonas aeruginosa PA01
ccggcgagaucgacaugcucag

SEQ ID NO: 32727 - RNA, 22 nt, Pseudomonas aeruginosa PA01
ccggcgcaaccgcaucaucagc

SEQ ID NO: 32728 - RNA, 22 nt, Pseudomonas aeruginosa PA01
ccggcggcgucgaugucguggc

SEQ ID NO: 32729 - RNA, 22 nt, Pseudomonas aeruginosa PA01
ccggcuucgaacgcaugcaacc

SEQ ID NO: 32730 - RNA, 22 nt, Pseudomonas aeruginosa PA01
ccgggacagaccgaaguggugc

SEQ ID NO: 32731 - RNA, 22 nt, Pseudomonas aeruginosa PA01
ccgggcagcucgaugcacaucc

SEQ ID NO: 32732 - RNA, 22 nt, Pseudomonas aeruginosa PA01
ccgggcugccgcuucguuccga

SEQ ID NO: 32733 - RNA, 22 nt, Pseudomonas aeruginosa PA01
ccggggcgguuucccagacaca

SEQ ID NO: 32734 - RNA, 22 nt, Pseudomonas aeruginosa PA01
ccggggugccgcugucggcgcu

SEQ ID NO: 32735 - RNA, 22 nt, Pseudomonas aeruginosa PA01
ccgggucgaggaagucuggcgc

SEQ ID NO: 32736 - RNA, 20 nt, Pseudomonas aeruginosa PA01
ccggucaucuuguugcggcg

SEQ ID NO: 32737 - RNA, 22 nt, Pseudomonas aeruginosa PA01
ccgguggugacccgcgagcagg

SEQ ID NO: 32738 - RNA, 22 nt, Pseudomonas aeruginosa PA01
ccgguguucgacaggacucgcu

SEQ ID NO: 32739 - RNA, 22 nt, Pseudomonas aeruginosa PA01
ccgguucuccagcaccaggcgg

SEQ ID NO: 32740 - RNA, 22 nt, Pseudomonas aeruginosa PA01
ccguaccuuccaggccgacagc

SEQ ID NO: 32741 - RNA, 22 nt, Pseudomonas aeruginosa PA01
ccgucguaccugcgcauuccau

SEQ ID NO: 32742 - RNA, 22 nt, Pseudomonas aeruginosa PA01
ccguggaucagcacgaugcggc

SEQ ID NO: 32743 - RNA, 22 nt, Pseudomonas aeruginosa PA01
ccguucaccggcgagguguugg

SEQ ID NO: 32744 - RNA, 22 nt, Pseudomonas aeruginosa PA01
ccguugaagaaccucgaucgcg

SEQ ID NO: 32745 - RNA, 22 nt, Pseudomonas aeruginosa PA01
ccuacgaggcgcugucggcgcc

SEQ ID NO: 32746 - RNA, 22 nt, Pseudomonas aeruginosa PA01
ccuacggcgaacggcggcgaac

SEQ ID NO: 32747 - RNA, 22 nt, Pseudomonas aeruginosa PA01
ccucgaaggccagcgcggcgcu

SEQ ID NO: 32748 - RNA, 22 nt, Pseudomonas aeruginosa PA01
ccucgaaguucggcccgaugac

SEQ ID NO: 32749 - RNA, 22 nt, Pseudomonas aeruginosa PA01
ccucgccaucgaggcucugcag

SEQ ID NO: 32750 - RNA, 23 nt, Pseudomonas aeruginosa PA01
ccucggcaccacccucggcccgc

SEQ ID NO: 32751 - RNA, 22 nt, Pseudomonas aeruginosa PA01
ccucggcagcuucaccggcgcc

SEQ ID NO: 32752 - RNA, 22 nt, Pseudomonas aeruginosa PA01
ccucuacggcgugcucgcggug

SEQ ID NO: 32753 - RNA, 22 nt, Pseudomonas aeruginosa PA01
ccucuuccucggcgcccaggcg

SEQ ID NO: 32754 - RNA, 22 nt, Pseudomonas aeruginosa PA01
ccugaacggacguaucaccacg

SEQ ID NO: 32755 - RNA, 22 nt, Pseudomonas aeruginosa PA01
ccugcagggcaugcaggaaacc

SEQ ID NO: 32756 - RNA, 22 nt, Pseudomonas aeruginosa PA01
ccugccugcgccuggccgaggc

SEQ ID NO: 32757 - RNA, 22 nt, Pseudomonas aeruginosa PA01
ccugcguucgggcaucuccgcc

SEQ ID NO: 32758 - RNA, 23 nt, Pseudomonas aeruginosa PA01
ccugcucgcgcaucugcucgauc

SEQ ID NO: 32759 - RNA, 22 nt, Pseudomonas aeruginosa PA01
ccugcugcugagugccgccagc

SEQ ID NO: 32760 - RNA, 22 nt, Pseudomonas aeruginosa PA01
ccuggaagugcuguuccuggac

SEQ ID NO: 32761 - RNA, 23 nt, Pseudomonas aeruginosa PA01
ccuggccuugcaggaggucgagc

SEQ ID NO: 32762 - RNA, 22 nt, Pseudomonas aeruginosa PA01
ccuggcggcaguuggugcagcg

SEQ ID NO: 32763 - RNA, 22 nt, Pseudomonas aeruginosa PA01
ccuggcgguugcgcaccaccuc

SEQ ID NO: 32764 - RNA, 22 nt, Pseudomonas aeruginosa PA01
ccuggcuggccaacaagcuggc

SEQ ID NO: 32765 - RNA, 22 nt, Pseudomonas aeruginosa PA01
ccugggugcggcgcuuggccug

SEQ ID NO: 32766 - RNA, 22 nt, Pseudomonas aeruginosa PA01
ccugguccaccugggccugacc

SEQ ID NO: 32767 - RNA, 22 nt, Pseudomonas aeruginosa PA01
ccuggugcacggucugcggcuc

SEQ ID NO: 32768 - RNA, 22 nt, Pseudomonas aeruginosa PA01
ccugugccggcgcugcguggcg

SEQ ID NO: 32769 - RNA, 19 nt, Pseudomonas aeruginosa PA01
ccuguucagcgucgugcgc

SEQ ID NO: 32770 - RNA, 22 nt, Pseudomonas aeruginosa PA01
ccuuccggacguccgcgucagc

SEQ ID NO: 32771 - RNA, 20 nt, Pseudomonas aeruginosa PA01
ccuucgacucggugugcauc

SEQ ID NO: 32772 - RNA, 22 nt, Pseudomonas aeruginosa PA01
ccuucgaggugcuggaaaucuc

SEQ ID NO: 32773 - RNA, 22 nt, Pseudomonas aeruginosa PA01
ccuugaucggauaacgcucgca

SEQ ID NO: 32774 - RNA, 22 nt, Pseudomonas aeruginosa PA01
ccuugccgaccacgucgacgcg

SEQ ID NO: 32775 - RNA, 22 nt, Pseudomonas aeruginosa PA01
ccuugcuggccgcagcccggac

SEQ ID NO: 32776 - RNA, 22 nt, Pseudomonas aeruginosa PA01
ccuugcuguucagcgccacggc

SEQ ID NO: 32777 - RNA, 21 nt, Pseudomonas aeruginosa PA01
ccuuuuucguggaucgcacgg

SEQ ID NO: 32778 - RNA, 22 nt, Pseudomonas aeruginosa PA01
cgaagagcccgucgagggccug

SEQ ID NO: 32779 - RNA, 20 nt, Pseudomonas aeruginosa PA01
cgaaggaaaaagaagggcgc

SEQ ID NO: 32780 - RNA, 22 nt, Pseudomonas aeruginosa PA01
cgaagggaacagcaggcgcagg

SEQ ID NO: 32781 - RNA, 22 nt, Pseudomonas aeruginosa PA01
cgaagguagcggaugucggcga

SEQ ID NO: 32782 - RNA, 22 nt, Pseudomonas aeruginosa PA01
cgacaaagacgucgcgcggccu

SEQ ID NO: 32783 - RNA, 22 nt, Pseudomonas aeruginosa PA01
cgacagcgccuucgagcgcggg

SEQ ID NO: 32784 - RNA, 18 nt, Pseudomonas aeruginosa PA01
cgaccaggcguggcugua

SEQ ID NO: 32785 - RNA, 22 nt, Pseudomonas aeruginosa PA01
cgacccauuggccgaccgggcg

SEQ ID NO: 32786 - RNA, 22 nt, Pseudomonas aeruginosa PA01
cgaccggccacgccuuuccagc

SEQ ID NO: 32787 - RNA, 22 nt, Pseudomonas aeruginosa PA01
cgacgauacgccccuuggaguu

SEQ ID NO: 32788 - RNA, 22 nt, Pseudomonas aeruginosa PA01
cgacgccaaucccgggcuggcc

SEQ ID NO: 32789 - RNA, 22 nt, Pseudomonas aeruginosa PA01
cgacggucagcacuugccgcgc

SEQ ID NO: 32790 - RNA, 22 nt, Pseudomonas aeruginosa PA01
cgacggucagccggccgaaguu

SEQ ID NO: 32791 - RNA, 22 nt, Pseudomonas aeruginosa PA01
agcagcuucugcuggcgccguu

SEQ ID NO: 32792 - RNA, 22 nt, Pseudomonas aeruginosa PA01
agcagggugaagcgcuuggcgg

SEQ ID NO: 32793 - RNA, 22 nt, Pseudomonas aeruginosa PA01
agcagguuggucuggucggcga

SEQ ID NO: 32794 - RNA, 19 nt, Pseudomonas aeruginosa PA01
agccgcgccugcuguugcu

SEQ ID NO: 32795 - RNA, 22 nt, Pseudomonas aeruginosa PA01
agccggauucucgccgaccgca

SEQ ID NO: 32796 - RNA, 22 nt, Pseudomonas aeruginosa PA01
agccggccggugcugcugguga

SEQ ID NO: 32797 - RNA, 22 nt, Pseudomonas aeruginosa PA01
agccggcgaucgccuugagcgg

SEQ ID NO: 32798 - RNA, 22 nt, Pseudomonas aeruginosa PA01
agccggcugugaccgagauucu

SEQ ID NO: 32799 - RNA, 22 nt, Pseudomonas aeruginosa PA01
agccgggucugcgcgucgaggg

SEQ ID NO: 32800 - RNA, 22 nt, Pseudomonas aeruginosa PA01
agccgguaguagaggucagcgc

SEQ ID NO: 32801 - RNA, 22 nt, Pseudomonas aeruginosa PA01
agccggucguaggcggcgagca

SEQ ID NO: 32802 - RNA, 22 nt, Pseudomonas aeruginosa PA01
agccuggcccaggucaagcgcc

SEQ ID NO: 32803 - RNA, 22 nt, Pseudomonas aeruginosa PA01
agccuggcgcuguucgccgcgg

SEQ ID NO: 32804 - RNA, 22 nt, Pseudomonas aeruginosa PA01
agccuggucaccggccugcuga

SEQ ID NO: 32805 - RNA, 22 nt, Pseudomonas aeruginosa PA01
agcgaccugcgccugcugcagg

SEQ ID NO: 32806 - RNA, 22 nt, Pseudomonas aeruginosa PA01
agcgccacgguggcgccgguga

SEQ ID NO: 32807 - RNA, 22 nt, Pseudomonas aeruginosa PA01
agcgccucgaccuggcguucga

SEQ ID NO: 32808 - RNA, 22 nt, Pseudomonas aeruginosa PA01
agcgccucgcgcucggcaugac

SEQ ID NO: 32809 - RNA, 22 nt, Pseudomonas aeruginosa PA01
agcgccuuguucugccagccgu

SEQ ID NO: 32810 - RNA, 22 nt, Pseudomonas aeruginosa PA01
agcgcgaggagauggucgaggu

SEQ ID NO: 32811 - RNA, 22 nt, Pseudomonas aeruginosa PA01
agcgcgcacgcacacccagcuc

SEQ ID NO: 32812 - RNA, 22 nt, Pseudomonas aeruginosa PA01
agcgcgccaucaggcgguucga

SEQ ID NO: 32813 - RNA, 22 nt, Pseudomonas aeruginosa PA01
agcgcggaccugcagguugcgg

SEQ ID NO: 32814 - RNA, 21 nt, Pseudomonas aeruginosa PA01
agcgcggcgccgaauaucggg

SEQ ID NO: 32815 - RNA, 22 nt, Pseudomonas aeruginosa PA01
agcgcuggcacgggcucgccga

SEQ ID NO: 32816 - RNA, 22 nt, Pseudomonas aeruginosa PA01
agcggcacuccgaccucggccg

SEQ ID NO: 32817 - RNA, 22 nt, Pseudomonas aeruginosa PA01
agcggccaguugcguuucgucg

SEQ ID NO: 32818 - RNA, 22 nt, Pseudomonas aeruginosa PA01
agcgggaugguccgcaguaccu

SEQ ID NO: 32819 - RNA, 22 nt, Pseudomonas aeruginosa PA01
agcgggcaguugccggugaucg

SEQ ID NO: 32820 - RNA, 22 nt, Pseudomonas aeruginosa PA01
agcggguugcagccguuguaga

SEQ ID NO: 32821 - RNA, 21 nt, Pseudomonas aeruginosa PA01
agcguucgggcucuucgacga

SEQ ID NO: 32822 - RNA, 22 nt, Pseudomonas aeruginosa PA01
agcucgaacagacgcuggccgg

SEQ ID NO: 32823 - RNA, 22 nt, Pseudomonas aeruginosa PA01
agcucggcgaugccgcaacuga

SEQ ID NO: 32824 - RNA, 22 nt, Pseudomonas aeruginosa PA01
agcucggugcuggcgacgaugg

SEQ ID NO: 32825 - RNA, 22 nt, Pseudomonas aeruginosa PA01
agcuggagcgugaguucgccgc

SEQ ID NO: 32826 - RNA, 22 nt, Pseudomonas aeruginosa PA01
agcugggucagccgccaggucu

SEQ ID NO: 32827 - RNA, 22 nt, Pseudomonas aeruginosa PA01
agcugugccagcggagcgacga

SEQ ID NO: 32828 - RNA, 21 nt, Pseudomonas aeruginosa PA01
agcuucaggccgcguucggcg

SEQ ID NO: 32829 - RNA, 22 nt, Pseudomonas aeruginosa PA01
agcuucauggagcccucggcga

SEQ ID NO: 32830 - RNA, 22 nt, Pseudomonas aeruginosa PA01
agcuuccagaucggcgagcgga

SEQ ID NO: 32831 - RNA, 22 nt, Pseudomonas aeruginosa PA01
agcuuggucagcaggcgcucga

SEQ ID NO: 32832 - RNA, 22 nt, Pseudomonas aeruginosa PA01
aggaagcccagguucacgcccu

SEQ ID NO: 32833 - RNA, 22 nt, Pseudomonas aeruginosa PA01
aggaaggucucuugcggcuugc

SEQ ID NO: 32834 - RNA, 22 nt, Pseudomonas aeruginosa PA01
aggacagcucgaugaucugcgc

SEQ ID NO: 32835 - RNA, 22 nt, Pseudomonas aeruginosa PA01
aggaucuugugcuugacgaacu

SEQ ID NO: 32836 - RNA, 22 nt, Pseudomonas aeruginosa PA01
aggauuuccggaucguuggcca

SEQ ID NO: 32837 - RNA, 22 nt, Pseudomonas aeruginosa PA01
aggcaacgaugaugacggcgau

SEQ ID NO: 32838 - RNA, 20 nt, Pseudomonas aeruginosa PA01
aggccagggcgcugaucggc

SEQ ID NO: 32839 - RNA, 22 nt, Pseudomonas aeruginosa PA01
aggccgaccugcagcgccgccg

SEQ ID NO: 32840 - RNA, 21 nt, Pseudomonas aeruginosa PA01
aggccgaugggaaacugccgc

SEQ ID NO: 32841 - RNA, 16 nt, Pseudomonas aeruginosa PA01
aggccggaaccgcaca

SEQ ID NO: 32842 - RNA, 22 nt, Pseudomonas aeruginosa PA01
aggccggguugauggccaggau

SEQ ID NO: 32843 - RNA, 22 nt, Pseudomonas aeruginosa PA01
aggccuugaagcaaggccaggg

SEQ ID NO: 32844 - RNA, 22 nt, Pseudomonas aeruginosa PA01
aggcgacgaacaucagggccag

SEQ ID NO: 32845 - RNA, 22 nt, Pseudomonas aeruginosa PA01
aggcgcacgccaacuucggugc

SEQ ID NO: 32846 - RNA, 22 nt, Pseudomonas aeruginosa PA01
aggcgcaggcuggugucgucgc

SEQ ID NO: 32847 - RNA, 23 nt, Pseudomonas aeruginosa PA01
aggcgccgucgaccugcagcaga

SEQ ID NO: 32848 - RNA, 22 nt, Pseudomonas aeruginosa PA01
aggcgcuggaccuggcgcucgg

SEQ ID NO: 32849 - RNA, 22 nt, Pseudomonas aeruginosa PA01
aggcgcuggccuguggcgccca

SEQ ID NO: 32850 - RNA, 22 nt, Pseudomonas aeruginosa PA01
aggcggagaugccguuguccuu

SEQ ID NO: 32851 - RNA, 22 nt, Pseudomonas aeruginosa PA01
aggcggugcgccuggcgcuguu

SEQ ID NO: 32852 - RNA, 22 nt, Pseudomonas aeruginosa PA01
aggcucaggcaggccgccggca

SEQ ID NO: 32853 - RNA, 22 nt, Pseudomonas aeruginosa PA01
aggcucagguaauagcugggca

SEQ ID NO: 32854 - RNA, 22 nt, Pseudomonas aeruginosa PA01
aggcuguagcgaugggcgcgcg

SEQ ID NO: 32855 - RNA, 22 nt, Pseudomonas aeruginosa PA01
agggaagacgcguaguccgggu

SEQ ID NO: 32856 - RNA, 22 nt, Pseudomonas aeruginosa PA01
agggaguuuguccgcaggcugu

SEQ ID NO: 32857 - RNA, 22 nt, Pseudomonas aeruginosa PA01
agggccaggucgucgccgagga

SEQ ID NO: 32858 - RNA, 22 nt, Pseudomonas aeruginosa PA01
agggccuggcgauguacggcca

SEQ ID NO: 32859 - RNA, 22 nt, Pseudomonas aeruginosa PA01
agggccugggcgaucgcgacgc

SEQ ID NO: 32860 - RNA, 22 nt, Pseudomonas aeruginosa PA01
agggcgaauaaccgcucgcggu

SEQ ID NO: 32861 - RNA, 22 nt, Pseudomonas aeruginosa PA01
agggcgaauaacgccccaggcg

SEQ ID NO: 32862 - RNA, 22 nt, Pseudomonas aeruginosa PA01
agggcgagauccucuucuucaa

SEQ ID NO: 32863 - RNA, 22 nt, Pseudomonas aeruginosa PA01
agggcgaggucagcguggacgc

SEQ ID NO: 32864 - RNA, 22 nt, Pseudomonas aeruginosa PA01
agggcggcgcgccguugcugac

SEQ ID NO: 32865 - RNA, 22 nt, Pseudomonas aeruginosa PA01
agggcgggaacugcgcgcgcag

SEQ ID NO: 32866 - RNA, 22 nt, Pseudomonas aeruginosa PA01
agggcgugaugauccuuaccgg

SEQ ID NO: 32867 - RNA, 19 nt, Pseudomonas aeruginosa PA01
agggcgugcagguggcgga

SEQ ID NO: 32868 - RNA, 22 nt, Pseudomonas aeruginosa PA01
aggggauuacacguugaagcgg

SEQ ID NO: 32869 - RNA, 22 nt, Pseudomonas aeruginosa PA01
aggguguccggcaccggcguca

SEQ ID NO: 32870 - RNA, 22 nt, Pseudomonas aeruginosa PA01
agguccgucgcaucgaccgcaa

SEQ ID NO: 32871 - RNA, 22 nt, Pseudomonas aeruginosa PA01
agguccuuggucgcggcgauga

SEQ ID NO: 32872 - RNA, 22 nt, Pseudomonas aeruginosa PA01
aggucgaacuggcugugcaggu

SEQ ID NO: 32873 - RNA, 22 nt, Pseudomonas aeruginosa PA01
aggucgcgcaggggcgaguuuu

SEQ ID NO: 32874 - RNA, 20 nt, Pseudomonas aeruginosa PA01
caaaccggugccuggcgugc

SEQ ID NO: 32875 - RNA, 22 nt, Pseudomonas aeruginosa PA01
caacauucgccccgcagacugc

SEQ ID NO: 32876 - RNA, 22 nt, Pseudomonas aeruginosa PA01
caagccuggggauaacgucagc

SEQ ID NO: 32877 - RNA, 22 nt, Pseudomonas aeruginosa PA01
caaggccagcagcagggugguc

SEQ ID NO: 32878 - RNA, 22 nt, Pseudomonas aeruginosa PA01
caaugaccaggcaguugaccac

SEQ ID NO: 32879 - RNA, 22 nt, Pseudomonas aeruginosa PA01
caauugaucgaacgggcgcaca

SEQ ID NO: 32880 - RNA, 22 nt, Pseudomonas aeruginosa PA01
caccaccucggccagccacuug

SEQ ID NO: 32881 - RNA, 22 nt, Pseudomonas aeruginosa PA01
caccagcuggcggugauggccg

SEQ ID NO: 32882 - RNA, 22 nt, Pseudomonas aeruginosa PA01
caccgaccgaaucggcgagucc

SEQ ID NO: 32883 - RNA, 21 nt, Pseudomonas aeruginosa PA01
caccgacgccauccaucgcag

SEQ ID NO: 32884 - RNA, 22 nt, Pseudomonas aeruginosa PA01
caccgcgaucccgcggauaucc

SEQ ID NO: 32885 - RNA, 22 nt, Pseudomonas aeruginosa PA01
caccgcggauccacugggccag

SEQ ID NO: 32886 - RNA, 22 nt, Pseudomonas aeruginosa PA01
caccggcggcaucaguuggcug

SEQ ID NO: 32887 - RNA, 22 nt, Pseudomonas aeruginosa PA01
caccgucaguucgcggcgcagc

SEQ ID NO: 32888 - RNA, 22 nt, Pseudomonas aeruginosa PA01
caccugugccuggucugccucg

SEQ ID NO: 32889 - RNA, 22 nt, Pseudomonas aeruginosa PA01
cacgaaugcauccucgaccugc

SEQ ID NO: 32890 - RNA, 22 nt, Pseudomonas aeruginosa PA01
cacgcggguccaugcgcuaccc

SEQ ID NO: 32891 - RNA, 22 nt, Pseudomonas aeruginosa PA01
cacgcugucgacgacgaagccg

SEQ ID NO: 32892 - RNA, 22 nt, Pseudomonas aeruginosa PA01
cacggcugguggucccagcugg

SEQ ID NO: 32893 - RNA, 22 nt, Pseudomonas aeruginosa PA01
cacgggcugcuguucguccugg

SEQ ID NO: 32894 - RNA, 22 nt, Pseudomonas aeruginosa PA01
cacggucgcgcuugaucgccga

SEQ ID NO: 32895 - RNA, 22 nt, Pseudomonas aeruginosa PA01
cacuggccgcaucgcugaagga

SEQ ID NO: 32896 - RNA, 22 nt, Pseudomonas aeruginosa PA01
cagaacagcucggccuugcgcu

SEQ ID NO: 32897 - RNA, 22 nt, Pseudomonas aeruginosa PA01
cagcaccuggcgcaucgccgug

SEQ ID NO: 32898 - RNA, 22 nt, Pseudomonas aeruginosa PA01
cagcacgcgcagcuuggccggc

SEQ ID NO: 32899 - RNA, 20 nt, Pseudomonas aeruginosa PA01
cagcagaagcccgacccggc

SEQ ID NO: 32900 - RNA, 22 nt, Pseudomonas aeruginosa PA01
cagcagauguacggccaugguu

SEQ ID NO: 32901 - RNA, 22 nt, Pseudomonas aeruginosa PA01
cagcagauuaucgcgggugaug

SEQ ID NO: 32902 - RNA, 22 nt, Pseudomonas aeruginosa PA01
cagccccaguagcgcuggcggc

SEQ ID NO: 32903 - RNA, 22 nt, Pseudomonas aeruginosa PA01
cagccgaacacggcgacggugu

SEQ ID NO: 32904 - RNA, 22 nt, Pseudomonas aeruginosa PA01
cagccggcagcccucgacggug

SEQ ID NO: 32905 - RNA, 22 nt, Pseudomonas aeruginosa PA01
cagccguugacccugaucgccg

SEQ ID NO: 32906 - RNA, 22 nt, Pseudomonas aeruginosa PA01
cagccugaaggacuggccggcg

SEQ ID NO: 32907 - RNA, 22 nt, Pseudomonas aeruginosa PA01
cagcgacuggcccaggcucagu

SEQ ID NO: 32908 - RNA, 22 nt, Pseudomonas aeruginosa PA01
cagcgcagugcuuucaugguug

SEQ ID NO: 32909 - RNA, 22 nt, Pseudomonas aeruginosa PA01
cagcgcguucuuggccugccag

SEQ ID NO: 32910 - RNA, 22 nt, Pseudomonas aeruginosa PA01
cagcggcaacuggcggaggcgg

SEQ ID NO: 32911 - RNA, 22 nt, Pseudomonas aeruginosa PA01
cagcggcugcuccaggcugagg

SEQ ID NO: 32912 - RNA, 22 nt, Pseudomonas aeruginosa PA01
cagcggugggccccacggcugc

SEQ ID NO: 32913 - RNA, 22 nt, Pseudomonas aeruginosa PA01
cagcgucugcccgccgcugacg

SEQ ID NO: 32914 - RNA, 22 nt, Pseudomonas aeruginosa PA01
cagcuacgucgaaccggugcug

SEQ ID NO: 32915 - RNA, 22 nt, Pseudomonas aeruginosa PA01
cagcuggaugcucgcgcucagc

SEQ ID NO: 32916 - RNA, 23 nt, Pseudomonas aeruginosa PA01
cagcuggcccucgacgucgaccu

SEQ ID NO: 32917 - RNA, 22 nt, Pseudomonas aeruginosa PA01
cagcugguuggcaauggcggcc

SEQ ID NO: 32918 - RNA, 22 nt, Pseudomonas aeruginosa PA01
caggccacgcaguuggccuggg

SEQ ID NO: 32919 - RNA, 22 nt, Pseudomonas aeruginosa PA01
caggccccgugcgcgggauguu

SEQ ID NO: 32920 - RNA, 22 nt, Pseudomonas aeruginosa PA01
caggccgaccaggaacgcggug

SEQ ID NO: 32921 - RNA, 23 nt, Pseudomonas aeruginosa PA01
caggccguugcuggcagcguggg

SEQ ID NO: 32922 - RNA, 22 nt, Pseudomonas aeruginosa PA01
caggcgacgucgagccgaggcc

SEQ ID NO: 32923 - RNA, 22 nt, Pseudomonas aeruginosa PA01
caggcgaucgccaucgccgcca

SEQ ID NO: 32924 - RNA, 22 nt, Pseudomonas aeruginosa PA01
ucgacguacuggaugccgcgcc

SEQ ID NO: 32925 - RNA, 22 nt, Pseudomonas aeruginosa PA01
ucgagaccgaacuugcucuggc

SEQ ID NO: 32926 - RNA, 22 nt, Pseudomonas aeruginosa PA01
ucgagcaccgcgcccugggcca

SEQ ID NO: 32927 - RNA, 22 nt, Pseudomonas aeruginosa PA01
ucgagcauccggucggcuucgu

SEQ ID NO: 32928 - RNA, 23 nt, Pseudomonas aeruginosa PA01
ucgagccgcgccuugacccggaa

SEQ ID NO: 32929 - RNA, 22 nt, Pseudomonas aeruginosa PA01
ucgagcgcuugcgcugaugcag

SEQ ID NO: 32930 - RNA, 22 nt, Pseudomonas aeruginosa PA01
ucgaggagcaggcugcggugag

SEQ ID NO: 32931 - RNA, 22 nt, Pseudomonas aeruginosa PA01
ucgaggcacgcugcagggaguc

SEQ ID NO: 32932 - RNA, 22 nt, Pseudomonas aeruginosa PA01
ucgaggccgcgcaccacguccg

SEQ ID NO: 32933 - RNA, 22 nt, Pseudomonas aeruginosa PA01
ucgagggucacgauguccuggg

SEQ ID NO: 32934 - RNA, 18 nt, Pseudomonas aeruginosa PA01
ucgaggguggccugcagc

SEQ ID NO: 32935 - RNA, 22 nt, Pseudomonas aeruginosa PA01
ucgaggucagcgauccgcaauu

SEQ ID NO: 32936 - RNA, 18 nt, Pseudomonas aeruginosa PA01
ucgaggucguagaaggug

SEQ ID NO: 32937 - RNA, 22 nt, Pseudomonas aeruginosa PA01
ucgaugaucaucaggcuggcgu

SEQ ID NO: 32938 - RNA, 21 nt, Pseudomonas aeruginosa PA01
ucgauggcgucgccgaucggc

SEQ ID NO: 32939 - RNA, 22 nt, Pseudomonas aeruginosa PA01
ucgccacgaaagcauggccggc

SEQ ID NO: 32940 - RNA, 22 nt, Pseudomonas aeruginosa PA01
ucgcccacgcggaaggccuugc

SEQ ID NO: 32941 - RNA, 22 nt, Pseudomonas aeruginosa PA01
ucgcccauggccuugggcgccg

SEQ ID NO: 32942 - RNA, 22 nt, Pseudomonas aeruginosa PA01
ucgccgaccucagcgccgggga

SEQ ID NO: 32943 - RNA, 22 nt, Pseudomonas aeruginosa PA01
ucgccgaccucgaaggcggucg

SEQ ID NO: 32944 - RNA, 21 nt, Pseudomonas aeruginosa PA01
ucgccgagagugaccagccgc

SEQ ID NO: 32945 - RNA, 22 nt, Pseudomonas aeruginosa PA01
ucgccgagcgucaccagcgucc

SEQ ID NO: 32946 - RNA, 22 nt, Pseudomonas aeruginosa PA01
ucgccgcccucggccagcuuuc

SEQ ID NO: 32947 - RNA, 22 nt, Pseudomonas aeruginosa PA01
ucgccggguuggucagccaggc

SEQ ID NO: 32948 - RNA, 19 nt, Pseudomonas aeruginosa PA01
ucgccgguggaccugguca

SEQ ID NO: 32949 - RNA, 22 nt, Pseudomonas aeruginosa PA01
ucgccgugaaagaggugucuga

SEQ ID NO: 32950 - RNA, 22 nt, Pseudomonas aeruginosa PA01
ucgcgcauggcgucgagcaggc

SEQ ID NO: 32951 - RNA, 22 nt, Pseudomonas aeruginosa PA01
ucgcgcauucgggucggggucu

SEQ ID NO: 32952 - RNA, 22 nt, Pseudomonas aeruginosa PA01
ucgcgccagccuucggcgcugg

SEQ ID NO: 32953 - RNA, 22 nt, Pseudomonas aeruginosa PA01
ucgcgcccaugaucgagcugau

SEQ ID NO: 32954 - RNA, 22 nt, Pseudomonas aeruginosa PA01
ucgcgcgccggauagccgacca

SEQ ID NO: 32955 - RNA, 22 nt, Pseudomonas aeruginosa PA01
ucgcggcggacgaauggcgcca

SEQ ID NO: 32956 - RNA, 22 nt, Pseudomonas aeruginosa PA01
ucgcggucgaccagcgcuggug

SEQ ID NO: 32957 - RNA, 22 nt, Pseudomonas aeruginosa PA01
ucgcucauggggccgaggccgu

SEQ ID NO: 32958 - RNA, 19 nt, Pseudomonas aeruginosa PA01
ucgcugcaacacgucaagc

SEQ ID NO: 32959 - RNA, 22 nt, Pseudomonas aeruginosa PA01
ucgcuggagcugcccggcggca

SEQ ID NO: 32960 - RNA, 22 nt, Pseudomonas aeruginosa PA01
ucggaggucaacccggccaugg

SEQ ID NO: 32961 - RNA, 22 nt, Pseudomonas aeruginosa PA01
ucggcaagccgguggccgggau

SEQ ID NO: 32962 - RNA, 22 nt, Pseudomonas aeruginosa PA01
ucggccagcucaccgagcccua

SEQ ID NO: 32963 - RNA, 22 nt, Pseudomonas aeruginosa PA01
ucggcgaagguggaaggcgacg

SEQ ID NO: 32964 - RNA, 21 nt, Pseudomonas aeruginosa PA01
ucggcgacgcugaugguuauc

SEQ ID NO: 32965 - RNA, 22 nt, Pseudomonas aeruginosa PA01
ucggcgagaucggcgauggccu

SEQ ID NO: 32966 - RNA, 22 nt, Pseudomonas aeruginosa PA01
ucggcgauccagccuucgaggu

SEQ ID NO: 32967 - RNA, 22 nt, Pseudomonas aeruginosa PA01
ucggcgcgcuggugaucggcug

SEQ ID NO: 32968 - RNA, 22 nt, Pseudomonas aeruginosa PA01
ucggcggccagccgccgggcaa

SEQ ID NO: 32969 - RNA, 22 nt, Pseudomonas aeruginosa PA01
ucggcggccuugcgcauggcac

SEQ ID NO: 32970 - RNA, 22 nt, Pseudomonas aeruginosa PA01
ucggcggcgaaguguuguggcc

SEQ ID NO: 32971 - RNA, 22 nt, Pseudomonas aeruginosa PA01
ucggcggugaugaaguaguccg

SEQ ID NO: 32972 - RNA, 22 nt, Pseudomonas aeruginosa PA01
ucggcguagccagccucguguc

SEQ ID NO: 32973 - RNA, 22 nt, Pseudomonas aeruginosa PA01
ucggcugcaugccgccgcgggu

SEQ ID NO: 32974 - RNA, 22 nt, Pseudomonas aeruginosa PA01
ucggcuggacccgcugcgcguc

SEQ ID NO: 32975 - RNA, 22 nt, Pseudomonas aeruginosa PA01
ucgggcagcucgaucaggcuga

SEQ ID NO: 32976 - RNA, 22 nt, Pseudomonas aeruginosa PA01
ucgggcucggaggcgaucaggu

SEQ ID NO: 32977 - RNA, 22 nt, Pseudomonas aeruginosa PA01
ucggggcgaacagcgggcauug

SEQ ID NO: 32978 - RNA, 22 nt, Pseudomonas aeruginosa PA01
ucgguauccccuauguguucaa

SEQ ID NO: 32979 - RNA, 22 nt, Pseudomonas aeruginosa PA01
ucggucagcgguuccgggccga

SEQ ID NO: 32980 - RNA, 22 nt, Pseudomonas aeruginosa PA01
ucggucucgaccagcaacuggc

SEQ ID NO: 32981 - RNA, 22 nt, Pseudomonas aeruginosa PA01
ucggucucggccagacuaccgc

SEQ ID NO: 32982 - RNA, 22 nt, Pseudomonas aeruginosa PA01
ucggucucguaggcguagaagc

SEQ ID NO: 32983 - RNA, 22 nt, Pseudomonas aeruginosa PA01
ucggucuggggccuggaaggcg

SEQ ID NO: 32984 - RNA, 21 nt, Pseudomonas aeruginosa PA01
ucggugauggucaucgacgag

SEQ ID NO: 32985 - RNA, 22 nt, Pseudomonas aeruginosa PA01
ucgguggucggcgagauccaga

SEQ ID NO: 32986 - RNA, 22 nt, Pseudomonas aeruginosa PA01
ucgucagccagcacggcaaucg

SEQ ID NO: 32987 - RNA, 22 nt, Pseudomonas aeruginosa PA01
ucguccucgcccgcaccuuccg

SEQ ID NO: 32988 - RNA, 22 nt, Pseudomonas aeruginosa PA01
ucgucgaaguccagggugaucu

SEQ ID NO: 32989 - RNA, 22 nt, Pseudomonas aeruginosa PA01
ucgucgaggucggagaccagca

SEQ ID NO: 32990 - RNA, 22 nt, Pseudomonas aeruginosa PA01
ucgucgcagaacagcgccugca

SEQ ID NO: 32991 - RNA, 22 nt, Pseudomonas aeruginosa PA01
ucgucggccucguucucgauga

SEQ ID NO: 32992 - RNA, 22 nt, Pseudomonas aeruginosa PA01
ucgucggcgaaaugccggucgc

SEQ ID NO: 32993 - RNA, 22 nt, Pseudomonas aeruginosa PA01
ucgucggcgaacuccgagcgca

SEQ ID NO: 32994 - RNA, 22 nt, Pseudomonas aeruginosa PA01
ucgucguuguggaucgggcaga

SEQ ID NO: 32995 - RNA, 22 nt, Pseudomonas aeruginosa PA01
ucgugaaauuuuaaguguuauu

SEQ ID NO: 32996 - RNA, 22 nt, Pseudomonas aeruginosa PA01
ucgugcugaaguggcauuugcc

SEQ ID NO: 32997 - RNA, 22 nt, Pseudomonas aeruginosa PA01
ucucccgcgacguucgcuccgg

SEQ ID NO: 32998 - RNA, 22 nt, Pseudomonas aeruginosa PA01
ucucccugcccggcaucgaaca

SEQ ID NO: 32999 - RNA, 22 nt, Pseudomonas aeruginosa PA01
ucuccgaggacaucagggcgag

SEQ ID NO: 33000 - RNA, 22 nt, Pseudomonas aeruginosa PA01
ucuccucgccggugggguuguu

SEQ ID NO: 33001 - RNA, 22 nt, Pseudomonas aeruginosa PA01
ucucgauggccggcuggccgua

SEQ ID NO: 33002 - RNA, 22 nt, Pseudomonas aeruginosa PA01
ucucgcccuucaccggcucggc

SEQ ID NO: 33003 - RNA, 22 nt, Pseudomonas aeruginosa PA01
ucucggcgcgcuucgccugccc

SEQ ID NO: 33004 - RNA, 19 nt, Pseudomonas aeruginosa PA01
ucucguccaggcuccggcg

SEQ ID NO: 33005 - RNA, 22 nt, Pseudomonas aeruginosa PA01
ucucgucguccaugcucgcgcc

SEQ ID NO: 33006 - RNA, 22 nt, Pseudomonas aeruginosa PA01
ucugagcguagcgacggggaau

SEQ ID NO: 33007 - RNA, 22 nt, Pseudomonas aeruginosa PA01
gggcggccgagguagacguugu

SEQ ID NO: 33008 - RNA, 22 nt, Pseudomonas aeruginosa PA01
gggcggccucggucacaugggc

SEQ ID NO: 33009 - RNA, 22 nt, Pseudomonas aeruginosa PA01
gggcggcuugcaggaaggcuuc

SEQ ID NO: 33010 - RNA, 22 nt, Pseudomonas aeruginosa PA01
gggcugugucgcaagcgcgaca

SEQ ID NO: 33011 - RNA, 19 nt, Pseudomonas aeruginosa PA01
gggcuguucgccguugauc

SEQ ID NO: 33012 - RNA, 22 nt, Pseudomonas aeruginosa PA01
gggcuucgcggaagcgccgguu

SEQ ID NO: 33013 - RNA, 22 nt, Pseudomonas aeruginosa PA01
ggggaacagggucuucuggucg

SEQ ID NO: 33014 - RNA, 22 nt, Pseudomonas aeruginosa PA01
ggggaucggcuacgaggaggug

SEQ ID NO: 33015 - RNA, 22 nt, Pseudomonas aeruginosa PA01
ggggcaagugaccugcccccau

SEQ ID NO: 33016 - RNA, 22 nt, Pseudomonas aeruginosa PA01
ggggcggcgacguucagcccgg

SEQ ID NO: 33017 - RNA, 22 nt, Pseudomonas aeruginosa PA01
gggggcaggucacuugccccgc

SEQ ID NO: 33018 - RNA, 22 nt, Pseudomonas aeruginosa PA01
ggggucaggucgcugagcaggg

SEQ ID NO: 33019 - RNA, 22 nt, Pseudomonas aeruginosa PA01
ggggugauccagcucaccggcg

SEQ ID NO: 33020 - RNA, 22 nt, Pseudomonas aeruginosa PA01
ggguaaggagcaucgccggcuu

SEQ ID NO: 33021 - RNA, 22 nt, Pseudomonas aeruginosa PA01
gggucaggccgauggucgccag

SEQ ID NO: 33022 - RNA, 22 nt, Pseudomonas aeruginosa PA01
gggucgguuccucgccuucggc

SEQ ID NO: 33023 - RNA, 22 nt, Pseudomonas aeruginosa PA01
gguccagauugcgcagcacgcc

SEQ ID NO: 33024 - RNA, 22 nt, Pseudomonas aeruginosa PA01
gguccucggcaaugccgccagu

SEQ ID NO: 33025 - RNA, 22 nt, Pseudomonas aeruginosa PA01
ggucgaccugcacgcggaucag

SEQ ID NO: 33026 - RNA, 22 nt, Pseudomonas aeruginosa PA01
ggucgacucguugucggugacg

SEQ ID NO: 33027 - RNA, 22 nt, Pseudomonas aeruginosa PA01
ggucgccugcaagucgucgugg

SEQ ID NO: 33028 - RNA, 22 nt, Pseudomonas aeruginosa PA01
ggucgcuccuuccaccagcgug

SEQ ID NO: 33029 - RNA, 22 nt, Pseudomonas aeruginosa PA01
ggucggcgauguugucggcggu

SEQ ID NO: 33030 - RNA, 22 nt, Pseudomonas aeruginosa PA01
ggucggcggcaugcgcgcuucc

SEQ ID NO: 33031 - RNA, 22 nt, Pseudomonas aeruginosa PA01
ggucgggguauucgccgacguc

SEQ ID NO: 33032 - RNA, 22 nt, Pseudomonas aeruginosa PA01
ggucggguucgagcaccuggcu

SEQ ID NO: 33033 - RNA, 22 nt, Pseudomonas aeruginosa PA01
ggucgucgagcagcucgcgcag

SEQ ID NO: 33034 - RNA, 22 nt, Pseudomonas aeruginosa PA01
guggccgaggugaucgcuuccg

SEQ ID NO: 33035 - RNA, 22 nt, Pseudomonas aeruginosa PA01
guggccggcgcgauggcgucca

SEQ ID NO: 33036 - RNA, 22 nt, Pseudomonas aeruginosa PA01
guggcgacgagcagcgaguucu

SEQ ID NO: 33037 - RNA, 22 nt, Pseudomonas aeruginosa PA01
guggcggcagaagguacgggug

SEQ ID NO: 33038 - RNA, 22 nt, Pseudomonas aeruginosa PA01
guggcggggcggacgcgcugag

SEQ ID NO: 33039 - RNA, 22 nt, Pseudomonas aeruginosa PA01
gugggacagcgagccgcuggcg

SEQ ID NO: 33040 - RNA, 22 nt, Pseudomonas aeruginosa PA01
guggucggugaugcuguagacg

SEQ ID NO: 33041 - RNA, 22 nt, Pseudomonas aeruginosa PA01
guguuggggcugucgaaggucg

SEQ ID NO: 33042 - RNA, 22 nt, Pseudomonas aeruginosa PA01
guuauucgcccuacggagcugg

SEQ ID NO: 33043 - RNA, 22 nt, Pseudomonas aeruginosa PA01
guuccaguucggccgcggcugg

SEQ ID NO: 33044 - RNA, 19 nt, Pseudomonas aeruginosa PA01
guucggcagccaguuccgc

SEQ ID NO: 33045 - RNA, 22 nt, Pseudomonas aeruginosa PA01
guucgucacucgucgaggaagg

SEQ ID NO: 33046 - RNA, 22 nt, Pseudomonas aeruginosa PA01
guucuaccucgccacccggacu

SEQ ID NO: 33047 - RNA, 22 nt, Pseudomonas aeruginosa PA01
guucuccgccacguccuucggg

SEQ ID NO: 33048 - RNA, 22 nt, Pseudomonas aeruginosa PA01
guugaucagccucugcgccuuc

SEQ ID NO: 33049 - RNA, 22 nt, Pseudomonas aeruginosa PA01
guugcgcgccguccucggugcc

SEQ ID NO: 33050 - RNA, 22 nt, Pseudomonas aeruginosa PA01
guugcgcucgguuucgccgaag

SEQ ID NO: 33051 - RNA, 22 nt, Pseudomonas aeruginosa PA01
guugcucggcaugcgcaucaag

SEQ ID NO: 33052 - RNA, 22 nt, Pseudomonas aeruginosa PA01
guugcuggaagaacggccgcug

SEQ ID NO: 33053 - RNA, 22 nt, Pseudomonas aeruginosa PA01
guugcugggugaaggcgaugau

SEQ ID NO: 33054 - RNA, 22 nt, Pseudomonas aeruginosa PA01
guuggccagagugucggagccg

SEQ ID NO: 33055 - RNA, 22 nt, Pseudomonas aeruginosa PA01
guuggcgggccaccguggcgcu

SEQ ID NO: 33056 - RNA, 22 nt, Pseudomonas aeruginosa PA01
guuggcucgugcgagggaggug

SEQ ID NO: 33057 - RNA, 22 nt, Pseudomonas aeruginosa PA01
guuggucggcuggucgccgaag

SEQ ID NO: 33058 - RNA, 20 nt, Pseudomonas aeruginosa PA01
guuucagcacgcucuuccag

SEQ ID NO: 33059 - RNA, 22 nt, Pseudomonas aeruginosa PA01
uacagcaccuguaccgcgagac

SEQ ID NO: 33060 - RNA, 22 nt, Pseudomonas aeruginosa PA01
uacaggguggcggcgccgagga

SEQ ID NO: 33061 - RNA, 23 nt, Pseudomonas aeruginosa PA01
uacgccaucugagugcucgccau

SEQ ID NO: 33062 - RNA, 22 nt, Pseudomonas aeruginosa PA01
uacugaccacgucuuccaggcu

SEQ ID NO: 33063 - RNA, 22 nt, Pseudomonas aeruginosa PA01
uagaugcaggugggcucggcgg

SEQ ID NO: 33064 - RNA, 22 nt, Pseudomonas aeruginosa PA01
uagcgccucggccaguucgucg

SEQ ID NO: 33065 - RNA, 22 nt, Pseudomonas aeruginosa PA01
uaugcuggaacugcaggguguc

SEQ ID NO: 33066 - RNA, 22 nt, Pseudomonas aeruginosa PA01
uauugacacugaacgagccgga

SEQ ID NO: 33067 - RNA, 19 nt, Pseudomonas aeruginosa PA01
uauuuccagcgcuacaucc

SEQ ID NO: 33068 - RNA, 20 nt, Pseudomonas aeruginosa PA01
ucaagggugagaugagcgac

SEQ ID NO: 33069 - RNA, 20 nt, Pseudomonas aeruginosa PA01
ucaccagauugcgggugacc

SEQ ID NO: 33070 - RNA, 20 nt, Pseudomonas aeruginosa PA01
ucaccgacauccuuggcguc

SEQ ID NO: 33071 - RNA, 22 nt, Pseudomonas aeruginosa PA01
ucaccggcggcuggaacgggcu

SEQ ID NO: 33072 - RNA, 22 nt, Pseudomonas aeruginosa PA01
ucaccggcuacgaccugggcau

SEQ ID NO: 33073 - RNA, 20 nt, Pseudomonas aeruginosa PA01
ucacggcccugguggucagg

SEQ ID NO: 33074 - RNA, 22 nt, Pseudomonas aeruginosa PA01
ucagagcuuuuccagacagccg

SEQ ID NO: 33075 - RNA, 22 nt, Pseudomonas aeruginosa PA01
ucagccaggucuggcggaugua

SEQ ID NO: 33076 - RNA, 22 nt, Pseudomonas aeruginosa PA01
ucagcgacaauuucuuccaggu

SEQ ID NO: 33077 - RNA, 22 nt, Pseudomonas aeruginosa PA01
ucagcgacgugaacaugccggg

SEQ ID NO: 33078 - RNA, 18 nt, Pseudomonas aeruginosa PA01
ucagcgugaccgucuacc

SEQ ID NO: 33079 - RNA, 22 nt, Pseudomonas aeruginosa PA01
ucagcuuccugcugaugcuggu

SEQ ID NO: 33080 - RNA, 22 nt, Pseudomonas aeruginosa PA01
ucaggcccauuucguugcggac

SEQ ID NO: 33081 - RNA, 20 nt, Pseudomonas aeruginosa PA01
ucaggccgucgaugccgggc

SEQ ID NO: 33082 - RNA, 22 nt, Pseudomonas aeruginosa PA01
ucaggccuggccgucgcugccc

SEQ ID NO: 33083 - RNA, 22 nt, Pseudomonas aeruginosa PA01
ucagggcagccugccucgccuc

SEQ ID NO: 33084 - RNA, 22 nt, Pseudomonas aeruginosa PA01
ucagguagugaggcaccagcaa

SEQ ID NO: 33085 - RNA, 22 nt, Pseudomonas aeruginosa PA01
ucaucugcuggguguccaccag

SEQ ID NO: 33086 - RNA, 22 nt, Pseudomonas aeruginosa PA01
ucauggagcgguacugcaugau

SEQ ID NO: 33087 - RNA, 22 nt, Pseudomonas aeruginosa PA01
uccaggcgcaugcgcucggcga

SEQ ID NO: 33088 - RNA, 22 nt, Pseudomonas aeruginosa PA01
uccagggccaucaccacggcgc

SEQ ID NO: 33089 - RNA, 22 nt, Pseudomonas aeruginosa PA01
uccagggcgugcaacaggaccu

SEQ ID NO: 33090 - RNA, 22 nt, Pseudomonas aeruginosa PA01
uccaggugagcgcagcccgacg

SEQ ID NO: 33091 - RNA, 22 nt, Pseudomonas aeruginosa PA01
uccccggucgaugcggaagcuc

SEQ ID NO: 33092 - RNA, 22 nt, Pseudomonas aeruginosa PA01
cgacucccgcaaaacagaccgg

SEQ ID NO: 33093 - RNA, 22 nt, Pseudomonas aeruginosa PA01
cgacuuccgcagccucggcgag

SEQ ID NO: 33094 - RNA, 22 nt, Pseudomonas aeruginosa PA01
cgacuugauccuggucuggccc

SEQ ID NO: 33095 - RNA, 22 nt, Pseudomonas aeruginosa PA01
cgagagcuucgccaaccugaug

SEQ ID NO: 33096 - RNA, 22 nt, Pseudomonas aeruginosa PA01
cgagcggccagggccugcaccg

SEQ ID NO: 33097 - RNA, 18 nt, Pseudomonas aeruginosa PA01
cgagcggcugacggccug

SEQ ID NO: 33098 - RNA, 22 nt, Pseudomonas aeruginosa PA01
cgaggaaguugaggauggcguu

SEQ ID NO: 33099 - RNA, 22 nt, Pseudomonas aeruginosa PA01
cgaggcgaucaagcgugccgug

SEQ ID NO: 33100 - RNA, 20 nt, Pseudomonas aeruginosa PA01
cgagguccuugaccacgugc

SEQ ID NO: 33101 - RNA, 22 nt, Pseudomonas aeruginosa PA01
cgaugcuggucagcuuggcguu

SEQ ID NO: 33102 - RNA, 22 nt, Pseudomonas aeruginosa PA01
cgauggccaagcgcagguccgg

SEQ ID NO: 33103 - RNA, 22 nt, Pseudomonas aeruginosa PA01
cgauguccagguggcgcugaac

SEQ ID NO: 33104 - RNA, 22 nt, Pseudomonas aeruginosa PA01
cgcaacgaccucgaccugucca

SEQ ID NO: 33105 - RNA, 22 nt, Pseudomonas aeruginosa PA01
cgcaccaucuuucccaucagcc

SEQ ID NO: 33106 - RNA, 22 nt, Pseudomonas aeruginosa PA01
cgcacgguagcuguccaccuug

SEQ ID NO: 33107 - RNA, 22 nt, Pseudomonas aeruginosa PA01
cgcagcaggcgguacucggcgc

SEQ ID NO: 33108 - RNA, 22 nt, Pseudomonas aeruginosa PA01
cgcagcgacgggcgggagcugc

SEQ ID NO: 33109 - RNA, 22 nt, Pseudomonas aeruginosa PA01
cgcaggaaacgcucgauggcca

SEQ ID NO: 33110 - RNA, 21 nt, Pseudomonas aeruginosa PA01
cgcaggcgaccugugggucgg

SEQ ID NO: 33111 - RNA, 22 nt, Pseudomonas aeruginosa PA01
cgcagggugaugugcgcggcca

SEQ ID NO: 33112 - RNA, 22 nt, Pseudomonas aeruginosa PA01
cgcaggucggggugucgacgcu

SEQ ID NO: 33113 - RNA, 22 nt, Pseudomonas aeruginosa PA01
cgcaggucguagguggugcgga

SEQ ID NO: 33114 - RNA, 22 nt, Pseudomonas aeruginosa PA01
cgcaucgcuccgcgcucgaccu

SEQ ID NO: 33115 - RNA, 22 nt, Pseudomonas aeruginosa PA01
cgccaaggaacugggcgucucg

SEQ ID NO: 33116 - RNA, 22 nt, Pseudomonas aeruginosa PA01
cgccagagcccgguggcgaucc

SEQ ID NO: 33117 - RNA, 22 nt, Pseudomonas aeruginosa PA01
cgccagcagcagcgggaacagc

SEQ ID NO: 33118 - RNA, 21 nt, Pseudomonas aeruginosa PA01
cgccagcggcgugccgaccuc

SEQ ID NO: 33119 - RNA, 22 nt, Pseudomonas aeruginosa PA01
cgccaggcgacuccgggcgugc

SEQ ID NO: 33120 - RNA, 22 nt, Pseudomonas aeruginosa PA01
cgccagggcgugccgcugaacg

SEQ ID NO: 33121 - RNA, 22 nt, Pseudomonas aeruginosa PA01
cgccagucuucgccgccaggcg

SEQ ID NO: 33122 - RNA, 22 nt, Pseudomonas aeruginosa PA01
cgccauccgccaccugcuggcg

SEQ ID NO: 33123 - RNA, 23 nt, Pseudomonas aeruginosa PA01
cgccaucgagcugccaggccagc

SEQ ID NO: 33124 - RNA, 22 nt, Pseudomonas aeruginosa PA01
cgccccgaccgaccuugcgcaa

SEQ ID NO: 33125 - RNA, 22 nt, Pseudomonas aeruginosa PA01
gcgcaacggccaccagggcgag

SEQ ID NO: 33126 - RNA, 22 nt, Pseudomonas aeruginosa PA01
gcgcacucaggcaaugcucagc

SEQ ID NO: 33127 - RNA, 22 nt, Pseudomonas aeruginosa PA01
gcgcaucgagcggcuggcguug

SEQ ID NO: 33128 - RNA, 22 nt, Pseudomonas aeruginosa PA01
gcgccauuugugcaguucgccg

SEQ ID NO: 33129 - RNA, 22 nt, Pseudomonas aeruginosa PA01
gcgccgacaucguuacccucgg

SEQ ID NO: 33130 - RNA, 22 nt, Pseudomonas aeruginosa PA01
gcgccgcggaucgccaucgagg

SEQ ID NO: 33131 - RNA, 20 nt, Pseudomonas aeruginosa PA01
gcgcgcacaucgacgcuugc

SEQ ID NO: 33132 - RNA, 22 nt, Pseudomonas aeruginosa PA01
gcgcgcagcgagacgguggugc

SEQ ID NO: 33133 - RNA, 22 nt, Pseudomonas aeruginosa PA01
gcgcgccuccucgccgcacauc

SEQ ID NO: 33134 - RNA, 22 nt, Pseudomonas aeruginosa PA01
gcgcgcgagaaagcggucggug

SEQ ID NO: 33135 - RNA, 22 nt, Pseudomonas aeruginosa PA01
gcgcgcuggcagaccagcuucu

SEQ ID NO: 33136 - RNA, 22 nt, Pseudomonas aeruginosa PA01
gcgcggguuccgcaaggugaug

SEQ ID NO: 33137 - RNA, 22 nt, Pseudomonas aeruginosa PA01
gcgcgguggucuucaggccggc

SEQ ID NO: 33138 - RNA, 22 nt, Pseudomonas aeruginosa PA01
gcgcgugcauuggcuggccggc

SEQ ID NO: 33139 - RNA, 22 nt, Pseudomonas aeruginosa PA01
gcgcuaucgaugcgaucuucgc

SEQ ID NO: 33140 - RNA, 22 nt, Pseudomonas aeruginosa PA01
gcgcuccagcacuucguccagc

SEQ ID NO: 33141 - RNA, 22 nt, Pseudomonas aeruginosa PA01
gcgcugauggccggcuggccgg

SEQ ID NO: 33142 - RNA, 22 nt, Pseudomonas aeruginosa PA01
gcgcugcuccagcaccguucgu

SEQ ID NO: 33143 - RNA, 19 nt, Pseudomonas aeruginosa PA01
gcgcugcugcuggucagcu

SEQ ID NO: 33144 - RNA, 22 nt, Pseudomonas aeruginosa PA01
gcgcuggagguguuccgccgcg

SEQ ID NO: 33145 - RNA, 22 nt, Pseudomonas aeruginosa PA01
gcgcuggcugagcaaugccagg

SEQ ID NO: 33146 - RNA, 22 nt, Pseudomonas aeruginosa PA01
gcgcuguugcugcucggcuggu

SEQ ID NO: 33147 - RNA, 19 nt, Pseudomonas aeruginosa PA01
gcgcuugggaucguccugc

SEQ ID NO: 33148 - RNA, 22 nt, Pseudomonas aeruginosa PA01
gcgcuuguuugcacgcaccuuc

SEQ ID NO: 33149 - RNA, 22 nt, Pseudomonas aeruginosa PA01
gcggaguggguguuggaguagg

SEQ ID NO: 33150 - RNA, 22 nt, Pseudomonas aeruginosa PA01
gcggaucgagcgacuggccgag

SEQ ID NO: 33151 - RNA, 22 nt, Pseudomonas aeruginosa PA01
gcggaucgccaccaggaucgcg

SEQ ID NO: 33152 - RNA, 22 nt, Pseudomonas aeruginosa PA01
gcggcaguucgggauggucgag

SEQ ID NO: 33153 - RNA, 22 nt, Pseudomonas aeruginosa PA01
gcggcauucaggccggcgagcu

SEQ ID NO: 33154 - RNA, 22 nt, Pseudomonas aeruginosa PA01
gcggccugcucgauggccucgc

SEQ ID NO: 33155 - RNA, 22 nt, Pseudomonas aeruginosa PA01
gcggccuggccuggaucguggc

SEQ ID NO: 33156 - RNA, 22 nt, Pseudomonas aeruginosa PA01
gcggccuugaagccgucgccgg

SEQ ID NO: 33157 - RNA, 18 nt, Pseudomonas aeruginosa PA01
gcggcgcucccagcccga

SEQ ID NO: 33158 - RNA, 22 nt, Pseudomonas aeruginosa PA01
gcggcgcuggcccgaaccagca

SEQ ID NO: 33159 - RNA, 22 nt, Pseudomonas aeruginosa PA01
gcggcgcuguucgucaugccgc

SEQ ID NO: 33160 - RNA, 22 nt, Pseudomonas aeruginosa PA01
gcggcggagguccgcgcauguc

SEQ ID NO: 33161 - RNA, 22 nt, Pseudomonas aeruginosa PA01
gcggcggcaagcgguugagcau

SEQ ID NO: 33162 - RNA, 22 nt, Pseudomonas aeruginosa PA01
gcggcggucugcgcguggaauu

SEQ ID NO: 33163 - RNA, 22 nt, Pseudomonas aeruginosa PA01
gcggcggugggccagguaccgg

SEQ ID NO: 33164 - RNA, 22 nt, Pseudomonas aeruginosa PA01
gcggcgugcuggcggaagaaug

SEQ ID NO: 33165 - RNA, 23 nt, Pseudomonas aeruginosa PA01
gcggcguuucaccuccaggcuga

SEQ ID NO: 33166 - RNA, 22 nt, Pseudomonas aeruginosa PA01
gcggcugguugaucucgugggc

SEQ ID NO: 33167 - RNA, 22 nt, Pseudomonas aeruginosa PA01
gcgggaggaucgaauugcaggc

SEQ ID NO: 33168 - RNA, 19 nt, Pseudomonas aeruginosa PA01
gcgggcauguacgaagggc

SEQ ID NO: 33169 - RNA, 22 nt, Pseudomonas aeruginosa PA01
gcgggcugaccaccgggcccau

SEQ ID NO: 33170 - RNA, 22 nt, Pseudomonas aeruginosa PA01
gcggggcgcucugcaacuugca

SEQ ID NO: 33171 - RNA, 23 nt, Pseudomonas aeruginosa PA01
gcgggucgcggaugucgaccacc

SEQ ID NO: 33172 - RNA, 22 nt, Pseudomonas aeruginosa PA01
gcggucgccacggcgaaugucc

SEQ ID NO: 33173 - RNA, 22 nt, Pseudomonas aeruginosa PA01
gcggugaaggcguugcugcucu

SEQ ID NO: 33174 - RNA, 22 nt, Pseudomonas aeruginosa PA01
gcggugaugaugacgguggucu

SEQ ID NO: 33175 - RNA, 22 nt, Pseudomonas aeruginosa PA01
gcgguguugcucaagcaacugc

SEQ ID NO: 33176 - RNA, 22 nt, Pseudomonas aeruginosa PA01
gcgguugagccuggcggcgaac

SEQ ID NO: 33177 - RNA, 22 nt, Pseudomonas aeruginosa PA01
gcgucaucgcccuugccgcacc

SEQ ID NO: 33178 - RNA, 21 nt, Pseudomonas aeruginosa PA01
gcgucgaggaaggcgucggca

SEQ ID NO: 33179 - RNA, 22 nt, Pseudomonas aeruginosa PA01
gcgucggcugcaucgcacgacc

SEQ ID NO: 33180 - RNA, 19 nt, Pseudomonas aeruginosa PA01
gcgucggcuuccuugacga

SEQ ID NO: 33181 - RNA, 22 nt, Pseudomonas aeruginosa PA01
gcgugcugcuggucgcuccgcu

SEQ ID NO: 33182 - RNA, 20 nt, Pseudomonas aeruginosa PA01
gcguggacgauggcgugauc

SEQ ID NO: 33183 - RNA, 22 nt, Pseudomonas aeruginosa PA01
gcguggcccgucgcgcgacagg

SEQ ID NO: 33184 - RNA, 22 nt, Pseudomonas aeruginosa PA01
gcguggucacccgccagcgcau

SEQ ID NO: 33185 - RNA, 22 nt, Pseudomonas aeruginosa PA01
gcguguaugauacccgagcuca

SEQ ID NO: 33186 - RNA, 22 nt, Pseudomonas aeruginosa PA01
gcguuaccaggugcgcggcuac

SEQ ID NO: 33187 - RNA, 22 nt, Pseudomonas aeruginosa PA01
gcguucgcggcauguccagcga

SEQ ID NO: 33188 - RNA, 22 nt, Pseudomonas aeruginosa PA01
gcguuggccuggccguugguca

SEQ ID NO: 33189 - RNA, 22 nt, Pseudomonas aeruginosa PA01
gcuaccagcaauuccacgcgac

SEQ ID NO: 33190 - RNA, 22 nt, Pseudomonas aeruginosa PA01
gcuaccauuagaacaagggcag

SEQ ID NO: 33191 - RNA, 22 nt, Pseudomonas aeruginosa PA01
gcuagccgcggucauucgcagu

SEQ ID NO: 33192 - RNA, 22 nt, Pseudomonas aeruginosa PA01
gcucaagcugcuggccgguuuc

SEQ ID NO: 33193 - RNA, 22 nt, Pseudomonas aeruginosa PA01
gcucgacgaucuccuccaccuc

SEQ ID NO: 33194 - RNA, 22 nt, Pseudomonas aeruginosa PA01
gcucgacguacugauaucggau

SEQ ID NO: 33195 - RNA, 22 nt, Pseudomonas aeruginosa PA01
gcucgaucagcagcuugccgcg

SEQ ID NO: 33196 - RNA, 22 nt, Pseudomonas aeruginosa PA01
gcucgaucuguuccggcuggua

SEQ ID NO: 33197 - RNA, 22 nt, Pseudomonas aeruginosa PA01
gcucgccggccaguucgccgag

SEQ ID NO: 33198 - RNA, 22 nt, Pseudomonas aeruginosa PA01
gcucgcgauugccguccagcca

SEQ ID NO: 33199 - RNA, 22 nt, Pseudomonas aeruginosa PA01
gcucgcgcagggucgggaucac

SEQ ID NO: 33200 - RNA, 22 nt, Pseudomonas aeruginosa PA01
gcucgcucaucaucacgaaauc

SEQ ID NO: 33201 - RNA, 21 nt, Pseudomonas aeruginosa PA01
gcucggcauccuggcgcgcga

SEQ ID NO: 33202 - RNA, 22 nt, Pseudomonas aeruginosa PA01
gcucggcgaugaccucgcuguc

SEQ ID NO: 33203 - RNA, 22 nt, Pseudomonas aeruginosa PA01
gcucggguguccugcaagcaga

SEQ ID NO: 33204 - RNA, 22 nt, Pseudomonas aeruginosa PA01
gcucgguggcgccgagcaucac

SEQ ID NO: 33205 - RNA, 22 nt, Pseudomonas aeruginosa PA01
gcugaaaccguugcuggagaac

SEQ ID NO: 33206 - RNA, 22 nt, Pseudomonas aeruginosa PA01
gcugaagggcuccgcgcugucc

SEQ ID NO: 33207 - RNA, 22 nt, Pseudomonas aeruginosa PA01
gcugaucgagcugaccuacgaa

SEQ ID NO: 33208 - RNA, 22 nt, Pseudomonas aeruginosa PA01
gcugaucuacgacucgccggug

SEQ ID NO: 33209 - RNA, 23 nt, Pseudomonas aeruginosa PA01
gcugccggcggcgucguugucgu

SEQ ID NO: 33210 - RNA, 22 nt, Pseudomonas aeruginosa PA01
gcugcgcaaccaccagccagac

SEQ ID NO: 33211 - RNA, 22 nt, Pseudomonas aeruginosa PA01
gcugcgcaaguaccuggcgcgu

SEQ ID NO: 33212 - RNA, 20 nt, Pseudomonas aeruginosa PA01
gcugcgcaccgagaccgcgc

SEQ ID NO: 33213 - RNA, 22 nt, Pseudomonas aeruginosa PA01
gcugcugacccuggcgaucggc

SEQ ID NO: 33214 - RNA, 22 nt, Pseudomonas aeruginosa PA01
gcuggccaccagcgccuggcgc

SEQ ID NO: 33215 - RNA, 22 nt, Pseudomonas aeruginosa PA01
gcuggccaccgagggcauccgc

SEQ ID NO: 33216 - RNA, 22 nt, Pseudomonas aeruginosa PA01
gcuggccgaguuccgccgacag

SEQ ID NO: 33217 - RNA, 22 nt, Pseudomonas aeruginosa PA01
gcuggccggggugcuccacgag

SEQ ID NO: 33218 - RNA, 22 nt, Pseudomonas aeruginosa PA01
gcuggcggcuccugcugacgcg

SEQ ID NO: 33219 - RNA, 22 nt, Pseudomonas aeruginosa PA01
gcuggcguugcaauugccgccg

SEQ ID NO: 33220 - RNA, 23 nt, Pseudomonas aeruginosa PA01
gcuggcuggcaagggugcggauc

SEQ ID NO: 33221 - RNA, 22 nt, Pseudomonas aeruginosa PA01
gcuggcuuuccagcgcggcuuu

SEQ ID NO: 33222 - RNA, 22 nt, Pseudomonas aeruginosa PA01
gcugggcuacccgcgcgacacc

SEQ ID NO: 33223 - RNA, 22 nt, Pseudomonas aeruginosa PA01
gcugggugugcugguggucgag

SEQ ID NO: 33224 - RNA, 22 nt, Pseudomonas aeruginosa PA01
gcugguggagguccgcgccauc

SEQ ID NO: 33225 - RNA, 22 nt, Pseudomonas aeruginosa PA01
gcugguggugcagcccaggcaa

SEQ ID NO: 33226 - RNA, 22 nt, Pseudomonas aeruginosa PA01
gcugguguucuggcgcgugcug

SEQ ID NO: 33227 - RNA, 22 nt, Pseudomonas aeruginosa PA01
gcugucgguggucgggcucggc

SEQ ID NO: 33228 - RNA, 22 nt, Pseudomonas aeruginosa PA01
gcuguugacgcgaaccacgcac

SEQ ID NO: 33229 - RNA, 22 nt, Pseudomonas aeruginosa PA01
gcuguugccgccaugcagcgcc

SEQ ID NO: 33230 - RNA, 22 nt, Pseudomonas aeruginosa PA01
gcuguuguugcugucgaaccca

SEQ ID NO: 33231 - RNA, 22 nt, Pseudomonas aeruginosa PA01
gcuucgaacggcuugcggauca

SEQ ID NO: 33232 - RNA, 21 nt, Pseudomonas aeruginosa PA01
gcuucgccgugauagccgggc

SEQ ID NO: 33233 - RNA, 22 nt, Pseudomonas aeruginosa PA01
gcuuggccaggucgagggcgac

SEQ ID NO: 33234 - RNA, 22 nt, Pseudomonas aeruginosa PA01
gcuuggcgcacugcgcgaauuc

SEQ ID NO: 33235 - RNA, 22 nt, Pseudomonas aeruginosa PA01
gcuuucaucgccggcggagaaa

SEQ ID NO: 33236 - RNA, 22 nt, Pseudomonas aeruginosa PA01
gcuuuuccauggacuguugcgg

SEQ ID NO: 33237 - RNA, 22 nt, Pseudomonas aeruginosa PA01
ggaagccgaacagguagcugag

SEQ ID NO: 33238 - RNA, 22 nt, Pseudomonas aeruginosa PA01
ggaagcgcuucugguggugggc

SEQ ID NO: 33239 - RNA, 22 nt, Pseudomonas aeruginosa PA01
ggaagguggcgaugcgcucguc

SEQ ID NO: 33240 - RNA, 22 nt, Pseudomonas aeruginosa PA01
ggaagugaaggucggcgaccug

SEQ ID NO: 33241 - RNA, 22 nt, Pseudomonas aeruginosa PA01
ggacaggucauacgguuucaug

SEQ ID NO: 33242 - RNA, 22 nt, Pseudomonas aeruginosa PA01
ggacgcacuucgcugcgggucg

SEQ ID NO: 33243 - RNA, 22 nt, Pseudomonas aeruginosa PA01
ggacggaccgucggccaggaug

SEQ ID NO: 33244 - RNA, 22 nt, Pseudomonas aeruginosa PA01
ggacggccuguucgugccggug

SEQ ID NO: 33245 - RNA, 22 nt, Pseudomonas aeruginosa PA01
ggacugggaaggguuuugcugg

SEQ ID NO: 33246 - RNA, 22 nt, Pseudomonas aeruginosa PA01
ggagcgccugugggaucguccc

SEQ ID NO: 33247 - RNA, 22 nt, Pseudomonas aeruginosa PA01
ggaucggaaaagugcuggcgag

SEQ ID NO: 33248 - RNA, 21 nt, Pseudomonas aeruginosa PA01
ggaucugcaccgcauggcgga

SEQ ID NO: 33249 - RNA, 23 nt, Pseudomonas aeruginosa PA01
ggaugcugucgacccgcucgcgc

SEQ ID NO: 33250 - RNA, 22 nt, Pseudomonas aeruginosa PA01
ggauggccgccaccggcaagca

SEQ ID NO: 33251 - RNA, 22 nt, Pseudomonas aeruginosa PA01
ggauuuccugguuguagcgagc

SEQ ID NO: 33252 - RNA, 22 nt, Pseudomonas aeruginosa PA01
ggcaagcugaagaugggcggca

SEQ ID NO: 33253 - RNA, 22 nt, Pseudomonas aeruginosa PA01
ggcacagcuucgguggggcgag

SEQ ID NO: 33254 - RNA, 22 nt, Pseudomonas aeruginosa PA01
ggcacccugcuugcuacgggcu

SEQ ID NO: 33255 - RNA, 22 nt, Pseudomonas aeruginosa PA01
ggcacggcucgcagaggaucug

SEQ ID NO: 33256 - RNA, 22 nt, Pseudomonas aeruginosa PA01
ggcacggucuucaccgucagcg

SEQ ID NO: 33257 - RNA, 21 nt, Pseudomonas aeruginosa PA01
ggcagccgcuucgaacgccug

SEQ ID NO: 33258 - RNA, 22 nt, Pseudomonas aeruginosa PA01
ggcagccugcccagcacuucua

SEQ ID NO: 33259 - RNA, 22 nt, Pseudomonas aeruginosa PA01
ggcaggcaugguggaucgacug

SEQ ID NO: 33260 - RNA, 22 nt, Pseudomonas aeruginosa PA01
ggcaggggagaugaccgauguu

SEQ ID NO: 33261 - RNA, 22 nt, Pseudomonas aeruginosa PA01
ggcaguuucccaucggccuggc

SEQ ID NO: 33262 - RNA, 22 nt, Pseudomonas aeruginosa PA01
ggcaucaggccgacgcgcuuga

SEQ ID NO: 33263 - RNA, 21 nt, Pseudomonas aeruginosa PA01
ggcaucggccauggccggcag

SEQ ID NO: 33264 - RNA, 22 nt, Pseudomonas aeruginosa PA01
ggcaugagcauucucgagcgcg

SEQ ID NO: 33265 - RNA, 22 nt, Pseudomonas aeruginosa PA01
ggccacgcaacuggagguuucc

SEQ ID NO: 33266 - RNA, 21 nt, Pseudomonas aeruginosa PA01
ggccaugcucgacaacccguc

SEQ ID NO: 33267 - RNA, 22 nt, Pseudomonas aeruginosa PA01
ggcccggcgauccggacaugca

SEQ ID NO: 33268 - RNA, 22 nt, Pseudomonas aeruginosa PA01
ggcccggcuguccaggcggccg

SEQ ID NO: 33269 - RNA, 22 nt, Pseudomonas aeruginosa PA01
ggcccgggugauccuccagcau

SEQ ID NO: 33270 - RNA, 22 nt, Pseudomonas aeruginosa PA01
ggcccuggcgaugcgcuggcug

SEQ ID NO: 33271 - RNA, 22 nt, Pseudomonas aeruginosa PA01
ggccgccguagccgcugaucag

SEQ ID NO: 33272 - RNA, 22 nt, Pseudomonas aeruginosa PA01
ggccgcgcuggcggaggaggaa

SEQ ID NO: 33273 - RNA, 22 nt, Pseudomonas aeruginosa PA01
ggccgcucugcugcagggccug

SEQ ID NO: 33274 - RNA, 22 nt, Pseudomonas aeruginosa PA01
ggccgcuuccgccgaucgcagc

SEQ ID NO: 33275 - RNA, 22 nt, Pseudomonas aeruginosa PA01
ggccggcaccgaugucaccgcg

SEQ ID NO: 33276 - RNA, 22 nt, Pseudomonas aeruginosa PA01
ggccggcgacgguggccgaggu

SEQ ID NO: 33277 - RNA, 23 nt, Pseudomonas aeruginosa PA01
ggccgggaucgagcaacuggcgc

SEQ ID NO: 33278 - RNA, 22 nt, Pseudomonas aeruginosa PA01
ggccgucgagguagugauugau

SEQ ID NO: 33279 - RNA, 22 nt, Pseudomonas aeruginosa PA01
ggccuccaccgugaucagccug

SEQ ID NO: 33280 - RNA, 22 nt, Pseudomonas aeruginosa PA01
ggccucccggcgcagacgacgc

SEQ ID NO: 33281 - RNA, 22 nt, Pseudomonas aeruginosa PA01
ggccugacccgucgcgcgucga

SEQ ID NO: 33282 - RNA, 22 nt, Pseudomonas aeruginosa PA01
ggccugccugcuguuucccggc

SEQ ID NO: 33283 - RNA, 22 nt, Pseudomonas aeruginosa PA01
ggccugcggcucggccuuggug

SEQ ID NO: 33284 - RNA, 22 nt, Pseudomonas aeruginosa PA01
ggccuguggauggugccggccg

SEQ ID NO: 33285 - RNA, 22 nt, Pseudomonas aeruginosa PA01
ggccuguucgauggcguggugg

SEQ ID NO: 33286 - RNA, 22 nt, Pseudomonas aeruginosa PA01
ggccuugucgucguccuggcug

SEQ ID NO: 33287 - RNA, 19 nt, Pseudomonas aeruginosa PA01
ggcgaaauccagacgcagc

SEQ ID NO: 33288 - RNA, 22 nt, Pseudomonas aeruginosa PA01
ggcgaacuccuggccuggcugc

SEQ ID NO: 33289 - RNA, 22 nt, Pseudomonas aeruginosa PA01
ggcgaauacgccaccggcguua

SEQ ID NO: 33290 - RNA, 22 nt, Pseudomonas aeruginosa PA01
ggcgacaucgccauuggcggug

SEQ ID NO: 33291 - RNA, 22 nt, Pseudomonas aeruginosa PA01
ggcgacaugaucgccaccggca

SEQ ID NO: 33292 - RNA, 22 nt, Pseudomonas aeruginosa PA01
ggcgaccugcucggccaggccu

SEQ ID NO: 33293 - RNA, 22 nt, Pseudomonas aeruginosa PA01
ggcgacgacgaagaguaaaugc

SEQ ID NO: 33294 - RNA, 22 nt, Pseudomonas aeruginosa PA01
ggcgagaggcgucgaggucggc

SEQ ID NO: 33295 - RNA, 22 nt, Pseudomonas aeruginosa PA01
ggcgagcgguucgcgggaaagg

SEQ ID NO: 33296 - RNA, 22 nt, Pseudomonas aeruginosa PA01
ggcgaggaacacgcagccgagc

SEQ ID NO: 33297 - RNA, 22 nt, Pseudomonas aeruginosa PA01
ggcgaggcccagcccgagcugg

SEQ ID NO: 33298 - RNA, 22 nt, Pseudomonas aeruginosa PA01
ggcgaucgccuacucgccgagc

SEQ ID NO: 33299 - RNA, 22 nt, Pseudomonas aeruginosa PA01
ggcgaucuccagcagacgcugg

SEQ ID NO: 33300 - RNA, 22 nt, Pseudomonas aeruginosa PA01
ggcgccugggucugccccgccu

SEQ ID NO: 33301 - RNA, 22 nt, Pseudomonas aeruginosa PA01
ggcgccuuucuggccgucggga

SEQ ID NO: 33302 - RNA, 22 nt, Pseudomonas aeruginosa PA01
ggcgcugcuguuccaguacgcg

SEQ ID NO: 33303 - RNA, 22 nt, Pseudomonas aeruginosa PA01
ggcgcugguggucgauccgggc

SEQ ID NO: 33304 - RNA, 22 nt, Pseudomonas aeruginosa PA01
ggcggacaguggcgauccgcau

SEQ ID NO: 33305 - RNA, 22 nt, Pseudomonas aeruginosa PA01
ggcggagaucuucgucgaaggu

SEQ ID NO: 33306 - RNA, 22 nt, Pseudomonas aeruginosa PA01
ggcggaugucgccgauuggcug

SEQ ID NO: 33307 - RNA, 22 nt, Pseudomonas aeruginosa PA01
ggcggcacgccuuccggcaccc

SEQ ID NO: 33308 - RNA, 22 nt, Pseudomonas aeruginosa PA01
ggcggcaugaucggcaucggcg

SEQ ID NO: 33309 - RNA, 22 nt, Pseudomonas aeruginosa PA01
ggcggcgacucgccgguuuccu

SEQ ID NO: 33310 - RNA, 22 nt, Pseudomonas aeruginosa PA01
ggcggcgauuucuccgucgagc

SEQ ID NO: 33311 - RNA, 22 nt, Pseudomonas aeruginosa PA01
ggcggcgcuccucgaaggggaa

SEQ ID NO: 33312 - RNA, 22 nt, Pseudomonas aeruginosa PA01
ggcggcggcgcugcugaucguc

SEQ ID NO: 33313 - RNA, 22 nt, Pseudomonas aeruginosa PA01
ggcgggcgcgagaggccgaacu

SEQ ID NO: 33314 - RNA, 22 nt, Pseudomonas aeruginosa PA01
ggcgggugcugcuggaggaccu

SEQ ID NO: 33315 - RNA, 19 nt, Pseudomonas aeruginosa PA01
ggcggucaccugcuggacc

SEQ ID NO: 33316 - RNA, 22 nt, Pseudomonas aeruginosa PA01
ggcggucgagcaugccaccgug

SEQ ID NO: 33317 - RNA, 22 nt, Pseudomonas aeruginosa PA01
ggcggucgaggagaucgucaag

SEQ ID NO: 33318 - RNA, 22 nt, Pseudomonas aeruginosa PA01
ggcgguguggagccagacggcg

SEQ ID NO: 33319 - RNA, 22 nt, Pseudomonas aeruginosa PA01
ggcgucacggcuggucagcaug

SEQ ID NO: 33320 - RNA, 22 nt, Pseudomonas aeruginosa PA01
ggcgugcuggcgcuggucaccg

SEQ ID NO: 33321 - RNA, 22 nt, Pseudomonas aeruginosa PA01
ggcguugaccggguuguccacc

SEQ ID NO: 33322 - RNA, 22 nt, Pseudomonas aeruginosa PA01
ggcguugaucuguuccaccagc

SEQ ID NO: 33323 - RNA, 22 nt, Pseudomonas aeruginosa PA01
ggcuacguggggcuggaggucg

SEQ ID NO: 33324 - RNA, 22 nt, Pseudomonas aeruginosa PA01
ggcucagccgcgcaugccgaag

SEQ ID NO: 33325 - RNA, 22 nt, Pseudomonas aeruginosa PA01
ggcucccuuggccauuuccgcc

SEQ ID NO: 33326 - RNA, 22 nt, Pseudomonas aeruginosa PA01
ggcucggaagucgacuaccagg

SEQ ID NO: 33327 - RNA, 22 nt, Pseudomonas aeruginosa PA01
ggcugacagggccgcggcgccu

SEQ ID NO: 33328 - RNA, 22 nt, Pseudomonas aeruginosa PA01
ggcugaccgacaaggugcgcgg

SEQ ID NO: 33329 - RNA, 22 nt, Pseudomonas aeruginosa PA01
ggcugaugcagcagcgccaugu

SEQ ID NO: 33330 - RNA, 22 nt, Pseudomonas aeruginosa PA01
ggcugccgccgauggccuugga

SEQ ID NO: 33331 - RNA, 22 nt, Pseudomonas aeruginosa PA01
ggcugcugauggcuauccaugu

SEQ ID NO: 33332 - RNA, 22 nt, Pseudomonas aeruginosa PA01
ggcuggugauguugccggcaag

SEQ ID NO: 33333 - RNA, 22 nt, Pseudomonas aeruginosa PA01
ggcugguggugaaaccgaccug

SEQ ID NO: 33334 - RNA, 19 nt, Pseudomonas aeruginosa PA01
ggcuucugcgccucgucga

SEQ ID NO: 33335 - RNA, 19 nt, Pseudomonas aeruginosa PA01
ggcuugccuucguugcgcu

SEQ ID NO: 33336 - RNA, 22 nt, Pseudomonas aeruginosa PA01
ggcuuggucagcgcggccaguu

SEQ ID NO: 33337 - RNA, 22 nt, Pseudomonas aeruginosa PA01
gggaaauggcuuccggccugac

SEQ ID NO: 33338 - RNA, 22 nt, Pseudomonas aeruginosa PA01
gggaccuugccagcgccagccc

SEQ ID NO: 33339 - RNA, 22 nt, Pseudomonas aeruginosa PA01
gggaggcgugauggcugcucaa

SEQ ID NO: 33340 - RNA, 22 nt, Pseudomonas aeruginosa PA01
gggcaacuucaucgccguggau

SEQ ID NO: 33341 - RNA, 22 nt, Pseudomonas aeruginosa PA01
gggcagcuucagcaagcgcucg

SEQ ID NO: 33342 - RNA, 22 nt, Pseudomonas aeruginosa PA01
gggccgggcgacgaacuggacg

SEQ ID NO: 33343 - RNA, 22 nt, Pseudomonas aeruginosa PA01
gggcgagaccgagcagcgcggu

SEQ ID NO: 33344 - RNA, 22 nt, Pseudomonas aeruginosa PA01
gggcgagccacucgccgaggaa

SEQ ID NO: 33345 - RNA, 22 nt, Pseudomonas aeruginosa PA01
gggcgaggacgucgaccuugag

SEQ ID NO: 33346 - RNA, 22 nt, Pseudomonas aeruginosa PA01
gggcgccgacgugccggucuuc

SEQ ID NO: 33347 - RNA, 20 nt, Pseudomonas aeruginosa PA01
gggcgcuggcauaggcgccc

SEQ ID NO: 33348 - RNA, 22 nt, Pseudomonas aeruginosa PA01
ugccggcgcaguucgggcgcaa

SEQ ID NO: 33349 - RNA, 22 nt, Pseudomonas aeruginosa PA01
ugccgggccaugguguuguuac

SEQ ID NO: 33350 - RNA, 22 nt, Pseudomonas aeruginosa PA01
ugccuccaggcgcgaguccagc

SEQ ID NO: 33351 - RNA, 22 nt, Pseudomonas aeruginosa PA01
ugccugcucggucgcaacgggg

SEQ ID NO: 33352 - RNA, 22 nt, Pseudomonas aeruginosa PA01
ugccuucacuucgucgaugacg

SEQ ID NO: 33353 - RNA, 21 nt, Pseudomonas aeruginosa PA01
ugccuuccugcucggcgagcc

SEQ ID NO: 33354 - RNA, 20 nt, Pseudomonas aeruginosa PA01
ugcgcaggucggugggcgug

SEQ ID NO: 33355 - RNA, 22 nt, Pseudomonas aeruginosa PA01
ugcgccaggcgcuggcacuggu

SEQ ID NO: 33356 - RNA, 22 nt, Pseudomonas aeruginosa PA01
ugcgccugcacgagaccuggcg

SEQ ID NO: 33357 - RNA, 22 nt, Pseudomonas aeruginosa PA01
ugcgccuggagcaggccugcga

SEQ ID NO: 33358 - RNA, 22 nt, Pseudomonas aeruginosa PA01
ugcgcugguggucgagcagcac

SEQ ID NO: 33359 - RNA, 22 nt, Pseudomonas aeruginosa PA01
ugcggcgaaccugcucggccaa

SEQ ID NO: 33360 - RNA, 22 nt, Pseudomonas aeruginosa PA01
ugcggcguucugcucgggaucc

SEQ ID NO: 33361 - RNA, 22 nt, Pseudomonas aeruginosa PA01
ugcgggccgacguggugguggu

SEQ ID NO: 33362 - RNA, 22 nt, Pseudomonas aeruginosa PA01
ugcgggccguugggaaucggcg

SEQ ID NO: 33363 - RNA, 22 nt, Pseudomonas aeruginosa PA01
ugcgggugccgccgucggccug

SEQ ID NO: 33364 - RNA, 22 nt, Pseudomonas aeruginosa PA01
ugcggucugguacggcgcggac

SEQ ID NO: 33365 - RNA, 22 nt, Pseudomonas aeruginosa PA01
ugcgguucauguagaugauguu

SEQ ID NO: 33366 - RNA, 22 nt, Pseudomonas aeruginosa PA01
ugcgguuguuguggcugccaug

SEQ ID NO: 33367 - RNA, 22 nt, Pseudomonas aeruginosa PA01
ugcgucgagccuguggucuucg

SEQ ID NO: 33368 - RNA, 22 nt, Pseudomonas aeruginosa PA01
ugcgugcggcuucggccaggcg

SEQ ID NO: 33369 - RNA, 22 nt, Pseudomonas aeruginosa PA01
ugcgugggucgcgcugggcguu

SEQ ID NO: 33370 - RNA, 22 nt, Pseudomonas aeruginosa PA01
ugcguuucuggcacagcggcuu

SEQ ID NO: 33371 - RNA, 22 nt, Pseudomonas aeruginosa PA01
ugcuccaguugcgccaguucca

SEQ ID NO: 33372 - RNA, 22 nt, Pseudomonas aeruginosa PA01
ugcuccaucagcaugcugcugg

SEQ ID NO: 33373 - RNA, 22 nt, Pseudomonas aeruginosa PA01
aaacugcaugagcggcucgacc

SEQ ID NO: 33374 - RNA, 22 nt, Pseudomonas aeruginosa PA01
aaagcuggaacggauagugcuc

SEQ ID NO: 33375 - RNA, 22 nt, Pseudomonas aeruginosa PA01
aaccccagcccucgcggccgau

SEQ ID NO: 33376 - RNA, 22 nt, Pseudomonas aeruginosa PA01
aaccugcucggccucgaccugc

SEQ ID NO: 33377 - RNA, 22 nt, Pseudomonas aeruginosa PA01
aacgccaagcugaccagcaucg

SEQ ID NO: 33378 - RNA, 22 nt, Pseudomonas aeruginosa PA01
aacgcgaagccggaaguggggu

SEQ ID NO: 33379 - RNA, 22 nt, Pseudomonas aeruginosa PA01
aacgggaagcccagggccucgg

SEQ ID NO: 33380 - RNA, 22 nt, Pseudomonas aeruginosa PA01
aagcccuuggcgucgcgcaccg

SEQ ID NO: 33381 - RNA, 22 nt, Pseudomonas aeruginosa PA01
aagcgccuggagauagucgucg

SEQ ID NO: 33382 - RNA, 22 nt, Pseudomonas aeruginosa PA01
aagcgcugggcgacgcccgucg

SEQ ID NO: 33383 - RNA, 22 nt, Pseudomonas aeruginosa PA01
aagcgcuuggguaacagccgag

SEQ ID NO: 33384 - RNA, 22 nt, Pseudomonas aeruginosa PA01
aagcggacccgcgccagguugc

SEQ ID NO: 33385 - RNA, 22 nt, Pseudomonas aeruginosa PA01
aagcggcgguagccauggcggu

SEQ ID NO: 33386 - RNA, 22 nt, Pseudomonas aeruginosa PA01
aagcgguugaaggcauuggcca

SEQ ID NO: 33387 - RNA, 22 nt, Pseudomonas aeruginosa PA01
aagcucggugccgaccacgacg

SEQ ID NO: 33388 - RNA, 22 nt, Pseudomonas aeruginosa PA01
aagcugggcauagaggucgucg

SEQ ID NO: 33389 - RNA, 22 nt, Pseudomonas aeruginosa PA01
aaggcagcuucuccggcucgau

SEQ ID NO: 33390 - RNA, 22 nt, Pseudomonas aeruginosa PA01
aaggccguggucgacgccgcgc

SEQ ID NO: 33391 - RNA, 22 nt, Pseudomonas aeruginosa PA01
aaggccugguagucgaggccca

SEQ ID NO: 33392 - RNA, 22 nt, Pseudomonas aeruginosa PA01
aaggcggcaggcuauuaccuuc

SEQ ID NO: 33393 - RNA, 22 nt, Pseudomonas aeruginosa PA01
aaggcggcggcggucaagccgg

SEQ ID NO: 33394 - RNA, 22 nt, Pseudomonas aeruginosa PA01
aaggcguccuggauuucgccga

SEQ ID NO: 33395 - RNA, 22 nt, Pseudomonas aeruginosa PA01
aaggucaucgguuucgagccca

SEQ ID NO: 33396 - RNA, 22 nt, Pseudomonas aeruginosa PA01
aaggucgagugcgccuacgagg

SEQ ID NO: 33397 - RNA, 22 nt, Pseudomonas aeruginosa PA01
aaggugaugaacgucucgcuga

SEQ ID NO: 33398 - RNA, 22 nt, Pseudomonas aeruginosa PA01
aaucgccgugcugcccggcgca

SEQ ID NO: 33399 - RNA, 22 nt, Pseudomonas aeruginosa PA01
aaucuccgcuucgucgaaaagc

SEQ ID NO: 33400 - RNA, 22 nt, Pseudomonas aeruginosa PA01
aaugcauuugccgcugccuggg

SEQ ID NO: 33401 - RNA, 22 nt, Pseudomonas aeruginosa PA01
acaccacgcgauccuuggccgc

SEQ ID NO: 33402 - RNA, 22 nt, Pseudomonas aeruginosa PA01
acagaaacgcgcuuuuuucguu

SEQ ID NO: 33403 - RNA, 22 nt, Pseudomonas aeruginosa PA01
agccugauggugguggacgccc

SEQ ID NO: 33404 - RNA, 20 nt, Pseudomonas aeruginosa PA01
agccuggcgcggguccgcuu

SEQ ID NO: 33405 - RNA, 22 nt, Pseudomonas aeruginosa PA01
agcgacaaguaucgguggaguu

SEQ ID NO: 33406 - RNA, 22 nt, Pseudomonas aeruginosa PA01
agcgacacuuauauaacgggug

SEQ ID NO: 33407 - RNA, 20 nt, Pseudomonas aeruginosa PA01
agcgacccuugagcgccggc

SEQ ID NO: 33408 - RNA, 22 nt, Pseudomonas aeruginosa PA01
agcgaggcgucuggcacggcga

SEQ ID NO: 33409 - RNA, 22 nt, Pseudomonas aeruginosa PA01
agcgaucgccccguucggccag

SEQ ID NO: 33410 - RNA, 22 nt, Pseudomonas aeruginosa PA01
agcgcagcaggcaggccuggua

SEQ ID NO: 33411 - RNA, 22 nt, Pseudomonas aeruginosa PA01
agcgcauggccagcggguagau

SEQ ID NO: 33412 - RNA, 22 nt, Pseudomonas aeruginosa PA01
agcgccaggugucgaccaucuu

SEQ ID NO: 33413 - RNA, 22 nt, Pseudomonas aeruginosa PA01
agcgccaguaccgggcggccgc

SEQ ID NO: 33414 - RNA, 21 nt, Pseudomonas aeruginosa PA01
agcgccuggcgucgaugccga

SEQ ID NO: 33415 - RNA, 22 nt, Pseudomonas aeruginosa PA01
agcgccuggucggccugguucu

SEQ ID NO: 33416 - RNA, 22 nt, Pseudomonas aeruginosa PA01
agcgccuguugcaggucggccu

SEQ ID NO: 33417 - RNA, 22 nt, Pseudomonas aeruginosa PA01
agcgcgaggccagccagcaacu

SEQ ID NO: 33418 - RNA, 22 nt, Pseudomonas aeruginosa PA01
agcgcgcugacggugaggacuc

SEQ ID NO: 33419 - RNA, 22 nt, Pseudomonas aeruginosa PA01
agcgcggcaagauguucggcuu

SEQ ID NO: 33420 - RNA, 22 nt, Pseudomonas aeruginosa PA01
agcgcgugguucagcagcacau

SEQ ID NO: 33421 - RNA, 22 nt, Pseudomonas aeruginosa PA01
agcgcguugaguuccaggugcc

SEQ ID NO: 33422 - RNA, 22 nt, Pseudomonas aeruginosa PA01
agcgggagaucgccaguugaug

SEQ ID NO: 33423 - RNA, 22 nt, Pseudomonas aeruginosa PA01
agcgggcugagggugcccucgg

SEQ ID NO: 33424 - RNA, 22 nt, Pseudomonas aeruginosa PA01
agcggguacgcugcaacagguu

SEQ ID NO: 33425 - RNA, 22 nt, Pseudomonas aeruginosa PA01
agcguggccuucuccucggaca

SEQ ID NO: 33426 - RNA, 22 nt, Pseudomonas aeruginosa PA01
agcuccaggcgcggcgaaccga

SEQ ID NO: 33427 - RNA, 22 nt, Pseudomonas aeruginosa PA01
agcugcaccauguugagcagcu

SEQ ID NO: 33428 - RNA, 22 nt, Pseudomonas aeruginosa PA01
agcuggaagaucaccuguucga

SEQ ID NO: 33429 - RNA, 22 nt, Pseudomonas aeruginosa PA01
agcuggaagcccgacgccgaua

SEQ ID NO: 33430 - RNA, 23 nt, Pseudomonas aeruginosa PA01
agcuggauggccgccugcuguuc

SEQ ID NO: 33431 - RNA, 19 nt, Pseudomonas aeruginosa PA01
agcuggcgcagcagggugc

SEQ ID NO: 33432 - RNA, 22 nt, Pseudomonas aeruginosa PA01
aggaacaguucgacgcccaggu

SEQ ID NO: 33433 - RNA, 19 nt, Pseudomonas aeruginosa PA01
aggaaggccgcuucgccgc

SEQ ID NO: 33434 - RNA, 22 nt, Pseudomonas aeruginosa PA01
aggacaaguccgugcuguacgc

SEQ ID NO: 33435 - RNA, 22 nt, Pseudomonas aeruginosa PA01
aggacgaugucgaccggggugc

SEQ ID NO: 33436 - RNA, 22 nt, Pseudomonas aeruginosa PA01
aggacgcugaaggcaugcucca

SEQ ID NO: 33437 - RNA, 22 nt, Pseudomonas aeruginosa PA01
aggagcgcgcggugaucgcccu

SEQ ID NO: 33438 - RNA, 20 nt, Pseudomonas aeruginosa PA01
aggaggccggcuuguugcgg

SEQ ID NO: 33439 - RNA, 22 nt, Pseudomonas aeruginosa PA01
aggcccagcacggugcccaugg

SEQ ID NO: 33440 - RNA, 21 nt, Pseudomonas aeruginosa PA01
aggcccguggcgucuucgucg

SEQ ID NO: 33441 - RNA, 22 nt, Pseudomonas aeruginosa PA01
aggcccucgggcaggugauuga

SEQ ID NO: 33442 - RNA, 22 nt, Pseudomonas aeruginosa PA01
aggccgaguugcgccaggacga

SEQ ID NO: 33443 - RNA, 22 nt, Pseudomonas aeruginosa PA01
aggccgcggaaggugacgaugc

SEQ ID NO: 33444 - RNA, 22 nt, Pseudomonas aeruginosa PA01
aggccggaucggaaaagcgucg

SEQ ID NO: 33445 - RNA, 22 nt, Pseudomonas aeruginosa PA01
aggccggcuaccucgaaggcgg

SEQ ID NO: 33446 - RNA, 22 nt, Pseudomonas aeruginosa PA01
aggcgaagacguccuugagcag

SEQ ID NO: 33447 - RNA, 22 nt, Pseudomonas aeruginosa PA01
aggcgccgcggcccugucagcc

SEQ ID NO: 33448 - RNA, 22 nt, Pseudomonas aeruginosa PA01
aggcgcugcgcauccagcggcc

SEQ ID NO: 33449 - RNA, 22 nt, Pseudomonas aeruginosa PA01
aggcgcuguucguggucagcac

SEQ ID NO: 33450 - RNA, 22 nt, Pseudomonas aeruginosa PA01
aggcgcuuguguaccacuucca

SEQ ID NO: 33451 - RNA, 22 nt, Pseudomonas aeruginosa PA01
aggcgggcaacgccgccgacga

SEQ ID NO: 33452 - RNA, 22 nt, Pseudomonas aeruginosa PA01
aggcguucucguaguccuggcu

SEQ ID NO: 33453 - RNA, 21 nt, Pseudomonas aeruginosa PA01
aggcuaccguugaagaacugc

SEQ ID NO: 33454 - RNA, 22 nt, Pseudomonas aeruginosa PA01
aggcucuggaugcugugcgccu

SEQ ID NO: 33455 - RNA, 22 nt, Pseudomonas aeruginosa PA01
aggcugauggcauccacgccau

SEQ ID NO: 33456 - RNA, 22 nt, Pseudomonas aeruginosa PA01
aggcuugcgcugggcccagccg

SEQ ID NO: 33457 - RNA, 22 nt, Pseudomonas aeruginosa PA01
agggccaucugccagcgggaac

SEQ ID NO: 33458 - RNA, 22 nt, Pseudomonas aeruginosa PA01
agggcgggcugccugccggacg

SEQ ID NO: 33459 - RNA, 22 nt, Pseudomonas aeruginosa PA01
agggcguuguucggauccuuca

SEQ ID NO: 33460 - RNA, 22 nt, Pseudomonas aeruginosa PA01
aggggccguaggggcuuucguu

SEQ ID NO: 33461 - RNA, 23 nt, Pseudomonas aeruginosa PA01
aggguaguacgcauagcguacgu

SEQ ID NO: 33462 - RNA, 22 nt, Pseudomonas aeruginosa PA01
agggucaagcugcgacgugccg

SEQ ID NO: 33463 - RNA, 22 nt, Pseudomonas aeruginosa PA01
agggucucgagcacaccgccga

SEQ ID NO: 33464 - RNA, 21 nt, Pseudomonas aeruginosa PA01
agggugaagagaugucgcucg

SEQ ID NO: 33465 - RNA, 22 nt, Pseudomonas aeruginosa PA01
agggugguccacagcggcaggc

SEQ ID NO: 33466 - RNA, 22 nt, Pseudomonas aeruginosa PA01
aggucaguggguuugcggucug

SEQ ID NO: 33467 - RNA, 22 nt, Pseudomonas aeruginosa PA01
agguccaggucgaccuggucca

SEQ ID NO: 33468 - RNA, 22 nt, Pseudomonas aeruginosa PA01
aggucgauauccgggcgcaggu

SEQ ID NO: 33469 - RNA, 22 nt, Pseudomonas aeruginosa PA01
aggucgcccuggcuggaggccu

SEQ ID NO: 33470 - RNA, 22 nt, Pseudomonas aeruginosa PA01
aggucggccagggucagcuggu

SEQ ID NO: 33471 - RNA, 22 nt, Pseudomonas aeruginosa PA01
aggucggcuucggcuucgaugu

SEQ ID NO: 33472 - RNA, 22 nt, Pseudomonas aeruginosa PA01
aggucggcuucgucgucuucca

SEQ ID NO: 33473 - RNA, 22 nt, Pseudomonas aeruginosa PA01
aggucguugaccggcaggccga

SEQ ID NO: 33474 - RNA, 22 nt, Pseudomonas aeruginosa PA01
aggugcucgacgaccaggcccu

SEQ ID NO: 33475 - RNA, 22 nt, Pseudomonas aeruginosa PA01
agguggagcguugcggcgccgg

SEQ ID NO: 33476 - RNA, 21 nt, Pseudomonas aeruginosa PA01
agguggauggugccaccgguc

SEQ ID NO: 33477 - RNA, 22 nt, Pseudomonas aeruginosa PA01
aggugguugugcggcgccacgg

SEQ ID NO: 33478 - RNA, 22 nt, Pseudomonas aeruginosa PA01
agguuccggaacaggcaauccu

SEQ ID NO: 33479 - RNA, 22 nt, Pseudomonas aeruginosa PA01
aguccuucggcaucgccggcau

SEQ ID NO: 33480 - RNA, 22 nt, Pseudomonas aeruginosa PA01
agucggcgccgagccagaggcc

SEQ ID NO: 33481 - RNA, 22 nt, Pseudomonas aeruginosa PA01
agucggcuugggucagcggguu

SEQ ID NO: 33482 - RNA, 22 nt, Pseudomonas aeruginosa PA01
agugccaugaagaagcucggca

SEQ ID NO: 33483 - RNA, 22 nt, Pseudomonas aeruginosa PA01
aguucgcugaucugcaguggcg

SEQ ID NO: 33484 - RNA, 22 nt, Pseudomonas aeruginosa PA01
aguucgucgacgaccgcgccgg

SEQ ID NO: 33485 - RNA, 22 nt, Pseudomonas aeruginosa PA01
aguucugcaugaccgguucgcg

SEQ ID NO: 33486 - RNA, 22 nt, Pseudomonas aeruginosa PA01
aguugcgugaaguggccuggga

SEQ ID NO: 33487 - RNA, 22 nt, Pseudomonas aeruginosa PA01
aguugguccucgccgccgauca

SEQ ID NO: 33488 - RNA, 22 nt, Pseudomonas aeruginosa PA01
aguuugccgcaauccccggagg

SEQ ID NO: 33489 - RNA, 22 nt, Pseudomonas aeruginosa PA01
aguuuggcauggcaacccaguc

SEQ ID NO: 33490 - RNA, 22 nt, Pseudomonas aeruginosa PA01
aucaccaugcccagcgacugcg

SEQ ID NO: 33491 - RNA, 23 nt, Pseudomonas aeruginosa PA01
aucaccucgaccuuggccuugcc

SEQ ID NO: 33492 - RNA, 22 nt, Pseudomonas aeruginosa PA01
aucacguccggcaggcgcucga

SEQ ID NO: 33493 - RNA, 22 nt, Pseudomonas aeruginosa PA01
aucacucguucaccgccacccu

SEQ ID NO: 33494 - RNA, 23 nt, Pseudomonas aeruginosa PA01
aucagcaacgcaaguaacacucg

SEQ ID NO: 33495 - RNA, 20 nt, Pseudomonas aeruginosa PA01
aucagcauguugggggcggg

SEQ ID NO: 33496 - RNA, 22 nt, Pseudomonas aeruginosa PA01
aucagcgaccgauugcgauggc

SEQ ID NO: 33497 - RNA, 22 nt, Pseudomonas aeruginosa PA01
aucagcuuggccuugaugguga

SEQ ID NO: 33498 - RNA, 22 nt, Pseudomonas aeruginosa PA01
aucaggccgcaggcguggcccu

SEQ ID NO: 33499 - RNA, 22 nt, Pseudomonas aeruginosa PA01
aucauccgccgaugcggcgaua

SEQ ID NO: 33500 - RNA, 22 nt, Pseudomonas aeruginosa PA01
auccacaacauauuguuguuuu

SEQ ID NO: 33501 - RNA, 22 nt, Pseudomonas aeruginosa PA01
auccauggcauugcugcgccug

SEQ ID NO: 33502 - RNA, 22 nt, Pseudomonas aeruginosa PA01
aucccgagcagaacgccgcauu

SEQ ID NO: 33503 - RNA, 19 nt, Pseudomonas aeruginosa PA01
auccgcaugggcaacugcc

SEQ ID NO: 33504 - RNA, 22 nt, Pseudomonas aeruginosa PA01
auccucccgcagaucgcccgcc

SEQ ID NO: 33505 - RNA, 23 nt, Pseudomonas aeruginosa PA01
auccucgcccagcucgcggcggu

SEQ ID NO: 33506 - RNA, 22 nt, Pseudomonas aeruginosa PA01
aucgacggcggauuggugaagg

SEQ ID NO: 33507 - RNA, 22 nt, Pseudomonas aeruginosa PA01
aucgccugaaggcucauccggg

SEQ ID NO: 33508 - RNA, 22 nt, Pseudomonas aeruginosa PA01
aucgccuuccugaucuuugcuu

SEQ ID NO: 33509 - RNA, 22 nt, Pseudomonas aeruginosa PA01
aucgcgccauggucgaccagga

SEQ ID NO: 33510 - RNA, 22 nt, Pseudomonas aeruginosa PA01
aucgcgguggcggugauggugg

SEQ ID NO: 33511 - RNA, 22 nt, Pseudomonas aeruginosa PA01
aucggcagguugaggaugucgc

SEQ ID NO: 33512 - RNA, 22 nt, Pseudomonas aeruginosa PA01
aucggccaguucgacgugguca

SEQ ID NO: 33513 - RNA, 22 nt, Pseudomonas aeruginosa PA01
aucggcgaucagcacaucggcc

SEQ ID NO: 33514 - RNA, 20 nt, Pseudomonas aeruginosa PA01
aucgggccuccggcucgucc

SEQ ID NO: 33515 - RNA, 23 nt, Pseudomonas aeruginosa PA01
aucgguaccgugcuguacaucgc

SEQ ID NO: 33516 - RNA, 16 nt, Pseudomonas aeruginosa PA01
aucuccgccaccucgc

SEQ ID NO: 33517 - RNA, 22 nt, Pseudomonas aeruginosa PA01
aucucgaaggcguagcgggugc

SEQ ID NO: 33518 - RNA, 22 nt, Pseudomonas aeruginosa PA01
aucucgaggaugcggccggaga

SEQ ID NO: 33519 - RNA, 22 nt, Pseudomonas aeruginosa PA01
aucuggagcaacaggucgcggg

SEQ ID NO: 33520 - RNA, 22 nt, Pseudomonas aeruginosa PA01
aucugggacaaggcguucaucg

SEQ ID NO: 33521 - RNA, 22 nt, Pseudomonas aeruginosa PA01
augaaccggcgcagcgcggcca

SEQ ID NO: 33522 - RNA, 22 nt, Pseudomonas aeruginosa PA01
augagcgugcggaucaggcgcu

SEQ ID NO: 33523 - RNA, 22 nt, Pseudomonas aeruginosa PA01
augaggccagugucauuguccc

SEQ ID NO: 33524 - RNA, 22 nt, Pseudomonas aeruginosa PA01
augcccgaggugaagccggaca

SEQ ID NO: 33525 - RNA, 22 nt, Pseudomonas aeruginosa PA01
augccgaaggcgaucgaggcga

SEQ ID NO: 33526 - RNA, 22 nt, Pseudomonas aeruginosa PA01
augccgaucagcgcggcgaugu

SEQ ID NO: 33527 - RNA, 22 nt, Pseudomonas aeruginosa PA01
augccgaugcucggggugacga

SEQ ID NO: 33528 - RNA, 22 nt, Pseudomonas aeruginosa PA01
augccggcgccaacggugccgu

SEQ ID NO: 33529 - RNA, 22 nt, Pseudomonas aeruginosa PA01
augccgguggcgaggacgaucu

SEQ ID NO: 33530 - RNA, 22 nt, Pseudomonas aeruginosa PA01
augccgguuuccagggcgagac

SEQ ID NO: 33531 - RNA, 22 nt, Pseudomonas aeruginosa PA01
augcgagccuguugcagcaggu

SEQ ID NO: 33532 - RNA, 19 nt, Pseudomonas aeruginosa PA01
augcggaugccguggcggc

SEQ ID NO: 33533 - RNA, 22 nt, Pseudomonas aeruginosa PA01
augcgugcagugggcugcuugu

SEQ ID NO: 33534 - RNA, 22 nt, Pseudomonas aeruginosa PA01
augcucgaagcgcuccagcggc

SEQ ID NO: 33535 - RNA, 22 nt, Pseudomonas aeruginosa PA01
augcuguucuuucacagcaucg

SEQ ID NO: 33536 - RNA, 22 nt, Pseudomonas aeruginosa PA01
auggacgaaacgauacgucccu

SEQ ID NO: 33537 - RNA, 22 nt, Pseudomonas aeruginosa PA01
auggccugcugcugcgccuccc

SEQ ID NO: 33538 - RNA, 22 nt, Pseudomonas aeruginosa PA01
auggcgucggcuaccgccuggc

SEQ ID NO: 33539 - RNA, 22 nt, Pseudomonas aeruginosa PA01
auguccggcagcgcggcgaagg

SEQ ID NO: 33540 - RNA, 22 nt, Pseudomonas aeruginosa PA01
auguccuccaggcagcgcgcgu

SEQ ID NO: 33541 - RNA, 22 nt, Pseudomonas aeruginosa PA01
augucgaggaagaccaggcgau

SEQ ID NO: 33542 - RNA, 22 nt, Pseudomonas aeruginosa PA01
augugcuggcccgcgaggcgcc

SEQ ID NO: 33543 - RNA, 22 nt, Pseudomonas aeruginosa PA01
auuccccguuaaccuuaaguua

SEQ ID NO: 33544 - RNA, 22 nt, Pseudomonas aeruginosa PA01
auugcggcacacgcaugcaggc

SEQ ID NO: 33545 - RNA, 22 nt, Pseudomonas aeruginosa PA01
auugggcgugucgcgggugcug

SEQ ID NO: 33546 - RNA, 19 nt, Pseudomonas aeruginosa PA01
caacggcuccgggaagucc

SEQ ID NO: 33547 - RNA, 22 nt, Pseudomonas aeruginosa PA01
caacgggccuuccaggcugccg

SEQ ID NO: 33548 - RNA, 22 nt, Pseudomonas aeruginosa PA01
caagcgccugcgcgccuuccug

SEQ ID NO: 33549 - RNA, 22 nt, Pseudomonas aeruginosa PA01
caagcuggcgaugucgauccgc

SEQ ID NO: 33550 - RNA, 22 nt, Pseudomonas aeruginosa PA01
caagcuuguccuugaagcgggc

SEQ ID NO: 33551 - RNA, 22 nt, Pseudomonas aeruginosa PA01
cacaggccgagcagggcgaucg

SEQ ID NO: 33552 - RNA, 22 nt, Pseudomonas aeruginosa PA01
cacagggucgggugcucagccg

SEQ ID NO: 33553 - RNA, 22 nt, Pseudomonas aeruginosa PA01
caccacgguggauuuccucgag

SEQ ID NO: 33554 - RNA, 22 nt, Pseudomonas aeruginosa PA01
caccaucuuccucgccgggccg

SEQ ID NO: 33555 - RNA, 22 nt, Pseudomonas aeruginosa PA01
cacccgcucgcugggcgaguug

SEQ ID NO: 33556 - RNA, 22 nt, Pseudomonas aeruginosa PA01
caccgcgaugccgccggugccc

SEQ ID NO: 33557 - RNA, 22 nt, Pseudomonas aeruginosa PA01
caccgcgcccuccaucaccucg

SEQ ID NO: 33558 - RNA, 22 nt, Pseudomonas aeruginosa PA01
caccgcgcggccaugaaaaaac

SEQ ID NO: 33559 - RNA, 22 nt, Pseudomonas aeruginosa PA01
caccgggccguugcugucgugg

SEQ ID NO: 33560 - RNA, 22 nt, Pseudomonas aeruginosa PA01
caccugcgcgacgcccagcgcu

SEQ ID NO: 33561 - RNA, 22 nt, Pseudomonas aeruginosa PA01
caccuggaacucguggcgcagg

SEQ ID NO: 33562 - RNA, 22 nt, Pseudomonas aeruginosa PA01
caccuucaaccgggucggccug

SEQ ID NO: 33563 - RNA, 22 nt, Pseudomonas aeruginosa PA01
cacgccaggccacguuuugccg

SEQ ID NO: 33564 - RNA, 22 nt, Pseudomonas aeruginosa PA01
cacgccccguggcgacagggcc

SEQ ID NO: 33565 - RNA, 22 nt, Pseudomonas aeruginosa PA01
cacgcccuucacguugcgcaac

SEQ ID NO: 33566 - RNA, 20 nt, Pseudomonas aeruginosa PA01
cacggacgccacuacgcgau

SEQ ID NO: 33567 - RNA, 20 nt, Pseudomonas aeruginosa PA01
cacggccgcgggcuguugag

SEQ ID NO: 33568 - RNA, 22 nt, Pseudomonas aeruginosa PA01
cacguggggcagcauggcgcga

SEQ ID NO: 33569 - RNA, 22 nt, Pseudomonas aeruginosa PA01
cccggcucugcucggcgugggc

SEQ ID NO: 33570 - RNA, 22 nt, Pseudomonas aeruginosa PA01
cccugaagaaggaaaagggcga

SEQ ID NO: 33571 - RNA, 21 nt, Pseudomonas aeruginosa PA01
cccugacccgaggcuacgccg

SEQ ID NO: 33572 - RNA, 23 nt, Pseudomonas aeruginosa PA01
cccugcgagccccuuuucgcuuc

SEQ ID NO: 33573 - RNA, 22 nt, Pseudomonas aeruginosa PA01
cccuguucgagagccuggcgga

SEQ ID NO: 33574 - RNA, 22 nt, Pseudomonas aeruginosa PA01
cccuucagcgccucgcccuggg

SEQ ID NO: 33575 - RNA, 22 nt, Pseudomonas aeruginosa PA01
ccgaacugauaccuguuggucu

SEQ ID NO: 33576 - RNA, 22 nt, Pseudomonas aeruginosa PA01
ccgaccacaucaucgugcucga

SEQ ID NO: 33577 - RNA, 22 nt, Pseudomonas aeruginosa PA01
ccgaccagcgccagcgagccag

SEQ ID NO: 33578 - RNA, 22 nt, Pseudomonas aeruginosa PA01
ccgaccugcgacagggcuaccc

SEQ ID NO: 33579 - RNA, 22 nt, Pseudomonas aeruginosa PA01
ccgaccuugccgagcgccggca

SEQ ID NO: 33580 - RNA, 22 nt, Pseudomonas aeruginosa PA01
ccgacgaggccgaugcggccga

SEQ ID NO: 33581 - RNA, 22 nt, Pseudomonas aeruginosa PA01
ccgacgcuccucuccgcggccu

SEQ ID NO: 33582 - RNA, 22 nt, Pseudomonas aeruginosa PA01
ccgacgguguggaucacguggg

SEQ ID NO: 33583 - RNA, 22 nt, Pseudomonas aeruginosa PA01
ccgacugcucgaacaugugcca

SEQ ID NO: 33584 - RNA, 22 nt, Pseudomonas aeruginosa PA01
ccgagcaggaagccuugcagcg

SEQ ID NO: 33585 - RNA, 22 nt, Pseudomonas aeruginosa PA01
ccgagcaggccgauggagccgg

SEQ ID NO: 33586 - RNA, 22 nt, Pseudomonas aeruginosa PA01
ccgagcggcuggcggauguagu

SEQ ID NO: 33587 - RNA, 22 nt, Pseudomonas aeruginosa PA01
ccgaucaccucgucaugcccgc

SEQ ID NO: 33588 - RNA, 22 nt, Pseudomonas aeruginosa PA01
ccgauugccguaggcgaccagg

SEQ ID NO: 33589 - RNA, 22 nt, Pseudomonas aeruginosa PA01
ccgcacgcucgaucagcgccga

SEQ ID NO: 33590 - RNA, 22 nt, Pseudomonas aeruginosa PA01
ccgccagcagcgaguugagcug

SEQ ID NO: 33591 - RNA, 22 nt, Pseudomonas aeruginosa PA01
ccgccagcguauccugauguau

SEQ ID NO: 33592 - RNA, 22 nt, Pseudomonas aeruginosa PA01
ccgccgaagcgcauggucaggc

SEQ ID NO: 33593 - RNA, 22 nt, Pseudomonas aeruginosa PA01
ccgccgacggugaucggcuucu

SEQ ID NO: 33594 - RNA, 23 nt, Pseudomonas aeruginosa PA01
ccgccgaucaguuccguucgcgc

SEQ ID NO: 33595 - RNA, 22 nt, Pseudomonas aeruginosa PA01
ccgccuccgccgguuguugccu

SEQ ID NO: 33596 - RNA, 22 nt, Pseudomonas aeruginosa PA01
ccgccugcugcuggcccucggc

SEQ ID NO: 33597 - RNA, 22 nt, Pseudomonas aeruginosa PA01
ccgcgcagaucccccggcuggc

SEQ ID NO: 33598 - RNA, 22 nt, Pseudomonas aeruginosa PA01
ccgcgccggcaaggugaucauc

SEQ ID NO: 33599 - RNA, 23 nt, Pseudomonas aeruginosa PA01
ccgcggccugcaauucuuccagc

SEQ ID NO: 33600 - RNA, 22 nt, Pseudomonas aeruginosa PA01
ccgcgggcagccccggaucggc

SEQ ID NO: 33601 - RNA, 22 nt, Pseudomonas aeruginosa PA01
ccgcgggcugacgcccaggcga

SEQ ID NO: 33602 - RNA, 22 nt, Pseudomonas aeruginosa PA01
ccgcggugaccgcugucguugu

SEQ ID NO: 33603 - RNA, 22 nt, Pseudomonas aeruginosa PA01
ccgcgucggccaguugcgccau

SEQ ID NO: 33604 - RNA, 22 nt, Pseudomonas aeruginosa PA01
ccgcguggcgguuauucgcccu

SEQ ID NO: 33605 - RNA, 22 nt, Pseudomonas aeruginosa PA01
ccgcucaagggcgugaccuugc

SEQ ID NO: 33606 - RNA, 22 nt, Pseudomonas aeruginosa PA01
ccgcucugcccgaccggguuga

SEQ ID NO: 33607 - RNA, 22 nt, Pseudomonas aeruginosa PA01
ccgcugaugcucgccggccugc

SEQ ID NO: 33608 - RNA, 22 nt, Pseudomonas aeruginosa PA01
ccgcuucccguggccaggagug

SEQ ID NO: 33609 - RNA, 22 nt, Pseudomonas aeruginosa PA01
ccggacagcgaguggaggaugc

SEQ ID NO: 33610 - RNA, 22 nt, Pseudomonas aeruginosa PA01
ccggacgcagugauggucuucg

SEQ ID NO: 33611 - RNA, 22 nt, Pseudomonas aeruginosa PA01
ccggagauggaagcacagggcu

SEQ ID NO: 33612 - RNA, 22 nt, Pseudomonas aeruginosa PA01
ccggauccugccccggcguaga

SEQ ID NO: 33613 - RNA, 22 nt, Pseudomonas aeruginosa PA01
ccggauuuugagucagacuggu

SEQ ID NO: 33614 - RNA, 22 nt, Pseudomonas aeruginosa PA01
ccggcagaagacaggccgguuc

SEQ ID NO: 33615 - RNA, 22 nt, Pseudomonas aeruginosa PA01
ccggcagccacugcgccugcug

SEQ ID NO: 33616 - RNA, 22 nt, Pseudomonas aeruginosa PA01
ccggccagcaccugcgggucgu

SEQ ID NO: 33617 - RNA, 21 nt, Pseudomonas aeruginosa PA01
ccggccaguccuucaggcugg

SEQ ID NO: 33618 - RNA, 22 nt, Pseudomonas aeruginosa PA01
ccggccaguucgcgggcgacgc

SEQ ID NO: 33619 - RNA, 22 nt, Pseudomonas aeruginosa PA01
ccggccaugucccuggguagcg

SEQ ID NO: 33620 - RNA, 22 nt, Pseudomonas aeruginosa PA01
ccggccgaggcgccggaccagg

SEQ ID NO: 33621 - RNA, 22 nt, Pseudomonas aeruginosa PA01
ccggcgacgugcugcgccuucu

SEQ ID NO: 33622 - RNA, 22 nt, Pseudomonas aeruginosa PA01
ccggcgauuuccucgccggcgu

SEQ ID NO: 33623 - RNA, 22 nt, Pseudomonas aeruginosa PA01
ccggcgcgccagaacucgaccg

SEQ ID NO: 33624 - RNA, 20 nt, Pseudomonas aeruginosa PA01
ccggcgcggccuuucgucgu

SEQ ID NO: 33625 - RNA, 22 nt, Pseudomonas aeruginosa PA01
ccggcgcugcugaucgcuucgu

SEQ ID NO: 33626 - RNA, 22 nt, Pseudomonas aeruginosa PA01
ccggcgcuucgccggccugugc

SEQ ID NO: 33627 - RNA, 20 nt, Pseudomonas aeruginosa PA01
ccggcgucgaaguucggcag

SEQ ID NO: 33628 - RNA, 22 nt, Pseudomonas aeruginosa PA01
ccggcuuccucgaacugcucgg

SEQ ID NO: 33629 - RNA, 22 nt, Pseudomonas aeruginosa PA01
ccgggcgcuggucugcgcggug

SEQ ID NO: 33630 - RNA, 22 nt, Pseudomonas aeruginosa PA01
ccgggcuuuuucaugucucgga

SEQ ID NO: 33631 - RNA, 22 nt, Pseudomonas aeruginosa PA01
ccggggcgcccuggcggucagg

SEQ ID NO: 33632 - RNA, 22 nt, Pseudomonas aeruginosa PA01
ccgggucgaucugcacgucgua

SEQ ID NO: 33633 - RNA, 22 nt, Pseudomonas aeruginosa PA01
ccgguccagaacgccgaacugg

SEQ ID NO: 33634 - RNA, 22 nt, Pseudomonas aeruginosa PA01
ccggugaccgccugcggauagg

SEQ ID NO: 33635 - RNA, 22 nt, Pseudomonas aeruginosa PA01
ccggugcuguucgccggcggcg

SEQ ID NO: 33636 - RNA, 22 nt, Pseudomonas aeruginosa PA01
ccggugucuucccaggucuucu

SEQ ID NO: 33637 - RNA, 22 nt, Pseudomonas aeruginosa PA01
ccgguugccgcgagccgagcau

SEQ ID NO: 33638 - RNA, 19 nt, Pseudomonas aeruginosa PA01
ccgguuuuccuucuggcau

SEQ ID NO: 33639 - RNA, 22 nt, Pseudomonas aeruginosa PA01
ccgucagcggccgaaaaacagc

SEQ ID NO: 33640 - RNA, 22 nt, Pseudomonas aeruginosa PA01
ccgucagcgguucauuccauuu

SEQ ID NO: 33641 - RNA, 19 nt, Pseudomonas aeruginosa PA01
ccgucgccggcguuggucg

SEQ ID NO: 33642 - RNA, 20 nt, Pseudomonas aeruginosa PA01
ccgucgguacuggaacuggg

SEQ ID NO: 33643 - RNA, 22 nt, Pseudomonas aeruginosa PA01
ccgugcccgcuucagcgugcug

SEQ ID NO: 33644 - RNA, 22 nt, Pseudomonas aeruginosa PA01
ccguuaucgguuuuuggcggug

SEQ ID NO: 33645 - RNA, 22 nt, Pseudomonas aeruginosa PA01
ccuagccgaaacagugcucuac

SEQ ID NO: 33646 - RNA, 22 nt, Pseudomonas aeruginosa PA01
ccuccuggacaucgacaucgcu

SEQ ID NO: 33647 - RNA, 22 nt, Pseudomonas aeruginosa PA01
ccucgacggacggucauuuucg

SEQ ID NO: 33648 - RNA, 22 nt, Pseudomonas aeruginosa PA01
ccucgaucacgcuggauuggcu

SEQ ID NO: 33649 - RNA, 22 nt, Pseudomonas aeruginosa PA01
ccucgcgggcuucgagcaacgg

SEQ ID NO: 33650 - RNA, 19 nt, Pseudomonas aeruginosa PA01
ccucgcugccguucgagca

SEQ ID NO: 33651 - RNA, 22 nt, Pseudomonas aeruginosa PA01
ccucggcagucgcgauuucggc

SEQ ID NO: 33652 - RNA, 22 nt, Pseudomonas aeruginosa PA01
cgccccacuggcgccgcucgaa

SEQ ID NO: 33653 - RNA, 22 nt, Pseudomonas aeruginosa PA01
cgcccggcuccugcgcuugacc

SEQ ID NO: 33654 - RNA, 22 nt, Pseudomonas aeruginosa PA01
cgccgacugcgcgugcgaaacc

SEQ ID NO: 33655 - RNA, 22 nt, Pseudomonas aeruginosa PA01
cgccgacuucgaggccuacugg

SEQ ID NO: 33656 - RNA, 22 nt, Pseudomonas aeruginosa PA01
cgccgagcauggcuacgaggag

SEQ ID NO: 33657 - RNA, 22 nt, Pseudomonas aeruginosa PA01
cgccgaggaagaaacaccgauu

SEQ ID NO: 33658 - RNA, 22 nt, Pseudomonas aeruginosa PA01
cgccgcaggcuuggccgccggu

SEQ ID NO: 33659 - RNA, 22 nt, Pseudomonas aeruginosa PA01
cgccgccgauacgcagccgguu

SEQ ID NO: 33660 - RNA, 22 nt, Pseudomonas aeruginosa PA01
cgccgcugaauaccaccgggcc

SEQ ID NO: 33661 - RNA, 22 nt, Pseudomonas aeruginosa PA01
cgccgcuggcgcuguucgcccu

SEQ ID NO: 33662 - RNA, 22 nt, Pseudomonas aeruginosa PA01
cgccgcuggucgaggccguacu

SEQ ID NO: 33663 - RNA, 22 nt, Pseudomonas aeruginosa PA01
cgccggacagccgcgaugcacu

SEQ ID NO: 33664 - RNA, 23 nt, Pseudomonas aeruginosa PA01
cgccggaggaucgcuuugccgcg

SEQ ID NO: 33665 - RNA, 19 nt, Pseudomonas aeruginosa PA01
cgccggcgccgggcugauc

SEQ ID NO: 33666 - RNA, 23 nt, Pseudomonas aeruginosa PA01
cgccggugcugccgggcaggacc

SEQ ID NO: 33667 - RNA, 22 nt, Pseudomonas aeruginosa PA01
cgccguucaagccggaggcgcc

SEQ ID NO: 33668 - RNA, 22 nt, Pseudomonas aeruginosa PA01
cgccuaaugucuucacucucaa

SEQ ID NO: 33669 - RNA, 22 nt, Pseudomonas aeruginosa PA01
cgccucggcgauguuggccagu

SEQ ID NO: 33670 - RNA, 22 nt, Pseudomonas aeruginosa PA01
cgccugccacagaucggccgcc

SEQ ID NO: 33671 - RNA, 22 nt, Pseudomonas aeruginosa PA01
cgccugcucgaucagguugagc

SEQ ID NO: 33672 - RNA, 22 nt, Pseudomonas aeruginosa PA01
cgccuggcccugcaacggcuug

SEQ ID NO: 33673 - RNA, 22 nt, Pseudomonas aeruginosa PA01
cgccuuccuuccacuuggccgg

SEQ ID NO: 33674 - RNA, 22 nt, Pseudomonas aeruginosa PA01
cgccuucgaaggccuggccgau

SEQ ID NO: 33675 - RNA, 22 nt, Pseudomonas aeruginosa PA01
cgcgaccugccgcugaucgcca

SEQ ID NO: 33676 - RNA, 22 nt, Pseudomonas aeruginosa PA01
cgcgacggucaaucgggaagcg

SEQ ID NO: 33677 - RNA, 22 nt, Pseudomonas aeruginosa PA01
cgcgagcgcggcugcuccaucc

SEQ ID NO: 33678 - RNA, 22 nt, Pseudomonas aeruginosa PA01
cgcgaggaaaccucgcuggccg

SEQ ID NO: 33679 - RNA, 22 nt, Pseudomonas aeruginosa PA01
cgcgcaggcgguacaggcggcu

SEQ ID NO: 33680 - RNA, 22 nt, Pseudomonas aeruginosa PA01
cgcgcaguuuacccggagaacc

SEQ ID NO: 33681 - RNA, 22 nt, Pseudomonas aeruginosa PA01
cgcgccagcagguggcggaugg

SEQ ID NO: 33682 - RNA, 22 nt, Pseudomonas aeruginosa PA01
cgcgccagguacuugcgcagcc

SEQ ID NO: 33683 - RNA, 22 nt, Pseudomonas aeruginosa PA01
cgcgcugauccugcucgccgcc

SEQ ID NO: 33684 - RNA, 22 nt, Pseudomonas aeruginosa PA01
cgcgcuggaacgacgucuaccu

SEQ ID NO: 33685 - RNA, 22 nt, Pseudomonas aeruginosa PA01
cgcggacgacgaggaagaccac

SEQ ID NO: 33686 - RNA, 22 nt, Pseudomonas aeruginosa PA01
cgcggcaccagccagguggcgg

SEQ ID NO: 33687 - RNA, 20 nt, Pseudomonas aeruginosa PA01
cgcggcacgccguuggcguc

SEQ ID NO: 33688 - RNA, 22 nt, Pseudomonas aeruginosa PA01
cgcggcgaggaacugcugagcg

SEQ ID NO: 33689 - RNA, 22 nt, Pseudomonas aeruginosa PA01
cgcggcgggguauugcccaggg

SEQ ID NO: 33690 - RNA, 22 nt, Pseudomonas aeruginosa PA01
cgcggcuguggcaggacaggca

SEQ ID NO: 33691 - RNA, 22 nt, Pseudomonas aeruginosa PA01
cgcggcuucgccgugguggccg

SEQ ID NO: 33692 - RNA, 22 nt, Pseudomonas aeruginosa PA01
cgcggcuucgcggugguugccg

SEQ ID NO: 33693 - RNA, 22 nt, Pseudomonas aeruginosa PA01
cgcgggaaguucuucaacgcga

SEQ ID NO: 33694 - RNA, 22 nt, Pseudomonas aeruginosa PA01
cgcgggccugcucgcuguuggu

SEQ ID NO: 33695 - RNA, 22 nt, Pseudomonas aeruginosa PA01
cgcggugcagcugcucgguggc

SEQ ID NO: 33696 - RNA, 22 nt, Pseudomonas aeruginosa PA01
cgcgguuaccguugaaguucug

SEQ ID NO: 33697 - RNA, 22 nt, Pseudomonas aeruginosa PA01
cgcguacaucggugucggcgcg

SEQ ID NO: 33698 - RNA, 22 nt, Pseudomonas aeruginosa PA01
cgcgugcgaugaccggagggau

SEQ ID NO: 33699 - RNA, 22 nt, Pseudomonas aeruginosa PA01
cgcuaccugggggcugcgguag

SEQ ID NO: 33700 - RNA, 22 nt, Pseudomonas aeruginosa PA01
cgcuacggccaggucaaucucg

SEQ ID NO: 33701 - RNA, 22 nt, Pseudomonas aeruginosa PA01
cgcugauacccgccagguggcg

SEQ ID NO: 33702 - RNA, 22 nt, Pseudomonas aeruginosa PA01
cgcugauccucaaguugcgcga

SEQ ID NO: 33703 - RNA, 22 nt, Pseudomonas aeruginosa PA01
cgcugccaucgauggcgacgaa

SEQ ID NO: 33704 - RNA, 22 nt, Pseudomonas aeruginosa PA01
cgcugcugagcaaccgcuggcc

SEQ ID NO: 33705 - RNA, 22 nt, Pseudomonas aeruginosa PA01
cgcugcugaucggcuucgccgg

SEQ ID NO: 33706 - RNA, 22 nt, Pseudomonas aeruginosa PA01
cgcuggugcgccaggcgcugug

SEQ ID NO: 33707 - RNA, 22 nt, Pseudomonas aeruginosa PA01
cgcuucccgcggcugguccacu

SEQ ID NO: 33708 - RNA, 22 nt, Pseudomonas aeruginosa PA01
cgcuucgaggaaggugccgugg

SEQ ID NO: 33709 - RNA, 22 nt, Pseudomonas aeruginosa PA01
cggacgauggcguagguggcug

SEQ ID NO: 33710 - RNA, 22 nt, Pseudomonas aeruginosa PA01
cggacugguugagggaauugag

SEQ ID NO: 33711 - RNA, 21 nt, Pseudomonas aeruginosa PA01
cggauaggcauugaucggguu

SEQ ID NO: 33712 - RNA, 22 nt, Pseudomonas aeruginosa PA01
cggaucgcggcgaaguccuccc

SEQ ID NO: 33713 - RNA, 22 nt, Pseudomonas aeruginosa PA01
cggaucuucuccaucgccgcuu

SEQ ID NO: 33714 - RNA, 22 nt, Pseudomonas aeruginosa PA01
cggcacccuggcgcgcagcagc

SEQ ID NO: 33715 - RNA, 22 nt, Pseudomonas aeruginosa PA01
cggcagcgccucgccacgcucc

SEQ ID NO: 33716 - RNA, 22 nt, Pseudomonas aeruginosa PA01
cggcaggcgcaugaaggucggg

SEQ ID NO: 33717 - RNA, 22 nt, Pseudomonas aeruginosa PA01
cggcauggacuccgcgcgcgag

SEQ ID NO: 33718 - RNA, 22 nt, Pseudomonas aeruginosa PA01
cggccagggcaaugucgaagcc

SEQ ID NO: 33719 - RNA, 21 nt, Pseudomonas aeruginosa PA01
cggccgagcgcugguaccgcg

SEQ ID NO: 33720 - RNA, 21 nt, Pseudomonas aeruginosa PA01
cggccgccacaacgcccucga

SEQ ID NO: 33721 - RNA, 22 nt, Pseudomonas aeruginosa PA01
cggccgccaguuggcuuguggg

SEQ ID NO: 33722 - RNA, 22 nt, Pseudomonas aeruginosa PA01
cggccggcgacagcggcuggca

SEQ ID NO: 33723 - RNA, 20 nt, Pseudomonas aeruginosa PA01
cggccucccgugcuugcggc

SEQ ID NO: 33724 - RNA, 22 nt, Pseudomonas aeruginosa PA01
cggccugcuggcuaucggucaa

SEQ ID NO: 33725 - RNA, 22 nt, Pseudomonas aeruginosa PA01
cggcgcaggguauggcgguuca

SEQ ID NO: 33726 - RNA, 22 nt, Pseudomonas aeruginosa PA01
cggcgcgacugucggucuggaa

SEQ ID NO: 33727 - RNA, 22 nt, Pseudomonas aeruginosa PA01
cggcgcgccgaaggcgauaugg

SEQ ID NO: 33728 - RNA, 22 nt, Pseudomonas aeruginosa PA01
cggcgcuggaucggcccccucu

SEQ ID NO: 33729 - RNA, 22 nt, Pseudomonas aeruginosa PA01
cggcggcagguuuucucgacgc

SEQ ID NO: 33730 - RNA, 20 nt, Pseudomonas aeruginosa PA01
cggcggcgaccucagccuca

SEQ ID NO: 33731 - RNA, 22 nt, Pseudomonas aeruginosa PA01
cggcggcuggcugaugggcaac

SEQ ID NO: 33732 - RNA, 22 nt, Pseudomonas aeruginosa PA01
cggcgggcauagccgagcagcg

SEQ ID NO: 33733 - RNA, 19 nt, Pseudomonas aeruginosa PA01
cggcguagcgaucgucgag

SEQ ID NO: 33734 - RNA, 22 nt, Pseudomonas aeruginosa PA01
cggcguaggugacgucguccug

SEQ ID NO: 33735 - RNA, 20 nt, Pseudomonas aeruginosa PA01
cugcauggcgcggccgacga

SEQ ID NO: 33736 - RNA, 22 nt, Pseudomonas aeruginosa PA01
cugccggccaggcggguguuca

SEQ ID NO: 33737 - RNA, 22 nt, Pseudomonas aeruginosa PA01
cugccguuggccagcaccgccg

SEQ ID NO: 33738 - RNA, 22 nt, Pseudomonas aeruginosa PA01
cugccguuugcguaaggccugc

SEQ ID NO: 33739 - RNA, 22 nt, Pseudomonas aeruginosa PA01
cugccuggagggcagcgugcgg

SEQ ID NO: 33740 - RNA, 22 nt, Pseudomonas aeruginosa PA01
cugcgcucguauucacccaugg

SEQ ID NO: 33741 - RNA, 22 nt, Pseudomonas aeruginosa PA01
cugcgggucagcaccgccggcu

SEQ ID NO: 33742 - RNA, 22 nt, Pseudomonas aeruginosa PA01
cugcggguggaagugaucgaca

SEQ ID NO: 33743 - RNA, 22 nt, Pseudomonas aeruginosa PA01
cugcggguuguccgcggcgagc

SEQ ID NO: 33744 - RNA, 22 nt, Pseudomonas aeruginosa PA01
cugcgguacgcuuuccgcuucg

SEQ ID NO: 33745 - RNA, 22 nt, Pseudomonas aeruginosa PA01
cugcuagucgcgggauccgcgc

SEQ ID NO: 33746 - RNA, 22 nt, Pseudomonas aeruginosa PA01
cugcugaucuggaucggagugg

SEQ ID NO: 33747 - RNA, 22 nt, Pseudomonas aeruginosa PA01
cugcugcaggucgacggcgccu

SEQ ID NO: 33748 - RNA, 22 nt, Pseudomonas aeruginosa PA01
cugcuucaaggagcacuagacu

SEQ ID NO: 33749 - RNA, 22 nt, Pseudomonas aeruginosa PA01
cuggaggagguaaggguaacga

SEQ ID NO: 33750 - RNA, 22 nt, Pseudomonas aeruginosa PA01
cuggaucgcagcccgguucgcu

SEQ ID NO: 33751 - RNA, 22 nt, Pseudomonas aeruginosa PA01
cuggaucgccuugcgcauggug

SEQ ID NO: 33752 - RNA, 22 nt, Pseudomonas aeruginosa PA01
cuggcccaggacuaugccgcgc

SEQ ID NO: 33753 - RNA, 22 nt, Pseudomonas aeruginosa PA01
cuggcccaggugauggccguca

SEQ ID NO: 33754 - RNA, 22 nt, Pseudomonas aeruginosa PA01
cuggcccugguggcggcgcccc

SEQ ID NO: 33755 - RNA, 22 nt, Pseudomonas aeruginosa PA01
cuggccgaaaagggccucgacu

SEQ ID NO: 33756 - RNA, 22 nt, Pseudomonas aeruginosa PA01
cuggccgauaccgucagucagu

SEQ ID NO: 33757 - RNA, 22 nt, Pseudomonas aeruginosa PA01
cuggccgccagggcgccuccag

SEQ ID NO: 33758 - RNA, 22 nt, Pseudomonas aeruginosa PA01
cuggcgcagcaguuccucgccg

SEQ ID NO: 33759 - RNA, 22 nt, Pseudomonas aeruginosa PA01
cuggcgccguugcccaguacca

SEQ ID NO: 33760 - RNA, 22 nt, Pseudomonas aeruginosa PA01
cuggcgccugagacggaaagcc

SEQ ID NO: 33761 - RNA, 22 nt, Pseudomonas aeruginosa PA01
cuggcgcuggcuccgucgguga

SEQ ID NO: 33762 - RNA, 22 nt, Pseudomonas aeruginosa PA01
cuggcgguggcuuucgguccau

SEQ ID NO: 33763 - RNA, 22 nt, Pseudomonas aeruginosa PA01
cugggagaacucguagacgcug

SEQ ID NO: 33764 - RNA, 22 nt, Pseudomonas aeruginosa PA01
cugggagggcucgagccuggag

SEQ ID NO: 33765 - RNA, 22 nt, Pseudomonas aeruginosa PA01
cugggcaucgagcacgucgagg

SEQ ID NO: 33766 - RNA, 22 nt, Pseudomonas aeruginosa PA01
cugggccaggccgguuuccugc

SEQ ID NO: 33767 - RNA, 22 nt, Pseudomonas aeruginosa PA01
cugggcgucguacagcuugccg

SEQ ID NO: 33768 - RNA, 22 nt, Pseudomonas aeruginosa PA01
cuggggaucuuccugaucgucg

SEQ ID NO: 33769 - RNA, 22 nt, Pseudomonas aeruginosa PA01
cuggggcgggcuguccgccgga

SEQ ID NO: 33770 - RNA, 21 nt, Pseudomonas aeruginosa PA01
cuggucgcacuuccucccccg

SEQ ID NO: 33771 - RNA, 22 nt, Pseudomonas aeruginosa PA01
cuggugcaaggcccacugcucg

SEQ ID NO: 33772 - RNA, 22 nt, Pseudomonas aeruginosa PA01
cuggugcagcacggugacaugg

SEQ ID NO: 33773 - RNA, 22 nt, Pseudomonas aeruginosa PA01
cugguggucggcgccgguucgu

SEQ ID NO: 33774 - RNA, 22 nt, Pseudomonas aeruginosa PA01
cuggugguggacccgaugagcu

SEQ ID NO: 33775 - RNA, 22 nt, Pseudomonas aeruginosa PA01
cugguguccugggucggcggcu

SEQ ID NO: 33776 - RNA, 22 nt, Pseudomonas aeruginosa PA01
cugguucagccugaugcgccug

SEQ ID NO: 33777 - RNA, 22 nt, Pseudomonas aeruginosa PA01
cugucgcggcuacuggccgaca

SEQ ID NO: 33778 - RNA, 22 nt, Pseudomonas aeruginosa PA01
cuguggauaacucugugagcaa

SEQ ID NO: 33779 - RNA, 22 nt, Pseudomonas aeruginosa PA01
cuucagucgccuguucggcggc

SEQ ID NO: 33780 - RNA, 22 nt, Pseudomonas aeruginosa PA01
cuuccucgguaucggcaucgug

SEQ ID NO: 33781 - RNA, 21 nt, Pseudomonas aeruginosa PA01
cuucgcgacggauggcgcagc

SEQ ID NO: 33782 - RNA, 22 nt, Pseudomonas aeruginosa PA01
cuucggccaccgacagccucag

SEQ ID NO: 33783 - RNA, 22 nt, Pseudomonas aeruginosa PA01
cuucggccuuggcguccuguag

SEQ ID NO: 33784 - RNA, 22 nt, Pseudomonas aeruginosa PA01
cuucggcggccgggugcucggc

SEQ ID NO: 33785 - RNA, 22 nt, Pseudomonas aeruginosa PA01
cuucgugguggucaccgcgcuu

SEQ ID NO: 33786 - RNA, 22 nt, Pseudomonas aeruginosa PA01
cuucucgagcaucugcagaucg

SEQ ID NO: 33787 - RNA, 22 nt, Pseudomonas aeruginosa PA01
cuugaucagcgccgaguggucc

SEQ ID NO: 33788 - RNA, 22 nt, Pseudomonas aeruginosa PA01
cuugaucgguuguacgccggag

SEQ ID NO: 33789 - RNA, 22 nt, Pseudomonas aeruginosa PA01
cuugccgccgacaucgcugaug

SEQ ID NO: 33790 - RNA, 22 nt, Pseudomonas aeruginosa PA01
cuugcuggacuacgccgggccu

SEQ ID NO: 33791 - RNA, 22 nt, Pseudomonas aeruginosa PA01
cuugggcugagccucaggccag

SEQ ID NO: 33792 - RNA, 22 nt, Pseudomonas aeruginosa PA01
gaaaccgccgccgagcaggguc

SEQ ID NO: 33793 - RNA, 22 nt, Pseudomonas aeruginosa PA01
gaacagcucgucgcggaagguc

SEQ ID NO: 33794 - RNA, 22 nt, Pseudomonas aeruginosa PA01
gaaccgcuuccgccggguggcc

SEQ ID NO: 33795 - RNA, 22 nt, Pseudomonas aeruginosa PA01
gaacuguucgucacggacauag

SEQ ID NO: 33796 - RNA, 22 nt, Pseudomonas aeruginosa PA01
gaagaccagccgaucuucgagc

SEQ ID NO: 33797 - RNA, 22 nt, Pseudomonas aeruginosa PA01
gaagagcgccaacgucgagggc

SEQ ID NO: 33798 - RNA, 22 nt, Pseudomonas aeruginosa PA01
gaagggcaagguggccaagcug

SEQ ID NO: 33799 - RNA, 22 nt, Pseudomonas aeruginosa PA01
gaaggucgccugcuggucagcg

SEQ ID NO: 33800 - RNA, 22 nt, Pseudomonas aeruginosa PA01
gacaaguaucugguuggcgguc

SEQ ID NO: 33801 - RNA, 22 nt, Pseudomonas aeruginosa PA01
gacauguaaugaagccucggua

SEQ ID NO: 33802 - RNA, 23 nt, Pseudomonas aeruginosa PA01
gaccacaccgacuucaugcuggu

SEQ ID NO: 33803 - RNA, 22 nt, Pseudomonas aeruginosa PA01
gaccaccgcgaacgggcugucc

SEQ ID NO: 33804 - RNA, 22 nt, Pseudomonas aeruginosa PA01
gaccaggcguacguauagcagg

SEQ ID NO: 33805 - RNA, 22 nt, Pseudomonas aeruginosa PA01
gacccgcuugagccauucggcu

SEQ ID NO: 33806 - RNA, 22 nt, Pseudomonas aeruginosa PA01
gaccgccagcagcucgucgcga

SEQ ID NO: 33807 - RNA, 23 nt, Pseudomonas aeruginosa PA01
gaccgccuggagcggaucagccu

SEQ ID NO: 33808 - RNA, 22 nt, Pseudomonas aeruginosa PA01
gaccggcagaucgaggaggggc

SEQ ID NO: 33809 - RNA, 22 nt, Pseudomonas aeruginosa PA01
gaccgucggcgucgaccagggu

SEQ ID NO: 33810 - RNA, 22 nt, Pseudomonas aeruginosa PA01
gaccgucucguugcggucgacc

SEQ ID NO: 33811 - RNA, 22 nt, Pseudomonas aeruginosa PA01
gaccgugcccagcgaggaggcg

SEQ ID NO: 33812 - RNA, 22 nt, Pseudomonas aeruginosa PA01
gacgacaaccaacuggugaccu

SEQ ID NO: 33813 - RNA, 22 nt, Pseudomonas aeruginosa PA01
gacgccaucaaccuguuccgcu

SEQ ID NO: 33814 - RNA, 22 nt, Pseudomonas aeruginosa PA01
gacgcccagcggccucagguag

SEQ ID NO: 33815 - RNA, 22 nt, Pseudomonas aeruginosa PA01
gacgccuccuucacguugcgcg

SEQ ID NO: 33816 - RNA, 22 nt, Pseudomonas aeruginosa PA01
gacgccugcgugcgcuuccuca

SEQ ID NO: 33817 - RNA, 22 nt, Pseudomonas aeruginosa PA01
gacgcgguggucuacgucaccg

SEQ ID NO: 33818 - RNA, 22 nt, Pseudomonas aeruginosa PA01
gccagcgaccgcaacuucaucg

SEQ ID NO: 33819 - RNA, 22 nt, Pseudomonas aeruginosa PA01
gccagguguccagguccugcca

SEQ ID NO: 33820 - RNA, 22 nt, Pseudomonas aeruginosa PA01
gccaucgccgcgaucuggcugu

SEQ ID NO: 33821 - RNA, 22 nt, Pseudomonas aeruginosa PA01
gccaucgggauuuccucaucag

SEQ ID NO: 33822 - RNA, 22 nt, Pseudomonas aeruginosa PA01
gccaugggugaauacgagcgca

SEQ ID NO: 33823 - RNA, 22 nt, Pseudomonas aeruginosa PA01
gcccaggcccuggcgcgggcuc

SEQ ID NO: 33824 - RNA, 22 nt, Pseudomonas aeruginosa PA01
gcccagggaguacggcggcaug

SEQ ID NO: 33825 - RNA, 22 nt, Pseudomonas aeruginosa PA01
gccccgccgaacauccaggcca

SEQ ID NO: 33826 - RNA, 22 nt, Pseudomonas aeruginosa PA01
gccccgcgggaggacggcugcu

SEQ ID NO: 33827 - RNA, 22 nt, Pseudomonas aeruginosa PA01
gccccggcugagcugcggcagg

SEQ ID NO: 33828 - RNA, 22 nt, Pseudomonas aeruginosa PA01
gcccgcccucggcgacguagcu

SEQ ID NO: 33829 - RNA, 22 nt, Pseudomonas aeruginosa PA01
gcccggaauaaaugcaccggac

SEQ ID NO: 33830 - RNA, 22 nt, Pseudomonas aeruginosa PA01
gcccggauaguucugcgcgagg

SEQ ID NO: 33831 - RNA, 18 nt, Pseudomonas aeruginosa PA01
gcccggcguaguccagca

SEQ ID NO: 33832 - RNA, 22 nt, Pseudomonas aeruginosa PA01
gcccggcucgaagagcgugcgc

SEQ ID NO: 33833 - RNA, 22 nt, Pseudomonas aeruginosa PA01
gcccggcuucccggcggaaagu

SEQ ID NO: 33834 - RNA, 22 nt, Pseudomonas aeruginosa PA01
gcccuucguacccgcgguggcc

SEQ ID NO: 33835 - RNA, 22 nt, Pseudomonas aeruginosa PA01
gccgaacugaugggcgacgaga

SEQ ID NO: 33836 - RNA, 23 nt, Pseudomonas aeruginosa PA01
gccgaccucggagacgccgaugc

SEQ ID NO: 33837 - RNA, 22 nt, Pseudomonas aeruginosa PA01
gccgacuucgccgcugagcugc

SEQ ID NO: 33838 - RNA, 22 nt, Pseudomonas aeruginosa PA01
gccgaggagaccuggcggguac

SEQ ID NO: 33839 - RNA, 22 nt, Pseudomonas aeruginosa PA01
gccgaucuucagcaggcugucc

SEQ ID NO: 33840 - RNA, 22 nt, Pseudomonas aeruginosa PA01
gccgaugugcggguucagugcg

SEQ ID NO: 33841 - RNA, 22 nt, Pseudomonas aeruginosa PA01
gccgccagccgaucguuggauu

SEQ ID NO: 33842 - RNA, 17 nt, Pseudomonas aeruginosa PA01
gccgccgaggucggcga

SEQ ID NO: 33843 - RNA, 22 nt, Pseudomonas aeruginosa PA01
gccgccgauggucugccggucg

SEQ ID NO: 33844 - RNA, 22 nt, Pseudomonas aeruginosa PA01
gccgccgggccgccgcugacuu

SEQ ID NO: 33845 - RNA, 22 nt, Pseudomonas aeruginosa PA01
gccgccgucguggaugcgcugg

SEQ ID NO: 33846 - RNA, 22 nt, Pseudomonas aeruginosa PA01
gccgccgugcugggcggcgaug

SEQ ID NO: 33847 - RNA, 22 nt, Pseudomonas aeruginosa PA01
gccgcgaguaccucgaacagau

SEQ ID NO: 33848 - RNA, 22 nt, Pseudomonas aeruginosa PA01
gccgcgcaacugcugcugcaac

SEQ ID NO: 33849 - RNA, 20 nt, Pseudomonas aeruginosa PA01
gccgcgccugcucggcacug

SEQ ID NO: 33850 - RNA, 22 nt, Pseudomonas aeruginosa PA01
gccgcgccuguacgauuaccuc

SEQ ID NO: 33851 - RNA, 22 nt, Pseudomonas aeruginosa PA01
gccgcugcgaugggcgucgagc

SEQ ID NO: 33852 - RNA, 22 nt, Pseudomonas aeruginosa PA01
gccgcuguuuucggcgugcgcc

SEQ ID NO: 33853 - RNA, 22 nt, Pseudomonas aeruginosa PA01
gccggagagauccgcaaccugc

SEQ ID NO: 33854 - RNA, 22 nt, Pseudomonas aeruginosa PA01
gccggcaugcugaagcgggccg

SEQ ID NO: 33855 - RNA, 22 nt, Pseudomonas aeruginosa PA01
gccggccaggccggcgccgagg

SEQ ID NO: 33856 - RNA, 22 nt, Pseudomonas aeruginosa PA01
gccggccuccgccuggcugugc

SEQ ID NO: 33857 - RNA, 22 nt, Pseudomonas aeruginosa PA01
gccggcgugcucgaagcguucg

SEQ ID NO: 33858 - RNA, 22 nt, Pseudomonas aeruginosa PA01
gccggcucaucagcacccgcug

SEQ ID NO: 33859 - RNA, 20 nt, Pseudomonas aeruginosa PA01
gccggcuggcccgagcgggc

SEQ ID NO: 33860 - RNA, 22 nt, Pseudomonas aeruginosa PA01
gccggcugggucaguugcaggc

SEQ ID NO: 33861 - RNA, 22 nt, Pseudomonas aeruginosa PA01
gccggcuucggugcaguguucc

SEQ ID NO: 33862 - RNA, 22 nt, Pseudomonas aeruginosa PA01
gccgggauggaggagcaucucg

SEQ ID NO: 33863 - RNA, 22 nt, Pseudomonas aeruginosa PA01
gccggucucgcggcggucgaag

SEQ ID NO: 33864 - RNA, 22 nt, Pseudomonas aeruginosa PA01
gccggugcagagcuucgugacc

SEQ ID NO: 33865 - RNA, 22 nt, Pseudomonas aeruginosa PA01
gccgugcgaggaacucaaggcg

SEQ ID NO: 33866 - RNA, 22 nt, Pseudomonas aeruginosa PA01
gccgugcggggucauggccagg

SEQ ID NO: 33867 - RNA, 22 nt, Pseudomonas aeruginosa PA01
gccuauccgacccgucccgaac

SEQ ID NO: 33868 - RNA, 22 nt, Pseudomonas aeruginosa PA01
gccucgaaggccugcaggucgg

SEQ ID NO: 33869 - RNA, 22 nt, Pseudomonas aeruginosa PA01
gccucgaggaucaucauccccg

SEQ ID NO: 33870 - RNA, 22 nt, Pseudomonas aeruginosa PA01
gccucguccagggucuugcccu

SEQ ID NO: 33871 - RNA, 22 nt, Pseudomonas aeruginosa PA01
gccugcgccgcuaccaacaggc

SEQ ID NO: 33872 - RNA, 22 nt, Pseudomonas aeruginosa PA01
gccuggagguccaggcgcuggc

SEQ ID NO: 33873 - RNA, 22 nt, Pseudomonas aeruginosa PA01
gccuggcgggcgccgacgucuu

SEQ ID NO: 33874 - RNA, 22 nt, Pseudomonas aeruginosa PA01
gccugguugcuggcauaguuga

SEQ ID NO: 33875 - RNA, 22 nt, Pseudomonas aeruginosa PA01
gccuguuucaguugucaugccc

SEQ ID NO: 33876 - RNA, 22 nt, Pseudomonas aeruginosa PA01
gccuuccacgcauauccuucag

SEQ ID NO: 33877 - RNA, 22 nt, Pseudomonas aeruginosa PA01
gccuugaacuguuccucgagca

SEQ ID NO: 33878 - RNA, 22 nt, Pseudomonas aeruginosa PA01
gccuugccgaagcgaugggcca

SEQ ID NO: 33879 - RNA, 22 nt, Pseudomonas aeruginosa PA01
gccuuggugcacgaggcgcagg

SEQ ID NO: 33880 - RNA, 22 nt, Pseudomonas aeruginosa PA01
gccuuucgcaugcaugcgucgc

SEQ ID NO: 33881 - RNA, 22 nt, Pseudomonas aeruginosa PA01
gcgaaacugcugcugcaacugc

SEQ ID NO: 33882 - RNA, 22 nt, Pseudomonas aeruginosa PA01
gcgaacaagcugcgccagcaug

SEQ ID NO: 33883 - RNA, 22 nt, Pseudomonas aeruginosa PA01
gcgaacuccggguccauggcga

SEQ ID NO: 33884 - RNA, 22 nt, Pseudomonas aeruginosa PA01
gcgaagaacaauuugcgcgccg

SEQ ID NO: 33885 - RNA, 21 nt, Pseudomonas aeruginosa PA01
gcgaagucguggccggcguug

SEQ ID NO: 33886 - RNA, 22 nt, Pseudomonas aeruginosa PA01
gcgacaccuuuggauuuauuag

SEQ ID NO: 33887 - RNA, 22 nt, Pseudomonas aeruginosa PA01
gcgaccagccuucgcgcuugcc

SEQ ID NO: 33888 - RNA, 22 nt, Pseudomonas aeruginosa PA01
gcgaccagguccagaugcucgu

SEQ ID NO: 33889 - RNA, 22 nt, Pseudomonas aeruginosa PA01
gcgaccaucagcaguugcuuga

SEQ ID NO: 33890 - RNA, 22 nt, Pseudomonas aeruginosa PA01
gcgaccuguugcuccagaucgc

SEQ ID NO: 33891 - RNA, 22 nt, Pseudomonas aeruginosa PA01
gcgagaucguccugcguugugg

SEQ ID NO: 33892 - RNA, 22 nt, Pseudomonas aeruginosa PA01
gcgagccgaugcaacgggcgac

SEQ ID NO: 33893 - RNA, 22 nt, Pseudomonas aeruginosa PA01
gcgaggaauucgccuugcugcg

SEQ ID NO: 33894 - RNA, 22 nt, Pseudomonas aeruginosa PA01
gcgaggagccgcuggacugguc

SEQ ID NO: 33895 - RNA, 22 nt, Pseudomonas aeruginosa PA01
gcgaugcgccggaucggcugac

SEQ ID NO: 33896 - RNA, 22 nt, Pseudomonas aeruginosa PA01
gcgauucugcagcgccuuuucc

SEQ ID NO: 33897 - RNA, 22 nt, Pseudomonas aeruginosa PA01
gcgcaagcucgacgagaacggc

SEQ ID NO: 33898 - RNA, 22 nt, Pseudomonas aeruginosa PA01
gcgcagggucuugaacagcggu

SEQ ID NO: 33899 - RNA, 23 nt, Pseudomonas aeruginosa PA01
gcgcaucgccugcugcaggucga

SEQ ID NO: 33900 - RNA, 22 nt, Pseudomonas aeruginosa PA01
gcgccacggcauucugcgacug

SEQ ID NO: 33901 - RNA, 22 nt, Pseudomonas aeruginosa PA01
gcuggcugcaauaacccacugc

SEQ ID NO: 33902 - RNA, 21 nt, Pseudomonas aeruginosa PA01
gcugggaccccgagguggucg

SEQ ID NO: 33903 - RNA, 22 nt, Pseudomonas aeruginosa PA01
gcugggucgcuauuuucgcugg

SEQ ID NO: 33904 - RNA, 22 nt, Pseudomonas aeruginosa PA01
gcugguaguggucgagcaucau

SEQ ID NO: 33905 - RNA, 22 nt, Pseudomonas aeruginosa PA01
gcugguggaaaccguagccgcg

SEQ ID NO: 33906 - RNA, 22 nt, Pseudomonas aeruginosa PA01
gcugguugaugucgcggcggau

SEQ ID NO: 33907 - RNA, 22 nt, Pseudomonas aeruginosa PA01
gcugucgaucacguaacggaug

SEQ ID NO: 33908 - RNA, 22 nt, Pseudomonas aeruginosa PA01
gcuguucggggugaucuggcca

SEQ ID NO: 33909 - RNA, 19 nt, Pseudomonas aeruginosa PA01
gcuuccaguuggcggcuuc

SEQ ID NO: 33910 - RNA, 22 nt, Pseudomonas aeruginosa PA01
gcuucuaccggaaaagcggcgc

SEQ ID NO: 33911 - RNA, 22 nt, Pseudomonas aeruginosa PA01
gcuucuucgagcagggcaaggg

SEQ ID NO: 33912 - RNA, 22 nt, Pseudomonas aeruginosa PA01
gcuucuucgccacccuggugca

SEQ ID NO: 33913 - RNA, 22 nt, Pseudomonas aeruginosa PA01
gcuugaucaugucggggaacac

SEQ ID NO: 33914 - RNA, 22 nt, Pseudomonas aeruginosa PA01
gcuuuccacauguugcggggac

SEQ ID NO: 33915 - RNA, 22 nt, Pseudomonas aeruginosa PA01
gcuuuccaggcgcuccuccucg

SEQ ID NO: 33916 - RNA, 22 nt, Pseudomonas aeruginosa PA01
ggaaaacgcggaucgcccuugc

SEQ ID NO: 33917 - RNA, 22 nt, Pseudomonas aeruginosa PA01
ggaagcggaacagcgcgccaug

SEQ ID NO: 33918 - RNA, 22 nt, Pseudomonas aeruginosa PA01
ggacaguugccaaucccgcagc

SEQ ID NO: 33919 - RNA, 22 nt, Pseudomonas aeruginosa PA01
ggacaguugggaagacuggugg

SEQ ID NO: 33920 - RNA, 22 nt, Pseudomonas aeruginosa PA01
ggacaucgacgggcugcucagc

SEQ ID NO: 33921 - RNA, 22 nt, Pseudomonas aeruginosa PA01
ggacugcuccugccccuggccg

SEQ ID NO: 33922 - RNA, 22 nt, Pseudomonas aeruginosa PA01
ggagaagguucgcgcgcgucug

SEQ ID NO: 33923 - RNA, 22 nt, Pseudomonas aeruginosa PA01
ggagccguugcagugguagcac

SEQ ID NO: 33924 - RNA, 22 nt, Pseudomonas aeruginosa PA01
ggagcgcgugaccggcuacggu

SEQ ID NO: 33925 - RNA, 22 nt, Pseudomonas aeruginosa PA01
ggagggcgccagcgaggugccg

SEQ ID NO: 33926 - RNA, 20 nt, Pseudomonas aeruginosa PA01
ggaguggcuguugccguggc

SEQ ID NO: 33927 - RNA, 22 nt, Pseudomonas aeruginosa PA01
ggaguucgcccauggaggcucu

SEQ ID NO: 33928 - RNA, 22 nt, Pseudomonas aeruginosa PA01
ggauaaccgcgagcgguuauuc

SEQ ID NO: 33929 - RNA, 23 nt, Pseudomonas aeruginosa PA01
ggaucgccggacggccgccgagu

SEQ ID NO: 33930 - RNA, 22 nt, Pseudomonas aeruginosa PA01
ggaucgccucgcuggucggcgc

SEQ ID NO: 33931 - RNA, 22 nt, Pseudomonas aeruginosa PA01
ggaucguccgggguggucuugc

SEQ ID NO: 33932 - RNA, 22 nt, Pseudomonas aeruginosa PA01
ggaugccacccucguucaggca

SEQ ID NO: 33933 - RNA, 22 nt, Pseudomonas aeruginosa PA01
ggauuucggccuggcuccggua

SEQ ID NO: 33934 - RNA, 22 nt, Pseudomonas aeruginosa PA01
ggcaaguuccaggugcugcgcc

SEQ ID NO: 33935 - RNA, 22 nt, Pseudomonas aeruginosa PA01
ggcacgcucgccguuggcgacg

SEQ ID NO: 33936 - RNA, 22 nt, Pseudomonas aeruginosa PA01
ggcacggcgaucaggcgggccu

SEQ ID NO: 33937 - RNA, 22 nt, Pseudomonas aeruginosa PA01
ggcagcuucgaccgcccguucg

SEQ ID NO: 33938 - RNA, 18 nt, Pseudomonas aeruginosa PA01
ggcaggaugcacgucgcc

SEQ ID NO: 33939 - RNA, 21 nt, Pseudomonas aeruginosa PA01
ggccaacuggcguaucgacgg

SEQ ID NO: 33940 - RNA, 22 nt, Pseudomonas aeruginosa PA01
ggccaagggcgauggcggccug

SEQ ID NO: 33941 - RNA, 22 nt, Pseudomonas aeruginosa PA01
ggccaggcugagaaggacggcg

SEQ ID NO: 33942 - RNA, 22 nt, Pseudomonas aeruginosa PA01
ggccaggucggcuucaccucgg

SEQ ID NO: 33943 - RNA, 22 nt, Pseudomonas aeruginosa PA01
ggccauccaucucgacggacug

SEQ ID NO: 33944 - RNA, 22 nt, Pseudomonas aeruginosa PA01
ggccaucuguugggcugcgucg

SEQ ID NO: 33945 - RNA, 22 nt, Pseudomonas aeruginosa PA01
ggccaugaggcggcggcgcugu

SEQ ID NO: 33946 - RNA, 22 nt, Pseudomonas aeruginosa PA01
ggcccaacgccugcggcaaguc

SEQ ID NO: 33947 - RNA, 22 nt, Pseudomonas aeruginosa PA01
ggccccaugagguacagguaga

SEQ ID NO: 33948 - RNA, 22 nt, Pseudomonas aeruginosa PA01
ggcccgcuggggcuggaggaag

SEQ ID NO: 33949 - RNA, 17 nt, Pseudomonas aeruginosa PA01
ggccgacagcgggcgga

SEQ ID NO: 33950 - RNA, 22 nt, Pseudomonas aeruginosa PA01
ggccgaucaccaccagccgggu

SEQ ID NO: 33951 - RNA, 22 nt, Pseudomonas aeruginosa PA01
ggccgccaggcaagccuugccg

SEQ ID NO: 33952 - RNA, 22 nt, Pseudomonas aeruginosa PA01
ggccgcggauugacccagacca

SEQ ID NO: 33953 - RNA, 22 nt, Pseudomonas aeruginosa PA01
ggccggucuccagccaggccag

SEQ ID NO: 33954 - RNA, 22 nt, Pseudomonas aeruginosa PA01
ggccucgguguuggccucgucg

SEQ ID NO: 33955 - RNA, 22 nt, Pseudomonas aeruginosa PA01
ggccugggccuggaagacguag

SEQ ID NO: 33956 - RNA, 20 nt, Pseudomonas aeruginosa PA01
ggccuggggcgacgaugcgc

SEQ ID NO: 33957 - RNA, 19 nt, Pseudomonas aeruginosa PA01
ggccuguuccgccgcuucg

SEQ ID NO: 33958 - RNA, 22 nt, Pseudomonas aeruginosa PA01
ggccuugucgaugucgccgcgg

SEQ ID NO: 33959 - RNA, 22 nt, Pseudomonas aeruginosa PA01
ggcgaacugcuugaggccgguc

SEQ ID NO: 33960 - RNA, 22 nt, Pseudomonas aeruginosa PA01
ggcgaagcgaucgaaaggcgac

SEQ ID NO: 33961 - RNA, 22 nt, Pseudomonas aeruginosa PA01
ggcgacgaucugcucgaggauc

SEQ ID NO: 33962 - RNA, 22 nt, Pseudomonas aeruginosa PA01
ggcgagcagcggcaggcugucg

SEQ ID NO: 33963 - RNA, 22 nt, Pseudomonas aeruginosa PA01
ggcgagcuuggcggcgauggcg

SEQ ID NO: 33964 - RNA, 22 nt, Pseudomonas aeruginosa PA01
ggcgaguccgcgauccugcugu

SEQ ID NO: 33965 - RNA, 22 nt, Pseudomonas aeruginosa PA01
ggcgaguugcguaggucuagga

SEQ ID NO: 33966 - RNA, 22 nt, Pseudomonas aeruginosa PA01
ggcgaucaucacguuggccgag

SEQ ID NO: 33967 - RNA, 22 nt, Pseudomonas aeruginosa PA01
ggcgaugaagaucgucggcgua

SEQ ID NO: 33968 - RNA, 22 nt, Pseudomonas aeruginosa PA01
ggcgaugucgccgggauuggcg

SEQ ID NO: 33969 - RNA, 22 nt, Pseudomonas aeruginosa PA01
ggcgccaucgucucggugcugc

SEQ ID NO: 33970 - RNA, 22 nt, Pseudomonas aeruginosa PA01
ggcgcccagcgucgccaggcuc

SEQ ID NO: 33971 - RNA, 22 nt, Pseudomonas aeruginosa PA01
ggcgcccugcaucaggcgcgcc

SEQ ID NO: 33972 - RNA, 19 nt, Pseudomonas aeruginosa PA01
ggcgccgaugcugaucguc

SEQ ID NO: 33973 - RNA, 20 nt, Pseudomonas aeruginosa PA01
ggcgccggggcgguaguguc

SEQ ID NO: 33974 - RNA, 22 nt, Pseudomonas aeruginosa PA01
ggcgcgaguugcugcgcgucua

SEQ ID NO: 33975 - RNA, 22 nt, Pseudomonas aeruginosa PA01
ggcgcugauguugcugaucgcc

SEQ ID NO: 33976 - RNA, 22 nt, Pseudomonas aeruginosa PA01
ggcgcugggcgucggcguugac

SEQ ID NO: 33977 - RNA, 22 nt, Pseudomonas aeruginosa PA01
ggcgcugucggguccuggcguc

SEQ ID NO: 33978 - RNA, 22 nt, Pseudomonas aeruginosa PA01
ggcggauggcgcucauggucgc

SEQ ID NO: 33979 - RNA, 22 nt, Pseudomonas aeruginosa PA01
ggcggcaugcucgaucgccugc

SEQ ID NO: 33980 - RNA, 23 nt, Pseudomonas aeruginosa PA01
ggcggccgcccuccucaugugcc

SEQ ID NO: 33981 - RNA, 22 nt, Pseudomonas aeruginosa PA01
ggcggcgagcagccggugaucg

SEQ ID NO: 33982 - RNA, 22 nt, Pseudomonas aeruginosa PA01
ggcggcgcugcaggucggccug

SEQ ID NO: 33983 - RNA, 22 nt, Pseudomonas aeruginosa PA01
ggcggcuugcuggcgaucccgg

SEQ ID NO: 33984 - RNA, 22 nt, Pseudomonas aeruginosa PA01
gguuuccaugaccacgcccugc

SEQ ID NO: 33985 - RNA, 22 nt, Pseudomonas aeruginosa PA01
guacgcugcggcuuggcgccga

SEQ ID NO: 33986 - RNA, 22 nt, Pseudomonas aeruginosa PA01
guagcgcuugugggcgaacggc

SEQ ID NO: 33987 - RNA, 22 nt, Pseudomonas aeruginosa PA01
guagcugcggaucgccgccagc

SEQ ID NO: 33988 - RNA, 19 nt, Pseudomonas aeruginosa PA01
gucacgaaguugacgaugc

SEQ ID NO: 33989 - RNA, 19 nt, Pseudomonas aeruginosa PA01
gucaggaggaucgccuggc

SEQ ID NO: 33990 - RNA, 22 nt, Pseudomonas aeruginosa PA01
gucaggccgaagaucgcgccgc

SEQ ID NO: 33991 - RNA, 22 nt, Pseudomonas aeruginosa PA01
gucaggguggcgaugccgucuu

SEQ ID NO: 33992 - RNA, 22 nt, Pseudomonas aeruginosa PA01
gucauccagagcgcccggguga

SEQ ID NO: 33993 - RNA, 22 nt, Pseudomonas aeruginosa PA01
guccagcaaguaggucgccgcg

SEQ ID NO: 33994 - RNA, 22 nt, Pseudomonas aeruginosa PA01
guccagccggcgcagcgcgagu

SEQ ID NO: 33995 - RNA, 22 nt, Pseudomonas aeruginosa PA01
guccagcuggaacggcucgccg

SEQ ID NO: 33996 - RNA, 22 nt, Pseudomonas aeruginosa PA01
gucccuggccaccgucccgcug

SEQ ID NO: 33997 - RNA, 22 nt, Pseudomonas aeruginosa PA01
guccgggagcgauggcguugac

SEQ ID NO: 33998 - RNA, 22 nt, Pseudomonas aeruginosa PA01
guccgguagugccuucggaagu

SEQ ID NO: 33999 - RNA, 22 nt, Pseudomonas aeruginosa PA01
guccucguugccgccaagccac

SEQ ID NO: 34000 - RNA, 22 nt, Pseudomonas aeruginosa PA01
guccugguggauggucgcgagc

SEQ ID NO: 34001 - RNA, 22 nt, Pseudomonas aeruginosa PA01
guccuucgcggucgcgguagcc

SEQ ID NO: 34002 - RNA, 22 nt, Pseudomonas aeruginosa PA01
guccuugaacuccggcccggcg

SEQ ID NO: 34003 - RNA, 19 nt, Pseudomonas aeruginosa PA01
guccuuggccagguucugc

SEQ ID NO: 34004 - RNA, 22 nt, Pseudomonas aeruginosa PA01
gucgaacaguugggcgcggaag

SEQ ID NO: 34005 - RNA, 22 nt, Pseudomonas aeruginosa PA01
gucgacgucgagggccagcugc

SEQ ID NO: 34006 - RNA, 22 nt, Pseudomonas aeruginosa PA01
gucgagcagagccuggagcagg

SEQ ID NO: 34007 - RNA, 22 nt, Pseudomonas aeruginosa PA01
gucgaguugauguggcugaccg

SEQ ID NO: 34008 - RNA, 22 nt, Pseudomonas aeruginosa PA01
gucgaucaccaccauccacucg

SEQ ID NO: 34009 - RNA, 22 nt, Pseudomonas aeruginosa PA01
gucgauccgcuugccauggggg

SEQ ID NO: 34010 - RNA, 22 nt, Pseudomonas aeruginosa PA01
gucgaugauggcgucggacagc

SEQ ID NO: 34011 - RNA, 19 nt, Pseudomonas aeruginosa PA01
gucgaugcagaccaccaac

SEQ ID NO: 34012 - RNA, 22 nt, Pseudomonas aeruginosa PA01
gucgccauuccggcuuguuggu

SEQ ID NO: 34013 - RNA, 22 nt, Pseudomonas aeruginosa PA01
gucgccgcggggguguagagga

SEQ ID NO: 34014 - RNA, 22 nt, Pseudomonas aeruginosa PA01
gucgcgcaccuccuggucgagg

SEQ ID NO: 34015 - RNA, 22 nt, Pseudomonas aeruginosa PA01
gucgcgcaggcggaacugggug

SEQ ID NO: 34016 - RNA, 22 nt, Pseudomonas aeruginosa PA01
gucgcgcaguugcggauuaccg

SEQ ID NO: 34017 - RNA, 22 nt, Pseudomonas aeruginosa PA01
gucgcugaccuggcaaccgcag

SEQ ID NO: 34018 - RNA, 22 nt, Pseudomonas aeruginosa PA01
gucgcugcugccgaggcugugc

SEQ ID NO: 34019 - RNA, 22 nt, Pseudomonas aeruginosa PA01
gucgcuucaaguuccucaccgg

SEQ ID NO: 34020 - RNA, 22 nt, Pseudomonas aeruginosa PA01
gucggcgauggccagcagcgcg

SEQ ID NO: 34021 - RNA, 22 nt, Pseudomonas aeruginosa PA01
gucggcgcgcuguaucgccagg

SEQ ID NO: 34022 - RNA, 22 nt, Pseudomonas aeruginosa PA01
gucggucgucgauggcgccggc

SEQ ID NO: 34023 - RNA, 22 nt, Pseudomonas aeruginosa PA01
gucggugcaggcacugccuucg

SEQ ID NO: 34024 - RNA, 22 nt, Pseudomonas aeruginosa PA01
gucguagcuguccagcgccagg

SEQ ID NO: 34025 - RNA, 22 nt, Pseudomonas aeruginosa PA01
gucguagguggcgaccgcgguc

SEQ ID NO: 34026 - RNA, 22 nt, Pseudomonas aeruginosa PA01
gucguugcaggcgcccggcgag

SEQ ID NO: 34027 - RNA, 22 nt, Pseudomonas aeruginosa PA01
gucucuuccaucaccgagcgca

SEQ ID NO: 34028 - RNA, 19 nt, Pseudomonas aeruginosa PA01
gucugcagcaaccggccgu

SEQ ID NO: 34029 - RNA, 22 nt, Pseudomonas aeruginosa PA01
gucuggggugaggccgagccga

SEQ ID NO: 34030 - RNA, 21 nt, Pseudomonas aeruginosa PA01
gucuucguccuucaucccggu

SEQ ID NO: 34031 - RNA, 22 nt, Pseudomonas aeruginosa PA01
gucuuucguagcgaaccuggcg

SEQ ID NO: 34032 - RNA, 20 nt, Pseudomonas aeruginosa PA01
gugaccagcauucgccugcc

SEQ ID NO: 34033 - RNA, 22 nt, Pseudomonas aeruginosa PA01
gugaucaagcgcgguaccgggc

SEQ ID NO: 34034 - RNA, 22 nt, Pseudomonas aeruginosa PA01
gugaucgaccaggggcggcugg

SEQ ID NO: 34035 - RNA, 22 nt, Pseudomonas aeruginosa PA01
gugauggucgagaagcucgagc

SEQ ID NO: 34036 - RNA, 22 nt, Pseudomonas aeruginosa PA01
gugcaggucgaggugcauugcg

SEQ ID NO: 34037 - RNA, 22 nt, Pseudomonas aeruginosa PA01
gugcaguuggcccgccgcgccg

SEQ ID NO: 34038 - RNA, 22 nt, Pseudomonas aeruginosa PA01
gugcccgagguccugcuggggg

SEQ ID NO: 34039 - RNA, 22 nt, Pseudomonas aeruginosa PA01
gugcccugcaucggcgcguuga

SEQ ID NO: 34040 - RNA, 22 nt, Pseudomonas aeruginosa PA01
gugcccugggccggagcggcgg

SEQ ID NO: 34041 - RNA, 22 nt, Pseudomonas aeruginosa PA01
gugccgcagguaaugagccguc

SEQ ID NO: 34042 - RNA, 22 nt, Pseudomonas aeruginosa PA01
gugccgcucagggucgcgccgc

SEQ ID NO: 34043 - RNA, 22 nt, Pseudomonas aeruginosa PA01
gugccugguauggcaacccucu

SEQ ID NO: 34044 - RNA, 22 nt, Pseudomonas aeruginosa PA01
gugccuggucgcuggccucgcg

SEQ ID NO: 34045 - RNA, 22 nt, Pseudomonas aeruginosa PA01
gugccugguucaggcggcgcug

SEQ ID NO: 34046 - RNA, 22 nt, Pseudomonas aeruginosa PA01
gugcgcacgaagggcaccauga

SEQ ID NO: 34047 - RNA, 22 nt, Pseudomonas aeruginosa PA01
gugcgcgaccugcugagaaagg

SEQ ID NO: 34048 - RNA, 22 nt, Pseudomonas aeruginosa PA01
gugcgcuggaagaucgacgacg

SEQ ID NO: 34049 - RNA, 22 nt, Pseudomonas aeruginosa PA01
gugcggucgaggaagccggugu

SEQ ID NO: 34050 - RNA, 20 nt, Pseudomonas aeruginosa PA01
gugcucgaccaguucguggc

SEQ ID NO: 34051 - RNA, 22 nt, Pseudomonas aeruginosa PA01
gugcugaacaugagcuggggcg

SEQ ID NO: 34052 - RNA, 22 nt, Pseudomonas aeruginosa PA01
gugcuggacaaucgcgccgaca

SEQ ID NO: 34053 - RNA, 22 nt, Pseudomonas aeruginosa PA01
gugcuugugauguaagacuggu

SEQ ID NO: 34054 - RNA, 22 nt, Pseudomonas aeruginosa PA01
guggaaaucgucgucgagucca

SEQ ID NO: 34055 - RNA, 22 nt, Pseudomonas aeruginosa PA01
guggccaguaccguggugcugu

SEQ ID NO: 34056 - RNA, 22 nt, Pseudomonas aeruginosa PA01
guggcccaggccggacagacca

SEQ ID NO: 34057 - RNA, 22 nt, Pseudomonas aeruginosa PA01
guggcccguguggcugacucga

SEQ ID NO: 34058 - RNA, 22 nt, Pseudomonas aeruginosa PA01
guggccuggcugaagagcgccu

SEQ ID NO: 34059 - RNA, 22 nt, Pseudomonas aeruginosa PA01
guggcguucauggugccggugg

SEQ ID NO: 34060 - RNA, 22 nt, Pseudomonas aeruginosa PA01
guggcuggaggacgaggagcug

SEQ ID NO: 34061 - RNA, 22 nt, Pseudomonas aeruginosa PA01
guggcugggugccgagccgagg

SEQ ID NO: 34062 - RNA, 22 nt, Pseudomonas aeruginosa PA01
guggucaccgcccaucugcucg

SEQ ID NO: 34063 - RNA, 22 nt, Pseudomonas aeruginosa PA01
guggucuuccucgucguccgcg

SEQ ID NO: 34064 - RNA, 22 nt, Pseudomonas aeruginosa PA01
gugugggcagagccugccgucc

SEQ ID NO: 34065 - RNA, 22 nt, Pseudomonas aeruginosa PA01
guguggugccgcgcgguguagc

SEQ ID NO: 34066 - RNA, 19 nt, Pseudomonas aeruginosa PA01
guguucgucgcgccccuuc

SEQ ID NO: 34067 - RNA, 20 nt, Pseudomonas aeruginosa PA01
ucgacgauguugccggcggc

SEQ ID NO: 34068 - RNA, 22 nt, Pseudomonas aeruginosa PA01
ucgacgggcauggcgagcugcg

SEQ ID NO: 34069 - RNA, 22 nt, Pseudomonas aeruginosa PA01
ucgaggccgaggaucgggucgg

SEQ ID NO: 34070 - RNA, 22 nt, Pseudomonas aeruginosa PA01
ucgagggcggugccgugcugcg

SEQ ID NO: 34071 - RNA, 22 nt, Pseudomonas aeruginosa PA01
ucgaggggaaucucguaccagg

SEQ ID NO: 34072 - RNA, 21 nt, Pseudomonas aeruginosa PA01
ucgagguccgccucggucauc

SEQ ID NO: 34073 - RNA, 22 nt, Pseudomonas aeruginosa PA01
ucgaggucgcucggggcuucca

SEQ ID NO: 34074 - RNA, 22 nt, Pseudomonas aeruginosa PA01
ucgaugggcgcccgaucgagcc

SEQ ID NO: 34075 - RNA, 22 nt, Pseudomonas aeruginosa PA01
ucgcaucgucaccccguccagc

SEQ ID NO: 34076 - RNA, 22 nt, Pseudomonas aeruginosa PA01
ucgcccagcgccuggcgggucg

SEQ ID NO: 34077 - RNA, 22 nt, Pseudomonas aeruginosa PA01
ucgcccaggcuccagucggcgg

SEQ ID NO: 34078 - RNA, 22 nt, Pseudomonas aeruginosa PA01
ucgcccaguucggccgcggcca

SEQ ID NO: 34079 - RNA, 22 nt, Pseudomonas aeruginosa PA01
ucgcccggcagaccggcccgac

SEQ ID NO: 34080 - RNA, 22 nt, Pseudomonas aeruginosa PA01
ucgccgaacagccagcugcgca

SEQ ID NO: 34081 - RNA, 22 nt, Pseudomonas aeruginosa PA01
ucgccgacguggucaaccaguc

SEQ ID NO: 34082 - RNA, 22 nt, Pseudomonas aeruginosa PA01
ucgccgagcaggcgcagcuugu

SEQ ID NO: 34083 - RNA, 22 nt, Pseudomonas aeruginosa PA01
ucgccgagcuggaacgccuggc

SEQ ID NO: 34084 - RNA, 22 nt, Pseudomonas aeruginosa PA01
ucgccgccgaccucguggcgga

SEQ ID NO: 34085 - RNA, 22 nt, Pseudomonas aeruginosa PA01
ucgccgcuuugcggaugcacgc

SEQ ID NO: 34086 - RNA, 22 nt, Pseudomonas aeruginosa PA01
ucgccggcaaagucgagggcuu

SEQ ID NO: 34087 - RNA, 22 nt, Pseudomonas aeruginosa PA01
ucgccggccuguugcucaacga

SEQ ID NO: 34088 - RNA, 22 nt, Pseudomonas aeruginosa PA01
ucgccggucaagaccaugcauc

SEQ ID NO: 34089 - RNA, 22 nt, Pseudomonas aeruginosa PA01
ucgccgucgucccagccgcgag

SEQ ID NO: 34090 - RNA, 22 nt, Pseudomonas aeruginosa PA01
ucgccucagcaugcaucgcccg

SEQ ID NO: 34091 - RNA, 22 nt, Pseudomonas aeruginosa PA01
ucgccuggacguugggaauggu

SEQ ID NO: 34092 - RNA, 22 nt, Pseudomonas aeruginosa PA01
ucgcgaauugaaggacagcguc

SEQ ID NO: 34093 - RNA, 22 nt, Pseudomonas aeruginosa PA01
ucgcgacgcgcucuggaugccg

SEQ ID NO: 34094 - RNA, 22 nt, Pseudomonas aeruginosa PA01
ucgcgccgagcaggugggugcu

SEQ ID NO: 34095 - RNA, 22 nt, Pseudomonas aeruginosa PA01
ucgcgccugcacuacuucggca

SEQ ID NO: 34096 - RNA, 22 nt, Pseudomonas aeruginosa PA01
ucgcggccgggggugucguagu

SEQ ID NO: 34097 - RNA, 22 nt, Pseudomonas aeruginosa PA01
ucgcggugaaaugcucgagggc

SEQ ID NO: 34098 - RNA, 22 nt, Pseudomonas aeruginosa PA01
ucgcgguguagucgggguuguc

SEQ ID NO: 34099 - RNA, 22 nt, Pseudomonas aeruginosa PA01
ucgcugaccgaggugcgcgcgg

SEQ ID NO: 34100 - RNA, 22 nt, Pseudomonas aeruginosa PA01
ucgcugaggcggcaguggcuga

SEQ ID NO: 34101 - RNA, 22 nt, Pseudomonas aeruginosa PA01
ucggaucguucagcaccuugcg

SEQ ID NO: 34102 - RNA, 22 nt, Pseudomonas aeruginosa PA01
ucggcaaaggauagccgcgugg

SEQ ID NO: 34103 - RNA, 22 nt, Pseudomonas aeruginosa PA01
ucggcaaggcgcuugcccggca

SEQ ID NO: 34104 - RNA, 22 nt, Pseudomonas aeruginosa PA01
ucggcaccagggcuucgcgcag

SEQ ID NO: 34105 - RNA, 22 nt, Pseudomonas aeruginosa PA01
ucggcacgguaaucgccgggau

SEQ ID NO: 34106 - RNA, 22 nt, Pseudomonas aeruginosa PA01
ucggcaggcagcugauagcucc

SEQ ID NO: 34107 - RNA, 20 nt, Pseudomonas aeruginosa PA01
ucggccaggccuucgaaggc

SEQ ID NO: 34108 - RNA, 22 nt, Pseudomonas aeruginosa PA01
ucggccagggucaggcgcaggu

SEQ ID NO: 34109 - RNA, 22 nt, Pseudomonas aeruginosa PA01
ucggcccaggcugccaggugcg

SEQ ID NO: 34110 - RNA, 23 nt, Pseudomonas aeruginosa PA01
ucggccgagccgaugguguagcc

SEQ ID NO: 34111 - RNA, 22 nt, Pseudomonas aeruginosa PA01
ucggccugccugaccaacugcc

SEQ ID NO: 34112 - RNA, 22 nt, Pseudomonas aeruginosa PA01
ucggccugcuugccgggggcca

SEQ ID NO: 34113 - RNA, 22 nt, Pseudomonas aeruginosa PA01
ucggccuggcccaggccaacgu

SEQ ID NO: 34114 - RNA, 22 nt, Pseudomonas aeruginosa PA01
ucggccuugagccgacgucgcg

SEQ ID NO: 34115 - RNA, 22 nt, Pseudomonas aeruginosa PA01
ucggcgaauucgaccuggucga

SEQ ID NO: 34116 - RNA, 22 nt, Pseudomonas aeruginosa PA01
ucggcgauggccgccagggcgc

SEQ ID NO: 34117 - RNA, 22 nt, Pseudomonas aeruginosa PA01
ucggcgccaccgcuucgagcac

SEQ ID NO: 34118 - RNA, 21 nt, Pseudomonas aeruginosa PA01
ucggcgcgauuguccagcacc

SEQ ID NO: 34119 - RNA, 18 nt, Pseudomonas aeruginosa PA01
ucggcgcgcacucggugg

SEQ ID NO: 34120 - RNA, 22 nt, Pseudomonas aeruginosa PA01
ucggcggcguacagguagcggc

SEQ ID NO: 34121 - RNA, 22 nt, Pseudomonas aeruginosa PA01
ucggcguugacgaagcgcagca

SEQ ID NO: 34122 - RNA, 22 nt, Pseudomonas aeruginosa PA01
ucggcugaucggcagcaacaag

SEQ ID NO: 34123 - RNA, 22 nt, Pseudomonas aeruginosa PA01
ucgggcagauccagcgccugcu

SEQ ID NO: 34124 - RNA, 22 nt, Pseudomonas aeruginosa PA01
ucgggccggucugccgggcgag

SEQ ID NO: 34125 - RNA, 20 nt, Pseudomonas aeruginosa PA01
ucggggcgaggaucagcgcg

SEQ ID NO: 34126 - RNA, 22 nt, Pseudomonas aeruginosa PA01
ucggucgguugcgccggguagu

SEQ ID NO: 34127 - RNA, 22 nt, Pseudomonas aeruginosa PA01
ucggucuuggugucacggcugu

SEQ ID NO: 34128 - RNA, 22 nt, Pseudomonas aeruginosa PA01
ucggugaggaucuugugcggau

SEQ ID NO: 34129 - RNA, 22 nt, Pseudomonas aeruginosa PA01
ucggugaggcggaucugcgucg

SEQ ID NO: 34130 - RNA, 22 nt, Pseudomonas aeruginosa PA01
ucggugguguagacgccgucga

SEQ ID NO: 34131 - RNA, 22 nt, Pseudomonas aeruginosa PA01
ucgguguagcccggcaggcgga

SEQ ID NO: 34132 - RNA, 22 nt, Pseudomonas aeruginosa PA01
ucguaguccugggccgguugcg

SEQ ID NO: 34133 - RNA, 22 nt, Pseudomonas aeruginosa PA01
ucguccaucaccaccaacccuu

SEQ ID NO: 34134 - RNA, 22 nt, Pseudomonas aeruginosa PA01
ucguccaucguccucaccggga

SEQ ID NO: 34135 - RNA, 22 nt, Pseudomonas aeruginosa PA01
ucguccauguccgcgaucaggg

SEQ ID NO: 34136 - RNA, 22 nt, Pseudomonas aeruginosa PA01
ucgucgacgcuccagccgagcu

SEQ ID NO: 34137 - RNA, 22 nt, Pseudomonas aeruginosa PA01
ucgucgagggugccgaagccgc

SEQ ID NO: 34138 - RNA, 22 nt, Pseudomonas aeruginosa PA01
ucgucgccugccaguuccaccc

SEQ ID NO: 34139 - RNA, 22 nt, Pseudomonas aeruginosa PA01
ucgucggccuucaacgccgccg

SEQ ID NO: 34140 - RNA, 22 nt, Pseudomonas aeruginosa PA01
ucgugguggucauccucggcau

SEQ ID NO: 34141 - RNA, 22 nt, Pseudomonas aeruginosa PA01
ucguuggcuucguuggccuggc

SEQ ID NO: 34142 - RNA, 22 nt, Pseudomonas aeruginosa PA01
ucguugugcagguucggcuggg

SEQ ID NO: 34143 - RNA, 22 nt, Pseudomonas aeruginosa PA01
ucuccuggcugaccaggggcga

SEQ ID NO: 34144 - RNA, 22 nt, Pseudomonas aeruginosa PA01
ucucgaggguugaaagggaugc

SEQ ID NO: 34145 - RNA, 23 nt, Pseudomonas aeruginosa PA01
ucucgccauagcugcgcagcgcc

SEQ ID NO: 34146 - RNA, 22 nt, Pseudomonas aeruginosa PA01
ucucgcgauagggcucggcgcg

SEQ ID NO: 34147 - RNA, 22 nt, Pseudomonas aeruginosa PA01
ucucgcugucaucaacccgugu

SEQ ID NO: 34148 - RNA, 22 nt, Pseudomonas aeruginosa PA01
ucugacgcuugacggugaugcc

SEQ ID NO: 34149 - RNA, 19 nt, Pseudomonas aeruginosa PA01
ucugcaccaccuggccguu

SEQ ID NO: 34150 - RNA, 22 nt, Pseudomonas aeruginosa PA01
ugcuccagguucgccggcgcgg

SEQ ID NO: 34151 - RNA, 23 nt, Pseudomonas aeruginosa PA01
ugcucggucucguagacggucga

SEQ ID NO: 34152 - RNA, 22 nt, Pseudomonas aeruginosa PA01
ugcucgguuucagucugcagcg

SEQ ID NO: 34153 - RNA, 22 nt, Pseudomonas aeruginosa PA01
ugcucuugaagugauggaagau

SEQ ID NO: 34154 - RNA, 22 nt, Pseudomonas aeruginosa PA01
ugcugaucaugcccaucaccgc

SEQ ID NO: 34155 - RNA, 22 nt, Pseudomonas aeruginosa PA01
ugcugcaacugcgccaggcguu

SEQ ID NO: 34156 - RNA, 22 nt, Pseudomonas aeruginosa PA01
ugcugcaggagggccagggcau

SEQ ID NO: 34157 - RNA, 22 nt, Pseudomonas aeruginosa PA01
ugcugccgggcaggaccagcau

SEQ ID NO: 34158 - RNA, 22 nt, Pseudomonas aeruginosa PA01
ugcugcggcauggcggcauccu

SEQ ID NO: 34159 - RNA, 22 nt, Pseudomonas aeruginosa PA01
ugcugcugagguagucggcuac

SEQ ID NO: 34160 - RNA, 22 nt, Pseudomonas aeruginosa PA01
ugcugcuguccggugacggcga

SEQ ID NO: 34161 - RNA, 22 nt, Pseudomonas aeruginosa PA01
ugcuggaagaucaucccgacgc

SEQ ID NO: 34162 - RNA, 22 nt, Pseudomonas aeruginosa PA01
ugcugguagaacaguugcagcu

SEQ ID NO: 34163 - RNA, 22 nt, Pseudomonas aeruginosa PA01
ugcuggucgaaggcgagcagcg

SEQ ID NO: 34164 - RNA, 22 nt, Pseudomonas aeruginosa PA01
ugcuggucucgguguucgugcc

SEQ ID NO: 34165 - RNA, 22 nt, Pseudomonas aeruginosa PA01
ugcugucucuggugcgggucug

SEQ ID NO: 34166 - RNA, 22 nt, Pseudomonas aeruginosa PA01
ugcuguucgaggaccuuggcgu

SEQ ID NO: 34167 - RNA, 22 nt, Pseudomonas aeruginosa PA01
ugcuguugccgcugguccgcgc

SEQ ID NO: 34168 - RNA, 18 nt, Pseudomonas aeruginosa PA01
uggaccuucuucucggca

SEQ ID NO: 34169 - RNA, 22 nt, Pseudomonas aeruginosa PA01
uggacgccagcgacccgcgccu

SEQ ID NO: 34170 - RNA, 23 nt, Pseudomonas aeruginosa PA01
uggacgugguggguugcaccuug

SEQ ID NO: 34171 - RNA, 20 nt, Pseudomonas aeruginosa PA01
uggagcaccucggcgaugcc

SEQ ID NO: 34172 - RNA, 22 nt, Pseudomonas aeruginosa PA01
uggaggucggcacgccgcuggc

SEQ ID NO: 34173 - RNA, 22 nt, Pseudomonas aeruginosa PA01
uggagugcagaaaggcuucgac

SEQ ID NO: 34174 - RNA, 22 nt, Pseudomonas aeruginosa PA01
uggaucgcgugagaggcauccc

SEQ ID NO: 34175 - RNA, 22 nt, Pseudomonas aeruginosa PA01
uggcacugggccgcagcgucgg

SEQ ID NO: 34176 - RNA, 21 nt, Pseudomonas aeruginosa PA01
uggcagguacccggccggcug

SEQ ID NO: 34177 - RNA, 22 nt, Pseudomonas aeruginosa PA01
uggccaaggccggcggcgaccc

SEQ ID NO: 34178 - RNA, 22 nt, Pseudomonas aeruginosa PA01
uggccaaggcguugcaggagca

SEQ ID NO: 34179 - RNA, 22 nt, Pseudomonas aeruginosa PA01
uggccacgcaggcccagcggaa

SEQ ID NO: 34180 - RNA, 22 nt, Pseudomonas aeruginosa PA01
uggccagcgcgacgggcuggcc

SEQ ID NO: 34181 - RNA, 22 nt, Pseudomonas aeruginosa PA01
uggccagcucggcgccggcaug

SEQ ID NO: 34182 - RNA, 20 nt, Pseudomonas aeruginosa PA01
uggccgacucguagccggcc

SEQ ID NO: 34183 - RNA, 22 nt, Pseudomonas aeruginosa PA01
uggccgaguucgcggccgguga

SEQ ID NO: 34184 - RNA, 22 nt, Pseudomonas aeruginosa PA01
uggccgccaguuucgccgucag

SEQ ID NO: 34185 - RNA, 22 nt, Pseudomonas aeruginosa PA01
uggccgccgcacgccgugcagg

SEQ ID NO: 34186 - RNA, 22 nt, Pseudomonas aeruginosa PA01
uggccgcgcccugcggggugau

SEQ ID NO: 34187 - RNA, 22 nt, Pseudomonas aeruginosa PA01
uggccggauugccgccgggcgu

SEQ ID NO: 34188 - RNA, 22 nt, Pseudomonas aeruginosa PA01
uggccggugucgaacgggugcc

SEQ ID NO: 34189 - RNA, 22 nt, Pseudomonas aeruginosa PA01
uggccguggccggccugggccu

SEQ ID NO: 34190 - RNA, 22 nt, Pseudomonas aeruginosa PA01
uggccguugcgguggacccggc

SEQ ID NO: 34191 - RNA, 22 nt, Pseudomonas aeruginosa PA01
uggccuggaacgccuccagcgg

SEQ ID NO: 34192 - RNA, 22 nt, Pseudomonas aeruginosa PA01
uggcgaccuucaagcgucggcu

SEQ ID NO: 34193 - RNA, 22 nt, Pseudomonas aeruginosa PA01
uggcgcagcaagcagucgcugc

SEQ ID NO: 34194 - RNA, 22 nt, Pseudomonas aeruginosa PA01
uggcgccaugcagcaguugcga

SEQ ID NO: 34195 - RNA, 22 nt, Pseudomonas aeruginosa PA01
uggcgccgguagaggaacacgc

SEQ ID NO: 34196 - RNA, 22 nt, Pseudomonas aeruginosa PA01
uggcgcugacccggcuggucau

SEQ ID NO: 34197 - RNA, 22 nt, Pseudomonas aeruginosa PA01
uggcgcugagcguggcgaugaa

SEQ ID NO: 34198 - RNA, 22 nt, Pseudomonas aeruginosa PA01
uggcggauccgcugcugauggu

SEQ ID NO: 34199 - RNA, 20 nt, Pseudomonas aeruginosa PA01
uggcggcugaucuucggcug

SEQ ID NO: 34200 - RNA, 22 nt, Pseudomonas aeruginosa PA01
uggcugauuugaucgaugucag

SEQ ID NO: 34201 - RNA, 22 nt, Pseudomonas aeruginosa PA01
uggcuggggucgaccuuguugu

SEQ ID NO: 34202 - RNA, 22 nt, Pseudomonas aeruginosa PA01
uggcuguugcgcaccucgccga

SEQ ID NO: 34203 - RNA, 22 nt, Pseudomonas aeruginosa PA01
uggcuguugcucgguguggcau

SEQ ID NO: 34204 - RNA, 22 nt, Pseudomonas aeruginosa PA01
uggcuucgaucgccagguucgg

SEQ ID NO: 34205 - RNA, 22 nt, Pseudomonas aeruginosa PA01
ugggaccgccgcuguagauaua

SEQ ID NO: 34206 - RNA, 22 nt, Pseudomonas aeruginosa PA01
ugggccagcuggaucucgccgg

SEQ ID NO: 34207 - RNA, 22 nt, Pseudomonas aeruginosa PA01
ugggcgaaguccuggcagaccc

SEQ ID NO: 34208 - RNA, 22 nt, Pseudomonas aeruginosa PA01
ugggcggcgaugaguucggccu

SEQ ID NO: 34209 - RNA, 22 nt, Pseudomonas aeruginosa PA01
ugggcgugcgcagggccuggag

SEQ ID NO: 34210 - RNA, 22 nt, Pseudomonas aeruginosa PA01
ugggcguuguucgucagacggg

SEQ ID NO: 34211 - RNA, 22 nt, Pseudomonas aeruginosa PA01
uggggcgacagcggccccgagg

SEQ ID NO: 34212 - RNA, 22 nt, Pseudomonas aeruginosa PA01
uggggcugaccucgcuguucgg

SEQ ID NO: 34213 - RNA, 22 nt, Pseudomonas aeruginosa PA01
ugguagcgauccgccgggucac

SEQ ID NO: 34214 - RNA, 22 nt, Pseudomonas aeruginosa PA01
ugguccuggcggagcugcccaa

SEQ ID NO: 34215 - RNA, 22 nt, Pseudomonas aeruginosa PA01
ugguccuguucgcccugacccu

SEQ ID NO: 34216 - RNA, 22 nt, Pseudomonas aeruginosa PA01
uggucgagcacgaugauguggu

SEQ ID NO: 34217 - RNA, 22 nt, Pseudomonas aeruginosa PA01
uggucgaucccggcguuggucc

SEQ ID NO: 34218 - RNA, 22 nt, Pseudomonas aeruginosa PA01
uggucgcagcgcugggacuacg

SEQ ID NO: 34219 - RNA, 22 nt, Pseudomonas aeruginosa PA01
uggucgccggaucggcgcccag

SEQ ID NO: 34220 - RNA, 22 nt, Pseudomonas aeruginosa PA01
uggucggcuuccucgcuucgga

SEQ ID NO: 34221 - RNA, 22 nt, Pseudomonas aeruginosa PA01
uggugcgcgacgaggagggagu

SEQ ID NO: 34222 - RNA, 22 nt, Pseudomonas aeruginosa PA01
uggugcugguggugaaggcgaa

SEQ ID NO: 34223 - RNA, 22 nt, Pseudomonas aeruginosa PA01
ugguggcgaccuucuuccaggg

SEQ ID NO: 34224 - RNA, 22 nt, Pseudomonas aeruginosa PA01
ugguguucaacgccagcaccgu

SEQ ID NO: 34225 - RNA, 22 nt, Pseudomonas aeruginosa PA01
ugucaugggugacggugaaggu

SEQ ID NO: 34226 - RNA, 22 nt, Pseudomonas aeruginosa PA01
uguccgacgugguccccggcga

SEQ ID NO: 34227 - RNA, 19 nt, Pseudomonas aeruginosa PA01
uguccgagccauggaugcu

SEQ ID NO: 34228 - RNA, 22 nt, Pseudomonas aeruginosa PA01
ugucgacccgcgucucuaugug

SEQ ID NO: 34229 - RNA, 22 nt, Pseudomonas aeruginosa PA01
ugucgagggcgcuggccagguc

SEQ ID NO: 34230 - RNA, 22 nt, Pseudomonas aeruginosa PA01
ugucggcgacggucuucgagga

SEQ ID NO: 34231 - RNA, 21 nt, Pseudomonas aeruginosa PA01
ugucggggccgcacgcggcga

SEQ ID NO: 34232 - RNA, 22 nt, Pseudomonas aeruginosa PA01
ugucugggaaaccgccccgguc

SEQ ID NO: 34233 - RNA, 22 nt, Pseudomonas putida KT2440
aaccugcacagugugcuuagcg

SEQ ID NO: 34234 - RNA, 22 nt, Pseudomonas putida KT2440
aaccugcgcccacacggacugu

SEQ ID NO: 34235 - RNA, 22 nt, Pseudomonas putida KT2440
aaccuggcuguaaggcggcucc

SEQ ID NO: 34236 - RNA, 22 nt, Pseudomonas putida KT2440
aacgacgcgcuggaucgaaagc

SEQ ID NO: 34237 - RNA, 22 nt, Pseudomonas putida KT2440
aacgccgugccuugcgccuggc

SEQ ID NO: 34238 - RNA, 22 nt, Pseudomonas putida KT2440
aacggcgagcgcauugccgcca

SEQ ID NO: 34239 - RNA, 22 nt, Pseudomonas putida KT2440
aacgggucuuguggaaagggga

SEQ ID NO: 34240 - RNA, 22 nt, Pseudomonas putida KT2440
aacgugcguccaugaaguugcg

SEQ ID NO: 34241 - RNA, 22 nt, Pseudomonas putida KT2440
aacuacaucgaaggccugagca

SEQ ID NO: 34242 - RNA, 22 nt, Pseudomonas putida KT2440
aacuccgcuuccugggcuguuu

SEQ ID NO: 34243 - RNA, 22 nt, Pseudomonas putida KT2440
aacugcaugagguuccaguggg

SEQ ID NO: 34244 - RNA, 22 nt, Pseudomonas putida KT2440
aacugggcggccuggucgggca

SEQ ID NO: 34245 - RNA, 22 nt, Pseudomonas putida KT2440
aagaagcugcugcgcgaaaucg

SEQ ID NO: 34246 - RNA, 22 nt, Pseudomonas putida KT2440
aagacguuggcgcccuguuccu

SEQ ID NO: 34247 - RNA, 20 nt, Pseudomonas putida KT2440
aagaggccggcucaggcgau

SEQ ID NO: 34248 - RNA, 22 nt, Pseudomonas putida KT2440
aagcagaucgcgaauuucaacu

SEQ ID NO: 34249 - RNA, 22 nt, Pseudomonas putida KT2440
aagcagcacaccgcggcacgcu

SEQ ID NO: 34250 - RNA, 22 nt, Pseudomonas putida KT2440
aagcccagguuagccagguauu

SEQ ID NO: 34251 - RNA, 22 nt, Pseudomonas putida KT2440
aagcccgcuccuacggaaucug

SEQ ID NO: 34252 - RNA, 22 nt, Pseudomonas putida KT2440
aagccgguggcggccucuuggc

SEQ ID NO: 34253 - RNA, 22 nt, Pseudomonas putida KT2440
aagcgcauggcgaggcauccag

SEQ ID NO: 34254 - RNA, 22 nt, Pseudomonas putida KT2440
aagcgcgcaggcccuccuggcc

SEQ ID NO: 34255 - RNA, 22 nt, Pseudomonas putida KT2440
aagcgcuucagguacugcauug

SEQ ID NO: 34256 - RNA, 22 nt, Pseudomonas putida KT2440
aagcggcuggaggauggcagcg

SEQ ID NO: 34257 - RNA, 22 nt, Pseudomonas putida KT2440
aagcgggcaccgccgucuucug

SEQ ID NO: 34258 - RNA, 22 nt, Pseudomonas putida KT2440
aagcugcacgccggcgguaagu

SEQ ID NO: 34259 - RNA, 22 nt, Pseudomonas putida KT2440
aaggacaucggcccgguggugg

SEQ ID NO: 34260 - RNA, 22 nt, Pseudomonas putida KT2440
aaggacgcuaaacuggcgcugg

SEQ ID NO: 34261 - RNA, 22 nt, Pseudomonas putida KT2440
aaggacgugggcaucgaccaga

SEQ ID NO: 34262 - RNA, 22 nt, Pseudomonas putida KT2440
aaggauuucuaagcuuucaaua

SEQ ID NO: 34263 - RNA, 22 nt, Pseudomonas putida KT2440
aaggccagcgggucagccgugu

SEQ ID NO: 34264 - RNA, 22 nt, Pseudomonas putida KT2440
aaggccauggccagcaguauca

SEQ ID NO: 34265 - RNA, 22 nt, Pseudomonas putida KT2440
aaggcgcuacagcuaccgucag

SEQ ID NO: 34266 - RNA, 22 nt, Pseudomonas putida KT2440
aagggcugcaacgcaaccccgg

SEQ ID NO: 34267 - RNA, 22 nt, Pseudomonas putida KT2440
aaggguugcaacgcaaccccaa

SEQ ID NO: 34268 - RNA, 22 nt, Pseudomonas putida KT2440
aagguccgcugccgaaacugaa

SEQ ID NO: 34269 - RNA, 22 nt, Pseudomonas putida KT2440
aagucuguacaggccucuucgc

SEQ ID NO: 34270 - RNA, 22 nt, Pseudomonas putida KT2440
aagugcaaggcugaguccgguc

SEQ ID NO: 34271 - RNA, 22 nt, Pseudomonas putida KT2440
aagugcgguguggaacuggccg

SEQ ID NO: 34272 - RNA, 22 nt, Pseudomonas putida KT2440
aagugguguggaacaagaaguu

SEQ ID NO: 34273 - RNA, 19 nt, Pseudomonas putida KT2440
aaguucggcagcuugcgcc

SEQ ID NO: 34274 - RNA, 22 nt, Pseudomonas putida KT2440
aauaccugugggagcgggcaag

SEQ ID NO: 34275 - RNA, 22 nt, Pseudomonas putida KT2440
aauccgcuccuacaggcgcgga

SEQ ID NO: 34276 - RNA, 22 nt, Pseudomonas putida KT2440
aaugaucuugaacgcuucggua

SEQ ID NO: 34277 - RNA, 22 nt, Pseudomonas putida KT2440
aaugauggcccauugucggcau

SEQ ID NO: 34278 - RNA, 22 nt, Pseudomonas putida KT2440
aauggcaaugucgagcuggcgg

SEQ ID NO: 34279 - RNA, 22 nt, Pseudomonas putida KT2440
aauugccguuguaugcgcguau

SEQ ID NO: 34280 - RNA, 22 nt, Pseudomonas putida KT2440
aauugcuggggccgcuuugcgg

SEQ ID NO: 34281 - RNA, 22 nt, Pseudomonas putida KT2440
acaccaggcagaacucggcguu

SEQ ID NO: 34282 - RNA, 22 nt, Pseudomonas putida KT2440
acagccugaaccggcccuuucg

SEQ ID NO: 34283 - RNA, 22 nt, Pseudomonas putida KT2440
acaggcgcccgagcacacggcg

SEQ ID NO: 34284 - RNA, 22 nt, Pseudomonas putida KT2440
acaucaaggacaauugcuucau

SEQ ID NO: 34285 - RNA, 23 nt, Pseudomonas putida KT2440
accacagucgccuuggcacccug

SEQ ID NO: 34286 - RNA, 22 nt, Pseudomonas putida KT2440
accaccugauccccuccggcuc

SEQ ID NO: 34287 - RNA, 21 nt, Pseudomonas putida KT2440
accaccugcaggcugcgcgcc

SEQ ID NO: 34288 - RNA, 21 nt, Pseudomonas putida KT2440
accagcgcgcgcagggccagc

SEQ ID NO: 34289 - RNA, 23 nt, Pseudomonas putida KT2440
accaugagcgccauccgucuggc

SEQ ID NO: 34290 - RNA, 22 nt, Pseudomonas putida KT2440
acccgcgaacaccggcgcagcc

SEQ ID NO: 34291 - RNA, 22 nt, Pseudomonas putida KT2440
acccgcgaaggcgucgguccug

SEQ ID NO: 34292 - RNA, 22 nt, Pseudomonas putida KT2440
acccgcuccuacacggucacca

SEQ ID NO: 34293 - RNA, 22 nt, Pseudomonas putida KT2440
acccgcuccuacaggggccuug

SEQ ID NO: 34294 - RNA, 22 nt, Pseudomonas putida KT2440
acccucgggcgucagccagggc

SEQ ID NO: 34295 - RNA, 22 nt, Pseudomonas putida KT2440
accgacucgaucaucagcgaac

SEQ ID NO: 34296 - RNA, 21 nt, Pseudomonas putida KT2440
accgauccuguacgugcuggc

SEQ ID NO: 34297 - RNA, 22 nt, Pseudomonas putida KT2440
accgcaauccuuggcauugacg

SEQ ID NO: 34298 - RNA, 22 nt, Pseudomonas putida KT2440
accgccgaugucgauggcuggc

SEQ ID NO: 34299 - RNA, 22 nt, Pseudomonas putida KT2440
accgccgucaggaggcugccgu

SEQ ID NO: 34300 - RNA, 22 nt, Pseudomonas putida KT2440
accgcgaacaagaacggcgaaa

SEQ ID NO: 34301 - RNA, 22 nt, Pseudomonas putida KT2440
accgcgcucuucaagguggcgg

SEQ ID NO: 34302 - RNA, 22 nt, Pseudomonas putida KT2440
accgcguccagguacgcgcccu

SEQ ID NO: 34303 - RNA, 22 nt, Pseudomonas putida KT2440
accgggcagucgguguggcgcu

SEQ ID NO: 34304 - RNA, 22 nt, Pseudomonas putida KT2440
accgggugcucaggaaagugca

SEQ ID NO: 34305 - RNA, 22 nt, Pseudomonas putida KT2440
accguauucgcggguaaacccg

SEQ ID NO: 34306 - RNA, 22 nt, Pseudomonas putida KT2440
accuaugacacgcacaccuuac

SEQ ID NO: 34307 - RNA, 22 nt, Pseudomonas putida KT2440
accucgcccuuguagccgucga

SEQ ID NO: 34308 - RNA, 22 nt, Pseudomonas putida KT2440
accucgcuuuuccgcaggagaa

SEQ ID NO: 34309 - RNA, 21 nt, Pseudomonas putida KT2440
accucggccugguagucgcgc

SEQ ID NO: 34310 - RNA, 22 nt, Pseudomonas putida KT2440
accucgggaauggucguaucgu

SEQ ID NO: 34311 - RNA, 22 nt, Pseudomonas putida KT2440
accugacccucgugggugagcg

SEQ ID NO: 34312 - RNA, 22 nt, Pseudomonas putida KT2440
accugagcacgagacgaaaaau

SEQ ID NO: 34313 - RNA, 22 nt, Pseudomonas putida KT2440
accugccacuggucagcgccug

SEQ ID NO: 34314 - RNA, 22 nt, Pseudomonas putida KT2440
accugcugacgcauucgcgggc

SEQ ID NO: 34315 - RNA, 22 nt, Pseudomonas putida KT2440
accugggccuucuucauugccg

SEQ ID NO: 34316 - RNA, 22 nt, Pseudomonas putida KT2440
accugucgaugcgcauguuugc

SEQ ID NO: 34317 - RNA, 22 nt, Pseudomonas putida KT2440
accuguggacgcuggcuugccg

SEQ ID NO: 34318 - RNA, 22 nt, Pseudomonas putida KT2440
aggccgcacaggcgcucggcgu

SEQ ID NO: 34319 - RNA, 22 nt, Pseudomonas putida KT2440
aggccguagaucaggucgaggu

SEQ ID NO: 34320 - RNA, 22 nt, Pseudomonas putida KT2440
aggcgcugaucacacaguuugc

SEQ ID NO: 34321 - RNA, 22 nt, Pseudomonas putida KT2440
aggcgcuuggccagcaaggacg

SEQ ID NO: 34322 - RNA, 18 nt, Pseudomonas putida KT2440
aggcgguaaucacuuucc

SEQ ID NO: 34323 - RNA, 22 nt, Pseudomonas putida KT2440
aggcggucagcgauggcuggau

SEQ ID NO: 34324 - RNA, 22 nt, Pseudomonas putida KT2440
aggcucagcaauugugcccggg

SEQ ID NO: 34325 - RNA, 22 nt, Pseudomonas putida KT2440
aggcugaagagguucggcguca

SEQ ID NO: 34326 - RNA, 22 nt, Pseudomonas putida KT2440
aggcugacccgcgccaucaugg

SEQ ID NO: 34327 - RNA, 22 nt, Pseudomonas putida KT2440
aggcugauccgggucggcgaua

SEQ ID NO: 34328 - RNA, 22 nt, Pseudomonas putida KT2440
aggcuguccaccugcuggugca

SEQ ID NO: 34329 - RNA, 22 nt, Pseudomonas putida KT2440
agggcaacgcgggcagcggucu

SEQ ID NO: 34330 - RNA, 22 nt, Pseudomonas putida KT2440
agggccuggaaacgcugcgccu

SEQ ID NO: 34331 - RNA, 22 nt, Pseudomonas putida KT2440
agggcugcggugcugguggcau

SEQ ID NO: 34332 - RNA, 22 nt, Pseudomonas putida KT2440
aggguccaggcauugaucgcca

SEQ ID NO: 34333 - RNA, 22 nt, Pseudomonas putida KT2440
aggguugcagcguccuggagcc

SEQ ID NO: 34334 - RNA, 22 nt, Pseudomonas putida KT2440
aggucaugcccagcggcugcug

SEQ ID NO: 34335 - RNA, 22 nt, Pseudomonas putida KT2440
aggucgaagaaguugcggccga

SEQ ID NO: 34336 - RNA, 22 nt, Pseudomonas putida KT2440
aggugcacaccgugcgccuggc

SEQ ID NO: 34337 - RNA, 22 nt, Pseudomonas putida KT2440
aggugcacgaagagcagcacga

SEQ ID NO: 34338 - RNA, 22 nt, Pseudomonas putida KT2440
aggugcaugacaguuucaaggu

SEQ ID NO: 34339 - RNA, 22 nt, Pseudomonas putida KT2440
aggugcucgaugaucaucccgg

SEQ ID NO: 34340 - RNA, 22 nt, Pseudomonas putida KT2440
aggugucgcguuccugcuguga

SEQ ID NO: 34341 - RNA, 22 nt, Pseudomonas putida KT2440
aggugugcgugucauaggucuu

SEQ ID NO: 34342 - RNA, 22 nt, Pseudomonas putida KT2440
agguugccaaaccauggccagc

SEQ ID NO: 34343 - RNA, 22 nt, Pseudomonas putida KT2440
aguacggcaggcgaaugcgccc

SEQ ID NO: 34344 - RNA, 22 nt, Pseudomonas putida KT2440
agucaggcugacgcugcgcgug

SEQ ID NO: 34345 - RNA, 22 nt, Pseudomonas putida KT2440
agucccugugggagcggccuug

SEQ ID NO: 34346 - RNA, 22 nt, Pseudomonas putida KT2440
agucggcaugguguuccagcac

SEQ ID NO: 34347 - RNA, 22 nt, Pseudomonas putida KT2440
agugaaugauuugcggcugguu

SEQ ID NO: 34348 - RNA, 22 nt, Pseudomonas putida KT2440
agugcauugaccuucacccuga

SEQ ID NO: 34349 - RNA, 22 nt, Pseudomonas putida KT2440
agugcauugaccuucacgcuga

SEQ ID NO: 34350 - RNA, 22 nt, Pseudomonas putida KT2440
agugcucagucagucgaucagc

SEQ ID NO: 34351 - RNA, 22 nt, Pseudomonas putida KT2440
agugcuggccaugcaguuacgu

SEQ ID NO: 34352 - RNA, 22 nt, Pseudomonas putida KT2440
agugcuggcggaccucaucgug

SEQ ID NO: 34353 - RNA, 22 nt, Pseudomonas putida KT2440
aguggcguggucaugacgaggc

SEQ ID NO: 34354 - RNA, 22 nt, Pseudomonas putida KT2440
aguucgguaucggcacgcugcu

SEQ ID NO: 34355 - RNA, 18 nt, Pseudomonas putida KT2440
aguuggccuguggaaaca

SEQ ID NO: 34356 - RNA, 22 nt, Pseudomonas putida KT2440
auauggcgcuccuucggggugg

SEQ ID NO: 34357 - RNA, 22 nt, Pseudomonas putida KT2440
aucaacgacaauuggccaugca

SEQ ID NO: 34358 - RNA, 22 nt, Pseudomonas putida KT2440
aucaagcagccacugucagugu

SEQ ID NO: 34359 - RNA, 22 nt, Pseudomonas putida KT2440
aucacacugaagaaguuggccu

SEQ ID NO: 34360 - RNA, 22 nt, Pseudomonas putida KT2440
aucacccuuuggggugagccgg

SEQ ID NO: 34361 - RNA, 22 nt, Pseudomonas putida KT2440
aucacucaucgaaucaggcgga

SEQ ID NO: 34362 - RNA, 22 nt, Pseudomonas putida KT2440
aucaguguggugcccagggcau

SEQ ID NO: 34363 - RNA, 22 nt, Pseudomonas putida KT2440
auccacucacaguaguggcugg

SEQ ID NO: 34364 - RNA, 22 nt, Pseudomonas putida KT2440
auccugcuagcgaccagcgucu

SEQ ID NO: 34365 - RNA, 22 nt, Pseudomonas putida KT2440
aucgacuugcugcccggcuggg

SEQ ID NO: 34366 - RNA, 22 nt, Pseudomonas putida KT2440
aucgagauggaggucggcuggg

SEQ ID NO: 34367 - RNA, 22 nt, Pseudomonas putida KT2440
aucgauacgccccggcgccugu

SEQ ID NO: 34368 - RNA, 21 nt, Pseudomonas putida KT2440
aucgcagcuagggagcggcca

SEQ ID NO: 34369 - RNA, 22 nt, Pseudomonas putida KT2440
aucgcccugguccagcacggug

SEQ ID NO: 34370 - RNA, 22 nt, Pseudomonas putida KT2440
aucgccuugguaccgcugcugg

SEQ ID NO: 34371 - RNA, 22 nt, Pseudomonas putida KT2440
aucgcgaagcccgccuggcggc

SEQ ID NO: 34372 - RNA, 22 nt, Pseudomonas putida KT2440
aucggccacgcgcagacguugc

SEQ ID NO: 34373 - RNA, 22 nt, Pseudomonas putida KT2440
aucggccaggcgcagacuggca

SEQ ID NO: 34374 - RNA, 22 nt, Pseudomonas putida KT2440
aucggccuguucguguggggcu

SEQ ID NO: 34375 - RNA, 22 nt, Pseudomonas putida KT2440
aucggcgagcguggaggugacc

SEQ ID NO: 34376 - RNA, 22 nt, Pseudomonas putida KT2440
aucggcgagguacugaucggcg

SEQ ID NO: 34377 - RNA, 22 nt, Pseudomonas putida KT2440
aucgucuucgccgaugaagcag

SEQ ID NO: 34378 - RNA, 22 nt, Pseudomonas putida KT2440
aucucgauaucgguggccugac

SEQ ID NO: 34379 - RNA, 22 nt, Pseudomonas putida KT2440
aucuggcaggcgcugcacuauu

SEQ ID NO: 34380 - RNA, 22 nt, Pseudomonas putida KT2440
aucuggcgcaugcgcagggcau

SEQ ID NO: 34381 - RNA, 22 nt, Pseudomonas putida KT2440
aucugguagugaucgcgcaugg

SEQ ID NO: 34382 - RNA, 22 nt, Pseudomonas putida KT2440
augaacauccccaacgccgcgu

SEQ ID NO: 34383 - RNA, 22 nt, Pseudomonas putida KT2440
augagcuuggcccaggggcacu

SEQ ID NO: 34384 - RNA, 22 nt, Pseudomonas putida KT2440
augcccgcgaauacgucagcag

SEQ ID NO: 34385 - RNA, 22 nt, Pseudomonas putida KT2440
augccgaagucugggacacuga

SEQ ID NO: 34386 - RNA, 22 nt, Pseudomonas putida KT2440
augccgcuccuaccggaccagc

SEQ ID NO: 34387 - RNA, 22 nt, Pseudomonas putida KT2440
augcuguagacaagguuucgau

SEQ ID NO: 34388 - RNA, 22 nt, Pseudomonas putida KT2440
augcuguugagcuguuugaggu

SEQ ID NO: 34389 - RNA, 18 nt, Pseudomonas putida KT2440
auggagccgaucaugcgc

SEQ ID NO: 34390 - RNA, 19 nt, Pseudomonas putida KT2440
auggcaccgacacccgcga

SEQ ID NO: 34391 - RNA, 22 nt, Pseudomonas putida KT2440
auggccagcagcaccuuguuca

SEQ ID NO: 34392 - RNA, 23 nt, Pseudomonas putida KT2440
auggccgagcaucgcguucaucu

SEQ ID NO: 34393 - RNA, 22 nt, Pseudomonas putida KT2440
auggcgauguccuguucgccgc

SEQ ID NO: 34394 - RNA, 22 nt, Pseudomonas putida KT2440
augggucaggucuucgaccaug

SEQ ID NO: 34395 - RNA, 22 nt, Pseudomonas putida KT2440
augucgcgcaccagguggucgu

SEQ ID NO: 34396 - RNA, 22 nt, Pseudomonas putida KT2440
auguugcugguggccaccaggg

SEQ ID NO: 34397 - RNA, 22 nt, Pseudomonas putida KT2440
auuccggguaaacccgcuccua

SEQ ID NO: 34398 - RNA, 22 nt, Pseudomonas putida KT2440
auucgcggguaaacccgcgccu

SEQ ID NO: 34399 - RNA, 22 nt, Pseudomonas putida KT2440
auucgcggguaaacccgcuccu

SEQ ID NO: 34400 - RNA, 22 nt, Pseudomonas putida KT2440
auucgcuggccgaauuccgcac

SEQ ID NO: 34401 - RNA, 22 nt, Pseudomonas putida KT2440
auugccuggugcuugaugugcc

SEQ ID NO: 34402 - RNA, 22 nt, Pseudomonas putida KT2440
caaagcucagcgugcugccguu

SEQ ID NO: 34403 - RNA, 22 nt, Pseudomonas putida KT2440
cccgcgaacaccggcgcagccg

SEQ ID NO: 34404 - RNA, 22 nt, Pseudomonas putida KT2440
cccgcgaacuguucggggugcu

SEQ ID NO: 34405 - RNA, 22 nt, Pseudomonas putida KT2440
cccgcgaaugcgauagcucagg

SEQ ID NO: 34406 - RNA, 22 nt, Pseudomonas putida KT2440
cccggcuaaagccgcgccuacg

SEQ ID NO: 34407 - RNA, 22 nt, Pseudomonas putida KT2440
cccugcaggcacggcuuuagcc

SEQ ID NO: 34408 - RNA, 22 nt, Pseudomonas putida KT2440
ccgacccugugggagcgggcuu

SEQ ID NO: 34409 - RNA, 22 nt, Pseudomonas putida KT2440
ccgcagugcuugcuucgcgggc

SEQ ID NO: 34410 - RNA, 22 nt, Pseudomonas putida KT2440
ccgcccaugaaccgucugccuu

SEQ ID NO: 34411 - RNA, 22 nt, Pseudomonas putida KT2440
ccgcgucagccuugaccaggcc

SEQ ID NO: 34412 - RNA, 22 nt, Pseudomonas putida KT2440
ccgcucaccccaaagggugauu

SEQ ID NO: 34413 - RNA, 22 nt, Pseudomonas putida KT2440
ccgcucugaacgcagcugcucc

SEQ ID NO: 34414 - RNA, 22 nt, Pseudomonas putida KT2440
ccgcuguuggaugucaugcaga

SEQ ID NO: 34415 - RNA, 22 nt, Pseudomonas putida KT2440
ccggacaguggcgaugcggccc

SEQ ID NO: 34416 - RNA, 22 nt, Pseudomonas putida KT2440
ccggacuucugguucagccgcg

SEQ ID NO: 34417 - RNA, 22 nt, Pseudomonas putida KT2440
ccggagcaggucaugggccgca

SEQ ID NO: 34418 - RNA, 22 nt, Pseudomonas putida KT2440
ccggcaucggcaaacgccugcu

SEQ ID NO: 34419 - RNA, 22 nt, Pseudomonas putida KT2440
ccggcuucacccgugccgguca

SEQ ID NO: 34420 - RNA, 22 nt, Pseudomonas putida KT2440
ccgggaucaacaucuucgaccu

SEQ ID NO: 34421 - RNA, 21 nt, Pseudomonas putida KT2440
ccgguaccggcguugcaggcg

SEQ ID NO: 34422 - RNA, 22 nt, Pseudomonas putida KT2440
ccgguaccgguguugaagugcu

SEQ ID NO: 34423 - RNA, 22 nt, Pseudomonas putida KT2440
ccgguagacaagcuggaccuga

SEQ ID NO: 34424 - RNA, 22 nt, Pseudomonas putida KT2440
ccggugaagcacugcucuuugc

SEQ ID NO: 34425 - RNA, 22 nt, Pseudomonas putida KT2440
ccguaggaucggguuuacccgc

SEQ ID NO: 34426 - RNA, 22 nt, Pseudomonas putida KT2440
ccguccugcugcuccagccauu

SEQ ID NO: 34427 - RNA, 22 nt, Pseudomonas putida KT2440
ccgugaaguggacugcaugcag

SEQ ID NO: 34428 - RNA, 22 nt, Pseudomonas putida KT2440
ccgugcucaaucggcagccagc

SEQ ID NO: 34429 - RNA, 23 nt, Pseudomonas putida KT2440
ccguuacuggaguuacgagcggc

SEQ ID NO: 34430 - RNA, 22 nt, Pseudomonas putida KT2440
ccucgcugcugcuggcgccguu

SEQ ID NO: 34431 - RNA, 23 nt, Pseudomonas putida KT2440
ccugauccugcugaccgagcgcc

SEQ ID NO: 34432 - RNA, 22 nt, Pseudomonas putida KT2440
ccugauccuguccaacccgccg

SEQ ID NO: 34433 - RNA, 22 nt, Pseudomonas putida KT2440
ccugaucgccgccuccuugcgc

SEQ ID NO: 34434 - RNA, 22 nt, Pseudomonas putida KT2440
ccugcagccacaugcccguaaa

SEQ ID NO: 34435 - RNA, 22 nt, Pseudomonas putida KT2440
ccuggaugaagucgagcucgcu

SEQ ID NO: 34436 - RNA, 22 nt, Pseudomonas putida KT2440
ccuggcaccgugugggagcggg

SEQ ID NO: 34437 - RNA, 22 nt, Pseudomonas putida KT2440
ccuggcuuuucaugccggagaa

SEQ ID NO: 34438 - RNA, 22 nt, Pseudomonas putida KT2440
ccuggguaccgguugugugcug

SEQ ID NO: 34439 - RNA, 22 nt, Pseudomonas putida KT2440
ccuguaggaacggcuuuagccg

SEQ ID NO: 34440 - RNA, 22 nt, Pseudomonas putida KT2440
ccuguaggagcggcuuuagccg

SEQ ID NO: 34441 - RNA, 22 nt, Pseudomonas putida KT2440
ccugugcugcaccugugggagc

SEQ ID NO: 34442 - RNA, 20 nt, Pseudomonas putida KT2440
ccuguucagccuucaccucg

SEQ ID NO: 34443 - RNA, 23 nt, Pseudomonas putida KT2440
ccuguucgaagguuuggcgauca

SEQ ID NO: 34444 - RNA, 22 nt, Pseudomonas putida KT2440
ccuguucggucuugccgaccca

SEQ ID NO: 34445 - RNA, 22 nt, Pseudomonas putida KT2440
ccuguuugcugugcgacagcgc

SEQ ID NO: 34446 - RNA, 22 nt, Pseudomonas putida KT2440
cgaacaguagaagcccuccucg

SEQ ID NO: 34447 - RNA, 22 nt, Pseudomonas putida KT2440
cgaagggccgcaaggcggcccc

SEQ ID NO: 34448 - RNA, 22 nt, Pseudomonas putida KT2440
cgaaggugggcaggcuggagcc

SEQ ID NO: 34449 - RNA, 21 nt, Pseudomonas putida KT2440
cgaaucuguucgucgcugggc

SEQ ID NO: 34450 - RNA, 22 nt, Pseudomonas putida KT2440
cgacaggucagugaacggcagu

SEQ ID NO: 34451 - RNA, 22 nt, Pseudomonas putida KT2440
cgacgcaaggccgcucccacag

SEQ ID NO: 34452 - RNA, 22 nt, Pseudomonas putida KT2440
cgagauggucaacggcaauuuc

SEQ ID NO: 34453 - RNA, 22 nt, Pseudomonas putida KT2440
cgagcaccagcaguugcuugcg

SEQ ID NO: 34454 - RNA, 22 nt, Pseudomonas putida KT2440
cgagcaugugaucgacagccgu

SEQ ID NO: 34455 - RNA, 22 nt, Pseudomonas putida KT2440
cgagcauugucuggauccguuu

SEQ ID NO: 34456 - RNA, 22 nt, Pseudomonas putida KT2440
cgagccacagcgccuggucgcc

SEQ ID NO: 34457 - RNA, 22 nt, Pseudomonas putida KT2440
cgagcgcagcaggcccuuggcc

SEQ ID NO: 34458 - RNA, 22 nt, Pseudomonas putida KT2440
cgaggaccaggcugaaguuguc

SEQ ID NO: 34459 - RNA, 22 nt, Pseudomonas putida KT2440
cgaggcuugaggccuggcaguc

SEQ ID NO: 34460 - RNA, 22 nt, Pseudomonas putida KT2440
cgagguuggcagccuggcaaug

SEQ ID NO: 34461 - RNA, 22 nt, Pseudomonas putida KT2440
cgaguugucugcuucgcgggcg

SEQ ID NO: 34462 - RNA, 22 nt, Pseudomonas putida KT2440
cgauaccugcgcaagcggcuug

SEQ ID NO: 34463 - RNA, 22 nt, Pseudomonas putida KT2440
cgauagcgguauaucgaggacu

SEQ ID NO: 34464 - RNA, 22 nt, Pseudomonas putida KT2440
cgauaggcuugcugaaggucuu

SEQ ID NO: 34465 - RNA, 22 nt, Pseudomonas putida KT2440
cgaugacgucacccuguaccag

SEQ ID NO: 34466 - RNA, 22 nt, Pseudomonas putida KT2440
cgaugcagcgauuggcgguggu

SEQ ID NO: 34467 - RNA, 22 nt, Pseudomonas putida KT2440
cgaugcucuggagucggccuuu

SEQ ID NO: 34468 - RNA, 22 nt, Pseudomonas putida KT2440
cgauggaaauggugcgcauggu

SEQ ID NO: 34469 - RNA, 22 nt, Pseudomonas putida KT2440
cgauggccguacgguagugcuc

SEQ ID NO: 34470 - RNA, 20 nt, Pseudomonas putida KT2440
cgcacugcuggcccaaggca

SEQ ID NO: 34471 - RNA, 22 nt, Pseudomonas putida KT2440
cgcauucacagguaaacccgcg

SEQ ID NO: 34472 - RNA, 22 nt, Pseudomonas putida KT2440
cgcauucgcggguaaacccggg

SEQ ID NO: 34473 - RNA, 22 nt, Pseudomonas putida KT2440
cgcauucgcggguaagccuguu

SEQ ID NO: 34474 - RNA, 22 nt, Pseudomonas putida KT2440
cgccacagcucugaagguucga

SEQ ID NO: 34475 - RNA, 22 nt, Pseudomonas putida KT2440
cgccagcucgucgagcaggccg

SEQ ID NO: 34476 - RNA, 22 nt, Pseudomonas putida KT2440
cgcccaugaccuccugacgccu

SEQ ID NO: 34477 - RNA, 22 nt, Pseudomonas putida KT2440
cgccgacuuugaacuggacccg

SEQ ID NO: 34478 - RNA, 22 nt, Pseudomonas putida KT2440
cgccgaguucugccuggugucg

SEQ ID NO: 34479 - RNA, 22 nt, Pseudomonas putida KT2440
cgccguguaacaguugcuucuc

SEQ ID NO: 34480 - RNA, 22 nt, Pseudomonas putida KT2440
cgccucgaaguugcgcgccugc

SEQ ID NO: 34481 - RNA, 22 nt, Pseudomonas putida KT2440
cgccugcaagaguugcugcugg

SEQ ID NO: 34482 - RNA, 23 nt, Pseudomonas putida KT2440
cgccuucgagcgcaagguacucg

SEQ ID NO: 34483 - RNA, 22 nt, Pseudomonas putida KT2440
cgccuuggccagcaguuugccg

SEQ ID NO: 34484 - RNA, 22 nt, Pseudomonas putida KT2440
cgccuuggcgaucaaggcacaa

SEQ ID NO: 34485 - RNA, 22 nt, Pseudomonas putida KT2440
cgcgagcuggccgagggcucgc

SEQ ID NO: 34486 - RNA, 22 nt, Pseudomonas putida KT2440
cgcgcucaagcaacacuugcca

SEQ ID NO: 34487 - RNA, 22 nt, Pseudomonas putida KT2440
cgcgcuugccagggguagccaa

SEQ ID NO: 34488 - RNA, 22 nt, Pseudomonas putida KT2440
cgugccuucggcaggaaauccu

SEQ ID NO: 34489 - RNA, 22 nt, Pseudomonas putida KT2440
cgugcgcauugccgucgagccg

SEQ ID NO: 34490 - RNA, 22 nt, Pseudomonas putida KT2440
cgugcgcuggacgaagugcgcc

SEQ ID NO: 34491 - RNA, 22 nt, Pseudomonas putida KT2440
cguggcacugcgucaaaacccg

SEQ ID NO: 34492 - RNA, 22 nt, Pseudomonas putida KT2440
cguggcuucgucgcgggccugg

SEQ ID NO: 34493 - RNA, 22 nt, Pseudomonas putida KT2440
cguggguacaccaggaaggucg

SEQ ID NO: 34494 - RNA, 22 nt, Pseudomonas putida KT2440
cgugucgccugauucgcgggca

SEQ ID NO: 34495 - RNA, 23 nt, Pseudomonas putida KT2440
cguugugcaccggugugauggac

SEQ ID NO: 34496 - RNA, 22 nt, Pseudomonas putida KT2440
cuacaucgauaucuucguggcc

SEQ ID NO: 34497 - RNA, 22 nt, Pseudomonas putida KT2440
cuacgcaucgacuggucgucca

SEQ ID NO: 34498 - RNA, 20 nt, Pseudomonas putida KT2440
cuaucgacaggauuuuuauu

SEQ ID NO: 34499 - RNA, 21 nt, Pseudomonas putida KT2440
cucaaucccucgcaucugugg

SEQ ID NO: 34500 - RNA, 22 nt, Pseudomonas putida KT2440
cucaccgaaguauucgauaagg

SEQ ID NO: 34501 - RNA, 22 nt, Pseudomonas putida KT2440
cucccaggccgccaggucugcc

SEQ ID NO: 34502 - RNA, 22 nt, Pseudomonas putida KT2440
cucgaacauuucgccgccggcc

SEQ ID NO: 34503 - RNA, 22 nt, Pseudomonas putida KT2440
cucgagcaugauuugcuggcca

SEQ ID NO: 34504 - RNA, 22 nt, Pseudomonas putida KT2440
cucggccugcuucagcaaggcu

SEQ ID NO: 34505 - RNA, 22 nt, Pseudomonas putida KT2440
cucgggcucgcccgcucccaca

SEQ ID NO: 34506 - RNA, 22 nt, Pseudomonas putida KT2440
cucgguaccuggcugcaggaac

SEQ ID NO: 34507 - RNA, 22 nt, Pseudomonas putida KT2440
cucggucacccgcagcguggcc

SEQ ID NO: 34508 - RNA, 22 nt, Pseudomonas putida KT2440
cucggucggccgggguaaaagc

SEQ ID NO: 34509 - RNA, 22 nt, Pseudomonas putida KT2440
cucgugguccgacucgucgcgc

SEQ ID NO: 34510 - RNA, 22 nt, Pseudomonas putida KT2440
cugacaggccuggugguguucg

SEQ ID NO: 34511 - RNA, 22 nt, Pseudomonas putida KT2440
cugagcgugcugacagcggcca

SEQ ID NO: 34512 - RNA, 22 nt, Pseudomonas putida KT2440
cugagcguugucgaacacgccc

SEQ ID NO: 34513 - RNA, 22 nt, Pseudomonas putida KT2440
cugaggauagagucgccaccga

SEQ ID NO: 34514 - RNA, 22 nt, Pseudomonas putida KT2440
cugaucaagcccuucgcuuucu

SEQ ID NO: 34515 - RNA, 22 nt, Pseudomonas putida KT2440
cugcagcagccuggcggcggca

SEQ ID NO: 34516 - RNA, 20 nt, Pseudomonas putida KT2440
cugccaaaggugcauugccg

SEQ ID NO: 34517 - RNA, 22 nt, Pseudomonas putida KT2440
cugccagggcuacggcacgccg

SEQ ID NO: 34518 - RNA, 21 nt, Pseudomonas putida KT2440
cugccgaggucauugccgagc

SEQ ID NO: 34519 - RNA, 22 nt, Pseudomonas putida KT2440
cugccgguuccuuguucggucg

SEQ ID NO: 34520 - RNA, 22 nt, Pseudomonas putida KT2440
cugcgcugucuuccggcagcug

SEQ ID NO: 34521 - RNA, 22 nt, Pseudomonas putida KT2440
cugcggcaggcgcucuagugcg

SEQ ID NO: 34522 - RNA, 18 nt, Pseudomonas putida KT2440
cugcugcugcggaugaau

SEQ ID NO: 34523 - RNA, 18 nt, Pseudomonas putida KT2440
cugcuggcugaccgcgcc

SEQ ID NO: 34524 - RNA, 22 nt, Pseudomonas putida KT2440
cugcuguucggcauugaccaug

SEQ ID NO: 34525 - RNA, 22 nt, Pseudomonas putida KT2440
cugcuugacgagauguaccgga

SEQ ID NO: 34526 - RNA, 22 nt, Pseudomonas putida KT2440
cuggaaauggccaaggcgcuga

SEQ ID NO: 34527 - RNA, 22 nt, Pseudomonas putida KT2440
cuggaacugggcgucaagcacg

SEQ ID NO: 34528 - RNA, 22 nt, Pseudomonas putida KT2440
cuggagcugcgccucaagcaga

SEQ ID NO: 34529 - RNA, 22 nt, Pseudomonas putida KT2440
cuggaugucgucgaggucguag

SEQ ID NO: 34530 - RNA, 22 nt, Pseudomonas putida KT2440
cuggcaauguagccuucgauga

SEQ ID NO: 34531 - RNA, 22 nt, Pseudomonas putida KT2440
cuggcaguggcugaccaccugu

SEQ ID NO: 34532 - RNA, 22 nt, Pseudomonas putida KT2440
cuggccagcggcgugcagcuga

SEQ ID NO: 34533 - RNA, 22 nt, Pseudomonas putida KT2440
cuggcgcugauggcauacaccg

SEQ ID NO: 34534 - RNA, 22 nt, Pseudomonas putida KT2440
cuggcgucugugagaucgagcg

SEQ ID NO: 34535 - RNA, 22 nt, Pseudomonas putida KT2440
cugggcuacgagguaggguuga

SEQ ID NO: 34536 - RNA, 22 nt, Pseudomonas putida KT2440
cugggugaauaccugcagcgcc

SEQ ID NO: 34537 - RNA, 22 nt, Pseudomonas putida KT2440
cugggugauccccggcgggcau

SEQ ID NO: 34538 - RNA, 22 nt, Pseudomonas putida KT2440
cuggucagaaccuggaaaugag

SEQ ID NO: 34539 - RNA, 22 nt, Pseudomonas putida KT2440
cuggucuggccucuucgcgggu

SEQ ID NO: 34540 - RNA, 22 nt, Pseudomonas putida KT2440
cuggugaugaguacgaccccau

SEQ ID NO: 34541 - RNA, 21 nt, Pseudomonas putida KT2440
cugguucucgaccugguuguu

SEQ ID NO: 34542 - RNA, 22 nt, Pseudomonas putida KT2440
cugguugcguucgucgaugucu

SEQ ID NO: 34543 - RNA, 22 nt, Pseudomonas putida KT2440
cugucggugccgaucggcgcga

SEQ ID NO: 34544 - RNA, 22 nt, Pseudomonas putida KT2440
cugugagccgcccguggugcgg

SEQ ID NO: 34545 - RNA, 22 nt, Pseudomonas putida KT2440
cugugcuguaccugugggagcg

SEQ ID NO: 34546 - RNA, 22 nt, Pseudomonas putida KT2440
cugugggagcggccuugugucg

SEQ ID NO: 34547 - RNA, 22 nt, Pseudomonas putida KT2440
cuguucgacuuccagccgcugg

SEQ ID NO: 34548 - RNA, 22 nt, Pseudomonas putida KT2440
cuguucgucgagaugccuucgu

SEQ ID NO: 34549 - RNA, 22 nt, Pseudomonas putida KT2440
cuucaagcugcaagaaaaagca

SEQ ID NO: 34550 - RNA, 22 nt, Pseudomonas putida KT2440
cuucacgcugcacgacaaugca

SEQ ID NO: 34551 - RNA, 22 nt, Pseudomonas putida KT2440
cuucaguacauugcuggugcuc

SEQ ID NO: 34552 - RNA, 22 nt, Pseudomonas putida KT2440
cuucgccaugcaaggcgccgug

SEQ ID NO: 34553 - RNA, 22 nt, Pseudomonas putida KT2440
cuucgcggguaaacccgccccu

SEQ ID NO: 34554 - RNA, 22 nt, Pseudomonas putida KT2440
cuucgcggguaaacccgcuccu

SEQ ID NO: 34555 - RNA, 22 nt, Pseudomonas putida KT2440
cuucggcagcaaagguggcgga

SEQ ID NO: 34556 - RNA, 22 nt, Pseudomonas putida KT2440
cuucggccugggccacggcggg

SEQ ID NO: 34557 - RNA, 22 nt, Pseudomonas putida KT2440
cuugagccuuggacgccuggcc

SEQ ID NO: 34558 - RNA, 22 nt, Pseudomonas putida KT2440
cuugagcuguggauggcgcgcc

SEQ ID NO: 34559 - RNA, 22 nt, Pseudomonas putida KT2440
cuugcaugauucggcuauucau

SEQ ID NO: 34560 - RNA, 22 nt, Pseudomonas putida KT2440
cuugccugauguaaucagcgau

SEQ ID NO: 34561 - RNA, 22 nt, Pseudomonas putida KT2440
cuugccuggcgucgagaauggc

SEQ ID NO: 34562 - RNA, 22 nt, Pseudomonas putida KT2440
cuugucggacgaugcagccucu

SEQ ID NO: 34563 - RNA, 22 nt, Pseudomonas putida KT2440
cuuucgcggguaaacccgcucc

SEQ ID NO: 34564 - RNA, 22 nt, Pseudomonas putida KT2440
gaacaacgcgguugucguuggc

SEQ ID NO: 34565 - RNA, 22 nt, Pseudomonas putida KT2440
gaacaggccgcgccugcuuaaa

SEQ ID NO: 34566 - RNA, 22 nt, Pseudomonas putida KT2440
gaacaggccgcgccugcuuaca

SEQ ID NO: 34567 - RNA, 22 nt, Pseudomonas putida KT2440
gaacccgcuccuacgacgggcu

SEQ ID NO: 34568 - RNA, 22 nt, Pseudomonas putida KT2440
gaacgcaaagcggcgacuuggc

SEQ ID NO: 34569 - RNA, 22 nt, Pseudomonas putida KT2440
gaaugcaccagcaccaguucga

SEQ ID NO: 34570 - RNA, 22 nt, Pseudomonas putida KT2440
gacacguuguucgcgcgcuguu

SEQ ID NO: 34571 - RNA, 22 nt, Pseudomonas putida KT2440
gacagcacaugccucaagcuga

SEQ ID NO: 34572 - RNA, 23 nt, Pseudomonas putida KT2440
gacagccaugcccuggucggcga

SEQ ID NO: 34573 - RNA, 20 nt, Pseudomonas putida KT2440
gcauucgcggguaaacccgc

SEQ ID NO: 34574 - RNA, 19 nt, Pseudomonas putida KT2440
gcauucgucacaggucacc

SEQ ID NO: 34575 - RNA, 18 nt, Pseudomonas putida KT2440
gccaaaugccuccagcuc

SEQ ID NO: 34576 - RNA, 23 nt, Pseudomonas putida KT2440
gccaacgaguuguuacgccgcuc

SEQ ID NO: 34577 - RNA, 22 nt, Pseudomonas putida KT2440
gccaggaccuggaccuguuccg

SEQ ID NO: 34578 - RNA, 22 nt, Pseudomonas putida KT2440
gccaggagcugacgccacuguu

SEQ ID NO: 34579 - RNA, 20 nt, Pseudomonas putida KT2440
gccagguagauggugucggg

SEQ ID NO: 34580 - RNA, 22 nt, Pseudomonas putida KT2440
gccaggucacugagcagcuggg

SEQ ID NO: 34581 - RNA, 22 nt, Pseudomonas putida KT2440
gccagugggcggugcaggcgca

SEQ ID NO: 34582 - RNA, 22 nt, Pseudomonas putida KT2440
gcccgucagcuuggcauggcca

SEQ ID NO: 34583 - RNA, 22 nt, Pseudomonas putida KT2440
gcccuggucgacgccaugggcg

SEQ ID NO: 34584 - RNA, 22 nt, Pseudomonas putida KT2440
gccgaccagccacugggccggg

SEQ ID NO: 34585 - RNA, 22 nt, Pseudomonas putida KT2440
gccgagaucaugcgcaacaccg

SEQ ID NO: 34586 - RNA, 22 nt, Pseudomonas putida KT2440
gccgauggccaugacuucaccc

SEQ ID NO: 34587 - RNA, 22 nt, Pseudomonas putida KT2440
gccgauguuggcggcggcgaac

SEQ ID NO: 34588 - RNA, 22 nt, Pseudomonas putida KT2440
gccgcugugcacccgggccaca

SEQ ID NO: 34589 - RNA, 22 nt, Pseudomonas putida KT2440
gccgcuuguacgcaguggcgag

SEQ ID NO: 34590 - RNA, 22 nt, Pseudomonas putida KT2440
gccggcaacaacgugcucggua

SEQ ID NO: 34591 - RNA, 22 nt, Pseudomonas putida KT2440
gccggcaugcgaggcaaacugu

SEQ ID NO: 34592 - RNA, 22 nt, Pseudomonas putida KT2440
gccgucaauguacagggccgcg

SEQ ID NO: 34593 - RNA, 22 nt, Pseudomonas putida KT2440
gccgucgacgcggcggcugauc

SEQ ID NO: 34594 - RNA, 22 nt, Pseudomonas putida KT2440
gccgugcucccagcggguacgu

SEQ ID NO: 34595 - RNA, 22 nt, Pseudomonas putida KT2440
gccguugccuggcggcgcucgg

SEQ ID NO: 34596 - RNA, 22 nt, Pseudomonas putida KT2440
gccucgguaucgccgugaccgg

SEQ ID NO: 34597 - RNA, 22 nt, Pseudomonas putida KT2440
gccugccaaccggccagcagga

SEQ ID NO: 34598 - RNA, 22 nt, Pseudomonas putida KT2440
gccuggacaugguacgaacggg

SEQ ID NO: 34599 - RNA, 22 nt, Pseudomonas putida KT2440
gccuggaucaguucggcgaugg

SEQ ID NO: 34600 - RNA, 22 nt, Pseudomonas putida KT2440
gccuggcugucggcuaccaccg

SEQ ID NO: 34601 - RNA, 22 nt, Pseudomonas putida KT2440
gccugggagaucgagcgccgcc

SEQ ID NO: 34602 - RNA, 22 nt, Pseudomonas putida KT2440
gccugguacagugcaacggugu

SEQ ID NO: 34603 - RNA, 22 nt, Pseudomonas putida KT2440
gccuucgacgaugaacaccacg

SEQ ID NO: 34604 - RNA, 22 nt, Pseudomonas putida KT2440
gccuugcacgcuucaagggcgc

SEQ ID NO: 34605 - RNA, 22 nt, Pseudomonas putida KT2440
gccuuggcugcuggcacguugu

SEQ ID NO: 34606 - RNA, 21 nt, Pseudomonas putida KT2440
gccuugucgaugucaucgcgc

SEQ ID NO: 34607 - RNA, 22 nt, Pseudomonas putida KT2440
gcgaaccagcuacggcgcugcu

SEQ ID NO: 34608 - RNA, 22 nt, Pseudomonas putida KT2440
gcgaagccaaagaugccgagca

SEQ ID NO: 34609 - RNA, 22 nt, Pseudomonas putida KT2440
gcgaagcggccagaacaggcaa

SEQ ID NO: 34610 - RNA, 20 nt, Pseudomonas putida KT2440
gcgagcgucggcccuggaug

SEQ ID NO: 34611 - RNA, 22 nt, Pseudomonas putida KT2440
gcgaucgcguuccgcguacggu

SEQ ID NO: 34612 - RNA, 22 nt, Pseudomonas putida KT2440
gcgauggcgucgacaaugagcu

SEQ ID NO: 34613 - RNA, 22 nt, Pseudomonas putida KT2440
gcgauguucaccagauagccuu

SEQ ID NO: 34614 - RNA, 22 nt, Pseudomonas putida KT2440
gcgcaagaggcggcgaucaucu

SEQ ID NO: 34615 - RNA, 22 nt, Pseudomonas putida KT2440
gcgcaccaggaugcccgcggca

SEQ ID NO: 34616 - RNA, 22 nt, Pseudomonas putida KT2440
gcgcaggucggcagcaaucggc

SEQ ID NO: 34617 - RNA, 22 nt, Pseudomonas putida KT2440
gcgcagucguuguaggagcggg

SEQ ID NO: 34618 - RNA, 22 nt, Pseudomonas putida KT2440
gcgcaugcugcuuggucacgaa

SEQ ID NO: 34619 - RNA, 22 nt, Pseudomonas putida KT2440
gcgcauggcguccagcugcucu

SEQ ID NO: 34620 - RNA, 22 nt, Pseudomonas putida KT2440
gcgcauguaggucgacuuaccg

SEQ ID NO: 34621 - RNA, 22 nt, Pseudomonas putida KT2440
gcgccugugagaccgagcgccg

SEQ ID NO: 34622 - RNA, 22 nt, Pseudomonas putida KT2440
gcgcugacgcuguuguugccuc

SEQ ID NO: 34623 - RNA, 22 nt, Pseudomonas putida KT2440
gcgcuggucuucgccacggugg

SEQ ID NO: 34624 - RNA, 21 nt, Pseudomonas putida KT2440
gcgcuguacauugacgaucgc

SEQ ID NO: 34625 - RNA, 22 nt, Pseudomonas putida KT2440
gcgcugugacgaccugcuggcg

SEQ ID NO: 34626 - RNA, 20 nt, Pseudomonas putida KT2440
gcggagcagaagaacaacac

SEQ ID NO: 34627 - RNA, 22 nt, Pseudomonas putida KT2440
gcggauuggcugcgacucaggu

SEQ ID NO: 34628 - RNA, 22 nt, Pseudomonas putida KT2440
gcggccaaccacuucaucgagg

SEQ ID NO: 34629 - RNA, 22 nt, Pseudomonas putida KT2440
gcggccauccuguaggagcggg

SEQ ID NO: 34630 - RNA, 22 nt, Pseudomonas putida KT2440
gcggcgaucuggauguugcagg

SEQ ID NO: 34631 - RNA, 22 nt, Pseudomonas putida KT2440
gcggcgaucuucaccgaaaugu

SEQ ID NO: 34632 - RNA, 22 nt, Pseudomonas putida KT2440
gcgggcuugcccgcucccacag

SEQ ID NO: 34633 - RNA, 22 nt, Pseudomonas putida KT2440
gcggguaaacccgcuccuacaa

SEQ ID NO: 34634 - RNA, 22 nt, Pseudomonas putida KT2440
gcggguaaacccgcuccuacga

SEQ ID NO: 34635 - RNA, 22 nt, Pseudomonas putida KT2440
gcggucaguggcuucaucgguc

SEQ ID NO: 34636 - RNA, 22 nt, Pseudomonas putida KT2440
gcgguuccagguuacgccgaug

SEQ ID NO: 34637 - RNA, 22 nt, Pseudomonas putida KT2440
gcgugauacguugcagcaucug

SEQ ID NO: 34638 - RNA, 22 nt, Pseudomonas putida KT2440
gcgugcguaaccuggcugguuu

SEQ ID NO: 34639 - RNA, 22 nt, Pseudomonas putida KT2440
gcguucggauuuuucuucagca

SEQ ID NO: 34640 - RNA, 22 nt, Pseudomonas putida KT2440
gcguucuaccgcuggcuggcau

SEQ ID NO: 34641 - RNA, 22 nt, Pseudomonas putida KT2440
gcguugccgguguucgcgggca

SEQ ID NO: 34642 - RNA, 22 nt, Pseudomonas putida KT2440
gcguugccugcuucgcggguga

SEQ ID NO: 34643 - RNA, 22 nt, Pseudomonas putida KT2440
gcuaaagccgugccugcagggg

SEQ ID NO: 34644 - RNA, 22 nt, Pseudomonas putida KT2440
gcuacgaccggcaucugcgcua

SEQ ID NO: 34645 - RNA, 22 nt, Pseudomonas putida KT2440
gcucacugaacgaggugcagcu

SEQ ID NO: 34646 - RNA, 22 nt, Pseudomonas putida KT2440
gcucauccacauagcgcgcccc

SEQ ID NO: 34647 - RNA, 22 nt, Pseudomonas putida KT2440
gcucccacaaggcuugcaaaga

SEQ ID NO: 34648 - RNA, 22 nt, Pseudomonas putida KT2440
gcucccacaggaucaccacaug

SEQ ID NO: 34649 - RNA, 22 nt, Pseudomonas putida KT2440
gcucgcugaucaugccggugau

SEQ ID NO: 34650 - RNA, 22 nt, Pseudomonas putida KT2440
gcucggucucacaggcgcugaa

SEQ ID NO: 34651 - RNA, 22 nt, Pseudomonas putida KT2440
gcucuucgcgagcgagucagac

SEQ ID NO: 34652 - RNA, 22 nt, Pseudomonas putida KT2440
gcugaaccugugggagcgggca

SEQ ID NO: 34653 - RNA, 22 nt, Pseudomonas putida KT2440
gcugaacugguggcgcugcagc

SEQ ID NO: 34654 - RNA, 19 nt, Pseudomonas putida KT2440
gcugcaggggcaccacagc

SEQ ID NO: 34655 - RNA, 22 nt, Pseudomonas putida KT2440
gcugcauuggucgugacgcucg

SEQ ID NO: 34656 - RNA, 22 nt, Pseudomonas putida KT2440
gcugccaaagaaacugugggac

SEQ ID NO: 34657 - RNA, 22 nt, Pseudomonas putida KT2440
gcugccacgcccaucugcguca

SEQ ID NO: 34658 - RNA, 22 nt, Pseudomonas putida KT2440
gguggccaccgcgcuugcagcg

SEQ ID NO: 34659 - RNA, 22 nt, Pseudomonas putida KT2440
gguggccugcgucagccaggcc

SEQ ID NO: 34660 - RNA, 22 nt, Pseudomonas putida KT2440
gguggccugcugaaaaugccac

SEQ ID NO: 34661 - RNA, 22 nt, Pseudomonas putida KT2440
gguugcaccgguguucgcgggu

SEQ ID NO: 34662 - RNA, 22 nt, Pseudomonas putida KT2440
gguuguccggggucugcacggc

SEQ ID NO: 34663 - RNA, 22 nt, Pseudomonas putida KT2440
gguuuacccgugaagaggcugg

SEQ ID NO: 34664 - RNA, 22 nt, Pseudomonas putida KT2440
guaaacccgcuccuacaggauc

SEQ ID NO: 34665 - RNA, 22 nt, Pseudomonas putida KT2440
guaaacccgcuccuaccagggg

SEQ ID NO: 34666 - RNA, 22 nt, Pseudomonas putida KT2440
guacccugcaucggggcguuga

SEQ ID NO: 34667 - RNA, 22 nt, Pseudomonas putida KT2440
guaccgagcacguuguugccgg

SEQ ID NO: 34668 - RNA, 22 nt, Pseudomonas putida KT2440
guacgccgaucuccgacaggcg

SEQ ID NO: 34669 - RNA, 22 nt, Pseudomonas putida KT2440
guacgucuggagcgcgaaaggu

SEQ ID NO: 34670 - RNA, 22 nt, Pseudomonas putida KT2440
guagccgucggcacgcaggacg

SEQ ID NO: 34671 - RNA, 23 nt, Pseudomonas putida KT2440
guaggcagccacuuccaggugga

SEQ ID NO: 34672 - RNA, 22 nt, Pseudomonas putida KT2440
guauucgcggguaaacccgcuc

SEQ ID NO: 34673 - RNA, 20 nt, Pseudomonas putida KT2440
gucagcauggcguuagucca

SEQ ID NO: 34674 - RNA, 22 nt, Pseudomonas putida KT2440
gucagcgaggugauggcaccgu

SEQ ID NO: 34675 - RNA, 22 nt, Pseudomonas putida KT2440
gucauuggucgugcgcaggcca

SEQ ID NO: 34676 - RNA, 22 nt, Pseudomonas putida KT2440
guccaccacugucaaacgcuuc

SEQ ID NO: 34677 - RNA, 22 nt, Pseudomonas putida KT2440
guccgccauggcgaagcggggu

SEQ ID NO: 34678 - RNA, 22 nt, Pseudomonas putida KT2440
guccugaaccaugucgcgcugg

SEQ ID NO: 34679 - RNA, 22 nt, Pseudomonas putida KT2440
gucgaagaggccgccaccggca

SEQ ID NO: 34680 - RNA, 22 nt, Pseudomonas putida KT2440
gucgaccgaauaacuguuggca

SEQ ID NO: 34681 - RNA, 22 nt, Pseudomonas putida KT2440
gucgauggcacuggcgguguug

SEQ ID NO: 34682 - RNA, 22 nt, Pseudomonas putida KT2440
gucgccuaugccggacgcaagc

SEQ ID NO: 34683 - RNA, 22 nt, Pseudomonas putida KT2440
gucgccuugcaacguaccccac

SEQ ID NO: 34684 - RNA, 22 nt, Pseudomonas putida KT2440
gucgcguucguugagguacagg

SEQ ID NO: 34685 - RNA, 22 nt, Pseudomonas putida KT2440
gucggccagagccuucaguucg

SEQ ID NO: 34686 - RNA, 22 nt, Pseudomonas putida KT2440
gucggccagguaggcgucgacg

SEQ ID NO: 34687 - RNA, 22 nt, Pseudomonas putida KT2440
gucggcguugaaaguaucgguu

SEQ ID NO: 34688 - RNA, 22 nt, Pseudomonas putida KT2440
gucugaucgaacguucuggccg

SEQ ID NO: 34689 - RNA, 22 nt, Pseudomonas putida KT2440
gucuggccuuccggugccuggu

SEQ ID NO: 34690 - RNA, 22 nt, Pseudomonas putida KT2440
gucuucggcggcuugcugagcg

SEQ ID NO: 34691 - RNA, 22 nt, Pseudomonas putida KT2440
gugaaaccaaacgcuugcaagc

SEQ ID NO: 34692 - RNA, 22 nt, Pseudomonas putida KT2440
gugaaaugcagggcaaaaagaa

SEQ ID NO: 34693 - RNA, 22 nt, Pseudomonas putida KT2440
gugaaaugcaggguaaaaagaa

SEQ ID NO: 34694 - RNA, 22 nt, Pseudomonas putida KT2440
gugaacggccgucacacaggcg

SEQ ID NO: 34695 - RNA, 22 nt, Pseudomonas putida KT2440
gugaacggcuguuccagcuguc

SEQ ID NO: 34696 - RNA, 22 nt, Pseudomonas putida KT2440
gugaacuguucggcgaccgugg

SEQ ID NO: 34697 - RNA, 22 nt, Pseudomonas putida KT2440
gugaagauccccguaggagcgg

SEQ ID NO: 34698 - RNA, 22 nt, Pseudomonas putida KT2440
gugacgaucgcaggcagguuca

SEQ ID NO: 34699 - RNA, 22 nt, Pseudomonas putida KT2440
gugauaccugugggagcgggcg

SEQ ID NO: 34700 - RNA, 22 nt, Pseudomonas putida KT2440
gugaugucgcugauccugcugg

SEQ ID NO: 34701 - RNA, 22 nt, Pseudomonas putida KT2440
gugcaauaccugugggagcggg

SEQ ID NO: 34702 - RNA, 22 nt, Pseudomonas putida KT2440
gugcagcgccugccagaucgug

SEQ ID NO: 34703 - RNA, 21 nt, Pseudomonas putida KT2440
gugcagguuuugucaguaccc

SEQ ID NO: 34704 - RNA, 22 nt, Pseudomonas putida KT2440
gugcagugacuuuaccgucgaa

SEQ ID NO: 34705 - RNA, 22 nt, Pseudomonas putida KT2440
gugcaguugcaggccagguugc

SEQ ID NO: 34706 - RNA, 22 nt, Pseudomonas putida KT2440
gugccaaugggcgccggcgcug

SEQ ID NO: 34707 - RNA, 22 nt, Pseudomonas putida KT2440
gugccguuggccggcacgguga

SEQ ID NO: 34708 - RNA, 22 nt, Pseudomonas putida KT2440
gugcgccaggcaaagcgcuucg

SEQ ID NO: 34709 - RNA, 22 nt, Pseudomonas putida KT2440
gugcgcugcugugggucgaggu

SEQ ID NO: 34710 - RNA, 22 nt, Pseudomonas putida KT2440
gugcggaacugcgcgccaaggc

SEQ ID NO: 34711 - RNA, 22 nt, Pseudomonas putida KT2440
gugcggcuucuucgcggcugua

SEQ ID NO: 34712 - RNA, 21 nt, Pseudomonas putida KT2440
gugcugcgcccuugccuggca

SEQ ID NO: 34713 - RNA, 22 nt, Pseudomonas putida KT2440
gugcuggaaaaccugugccugg

SEQ ID NO: 34714 - RNA, 22 nt, Pseudomonas putida KT2440
guggacgaggugguuuucgacg

SEQ ID NO: 34715 - RNA, 22 nt, Pseudomonas putida KT2440
guggcaugcgccuguuccagac

SEQ ID NO: 34716 - RNA, 22 nt, Pseudomonas putida KT2440
guggccacuggcauugucgggc

SEQ ID NO: 34717 - RNA, 22 nt, Pseudomonas putida KT2440
guggcccugggcaguaccggcg

SEQ ID NO: 34718 - RNA, 22 nt, Pseudomonas putida KT2440
guggccgaggucggccugaucg

SEQ ID NO: 34719 - RNA, 22 nt, Pseudomonas putida KT2440
guggcgaucugccgguucaugu

SEQ ID NO: 34720 - RNA, 22 nt, Pseudomonas putida KT2440
guggcugacagaguccugcaca

SEQ ID NO: 34721 - RNA, 22 nt, Pseudomonas putida KT2440
gugguacguaacacgcguugaa

SEQ ID NO: 34722 - RNA, 22 nt, Pseudomonas putida KT2440
guggugcauugcaaauaagcga

SEQ ID NO: 34723 - RNA, 22 nt, Pseudomonas putida KT2440
guguaggcgaucugcuuguucg

SEQ ID NO: 34724 - RNA, 22 nt, Pseudomonas putida KT2440
guguucaccgcaccugugggca

SEQ ID NO: 34725 - RNA, 22 nt, Pseudomonas putida KT2440
guucgagacgggagcagaguug

SEQ ID NO: 34726 - RNA, 22 nt, Pseudomonas putida KT2440
guucgcgggcaagcccgcuccu

SEQ ID NO: 34727 - RNA, 22 nt, Pseudomonas putida KT2440
guucggcgaagcccaggguguc

SEQ ID NO: 34728 - RNA, 22 nt, Pseudomonas putida KT2440
guucuggcucagguacugguua

SEQ ID NO: 34729 - RNA, 22 nt, Pseudomonas putida KT2440
guugccaaggcgauugaagucg

SEQ ID NO: 34730 - RNA, 22 nt, Pseudomonas putida KT2440
guugccacuggugcugcugcag

SEQ ID NO: 34731 - RNA, 22 nt, Pseudomonas putida KT2440
guugcccagaugauccaaccag

SEQ ID NO: 34732 - RNA, 22 nt, Pseudomonas putida KT2440
guugccgcacaggccuugcggg

SEQ ID NO: 34733 - RNA, 22 nt, Pseudomonas putida KT2440
guugccgcugcguacgcccuug

SEQ ID NO: 34734 - RNA, 22 nt, Pseudomonas putida KT2440
guugccuguccccgcgggccug

SEQ ID NO: 34735 - RNA, 22 nt, Pseudomonas putida KT2440
guugcucuucaggcggcgcugg

SEQ ID NO: 34736 - RNA, 22 nt, Pseudomonas putida KT2440
guuguucaugauuucagugccg

SEQ ID NO: 34737 - RNA, 22 nt, Pseudomonas putida KT2440
uacacccuaccggcaggcaggu

SEQ ID NO: 34738 - RNA, 22 nt, Pseudomonas putida KT2440
uacacgggcguagacugcgggc

SEQ ID NO: 34739 - RNA, 22 nt, Pseudomonas putida KT2440
uacagccuuggggagcguccgu

SEQ ID NO: 34740 - RNA, 22 nt, Pseudomonas putida KT2440
uacccgcgaaagggccagcaca

SEQ ID NO: 34741 - RNA, 22 nt, Pseudomonas putida KT2440
uaccggugggcucaucggcgaa

SEQ ID NO: 34742 - RNA, 22 nt, Pseudomonas putida KT2440
uaccgugaggcgcgccuggagg

SEQ ID NO: 34743 - RNA, 22 nt, Pseudomonas putida KT2440
ucgaucgacaugggcggcagca

SEQ ID NO: 34744 - RNA, 22 nt, Pseudomonas putida KT2440
ucgaugcgcguguaggacagcu

SEQ ID NO: 34745 - RNA, 23 nt, Pseudomonas putida KT2440
ucgaugcuaaacagcgugaagcc

SEQ ID NO: 34746 - RNA, 22 nt, Pseudomonas putida KT2440
ucgauggggccaguggugcgcu

SEQ ID NO: 34747 - RNA, 22 nt, Pseudomonas putida KT2440
ucgaugucgaucuaccagcugc

SEQ ID NO: 34748 - RNA, 22 nt, Pseudomonas putida KT2440
ucgauguguugaagcugggugg

SEQ ID NO: 34749 - RNA, 22 nt, Pseudomonas putida KT2440
ucgcagcggguggucacagcca

SEQ ID NO: 34750 - RNA, 22 nt, Pseudomonas putida KT2440
ucgccauuugagcgccgacaag

SEQ ID NO: 34751 - RNA, 22 nt, Pseudomonas putida KT2440
ucgccgguguucgcgggcgugc

SEQ ID NO: 34752 - RNA, 22 nt, Pseudomonas putida KT2440
ucgccuggaaccacagcagccc

SEQ ID NO: 34753 - RNA, 22 nt, Pseudomonas putida KT2440
ucgcgcaacugucgcugagccu

SEQ ID NO: 34754 - RNA, 22 nt, Pseudomonas putida KT2440
ucgcgcucgaacuggaagcggu

SEQ ID NO: 34755 - RNA, 22 nt, Pseudomonas putida KT2440
ucgcgggaagugauagccccgg

SEQ ID NO: 34756 - RNA, 22 nt, Pseudomonas putida KT2440
ucgcggguaaacccgccuacca

SEQ ID NO: 34757 - RNA, 22 nt, Pseudomonas putida KT2440
ucgcggguaaacccgcgccugc

SEQ ID NO: 34758 - RNA, 22 nt, Pseudomonas putida KT2440
ucgcggguaacccgcuccuaca

SEQ ID NO: 34759 - RNA, 22 nt, Pseudomonas putida KT2440
ucgcggugguggccgacgaggu

SEQ ID NO: 34760 - RNA, 22 nt, Pseudomonas putida KT2440
ucgcugagcgggaucgggccaa

SEQ ID NO: 34761 - RNA, 22 nt, Pseudomonas putida KT2440
ucgcuggacggccugcgugccg

SEQ ID NO: 34762 - RNA, 22 nt, Pseudomonas putida KT2440
ucgcuguugaucugacgcugca

SEQ ID NO: 34763 - RNA, 22 nt, Pseudomonas putida KT2440
ucggcauugucguuaucggcca

SEQ ID NO: 34764 - RNA, 22 nt, Pseudomonas putida KT2440
ucggccagcaggcgcaggguuu

SEQ ID NO: 34765 - RNA, 22 nt, Pseudomonas putida KT2440
ucggccagggcaacuggcugcc

SEQ ID NO: 34766 - RNA, 22 nt, Pseudomonas putida KT2440
ucggccucuucggccaugucca

SEQ ID NO: 34767 - RNA, 22 nt, Pseudomonas putida KT2440
ucggccuugccuuugguggccu

SEQ ID NO: 34768 - RNA, 22 nt, Pseudomonas putida KT2440
ucggccuuguacgagcucuccu

SEQ ID NO: 34769 - RNA, 22 nt, Pseudomonas putida KT2440
ucggcgaacugggcgcgcaagg

SEQ ID NO: 34770 - RNA, 22 nt, Pseudomonas putida KT2440
ucggcgauggccggguguaccg

SEQ ID NO: 34771 - RNA, 22 nt, Pseudomonas putida KT2440
ucggcgcuuuuugcauaguccg

SEQ ID NO: 34772 - RNA, 23 nt, Pseudomonas putida KT2440
ucgggcaugugaucacccagggc

SEQ ID NO: 34773 - RNA, 22 nt, Pseudomonas putida KT2440
ucggucguucggucagucauag

SEQ ID NO: 34774 - RNA, 22 nt, Pseudomonas putida KT2440
ucggugagggucagcucaagca

SEQ ID NO: 34775 - RNA, 22 nt, Pseudomonas putida KT2440
ucggugccagcaacggcgauac

SEQ ID NO: 34776 - RNA, 22 nt, Pseudomonas putida KT2440
ucgucgaauuggucagcccgcu

SEQ ID NO: 34777 - RNA, 22 nt, Pseudomonas putida KT2440
ucgucgccuuugacagcggcuu

SEQ ID NO: 34778 - RNA, 22 nt, Pseudomonas putida KT2440
ucgucggugaugaucucgaugu

SEQ ID NO: 34779 - RNA, 20 nt, Pseudomonas putida KT2440
ucgucugagcaucgacgggg

SEQ ID NO: 34780 - RNA, 22 nt, Pseudomonas putida KT2440
ucgugcugauccugggcuugcu

SEQ ID NO: 34781 - RNA, 21 nt, Pseudomonas putida KT2440
ucguggucaucagccagcgcc

SEQ ID NO: 34782 - RNA, 22 nt, Pseudomonas putida KT2440
ucguucgcuacgcuggaagugc

SEQ ID NO: 34783 - RNA, 22 nt, Pseudomonas putida KT2440
ucguugcgcgucgagaacaggu

SEQ ID NO: 34784 - RNA, 22 nt, Pseudomonas putida KT2440
ucuaccugauuccagcgguggc

SEQ ID NO: 34785 - RNA, 22 nt, Pseudomonas putida KT2440
ucuaccuggguagccaccucac

SEQ ID NO: 34786 - RNA, 22 nt, Pseudomonas putida KT2440
ucuacgagcagaugcucgagcc

SEQ ID NO: 34787 - RNA, 22 nt, Pseudomonas putida KT2440
ucuagaaaagcauucgccgacu

SEQ ID NO: 34788 - RNA, 22 nt, Pseudomonas putida KT2440
ucucaaggcuuaauacagcccc

SEQ ID NO: 34789 - RNA, 22 nt, Pseudomonas putida KT2440
ucuccaauaagccucauggacc

SEQ ID NO: 34790 - RNA, 22 nt, Pseudomonas putida KT2440
ucugcaccaucgggcgcgaugc

SEQ ID NO: 34791 - RNA, 22 nt, Pseudomonas putida KT2440
ucugcgcaccaguuggcuuacg

SEQ ID NO: 34792 - RNA, 22 nt, Pseudomonas putida KT2440
ucuggaggugaucaagcaugga

SEQ ID NO: 34793 - RNA, 22 nt, Pseudomonas putida KT2440
ucuggcguugcugggccuguac

SEQ ID NO: 34794 - RNA, 22 nt, Pseudomonas putida KT2440
ucuggucuucguugcgcaggcu

SEQ ID NO: 34795 - RNA, 22 nt, Pseudomonas putida KT2440
ucuucgcgggcaagcccgcucc

SEQ ID NO: 34796 - RNA, 22 nt, Pseudomonas putida KT2440
ugaaagugccccaguggggugc

SEQ ID NO: 34797 - RNA, 22 nt, Pseudomonas putida KT2440
ugaacgacacccccgaggcgcu

SEQ ID NO: 34798 - RNA, 22 nt, Pseudomonas putida KT2440
ugaagugcuggaacaccaucga

SEQ ID NO: 34799 - RNA, 22 nt, Pseudomonas putida KT2440
ugacaucggcgaaguccugaug

SEQ ID NO: 34800 - RNA, 22 nt, Pseudomonas putida KT2440
ugacauugucgaagccgucauc

SEQ ID NO: 34801 - RNA, 22 nt, Pseudomonas putida KT2440
ugaccagaacggccgcgacauu

SEQ ID NO: 34802 - RNA, 22 nt, Pseudomonas putida KT2440
ugaccagcagcuccuugccgac

SEQ ID NO: 34803 - RNA, 22 nt, Pseudomonas putida KT2440
ugaccguggugcuguucgccau

SEQ ID NO: 34804 - RNA, 22 nt, Pseudomonas putida KT2440
ugaccucacgcauucgcgggca

SEQ ID NO: 34805 - RNA, 22 nt, Pseudomonas putida KT2440
ugacgcuaccccuguaggagcg

SEQ ID NO: 34806 - RNA, 22 nt, Pseudomonas putida KT2440
ugacucgaggcagggucaccuu

SEQ ID NO: 34807 - RNA, 22 nt, Pseudomonas putida KT2440
ugagcaggcugccaucggcacu

SEQ ID NO: 34808 - RNA, 22 nt, Pseudomonas putida KT2440
ugagcguagcagugaggcggcg

SEQ ID NO: 34809 - RNA, 22 nt, Pseudomonas putida KT2440
ugagcugcuugaguucuuuuuc

SEQ ID NO: 34810 - RNA, 22 nt, Pseudomonas putida KT2440
ugaggccuggcgcgaggcgcug

SEQ ID NO: 34811 - RNA, 22 nt, Pseudomonas putida KT2440
ugaggcugacgcgcaaggugcu

SEQ ID NO: 34812 - RNA, 22 nt, Pseudomonas putida KT2440
ugaguaccuucggcgacggcga

SEQ ID NO: 34813 - RNA, 22 nt, Pseudomonas putida KT2440
ugauagccucgauaguggaguc

SEQ ID NO: 34814 - RNA, 22 nt, Pseudomonas putida KT2440
ugaucguucgccacuuugccga

SEQ ID NO: 34815 - RNA, 22 nt, Pseudomonas putida KT2440
ugaugaaaacccucgggcaguu

SEQ ID NO: 34816 - RNA, 22 nt, Pseudomonas putida KT2440
ugaugcaguucaacggugaagg

SEQ ID NO: 34817 - RNA, 22 nt, Pseudomonas putida KT2440
ugaugucggagaacagcagcuu

SEQ ID NO: 34818 - RNA, 22 nt, Pseudomonas putida KT2440
ugcaauccauuguaggagcggg

SEQ ID NO: 34819 - RNA, 22 nt, Pseudomonas putida KT2440
ugcaccguaccugugggagcgg

SEQ ID NO: 34820 - RNA, 22 nt, Pseudomonas putida KT2440
ugcaccgucucuguguaggagc

SEQ ID NO: 34821 - RNA, 22 nt, Pseudomonas putida KT2440
ugcaccugggcauuggcggcgu

SEQ ID NO: 34822 - RNA, 22 nt, Pseudomonas putida KT2440
ugcacgcacuggagaaguacac

SEQ ID NO: 34823 - RNA, 22 nt, Pseudomonas putida KT2440
ugcacggccagccgcugcaggg

SEQ ID NO: 34824 - RNA, 22 nt, Pseudomonas putida KT2440
ugcacgucgccgaugaugucaa

SEQ ID NO: 34825 - RNA, 22 nt, Pseudomonas putida KT2440
ugcagaccugugggagcgggca

SEQ ID NO: 34826 - RNA, 22 nt, Pseudomonas putida KT2440
ugcagcaguucuuccaugcgcu

SEQ ID NO: 34827 - RNA, 22 nt, Pseudomonas putida KT2440
ugcaggagcgggcuugcccgca

SEQ ID NO: 34828 - RNA, 22 nt, Pseudomonas putida KT2440
ugggcaaguuugccgacguagu

SEQ ID NO: 34829 - RNA, 22 nt, Pseudomonas putida KT2440
ugggccaagucuuauuuggauu

SEQ ID NO: 34830 - RNA, 22 nt, Pseudomonas putida KT2440
ugggccauaccugaugcgcgac

SEQ ID NO: 34831 - RNA, 22 nt, Pseudomonas putida KT2440
ugggcgagcuugucgaggaacu

SEQ ID NO: 34832 - RNA, 22 nt, Pseudomonas putida KT2440
ugggcgauccagcgcaauucgc

SEQ ID NO: 34833 - RNA, 22 nt, Pseudomonas putida KT2440
ugggcuccacggugaccaccgg

SEQ ID NO: 34834 - RNA, 22 nt, Pseudomonas putida KT2440
ugggcugaccccgcuguaccuu

SEQ ID NO: 34835 - RNA, 22 nt, Pseudomonas putida KT2440
ugggucgaugacgauggcccgg

SEQ ID NO: 34836 - RNA, 19 nt, Pseudomonas putida KT2440
ugggugccgccacgcuggu

SEQ ID NO: 34837 - RNA, 22 nt, Pseudomonas putida KT2440
uggucgacggccgcgccaugac

SEQ ID NO: 34838 - RNA, 22 nt, Pseudomonas putida KT2440
uggucugcgacuacgacgcggg

SEQ ID NO: 34839 - RNA, 22 nt, Pseudomonas putida KT2440
uggugaacauagccuguuuucc

SEQ ID NO: 34840 - RNA, 22 nt, Pseudomonas putida KT2440
uggugccugcuucgcgggcaag

SEQ ID NO: 34841 - RNA, 18 nt, Pseudomonas putida KT2440
uggugcgcuguugagcca

SEQ ID NO: 34842 - RNA, 22 nt, Pseudomonas putida KT2440
ugguggcaaaacgcuuggccaa

SEQ ID NO: 34843 - RNA, 18 nt, Pseudomonas putida KT2440
ugguggccucggacuacc

SEQ ID NO: 34844 - RNA, 22 nt, Pseudomonas putida KT2440
ugguucgccuacuucgagcccu

SEQ ID NO: 34845 - RNA, 22 nt, Pseudomonas putida KT2440
uguaagcaggcgcggccuguuc

SEQ ID NO: 34846 - RNA, 22 nt, Pseudomonas putida KT2440
uguacgaaaucaucccgggcuu

SEQ ID NO: 34847 - RNA, 22 nt, Pseudomonas putida KT2440
uguacuggccucuucgcgggca

SEQ ID NO: 34848 - RNA, 22 nt, Pseudomonas putida KT2440
uguagcgauaguccgucuugcu

SEQ ID NO: 34849 - RNA, 22 nt, Pseudomonas putida KT2440
uguaggagcggguucacccgcg

SEQ ID NO: 34850 - RNA, 22 nt, Pseudomonas putida KT2440
uguaggagcggguuuagccgcg

SEQ ID NO: 34851 - RNA, 22 nt, Pseudomonas putida KT2440
uguaggagcugguuuacccgcg

SEQ ID NO: 34852 - RNA, 22 nt, Pseudomonas putida KT2440
uguaggcgcggguuaacccgcg

SEQ ID NO: 34853 - RNA, 21 nt, Pseudomonas putida KT2440
uguaggcuuugaccccggccu

SEQ ID NO: 34854 - RNA, 22 nt, Pseudomonas putida KT2440
uguagugcaucagguucguugc

SEQ ID NO: 34855 - RNA, 22 nt, Pseudomonas putida KT2440
ugucagcuggccgugcuguuga

SEQ ID NO: 34856 - RNA, 22 nt, Pseudomonas putida KT2440
ugucaucgaccaguugcucgac

SEQ ID NO: 34857 - RNA, 22 nt, Pseudomonas putida KT2440
uguccgcaagcugaaggugggu

SEQ ID NO: 34858 - RNA, 22 nt, Pseudomonas putida KT2440
uguccggcuaccugagccgggg

SEQ ID NO: 34859 - RNA, 22 nt, Pseudomonas putida KT2440
ugucgggcaucgacuucgaaca

SEQ ID NO: 34860 - RNA, 22 nt, Pseudomonas putida KT2440
ugucuacagcgcgcagaugaua

SEQ ID NO: 34861 - RNA, 22 nt, Pseudomonas putida KT2440
ugugacuuaccugugggagcgg

SEQ ID NO: 34862 - RNA, 22 nt, Pseudomonas putida KT2440
ugugcagcccccguaggagcgg

SEQ ID NO: 34863 - RNA, 17 nt, Pseudomonas putida KT2440
ugugccagcggugguug

SEQ ID NO: 34864 - RNA, 22 nt, Pseudomonas putida KT2440
ugugccguaccugugggagcgg

SEQ ID NO: 34865 - RNA, 23 nt, Pseudomonas putida KT2440
ugugcugaucgagcucggcacgc

SEQ ID NO: 34866 - RNA, 22 nt, Pseudomonas putida KT2440
ugugucaguucaagcacgauga

SEQ ID NO: 34867 - RNA, 22 nt, Pseudomonas putida KT2440
ugugugccaggcggcugaccag

SEQ ID NO: 34868 - RNA, 22 nt, Pseudomonas putida KT2440
uguuagcgucacuguaugcgcc

SEQ ID NO: 34869 - RNA, 22 nt, Pseudomonas putida KT2440
uguucgacgccucgaucggcua

SEQ ID NO: 34870 - RNA, 22 nt, Pseudomonas putida KT2440
uguucgcugagguugccgcuga

SEQ ID NO: 34871 - RNA, 21 nt, Pseudomonas putida KT2440
uguucgcugccgccugcuguc

SEQ ID NO: 34872 - RNA, 22 nt, Pseudomonas putida KT2440
uguucgucaagagccgaaaggg

SEQ ID NO: 34873 - RNA, 22 nt, Pseudomonas putida KT2440
uuacccaggagagaagccauga

SEQ ID NO: 34874 - RNA, 22 nt, Pseudomonas putida KT2440
uuacccgcgagccgggcgacgc

SEQ ID NO: 34875 - RNA, 22 nt, Pseudomonas putida KT2440
uuacccugcgggagcgggcgug

SEQ ID NO: 34876 - RNA, 22 nt, Pseudomonas putida KT2440
uuaccguguggggccauucgau

SEQ ID NO: 34877 - RNA, 22 nt, Pseudomonas putida KT2440
uuaggcuucaguuauaccugua

SEQ ID NO: 34878 - RNA, 22 nt, Pseudomonas putida KT2440
uuauccaguguaggagcggguu

SEQ ID NO: 34879 - RNA, 22 nt, Pseudomonas putida KT2440
uucacaggcuccuugcugaucg

SEQ ID NO: 34880 - RNA, 22 nt, Pseudomonas putida KT2440
uucaccguugaacugcaucagg

SEQ ID NO: 34881 - RNA, 22 nt, Pseudomonas putida KT2440
uucagcucgaugcuugcagugc

SEQ ID NO: 34882 - RNA, 22 nt, Pseudomonas putida KT2440
uucaggugcgcucggucagcgc

SEQ ID NO: 34883 - RNA, 22 nt, Pseudomonas putida KT2440
uucaucacugcgcgcagccuca

SEQ ID NO: 34884 - RNA, 22 nt, Pseudomonas putida KT2440
uucauccgcugcuaccagcgca

SEQ ID NO: 34885 - RNA, 22 nt, Pseudomonas putida KT2440
uuccgccaggucuucgcuggcg

SEQ ID NO: 34886 - RNA, 22 nt, Pseudomonas putida KT2440
uuccugaucucggcgacgccga

SEQ ID NO: 34887 - RNA, 22 nt, Pseudomonas putida KT2440
uuccugguggccggcucggugu

SEQ ID NO: 34888 - RNA, 22 nt, Pseudomonas putida KT2440
uucgauccggggcaguacacca

SEQ ID NO: 34889 - RNA, 22 nt, Pseudomonas putida KT2440
uucgauguguauggcaacguuu

SEQ ID NO: 34890 - RNA, 22 nt, Pseudomonas putida KT2440
uucgcccgcuacucgaugaacu

SEQ ID NO: 34891 - RNA, 22 nt, Pseudomonas putida KT2440
uucgcgcuguggaccgugcugg

SEQ ID NO: 34892 - RNA, 22 nt, Pseudomonas putida KT2440
uucgcggacacgcccgcuccca

SEQ ID NO: 34893 - RNA, 22 nt, Pseudomonas putida KT2440
uucgcgggcaagcccgcccuua

SEQ ID NO: 34894 - RNA, 22 nt, Pseudomonas putida KT2440
uucgcgggcaagcccgcuccua

SEQ ID NO: 34895 - RNA, 22 nt, Pseudomonas putida KT2440
uucgcggguaaacccgcuccaa

SEQ ID NO: 34896 - RNA, 22 nt, Pseudomonas putida KT2440
uucgcggguaaacccgcuccua

SEQ ID NO: 34897 - RNA, 22 nt, Pseudomonas putida KT2440
uucgcggguaaacccgcugcug

SEQ ID NO: 34898 - RNA, 22 nt, Pseudomonas putida KT2440
uucgcgggugaacccgcuccua

SEQ ID NO: 34899 - RNA, 22 nt, Pseudomonas putida KT2440
uucgcggguuagcccuccccua

SEQ ID NO: 34900 - RNA, 22 nt, Pseudomonas putida KT2440
uucgcugugucggcgacgugaa

SEQ ID NO: 34901 - RNA, 22 nt, Pseudomonas putida KT2440
uucggccugcaacaucgccagg

SEQ ID NO: 34902 - RNA, 21 nt, Pseudomonas putida KT2440
uucugggccgugcuguuuccc

SEQ ID NO: 34903 - RNA, 22 nt, Pseudomonas putida KT2440
uucugggccgugcuguuucccu

SEQ ID NO: 34904 - RNA, 22 nt, Pseudomonas putida KT2440
uugaacagggugcgguacuggu

SEQ ID NO: 34905 - RNA, 20 nt, Pseudomonas putida KT2440
uugaacccggacugacgcuu

SEQ ID NO: 34906 - RNA, 22 nt, Pseudomonas putida KT2440
uugaacugcggcuggucgaggu

SEQ ID NO: 34907 - RNA, 22 nt, Pseudomonas putida KT2440
uugaaucagcgcauuaccacgu

SEQ ID NO: 34908 - RNA, 22 nt, Pseudomonas putida KT2440
uugagccuagauaauucauuga

SEQ ID NO: 34909 - RNA, 20 nt, Pseudomonas putida KT2440
uugagggcgccguuguaggc

SEQ ID NO: 34910 - RNA, 22 nt, Pseudomonas putida KT2440
uugaugacaaugcacugguugg

SEQ ID NO: 34911 - RNA, 22 nt, Pseudomonas putida KT2440
uugcagcaggcggaucgagucg

SEQ ID NO: 34912 - RNA, 22 nt, Pseudomonas putida KT2440
uugcccgcgaacaccggcaacg

SEQ ID NO: 34913 - RNA, 22 nt, Pseudomonas putida KT2440
aaagggcugcgaagcagccccg

SEQ ID NO: 34914 - RNA, 22 nt, Pseudomonas putida KT2440
aaagggcugcuggcggcguugu

SEQ ID NO: 34915 - RNA, 22 nt, Pseudomonas putida KT2440
aacagccuccgggucgccgaag

SEQ ID NO: 34916 - RNA, 20 nt, Pseudomonas putida KT2440
aacaggcgccauugccguug

SEQ ID NO: 34917 - RNA, 21 nt, Pseudomonas putida KT2440
aacagguagaagcucgcgccg

SEQ ID NO: 34918 - RNA, 22 nt, Pseudomonas putida KT2440
aacccgcucccacaagggcguc

SEQ ID NO: 34919 - RNA, 22 nt, Pseudomonas putida KT2440
aacccgcuccuacaauggauug

SEQ ID NO: 34920 - RNA, 22 nt, Pseudomonas putida KT2440
aacccgcuccuacaggggacgc

SEQ ID NO: 34921 - RNA, 22 nt, Pseudomonas putida KT2440
aacccgcuccuacagggugcug

SEQ ID NO: 34922 - RNA, 22 nt, Pseudomonas putida KT2440
aaccgcuaccugcucagcgccu

SEQ ID NO: 34923 - RNA, 22 nt, Pseudomonas putida KT2440
aaccugaaucaaguacagggag

SEQ ID NO: 34924 - RNA, 22 nt, Pseudomonas putida KT2440
aacgcggguugcgguugcggcu

SEQ ID NO: 34925 - RNA, 22 nt, Pseudomonas putida KT2440
aacucgcuugccgaucaggccu

SEQ ID NO: 34926 - RNA, 22 nt, Pseudomonas putida KT2440
aacugacaggcccuguacugau

SEQ ID NO: 34927 - RNA, 22 nt, Pseudomonas putida KT2440
aacugaucguucagggccuguu

SEQ ID NO: 34928 - RNA, 22 nt, Pseudomonas putida KT2440
aacugccgcagcguaaggcaua

SEQ ID NO: 34929 - RNA, 22 nt, Pseudomonas putida KT2440
aacugccgguaaagcagagcgc

SEQ ID NO: 34930 - RNA, 23 nt, Pseudomonas putida KT2440
aacuggccccagaggcuuuugcc

SEQ ID NO: 34931 - RNA, 22 nt, Pseudomonas putida KT2440
aacuggccgcagccuugccagc

SEQ ID NO: 34932 - RNA, 21 nt, Pseudomonas putida KT2440
aagaggccagugcaggugaug

SEQ ID NO: 34933 - RNA, 22 nt, Pseudomonas putida KT2440
aagaucagcucugcgccauggc

SEQ ID NO: 34934 - RNA, 22 nt, Pseudomonas putida KT2440
aagaucgacuggaugucguagu

SEQ ID NO: 34935 - RNA, 22 nt, Pseudomonas putida KT2440
aagcagugccgcgcuggugcgc

SEQ ID NO: 34936 - RNA, 22 nt, Pseudomonas putida KT2440
aagccaauggcguaugccagau

SEQ ID NO: 34937 - RNA, 22 nt, Pseudomonas putida KT2440
aagccacgucggcagggucuga

SEQ ID NO: 34938 - RNA, 22 nt, Pseudomonas putida KT2440
aagcccgcucccgcagguuuuu

SEQ ID NO: 34939 - RNA, 22 nt, Pseudomonas putida KT2440
aagccggcgaaguuauccauga

SEQ ID NO: 34940 - RNA, 22 nt, Pseudomonas putida KT2440
aagcgcugcucgcguucgucga

SEQ ID NO: 34941 - RNA, 22 nt, Pseudomonas putida KT2440
aagcggcugguaguaggugggu

SEQ ID NO: 34942 - RNA, 20 nt, Pseudomonas putida KT2440
aaggcccaacucgccgagga

SEQ ID NO: 34943 - RNA, 22 nt, Pseudomonas putida KT2440
aaggcgcacaccagcgcgccau

SEQ ID NO: 34944 - RNA, 22 nt, Pseudomonas putida KT2440
aaggcgucgaucacgguguuac

SEQ ID NO: 34945 - RNA, 22 nt, Pseudomonas putida KT2440
aagucgaucccguccaacguac

SEQ ID NO: 34946 - RNA, 22 nt, Pseudomonas putida KT2440
aagucugggguccugcccugaa

SEQ ID NO: 34947 - RNA, 22 nt, Pseudomonas putida KT2440
aaguguuggugcaccuggagau

SEQ ID NO: 34948 - RNA, 22 nt, Pseudomonas putida KT2440
aaguugccuguaccugccucuu

SEQ ID NO: 34949 - RNA, 22 nt, Pseudomonas putida KT2440
aauaccugauuggcaguggcaa

SEQ ID NO: 34950 - RNA, 22 nt, Pseudomonas putida KT2440
aauggcgcgugucgagcggcgg

SEQ ID NO: 34951 - RNA, 22 nt, Pseudomonas putida KT2440
aauggcguagaagucgaucagg

SEQ ID NO: 34952 - RNA, 22 nt, Pseudomonas putida KT2440
acaaaggcgccguguugccccg

SEQ ID NO: 34953 - RNA, 22 nt, Pseudomonas putida KT2440
acaacgcgcccgccuggcccug

SEQ ID NO: 34954 - RNA, 22 nt, Pseudomonas putida KT2440
acaccgcucuccaugaaacuca

SEQ ID NO: 34955 - RNA, 19 nt, Pseudomonas putida KT2440
acaccucgaugucgcugcc

SEQ ID NO: 34956 - RNA, 22 nt, Pseudomonas putida KT2440
acacugcugccugcgccaguug

SEQ ID NO: 34957 - RNA, 22 nt, Pseudomonas putida KT2440
acaggcugauggccuggacgcu

SEQ ID NO: 34958 - RNA, 22 nt, Pseudomonas putida KT2440
acaggucggcgcccuggcggac

SEQ ID NO: 34959 - RNA, 22 nt, Pseudomonas putida KT2440
acaguaccugugggagcgggca

SEQ ID NO: 34960 - RNA, 19 nt, Pseudomonas putida KT2440
acaugcaggcgaucauguc

SEQ ID NO: 34961 - RNA, 20 nt, Pseudomonas putida KT2440
acauggccauggcgucgaug

SEQ ID NO: 34962 - RNA, 22 nt, Pseudomonas putida KT2440
accaccggugguugcugcaguc

SEQ ID NO: 34963 - RNA, 22 nt, Pseudomonas putida KT2440
accagaucaccgugaccgggcc

SEQ ID NO: 34964 - RNA, 22 nt, Pseudomonas putida KT2440
accagcgcgcucauccaggugu

SEQ ID NO: 34965 - RNA, 22 nt, Pseudomonas putida KT2440
accaggcgccgguggccuuccc

SEQ ID NO: 34966 - RNA, 22 nt, Pseudomonas putida KT2440
accaucuaaaaggccauugggg

SEQ ID NO: 34967 - RNA, 22 nt, Pseudomonas putida KT2440
acccgcgaaugcgucggagcag

SEQ ID NO: 34968 - RNA, 22 nt, Pseudomonas putida KT2440
acccgcuccuacacgggucacc

SEQ ID NO: 34969 - RNA, 22 nt, Pseudomonas putida KT2440
acccgcuccuacaggggggcgc

SEQ ID NO: 34970 - RNA, 22 nt, Pseudomonas putida KT2440
acccgcuccuacagguacauca

SEQ ID NO: 34971 - RNA, 22 nt, Pseudomonas putida KT2440
acccgcuccuaccagggacgug

SEQ ID NO: 34972 - RNA, 21 nt, Pseudomonas putida KT2440
acccucgcuggggugcaugcu

SEQ ID NO: 34973 - RNA, 22 nt, Pseudomonas putida KT2440
acccugggccaccugcgguuug

SEQ ID NO: 34974 - RNA, 22 nt, Pseudomonas putida KT2440
accgccugguggaagaggugaa

SEQ ID NO: 34975 - RNA, 22 nt, Pseudomonas putida KT2440
ugcuggaggauguuggcgagca

SEQ ID NO: 34976 - RNA, 22 nt, Pseudomonas putida KT2440
ugcuggcgguaaugcucgcggg

SEQ ID NO: 34977 - RNA, 22 nt, Pseudomonas putida KT2440
ugcugggcgccaaccacuggca

SEQ ID NO: 34978 - RNA, 22 nt, Pseudomonas putida KT2440
ugcuuacccaauagcguguccu

SEQ ID NO: 34979 - RNA, 22 nt, Pseudomonas putida KT2440
ugcuuggccugagcuggcagca

SEQ ID NO: 34980 - RNA, 22 nt, Pseudomonas putida KT2440
uggaccucaauacucgccuggc

SEQ ID NO: 34981 - RNA, 22 nt, Pseudomonas putida KT2440
uggaccugugggagcgggcgcg

SEQ ID NO: 34982 - RNA, 21 nt, Pseudomonas putida KT2440
uggagauguagucguuguugu

SEQ ID NO: 34983 - RNA, 22 nt, Pseudomonas putida KT2440
uggagauguagucguuguugua

SEQ ID NO: 34984 - RNA, 22 nt, Pseudomonas putida KT2440
uggagcacgccgggcuggcgcg

SEQ ID NO: 34985 - RNA, 22 nt, Pseudomonas putida KT2440
uggagccggaggugcugcugcu

SEQ ID NO: 34986 - RNA, 22 nt, Pseudomonas putida KT2440
uggagcgcaccacaucuucauu

SEQ ID NO: 34987 - RNA, 22 nt, Pseudomonas putida KT2440
gcgcacacguucggccacgcug

SEQ ID NO: 34988 - RNA, 22 nt, Pseudomonas putida KT2440
gcgcacuucuucgaucaggcug

SEQ ID NO: 34989 - RNA, 22 nt, Pseudomonas putida KT2440
gcgcagaccaggaguggccugg

SEQ ID NO: 34990 - RNA, 22 nt, Pseudomonas putida KT2440
gcgcagguggucgaacagggcc

SEQ ID NO: 34991 - RNA, 22 nt, Pseudomonas putida KT2440
gcgcaguuuuugccccaccacg

SEQ ID NO: 34992 - RNA, 22 nt, Pseudomonas putida KT2440
gcgccguacgugugggagcggg

SEQ ID NO: 34993 - RNA, 22 nt, Pseudomonas putida KT2440
gcgccugugaggucgagcgccg

SEQ ID NO: 34994 - RNA, 22 nt, Pseudomonas putida KT2440
gcgcgacuccugugggagcggg

SEQ ID NO: 34995 - RNA, 22 nt, Pseudomonas putida KT2440
gcgcgcuauguggaugagcguu

SEQ ID NO: 34996 - RNA, 22 nt, Pseudomonas putida KT2440
gcgcgguaguugcgcgaguccu

SEQ ID NO: 34997 - RNA, 22 nt, Pseudomonas putida KT2440
gcgcgugaugaugcaguggucg

SEQ ID NO: 34998 - RNA, 22 nt, Pseudomonas putida KT2440
gcgcguguaccgggcagcgguu

SEQ ID NO: 34999 - RNA, 22 nt, Pseudomonas putida KT2440
gcgcuaccguuccugcugaccc

SEQ ID NO: 35000 - RNA, 22 nt, Pseudomonas putida KT2440
gcggcgaugugguugcaagcgg

SEQ ID NO: 35001 - RNA, 22 nt, Pseudomonas putida KT2440
gcgggcaugcccgcucccgcag

SEQ ID NO: 35002 - RNA, 22 nt, Pseudomonas putida KT2440
gcgggcaugccugcccccacgg

SEQ ID NO: 35003 - RNA, 22 nt, Pseudomonas putida KT2440
gcgggugaaaagccacugcuga

SEQ ID NO: 35004 - RNA, 22 nt, Pseudomonas putida KT2440
gcgggugaacccgcuccuacaa

SEQ ID NO: 35005 - RNA, 22 nt, Pseudomonas putida KT2440
gcgggugaacccgcuccuacca

SEQ ID NO: 35006 - RNA, 22 nt, Pseudomonas putida KT2440
gcgguaccugguaggagcgggu

SEQ ID NO: 35007 - RNA, 22 nt, Pseudomonas putida KT2440
gcggucagugaacggcugcggc

SEQ ID NO: 35008 - RNA, 22 nt, Pseudomonas putida KT2440
gcggugucuucuucgcggguaa

SEQ ID NO: 35009 - RNA, 22 nt, Pseudomonas putida KT2440
gcguacugacccaggagucggg

SEQ ID NO: 35010 - RNA, 22 nt, Pseudomonas putida KT2440
gcgugacgcagaugggcguggc

SEQ ID NO: 35011 - RNA, 22 nt, Pseudomonas putida KT2440
gcgugcaguuuucaagcuguug

SEQ ID NO: 35012 - RNA, 22 nt, Pseudomonas putida KT2440
gcgugccaguggcagcagcacu

SEQ ID NO: 35013 - RNA, 22 nt, Pseudomonas putida KT2440
gcgugguagugccugccggcaa

SEQ ID NO: 35014 - RNA, 22 nt, Pseudomonas putida KT2440
gcguugauggugugccaggugg

SEQ ID NO: 35015 - RNA, 22 nt, Pseudomonas putida KT2440
gcguugucuucggcguuggaca

SEQ ID NO: 35016 - RNA, 21 nt, Pseudomonas putida KT2440
gcuacaccaugaccggugcgc

SEQ ID NO: 35017 - RNA, 22 nt, Pseudomonas putida KT2440
gcuaucgaagcguugcggcauu

SEQ ID NO: 35018 - RNA, 22 nt, Pseudomonas putida KT2440
gcuauugagaaacaagaucgaa

SEQ ID NO: 35019 - RNA, 22 nt, Pseudomonas putida KT2440
gcucagcgugaaggucaaugca

SEQ ID NO: 35020 - RNA, 22 nt, Pseudomonas putida KT2440
gcucaugcuuacuucuucgccu

SEQ ID NO: 35021 - RNA, 22 nt, Pseudomonas putida KT2440
gcuccuacacagagacggugca

SEQ ID NO: 35022 - RNA, 22 nt, Pseudomonas putida KT2440
gcucgcugcccgacggcuugau

SEQ ID NO: 35023 - RNA, 22 nt, Pseudomonas putida KT2440
gcugaacaggguuaugcgcgca

SEQ ID NO: 35024 - RNA, 22 nt, Pseudomonas putida KT2440
gcugagugcgucguuuuaacug

SEQ ID NO: 35025 - RNA, 22 nt, Pseudomonas putida KT2440
gcugcacggcuugcugccgagc

SEQ ID NO: 35026 - RNA, 21 nt, Pseudomonas putida KT2440
gcugcaggccuucgccugggc

SEQ ID NO: 35027 - RNA, 22 nt, Pseudomonas putida KT2440
gcugccaucgagguggucguug

SEQ ID NO: 35028 - RNA, 22 nt, Pseudomonas putida KT2440
gcugcccaggccggaacugagg

SEQ ID NO: 35029 - RNA, 22 nt, Pseudomonas putida KT2440
gcugcucacgcagccauugcgg

SEQ ID NO: 35030 - RNA, 19 nt, Pseudomonas putida KT2440
gcugcugauucaguacugg

SEQ ID NO: 35031 - RNA, 22 nt, Pseudomonas putida KT2440
gcugcugccagggcaauggaug

SEQ ID NO: 35032 - RNA, 22 nt, Pseudomonas putida KT2440
gcuggucagcacggucacgcca

SEQ ID NO: 35033 - RNA, 22 nt, Pseudomonas putida KT2440
gcugguucaucgacuggaugcu

SEQ ID NO: 35034 - RNA, 22 nt, Pseudomonas putida KT2440
gcugucagcgaugcauucgaaa

SEQ ID NO: 35035 - RNA, 22 nt, Pseudomonas putida KT2440
gcugucgaaaagaugggcggca

SEQ ID NO: 35036 - RNA, 22 nt, Pseudomonas putida KT2440
gcuguucaaggcuguuguagcu

SEQ ID NO: 35037 - RNA, 22 nt, Pseudomonas putida KT2440
gcuguucggccuguaucaacgc

SEQ ID NO: 35038 - RNA, 22 nt, Pseudomonas putida KT2440
gcuucgccgauuuucagcgggu

SEQ ID NO: 35039 - RNA, 22 nt, Pseudomonas putida KT2440
gcuucgcggccaagccgcugcc

SEQ ID NO: 35040 - RNA, 22 nt, Pseudomonas putida KT2440
gcuugaggccguagcccuggua

SEQ ID NO: 35041 - RNA, 22 nt, Pseudomonas putida KT2440
gcuuggccuucuuuucggcagu

SEQ ID NO: 35042 - RNA, 22 nt, Pseudomonas putida KT2440
gcuugucgaauaucagugccgc

SEQ ID NO: 35043 - RNA, 22 nt, Pseudomonas putida KT2440
ggagcuguucuucucggcgcug

SEQ ID NO: 35044 - RNA, 22 nt, Pseudomonas putida KT2440
ggaggcuguacgugucauagcc

SEQ ID NO: 35045 - RNA, 22 nt, Pseudomonas putida KT2440
ggagucgauggccaccaggguc

SEQ ID NO: 35046 - RNA, 22 nt, Pseudomonas putida KT2440
ggaugacgcggugaucauccuc

SEQ ID NO: 35047 - RNA, 22 nt, Pseudomonas putida KT2440
ggauugucggcagugugcuggc

SEQ ID NO: 35048 - RNA, 18 nt, Pseudomonas putida KT2440
ggcaaugugguugguacu

SEQ ID NO: 35049 - RNA, 22 nt, Pseudomonas putida KT2440
ggcaccuucgccuaugugguca

SEQ ID NO: 35050 - RNA, 22 nt, Pseudomonas putida KT2440
ggcacgaucucggcgcccagca

SEQ ID NO: 35051 - RNA, 22 nt, Pseudomonas putida KT2440
ggcacggaucggucaggcggcc

SEQ ID NO: 35052 - RNA, 23 nt, Pseudomonas putida KT2440
ggcacgguuucgucggagccugg

SEQ ID NO: 35053 - RNA, 22 nt, Pseudomonas putida KT2440
ggcacgucgaucacuguuaccc

SEQ ID NO: 35054 - RNA, 22 nt, Pseudomonas putida KT2440
ggcacucgaucucacaggugcc

SEQ ID NO: 35055 - RNA, 20 nt, Pseudomonas putida KT2440
ggcagcaauuacgaauggcg

SEQ ID NO: 35056 - RNA, 22 nt, Pseudomonas putida KT2440
ggcagcauaaaguaagggugug

SEQ ID NO: 35057 - RNA, 22 nt, Pseudomonas putida KT2440
ggcagguggccuacgaucgccg

SEQ ID NO: 35058 - RNA, 22 nt, Pseudomonas putida KT2440
ggcaucgucgaccugugcgggc

SEQ ID NO: 35059 - RNA, 22 nt, Pseudomonas putida KT2440
ggcaugaugcaccugugagagc

SEQ ID NO: 35060 - RNA, 22 nt, Pseudomonas putida KT2440
ggcaugcccgcgaaucaggcga

SEQ ID NO: 35061 - RNA, 22 nt, Pseudomonas putida KT2440
ggccaaguguacgacggugagc

SEQ ID NO: 35062 - RNA, 22 nt, Pseudomonas putida KT2440
ggccaguucgucgcuguccagc

SEQ ID NO: 35063 - RNA, 22 nt, Pseudomonas putida KT2440
ggccaguuucucggugcccaug

SEQ ID NO: 35064 - RNA, 22 nt, Pseudomonas putida KT2440
ggccgcuucuugcgcuggggcu

SEQ ID NO: 35065 - RNA, 22 nt, Pseudomonas putida KT2440
ggccgguuugcuggugcuggca

SEQ ID NO: 35066 - RNA, 22 nt, Pseudomonas putida KT2440
ggccucugugcgcguggggggu

SEQ ID NO: 35067 - RNA, 22 nt, Pseudomonas putida KT2440
ggccuucgauccggaugcugac

SEQ ID NO: 35068 - RNA, 22 nt, Pseudomonas putida KT2440
ggccuuugucguaugugggguu

SEQ ID NO: 35069 - RNA, 21 nt, Pseudomonas putida KT2440
ggcgaagcauuggaacaggac

SEQ ID NO: 35070 - RNA, 22 nt, Pseudomonas putida KT2440
ggcgacauggcguugaugacga

SEQ ID NO: 35071 - RNA, 22 nt, Pseudomonas putida KT2440
ggcgagcacacuucuugguugc

SEQ ID NO: 35072 - RNA, 22 nt, Pseudomonas putida KT2440
ggcgagcugaucaucaucaagc

SEQ ID NO: 35073 - RNA, 22 nt, Pseudomonas putida KT2440
ggcgaucaccaaggcgugcaag

SEQ ID NO: 35074 - RNA, 17 nt, Pseudomonas putida KT2440
ggcgaucaccccacccu

SEQ ID NO: 35075 - RNA, 22 nt, Pseudomonas putida KT2440
ggcgauguuuuccuugccgucc

SEQ ID NO: 35076 - RNA, 22 nt, Pseudomonas putida KT2440
ggcgcgaagcggccccgggauu

SEQ ID NO: 35077 - RNA, 22 nt, Pseudomonas putida KT2440
ggcgguacaucaggucucgcca

SEQ ID NO: 35078 - RNA, 22 nt, Pseudomonas putida KT2440
ggcggugauggucgagcuguuc

SEQ ID NO: 35079 - RNA, 22 nt, Pseudomonas putida KT2440
ggcgugcaaauaucucuaacga

SEQ ID NO: 35080 - RNA, 19 nt, Pseudomonas putida KT2440
ggcguugagcugcuggcgu

SEQ ID NO: 35081 - RNA, 22 nt, Pseudomonas putida KT2440
ggcuccgucaaagugaugcugg

SEQ ID NO: 35082 - RNA, 22 nt, Pseudomonas putida KT2440
ggcucgaucugcugcagggcuu

SEQ ID NO: 35083 - RNA, 22 nt, Pseudomonas putida KT2440
ggcugagggccugggucacugu

SEQ ID NO: 35084 - RNA, 22 nt, Pseudomonas putida KT2440
ggcugagggcgaugccgaugcu

SEQ ID NO: 35085 - RNA, 22 nt, Pseudomonas putida KT2440
ggcugaucaggcgcugaugugc

SEQ ID NO: 35086 - RNA, 22 nt, Pseudomonas putida KT2440
ggcugcuguggcgcaacgggcu

SEQ ID NO: 35087 - RNA, 22 nt, Pseudomonas putida KT2440
ggcugugauggugaccuugacc

SEQ ID NO: 35088 - RNA, 23 nt, Pseudomonas putida KT2440
gggcagucgaguagcguauggau

SEQ ID NO: 35089 - RNA, 22 nt, Pseudomonas putida KT2440
gggcgguagcgcaugcagcggu

SEQ ID NO: 35090 - RNA, 22 nt, Pseudomonas putida KT2440
gggcguauucacgcagagcgcc

SEQ ID NO: 35091 - RNA, 22 nt, Pseudomonas putida KT2440
gggcgugacggcagugacuggc

SEQ ID NO: 35092 - RNA, 22 nt, Pseudomonas putida KT2440
gggcugacgcgauucugcucga

SEQ ID NO: 35093 - RNA, 22 nt, Pseudomonas putida KT2440
gggcugcauagcagccccaggu

SEQ ID NO: 35094 - RNA, 18 nt, Pseudomonas putida KT2440
ggguccgaacagugcucg

SEQ ID NO: 35095 - RNA, 22 nt, Pseudomonas putida KT2440
gggucguacaguucgaucaguu

SEQ ID NO: 35096 - RNA, 22 nt, Pseudomonas putida KT2440
gggugaucucucaucaaacaaa

SEQ ID NO: 35097 - RNA, 20 nt, Pseudomonas putida KT2440
ggguuacccgcgaagaggcc

SEQ ID NO: 35098 - RNA, 22 nt, Pseudomonas putida KT2440
ggguucacccgcgaagaggcca

SEQ ID NO: 35099 - RNA, 22 nt, Pseudomonas putida KT2440
gguaccguccgaacugggcggc

SEQ ID NO: 35100 - RNA, 22 nt, Pseudomonas putida KT2440
gguaccuccaccgaugucaucg

SEQ ID NO: 35101 - RNA, 22 nt, Pseudomonas putida KT2440
ggucaacaagauugccguuugg

SEQ ID NO: 35102 - RNA, 22 nt, Pseudomonas putida KT2440
ggucaaccagcaacuggcacug

SEQ ID NO: 35103 - RNA, 22 nt, Pseudomonas putida KT2440
ggucaacggugugucgcugcgc

SEQ ID NO: 35104 - RNA, 22 nt, Pseudomonas putida KT2440
ggucaguauaugcucuaugcga

SEQ ID NO: 35105 - RNA, 22 nt, Pseudomonas putida KT2440
ggucauggccggggucaagcug

SEQ ID NO: 35106 - RNA, 23 nt, Pseudomonas putida KT2440
ggucgacgcuguucuugccugcg

SEQ ID NO: 35107 - RNA, 22 nt, Pseudomonas putida KT2440
ggucgaggcuucgccaggcggu

SEQ ID NO: 35108 - RNA, 22 nt, Pseudomonas putida KT2440
ggucgcaccugucgcacugcuc

SEQ ID NO: 35109 - RNA, 22 nt, Pseudomonas putida KT2440
ggucgcugcugaucagcugggu

SEQ ID NO: 35110 - RNA, 19 nt, Pseudomonas putida KT2440
ggucggacaaggcagacau

SEQ ID NO: 35111 - RNA, 22 nt, Pseudomonas putida KT2440
ggugcacgugcucgggguggcu

SEQ ID NO: 35112 - RNA, 22 nt, Pseudomonas putida KT2440
ggugcagaaccuggugcgcaau

SEQ ID NO: 35113 - RNA, 22 nt, Pseudomonas putida KT2440
ggugccaccguauucgcugaug

SEQ ID NO: 35114 - RNA, 22 nt, Pseudomonas putida KT2440
ggugccgaggaacugcggcgcg

SEQ ID NO: 35115 - RNA, 22 nt, Pseudomonas putida KT2440
ggugccuuguucagcgccagcc

SEQ ID NO: 35116 - RNA, 22 nt, Pseudomonas putida KT2440
ggugcggagcgccccuacgauu

SEQ ID NO: 35117 - RNA, 22 nt, Pseudomonas putida KT2440
ggugcugaugcucggcgacggg

SEQ ID NO: 35118 - RNA, 23 nt, Pseudomonas putida KT2440
gguggccagcacuucgaauacgc

SEQ ID NO: 35119 - RNA, 22 nt, Pseudomonas putida KT2440
ggugguacagcggcgaagcgau

SEQ ID NO: 35120 - RNA, 22 nt, Pseudomonas putida KT2440
ggugucgaugcccugguacugg

SEQ ID NO: 35121 - RNA, 22 nt, Pseudomonas putida KT2440
ggugugccacgugcgcuggagc

SEQ ID NO: 35122 - RNA, 22 nt, Pseudomonas putida KT2440
gguuccugugggagcgggcgcg

SEQ ID NO: 35123 - RNA, 22 nt, Pseudomonas putida KT2440
gguucgucacagugaaaucggg

SEQ ID NO: 35124 - RNA, 22 nt, Pseudomonas putida KT2440
gguugccauggauuauuggaaa

SEQ ID NO: 35125 - RNA, 20 nt, Pseudomonas putida KT2440
gguuuacccgcgaagaggcc

SEQ ID NO: 35126 - RNA, 22 nt, Pseudomonas putida KT2440
gguuucacaucgaacggguugg

SEQ ID NO: 35127 - RNA, 22 nt, Pseudomonas putida KT2440
guacgugccgaucgaugaagca

SEQ ID NO: 35128 - RNA, 22 nt, Pseudomonas putida KT2440
guagaggcguaccaguggcaac

SEQ ID NO: 35129 - RNA, 22 nt, Pseudomonas putida KT2440
guagcccacgaacagcaacaug

SEQ ID NO: 35130 - RNA, 22 nt, Pseudomonas putida KT2440
guaggagcgggcuugcccgcga

SEQ ID NO: 35131 - RNA, 22 nt, Pseudomonas putida KT2440
guaggagcggguuacccgcgaa

SEQ ID NO: 35132 - RNA, 22 nt, Pseudomonas putida KT2440
guaggcaggugcgccuggcacu

SEQ ID NO: 35133 - RNA, 22 nt, Pseudomonas putida KT2440
guauuaccugugggagcggccu

SEQ ID NO: 35134 - RNA, 22 nt, Pseudomonas putida KT2440
gucaccgcaaucagggcgaaca

SEQ ID NO: 35135 - RNA, 22 nt, Pseudomonas putida KT2440
gucacugacgaugucgauaccg

SEQ ID NO: 35136 - RNA, 20 nt, Pseudomonas putida KT2440
gucacugccuugccauuggc

SEQ ID NO: 35137 - RNA, 22 nt, Pseudomonas putida KT2440
gucagcagcuggcugguggugu

SEQ ID NO: 35138 - RNA, 22 nt, Pseudomonas putida KT2440
gucauggucucuccuucgcuua

SEQ ID NO: 35139 - RNA, 22 nt, Pseudomonas putida KT2440
guccagcgcagaggccacacgg

SEQ ID NO: 35140 - RNA, 22 nt, Pseudomonas putida KT2440
guccugcaaggucagguugguc

SEQ ID NO: 35141 - RNA, 22 nt, Pseudomonas putida KT2440
guccuguuccaaugcuucgccc

SEQ ID NO: 35142 - RNA, 22 nt, Pseudomonas putida KT2440
guccuugaccgugucggccacg

SEQ ID NO: 35143 - RNA, 22 nt, Pseudomonas putida KT2440
gucgcacaggaccaggucgaac

SEQ ID NO: 35144 - RNA, 22 nt, Pseudomonas putida KT2440
gucgcgcugcacauagugaugg

SEQ ID NO: 35145 - RNA, 22 nt, Pseudomonas putida KT2440
gucgcggugcaggcuggccagu

SEQ ID NO: 35146 - RNA, 22 nt, Pseudomonas putida KT2440
gucgcugaugcguucgccggug

SEQ ID NO: 35147 - RNA, 22 nt, Pseudomonas putida KT2440
gucggccagggcauauccggcg

SEQ ID NO: 35148 - RNA, 22 nt, Pseudomonas putida KT2440
gucguagaucgacaugccggcg

SEQ ID NO: 35149 - RNA, 22 nt, Pseudomonas putida KT2440
gucguugaguucggcaauggca

SEQ ID NO: 35150 - RNA, 22 nt, Pseudomonas putida KT2440
gucuuccagcgaagcgucgggu

SEQ ID NO: 35151 - RNA, 22 nt, Pseudomonas putida KT2440
gugaccaacgucgccaccccca

SEQ ID NO: 35152 - RNA, 22 nt, Pseudomonas putida KT2440
gugacccguguaggagcggguu

SEQ ID NO: 35153 - RNA, 22 nt, Pseudomonas putida KT2440
gugaccguguaggagcggguuu

SEQ ID NO: 35154 - RNA, 22 nt, Pseudomonas putida KT2440
gugacgcugcucgguagagucg

SEQ ID NO: 35155 - RNA, 22 nt, Pseudomonas putida KT2440
gugauuccugugggagcgggcg

SEQ ID NO: 35156 - RNA, 22 nt, Pseudomonas putida KT2440
gugcaauugcaguugaaugccg

SEQ ID NO: 35157 - RNA, 22 nt, Pseudomonas putida KT2440
gugcacagccaucuggucagcg

SEQ ID NO: 35158 - RNA, 22 nt, Pseudomonas putida KT2440
gugcaucacgcguacaucaggc

SEQ ID NO: 35159 - RNA, 22 nt, Pseudomonas putida KT2440
gugcauuaccugugggagcggg

SEQ ID NO: 35160 - RNA, 22 nt, Pseudomonas putida KT2440
gugccagcggucagcgcggugc

SEQ ID NO: 35161 - RNA, 22 nt, Pseudomonas putida KT2440
gugccguuggccggcacaguga

SEQ ID NO: 35162 - RNA, 22 nt, Pseudomonas putida KT2440
gugcgcagaugccagcguugcu

SEQ ID NO: 35163 - RNA, 22 nt, Pseudomonas putida KT2440
gugcgccaggcccgggcaagcg

SEQ ID NO: 35164 - RNA, 22 nt, Pseudomonas putida KT2440
gugcgccugaaggcggcggugu

SEQ ID NO: 35165 - RNA, 22 nt, Pseudomonas putida KT2440
gugcgcguggugcacggggaaa

SEQ ID NO: 35166 - RNA, 22 nt, Pseudomonas putida KT2440
guggaccagacaauggugcggu

SEQ ID NO: 35167 - RNA, 22 nt, Pseudomonas putida KT2440
guggccuacuggugcguucgga

SEQ ID NO: 35168 - RNA, 22 nt, Pseudomonas putida KT2440
guggcgaaaucaacuacgaagu

SEQ ID NO: 35169 - RNA, 22 nt, Pseudomonas putida KT2440
guggcgcuguaguucgacugca

SEQ ID NO: 35170 - RNA, 22 nt, Pseudomonas putida KT2440
guggguaagucacacauuggcu

SEQ ID NO: 35171 - RNA, 22 nt, Pseudomonas putida KT2440
guggucauccccggcaagggcc

SEQ ID NO: 35172 - RNA, 22 nt, Pseudomonas putida KT2440
guguaggagcggguuuacccgc

SEQ ID NO: 35173 - RNA, 19 nt, Pseudomonas putida KT2440
guguccgacgacggcacgu

SEQ ID NO: 35174 - RNA, 22 nt, Pseudomonas putida KT2440
gugucgaacugcucaacgacgc

SEQ ID NO: 35175 - RNA, 22 nt, Pseudomonas putida KT2440
gugucggcguucuucaucagcu

SEQ ID NO: 35176 - RNA, 22 nt, Pseudomonas putida KT2440
guucauccgaggcguugcggca

SEQ ID NO: 35177 - RNA, 22 nt, Pseudomonas putida KT2440
guuccgcgacuacgccgccuac

SEQ ID NO: 35178 - RNA, 22 nt, Pseudomonas putida KT2440
guuccugggcgaggugacgcag

SEQ ID NO: 35179 - RNA, 22 nt, Pseudomonas putida KT2440
guucgacucgauucagggcuug

SEQ ID NO: 35180 - RNA, 22 nt, Pseudomonas putida KT2440
guucgagccgauguaccggcag

SEQ ID NO: 35181 - RNA, 22 nt, Pseudomonas putida KT2440
guucgaggugaaggcugaacag

SEQ ID NO: 35182 - RNA, 22 nt, Pseudomonas putida KT2440
guucggcggcgaucagcgaacg

SEQ ID NO: 35183 - RNA, 22 nt, Pseudomonas putida KT2440
guucgucgacagugagcaugcc

SEQ ID NO: 35184 - RNA, 22 nt, Pseudomonas putida KT2440
guucgucgcuggcgcgcaaggc

SEQ ID NO: 35185 - RNA, 22 nt, Pseudomonas putida KT2440
guucgucugcggguugcugaug

SEQ ID NO: 35186 - RNA, 22 nt, Pseudomonas putida KT2440
guugaucauggccggcgcacgu

SEQ ID NO: 35187 - RNA, 22 nt, Pseudomonas putida KT2440
guugaucgagcacccggcggug

SEQ ID NO: 35188 - RNA, 22 nt, Pseudomonas putida KT2440
guugcccguggccaccgugguu

SEQ ID NO: 35189 - RNA, 22 nt, Pseudomonas putida KT2440
guugcgccuggccacccugcca

SEQ ID NO: 35190 - RNA, 22 nt, Pseudomonas putida KT2440
guugcgcgaguuuguuguucag

SEQ ID NO: 35191 - RNA, 22 nt, Pseudomonas putida KT2440
guuuacccgcgaagaggccgga

SEQ ID NO: 35192 - RNA, 22 nt, Pseudomonas putida KT2440
uaaacccgcuccuacaaagguu

SEQ ID NO: 35193 - RNA, 22 nt, Pseudomonas putida KT2440
uaaacccgcuccuaccacggcg

SEQ ID NO: 35194 - RNA, 22 nt, Pseudomonas putida KT2440
uaaagccguuccuacagggggu

SEQ ID NO: 35195 - RNA, 22 nt, Pseudomonas putida KT2440
uaaccgagcauucugcggcugu

SEQ ID NO: 35196 - RNA, 21 nt, Pseudomonas putida KT2440
uacccugaacgugcgccugga

SEQ ID NO: 35197 - RNA, 22 nt, Pseudomonas putida KT2440
uaccguuggccggcacggugau

SEQ ID NO: 35198 - RNA, 22 nt, Pseudomonas putida KT2440
uaccugguggucgauacgcccg

SEQ ID NO: 35199 - RNA, 22 nt, Pseudomonas putida KT2440
uacgagccgcaggcaagcgcag

SEQ ID NO: 35200 - RNA, 22 nt, Pseudomonas putida KT2440
uacgcccagaacggcaucgccc

SEQ ID NO: 35201 - RNA, 22 nt, Pseudomonas putida KT2440
uacucgcgaaggcgcagaccug

SEQ ID NO: 35202 - RNA, 22 nt, Pseudomonas putida KT2440
uagaggccugcaauagcuugag

SEQ ID NO: 35203 - RNA, 22 nt, Pseudomonas putida KT2440
uagcagauagugcaguuucaug

SEQ ID NO: 35204 - RNA, 22 nt, Pseudomonas putida KT2440
uagcagcggccagaacgcucua

SEQ ID NO: 35205 - RNA, 22 nt, Pseudomonas putida KT2440
uagcauggucauuccgcuggcg

SEQ ID NO: 35206 - RNA, 22 nt, Pseudomonas putida KT2440
uagcgcagaugccggucguagc

SEQ ID NO: 35207 - RNA, 22 nt, Pseudomonas putida KT2440
uagcugaggccguuggugcccg

SEQ ID NO: 35208 - RNA, 22 nt, Pseudomonas putida KT2440
uaggagcgggcuugcccgcgaa

SEQ ID NO: 35209 - RNA, 22 nt, Pseudomonas putida KT2440
uaggagcggguuuacccgcgaa

SEQ ID NO: 35210 - RNA, 22 nt, Pseudomonas putida KT2440
uaggagcggguuuacccgcgua

SEQ ID NO: 35211 - RNA, 22 nt, Pseudomonas putida KT2440
uaggaucggguuuacccgcgaa

SEQ ID NO: 35212 - RNA, 22 nt, Pseudomonas putida KT2440
uaggcuucgcucuccagcaggu

SEQ ID NO: 35213 - RNA, 22 nt, Pseudomonas putida KT2440
uaggugaaggucagcgugcaau

SEQ ID NO: 35214 - RNA, 22 nt, Pseudomonas putida KT2440
uaucagcaucacaaguggccau

SEQ ID NO: 35215 - RNA, 22 nt, Pseudomonas putida KT2440
uaucaucgacugguucagcgcc

SEQ ID NO: 35216 - RNA, 22 nt, Pseudomonas putida KT2440
uauccaucgcccuggcucaggg

SEQ ID NO: 35217 - RNA, 22 nt, Pseudomonas putida KT2440
uauccgcgucgagggcgugcgg

SEQ ID NO: 35218 - RNA, 22 nt, Pseudomonas putida KT2440
uauccggcggucugcacggugu

SEQ ID NO: 35219 - RNA, 22 nt, Pseudomonas putida KT2440
uaucgccguggacgugcgcaaa

SEQ ID NO: 35220 - RNA, 22 nt, Pseudomonas putida KT2440
uaucgccugagccggccucuuc

SEQ ID NO: 35221 - RNA, 22 nt, Pseudomonas putida KT2440
uaugccugucggaucuacguca

SEQ ID NO: 35222 - RNA, 22 nt, Pseudomonas putida KT2440
uaugcgggcgcagcuucagccg

SEQ ID NO: 35223 - RNA, 22 nt, Pseudomonas putida KT2440
ucaacgguguaugucgcuaggu

SEQ ID NO: 35224 - RNA, 22 nt, Pseudomonas putida KT2440
ucaaggauggccaccaggguca

SEQ ID NO: 35225 - RNA, 22 nt, Pseudomonas putida KT2440
ucaagguacgacgcugggcgua

SEQ ID NO: 35226 - RNA, 22 nt, Pseudomonas putida KT2440
ucacccggaucauuucgucgag

SEQ ID NO: 35227 - RNA, 22 nt, Pseudomonas putida KT2440
ucaccgcugcgcuugaucagcg

SEQ ID NO: 35228 - RNA, 22 nt, Pseudomonas putida KT2440
ucaccgucguacacuuggccau

SEQ ID NO: 35229 - RNA, 22 nt, Pseudomonas putida KT2440
ucaccgugccggccaacggcac

SEQ ID NO: 35230 - RNA, 22 nt, Pseudomonas putida KT2440
ucacggcgaugaucggcaguuu

SEQ ID NO: 35231 - RNA, 18 nt, Pseudomonas putida KT2440
ucacguuuucacaccguc

SEQ ID NO: 35232 - RNA, 20 nt, Pseudomonas putida KT2440
ucagcagguuggugaugauc

SEQ ID NO: 35233 - RNA, 22 nt, Pseudomonas putida KT2440
ucagcccaauaucgcaggcccc

SEQ ID NO: 35234 - RNA, 20 nt, Pseudomonas putida KT2440
ucagccguuuucacacaguc

SEQ ID NO: 35235 - RNA, 20 nt, Pseudomonas putida KT2440
ucagccugguggugaacagc

SEQ ID NO: 35236 - RNA, 22 nt, Pseudomonas putida KT2440
ucagcgugaaggucaaugcacu

SEQ ID NO: 35237 - RNA, 22 nt, Pseudomonas putida KT2440
ucagcugauuguugagcaggaa

SEQ ID NO: 35238 - RNA, 22 nt, Pseudomonas putida KT2440
ucagcuugaggcaugugcuguc

SEQ ID NO: 35239 - RNA, 22 nt, Pseudomonas putida KT2440
ucaggccuuugucgaaggcauc

SEQ ID NO: 35240 - RNA, 22 nt, Pseudomonas putida KT2440
ucagggucacgaccaggucgug

SEQ ID NO: 35241 - RNA, 22 nt, Pseudomonas putida KT2440
ucaggucaccaucaaggcuggc

SEQ ID NO: 35242 - RNA, 22 nt, Pseudomonas putida KT2440
ucaucaugcuguucauccugcu

SEQ ID NO: 35243 - RNA, 22 nt, Pseudomonas putida KT2440
ucaucccguuguaguccuccag

SEQ ID NO: 35244 - RNA, 22 nt, Pseudomonas putida KT2440
ucaucgaguccggcccguacag

SEQ ID NO: 35245 - RNA, 22 nt, Pseudomonas putida KT2440
ucaucgaucaauccgggcuggc

SEQ ID NO: 35246 - RNA, 22 nt, Pseudomonas putida KT2440
ucaucgaugugggcgaauuggg

SEQ ID NO: 35247 - RNA, 22 nt, Pseudomonas putida KT2440
ucaucgcuggccugcuccaggg

SEQ ID NO: 35248 - RNA, 22 nt, Pseudomonas putida KT2440
ucaugcuuucuggcaggugcgg

SEQ ID NO: 35249 - RNA, 22 nt, Pseudomonas putida KT2440
ucauuggcagcgcaucgacuga

SEQ ID NO: 35250 - RNA, 22 nt, Pseudomonas putida KT2440
uccaaccguacccuuccuggag

SEQ ID NO: 35251 - RNA, 22 nt, Pseudomonas putida KT2440
uccacagauuguugacagccca

SEQ ID NO: 35252 - RNA, 22 nt, Pseudomonas putida KT2440
uccaccugguuuagcagaagcu

SEQ ID NO: 35253 - RNA, 22 nt, Pseudomonas putida KT2440
uccagcaccugcugcuggccga

SEQ ID NO: 35254 - RNA, 17 nt, Pseudomonas putida KT2440
uccagcgaugacccggc

SEQ ID NO: 35255 - RNA, 18 nt, Pseudomonas putida KT2440
uccaggccucggccaugc

SEQ ID NO: 35256 - RNA, 22 nt, Pseudomonas putida KT2440
uccaggcugggcagcaacccgg

SEQ ID NO: 35257 - RNA, 22 nt, Pseudomonas putida KT2440
uccagggugcgcgcagucgcuu

SEQ ID NO: 35258 - RNA, 22 nt, Pseudomonas putida KT2440
uccagguccucguugcgcggcg

SEQ ID NO: 35259 - RNA, 22 nt, Pseudomonas putida KT2440
uccagguguuacgcagcacauc

SEQ ID NO: 35260 - RNA, 22 nt, Pseudomonas putida KT2440
ucccggucacggucgagcgccu

SEQ ID NO: 35261 - RNA, 22 nt, Pseudomonas putida KT2440
uccgaugacgauaucuaccaga

SEQ ID NO: 35262 - RNA, 23 nt, Pseudomonas putida KT2440
uccugguucgucacgagcaggcg

SEQ ID NO: 35263 - RNA, 22 nt, Pseudomonas putida KT2440
uccuuagcagucugcgucggcu

SEQ ID NO: 35264 - RNA, 22 nt, Pseudomonas putida KT2440
ucgaaggcauuguugcgggcac

SEQ ID NO: 35265 - RNA, 22 nt, Pseudomonas putida KT2440
ucgacgccgcuggugugcucgg

SEQ ID NO: 35266 - RNA, 22 nt, Pseudomonas putida KT2440
ucgagcggccggguagcggcga

SEQ ID NO: 35267 - RNA, 22 nt, Pseudomonas putida KT2440
ucgaggaugcgcgguacaucug

SEQ ID NO: 35268 - RNA, 22 nt, Pseudomonas putida KT2440
ucgaggaugcuggugucgucgg

SEQ ID NO: 35269 - RNA, 19 nt, Pseudomonas putida KT2440
ucgaguaccgauggggcau

SEQ ID NO: 35270 - RNA, 22 nt, Pseudomonas putida KT2440
ucgauaccggagaacugcgguu

SEQ ID NO: 35271 - RNA, 22 nt, Pseudomonas putida KT2440
ucgaucagcaaggagccuguga

SEQ ID NO: 35272 - RNA, 22 nt, Pseudomonas putida KT2440
ucgcaacaacgcugaugcauca

SEQ ID NO: 35273 - RNA, 22 nt, Pseudomonas putida KT2440
ucgcacguaccgacgaucgcau

SEQ ID NO: 35274 - RNA, 22 nt, Pseudomonas putida KT2440
ucgcaucagugaccguguucgg

SEQ ID NO: 35275 - RNA, 22 nt, Pseudomonas putida KT2440
ucgccaugcuggaggagggggu

SEQ ID NO: 35276 - RNA, 22 nt, Pseudomonas putida KT2440
ucgccgaaacgguuuucaucag

SEQ ID NO: 35277 - RNA, 21 nt, Pseudomonas putida KT2440
ucgccgaccguguugucgcgc

SEQ ID NO: 35278 - RNA, 22 nt, Pseudomonas putida KT2440
ucgccgacgucgagaaaggcau

SEQ ID NO: 35279 - RNA, 22 nt, Pseudomonas putida KT2440
ucgccgaggcgcuggaggccga

SEQ ID NO: 35280 - RNA, 22 nt, Pseudomonas putida KT2440
ucgccggugccgauggcaaagc

SEQ ID NO: 35281 - RNA, 22 nt, Pseudomonas putida KT2440
ucgcgacacaaggccgcuccca

SEQ ID NO: 35282 - RNA, 22 nt, Pseudomonas putida KT2440
ucgcgcaauucgacgcggcuga

SEQ ID NO: 35283 - RNA, 22 nt, Pseudomonas putida KT2440
ucgcggcaagcccgcuccuaca

SEQ ID NO: 35284 - RNA, 22 nt, Pseudomonas putida KT2440
ucgcggguaaacccgcuccuac

SEQ ID NO: 35285 - RNA, 22 nt, Pseudomonas putida KT2440
ucgcgggugaacccgcugaugg

SEQ ID NO: 35286 - RNA, 22 nt, Pseudomonas putida KT2440
ucgcggguggcgauguacaugg

SEQ ID NO: 35287 - RNA, 23 nt, Pseudomonas putida KT2440
ucgcgucgguacaugugccacuc

SEQ ID NO: 35288 - RNA, 22 nt, Pseudomonas putida KT2440
ucgcguugaugggccaagcggc

SEQ ID NO: 35289 - RNA, 23 nt, Pseudomonas putida KT2440
ucgcuggacgaagugcgcaccgc

SEQ ID NO: 35290 - RNA, 22 nt, Pseudomonas putida KT2440
ucggaagaaaccuucaugggca

SEQ ID NO: 35291 - RNA, 23 nt, Pseudomonas putida KT2440
ucggaagcagcgccaucgccggc

SEQ ID NO: 35292 - RNA, 22 nt, Pseudomonas putida KT2440
ucggaaggugaguuccccggac

SEQ ID NO: 35293 - RNA, 22 nt, Pseudomonas putida KT2440
ucggacagcgccagguagcugg

SEQ ID NO: 35294 - RNA, 22 nt, Pseudomonas putida KT2440
ucggagacaggugcggcgcgcc

SEQ ID NO: 35295 - RNA, 19 nt, Pseudomonas putida KT2440
ucggaggcuuucugcgcgu

SEQ ID NO: 35296 - RNA, 22 nt, Pseudomonas putida KT2440
ucggcacgcuugagggugucgc

SEQ ID NO: 35297 - RNA, 22 nt, Pseudomonas putida KT2440
ucggccaaccaacugaugggug

SEQ ID NO: 35298 - RNA, 22 nt, Pseudomonas putida KT2440
ucggccuuggcagugguguaga

SEQ ID NO: 35299 - RNA, 22 nt, Pseudomonas putida KT2440
ucggcugauggcgcaggcgaug

SEQ ID NO: 35300 - RNA, 22 nt, Pseudomonas putida KT2440
ucggcuuggcgcuugcuggugu

SEQ ID NO: 35301 - RNA, 22 nt, Pseudomonas putida KT2440
ucgggcaguugaacugccaagg

SEQ ID NO: 35302 - RNA, 21 nt, Pseudomonas putida KT2440
ucgggcgucugguuguucucg

SEQ ID NO: 35303 - RNA, 22 nt, Pseudomonas putida KT2440
ucgggcucaguggccuggugcu

SEQ ID NO: 35304 - RNA, 22 nt, Pseudomonas putida KT2440
ucgggucugcccgcgcaggcgc

SEQ ID NO: 35305 - RNA, 22 nt, Pseudomonas putida KT2440
ucggucgaucggguuggcgccg

SEQ ID NO: 35306 - RNA, 22 nt, Pseudomonas putida KT2440
ucggugaguuucuuagaaucgu

SEQ ID NO: 35307 - RNA, 22 nt, Pseudomonas putida KT2440
ucggugcaggccgcccgaggca

SEQ ID NO: 35308 - RNA, 22 nt, Pseudomonas putida KT2440
ucggugccagcgcgcaugucca

SEQ ID NO: 35309 - RNA, 22 nt, Pseudomonas putida KT2440
ucggugcuaccgaccuguucca

SEQ ID NO: 35310 - RNA, 22 nt, Pseudomonas putida KT2440
ucguacgacaaguccaaagagu

SEQ ID NO: 35311 - RNA, 22 nt, Pseudomonas putida KT2440
ucguaggagcgaguuuacccgc

SEQ ID NO: 35312 - RNA, 22 nt, Pseudomonas putida KT2440
ucguaggagcggguuuacccgc

SEQ ID NO: 35313 - RNA, 22 nt, Pseudomonas putida KT2440
ucgucagaagucagcaggcugu

SEQ ID NO: 35314 - RNA, 20 nt, Pseudomonas putida KT2440
ucguccugucgccugcugcu

SEQ ID NO: 35315 - RNA, 22 nt, Pseudomonas putida KT2440
ucgucgaugaggcccugcagcg

SEQ ID NO: 35316 - RNA, 22 nt, Pseudomonas putida KT2440
ucguggauuuccagcgugccgu

SEQ ID NO: 35317 - RNA, 22 nt, Pseudomonas putida KT2440
ucuacgacaugaucuucaccca

SEQ ID NO: 35318 - RNA, 21 nt, Pseudomonas putida KT2440
ucuccgcgcgcagcauugccg

SEQ ID NO: 35319 - RNA, 22 nt, Pseudomonas putida KT2440
ucucgcuaaaauugugcaguug

SEQ ID NO: 35320 - RNA, 22 nt, Pseudomonas putida KT2440
ucucggccaaguggcgcugugc

SEQ ID NO: 35321 - RNA, 22 nt, Pseudomonas putida KT2440
ucucuacagcguugacaggcau

SEQ ID NO: 35322 - RNA, 21 nt, Pseudomonas putida KT2440
ucugaucguugaucggcgaag

SEQ ID NO: 35323 - RNA, 22 nt, Pseudomonas putida KT2440
ucugcacgacaucuucuucgaa

SEQ ID NO: 35324 - RNA, 22 nt, Pseudomonas putida KT2440
ucugcgaagggcugaggaauug

SEQ ID NO: 35325 - RNA, 22 nt, Pseudomonas putida KT2440
ucuggcaguuccuggcugcgcc

SEQ ID NO: 35326 - RNA, 22 nt, Pseudomonas putida KT2440
ucugucgcucggucaucgagga

SEQ ID NO: 35327 - RNA, 22 nt, Pseudomonas putida KT2440
ucuugcgugguuugugcuugcu

SEQ ID NO: 35328 - RNA, 22 nt, Pseudomonas putida KT2440
ucuuucagccggacccggccug

SEQ ID NO: 35329 - RNA, 22 nt, Pseudomonas putida KT2440
ugaacacccaugaguuguaucc

SEQ ID NO: 35330 - RNA, 22 nt, Pseudomonas putida KT2440
ugaacugacgcauucgcgggca

SEQ ID NO: 35331 - RNA, 22 nt, Pseudomonas putida KT2440
ugacagccaucagcaucggaug

SEQ ID NO: 35332 - RNA, 20 nt, Pseudomonas putida KT2440
ugaccacgccacaggcgcug

SEQ ID NO: 35333 - RNA, 22 nt, Pseudomonas putida KT2440
ugaccgaucaucagccagcaau

SEQ ID NO: 35334 - RNA, 22 nt, Pseudomonas putida KT2440
ugaccgguauugccagccguca

SEQ ID NO: 35335 - RNA, 22 nt, Pseudomonas putida KT2440
ugaccuugggugagcggggcgg

SEQ ID NO: 35336 - RNA, 22 nt, Pseudomonas putida KT2440
ugacgcccuugugggagcgggu

SEQ ID NO: 35337 - RNA, 22 nt, Pseudomonas putida KT2440
ugagcaggucaucggucaggaa

SEQ ID NO: 35338 - RNA, 22 nt, Pseudomonas putida KT2440
ugagccugcccggucgggucaa

SEQ ID NO: 35339 - RNA, 22 nt, Pseudomonas putida KT2440
ugaucgagcagguuggccaggc

SEQ ID NO: 35340 - RNA, 21 nt, Pseudomonas putida KT2440
ugaucgcgcacagccagcuuu

SEQ ID NO: 35341 - RNA, 19 nt, Pseudomonas putida KT2440
ugaucgcugacgugauucc

SEQ ID NO: 35342 - RNA, 22 nt, Pseudomonas putida KT2440
ugaucggcaaugcaaaacgccc

SEQ ID NO: 35343 - RNA, 22 nt, Pseudomonas putida KT2440
ugaucguacugaucacggccuu

SEQ ID NO: 35344 - RNA, 22 nt, Pseudomonas putida KT2440
ugaugcccagcgucaguggcaa

SEQ ID NO: 35345 - RNA, 21 nt, Pseudomonas putida KT2440
ugaugccguucuucuccaugc

SEQ ID NO: 35346 - RNA, 21 nt, Pseudomonas putida KT2440
ugaugcgguccuuggccauga

SEQ ID NO: 35347 - RNA, 22 nt, Pseudomonas putida KT2440
ugaugcugccccgaagccacac

SEQ ID NO: 35348 - RNA, 22 nt, Pseudomonas putida KT2440
ugauggcguagcucagcagcgu

SEQ ID NO: 35349 - RNA, 22 nt, Pseudomonas putida KT2440
ugauuaccugugggagcgggca

SEQ ID NO: 35350 - RNA, 22 nt, Pseudomonas putida KT2440
ugcaaucgacccaaagcugccc

SEQ ID NO: 35351 - RNA, 22 nt, Pseudomonas putida KT2440
ugcaaucgauagacgcacguua

SEQ ID NO: 35352 - RNA, 22 nt, Pseudomonas putida KT2440
ugcacccaggccaugugcggca

SEQ ID NO: 35353 - RNA, 22 nt, Pseudomonas putida KT2440
ugcacgucagucuugggcacgc

SEQ ID NO: 35354 - RNA, 22 nt, Pseudomonas putida KT2440
ugcagauuccguaggagcgggc

SEQ ID NO: 35355 - RNA, 22 nt, Pseudomonas putida KT2440
ugcagccgcgcaguugcuuggc

SEQ ID NO: 35356 - RNA, 22 nt, Pseudomonas putida KT2440
ugcagcguuuuaucugguacug

SEQ ID NO: 35357 - RNA, 21 nt, Pseudomonas putida KT2440
ugcagcucgguuucauccagg

SEQ ID NO: 35358 - RNA, 23 nt, Pseudomonas putida KT2440
ugcaggcgcggguuuacccgcga

SEQ ID NO: 35359 - RNA, 22 nt, Pseudomonas putida KT2440
ugcaggcgcggucuugcccgca

SEQ ID NO: 35360 - RNA, 22 nt, Pseudomonas putida KT2440
ugcagggacguaaugcgggauc

SEQ ID NO: 35361 - RNA, 22 nt, Pseudomonas putida KT2440
ugcagggccguggagccuucac

SEQ ID NO: 35362 - RNA, 22 nt, Pseudomonas putida KT2440
ugcagggcgcgggugaaggcuu

SEQ ID NO: 35363 - RNA, 22 nt, Pseudomonas putida KT2440
ugcagugccugugagaucgagc

SEQ ID NO: 35364 - RNA, 22 nt, Pseudomonas putida KT2440
ugcaguucagcgaccgacagga

SEQ ID NO: 35365 - RNA, 20 nt, Pseudomonas putida KT2440
ugcauaccgccaugccgauc

SEQ ID NO: 35366 - RNA, 22 nt, Pseudomonas putida KT2440
ugccaagucgccgcuuugcguu

SEQ ID NO: 35367 - RNA, 22 nt, Pseudomonas putida KT2440
ugccacggguuugcaggugacc

SEQ ID NO: 35368 - RNA, 22 nt, Pseudomonas putida KT2440
ugccagcggcaagcaagcgccg

SEQ ID NO: 35369 - RNA, 22 nt, Pseudomonas putida KT2440
ugccauuuaucugucgacucgu

SEQ ID NO: 35370 - RNA, 21 nt, Pseudomonas putida KT2440
ugcccaagggcuuggucaggu

SEQ ID NO: 35371 - RNA, 22 nt, Pseudomonas putida KT2440
ugcccaguugccaaugggcaug

SEQ ID NO: 35372 - RNA, 22 nt, Pseudomonas putida KT2440
ugcccaucacgggugauggccg

SEQ ID NO: 35373 - RNA, 22 nt, Pseudomonas putida KT2440
ugcccgaccaggccgcccaguu

SEQ ID NO: 35374 - RNA, 22 nt, Pseudomonas putida KT2440
ugcccgcuggcuuccaggaucu

SEQ ID NO: 35375 - RNA, 17 nt, Pseudomonas putida KT2440
ugccggcuuuuacccau

SEQ ID NO: 35376 - RNA, 22 nt, Pseudomonas putida KT2440
ugccggucggucaucagguuca

SEQ ID NO: 35377 - RNA, 22 nt, Pseudomonas putida KT2440
ugccggugcuggccccggcacu

SEQ ID NO: 35378 - RNA, 22 nt, Pseudomonas putida KT2440
ugccguuggcguacaucggcuc

SEQ ID NO: 35379 - RNA, 22 nt, Pseudomonas putida KT2440
ugccugaacaaaaaauacaagg

SEQ ID NO: 35380 - RNA, 22 nt, Pseudomonas putida KT2440
ugccuucgcccugccgauccug

SEQ ID NO: 35381 - RNA, 23 nt, Pseudomonas putida KT2440
ugcgagggacgugggguguauug

SEQ ID NO: 35382 - RNA, 22 nt, Pseudomonas putida KT2440
ugcgccagggcgaugugcuguu

SEQ ID NO: 35383 - RNA, 22 nt, Pseudomonas putida KT2440
ugcgccagggggcucgcgugcg

SEQ ID NO: 35384 - RNA, 22 nt, Pseudomonas putida KT2440
ugcgccuggucgagcacaugcc

SEQ ID NO: 35385 - RNA, 22 nt, Pseudomonas putida KT2440
ugcgcgguccuuguaggagcgg

SEQ ID NO: 35386 - RNA, 22 nt, Pseudomonas putida KT2440
ugcggacuuuucgcccuuucga

SEQ ID NO: 35387 - RNA, 22 nt, Pseudomonas putida KT2440
ugcggcaggauggugcuuugca

SEQ ID NO: 35388 - RNA, 22 nt, Pseudomonas putida KT2440
ugcgucaguuguucggccaugc

SEQ ID NO: 35389 - RNA, 22 nt, Pseudomonas putida KT2440
ugcucgaaaccgucgagcugau

SEQ ID NO: 35390 - RNA, 21 nt, Pseudomonas putida KT2440
ugcucgaucaacgccgcaugc

SEQ ID NO: 35391 - RNA, 22 nt, Pseudomonas putida KT2440
ugcugagcaaggccgggcucga

SEQ ID NO: 35392 - RNA, 22 nt, Pseudomonas putida KT2440
ugcugauaucggcggcggccag

SEQ ID NO: 35393 - RNA, 22 nt, Pseudomonas putida KT2440
ugcugcccacaggccgccgcgu

SEQ ID NO: 35394 - RNA, 22 nt, Pseudomonas putida KT2440
ugcugcgcagcccuuucgcgac

SEQ ID NO: 35395 - RNA, 22 nt, Pseudomonas putida KT2440
ugcugcgccuggccgagcaaac

SEQ ID NO: 35396 - RNA, 22 nt, Pseudomonas putida KT2440
ugcugcucaaggccagcgcggg

SEQ ID NO: 35397 - RNA, 19 nt, Pseudomonas putida KT2440
ugcugcuggugggcaaggc

SEQ ID NO: 35398 - RNA, 22 nt, Pseudomonas putida KT2440
ugcuggaacgcugggggccgcc

SEQ ID NO: 35399 - RNA, 22 nt, Pseudomonas putida KT2440
ugcuggacaugcuggacgaagu

SEQ ID NO: 35400 - RNA, 22 nt, Pseudomonas putida KT2440
acguccagcggcaugccguauu

SEQ ID NO: 35401 - RNA, 20 nt, Pseudomonas putida KT2440
acucgcuggcggugaccgag

SEQ ID NO: 35402 - RNA, 22 nt, Pseudomonas putida KT2440
acucggcgggggauguguuccu

SEQ ID NO: 35403 - RNA, 22 nt, Pseudomonas putida KT2440
acugaaggccaagcaggacggc

SEQ ID NO: 35404 - RNA, 20 nt, Pseudomonas putida KT2440
acugaagguuggcgguggcc

SEQ ID NO: 35405 - RNA, 22 nt, Pseudomonas putida KT2440
acugcgcgauagccuguggggc

SEQ ID NO: 35406 - RNA, 22 nt, Pseudomonas putida KT2440
acuggccaggcggcuguccaua

SEQ ID NO: 35407 - RNA, 22 nt, Pseudomonas putida KT2440
acuggcccuccgcgugcgguac

SEQ ID NO: 35408 - RNA, 21 nt, Pseudomonas putida KT2440
acuggcgcgcuugccggcugg

SEQ ID NO: 35409 - RNA, 22 nt, Pseudomonas putida KT2440
acuguucguaguagccucgccc

SEQ ID NO: 35410 - RNA, 22 nt, Pseudomonas putida KT2440
acuucgcggguaaacccgcucc

SEQ ID NO: 35411 - RNA, 23 nt, Pseudomonas putida KT2440
acuugcccaccgccgugaccagc

SEQ ID NO: 35412 - RNA, 22 nt, Pseudomonas putida KT2440
agaacccugugagagcgggcuu

SEQ ID NO: 35413 - RNA, 22 nt, Pseudomonas putida KT2440
agaaugaucagggugcuggagg

SEQ ID NO: 35414 - RNA, 22 nt, Pseudomonas putida KT2440
agaccgcugcugccacagggug

SEQ ID NO: 35415 - RNA, 22 nt, Pseudomonas putida KT2440
agacgcaggcggauggcuucga

SEQ ID NO: 35416 - RNA, 22 nt, Pseudomonas putida KT2440
agacucagguugcuuggaaagu

SEQ ID NO: 35417 - RNA, 22 nt, Pseudomonas putida KT2440
agacuucgucggggcugcgcag

SEQ ID NO: 35418 - RNA, 22 nt, Pseudomonas putida KT2440
agaucgagugcgagcccgcucc

SEQ ID NO: 35419 - RNA, 22 nt, Pseudomonas putida KT2440
agcaaggcgcuuuccggccggc

SEQ ID NO: 35420 - RNA, 22 nt, Pseudomonas putida KT2440
agcacggccagguggucgguga

SEQ ID NO: 35421 - RNA, 22 nt, Pseudomonas putida KT2440
agcagcacauggcguggguccg

SEQ ID NO: 35422 - RNA, 22 nt, Pseudomonas putida KT2440
agcagcgagcgacaagacaaga

SEQ ID NO: 35423 - RNA, 21 nt, Pseudomonas putida KT2440
agcaggaugccacgcgcuugc

SEQ ID NO: 35424 - RNA, 22 nt, Pseudomonas putida KT2440
agcagggcgcugacguccaccg

SEQ ID NO: 35425 - RNA, 22 nt, Pseudomonas putida KT2440
agcagguggagaucaucaccag

SEQ ID NO: 35426 - RNA, 22 nt, Pseudomonas putida KT2440
agcagguucugcgcggucagca

SEQ ID NO: 35427 - RNA, 22 nt, Pseudomonas putida KT2440
agcaguaccgcauugccuuggc

SEQ ID NO: 35428 - RNA, 22 nt, Pseudomonas putida KT2440
agcaguggaugggccgggucga

SEQ ID NO: 35429 - RNA, 22 nt, Pseudomonas putida KT2440
agcaucaucgacgauugcguga

SEQ ID NO: 35430 - RNA, 22 nt, Pseudomonas putida KT2440
agccagcggcgcuacccguucu

SEQ ID NO: 35431 - RNA, 22 nt, Pseudomonas putida KT2440
agccaggcgcuggaucaguuga

SEQ ID NO: 35432 - RNA, 22 nt, Pseudomonas putida KT2440
agcccgcucccacaggaauggc

SEQ ID NO: 35433 - RNA, 22 nt, Pseudomonas putida KT2440
agcccgcuccgacauugaucgg

SEQ ID NO: 35434 - RNA, 22 nt, Pseudomonas putida KT2440
agcccgcuccuacaacgacugc

SEQ ID NO: 35435 - RNA, 22 nt, Pseudomonas putida KT2440
agcccgcuccugcagauuaccc

SEQ ID NO: 35436 - RNA, 22 nt, Pseudomonas putida KT2440
agcccguuccugcacagaucgc

SEQ ID NO: 35437 - RNA, 22 nt, Pseudomonas putida KT2440
agccgccaugaugucgaccuua

SEQ ID NO: 35438 - RNA, 22 nt, Pseudomonas putida KT2440
agccgccucgaaggccugcaca

SEQ ID NO: 35439 - RNA, 22 nt, Pseudomonas putida KT2440
agccgccuuugauuaccgccac

SEQ ID NO: 35440 - RNA, 22 nt, Pseudomonas putida KT2440
agccgcuccuacgaggacccca

SEQ ID NO: 35441 - RNA, 22 nt, Pseudomonas putida KT2440
agccggugauuaccgacugacc

SEQ ID NO: 35442 - RNA, 22 nt, Pseudomonas putida KT2440
agccgugggucggugaacaucu

SEQ ID NO: 35443 - RNA, 22 nt, Pseudomonas putida KT2440
agccugucgggguaucucaaga

SEQ ID NO: 35444 - RNA, 22 nt, Pseudomonas putida KT2440
agccuucgccacagcgcacgcc

SEQ ID NO: 35445 - RNA, 22 nt, Pseudomonas putida KT2440
agccuugucgcgcucgcccggg

SEQ ID NO: 35446 - RNA, 22 nt, Pseudomonas putida KT2440
agcgaugcgaugcgauguacca

SEQ ID NO: 35447 - RNA, 22 nt, Pseudomonas putida KT2440
agcgcaagacucaggcugggcu

SEQ ID NO: 35448 - RNA, 22 nt, Pseudomonas putida KT2440
agcgcagcgguggacuccugca

SEQ ID NO: 35449 - RNA, 22 nt, Pseudomonas putida KT2440
agcgccgagaagaacagcucca

SEQ ID NO: 35450 - RNA, 22 nt, Pseudomonas putida KT2440
agcgcgcauuuguuccccgagu

SEQ ID NO: 35451 - RNA, 22 nt, Pseudomonas putida KT2440
agcgcucuucuucggcggcggc

SEQ ID NO: 35452 - RNA, 22 nt, Pseudomonas putida KT2440
agcgcugccccuguguuugccc

SEQ ID NO: 35453 - RNA, 22 nt, Pseudomonas putida KT2440
agcggcaagcugcaagaaagca

SEQ ID NO: 35454 - RNA, 23 nt, Pseudomonas putida KT2440
agcggguagcggcgucuuuuucg

SEQ ID NO: 35455 - RNA, 22 nt, Pseudomonas putida KT2440
agcggguucacccgcgaaugcg

SEQ ID NO: 35456 - RNA, 22 nt, Pseudomonas putida KT2440
agcggguuuucucgcgaaugcg

SEQ ID NO: 35457 - RNA, 18 nt, Pseudomonas putida KT2440
agcguagcggugcgcgcc

SEQ ID NO: 35458 - RNA, 22 nt, Pseudomonas putida KT2440
agcgucugcggaguacggcggu

SEQ ID NO: 35459 - RNA, 22 nt, Pseudomonas putida KT2440
agcuacuguccgcgucaccuug

SEQ ID NO: 35460 - RNA, 22 nt, Pseudomonas putida KT2440
agcucgucgaacgagguuuccu

SEQ ID NO: 35461 - RNA, 22 nt, Pseudomonas putida KT2440
agcucguuaaucaugugcggcg

SEQ ID NO: 35462 - RNA, 22 nt, Pseudomonas putida KT2440
agcucuucaaccuuggcgucga

SEQ ID NO: 35463 - RNA, 22 nt, Pseudomonas putida KT2440
agcucuuggcugagcgcugaau

SEQ ID NO: 35464 - RNA, 22 nt, Pseudomonas putida KT2440
agcuggacgagcagggccagca

SEQ ID NO: 35465 - RNA, 22 nt, Pseudomonas putida KT2440
agcugggucgaugcggaaaaca

SEQ ID NO: 35466 - RNA, 22 nt, Pseudomonas putida KT2440
agcuggucgauauggcgggcau

SEQ ID NO: 35467 - RNA, 22 nt, Pseudomonas putida KT2440
agcuguugucgcggcgcggcau

SEQ ID NO: 35468 - RNA, 19 nt, Pseudomonas putida KT2440
agcuucaggcgcuggaccg

SEQ ID NO: 35469 - RNA, 22 nt, Pseudomonas putida KT2440
agcuugucgcgcgagcgggcaa

SEQ ID NO: 35470 - RNA, 22 nt, Pseudomonas putida KT2440
aggcacugucgagcagugacug

SEQ ID NO: 35471 - RNA, 22 nt, Pseudomonas putida KT2440
aggcaucgaagauuuugagcug

SEQ ID NO: 35472 - RNA, 22 nt, Pseudomonas putida KT2440
aggcaugcuguggcauggcagc

SEQ ID NO: 35473 - RNA, 23 nt, Pseudomonas putida KT2440
aggccgaugccggccagcagcag

SEQ ID NO: 35474 - RNA, 22 nt, Pseudomonas putida KT2440
aggccgcucccacagauaaugc

SEQ ID NO: 35475 - RNA, 22 nt, Pseudomonas putida KT2440
aggccgcucccacagguaauac

SEQ ID NO: 35476 - RNA, 22 nt, Pseudomonas putida KT2440
aggccgguguaggcgcggguuu

SEQ ID NO: 35477 - RNA, 22 nt, Pseudomonas putida KT2440
aggccguaggaguacgccagca

SEQ ID NO: 35478 - RNA, 22 nt, Pseudomonas putida KT2440
aggccugccagugcacaugccg

SEQ ID NO: 35479 - RNA, 22 nt, Pseudomonas putida KT2440
aggccuucaggccuucgaagca

SEQ ID NO: 35480 - RNA, 22 nt, Pseudomonas putida KT2440
aggccuugcgccugcuggccaa

SEQ ID NO: 35481 - RNA, 22 nt, Pseudomonas putida KT2440
aggcgacgguugaguucgagcc

SEQ ID NO: 35482 - RNA, 22 nt, Pseudomonas putida KT2440
aggcgaucgauacggccgucca

SEQ ID NO: 35483 - RNA, 22 nt, Pseudomonas putida KT2440
aggcgcugccgucauccuggau

SEQ ID NO: 35484 - RNA, 22 nt, Pseudomonas putida KT2440
aggcgcugcuguugcaucgcgu

SEQ ID NO: 35485 - RNA, 22 nt, Pseudomonas putida KT2440
auucgcgggcuugcucgcuccc

SEQ ID NO: 35486 - RNA, 22 nt, Pseudomonas putida KT2440
auucgcgggugaacccgcuccc

SEQ ID NO: 35487 - RNA, 22 nt, Pseudomonas putida KT2440
auucgggcgcaacuucggcugg

SEQ ID NO: 35488 - RNA, 22 nt, Pseudomonas putida KT2440
auuguucgaacagcagcauggc

SEQ ID NO: 35489 - RNA, 22 nt, Pseudomonas putida KT2440
auuguugcugccguuguggcua

SEQ ID NO: 35490 - RNA, 20 nt, Pseudomonas putida KT2440
auuugccugaucacccuggu

SEQ ID NO: 35491 - RNA, 22 nt, Pseudomonas putida KT2440
caacaguggcguaacgacagca

SEQ ID NO: 35492 - RNA, 22 nt, Pseudomonas putida KT2440
caacuucauggacgcacguuau

SEQ ID NO: 35493 - RNA, 22 nt, Pseudomonas putida KT2440
caagcgccuugacgagaacaac

SEQ ID NO: 35494 - RNA, 22 nt, Pseudomonas putida KT2440
caagcugaucaagcgcgaggag

SEQ ID NO: 35495 - RNA, 22 nt, Pseudomonas putida KT2440
caaggacccgucgccgaaggac

SEQ ID NO: 35496 - RNA, 22 nt, Pseudomonas putida KT2440
caaggccgcucccacagggacu

SEQ ID NO: 35497 - RNA, 22 nt, Pseudomonas putida KT2440
caaggcuuuucauacgggccuu

SEQ ID NO: 35498 - RNA, 22 nt, Pseudomonas putida KT2440
caagucacccaggaggcugccg

SEQ ID NO: 35499 - RNA, 22 nt, Pseudomonas putida KT2440
caauuucguuuuccagaggcgc

SEQ ID NO: 35500 - RNA, 22 nt, Pseudomonas putida KT2440
cacagccugagccugccguucc

SEQ ID NO: 35501 - RNA, 17 nt, Pseudomonas putida KT2440
caccaugcucgcugccc

SEQ ID NO: 35502 - RNA, 23 nt, Pseudomonas putida KT2440
caccgacuacagcgugguggucg

SEQ ID NO: 35503 - RNA, 21 nt, Pseudomonas putida KT2440
caccuggcgauguggaugggg

SEQ ID NO: 35504 - RNA, 22 nt, Pseudomonas putida KT2440
caccugggugaacaucgccagc

SEQ ID NO: 35505 - RNA, 22 nt, Pseudomonas putida KT2440
caccugucgccgcaggccauga

SEQ ID NO: 35506 - RNA, 22 nt, Pseudomonas putida KT2440
cacgaggcgggccugcggugcg

SEQ ID NO: 35507 - RNA, 22 nt, Pseudomonas putida KT2440
cacgaucaguggcaacugcgcg

SEQ ID NO: 35508 - RNA, 22 nt, Pseudomonas putida KT2440
cacggcuuacgaccuggccugg

SEQ ID NO: 35509 - RNA, 22 nt, Pseudomonas putida KT2440
cacugauauccagguccagggu

SEQ ID NO: 35510 - RNA, 22 nt, Pseudomonas putida KT2440
cacugcuucagaguucgcgcuu

SEQ ID NO: 35511 - RNA, 23 nt, Pseudomonas putida KT2440
cagaacgugcuggccgaccuggc

SEQ ID NO: 35512 - RNA, 22 nt, Pseudomonas putida KT2440
cagaagcgucgaggucgagcca

SEQ ID NO: 35513 - RNA, 22 nt, Pseudomonas putida KT2440
cagaccaggcucuggcgcugcu

SEQ ID NO: 35514 - RNA, 22 nt, Pseudomonas putida KT2440
cagaccgucguaggagcggguu

SEQ ID NO: 35515 - RNA, 22 nt, Pseudomonas putida KT2440
cagagcagaugcggucuugcag

SEQ ID NO: 35516 - RNA, 22 nt, Pseudomonas putida KT2440
cagagcucuugcuucgauuagg

SEQ ID NO: 35517 - RNA, 22 nt, Pseudomonas putida KT2440
cagauugucggcagcgugcuga

SEQ ID NO: 35518 - RNA, 22 nt, Pseudomonas putida KT2440
cagcagcagcgccugugcaucg

SEQ ID NO: 35519 - RNA, 22 nt, Pseudomonas putida KT2440
cagcagcgguaccaaggcgauc

SEQ ID NO: 35520 - RNA, 22 nt, Pseudomonas putida KT2440
cagcaguugcucgucgcgcagg

SEQ ID NO: 35521 - RNA, 22 nt, Pseudomonas putida KT2440
cagcaugcagaccuggcacggg

SEQ ID NO: 35522 - RNA, 22 nt, Pseudomonas putida KT2440
cagccgcugcugcgcugggcca

SEQ ID NO: 35523 - RNA, 22 nt, Pseudomonas putida KT2440
cagccucuucacggucugcggu

SEQ ID NO: 35524 - RNA, 22 nt, Pseudomonas putida KT2440
cagcgccugggcgaggaugggu

SEQ ID NO: 35525 - RNA, 22 nt, Pseudomonas putida KT2440
cagcgcuauaagcuaaagucca

SEQ ID NO: 35526 - RNA, 22 nt, Pseudomonas putida KT2440
cagcgcuugcacggcaccggca

SEQ ID NO: 35527 - RNA, 22 nt, Pseudomonas putida KT2440
cagcggcacgcucggcggcaag

SEQ ID NO: 35528 - RNA, 22 nt, Pseudomonas putida KT2440
cagcggcuggccagcuuccugg

SEQ ID NO: 35529 - RNA, 23 nt, Pseudomonas putida KT2440
cagcucgucggaagggcgcuugg

SEQ ID NO: 35530 - RNA, 22 nt, Pseudomonas putida KT2440
cagcucucacaggugcaucaug

SEQ ID NO: 35531 - RNA, 22 nt, Pseudomonas putida KT2440
cagcuggcauugggccauggcu

SEQ ID NO: 35532 - RNA, 22 nt, Pseudomonas putida KT2440
cagcuggcggugguggguucgu

SEQ ID NO: 35533 - RNA, 22 nt, Pseudomonas putida KT2440
cagcuguucgacgugcuguauc

SEQ ID NO: 35534 - RNA, 22 nt, Pseudomonas putida KT2440
cagcuguucggcggcgcggguc

SEQ ID NO: 35535 - RNA, 22 nt, Pseudomonas putida KT2440
cagcuucagccuggcgcugcag

SEQ ID NO: 35536 - RNA, 22 nt, Pseudomonas putida KT2440
caggauagagccgucuuugauc

SEQ ID NO: 35537 - RNA, 22 nt, Pseudomonas putida KT2440
caggcaccagggcgggccugug

SEQ ID NO: 35538 - RNA, 22 nt, Pseudomonas putida KT2440
caggcaguggcggccgccgaca

SEQ ID NO: 35539 - RNA, 22 nt, Pseudomonas putida KT2440
caggccuugggcuucggccagc

SEQ ID NO: 35540 - RNA, 22 nt, Pseudomonas putida KT2440
caggcgcacugguugggcagga

SEQ ID NO: 35541 - RNA, 22 nt, Pseudomonas putida KT2440
caggcgcuggugccacacgacc

SEQ ID NO: 35542 - RNA, 22 nt, Pseudomonas putida KT2440
caggcguaacaggccgucuucg

SEQ ID NO: 35543 - RNA, 23 nt, Pseudomonas putida KT2440
caggcucaugccuugggccgagc

SEQ ID NO: 35544 - RNA, 22 nt, Pseudomonas putida KT2440
cagggccuggccaagcugcgcg

SEQ ID NO: 35545 - RNA, 22 nt, Pseudomonas putida KT2440
cagguaaaaaucaugcaguucu

SEQ ID NO: 35546 - RNA, 22 nt, Pseudomonas putida KT2440
cagguaaugguggugguacuga

SEQ ID NO: 35547 - RNA, 22 nt, Pseudomonas putida KT2440
cagguaguuacccagcgcacca

SEQ ID NO: 35548 - RNA, 22 nt, Pseudomonas putida KT2440
caggucaggaucagccgucagc

SEQ ID NO: 35549 - RNA, 22 nt, Pseudomonas putida KT2440
caggugaccuucgugucgauca

SEQ ID NO: 35550 - RNA, 22 nt, Pseudomonas putida KT2440
caggugaucguugcgcgccagg

SEQ ID NO: 35551 - RNA, 23 nt, Pseudomonas putida KT2440
caguaccgccuugaagcacuuga

SEQ ID NO: 35552 - RNA, 22 nt, Pseudomonas putida KT2440
cagucgguucauggcugcaccu

SEQ ID NO: 35553 - RNA, 22 nt, Pseudomonas putida KT2440
cagugaaagcgguugcgcccgg

SEQ ID NO: 35554 - RNA, 22 nt, Pseudomonas putida KT2440
cagugcccagcaauacgccacc

SEQ ID NO: 35555 - RNA, 22 nt, Pseudomonas putida KT2440
caguucagaaccgccguagacc

SEQ ID NO: 35556 - RNA, 22 nt, Pseudomonas putida KT2440
caguucgaccaccugggccagg

SEQ ID NO: 35557 - RNA, 22 nt, Pseudomonas putida KT2440
cauaagcucuuugaaaaugcuu

SEQ ID NO: 35558 - RNA, 22 nt, Pseudomonas putida KT2440
cauaccucugacgcuggccugc

SEQ ID NO: 35559 - RNA, 22 nt, Pseudomonas putida KT2440
caucacugacagcaccagugcc

SEQ ID NO: 35560 - RNA, 22 nt, Pseudomonas putida KT2440
caucauccguaccgaggaauau

SEQ ID NO: 35561 - RNA, 22 nt, Pseudomonas putida KT2440
caucccguaucugugcugcuag

SEQ ID NO: 35562 - RNA, 22 nt, Pseudomonas putida KT2440
caucgcccagcggaacuggcuu

SEQ ID NO: 35563 - RNA, 22 nt, Pseudomonas putida KT2440
caucgcgaaucaggucugccgu

SEQ ID NO: 35564 - RNA, 22 nt, Pseudomonas putida KT2440
caugaugacuaaaaacauccua

SEQ ID NO: 35565 - RNA, 22 nt, Pseudomonas putida KT2440
cauguucgucuggaacaugguc

SEQ ID NO: 35566 - RNA, 22 nt, Pseudomonas putida KT2440
cauugccaacccugaccuggug

SEQ ID NO: 35567 - RNA, 22 nt, Pseudomonas putida KT2440
cauuggcgagcuuguucgauuu

SEQ ID NO: 35568 - RNA, 22 nt, Pseudomonas putida KT2440
cauuggugaugcgggcguucuc

SEQ ID NO: 35569 - RNA, 22 nt, Pseudomonas putida KT2440
ccacgucgcuuucgccggccag

SEQ ID NO: 35570 - RNA, 22 nt, Pseudomonas putida KT2440
cgccaucgccauggccgccaac

SEQ ID NO: 35571 - RNA, 23 nt, Pseudomonas putida KT2440
cgccaugcugacccgaccgacgc

SEQ ID NO: 35572 - RNA, 22 nt, Pseudomonas putida KT2440
cgccaugguugaagcugcaccu

SEQ ID NO: 35573 - RNA, 22 nt, Pseudomonas putida KT2440
cgcccugacgggcugcgcaggu

SEQ ID NO: 35574 - RNA, 17 nt, Pseudomonas putida KT2440
cgccggaucggugccuu

SEQ ID NO: 35575 - RNA, 22 nt, Pseudomonas putida KT2440
cgccuggucgucggccuuggcc

SEQ ID NO: 35576 - RNA, 22 nt, Pseudomonas putida KT2440
cgcgaaagggccgguacagguu

SEQ ID NO: 35577 - RNA, 22 nt, Pseudomonas putida KT2440
cgcgaagaggcagguacaggca

SEQ ID NO: 35578 - RNA, 22 nt, Pseudomonas putida KT2440
cgcgaagaggccagacaggcaa

SEQ ID NO: 35579 - RNA, 22 nt, Pseudomonas putida KT2440
cgcgacgaaacgcuccgaaugc

SEQ ID NO: 35580 - RNA, 22 nt, Pseudomonas putida KT2440
cgcgacuucgugcagcaggaua

SEQ ID NO: 35581 - RNA, 22 nt, Pseudomonas putida KT2440
cgcgccaucgaagaucgccgca

SEQ ID NO: 35582 - RNA, 22 nt, Pseudomonas putida KT2440
cgcgcgaaccgguguagccguu

SEQ ID NO: 35583 - RNA, 22 nt, Pseudomonas putida KT2440
cgcgcguucccacggguuugcc

SEQ ID NO: 35584 - RNA, 22 nt, Pseudomonas putida KT2440
cgcggcuaaacccgcuccuaca

SEQ ID NO: 35585 - RNA, 22 nt, Pseudomonas putida KT2440
cgcggcuaaagccgcuccuacg

SEQ ID NO: 35586 - RNA, 22 nt, Pseudomonas putida KT2440
cgcggguaaacccgcuccuacg

SEQ ID NO: 35587 - RNA, 22 nt, Pseudomonas putida KT2440
cgcggguuuacccgcgaaugcg

SEQ ID NO: 35588 - RNA, 22 nt, Pseudomonas putida KT2440
cgcggucugguaccgccgggug

SEQ ID NO: 35589 - RNA, 22 nt, Pseudomonas putida KT2440
cgcgguguggcuggggcgcugu

SEQ ID NO: 35590 - RNA, 22 nt, Pseudomonas putida KT2440
cgcgguuugcuggugcugcagg

SEQ ID NO: 35591 - RNA, 22 nt, Pseudomonas putida KT2440
cgcguaccugagcucggggaga

SEQ ID NO: 35592 - RNA, 22 nt, Pseudomonas putida KT2440
cgcguagcgccgugacucgacc

SEQ ID NO: 35593 - RNA, 22 nt, Pseudomonas putida KT2440
cgcgucauccgaugcagcaguc

SEQ ID NO: 35594 - RNA, 22 nt, Pseudomonas putida KT2440
cgcguuggauucuucgcgggca

SEQ ID NO: 35595 - RNA, 22 nt, Pseudomonas putida KT2440
cgcuacccagauaggcuugagg

SEQ ID NO: 35596 - RNA, 22 nt, Pseudomonas putida KT2440
cgcuccagguuaccgaucacgc

SEQ ID NO: 35597 - RNA, 22 nt, Pseudomonas putida KT2440
cgcucccacagggaccucacag

SEQ ID NO: 35598 - RNA, 22 nt, Pseudomonas putida KT2440
cgcucccacagggcucaccaca

SEQ ID NO: 35599 - RNA, 22 nt, Pseudomonas putida KT2440
cgcucccacagguucaccgcug

SEQ ID NO: 35600 - RNA, 22 nt, Pseudomonas putida KT2440
cgcuccuacaaguagugcaccg

SEQ ID NO: 35601 - RNA, 22 nt, Pseudomonas putida KT2440
cgcuccuacagguucaccacag

SEQ ID NO: 35602 - RNA, 22 nt, Pseudomonas putida KT2440
cgcuggaacaacccgccgcugc

SEQ ID NO: 35603 - RNA, 22 nt, Pseudomonas putida KT2440
cgcuggagcauggugugcuggg

SEQ ID NO: 35604 - RNA, 22 nt, Pseudomonas putida KT2440
cgcuggaucucacaggcgcugc

SEQ ID NO: 35605 - RNA, 22 nt, Pseudomonas putida KT2440
cgcuggauggacucggcaaucg

SEQ ID NO: 35606 - RNA, 19 nt, Pseudomonas putida KT2440
cgcuuccgacaggcacggc

SEQ ID NO: 35607 - RNA, 22 nt, Pseudomonas putida KT2440
cgcuuugcggcucugugggggc

SEQ ID NO: 35608 - RNA, 22 nt, Pseudomonas putida KT2440
cggcaacauccgucagcuggaa

SEQ ID NO: 35609 - RNA, 22 nt, Pseudomonas putida KT2440
cggcaacggugcugcccauggc

SEQ ID NO: 35610 - RNA, 22 nt, Pseudomonas putida KT2440
cggcaaugaccucggcaggaag

SEQ ID NO: 35611 - RNA, 22 nt, Pseudomonas putida KT2440
cggcaaugcucucugaagaucu

SEQ ID NO: 35612 - RNA, 22 nt, Pseudomonas putida KT2440
cggcacaaucccuggaggcggu

SEQ ID NO: 35613 - RNA, 22 nt, Pseudomonas putida KT2440
cggcagucaccaggucggugca

SEQ ID NO: 35614 - RNA, 22 nt, Pseudomonas putida KT2440
cggcaucaauggcggccucaag

SEQ ID NO: 35615 - RNA, 21 nt, Pseudomonas putida KT2440
cggcaugaucaacggcaugau

SEQ ID NO: 35616 - RNA, 22 nt, Pseudomonas putida KT2440
cggccaacugcuguucgggggu

SEQ ID NO: 35617 - RNA, 22 nt, Pseudomonas putida KT2440
cggccaugaaugucgcgccgca

SEQ ID NO: 35618 - RNA, 22 nt, Pseudomonas putida KT2440
cggcgauaguagucgugcgcau

SEQ ID NO: 35619 - RNA, 22 nt, Pseudomonas putida KT2440
cggcgaucacaucgguggccgc

SEQ ID NO: 35620 - RNA, 22 nt, Pseudomonas putida KT2440
cggcgcaaccgucggucguagg

SEQ ID NO: 35621 - RNA, 22 nt, Pseudomonas putida KT2440
cggcugauggcgcuggcgcauu

SEQ ID NO: 35622 - RNA, 22 nt, Pseudomonas putida KT2440
cgggcacaucagccugcagcca

SEQ ID NO: 35623 - RNA, 22 nt, Pseudomonas putida KT2440
cgggccuucaauaagcuugucg

SEQ ID NO: 35624 - RNA, 22 nt, Pseudomonas putida KT2440
cgggcgaugaccugaagcugcu

SEQ ID NO: 35625 - RNA, 22 nt, Pseudomonas putida KT2440
cggguaaacccgcuccuacaca

SEQ ID NO: 35626 - RNA, 22 nt, Pseudomonas putida KT2440
cggguaaacccgcuccuacagg

SEQ ID NO: 35627 - RNA, 22 nt, Pseudomonas putida KT2440
cggucaaugauuucgugggcgc

SEQ ID NO: 35628 - RNA, 22 nt, Pseudomonas putida KT2440
cggucgauggcggcaucgacuu

SEQ ID NO: 35629 - RNA, 22 nt, Pseudomonas putida KT2440
cggucgucguaggagcggguuc

SEQ ID NO: 35630 - RNA, 20 nt, Pseudomonas putida KT2440
cggucugcugcggcgagcgc

SEQ ID NO: 35631 - RNA, 22 nt, Pseudomonas putida KT2440
cggugcacuacuuguaggagcg

SEQ ID NO: 35632 - RNA, 22 nt, Pseudomonas putida KT2440
cggugccugcgguacccgcucg

SEQ ID NO: 35633 - RNA, 22 nt, Pseudomonas putida KT2440
cggugcguucugcagccucggu

SEQ ID NO: 35634 - RNA, 22 nt, Pseudomonas putida KT2440
cggugcugggcuugcgccaagg

SEQ ID NO: 35635 - RNA, 22 nt, Pseudomonas putida KT2440
cggugguaguagcuggccgggu

SEQ ID NO: 35636 - RNA, 22 nt, Pseudomonas putida KT2440
cgguucgccgccggaagcuugc

SEQ ID NO: 35637 - RNA, 22 nt, Pseudomonas putida KT2440
cgguugucgcgggcauccaccu

SEQ ID NO: 35638 - RNA, 22 nt, Pseudomonas putida KT2440
cguacgacaccuggaucucgca

SEQ ID NO: 35639 - RNA, 22 nt, Pseudomonas putida KT2440
cguacucgcuccugccuggggu

SEQ ID NO: 35640 - RNA, 22 nt, Pseudomonas putida KT2440
cguaggagcggcuuuagccgcg

SEQ ID NO: 35641 - RNA, 22 nt, Pseudomonas putida KT2440
cgucgcugauagggagcgccca

SEQ ID NO: 35642 - RNA, 22 nt, Pseudomonas putida KT2440
cgucggugaucacauagcuguu

SEQ ID NO: 35643 - RNA, 22 nt, Pseudomonas putida KT2440
cgugacgcuucaugguuggcuc

SEQ ID NO: 35644 - RNA, 22 nt, Pseudomonas putida KT2440
cgugauggcauguuuuaucugc

SEQ ID NO: 35645 - RNA, 22 nt, Pseudomonas putida KT2440
cgugcuuuuuaaccuggccagu

SEQ ID NO: 35646 - RNA, 23 nt, Pseudomonas putida KT2440
cguggcagucuuccuugcccugc

SEQ ID NO: 35647 - RNA, 22 nt, Pseudomonas putida KT2440
cguggucaguugcucgaggugg

SEQ ID NO: 35648 - RNA, 22 nt, Pseudomonas putida KT2440
cguguaccugaucgacagcggc

SEQ ID NO: 35649 - RNA, 22 nt, Pseudomonas putida KT2440
cguuaucguucauucgcggcua

SEQ ID NO: 35650 - RNA, 22 nt, Pseudomonas putida KT2440
cguugccugcuucgugggcaag

SEQ ID NO: 35651 - RNA, 21 nt, Pseudomonas putida KT2440
cguugcugcaaguuauguauu

SEQ ID NO: 35652 - RNA, 22 nt, Pseudomonas putida KT2440
cuaccaucuagauccggaguau

SEQ ID NO: 35653 - RNA, 22 nt, Pseudomonas putida KT2440
cucaccgccaucgcugauggcc

SEQ ID NO: 35654 - RNA, 22 nt, Pseudomonas putida KT2440
cuccaggaaggguacgguugga

SEQ ID NO: 35655 - RNA, 22 nt, Pseudomonas putida KT2440
gagcccaugucggcguacuugc

SEQ ID NO: 35656 - RNA, 22 nt, Pseudomonas putida KT2440
gagcggguuuacccgcgaaagg

SEQ ID NO: 35657 - RNA, 22 nt, Pseudomonas putida KT2440
gagcgguucuugcagugucggc

SEQ ID NO: 35658 - RNA, 22 nt, Pseudomonas putida KT2440
gagcugauaggcgauauucucg

SEQ ID NO: 35659 - RNA, 22 nt, Pseudomonas putida KT2440
gagcuggcgcagcugguuguuc

SEQ ID NO: 35660 - RNA, 22 nt, Pseudomonas putida KT2440
gaggcgcuugcgcggcucugga

SEQ ID NO: 35661 - RNA, 22 nt, Pseudomonas putida KT2440
gaggcgguagccgcgaaugaac

SEQ ID NO: 35662 - RNA, 22 nt, Pseudomonas putida KT2440
gaggcugauggcgaucuugagc

SEQ ID NO: 35663 - RNA, 22 nt, Pseudomonas putida KT2440
gagucguugcgcugguucauug

SEQ ID NO: 35664 - RNA, 22 nt, Pseudomonas putida KT2440
gauacagcacgucgaacagcug

SEQ ID NO: 35665 - RNA, 22 nt, Pseudomonas putida KT2440
gaucgcauccaggucauccccu

SEQ ID NO: 35666 - RNA, 22 nt, Pseudomonas putida KT2440
gaucuggccuugcucagccaac

SEQ ID NO: 35667 - RNA, 22 nt, Pseudomonas putida KT2440
gaugcggugcauggccaggagu

SEQ ID NO: 35668 - RNA, 22 nt, Pseudomonas putida KT2440
gaugcuguugucgcugccuucg

SEQ ID NO: 35669 - RNA, 22 nt, Pseudomonas putida KT2440
gaugucgaacagguaguccagg

SEQ ID NO: 35670 - RNA, 22 nt, Pseudomonas putida KT2440
gauucccuucuauuggcgcgau

SEQ ID NO: 35671 - RNA, 21 nt, Pseudomonas putida KT2440
gcaaccgggggucacuggugc

SEQ ID NO: 35672 - RNA, 22 nt, Pseudomonas putida KT2440
gcaacgccggcuggucgggguu

SEQ ID NO: 35673 - RNA, 22 nt, Pseudomonas putida KT2440
gcaagccuggcggcggcgccug

SEQ ID NO: 35674 - RNA, 22 nt, Pseudomonas putida KT2440
gcaagcgcaucuccagccacca

SEQ ID NO: 35675 - RNA, 22 nt, Pseudomonas putida KT2440
gcaaggcugcucggccgaggag

SEQ ID NO: 35676 - RNA, 22 nt, Pseudomonas putida KT2440
gcaaggcuuguucggcguuguc

SEQ ID NO: 35677 - RNA, 22 nt, Pseudomonas putida KT2440
gcacaugucauccacaaguccu

SEQ ID NO: 35678 - RNA, 22 nt, Pseudomonas putida KT2440
gcacccaguuggugccagguuc

SEQ ID NO: 35679 - RNA, 22 nt, Pseudomonas putida KT2440
gcagcacggugaggaucacauc

SEQ ID NO: 35680 - RNA, 22 nt, Pseudomonas putida KT2440
gcagccaagaucgucauuggug

SEQ ID NO: 35681 - RNA, 22 nt, Pseudomonas putida KT2440
gcagccuugcuuaccucgauca

SEQ ID NO: 35682 - RNA, 22 nt, Pseudomonas putida KT2440
gcagcgacuacugcugcguugg

SEQ ID NO: 35683 - RNA, 22 nt, Pseudomonas putida KT2440
gcagcugcguccggugcgcugg

SEQ ID NO: 35684 - RNA, 22 nt, Pseudomonas putida KT2440
gcaggcuucaaggccacgcggu

SEQ ID NO: 35685 - RNA, 22 nt, Pseudomonas putida KT2440
gcagggucucgagcacaccgcc

SEQ ID NO: 35686 - RNA, 22 nt, Pseudomonas putida KT2440
gcaggucggcugaauaaugaaa

SEQ ID NO: 35687 - RNA, 22 nt, Pseudomonas putida KT2440
gcaggucugaguaguucaggua

SEQ ID NO: 35688 - RNA, 22 nt, Pseudomonas putida KT2440
gcaguaccugugggagcgggcg

SEQ ID NO: 35689 - RNA, 22 nt, Pseudomonas putida KT2440
gcaguacgucguagucuuucag

SEQ ID NO: 35690 - RNA, 22 nt, Pseudomonas putida KT2440
gcagugcauggaaugccaccgc

SEQ ID NO: 35691 - RNA, 20 nt, Pseudomonas putida KT2440
gcagugucagcuuuggcgcc

SEQ ID NO: 35692 - RNA, 21 nt, Pseudomonas putida KT2440
gcaucgaaacgaccagcucgc

SEQ ID NO: 35693 - RNA, 22 nt, Pseudomonas putida KT2440
gcauggagcccagcgaggucac

SEQ ID NO: 35694 - RNA, 22 nt, Pseudomonas putida KT2440
gcaugguguacggcaucgucga

SEQ ID NO: 35695 - RNA, 22 nt, Pseudomonas putida KT2440
gcauuagcagguaaacccgcgc

SEQ ID NO: 35696 - RNA, 22 nt, Pseudomonas putida KT2440
gcauuaucugugggagcggccu

SEQ ID NO: 35697 - RNA, 22 nt, Pseudomonas putida KT2440
gcauucgcgggugaacccgcuc

SEQ ID NO: 35698 - RNA, 22 nt, Pseudomonas putida KT2440
gcauugaaggcggguaccggca

SEQ ID NO: 35699 - RNA, 22 nt, Pseudomonas putida KT2440
gccaacgccgccgugcuggcca

SEQ ID NO: 35700 - RNA, 22 nt, Pseudomonas putida KT2440
gccacuguucaucgucauugug

SEQ ID NO: 35701 - RNA, 22 nt, Pseudomonas putida KT2440
gccagcaagguggguuaugccc

SEQ ID NO: 35702 - RNA, 22 nt, Pseudomonas putida KT2440
gccagcaucuggucgggcaccu

SEQ ID NO: 35703 - RNA, 20 nt, Pseudomonas putida KT2440
gccaggcauccagggcaucg

SEQ ID NO: 35704 - RNA, 18 nt, Pseudomonas putida KT2440
gccaggcucccagccucg

SEQ ID NO: 35705 - RNA, 22 nt, Pseudomonas putida KT2440
gccaggugcugcuggcauugcu

SEQ ID NO: 35706 - RNA, 22 nt, Pseudomonas putida KT2440
gccagguuggcaaggcguugcu

SEQ ID NO: 35707 - RNA, 22 nt, Pseudomonas putida KT2440
gccagugagcaccgcggacaag

SEQ ID NO: 35708 - RNA, 22 nt, Pseudomonas putida KT2440
gccaucaagguggcugggggcg

SEQ ID NO: 35709 - RNA, 22 nt, Pseudomonas putida KT2440
gccaucguuauugugcuugcca

SEQ ID NO: 35710 - RNA, 22 nt, Pseudomonas putida KT2440
gccaugaucgaaggccaguucg

SEQ ID NO: 35711 - RNA, 22 nt, Pseudomonas putida KT2440
gccaugcgcucuuugaagcugg

SEQ ID NO: 35712 - RNA, 22 nt, Pseudomonas putida KT2440
gccaugguguuguugcuguacu

SEQ ID NO: 35713 - RNA, 22 nt, Pseudomonas putida KT2440
gcccagauacacccaagggucg

SEQ ID NO: 35714 - RNA, 22 nt, Pseudomonas putida KT2440
gcccaugcccagguuggugcag

SEQ ID NO: 35715 - RNA, 22 nt, Pseudomonas putida KT2440
gcccuuguagugcuccaggucg

SEQ ID NO: 35716 - RNA, 22 nt, Pseudomonas putida KT2440
gccgcugauguguggcccgagu

SEQ ID NO: 35717 - RNA, 22 nt, Pseudomonas putida KT2440
gccgguaccugcuucgugaaga

SEQ ID NO: 35718 - RNA, 22 nt, Pseudomonas putida KT2440
gccgguguacguacaaccgccu

SEQ ID NO: 35719 - RNA, 22 nt, Pseudomonas putida KT2440
gccguaccugcacagggccuug

SEQ ID NO: 35720 - RNA, 22 nt, Pseudomonas putida KT2440
gccguccuugucgaagugguac

SEQ ID NO: 35721 - RNA, 22 nt, Pseudomonas putida KT2440
gccgucgaccacgcgaaucgac

SEQ ID NO: 35722 - RNA, 23 nt, Pseudomonas putida KT2440
gccgugaccguggcuggcguggu

SEQ ID NO: 35723 - RNA, 22 nt, Pseudomonas putida KT2440
gccguuggugguuaccuugcca

SEQ ID NO: 35724 - RNA, 22 nt, Pseudomonas putida KT2440
aaaccuguaccggcccuuucgc

SEQ ID NO: 35725 - RNA, 22 nt, Pseudomonas putida KT2440
aaaggcaucgaccgcggcacgg

SEQ ID NO: 35726 - RNA, 22 nt, Pseudomonas putida KT2440
aaauagcacaccgagcagugua

SEQ ID NO: 35727 - RNA, 22 nt, Pseudomonas putida KT2440
aacagccgcagaaugcucgguu

SEQ ID NO: 35728 - RNA, 22 nt, Pseudomonas putida KT2440
aacccgcuccuacaggauggcc

SEQ ID NO: 35729 - RNA, 22 nt, Pseudomonas putida KT2440
aacccgcuccuacgggggcugc

SEQ ID NO: 35730 - RNA, 22 nt, Pseudomonas putida KT2440
aaccggguuaccaggaccaugc

SEQ ID NO: 35731 - RNA, 22 nt, Pseudomonas putida KT2440
accuucagcuugcggacauuga

SEQ ID NO: 35732 - RNA, 22 nt, Pseudomonas putida KT2440
accuuggccaaucgcugucgcu

SEQ ID NO: 35733 - RNA, 23 nt, Pseudomonas putida KT2440
accuuggcgauugcccuggcguu

SEQ ID NO: 35734 - RNA, 22 nt, Pseudomonas putida KT2440
acgacccguacuuuucucucac

SEQ ID NO: 35735 - RNA, 22 nt, Pseudomonas putida KT2440
acgacggcuuguagcgguucgg

SEQ ID NO: 35736 - RNA, 22 nt, Pseudomonas putida KT2440
acgagcugucggcaccgaugcu

SEQ ID NO: 35737 - RNA, 22 nt, Pseudomonas putida KT2440
acgccgaccgccucauggagcu

SEQ ID NO: 35738 - RNA, 22 nt, Pseudomonas putida KT2440
acgccgcacauugccuguaugg

SEQ ID NO: 35739 - RNA, 22 nt, Pseudomonas putida KT2440
acgccuugccccucggcggugu

SEQ ID NO: 35740 - RNA, 22 nt, Pseudomonas putida KT2440
acgccuuguucuuuuucgagga

SEQ ID NO: 35741 - RNA, 22 nt, Pseudomonas putida KT2440
acgcgucacagagcaagguguc

SEQ ID NO: 35742 - RNA, 22 nt, Pseudomonas putida KT2440
acgcuaugaccaggugauggac

SEQ ID NO: 35743 - RNA, 22 nt, Pseudomonas putida KT2440
acgcuguucaugcgcuccaugg

SEQ ID NO: 35744 - RNA, 22 nt, Pseudomonas putida KT2440
acggccugguacucaguggccg

SEQ ID NO: 35745 - RNA, 22 nt, Pseudomonas putida KT2440
acggcgaugcggaacucgucga

SEQ ID NO: 35746 - RNA, 22 nt, Pseudomonas putida KT2440
acggcgcucgcugccgacauga

SEQ ID NO: 35747 - RNA, 22 nt, Pseudomonas putida KT2440
acggcuaugacacguacagccu

SEQ ID NO: 35748 - RNA, 22 nt, Pseudomonas putida KT2440
acgguaauggguaucccuugcg

SEQ ID NO: 35749 - RNA, 22 nt, Pseudomonas putida KT2440
acggucauucagcaccacggcc

SEQ ID NO: 35750 - RNA, 22 nt, Pseudomonas putida KT2440
acggugaacaccgggaaacugu

SEQ ID NO: 35751 - RNA, 22 nt, Pseudomonas putida KT2440
acgguguaugucgagcgccagc

SEQ ID NO: 35752 - RNA, 22 nt, Pseudomonas putida KT2440
acgguugacgcauggggcucca

SEQ ID NO: 35753 - RNA, 22 nt, Pseudomonas putida KT2440
acguccaguggcgagugcugca

SEQ ID NO: 35754 - RNA, 22 nt, Pseudomonas putida KT2440
acgugcacaaugccucggucga

SEQ ID NO: 35755 - RNA, 22 nt, Pseudomonas putida KT2440
acgugcccugaaagcuuuugcc

SEQ ID NO: 35756 - RNA, 22 nt, Pseudomonas putida KT2440
acguggguuucgccaagcuuga

SEQ ID NO: 35757 - RNA, 22 nt, Pseudomonas putida KT2440
acgugucggcuauguaaauggu

SEQ ID NO: 35758 - RNA, 22 nt, Pseudomonas putida KT2440
acuacgacaucaacgacuacgg

SEQ ID NO: 35759 - RNA, 22 nt, Pseudomonas putida KT2440
acuaucgagaagauucuugcuc

SEQ ID NO: 35760 - RNA, 23 nt, Pseudomonas putida KT2440
acucaaggcgcucagugauggug

SEQ ID NO: 35761 - RNA, 22 nt, Pseudomonas putida KT2440
acucaccgcggaaaguccgccg

SEQ ID NO: 35762 - RNA, 22 nt, Pseudomonas putida KT2440
acucgaguuugcugccuucgua

SEQ ID NO: 35763 - RNA, 22 nt, Pseudomonas putida KT2440
acugcgaaagcgcucaggcccu

SEQ ID NO: 35764 - RNA, 22 nt, Pseudomonas putida KT2440
acugcgcgauugcgcgguuggg

SEQ ID NO: 35765 - RNA, 22 nt, Pseudomonas putida KT2440
acugcugagcuugaacagcuug

SEQ ID NO: 35766 - RNA, 22 nt, Pseudomonas putida KT2440
acugcugccaggcauucuggag

SEQ ID NO: 35767 - RNA, 22 nt, Pseudomonas putida KT2440
acuggccagugauuucgcaccg

SEQ ID NO: 35768 - RNA, 22 nt, Pseudomonas putida KT2440
acugggccugacuaucugcgcc

SEQ ID NO: 35769 - RNA, 22 nt, Pseudomonas putida KT2440
acuguggugugccgcugggcgg

SEQ ID NO: 35770 - RNA, 22 nt, Pseudomonas putida KT2440
acuguuccugccagccgugcau

SEQ ID NO: 35771 - RNA, 22 nt, Pseudomonas putida KT2440
acuuccacaacuaccggcagcu

SEQ ID NO: 35772 - RNA, 22 nt, Pseudomonas putida KT2440
acuugcagacguauuccugagu

SEQ ID NO: 35773 - RNA, 22 nt, Pseudomonas putida KT2440
agaacacucgagcgcagcgcuc

SEQ ID NO: 35774 - RNA, 22 nt, Pseudomonas putida KT2440
agacccguuccuacgcaggcac

SEQ ID NO: 35775 - RNA, 22 nt, Pseudomonas putida KT2440
agacgcgccuguauuucgaccu

SEQ ID NO: 35776 - RNA, 22 nt, Pseudomonas putida KT2440
agaugcccuuuucacggucguc

SEQ ID NO: 35777 - RNA, 22 nt, Pseudomonas putida KT2440
agcaacuucuucggugcugccg

SEQ ID NO: 35778 - RNA, 20 nt, Pseudomonas putida KT2440
agcaaugccgcagggcagga

SEQ ID NO: 35779 - RNA, 22 nt, Pseudomonas putida KT2440
agcaccugggccaggcgcugcg

SEQ ID NO: 35780 - RNA, 22 nt, Pseudomonas putida KT2440
agcaccuugcgcgucagccuca

SEQ ID NO: 35781 - RNA, 22 nt, Pseudomonas putida KT2440
agcagcgccaacaucgccacug

SEQ ID NO: 35782 - RNA, 22 nt, Pseudomonas putida KT2440
agcagcgcccggacacugcguu

SEQ ID NO: 35783 - RNA, 22 nt, Pseudomonas putida KT2440
agcagcuguucaacggcgccua

SEQ ID NO: 35784 - RNA, 20 nt, Pseudomonas putida KT2440
agcaggcgauucguguggcc

SEQ ID NO: 35785 - RNA, 22 nt, Pseudomonas putida KT2440
agcagggcgaugugaucaccgu

SEQ ID NO: 35786 - RNA, 22 nt, Pseudomonas putida KT2440
agcccgcuccuacaacgaucug

SEQ ID NO: 35787 - RNA, 22 nt, Pseudomonas putida KT2440
agccgaccacguggcuuaucgg

SEQ ID NO: 35788 - RNA, 22 nt, Pseudomonas putida KT2440
agccgaucaggcucucggcgac

SEQ ID NO: 35789 - RNA, 22 nt, Pseudomonas putida KT2440
agccgcgaaugaacgcaccgcg

SEQ ID NO: 35790 - RNA, 22 nt, Pseudomonas putida KT2440
agccgcuccuacaggggcugca

SEQ ID NO: 35791 - RNA, 22 nt, Pseudomonas putida KT2440
agccugccaugacacggcuuca

SEQ ID NO: 35792 - RNA, 22 nt, Pseudomonas putida KT2440
agccuucgagcuccgccagcca

SEQ ID NO: 35793 - RNA, 22 nt, Pseudomonas putida KT2440
agcgccugugagauccagcgcc

SEQ ID NO: 35794 - RNA, 22 nt, Pseudomonas putida KT2440
agcgcgugacccucgacagccg

SEQ ID NO: 35795 - RNA, 22 nt, Pseudomonas putida KT2440
agcgcuuuaccccaggggaggu

SEQ ID NO: 35796 - RNA, 22 nt, Pseudomonas putida KT2440
agcggccaguucccugucgcgc

SEQ ID NO: 35797 - RNA, 22 nt, Pseudomonas putida KT2440
agcggccucuucgcggguaaac

SEQ ID NO: 35798 - RNA, 22 nt, Pseudomonas putida KT2440
agcggguucacccgcgaauacg

SEQ ID NO: 35799 - RNA, 22 nt, Pseudomonas putida KT2440
agcggguuuacccgcgaauacg

SEQ ID NO: 35800 - RNA, 22 nt, Pseudomonas putida KT2440
agcguugacgauggcuuuccgc

SEQ ID NO: 35801 - RNA, 22 nt, Pseudomonas putida KT2440
agcguugcggugcgggcugcag

SEQ ID NO: 35802 - RNA, 22 nt, Pseudomonas putida KT2440
agcugcgagaaggcgaugacca

SEQ ID NO: 35803 - RNA, 22 nt, Pseudomonas putida KT2440
agcuggaucuacaucggcagcc

SEQ ID NO: 35804 - RNA, 16 nt, Pseudomonas putida KT2440
agcuggccugcagccc

SEQ ID NO: 35805 - RNA, 19 nt, Pseudomonas putida KT2440
agcuggucggcaucagcgc

SEQ ID NO: 35806 - RNA, 21 nt, Pseudomonas putida KT2440
agcuggugcaccgccuggauc

SEQ ID NO: 35807 - RNA, 19 nt, Pseudomonas putida KT2440
agcuggugcccuggucggc

SEQ ID NO: 35808 - RNA, 22 nt, Pseudomonas putida KT2440
agcugugcacgaccugugggag

SEQ ID NO: 35809 - RNA, 22 nt, Pseudomonas putida KT2440
agcuugugguucugaugcugca

SEQ ID NO: 35810 - RNA, 22 nt, Pseudomonas putida KT2440
aggaagccgaaguuguugcgga

SEQ ID NO: 35811 - RNA, 22 nt, Pseudomonas putida KT2440
aggaggcuggcugcaucaggua

SEQ ID NO: 35812 - RNA, 22 nt, Pseudomonas putida KT2440
aggcagcuaugggucgaaugcg

SEQ ID NO: 35813 - RNA, 22 nt, Pseudomonas putida KT2440
aggcauuggcagugaucgguca

SEQ ID NO: 35814 - RNA, 22 nt, Pseudomonas putida KT2440
aggccaguacguggccgucgag

SEQ ID NO: 35815 - RNA, 22 nt, Pseudomonas putida KT2440
aggcccgugccacagaugcgcu

SEQ ID NO: 35816 - RNA, 22 nt, Pseudomonas putida KT2440
caacagucugugucugcacggc

SEQ ID NO: 35817 - RNA, 22 nt, Pseudomonas putida KT2440
caacggcgaaccggccguguuc

SEQ ID NO: 35818 - RNA, 23 nt, Pseudomonas putida KT2440
caacggugauguccuggucagcg

SEQ ID NO: 35819 - RNA, 22 nt, Pseudomonas putida KT2440
caacuggugggcagugcggcgg

SEQ ID NO: 35820 - RNA, 22 nt, Pseudomonas putida KT2440
caagcccgcuccugcaugucca

SEQ ID NO: 35821 - RNA, 22 nt, Pseudomonas putida KT2440
caaggccaaccacgccugcgcc

SEQ ID NO: 35822 - RNA, 22 nt, Pseudomonas putida KT2440
caaggcccgcuugguugauucg

SEQ ID NO: 35823 - RNA, 22 nt, Pseudomonas putida KT2440
caaggcggugaccaccacgaag

SEQ ID NO: 35824 - RNA, 22 nt, Pseudomonas putida KT2440
caaggcuucuauacccggcaug

SEQ ID NO: 35825 - RNA, 21 nt, Pseudomonas putida KT2440
caaggguugggccugcagcag

SEQ ID NO: 35826 - RNA, 22 nt, Pseudomonas putida KT2440
caaggucggcgggcgggugcug

SEQ ID NO: 35827 - RNA, 19 nt, Pseudomonas putida KT2440
caaguuggcgagcagcauc

SEQ ID NO: 35828 - RNA, 22 nt, Pseudomonas putida KT2440
caauggcggccuugaucgcugc

SEQ ID NO: 35829 - RNA, 22 nt, Pseudomonas putida KT2440
cacagccgguuggcaaacugau

SEQ ID NO: 35830 - RNA, 22 nt, Pseudomonas putida KT2440
cacagguagguuuucggcugga

SEQ ID NO: 35831 - RNA, 22 nt, Pseudomonas putida KT2440
cacccauuucugguugccggug

SEQ ID NO: 35832 - RNA, 22 nt, Pseudomonas putida KT2440
caccgaagcgccguaagugugg

SEQ ID NO: 35833 - RNA, 22 nt, Pseudomonas putida KT2440
caccugugaggggcgggucugc

SEQ ID NO: 35834 - RNA, 21 nt, Pseudomonas putida KT2440
caccuguuuaccgguacgguc

SEQ ID NO: 35835 - RNA, 22 nt, Pseudomonas putida KT2440
caccuugccguggcuggccggu

SEQ ID NO: 35836 - RNA, 22 nt, Pseudomonas putida KT2440
cacgaccuggucgugacccuga

SEQ ID NO: 35837 - RNA, 22 nt, Pseudomonas putida KT2440
cacgccgaugucgugcucgauc

SEQ ID NO: 35838 - RNA, 22 nt, Pseudomonas putida KT2440
cacgcugggcucgucgagcacg

SEQ ID NO: 35839 - RNA, 22 nt, Pseudomonas putida KT2440
cacggcuggcaccgcucuugcg

SEQ ID NO: 35840 - RNA, 22 nt, Pseudomonas putida KT2440
cacgguuggugcugcgccaaug

SEQ ID NO: 35841 - RNA, 22 nt, Pseudomonas putida KT2440
cagaucguuguaggagcgggcu

SEQ ID NO: 35842 - RNA, 22 nt, Pseudomonas putida KT2440
cagauguucggcaacucgagca

SEQ ID NO: 35843 - RNA, 22 nt, Pseudomonas putida KT2440
cagauucgugccauccagcgcg

SEQ ID NO: 35844 - RNA, 22 nt, Pseudomonas putida KT2440
cagcagcagcgucuggucaucg

SEQ ID NO: 35845 - RNA, 22 nt, Pseudomonas putida KT2440
cagcaucgcagggggagccguu

SEQ ID NO: 35846 - RNA, 22 nt, Pseudomonas putida KT2440
cagcauuaagggcgaugguguc

SEQ ID NO: 35847 - RNA, 22 nt, Pseudomonas putida KT2440
cagcgccucgcgccaggccuca

SEQ ID NO: 35848 - RNA, 22 nt, Pseudomonas putida KT2440
cagcuugagguauuccucgcga

SEQ ID NO: 35849 - RNA, 22 nt, Pseudomonas putida KT2440
caggccacggucaaggucauga

SEQ ID NO: 35850 - RNA, 22 nt, Pseudomonas putida KT2440
caggccaugcaacgauccgggc

SEQ ID NO: 35851 - RNA, 22 nt, Pseudomonas putida KT2440
caggccgaggccggcaccggcu

SEQ ID NO: 35852 - RNA, 22 nt, Pseudomonas putida KT2440
caggccgugcaccuggacauca

SEQ ID NO: 35853 - RNA, 22 nt, Pseudomonas putida KT2440
caggcgaaggaucucuagcggc

SEQ ID NO: 35854 - RNA, 22 nt, Pseudomonas putida KT2440
caggcgcauggccaggcaaccg

SEQ ID NO: 35855 - RNA, 22 nt, Pseudomonas putida KT2440
caggcguucaagggucagugca

SEQ ID NO: 35856 - RNA, 22 nt, Pseudomonas putida KT2440
cagggucgaaacagccguuaag

SEQ ID NO: 35857 - RNA, 22 nt, Pseudomonas putida KT2440
caggucggcacguuguucagga

SEQ ID NO: 35858 - RNA, 22 nt, Pseudomonas putida KT2440
cagguggaccugccgacugccg

SEQ ID NO: 35859 - RNA, 22 nt, Pseudomonas putida KT2440
caguaccugugggagcgggcgc

SEQ ID NO: 35860 - RNA, 22 nt, Pseudomonas putida KT2440
cagugaugucuuccagugggcg

SEQ ID NO: 35861 - RNA, 22 nt, Pseudomonas putida KT2440
cagugccagugccgccgggccg

SEQ ID NO: 35862 - RNA, 22 nt, Pseudomonas putida KT2440
cagugcuuaucauugcucgggu

SEQ ID NO: 35863 - RNA, 22 nt, Pseudomonas putida KT2440
caguggcccggagcggucaagc

SEQ ID NO: 35864 - RNA, 22 nt, Pseudomonas putida KT2440
cagugggcacgguuggcgaucc

SEQ ID NO: 35865 - RNA, 22 nt, Pseudomonas putida KT2440
caguucgaagcgguggcuuuca

SEQ ID NO: 35866 - RNA, 22 nt, Pseudomonas putida KT2440
caucaacugaucuggaccuacc

SEQ ID NO: 35867 - RNA, 22 nt, Pseudomonas putida KT2440
cauccagguccggcagcgugcc

SEQ ID NO: 35868 - RNA, 22 nt, Pseudomonas putida KT2440
caucgcgacacaaggccgcucc

SEQ ID NO: 35869 - RNA, 22 nt, Pseudomonas putida KT2440
caugcccgcucccacagguuca

SEQ ID NO: 35870 - RNA, 22 nt, Pseudomonas putida KT2440
cauggcagccuguuggcguugu

SEQ ID NO: 35871 - RNA, 22 nt, Pseudomonas putida KT2440
caugggugaaauauuagcgaug

SEQ ID NO: 35872 - RNA, 22 nt, Pseudomonas putida KT2440
cauggucgaagucgucaccacc

SEQ ID NO: 35873 - RNA, 22 nt, Pseudomonas putida KT2440
cauggucgccgccauuggcgcg

SEQ ID NO: 35874 - RNA, 22 nt, Pseudomonas putida KT2440
cauguaggagcggguuuacccg

SEQ ID NO: 35875 - RNA, 22 nt, Pseudomonas putida KT2440
caugucggccuggaacuugauc

SEQ ID NO: 35876 - RNA, 21 nt, Pseudomonas putida KT2440
cauguggucgauguggccagu

SEQ ID NO: 35877 - RNA, 22 nt, Pseudomonas putida KT2440
cauucgcggguaaacccguucc

SEQ ID NO: 35878 - RNA, 22 nt, Pseudomonas putida KT2440
cauucggagcguuucgucgcgg

SEQ ID NO: 35879 - RNA, 22 nt, Pseudomonas putida KT2440
cauuggccugggcgauuucacc

SEQ ID NO: 35880 - RNA, 22 nt, Pseudomonas putida KT2440
cauuggcuucgauuuuaucccg

SEQ ID NO: 35881 - RNA, 22 nt, Pseudomonas putida KT2440
cauuugugucgacagcgagccu

SEQ ID NO: 35882 - RNA, 22 nt, Pseudomonas putida KT2440
ccaacgguugcgaucgacauca

SEQ ID NO: 35883 - RNA, 22 nt, Pseudomonas putida KT2440
ccaagcucagcauugucuauuc

SEQ ID NO: 35884 - RNA, 22 nt, Pseudomonas putida KT2440
ccaaucgcaucccacgcgaauc

SEQ ID NO: 35885 - RNA, 22 nt, Pseudomonas putida KT2440
ccaccuguggguagcgcucggu

SEQ ID NO: 35886 - RNA, 22 nt, Pseudomonas putida KT2440
ccacgccuuggccgugacgccg

SEQ ID NO: 35887 - RNA, 22 nt, Pseudomonas putida KT2440
ccacgcgaauaccugugcagcg

SEQ ID NO: 35888 - RNA, 22 nt, Pseudomonas putida KT2440
ccaggcuugcgcccaggccgau

SEQ ID NO: 35889 - RNA, 22 nt, Pseudomonas putida KT2440
ccagggcuucacacguguggcu

SEQ ID NO: 35890 - RNA, 22 nt, Pseudomonas putida KT2440
ccaggguauugagcaggccacg

SEQ ID NO: 35891 - RNA, 19 nt, Pseudomonas putida KT2440
ccagguuauugaaggcacg

SEQ ID NO: 35892 - RNA, 22 nt, Pseudomonas putida KT2440
ccaguacugugugcucagcggu

SEQ ID NO: 35893 - RNA, 22 nt, Pseudomonas putida KT2440
ccagugcugcguucauggcuuc

SEQ ID NO: 35894 - RNA, 22 nt, Pseudomonas putida KT2440
ccaucagugccaaugccagcac

SEQ ID NO: 35895 - RNA, 22 nt, Pseudomonas putida KT2440
ccauggccagcgagugggcauu

SEQ ID NO: 35896 - RNA, 22 nt, Pseudomonas putida KT2440
ccaugguguuuuucugcugguu

SEQ ID NO: 35897 - RNA, 22 nt, Pseudomonas putida KT2440
ccauuccgcugaaucgcggagu

SEQ ID NO: 35898 - RNA, 22 nt, Pseudomonas putida KT2440
cccaggcaguacaucagcgaca

SEQ ID NO: 35899 - RNA, 22 nt, Pseudomonas putida KT2440
cccgcgaacaccggcaaagccg

SEQ ID NO: 35900 - RNA, 22 nt, Pseudomonas putida KT2440
cccgcgaacaccggcgaagccg

SEQ ID NO: 35901 - RNA, 22 nt, Pseudomonas putida KT2440
cgcggcaaggugggguugacca

SEQ ID NO: 35902 - RNA, 22 nt, Pseudomonas putida KT2440
cgcggguaaaccagcuccuaca

SEQ ID NO: 35903 - RNA, 22 nt, Pseudomonas putida KT2440
cgcggguaaacccgauccuaca

SEQ ID NO: 35904 - RNA, 22 nt, Pseudomonas putida KT2440
cgcggguaaacccgccccuaua

SEQ ID NO: 35905 - RNA, 22 nt, Pseudomonas putida KT2440
cgcggguaaacccgccgcuaca

SEQ ID NO: 35906 - RNA, 22 nt, Pseudomonas putida KT2440
cgcggguaaacccgcgccuaca

SEQ ID NO: 35907 - RNA, 22 nt, Pseudomonas putida KT2440
cgcggguaaacccgcgccugca

SEQ ID NO: 35908 - RNA, 22 nt, Pseudomonas putida KT2440
cgcggguaaacccgcuccuaca

SEQ ID NO: 35909 - RNA, 22 nt, Pseudomonas putida KT2440
cgcggguaaacccgcuccugcg

SEQ ID NO: 35910 - RNA, 22 nt, Pseudomonas putida KT2440
cgcggguaaaccugccccuaca

SEQ ID NO: 35911 - RNA, 22 nt, Pseudomonas putida KT2440
cgcggguaaacucgcuccuacg

SEQ ID NO: 35912 - RNA, 22 nt, Pseudomonas putida KT2440
cgcggguaaagccgcaccugca

SEQ ID NO: 35913 - RNA, 22 nt, Pseudomonas putida KT2440
cgcggguaagcccgcuccuaca

SEQ ID NO: 35914 - RNA, 22 nt, Pseudomonas putida KT2440
cgcggguagggcucgaaguagg

SEQ ID NO: 35915 - RNA, 22 nt, Pseudomonas putida KT2440
cgcggguuaacccgcgccuaca

SEQ ID NO: 35916 - RNA, 22 nt, Pseudomonas putida KT2440
cgcggguuuaccugugaaugcg

SEQ ID NO: 35917 - RNA, 22 nt, Pseudomonas putida KT2440
cgcgguuuuccacaugcggguu

SEQ ID NO: 35918 - RNA, 22 nt, Pseudomonas putida KT2440
cgcgucaccuguuucgcgggca

SEQ ID NO: 35919 - RNA, 22 nt, Pseudomonas putida KT2440
cgcguugccugcuucgcgggug

SEQ ID NO: 35920 - RNA, 21 nt, Pseudomonas putida KT2440
cgcucagguagugcggcacug

SEQ ID NO: 35921 - RNA, 22 nt, Pseudomonas putida KT2440
cgcucccacaggauaggcgccg

SEQ ID NO: 35922 - RNA, 22 nt, Pseudomonas putida KT2440
cgcucccacaggaucaccgcaa

SEQ ID NO: 35923 - RNA, 22 nt, Pseudomonas putida KT2440
cgcucccacaggcagggcgcaa

SEQ ID NO: 35924 - RNA, 22 nt, Pseudomonas putida KT2440
cgcucccacaggcauugcacag

SEQ ID NO: 35925 - RNA, 22 nt, Pseudomonas putida KT2440
cgcucccacagggucggcguau

SEQ ID NO: 35926 - RNA, 22 nt, Pseudomonas putida KT2440
cgcucccacagguacagcacag

SEQ ID NO: 35927 - RNA, 22 nt, Pseudomonas putida KT2440
cgcucccacaggucgugcacag

SEQ ID NO: 35928 - RNA, 22 nt, Pseudomonas putida KT2440
cgcucccacaggugucucgcaa

SEQ ID NO: 35929 - RNA, 22 nt, Pseudomonas putida KT2440
cgcucccacaguaucaccacag

SEQ ID NO: 35930 - RNA, 22 nt, Pseudomonas putida KT2440
cgcuccuacagggaucgccacg

SEQ ID NO: 35931 - RNA, 22 nt, Pseudomonas putida KT2440
cgcuccuacagggguagcgcca

SEQ ID NO: 35932 - RNA, 22 nt, Pseudomonas putida KT2440
cgcuccuacagguacagcgcag

SEQ ID NO: 35933 - RNA, 22 nt, Pseudomonas putida KT2440
cgcuccuacagguacagugcag

SEQ ID NO: 35934 - RNA, 22 nt, Pseudomonas putida KT2440
cgcucgaucucauaggcgcuga

SEQ ID NO: 35935 - RNA, 22 nt, Pseudomonas putida KT2440
cgcucugugacagcugcauggc

SEQ ID NO: 35936 - RNA, 22 nt, Pseudomonas putida KT2440
cgcugcacagguauucgcguug

SEQ ID NO: 35937 - RNA, 22 nt, Pseudomonas putida KT2440
cgcugcagacugagauuugucu

SEQ ID NO: 35938 - RNA, 21 nt, Pseudomonas putida KT2440
cgcugcucacgacgcaggucu

SEQ ID NO: 35939 - RNA, 22 nt, Pseudomonas putida KT2440
cgcugcuggucauccuucaugg

SEQ ID NO: 35940 - RNA, 23 nt, Pseudomonas putida KT2440
cgcugguggcacguagcaccgcu

SEQ ID NO: 35941 - RNA, 22 nt, Pseudomonas putida KT2440
cgcuugagcgaggcgcuggugg

SEQ ID NO: 35942 - RNA, 22 nt, Pseudomonas putida KT2440
cggaagaucagcgccgcacggc

SEQ ID NO: 35943 - RNA, 22 nt, Pseudomonas putida KT2440
cggaguucgcgguugugccgga

SEQ ID NO: 35944 - RNA, 21 nt, Pseudomonas putida KT2440
cggaucaucccauguacaccg

SEQ ID NO: 35945 - RNA, 22 nt, Pseudomonas putida KT2440
cggcaagccagcguccacaggu

SEQ ID NO: 35946 - RNA, 17 nt, Pseudomonas putida KT2440
cggcaaggaacaggauu

SEQ ID NO: 35947 - RNA, 22 nt, Pseudomonas putida KT2440
cggcaagguagugcugccggug

SEQ ID NO: 35948 - RNA, 22 nt, Pseudomonas putida KT2440
cggcagcaucgaacauggcgaa

SEQ ID NO: 35949 - RNA, 22 nt, Pseudomonas putida KT2440
cggcccuuucgcggguaaaccc

SEQ ID NO: 35950 - RNA, 22 nt, Pseudomonas putida KT2440
cggcguagccgguguucgcggg

SEQ ID NO: 35951 - RNA, 22 nt, Pseudomonas putida KT2440
cggcgugagcugguggccgagc

SEQ ID NO: 35952 - RNA, 22 nt, Pseudomonas putida KT2440
cggcuaaagccgcuccuacaag

SEQ ID NO: 35953 - RNA, 22 nt, Pseudomonas putida KT2440
cggcuaaagccgcuccuacagg

SEQ ID NO: 35954 - RNA, 22 nt, Pseudomonas putida KT2440
cggcuccaucacguucagcugc

SEQ ID NO: 35955 - RNA, 22 nt, Pseudomonas putida KT2440
cggcuugaaccauggcuggcua

SEQ ID NO: 35956 - RNA, 22 nt, Pseudomonas putida KT2440
cgggaugagcgaccugugggaa

SEQ ID NO: 35957 - RNA, 22 nt, Pseudomonas putida KT2440
cgggaugucgaagcguaggugu

SEQ ID NO: 35958 - RNA, 22 nt, Pseudomonas putida KT2440
cgggcaugcucgcccccacagg

SEQ ID NO: 35959 - RNA, 22 nt, Pseudomonas putida KT2440
cgggccuugauauugagaauuu

SEQ ID NO: 35960 - RNA, 22 nt, Pseudomonas putida KT2440
cgggcgaugguguuuucgcagu

SEQ ID NO: 35961 - RNA, 22 nt, Pseudomonas putida KT2440
cgggcucaaugcguuccaagau

SEQ ID NO: 35962 - RNA, 22 nt, Pseudomonas putida KT2440
cggguaaacccgcuccuacaac

SEQ ID NO: 35963 - RNA, 22 nt, Pseudomonas putida KT2440
cggguaucgcacaccaguucga

SEQ ID NO: 35964 - RNA, 22 nt, Pseudomonas putida KT2440
cggguuuacccgcgaaugcgau

SEQ ID NO: 35965 - RNA, 22 nt, Pseudomonas putida KT2440
cgguacucaggcuguugaucga

SEQ ID NO: 35966 - RNA, 22 nt, Pseudomonas putida KT2440
cgguauggucgguuccgugcuc

SEQ ID NO: 35967 - RNA, 22 nt, Pseudomonas putida KT2440
cgguccagcgcacgcuccgucu

SEQ ID NO: 35968 - RNA, 22 nt, Pseudomonas putida KT2440
cgguccuuguaggugcggguuu

SEQ ID NO: 35969 - RNA, 22 nt, Pseudomonas putida KT2440
cggucgugaagagagaucugag

SEQ ID NO: 35970 - RNA, 22 nt, Pseudomonas putida KT2440
cggucugcugcuggcgcggccu

SEQ ID NO: 35971 - RNA, 22 nt, Pseudomonas putida KT2440
cggugaagaaccugugggggcg

SEQ ID NO: 35972 - RNA, 22 nt, Pseudomonas putida KT2440
cggugaugaucagcaugcgcgu

SEQ ID NO: 35973 - RNA, 22 nt, Pseudomonas putida KT2440
cggugauuacugcguggugcac

SEQ ID NO: 35974 - RNA, 22 nt, Pseudomonas putida KT2440
cggugcagcgcuugaaguguuc

SEQ ID NO: 35975 - RNA, 22 nt, Pseudomonas putida KT2440
cggugccugcuucgcgggcucg

SEQ ID NO: 35976 - RNA, 22 nt, Pseudomonas putida KT2440
cggugcgauuacugugggagcg

SEQ ID NO: 35977 - RNA, 22 nt, Pseudomonas putida KT2440
cgguggcuuguugcugaucgaa

SEQ ID NO: 35978 - RNA, 22 nt, Pseudomonas putida KT2440
cgguugaucguugagcgcagcg

SEQ ID NO: 35979 - RNA, 22 nt, Pseudomonas putida KT2440
cgguugccuggccaugcgccug

SEQ ID NO: 35980 - RNA, 22 nt, Pseudomonas putida KT2440
cguaggcgcggcuuuagccggg

SEQ ID NO: 35981 - RNA, 22 nt, Pseudomonas putida KT2440
cguauucgcggguaaacccgcu

SEQ ID NO: 35982 - RNA, 18 nt, Pseudomonas putida KT2440
cgucugcugcuggccgau

SEQ ID NO: 35983 - RNA, 23 nt, Pseudomonas putida KT2440
cgugaguugcacggcgcacugcu

SEQ ID NO: 35984 - RNA, 19 nt, Pseudomonas putida KT2440
cgugaucgcagcguugcgu

SEQ ID NO: 35985 - RNA, 19 nt, Pseudomonas putida KT2440
cgugcacgcuugaucagca

SEQ ID NO: 35986 - RNA, 22 nt, Pseudomonas putida KT2440
gacaucgcgcuggaugccgaug

SEQ ID NO: 35987 - RNA, 22 nt, Pseudomonas putida KT2440
gaccagcgcggugguaaggcuc

SEQ ID NO: 35988 - RNA, 22 nt, Pseudomonas putida KT2440
gaccgugcaccugggugaaggc

SEQ ID NO: 35989 - RNA, 22 nt, Pseudomonas putida KT2440
gaccugggaaaaugcucagcug

SEQ ID NO: 35990 - RNA, 22 nt, Pseudomonas putida KT2440
gaccuugacuucgauggugucg

SEQ ID NO: 35991 - RNA, 22 nt, Pseudomonas putida KT2440
gacgaagcgguuggggaaauug

SEQ ID NO: 35992 - RNA, 22 nt, Pseudomonas putida KT2440
gacgaucugcaauugcggauga

SEQ ID NO: 35993 - RNA, 22 nt, Pseudomonas putida KT2440
gacgcaaggccguucccacaaa

SEQ ID NO: 35994 - RNA, 22 nt, Pseudomonas putida KT2440
gacggcagugccagcgugccac

SEQ ID NO: 35995 - RNA, 22 nt, Pseudomonas putida KT2440
gacggucgauuuugccuuccgc

SEQ ID NO: 35996 - RNA, 22 nt, Pseudomonas putida KT2440
gacggugugaaaacgugaugac

SEQ ID NO: 35997 - RNA, 22 nt, Pseudomonas putida KT2440
gacguugguagcgguggcguug

SEQ ID NO: 35998 - RNA, 22 nt, Pseudomonas putida KT2440
gacugccaggccucaagccucg

SEQ ID NO: 35999 - RNA, 22 nt, Pseudomonas putida KT2440
gacuucaaucgccuuggcaacg

SEQ ID NO: 36000 - RNA, 22 nt, Pseudomonas putida KT2440
gagaaugccgauaucaguacga

SEQ ID NO: 36001 - RNA, 22 nt, Pseudomonas putida KT2440
gagaugcuggugcugcagcucg

SEQ ID NO: 36002 - RNA, 22 nt, Pseudomonas putida KT2440
gagccaggcgaguauugagguc

SEQ ID NO: 36003 - RNA, 22 nt, Pseudomonas putida KT2440
gagccgaaaauaagcgauauua

SEQ ID NO: 36004 - RNA, 22 nt, Pseudomonas putida KT2440
gagcgcgagguugucggacucg

SEQ ID NO: 36005 - RNA, 22 nt, Pseudomonas putida KT2440
gagcgcguucaauugcagggug

SEQ ID NO: 36006 - RNA, 22 nt, Pseudomonas putida KT2440
gagcggguucacccgcgaaugc

SEQ ID NO: 36007 - RNA, 22 nt, Pseudomonas putida KT2440
gagcggguuuacccgcgaaggu

SEQ ID NO: 36008 - RNA, 22 nt, Pseudomonas putida KT2440
gagcggguuuacccgcgaauac

SEQ ID NO: 36009 - RNA, 22 nt, Pseudomonas putida KT2440
gagcgucaaggcugccaggcca

SEQ ID NO: 36010 - RNA, 22 nt, Pseudomonas putida KT2440
gaggcuugcuguucaucggggc

SEQ ID NO: 36011 - RNA, 22 nt, Pseudomonas putida KT2440
gaggucgaagcgcucgaucagc

SEQ ID NO: 36012 - RNA, 22 nt, Pseudomonas putida KT2440
gagguugcgcgccaacuugccg

SEQ ID NO: 36013 - RNA, 22 nt, Pseudomonas putida KT2440
gaguaucggcgggagcgggcau

SEQ ID NO: 36014 - RNA, 22 nt, Pseudomonas putida KT2440
gaguggcucaugugcugcgcgg

SEQ ID NO: 36015 - RNA, 22 nt, Pseudomonas putida KT2440
gauaccaaucaccauugaccug

SEQ ID NO: 36016 - RNA, 22 nt, Pseudomonas putida KT2440
gauacccugccacugaaccuga

SEQ ID NO: 36017 - RNA, 22 nt, Pseudomonas putida KT2440
gauauucacgaugcuggccaag

SEQ ID NO: 36018 - RNA, 22 nt, Pseudomonas putida KT2440
gaucaaguuccaggccgacaug

SEQ ID NO: 36019 - RNA, 22 nt, Pseudomonas putida KT2440
gaucaucggacauucggggugg

SEQ ID NO: 36020 - RNA, 22 nt, Pseudomonas putida KT2440
gaucccggggcgcauugcgacg

SEQ ID NO: 36021 - RNA, 22 nt, Pseudomonas putida KT2440
gauccguuaaaucuguggccau

SEQ ID NO: 36022 - RNA, 22 nt, Pseudomonas putida KT2440
gauccguugcugcgguaaggau

SEQ ID NO: 36023 - RNA, 22 nt, Pseudomonas putida KT2440
gaucgacggauccccuguagcc

SEQ ID NO: 36024 - RNA, 22 nt, Pseudomonas putida KT2440
gaucgaggcgcugcgccaguug

SEQ ID NO: 36025 - RNA, 22 nt, Pseudomonas putida KT2440
gaucggcacaaacgaaaacgcc

SEQ ID NO: 36026 - RNA, 22 nt, Pseudomonas putida KT2440
gaucggugugcgguagcguagc

SEQ ID NO: 36027 - RNA, 22 nt, Pseudomonas putida KT2440
gaucguccacccgcagcaugga

SEQ ID NO: 36028 - RNA, 21 nt, Pseudomonas putida KT2440
gaucugucauucguuuggcug

SEQ ID NO: 36029 - RNA, 22 nt, Pseudomonas putida KT2440
gaugaagcucuuaugaauaguu

SEQ ID NO: 36030 - RNA, 22 nt, Pseudomonas putida KT2440
gaugcgaucaguugcaggccug

SEQ ID NO: 36031 - RNA, 22 nt, Pseudomonas putida KT2440
gaugcgcgacauuuucggcgcg

SEQ ID NO: 36032 - RNA, 22 nt, Pseudomonas putida KT2440
gaugcgcucgacgaccaugaug

SEQ ID NO: 36033 - RNA, 22 nt, Pseudomonas putida KT2440
gaugcgcugugcaaacgcuacg

SEQ ID NO: 36034 - RNA, 22 nt, Pseudomonas putida KT2440
gaugcuggcagcgccgcgcagu

SEQ ID NO: 36035 - RNA, 22 nt, Pseudomonas putida KT2440
gauggccaagcgggagauugug

SEQ ID NO: 36036 - RNA, 22 nt, Pseudomonas putida KT2440
gauggccauggcuggccuggcc

SEQ ID NO: 36037 - RNA, 22 nt, Pseudomonas putida KT2440
gauggcggucaagccguucauc

SEQ ID NO: 36038 - RNA, 22 nt, Pseudomonas putida KT2440
gauguaccuguaggagcggguu

SEQ ID NO: 36039 - RNA, 22 nt, Pseudomonas putida KT2440
gaugucggugaucgccacaccg

SEQ ID NO: 36040 - RNA, 22 nt, Pseudomonas putida KT2440
gauguucguggucaucuucauc

SEQ ID NO: 36041 - RNA, 22 nt, Pseudomonas putida KT2440
gauuggcagccaggccacggua

SEQ ID NO: 36042 - RNA, 22 nt, Pseudomonas putida KT2440
gcaagcggcugcccaguucguc

SEQ ID NO: 36043 - RNA, 22 nt, Pseudomonas putida KT2440
gcaagcucgcgccuacaaugga

SEQ ID NO: 36044 - RNA, 22 nt, Pseudomonas putida KT2440
gcaaugcaaguaccguugaagc

SEQ ID NO: 36045 - RNA, 22 nt, Pseudomonas putida KT2440
gcacagcugcugcagcggccgg

SEQ ID NO: 36046 - RNA, 20 nt, Pseudomonas putida KT2440
gcacagguugagugggugca

SEQ ID NO: 36047 - RNA, 22 nt, Pseudomonas putida KT2440
gcacauggaugucauuucugcc

SEQ ID NO: 36048 - RNA, 19 nt, Pseudomonas putida KT2440
gcacccgagccaguagcuc

SEQ ID NO: 36049 - RNA, 20 nt, Pseudomonas putida KT2440
gcaccgacggucaagguggc

SEQ ID NO: 36050 - RNA, 22 nt, Pseudomonas putida KT2440
gcaccugcggccaccucggugc

SEQ ID NO: 36051 - RNA, 22 nt, Pseudomonas putida KT2440
gcacugcaagcaucgagcugaa

SEQ ID NO: 36052 - RNA, 21 nt, Pseudomonas putida KT2440
gcacuucacugacggcguaac

SEQ ID NO: 36053 - RNA, 22 nt, Pseudomonas putida KT2440
gcagacgccuccugagggcugc

SEQ ID NO: 36054 - RNA, 22 nt, Pseudomonas putida KT2440
gcagagcguauucggcaucaac

SEQ ID NO: 36055 - RNA, 22 nt, Pseudomonas putida KT2440
gcagcaugugugcggcaauugg

SEQ ID NO: 36056 - RNA, 22 nt, Pseudomonas putida KT2440
gcagcugcuggaccugccgguu

SEQ ID NO: 36057 - RNA, 22 nt, Pseudomonas putida KT2440
gcaggagcggguuuacccgcga

SEQ ID NO: 36058 - RNA, 22 nt, Pseudomonas putida KT2440
gcaggaucaagaaucaccgccg

SEQ ID NO: 36059 - RNA, 22 nt, Pseudomonas putida KT2440
gcaggcugcaacgguuuuccaa

SEQ ID NO: 36060 - RNA, 22 nt, Pseudomonas putida KT2440
gcagucgaggcuuugcgcgaau

SEQ ID NO: 36061 - RNA, 22 nt, Pseudomonas putida KT2440
gcagucuucggucgaaggccug

SEQ ID NO: 36062 - RNA, 22 nt, Pseudomonas putida KT2440
gcaucgaucaccagugcuucgg

SEQ ID NO: 36063 - RNA, 22 nt, Pseudomonas putida KT2440
gcaucgccauccaggccuuuca

SEQ ID NO: 36064 - RNA, 22 nt, Pseudomonas putida KT2440
gcaucgugaauaucuccaguuc

SEQ ID NO: 36065 - RNA, 22 nt, Pseudomonas putida KT2440
gcaugcccaccgacuugggcug

SEQ ID NO: 36066 - RNA, 22 nt, Pseudomonas putida KT2440
gcauggcguugagggcugggug

SEQ ID NO: 36067 - RNA, 22 nt, Pseudomonas putida KT2440
gcauggcugaccccggcgggca

SEQ ID NO: 36068 - RNA, 22 nt, Pseudomonas putida KT2440
gcaugucgauuaccugcaugau

SEQ ID NO: 36069 - RNA, 22 nt, Pseudomonas putida KT2440
gcauuccucaaccuggaugaag

SEQ ID NO: 36070 - RNA, 22 nt, Pseudomonas putida KT2440
gcauucgcgggcaagcccgcuc

SEQ ID NO: 36071 - RNA, 22 nt, Pseudomonas putida KT2440
gcugccauggccgucggcgagc

SEQ ID NO: 36072 - RNA, 22 nt, Pseudomonas putida KT2440
gcugcgcagggaucaggccggu

SEQ ID NO: 36073 - RNA, 20 nt, Pseudomonas putida KT2440
gcugcugccgcuuuacuacc

SEQ ID NO: 36074 - RNA, 22 nt, Pseudomonas putida KT2440
gcugcuggucuucagugggccu

SEQ ID NO: 36075 - RNA, 22 nt, Pseudomonas putida KT2440
gcuggccacgaauacaugaucg

SEQ ID NO: 36076 - RNA, 22 nt, Pseudomonas putida KT2440
gcuggucagcaagcaggaccug

SEQ ID NO: 36077 - RNA, 22 nt, Pseudomonas putida KT2440
gcuuccaucugcuuggccuggu

SEQ ID NO: 36078 - RNA, 22 nt, Pseudomonas putida KT2440
gcuuccaucuuggcgacggugu

SEQ ID NO: 36079 - RNA, 22 nt, Pseudomonas putida KT2440
gcuucgagacggagauugucga

SEQ ID NO: 36080 - RNA, 22 nt, Pseudomonas putida KT2440
gcuucgucgaugucguggcuga

SEQ ID NO: 36081 - RNA, 22 nt, Pseudomonas putida KT2440
gcuugaccgcuccgggccacug

SEQ ID NO: 36082 - RNA, 22 nt, Pseudomonas putida KT2440
gcuugcaagcguuugguuucac

SEQ ID NO: 36083 - RNA, 22 nt, Pseudomonas putida KT2440
gcuugccguuggcguugugcgg

SEQ ID NO: 36084 - RNA, 22 nt, Pseudomonas putida KT2440
gcuuucgaaccagacgcguuac

SEQ ID NO: 36085 - RNA, 19 nt, Pseudomonas putida KT2440
ggaaggucuugccggcgac

SEQ ID NO: 36086 - RNA, 22 nt, Pseudomonas putida KT2440
ggaauccuuccucgcgcgcaug

SEQ ID NO: 36087 - RNA, 22 nt, Pseudomonas putida KT2440
ggacccugaacgcagccugaug

SEQ ID NO: 36088 - RNA, 22 nt, Pseudomonas putida KT2440
ggacuacaccaucgcccuggug

SEQ ID NO: 36089 - RNA, 22 nt, Pseudomonas putida KT2440
ggagcuguuucggggguugccg

SEQ ID NO: 36090 - RNA, 22 nt, Pseudomonas putida KT2440
ggaggcaugucgaugguguguu

SEQ ID NO: 36091 - RNA, 22 nt, Pseudomonas putida KT2440
ggaguacgcgguggccgauuac

SEQ ID NO: 36092 - RNA, 22 nt, Pseudomonas putida KT2440
ggaguacgucgcaguugauggg

SEQ ID NO: 36093 - RNA, 22 nt, Pseudomonas putida KT2440
ggcacaaggucgcuuccacaag

SEQ ID NO: 36094 - RNA, 23 nt, Pseudomonas putida KT2440
ggcacagguucagcucaccuucg

SEQ ID NO: 36095 - RNA, 22 nt, Pseudomonas putida KT2440
ggcaggcucauggcgcgugccu

SEQ ID NO: 36096 - RNA, 22 nt, Pseudomonas putida KT2440
ggcaucgaccugggccggggua

SEQ ID NO: 36097 - RNA, 22 nt, Pseudomonas putida KT2440
ggcaucggccugaucaccgaag

SEQ ID NO: 36098 - RNA, 22 nt, Pseudomonas putida KT2440
ggcaugcacgagcaggguggcc

SEQ ID NO: 36099 - RNA, 22 nt, Pseudomonas putida KT2440
ggccaacaugggcaugaacguc

SEQ ID NO: 36100 - RNA, 22 nt, Pseudomonas putida KT2440
ggccagaaucaucgccaacugg

SEQ ID NO: 36101 - RNA, 21 nt, Pseudomonas putida KT2440
ggccagacggagcgugcgcug

SEQ ID NO: 36102 - RNA, 22 nt, Pseudomonas putida KT2440
ggccagcaacuggucguucagc

SEQ ID NO: 36103 - RNA, 22 nt, Pseudomonas putida KT2440
ggccaugcuuuucucgaucauc

SEQ ID NO: 36104 - RNA, 18 nt, Pseudomonas putida KT2440
ggccauguugagcugguu

SEQ ID NO: 36105 - RNA, 22 nt, Pseudomonas putida KT2440
ggcccaguggcuggucggccug

SEQ ID NO: 36106 - RNA, 22 nt, Pseudomonas putida KT2440
ggcccugugggagcggccuugu

SEQ ID NO: 36107 - RNA, 22 nt, Pseudomonas putida KT2440
ggccgacuaugcgcugcuggcc

SEQ ID NO: 36108 - RNA, 22 nt, Pseudomonas putida KT2440
ggccgaguucgaagugucgauu

SEQ ID NO: 36109 - RNA, 22 nt, Pseudomonas putida KT2440
ggccuaccugguggcgccgcgg

SEQ ID NO: 36110 - RNA, 22 nt, Pseudomonas putida KT2440
ggccucuucgcgggcgaguccc

SEQ ID NO: 36111 - RNA, 22 nt, Pseudomonas putida KT2440
ggccucuucgcggguaaacccu

SEQ ID NO: 36112 - RNA, 22 nt, Pseudomonas putida KT2440
ggccugcuggugcgcuuuggug

SEQ ID NO: 36113 - RNA, 22 nt, Pseudomonas putida KT2440
ggccuugaccccggccucaccg

SEQ ID NO: 36114 - RNA, 22 nt, Pseudomonas putida KT2440
ggcgacaugccggugucgcugc

SEQ ID NO: 36115 - RNA, 22 nt, Pseudomonas putida KT2440
ggcgaucuugcugcccaggcgg

SEQ ID NO: 36116 - RNA, 23 nt, Pseudomonas putida KT2440
ggcgcuguauggcuaugcccagg

SEQ ID NO: 36117 - RNA, 22 nt, Pseudomonas putida KT2440
ggcgcugucgaguuugcguggc

SEQ ID NO: 36118 - RNA, 22 nt, Pseudomonas putida KT2440
ggcgggaugaaggccgaggacu

SEQ ID NO: 36119 - RNA, 22 nt, Pseudomonas putida KT2440
ggcggguacagugcauuggauc

SEQ ID NO: 36120 - RNA, 22 nt, Pseudomonas putida KT2440
ggcggugagcuauuccgacccg

SEQ ID NO: 36121 - RNA, 22 nt, Pseudomonas putida KT2440
ggcgucgagccguggcaaggac

SEQ ID NO: 36122 - RNA, 23 nt, Pseudomonas putida KT2440
ggcuaucggcaagucugcgacua

SEQ ID NO: 36123 - RNA, 22 nt, Pseudomonas putida KT2440
ggcucaccgaagcguuccagug

SEQ ID NO: 36124 - RNA, 22 nt, Pseudomonas putida KT2440
ggcucgcugggcgaugucaugg

SEQ ID NO: 36125 - RNA, 22 nt, Pseudomonas putida KT2440
ggcugaagccgcuccuacaggg

SEQ ID NO: 36126 - RNA, 22 nt, Pseudomonas putida KT2440
ggcuucuuugcaagccuugugg

SEQ ID NO: 36127 - RNA, 20 nt, Pseudomonas putida KT2440
ggcuugauauuuucggcagc

SEQ ID NO: 36128 - RNA, 22 nt, Pseudomonas putida KT2440
gggcagugaggcugcggguaaa

SEQ ID NO: 36129 - RNA, 22 nt, Pseudomonas putida KT2440
gggcaugaagcgguggcgugga

SEQ ID NO: 36130 - RNA, 22 nt, Pseudomonas putida KT2440
gggcgaauuucucgggguucug

SEQ ID NO: 36131 - RNA, 22 nt, Pseudomonas putida KT2440
gggcugaucgccucgccgccgg

SEQ ID NO: 36132 - RNA, 22 nt, Pseudomonas putida KT2440
gggcugcugugcuggugccucg

SEQ ID NO: 36133 - RNA, 22 nt, Pseudomonas putida KT2440
gggcugucaacaaucuguggag

SEQ ID NO: 36134 - RNA, 22 nt, Pseudomonas putida KT2440
ggguaaccucgcgcagaucgau

SEQ ID NO: 36135 - RNA, 22 nt, Pseudomonas putida KT2440
ggguuuacccgcgaagaggucc

SEQ ID NO: 36136 - RNA, 22 nt, Pseudomonas putida KT2440
gguacgugcguagcgggcaucu

SEQ ID NO: 36137 - RNA, 22 nt, Pseudomonas putida KT2440
ggucacggcacuguuggccgag

SEQ ID NO: 36138 - RNA, 22 nt, Pseudomonas putida KT2440
ggucacgugucaguugcugggc

SEQ ID NO: 36139 - RNA, 22 nt, Pseudomonas putida KT2440
ggucauggagucggcugugucc

SEQ ID NO: 36140 - RNA, 22 nt, Pseudomonas putida KT2440
gguccagcacaccggcagcucu

SEQ ID NO: 36141 - RNA, 22 nt, Pseudomonas putida KT2440
ggucgaccucgacaggcugcug

SEQ ID NO: 36142 - RNA, 22 nt, Pseudomonas putida KT2440
ggucgaugaagcccaguggucg

SEQ ID NO: 36143 - RNA, 22 nt, Pseudomonas putida KT2440
ggucgcaaccgacguuguuggg

SEQ ID NO: 36144 - RNA, 22 nt, Pseudomonas putida KT2440
ggucggauccagcggcgauuca

SEQ ID NO: 36145 - RNA, 22 nt, Pseudomonas putida KT2440
ggucggucaagucguccgcagg

SEQ ID NO: 36146 - RNA, 22 nt, Pseudomonas putida KT2440
ggucgucaccuucccagaugau

SEQ ID NO: 36147 - RNA, 22 nt, Pseudomonas putida KT2440
ggucuucaucggguggcuggcc

SEQ ID NO: 36148 - RNA, 22 nt, Pseudomonas putida KT2440
ggugaagcagguucgcgugucg

SEQ ID NO: 36149 - RNA, 22 nt, Pseudomonas putida KT2440
ggugauccuggccgguggcugc

SEQ ID NO: 36150 - RNA, 22 nt, Pseudomonas putida KT2440
ggugaugcuucaacggggccgg

SEQ ID NO: 36151 - RNA, 22 nt, Pseudomonas putida KT2440
ggugccugcguaggaacggguc

SEQ ID NO: 36152 - RNA, 22 nt, Pseudomonas putida KT2440
ggugcguacuugaccagcuggu

SEQ ID NO: 36153 - RNA, 22 nt, Pseudomonas putida KT2440
ggugcuacuuggugcuucugcu

SEQ ID NO: 36154 - RNA, 22 nt, Pseudomonas putida KT2440
ggugcucgauaaacguagugac

SEQ ID NO: 36155 - RNA, 22 nt, Pseudomonas putida KT2440
gguggcaggaucgauguucaug

SEQ ID NO: 36156 - RNA, 22 nt, Pseudomonas putida KT2440
uaccugaccacacgcggaucug

SEQ ID NO: 36157 - RNA, 22 nt, Pseudomonas putida KT2440
uacgcgccgggcauccgcugcc

SEQ ID NO: 36158 - RNA, 22 nt, Pseudomonas putida KT2440
uacgcggguaaacccgcuccua

SEQ ID NO: 36159 - RNA, 22 nt, Pseudomonas putida KT2440
uacggcuuccucgagugcguca

SEQ ID NO: 36160 - RNA, 22 nt, Pseudomonas putida KT2440
uacguugcagcgccugccagau

SEQ ID NO: 36161 - RNA, 22 nt, Pseudomonas putida KT2440
uacucgaggucacagucgauca

SEQ ID NO: 36162 - RNA, 22 nt, Pseudomonas putida KT2440
uacugcgccaccagcguuccgg

SEQ ID NO: 36163 - RNA, 22 nt, Pseudomonas putida KT2440
uacugcuggaagcggguucacg

SEQ ID NO: 36164 - RNA, 22 nt, Pseudomonas putida KT2440
uacuucgaacgcagggccauga

SEQ ID NO: 36165 - RNA, 22 nt, Pseudomonas putida KT2440
uacuuggcagucuuugcggcgc

SEQ ID NO: 36166 - RNA, 22 nt, Pseudomonas putida KT2440
uagcagcggccagagcgcucua

SEQ ID NO: 36167 - RNA, 22 nt, Pseudomonas putida KT2440
uagcccugagcaagccucccgu

SEQ ID NO: 36168 - RNA, 22 nt, Pseudomonas putida KT2440
uagcgccacucuggcugcuuuu

SEQ ID NO: 36169 - RNA, 22 nt, Pseudomonas putida KT2440
uagcggguggcgagcaugccgc

SEQ ID NO: 36170 - RNA, 23 nt, Pseudomonas putida KT2440
uaggagcggguucacccgcgaag

SEQ ID NO: 36171 - RNA, 22 nt, Pseudomonas putida KT2440
uaggaggcgucaggaggucaug

SEQ ID NO: 36172 - RNA, 22 nt, Pseudomonas putida KT2440
uaggugaucacgccgccuucgg

SEQ ID NO: 36173 - RNA, 22 nt, Pseudomonas putida KT2440
uaggugcacugcgaguguuuga

SEQ ID NO: 36174 - RNA, 22 nt, Pseudomonas putida KT2440
uauccacacuuuccugauucaa

SEQ ID NO: 36175 - RNA, 22 nt, Pseudomonas putida KT2440
uauggccuggcuggcgagcgug

SEQ ID NO: 36176 - RNA, 22 nt, Pseudomonas putida KT2440
ucaacccgucuccaagauucug

SEQ ID NO: 36177 - RNA, 22 nt, Pseudomonas putida KT2440
ucaacucgucguagcggaucgc

SEQ ID NO: 36178 - RNA, 22 nt, Pseudomonas putida KT2440
ucaccggcuucucugaucgcga

SEQ ID NO: 36179 - RNA, 22 nt, Pseudomonas putida KT2440
ucacgcacaagcugcugaccag

SEQ ID NO: 36180 - RNA, 22 nt, Pseudomonas putida KT2440
ucacgccguugacgcugaguuu

SEQ ID NO: 36181 - RNA, 22 nt, Pseudomonas putida KT2440
ucacggugauccucgacagcau

SEQ ID NO: 36182 - RNA, 22 nt, Pseudomonas putida KT2440
ucacuugcuggcucagcgccca

SEQ ID NO: 36183 - RNA, 22 nt, Pseudomonas putida KT2440
ucacuugggucuucucggccgg

SEQ ID NO: 36184 - RNA, 22 nt, Pseudomonas putida KT2440
ucagccacuugggcgaagagcc

SEQ ID NO: 36185 - RNA, 22 nt, Pseudomonas putida KT2440
ucagcgcccgcugcauuucgaa

SEQ ID NO: 36186 - RNA, 22 nt, Pseudomonas putida KT2440
ucagcggugcauuuuaccauuc

SEQ ID NO: 36187 - RNA, 22 nt, Pseudomonas putida KT2440
ucagcuuuggcuaucagccgug

SEQ ID NO: 36188 - RNA, 18 nt, Pseudomonas putida KT2440
ucagguacacgcgaggcg

SEQ ID NO: 36189 - RNA, 22 nt, Pseudomonas putida KT2440
ucaguggcgagcgugucacacc

SEQ ID NO: 36190 - RNA, 22 nt, Pseudomonas putida KT2440
ucaguucacggguaucgaugcc

SEQ ID NO: 36191 - RNA, 22 nt, Pseudomonas putida KT2440
ucaguucauugccccggcagcu

SEQ ID NO: 36192 - RNA, 22 nt, Pseudomonas putida KT2440
ucaucgguguuuugcgccaugg

SEQ ID NO: 36193 - RNA, 22 nt, Pseudomonas putida KT2440
ucaugccguggugggcgaacag

SEQ ID NO: 36194 - RNA, 22 nt, Pseudomonas putida KT2440
ucauggcgccaacggucagcgc

SEQ ID NO: 36195 - RNA, 22 nt, Pseudomonas putida KT2440
ucauggcuucucuccuggguaa

SEQ ID NO: 36196 - RNA, 22 nt, Pseudomonas putida KT2440
ucauguucggccgcagccggaa

SEQ ID NO: 36197 - RNA, 22 nt, Pseudomonas putida KT2440
ucauugaccacauaggcgaagg

SEQ ID NO: 36198 - RNA, 22 nt, Pseudomonas putida KT2440
uccagcacguugcugucggugg

SEQ ID NO: 36199 - RNA, 22 nt, Pseudomonas putida KT2440
uccagccgaaaaccuaccugug

SEQ ID NO: 36200 - RNA, 22 nt, Pseudomonas putida KT2440
uccagcgauuuggcgugguggc

SEQ ID NO: 36201 - RNA, 22 nt, Pseudomonas putida KT2440
uccagcgccaguacugccacgc

SEQ ID NO: 36202 - RNA, 22 nt, Pseudomonas putida KT2440
uccagcugccuagccgaagacc

SEQ ID NO: 36203 - RNA, 22 nt, Pseudomonas putida KT2440
uccaggccuucgaugguggugc

SEQ ID NO: 36204 - RNA, 22 nt, Pseudomonas putida KT2440
uccaggucagccaugugggugc

SEQ ID NO: 36205 - RNA, 20 nt, Pseudomonas putida KT2440
uccagguggcaaugaacugg

SEQ ID NO: 36206 - RNA, 22 nt, Pseudomonas putida KT2440
uccaucugcacaucaggauguc

SEQ ID NO: 36207 - RNA, 22 nt, Pseudomonas putida KT2440
ucccggugcaccugcagcaggu

SEQ ID NO: 36208 - RNA, 22 nt, Pseudomonas putida KT2440
ucccguggugacccgugaacaa

SEQ ID NO: 36209 - RNA, 22 nt, Pseudomonas putida KT2440
ucccugguguaagcgaggcaau

SEQ ID NO: 36210 - RNA, 22 nt, Pseudomonas putida KT2440
ucccuguaggagcggcuucagc

SEQ ID NO: 36211 - RNA, 22 nt, Pseudomonas putida KT2440
ucccugugggugcgggcgggcc

SEQ ID NO: 36212 - RNA, 22 nt, Pseudomonas putida KT2440
uccgcagcgccuucgcccucuu

SEQ ID NO: 36213 - RNA, 22 nt, Pseudomonas putida KT2440
uccgccugacggguggcgagcc

SEQ ID NO: 36214 - RNA, 22 nt, Pseudomonas putida KT2440
uccggcaaugcaccuuuggcag

SEQ ID NO: 36215 - RNA, 22 nt, Pseudomonas putida KT2440
uccggccaacccugcugaugau

SEQ ID NO: 36216 - RNA, 22 nt, Pseudomonas putida KT2440
uccggcgaguuggcccgcgagc

SEQ ID NO: 36217 - RNA, 22 nt, Pseudomonas putida KT2440
uccggcuggccucgaucugcgu

SEQ ID NO: 36218 - RNA, 22 nt, Pseudomonas putida KT2440
uccguggucgggcccaaugccu

SEQ ID NO: 36219 - RNA, 22 nt, Pseudomonas putida KT2440
uccucgaaacacuugaugguaa

SEQ ID NO: 36220 - RNA, 22 nt, Pseudomonas putida KT2440
uccucgaugauccgcugaucgu

SEQ ID NO: 36221 - RNA, 22 nt, Pseudomonas putida KT2440
uccucggcgaguugggccuuag

SEQ ID NO: 36222 - RNA, 22 nt, Pseudomonas putida KT2440
uccucggcgauugccaccgaaa

SEQ ID NO: 36223 - RNA, 22 nt, Pseudomonas putida KT2440
uccugaucgcgaccaugaccua

SEQ ID NO: 36224 - RNA, 22 nt, Pseudomonas putida KT2440
uccugcguucaauggucuuggc

SEQ ID NO: 36225 - RNA, 22 nt, Pseudomonas putida KT2440
uccuggccaugcaccgcaucga

SEQ ID NO: 36226 - RNA, 22 nt, Pseudomonas putida KT2440
uccuggcuuugcggcgugguuc

SEQ ID NO: 36227 - RNA, 22 nt, Pseudomonas putida KT2440
uccuucaauccugcgacucgca

SEQ ID NO: 36228 - RNA, 22 nt, Pseudomonas putida KT2440
uccuugugggagcgggcgggcc

SEQ ID NO: 36229 - RNA, 22 nt, Pseudomonas putida KT2440
ucgaacaccgccggcucgcccu

SEQ ID NO: 36230 - RNA, 17 nt, Pseudomonas putida KT2440
ucgaagugcugcacaac

SEQ ID NO: 36231 - RNA, 22 nt, Pseudomonas putida KT2440
ucgacaugcucgagcguggugu

SEQ ID NO: 36232 - RNA, 22 nt, Pseudomonas putida KT2440
ucgaccaaugcccaggccacgu

SEQ ID NO: 36233 - RNA, 22 nt, Pseudomonas putida KT2440
ucgaccugcacggcacccuggc

SEQ ID NO: 36234 - RNA, 22 nt, Pseudomonas putida KT2440
ucgaccugcgccauguccgggu

SEQ ID NO: 36235 - RNA, 22 nt, Pseudomonas putida KT2440
ucgaccugucugggcacagccu

SEQ ID NO: 36236 - RNA, 22 nt, Pseudomonas putida KT2440
ucgaccuuggaguauggcaggu

SEQ ID NO: 36237 - RNA, 22 nt, Pseudomonas putida KT2440
ucgagcauguccaaggccgcac

SEQ ID NO: 36238 - RNA, 22 nt, Pseudomonas putida KT2440
ucgagcggguugccguugucgu

SEQ ID NO: 36239 - RNA, 22 nt, Pseudomonas putida KT2440
ucgaggcgcacuucggcguacc

SEQ ID NO: 36240 - RNA, 22 nt, Pseudomonas putida KT2440
ucgaggugucguccugcagaac

SEQ ID NO: 36241 - RNA, 22 nt, Pseudomonas putida KT2440
ugcaggagcgggcuugcccgcg

SEQ ID NO: 36242 - RNA, 22 nt, Pseudomonas putida KT2440
ugcaggccguuggugcggauuu

SEQ ID NO: 36243 - RNA, 22 nt, Pseudomonas putida KT2440
ugcaggcgcggguuuacccgcg

SEQ ID NO: 36244 - RNA, 22 nt, Pseudomonas putida KT2440
ugcaggcggccccguacgcgcu

SEQ ID NO: 36245 - RNA, 22 nt, Pseudomonas putida KT2440
ugcaggugauaguggcccacca

SEQ ID NO: 36246 - RNA, 22 nt, Pseudomonas putida KT2440
ugcagucagucuaccgagggac

SEQ ID NO: 36247 - RNA, 22 nt, Pseudomonas putida KT2440
ugcagucguuguuggagcgggc

SEQ ID NO: 36248 - RNA, 22 nt, Pseudomonas putida KT2440
ugcauucgcgggcacgcccgcu

SEQ ID NO: 36249 - RNA, 22 nt, Pseudomonas putida KT2440
ugccaccugugacgguuucuuc

SEQ ID NO: 36250 - RNA, 22 nt, Pseudomonas putida KT2440
ugcccgcuccaacaacgacugc

SEQ ID NO: 36251 - RNA, 22 nt, Pseudomonas putida KT2440
ugcccgcucccacagggaccgc

SEQ ID NO: 36252 - RNA, 22 nt, Pseudomonas putida KT2440
ugcccgcucccacagguacggu

SEQ ID NO: 36253 - RNA, 22 nt, Pseudomonas putida KT2440
ugcccgcucccacaguaaucgc

SEQ ID NO: 36254 - RNA, 22 nt, Pseudomonas putida KT2440
ugcccgcuccugccggaauacc

SEQ ID NO: 36255 - RNA, 22 nt, Pseudomonas putida KT2440
ugcccgucaguuugggcgggcu

SEQ ID NO: 36256 - RNA, 22 nt, Pseudomonas putida KT2440
ugcccugggccagcagcaaggu

SEQ ID NO: 36257 - RNA, 22 nt, Pseudomonas putida KT2440
ugccgaacucggaccauggggg

SEQ ID NO: 36258 - RNA, 22 nt, Pseudomonas putida KT2440
ugccgccaggcaaccgcuggca

SEQ ID NO: 36259 - RNA, 22 nt, Pseudomonas putida KT2440
ugccgucguacaggccagugug

SEQ ID NO: 36260 - RNA, 22 nt, Pseudomonas putida KT2440
ugccguuuagcuccgucgcuag

SEQ ID NO: 36261 - RNA, 22 nt, Pseudomonas putida KT2440
ugcgaacaggguguugugcggg

SEQ ID NO: 36262 - RNA, 22 nt, Pseudomonas putida KT2440
ugcgaagucaaucgcgugaauu

SEQ ID NO: 36263 - RNA, 22 nt, Pseudomonas putida KT2440
ugcgagacaccugugggagcgg

SEQ ID NO: 36264 - RNA, 22 nt, Pseudomonas putida KT2440
ugcgcagguauagggcuacgug

SEQ ID NO: 36265 - RNA, 19 nt, Pseudomonas putida KT2440
ugcgccguggauagagugg

SEQ ID NO: 36266 - RNA, 22 nt, Pseudomonas putida KT2440
ugcgcgcauuuugcccaucgau

SEQ ID NO: 36267 - RNA, 22 nt, Pseudomonas putida KT2440
ugcggaugccauugauguugaa

SEQ ID NO: 36268 - RNA, 22 nt, Pseudomonas putida KT2440
ugcggcagaagcagcagacccu

SEQ ID NO: 36269 - RNA, 22 nt, Pseudomonas putida KT2440
ugcggcauugcuuaggcuuacg

SEQ ID NO: 36270 - RNA, 22 nt, Pseudomonas putida KT2440
ugcggccuugcgcagcgguacc

SEQ ID NO: 36271 - RNA, 22 nt, Pseudomonas putida KT2440
ugcggcuugcugaggcgcgacu

SEQ ID NO: 36272 - RNA, 22 nt, Pseudomonas putida KT2440
ugcgggcaagaccgcgccugca

SEQ ID NO: 36273 - RNA, 22 nt, Pseudomonas putida KT2440
ugcggguaaucgaucgucagac

SEQ ID NO: 36274 - RNA, 22 nt, Pseudomonas putida KT2440
ugcguacaggucgauggucguu

SEQ ID NO: 36275 - RNA, 22 nt, Pseudomonas putida KT2440
ugcgugaucgaguugcggguag

SEQ ID NO: 36276 - RNA, 22 nt, Pseudomonas putida KT2440
ugcguuccuuggcguggaugac

SEQ ID NO: 36277 - RNA, 22 nt, Pseudomonas putida KT2440
ugcuaccugcaggccggccgug

SEQ ID NO: 36278 - RNA, 22 nt, Pseudomonas putida KT2440
ugcucaguacgcggcuuugcgg

SEQ ID NO: 36279 - RNA, 22 nt, Pseudomonas putida KT2440
ugcuccgaauaaccauggccgg

SEQ ID NO: 36280 - RNA, 21 nt, Pseudomonas putida KT2440
ugcucggcggcggacuucugc

SEQ ID NO: 36281 - RNA, 22 nt, Pseudomonas putida KT2440
ugcugauccgcuggcacaagcc

SEQ ID NO: 36282 - RNA, 22 nt, Pseudomonas putida KT2440
ugcugcaaggcugccaacauug

SEQ ID NO: 36283 - RNA, 18 nt, Pseudomonas putida KT2440
ugcugcucagccuggcgg

SEQ ID NO: 36284 - RNA, 22 nt, Pseudomonas putida KT2440
ugcugcugggugagguuggcuu

SEQ ID NO: 36285 - RNA, 22 nt, Pseudomonas putida KT2440
ugcuggccuacgccgcgucgug

SEQ ID NO: 36286 - RNA, 23 nt, Pseudomonas putida KT2440
ugcuggcgcggaagucgcugagc

SEQ ID NO: 36287 - RNA, 22 nt, Pseudomonas putida KT2440
ugcuggcgcucgaugucggugg

SEQ ID NO: 36288 - RNA, 22 nt, Pseudomonas putida KT2440
ugcuggcguauuucuucccgga

SEQ ID NO: 36289 - RNA, 22 nt, Pseudomonas putida KT2440
ugcuggucaaccgccuggauga

SEQ ID NO: 36290 - RNA, 22 nt, Pseudomonas putida KT2440
ugcugguccgguaggagcggca

SEQ ID NO: 36291 - RNA, 18 nt, Pseudomonas putida KT2440
ugcuggucuuggucgcca

SEQ ID NO: 36292 - RNA, 22 nt, Pseudomonas putida KT2440
ugcuguaccuguguaggagcgg

SEQ ID NO: 36293 - RNA, 19 nt, Pseudomonas putida KT2440
ugcugucgguggcagugau

SEQ ID NO: 36294 - RNA, 22 nt, Pseudomonas putida KT2440
ugcugucguuacgccacuguug

SEQ ID NO: 36295 - RNA, 22 nt, Pseudomonas putida KT2440
ugcugugcgcgaucuucauugc

SEQ ID NO: 36296 - RNA, 22 nt, Pseudomonas putida KT2440
ugcuugaagugugccgcgccgc

SEQ ID NO: 36297 - RNA, 22 nt, Pseudomonas putida KT2440
uggacaacguauuugacuucga

SEQ ID NO: 36298 - RNA, 23 nt, Pseudomonas putida KT2440
uggaccggcaguuccaggccagc

SEQ ID NO: 36299 - RNA, 22 nt, Pseudomonas putida KT2440
uggacgcucaacgcggcgagcg

SEQ ID NO: 36300 - RNA, 22 nt, Pseudomonas putida KT2440
uggaugccucgccaugcgcuug

SEQ ID NO: 36301 - RNA, 21 nt, Pseudomonas putida KT2440
uggcaccauugccgcccugcu

SEQ ID NO: 36302 - RNA, 22 nt, Pseudomonas putida KT2440
uggcagcgaggugggcaucaag

SEQ ID NO: 36303 - RNA, 22 nt, Pseudomonas putida KT2440
uggcagcuuacugcgugacguu

SEQ ID NO: 36304 - RNA, 22 nt, Pseudomonas putida KT2440
uggcagguguggauccaaugac

SEQ ID NO: 36305 - RNA, 22 nt, Pseudomonas putida KT2440
uggccagccagauggcaucgau

SEQ ID NO: 36306 - RNA, 22 nt, Pseudomonas putida KT2440
uggcccugcuguuggcccuggc

SEQ ID NO: 36307 - RNA, 22 nt, Pseudomonas putida KT2440
uggcccuuggcgagcaucuggg

SEQ ID NO: 36308 - RNA, 22 nt, Pseudomonas putida KT2440
uggccucuucacggccaauggc

SEQ ID NO: 36309 - RNA, 22 nt, Pseudomonas putida KT2440
uggccucuucgcggguaaaccc

SEQ ID NO: 36310 - RNA, 22 nt, Pseudomonas putida KT2440
uggccugacgccauauuaucug

SEQ ID NO: 36311 - RNA, 22 nt, Pseudomonas putida KT2440
uggccugcacgcuggugcgcga

SEQ ID NO: 36312 - RNA, 22 nt, Pseudomonas putida KT2440
uggccugccguucgacagugug

SEQ ID NO: 36313 - RNA, 22 nt, Pseudomonas putida KT2440
uggccuguuggcugaaaugcug

SEQ ID NO: 36314 - RNA, 22 nt, Pseudomonas putida KT2440
uggcgagacucacggcgagccc

SEQ ID NO: 36315 - RNA, 22 nt, Pseudomonas putida KT2440
uggcgagugaacuuuucggcgc

SEQ ID NO: 36316 - RNA, 22 nt, Pseudomonas putida KT2440
uggcgagugaccgguucaccac

SEQ ID NO: 36317 - RNA, 22 nt, Pseudomonas putida KT2440
uggcggcagccagaagggcuag

SEQ ID NO: 36318 - RNA, 22 nt, Pseudomonas putida KT2440
uggcgucgagcuggugcgcagc

SEQ ID NO: 36319 - RNA, 22 nt, Pseudomonas putida KT2440
uggcucaggcugccauccgugc

SEQ ID NO: 36320 - RNA, 22 nt, Pseudomonas putida KT2440
uggcuccgaucgucugaucgaa

SEQ ID NO: 36321 - RNA, 22 nt, Pseudomonas putida KT2440
uggcucggccccggagcuggcc

SEQ ID NO: 36322 - RNA, 22 nt, Pseudomonas putida KT2440
uggcuuaucggcguagcgccaa

SEQ ID NO: 36323 - RNA, 22 nt, Pseudomonas putida KT2440
uggcuugcgaucucgcgcaacu

SEQ ID NO: 36324 - RNA, 22 nt, Pseudomonas putida KT2440
ugggagcgggcgugcccgcgaa

SEQ ID NO: 36325 - RNA, 22 nt, Pseudomonas putida KT2440
ugggagcgggcuugcccgcgaa

SEQ ID NO: 36326 - RNA, 22 nt, Pseudomonas putida KT2440
uugcccgcucgcgcgacaagcu

SEQ ID NO: 36327 - RNA, 20 nt, Pseudomonas putida KT2440
uugccgagcaguuguguauc

SEQ ID NO: 36328 - RNA, 22 nt, Pseudomonas putida KT2440
uugccgcguuugacgcuggcgg

SEQ ID NO: 36329 - RNA, 22 nt, Pseudomonas putida KT2440
uugccgucgaguucgaccugcu

SEQ ID NO: 36330 - RNA, 22 nt, Pseudomonas putida KT2440
uugccguggcguacgcacggua

SEQ ID NO: 36331 - RNA, 22 nt, Pseudomonas putida KT2440
uugccugugcugacccuuucgc

SEQ ID NO: 36332 - RNA, 22 nt, Pseudomonas putida KT2440
uugccuguguuggccucuucgc

SEQ ID NO: 36333 - RNA, 22 nt, Pseudomonas putida KT2440
uugcgcaugccgguacaccugg

SEQ ID NO: 36334 - RNA, 22 nt, Pseudomonas putida KT2440
uugcgcuguaccugugggagcg

SEQ ID NO: 36335 - RNA, 22 nt, Pseudomonas putida KT2440
uugcgcuugaguuccugaucgu

SEQ ID NO: 36336 - RNA, 22 nt, Pseudomonas putida KT2440
uugcgcuuguggaugagguugc

SEQ ID NO: 36337 - RNA, 19 nt, Pseudomonas putida KT2440
uugcgggcgcugcaggguc

SEQ ID NO: 36338 - RNA, 22 nt, Pseudomonas putida KT2440
uugcucggcuggcuggcucagc

SEQ ID NO: 36339 - RNA, 22 nt, Pseudomonas putida KT2440
uugcugcugagugugccgguaa

SEQ ID NO: 36340 - RNA, 22 nt, Pseudomonas putida KT2440
uugcuggagcuggcccgccagc

SEQ ID NO: 36341 - RNA, 22 nt, Pseudomonas putida KT2440
uuggcaccugugagaucgagug

SEQ ID NO: 36342 - RNA, 22 nt, Pseudomonas putida KT2440
uuggccguggagcagcuggccg

SEQ ID NO: 36343 - RNA, 22 nt, Pseudomonas putida KT2440
uuggccugaaucuucgcggcga

SEQ ID NO: 36344 - RNA, 22 nt, Pseudomonas putida KT2440
uuggccuugcuguugccguuga

SEQ ID NO: 36345 - RNA, 22 nt, Pseudomonas putida KT2440
uugucgaggaggcgcuacguca

SEQ ID NO: 36346 - RNA, 22 nt, Pseudomonas putida KT2440
uugucgaucuuccccgaccgca

SEQ ID NO: 36347 - RNA, 22 nt, Pseudomonas putida KT2440
uugucggcgcguuuacggcugc

SEQ ID NO: 36348 - RNA, 22 nt, Pseudomonas putida KT2440
uugugcaggcucaacguggcac

SEQ ID NO: 36349 - RNA, 22 nt, Pseudomonas putida KT2440
uugugcagguccugugcgagcg

SEQ ID NO: 36350 - RNA, 22 nt, Pseudomonas putida KT2440
uuucauugaucucaguacugau

SEQ ID NO: 36351 - RNA, 22 nt, Pseudomonas putida KT2440
uuucgcggguaaacccgcuccu

SEQ ID NO: 36352 - RNA, 22 nt, Pseudomonas putida KT2440
uuugagcaguuccagccagcug

SEQ ID NO: 36353 - RNA, 22 nt, Pseudomonas putida KT2440
uuugcaaauacggccaauaacu

SEQ ID NO: 36354 - RNA, 22 nt, Pseudomonas putida KT2440
uuugccagagccgcuggcaccg

SEQ ID NO: 36355 - RNA, 22 nt, Pseudomonas putida KT2440
uuugccaggcagggcggcguuu

SEQ ID NO: 36356 - RNA, 20 nt, Pseudomonas putida KT2440
uuugccgacggcguggcggu

SEQ ID NO: 36357 - RNA, 22 nt, Pseudomonas putida KT2440
uuugccggggucggccuugccg

SEQ ID NO: 36358 - RNA, 22 nt, Pseudomonas putida KT2440
uuugcgcuugugcguacucggc

SEQ ID NO: 36359 - RNA, 22 nt, Pseudomonas putida KT2440
uuuggccguaucgaauacagca

SEQ ID NO: 36360 - RNA, 22 nt, Pseudomonas putida KT2440
aaagcgcuugccgugcgcuucc

SEQ ID NO: 36361 - RNA, 22 nt, Pseudomonas putida KT2440
aaagggccgcaaagcggccccg

SEQ ID NO: 36362 - RNA, 22 nt, Pseudomonas putida KT2440
gccuauccugugggagcgggcu

SEQ ID NO: 36363 - RNA, 21 nt, Pseudomonas putida KT2440
gccugcuugaugaucgagauc

SEQ ID NO: 36364 - RNA, 22 nt, Pseudomonas putida KT2440
gccuguaucugugcaggggcag

SEQ ID NO: 36365 - RNA, 22 nt, Pseudomonas putida KT2440
gccugugagaucgagcgccgcc

SEQ ID NO: 36366 - RNA, 22 nt, Pseudomonas putida KT2440
gccuguggcaugcgugccucgg

SEQ ID NO: 36367 - RNA, 22 nt, Pseudomonas putida KT2440
gccuguucaccgacacugccga

SEQ ID NO: 36368 - RNA, 19 nt, Pseudomonas putida KT2440
gccuuccagccacugggcc

SEQ ID NO: 36369 - RNA, 22 nt, Pseudomonas putida KT2440
gccuugcugccggugcaggaaa

SEQ ID NO: 36370 - RNA, 22 nt, Pseudomonas putida KT2440
gccuuguaucggcccucucgcg

SEQ ID NO: 36371 - RNA, 22 nt, Pseudomonas putida KT2440
gcgaaaucaugucgucgugccu

SEQ ID NO: 36372 - RNA, 22 nt, Pseudomonas putida KT2440
gcgaaggcgcccgacauggacu

SEQ ID NO: 36373 - RNA, 22 nt, Pseudomonas putida KT2440
gcgaauggggccuuacaggccu

SEQ ID NO: 36374 - RNA, 22 nt, Pseudomonas putida KT2440
gcgacacaaggccgcucccaca

SEQ ID NO: 36375 - RNA, 22 nt, Pseudomonas putida KT2440
gcgagcaugcuguugacguucu

SEQ ID NO: 36376 - RNA, 23 nt, Pseudomonas putida KT2440
gcgauaguucaggcgacgcagau

SEQ ID NO: 36377 - RNA, 22 nt, Pseudomonas putida KT2440
gcgaucugugcaggaacgggcu

SEQ ID NO: 36378 - RNA, 22 nt, Pseudomonas putida KT2440
gcgcaaggcggugucggccagc

SEQ ID NO: 36379 - RNA, 22 nt, Pseudomonas putida KT2440
uggaggcagguggccugugcuu

SEQ ID NO: 36380 - RNA, 22 nt, Pseudomonas putida KT2440
uggagggccuacggguugcggu

SEQ ID NO: 36381 - RNA, 22 nt, Pseudomonas putida KT2440
uggaugccugcgaaacgcuguc

SEQ ID NO: 36382 - RNA, 19 nt, Pseudomonas putida KT2440
uggauggcucgucaucgag

SEQ ID NO: 36383 - RNA, 22 nt, Pseudomonas putida KT2440
uggcaauguccucugugucgaa

SEQ ID NO: 36384 - RNA, 19 nt, Pseudomonas putida KT2440
uggcacaaaugaaggcaug

SEQ ID NO: 36385 - RNA, 22 nt, Pseudomonas putida KT2440
uggcagccauguugaaaguggc

SEQ ID NO: 36386 - RNA, 20 nt, Pseudomonas putida KT2440
uggcaggaucugaugcaggu

SEQ ID NO: 36387 - RNA, 22 nt, Pseudomonas putida KT2440
uggcaguugcaguucgaacaag

SEQ ID NO: 36388 - RNA, 22 nt, Pseudomonas putida KT2440
uggccagcuuaucuauacccgg

SEQ ID NO: 36389 - RNA, 18 nt, Pseudomonas putida KT2440
uggccauggccuugcgac

SEQ ID NO: 36390 - RNA, 23 nt, Pseudomonas putida KT2440
uggcccgucgcggucacagucgg

SEQ ID NO: 36391 - RNA, 22 nt, Pseudomonas putida KT2440
uggccugcugccgccguggggu

SEQ ID NO: 36392 - RNA, 22 nt, Pseudomonas putida KT2440
uggccuucgagcgccugccgca

SEQ ID NO: 36393 - RNA, 22 nt, Pseudomonas putida KT2440
uggccuuucgugagcagccgcu

SEQ ID NO: 36394 - RNA, 22 nt, Pseudomonas putida KT2440
uggcgaguccgaagcccgcgcc

SEQ ID NO: 36395 - RNA, 22 nt, Pseudomonas putida KT2440
uggcgaucccuguaggagcggg

SEQ ID NO: 36396 - RNA, 22 nt, Pseudomonas putida KT2440
uggcgcaaccagucgaucaaug

SEQ ID NO: 36397 - RNA, 22 nt, Pseudomonas putida KT2440
uggcgcauuacgaccgggcgcg

SEQ ID NO: 36398 - RNA, 22 nt, Pseudomonas putida KT2440
uggcgcgucaugaguaccccca

SEQ ID NO: 36399 - RNA, 22 nt, Pseudomonas putida KT2440
uggcgcuggacagcgagcgccu

SEQ ID NO: 36400 - RNA, 22 nt, Pseudomonas putida KT2440
uggcgucggcggucaaucgcuu

SEQ ID NO: 36401 - RNA, 22 nt, Pseudomonas putida KT2440
uggcuggacgaggucggcgccg

SEQ ID NO: 36402 - RNA, 22 nt, Pseudomonas putida KT2440
ugggagcgaccuugugucgcga

SEQ ID NO: 36403 - RNA, 22 nt, Pseudomonas putida KT2440
ugggagcgagcaagcccgcgaa

SEQ ID NO: 36404 - RNA, 22 nt, Pseudomonas putida KT2440
ugggccguggcuuugccguggu

SEQ ID NO: 36405 - RNA, 22 nt, Pseudomonas putida KT2440
ugggccuguaugaaaagccuug

SEQ ID NO: 36406 - RNA, 22 nt, Pseudomonas putida KT2440
ugggcgaucgacagcagcaggu

SEQ ID NO: 36407 - RNA, 22 nt, Pseudomonas putida KT2440
ugggucaacugguagcgcagga

SEQ ID NO: 36408 - RNA, 22 nt, Pseudomonas putida KT2440
ugggugaccguggagcgggcgc

SEQ ID NO: 36409 - RNA, 22 nt, Pseudomonas putida KT2440
ugguaacccugugggagcgggc

SEQ ID NO: 36410 - RNA, 22 nt, Pseudomonas putida KT2440
ugguagcggcagugugcgccug

SEQ ID NO: 36411 - RNA, 22 nt, Pseudomonas putida KT2440
ugguaggagcggguucacccgc

SEQ ID NO: 36412 - RNA, 22 nt, Pseudomonas putida KT2440
ugguaggcggguuuacccgcga

SEQ ID NO: 36413 - RNA, 22 nt, Pseudomonas putida KT2440
uggucaccacugcggcuggccu

SEQ ID NO: 36414 - RNA, 22 nt, Pseudomonas putida KT2440
uggucauccacccgccgcugac

SEQ ID NO: 36415 - RNA, 22 nt, Pseudomonas putida KT2440
ugguccagacgauuucgcgcgg

SEQ ID NO: 36416 - RNA, 22 nt, Pseudomonas putida KT2440
ugguccaugccgaacagguaga

SEQ ID NO: 36417 - RNA, 22 nt, Pseudomonas putida KT2440
ugguccugcucgaagcgauggu

SEQ ID NO: 36418 - RNA, 22 nt, Pseudomonas putida KT2440
uggucgcuguugacccggguaa

SEQ ID NO: 36419 - RNA, 22 nt, Pseudomonas putida KT2440
uggucggcgaucaccgugaagu

SEQ ID NO: 36420 - RNA, 22 nt, Pseudomonas putida KT2440
uggucgucgagcuugggguugg

SEQ ID NO: 36421 - RNA, 22 nt, Pseudomonas putida KT2440
uggugacgggugccguaguguu

SEQ ID NO: 36422 - RNA, 23 nt, Pseudomonas putida KT2440
uggugccaguuucagcaagagaa

SEQ ID NO: 36423 - RNA, 22 nt, Pseudomonas putida KT2440
uggugccauuccugugggagcg

SEQ ID NO: 36424 - RNA, 22 nt, Pseudomonas putida KT2440
uggugccgacguagacguuguc

SEQ ID NO: 36425 - RNA, 22 nt, Pseudomonas putida KT2440
ugguggaccuguccggccagau

SEQ ID NO: 36426 - RNA, 22 nt, Pseudomonas putida KT2440
uguaccucaacucgcugaacca

SEQ ID NO: 36427 - RNA, 22 nt, Pseudomonas putida KT2440
uguaccugugugagcgggcuug

SEQ ID NO: 36428 - RNA, 22 nt, Pseudomonas putida KT2440
uguagaagcgggcuugcccgcg

SEQ ID NO: 36429 - RNA, 22 nt, Pseudomonas putida KT2440
uguagcggcggguuuacccgcg

SEQ ID NO: 36430 - RNA, 22 nt, Pseudomonas putida KT2440
uguaggagcggauuuacccgcg

SEQ ID NO: 36431 - RNA, 22 nt, Pseudomonas putida KT2440
uguaggagcgggcuugcccgcg

SEQ ID NO: 36432 - RNA, 22 nt, Pseudomonas putida KT2440
uguaggagcgggcuugccgcga

SEQ ID NO: 36433 - RNA, 22 nt, Pseudomonas putida KT2440
uguaggagcggguuuacccgcg

SEQ ID NO: 36434 - RNA, 22 nt, Pseudomonas putida KT2440
uguaggaguggguuggcucacg

SEQ ID NO: 36435 - RNA, 22 nt, Pseudomonas putida KT2440
uguaggcgcggguuuacccgcg

SEQ ID NO: 36436 - RNA, 22 nt, Pseudomonas putida KT2440
uguaggcgcggguuugcccgcg

SEQ ID NO: 36437 - RNA, 22 nt, Pseudomonas putida KT2440
ugucaucggccaaggggcagcc

SEQ ID NO: 36438 - RNA, 22 nt, Pseudomonas putida KT2440
uguccgccugugggagcgggca

SEQ ID NO: 36439 - RNA, 22 nt, Pseudomonas putida KT2440
ugucgagaaaauucugguuggc

SEQ ID NO: 36440 - RNA, 22 nt, Pseudomonas putida KT2440
ugucgcgcuuuucgucgguccu

SEQ ID NO: 36441 - RNA, 22 nt, Pseudomonas putida KT2440
ugucggccccgagcugccugug

SEQ ID NO: 36442 - RNA, 22 nt, Pseudomonas putida KT2440
ugucggccuugcccuggucgcu

SEQ ID NO: 36443 - RNA, 22 nt, Pseudomonas putida KT2440
ugucucgcgaugaccugaucug

SEQ ID NO: 36444 - RNA, 22 nt, Pseudomonas putida KT2440
ugugcaaugccugugggagcgg

SEQ ID NO: 36445 - RNA, 23 nt, Pseudomonas putida KT2440
ugugccagcuuguagugaagggg

SEQ ID NO: 36446 - RNA, 23 nt, Pseudomonas putida KT2440
ugugccggaagcgugcagccagc

SEQ ID NO: 36447 - RNA, 22 nt, Pseudomonas putida KT2440
ugugccggauggcuauguauug

SEQ ID NO: 36448 - RNA, 22 nt, Pseudomonas putida KT2440
ugugcgcacggucauugccgac

SEQ ID NO: 36449 - RNA, 22 nt, Pseudomonas putida KT2440
ugugcugcgaggggccauuaca

SEQ ID NO: 36450 - RNA, 17 nt, Pseudomonas putida KT2440
uguggcgcuggcuggac

SEQ ID NO: 36451 - RNA, 22 nt, Pseudomonas putida KT2440
uguucaagcugaccgaugagcu

SEQ ID NO: 36452 - RNA, 22 nt, Pseudomonas putida KT2440
uguuccgcgugcugguggacuu

SEQ ID NO: 36453 - RNA, 22 nt, Pseudomonas putida KT2440
uguucgcuuugaguuccgauca

SEQ ID NO: 36454 - RNA, 22 nt, Pseudomonas putida KT2440
uguucguacucagcuugaugua

SEQ ID NO: 36455 - RNA, 22 nt, Pseudomonas putida KT2440
uguucugcgaggucauggccac

SEQ ID NO: 36456 - RNA, 22 nt, Pseudomonas putida KT2440
uguugccggccuggagcgcgcc

SEQ ID NO: 36457 - RNA, 22 nt, Pseudomonas putida KT2440
uuacaucgacuucgucggcggu

SEQ ID NO: 36458 - RNA, 22 nt, Pseudomonas putida KT2440
uuaccagcgcuggcgccgggug

SEQ ID NO: 36459 - RNA, 22 nt, Pseudomonas putida KT2440
uuaccggacuccaguagccaga

SEQ ID NO: 36460 - RNA, 22 nt, Pseudomonas putida KT2440
uucaaacuuucgcaaaugcuug

SEQ ID NO: 36461 - RNA, 22 nt, Pseudomonas putida KT2440
uucagcgcuuucaugcguccgg

SEQ ID NO: 36462 - RNA, 22 nt, Pseudomonas putida KT2440
uucaucguucugaaucuuccug

SEQ ID NO: 36463 - RNA, 22 nt, Pseudomonas putida KT2440
uucauucgacacagaggacauu

SEQ ID NO: 36464 - RNA, 22 nt, Pseudomonas putida KT2440
uuccaagauugucgacaauccu

SEQ ID NO: 36465 - RNA, 22 nt, Pseudomonas putida KT2440
uuccagcgcaguuacuuucucg

SEQ ID NO: 36466 - RNA, 22 nt, Pseudomonas putida KT2440
uucgaaguacuggcuaccaacg

SEQ ID NO: 36467 - RNA, 22 nt, Pseudomonas putida KT2440
uucgacaucccagugcugggca

SEQ ID NO: 36468 - RNA, 22 nt, Pseudomonas putida KT2440
uucgacgaugaccuugcgccgg

SEQ ID NO: 36469 - RNA, 22 nt, Pseudomonas putida KT2440
uucgagcagcuugcgggccacg

SEQ ID NO: 36470 - RNA, 22 nt, Pseudomonas putida KT2440
uucgcacacauugggcacuucg

SEQ ID NO: 36471 - RNA, 22 nt, Pseudomonas putida KT2440
uucgcagcaccagacugccccg

SEQ ID NO: 36472 - RNA, 22 nt, Pseudomonas putida KT2440
uucgccauguuccagcagcagc

SEQ ID NO: 36473 - RNA, 22 nt, Pseudomonas putida KT2440
uucgccgcuugccauucagggu

SEQ ID NO: 36474 - RNA, 22 nt, Pseudomonas putida KT2440
uucgccggcccuggcgcagccu

SEQ ID NO: 36475 - RNA, 22 nt, Pseudomonas putida KT2440
uucgcgcagggugccggccagc

SEQ ID NO: 36476 - RNA, 22 nt, Pseudomonas putida KT2440
uucgcgcucaucgucacggccc

SEQ ID NO: 36477 - RNA, 22 nt, Pseudomonas putida KT2440
uucgcggaagcccgcuccuaca

SEQ ID NO: 36478 - RNA, 22 nt, Pseudomonas putida KT2440
uucgcgggcaagcccgcuucua

SEQ ID NO: 36479 - RNA, 22 nt, Pseudomonas putida KT2440
uucgcgggcaugcccgcuccca

SEQ ID NO: 36480 - RNA, 22 nt, Pseudomonas putida KT2440
uucgcggguaaacccgccccua

SEQ ID NO: 36481 - RNA, 22 nt, Pseudomonas putida KT2440
uucgcggguaaacccgcgccua

SEQ ID NO: 36482 - RNA, 22 nt, Pseudomonas putida KT2440
uucggcagcggaccuugcccug

SEQ ID NO: 36483 - RNA, 22 nt, Pseudomonas putida KT2440
uucgugcagccacaguugcugg

SEQ ID NO: 36484 - RNA, 22 nt, Pseudomonas putida KT2440
uucuaccagcaaguacuggcga

SEQ ID NO: 36485 - RNA, 22 nt, Pseudomonas putida KT2440
uucucggucgaucagcacgucc

SEQ ID NO: 36486 - RNA, 22 nt, Pseudomonas putida KT2440
uucugccgcacugacaucagag

SEQ ID NO: 36487 - RNA, 22 nt, Pseudomonas putida KT2440
uugaacgcgucgcuuucggccu

SEQ ID NO: 36488 - RNA, 19 nt, Pseudomonas putida KT2440
uugaaggcacccagucgau

SEQ ID NO: 36489 - RNA, 22 nt, Pseudomonas putida KT2440
uugaccuuggccaugguuucgg

SEQ ID NO: 36490 - RNA, 22 nt, Pseudomonas putida KT2440
uugacgaagucagcaaaaagga

SEQ ID NO: 36491 - RNA, 22 nt, Pseudomonas putida KT2440
uugagcaccaugcgcaagguga

SEQ ID NO: 36492 - RNA, 23 nt, Pseudomonas putida KT2440
uugagcaggaacagguugguaau

SEQ ID NO: 36493 - RNA, 22 nt, Pseudomonas putida KT2440
uugauuucgaacgggggguaau

SEQ ID NO: 36494 - RNA, 22 nt, Pseudomonas putida KT2440
uugcagugcugagcauguucug

SEQ ID NO: 36495 - RNA, 22 nt, Pseudomonas putida KT2440
uugcccacgaagcaggcaacgc

SEQ ID NO: 36496 - RNA, 22 nt, Pseudomonas putida KT2440
uugcccggucuuggccauguag

SEQ ID NO: 36497 - RNA, 19 nt, Pseudomonas putida KT2440
uugcccugaagcaggugcg

SEQ ID NO: 36498 - RNA, 22 nt, Pseudomonas putida KT2440
uugccgaugacacugucguggc

SEQ ID NO: 36499 - RNA, 22 nt, Pseudomonas putida KT2440
uugccgcgcuuuguacuggacc

SEQ ID NO: 36500 - RNA, 21 nt, Pseudomonas putida KT2440
uugccgggcaugcuuggcggu

SEQ ID NO: 36501 - RNA, 22 nt, Pseudomonas putida KT2440
uugccggugucggucagcacga

SEQ ID NO: 36502 - RNA, 22 nt, Pseudomonas putida KT2440
uugccgugcucgugggggauga

SEQ ID NO: 36503 - RNA, 22 nt, Pseudomonas putida KT2440
uugccuguaccagcccuuucgc

SEQ ID NO: 36504 - RNA, 22 nt, Pseudomonas putida KT2440
uugccuguucuggccgcuucgc

SEQ ID NO: 36505 - RNA, 22 nt, Pseudomonas putida KT2440
uugcgaaggcguuacgcuuccc

SEQ ID NO: 36506 - RNA, 22 nt, Pseudomonas putida KT2440
uugcgcccugccugugggagcg

SEQ ID NO: 36507 - RNA, 22 nt, Pseudomonas putida KT2440
uugcgcgaguuugccgcacugu

SEQ ID NO: 36508 - RNA, 22 nt, Pseudomonas putida KT2440
uugcggcaaguuguuccagcgu

SEQ ID NO: 36509 - RNA, 22 nt, Pseudomonas putida KT2440
uugcuccagcaauugccgcgug

SEQ ID NO: 36510 - RNA, 22 nt, Pseudomonas putida KT2440
uugcuggaucaaguauucacuu

SEQ ID NO: 36511 - RNA, 22 nt, Pseudomonas putida KT2440
uugcuguacaggcccucggccu

SEQ ID NO: 36512 - RNA, 22 nt, Pseudomonas putida KT2440
uugcugucggugguuuaccugu

SEQ ID NO: 36513 - RNA, 22 nt, Pseudomonas putida KT2440
uugcuucacauagcgggcacac

SEQ ID NO: 36514 - RNA, 22 nt, Pseudomonas putida KT2440
uuggagcggguuuacccgcgaa

SEQ ID NO: 36515 - RNA, 22 nt, Pseudomonas putida KT2440
uuggcaagcaccuggauucggu

SEQ ID NO: 36516 - RNA, 22 nt, Pseudomonas putida KT2440
uuggcaaguuugaugaucaguu

SEQ ID NO: 36517 - RNA, 22 nt, Pseudomonas putida KT2440
uuggccaugggccugggcugau

SEQ ID NO: 36518 - RNA, 22 nt, Pseudomonas putida KT2440
uuggccuguucgucgagcagaa

SEQ ID NO: 36519 - RNA, 22 nt, Pseudomonas putida KT2440
uuguaggagcggguucacccgc

SEQ ID NO: 36520 - RNA, 22 nt, Pseudomonas putida KT2440
uuguaggagcggguuuacccgc

SEQ ID NO: 36521 - RNA, 22 nt, Pseudomonas putida KT2440
uugucagcguccggcgcaccug

SEQ ID NO: 36522 - RNA, 17 nt, Pseudomonas putida KT2440
uugucgacaaucuugga

SEQ ID NO: 36523 - RNA, 22 nt, Pseudomonas putida KT2440
uuguggaagcgaccuugugccg

SEQ ID NO: 36524 - RNA, 23 nt, Pseudomonas putida KT2440
uuguggcagcacgggugcagcag

SEQ ID NO: 36525 - RNA, 22 nt, Pseudomonas putida KT2440
uuuccaauaauccauggcaacc

SEQ ID NO: 36526 - RNA, 22 nt, Pseudomonas putida KT2440
uuucgccggccaccagcagcuc

SEQ ID NO: 36527 - RNA, 22 nt, Pseudomonas putida KT2440
uuucgcgacacaaggccgcucc

SEQ ID NO: 36528 - RNA, 22 nt, Pseudomonas putida KT2440
uuucggccugcucgcgcaggaa

SEQ ID NO: 36529 - RNA, 22 nt, Pseudomonas putida KT2440
uuuggacgaucccaacagguga

SEQ ID NO: 36530 - RNA, 21 nt, Pseudomonas putida KT2440
accggcaguggcuuguucagg

SEQ ID NO: 36531 - RNA, 22 nt, Pseudomonas putida KT2440
accggccaggagguaauggcgu

SEQ ID NO: 36532 - RNA, 22 nt, Pseudomonas putida KT2440
accggccuugauggugaccugg

SEQ ID NO: 36533 - RNA, 22 nt, Pseudomonas putida KT2440
accggcuucgccgguguucgcg

SEQ ID NO: 36534 - RNA, 22 nt, Pseudomonas putida KT2440
accgggcagauccacggccuga

SEQ ID NO: 36535 - RNA, 22 nt, Pseudomonas putida KT2440
accgggcuggugguguaagcga

SEQ ID NO: 36536 - RNA, 22 nt, Pseudomonas putida KT2440
accgucaccgccgaacgcaucc

SEQ ID NO: 36537 - RNA, 22 nt, Pseudomonas putida KT2440
accuccgcuacaugcacccagg

SEQ ID NO: 36538 - RNA, 22 nt, Pseudomonas putida KT2440
accucgagaagguuaaggcagu

SEQ ID NO: 36539 - RNA, 22 nt, Pseudomonas putida KT2440
accucgcgugccgccgacgaca

SEQ ID NO: 36540 - RNA, 22 nt, Pseudomonas putida KT2440
accuggcccugcuggcggcggu

SEQ ID NO: 36541 - RNA, 17 nt, Pseudomonas putida KT2440
accugggcggcucaugg

SEQ ID NO: 36542 - RNA, 22 nt, Pseudomonas putida KT2440
accuguggcgcuggcuugccgg

SEQ ID NO: 36543 - RNA, 22 nt, Pseudomonas putida KT2440
accugugggagcgggcgugccc

SEQ ID NO: 36544 - RNA, 22 nt, Pseudomonas putida KT2440
accuuggcuucaagcggguuag

SEQ ID NO: 36545 - RNA, 22 nt, Pseudomonas putida KT2440
acgacugugacaugguucaggg

SEQ ID NO: 36546 - RNA, 22 nt, Pseudomonas putida KT2440
acgcaggugaucgcucggcaau

SEQ ID NO: 36547 - RNA, 22 nt, Pseudomonas putida KT2440
acgcugacagcaugcccgcuca

SEQ ID NO: 36548 - RNA, 22 nt, Pseudomonas putida KT2440
acgcugaccugccugccgguag

SEQ ID NO: 36549 - RNA, 21 nt, Pseudomonas putida KT2440
acggacaaccccgaaguugua

SEQ ID NO: 36550 - RNA, 20 nt, Pseudomonas putida KT2440
acggaugguuugccgggcca

SEQ ID NO: 36551 - RNA, 23 nt, Pseudomonas putida KT2440
acggcgaggaagccagcuucauc

SEQ ID NO: 36552 - RNA, 22 nt, Pseudomonas putida KT2440
acgguacagcguucaggaugga

SEQ ID NO: 36553 - RNA, 22 nt, Pseudomonas putida KT2440
aggcguuuguagucaaguggcg

SEQ ID NO: 36554 - RNA, 22 nt, Pseudomonas putida KT2440
aggcugcagcguuguaccagcc

SEQ ID NO: 36555 - RNA, 22 nt, Pseudomonas putida KT2440
aggcugcgugcgaucgguucca

SEQ ID NO: 36556 - RNA, 22 nt, Pseudomonas putida KT2440
agggcgcugucgauggccgccu

SEQ ID NO: 36557 - RNA, 22 nt, Pseudomonas putida KT2440
agggugcuagcucaaugaugca

SEQ ID NO: 36558 - RNA, 22 nt, Pseudomonas putida KT2440
agguaacggcuaucgcggcuac

SEQ ID NO: 36559 - RNA, 22 nt, Pseudomonas putida KT2440
aggucgacuucggcggugucca

SEQ ID NO: 36560 - RNA, 22 nt, Pseudomonas putida KT2440
aggucguauugccaacuggcgg

SEQ ID NO: 36561 - RNA, 22 nt, Pseudomonas putida KT2440
aggucuugcccagcacggugua

SEQ ID NO: 36562 - RNA, 22 nt, Pseudomonas putida KT2440
aggugcaagaggcgcgugcggc

SEQ ID NO: 36563 - RNA, 22 nt, Pseudomonas putida KT2440
agguggcugcccaaugacucgg

SEQ ID NO: 36564 - RNA, 18 nt, Pseudomonas putida KT2440
aggugggcaacugguugc

SEQ ID NO: 36565 - RNA, 22 nt, Pseudomonas putida KT2440
aggugguagcaggucgagcaag

SEQ ID NO: 36566 - RNA, 22 nt, Pseudomonas putida KT2440
agguguacagcagcgccugcag

SEQ ID NO: 36567 - RNA, 22 nt, Pseudomonas putida KT2440
agguuucgucgacgaucugguu

SEQ ID NO: 36568 - RNA, 22 nt, Pseudomonas putida KT2440
agguuugccacacguguuuauc

SEQ ID NO: 36569 - RNA, 22 nt, Pseudomonas putida KT2440
aguaccuggccaagcacggcaa

SEQ ID NO: 36570 - RNA, 22 nt, Pseudomonas putida KT2440
agucaagaaugcgugggucuuu

SEQ ID NO: 36571 - RNA, 21 nt, Pseudomonas putida KT2440
agucagcugguuguuggccgc

SEQ ID NO: 36572 - RNA, 22 nt, Pseudomonas putida KT2440
agucggcgaaugcuuuucuaga

SEQ ID NO: 36573 - RNA, 22 nt, Pseudomonas putida KT2440
agugccaggcgcaccugccuac

SEQ ID NO: 36574 - RNA, 22 nt, Pseudomonas putida KT2440
agugccgcggacucgucgccag

SEQ ID NO: 36575 - RNA, 22 nt, Pseudomonas putida KT2440
agugccggggcugcuucgcagc

SEQ ID NO: 36576 - RNA, 22 nt, Pseudomonas putida KT2440
agugcgcagcgugcuguucggu

SEQ ID NO: 36577 - RNA, 22 nt, Pseudomonas putida KT2440
agugcgcguguucgugggcuug

SEQ ID NO: 36578 - RNA, 22 nt, Pseudomonas putida KT2440
aguugaccaguaccgccagcgc

SEQ ID NO: 36579 - RNA, 22 nt, Pseudomonas putida KT2440
aguugauuuugcggucugccau

SEQ ID NO: 36580 - RNA, 22 nt, Pseudomonas putida KT2440
aguugccggagcgcgucagccc

SEQ ID NO: 36581 - RNA, 22 nt, Pseudomonas putida KT2440
auacaccgccugugccucugcg

SEQ ID NO: 36582 - RNA, 22 nt, Pseudomonas putida KT2440
auacagcuguagcgccggggcu

SEQ ID NO: 36583 - RNA, 22 nt, Pseudomonas putida KT2440
auacccgcaacaaugcacagcg

SEQ ID NO: 36584 - RNA, 22 nt, Pseudomonas putida KT2440
auaccgguaauuucacgcucca

SEQ ID NO: 36585 - RNA, 22 nt, Pseudomonas putida KT2440
aucaccugcacuggccucuucg

SEQ ID NO: 36586 - RNA, 22 nt, Pseudomonas putida KT2440
aucagcccgucgcagaugggca

SEQ ID NO: 36587 - RNA, 22 nt, Pseudomonas putida KT2440
aucagccugcugcucacccacg

SEQ ID NO: 36588 - RNA, 22 nt, Pseudomonas putida KT2440
aucagguuggcguacucguugg

SEQ ID NO: 36589 - RNA, 22 nt, Pseudomonas putida KT2440
aucagugggugccugccuaacu

SEQ ID NO: 36590 - RNA, 22 nt, Pseudomonas putida KT2440
aucaucgcccuucggcgccacc

SEQ ID NO: 36591 - RNA, 22 nt, Pseudomonas putida KT2440
aucccgcgaaacggcucggcug

SEQ ID NO: 36592 - RNA, 22 nt, Pseudomonas putida KT2440
aucgacaaggcccgugagcgca

SEQ ID NO: 36593 - RNA, 22 nt, Pseudomonas putida KT2440
aucgacgcgguuggaucgcggg

SEQ ID NO: 36594 - RNA, 22 nt, Pseudomonas putida KT2440
aucgagagcuggcucaaugacu

SEQ ID NO: 36595 - RNA, 22 nt, Pseudomonas putida KT2440
aucgagcaccaccacauggugg

SEQ ID NO: 36596 - RNA, 22 nt, Pseudomonas putida KT2440
aucgaucagcaccgccuugggc

SEQ ID NO: 36597 - RNA, 22 nt, Pseudomonas putida KT2440
aucgaucagcgaggccagcacc

SEQ ID NO: 36598 - RNA, 22 nt, Pseudomonas putida KT2440
aucgaucauggccagguacugc

SEQ ID NO: 36599 - RNA, 20 nt, Pseudomonas putida KT2440
aucgauccagcgcaacaggc

SEQ ID NO: 36600 - RNA, 22 nt, Pseudomonas putida KT2440
aucgccaucagccucuauccgc

SEQ ID NO: 36601 - RNA, 22 nt, Pseudomonas putida KT2440
aucgcccuuaaugcuggaguuc

SEQ ID NO: 36602 - RNA, 22 nt, Pseudomonas putida KT2440
aucggcgccauuggcuuugcgc

SEQ ID NO: 36603 - RNA, 22 nt, Pseudomonas putida KT2440
aucggcuuggcgaugcgugugg

SEQ ID NO: 36604 - RNA, 22 nt, Pseudomonas putida KT2440
aucgggcgggguuugaucgaug

SEQ ID NO: 36605 - RNA, 22 nt, Pseudomonas putida KT2440
aucgugcccuuggucaaccugc

SEQ ID NO: 36606 - RNA, 22 nt, Pseudomonas putida KT2440
aucugcgccuggaccgcggcga

SEQ ID NO: 36607 - RNA, 22 nt, Pseudomonas putida KT2440
aucugggugaugaauuggccgg

SEQ ID NO: 36608 - RNA, 20 nt, Pseudomonas putida KT2440
aucugguuaguggccagccc

SEQ ID NO: 36609 - RNA, 22 nt, Pseudomonas putida KT2440
aucuugcgcaagauccagggug

SEQ ID NO: 36610 - RNA, 22 nt, Pseudomonas putida KT2440
augaagacuauaucgaucugaa

SEQ ID NO: 36611 - RNA, 22 nt, Pseudomonas putida KT2440
augacaaaguggcaggcguaaa

SEQ ID NO: 36612 - RNA, 22 nt, Pseudomonas putida KT2440
augaccagucucuggccgcaag

SEQ ID NO: 36613 - RNA, 22 nt, Pseudomonas putida KT2440
augacccacgugaccauuguca

SEQ ID NO: 36614 - RNA, 22 nt, Pseudomonas putida KT2440
augacccguuccugcacaggaa

SEQ ID NO: 36615 - RNA, 21 nt, Pseudomonas putida KT2440
augacgucaucagcgcacgga

SEQ ID NO: 36616 - RNA, 22 nt, Pseudomonas putida KT2440
augaggaucuugugcgccucca

SEQ ID NO: 36617 - RNA, 22 nt, Pseudomonas putida KT2440
augauguucaagucguauucgg

SEQ ID NO: 36618 - RNA, 22 nt, Pseudomonas putida KT2440
augcccgccauaucgaccagcu

SEQ ID NO: 36619 - RNA, 22 nt, Pseudomonas putida KT2440
augcccgccggggucagccaug

SEQ ID NO: 36620 - RNA, 22 nt, Pseudomonas putida KT2440
augcccgcucccacagguagcc

SEQ ID NO: 36621 - RNA, 21 nt, Pseudomonas putida KT2440
augccgaucaagccgccaccc

SEQ ID NO: 36622 - RNA, 19 nt, Pseudomonas putida KT2440
augccgcgaagugcugcgc

SEQ ID NO: 36623 - RNA, 22 nt, Pseudomonas putida KT2440
augccgcgccgcgacaacagcu

SEQ ID NO: 36624 - RNA, 22 nt, Pseudomonas putida KT2440
augccgguguugauggccugga

SEQ ID NO: 36625 - RNA, 22 nt, Pseudomonas putida KT2440
augcgcaggucuucgccgauca

SEQ ID NO: 36626 - RNA, 22 nt, Pseudomonas putida KT2440
augcgcguggccgagcguaucc

SEQ ID NO: 36627 - RNA, 22 nt, Pseudomonas putida KT2440
augcugcucagcauuucgccgc

SEQ ID NO: 36628 - RNA, 22 nt, Pseudomonas putida KT2440
augcuggcggcagacugguaug

SEQ ID NO: 36629 - RNA, 22 nt, Pseudomonas putida KT2440
auggccuggucggcggucggca

SEQ ID NO: 36630 - RNA, 22 nt, Pseudomonas putida KT2440
augggacagauccgccggcuug

SEQ ID NO: 36631 - RNA, 23 nt, Pseudomonas putida KT2440
auggucgacgagaaccuggagca

SEQ ID NO: 36632 - RNA, 22 nt, Pseudomonas putida KT2440
auggugcggcauugcucggggc

SEQ ID NO: 36633 - RNA, 22 nt, Pseudomonas putida KT2440
auggugcugcuguugccggccc

SEQ ID NO: 36634 - RNA, 22 nt, Pseudomonas putida KT2440
auuccugaaaaguaagggccgg

SEQ ID NO: 36635 - RNA, 22 nt, Pseudomonas putida KT2440
auucgagcugcaggcgguccug

SEQ ID NO: 36636 - RNA, 21 nt, Pseudomonas putida KT2440
auucgccaacgugacugccuc

SEQ ID NO: 36637 - RNA, 22 nt, Pseudomonas putida KT2440
auucgcgggcaagcccgcuccu

SEQ ID NO: 36638 - RNA, 22 nt, Pseudomonas putida KT2440
ccagaugguagauacgcgucau

SEQ ID NO: 36639 - RNA, 22 nt, Pseudomonas putida KT2440
ccagcagugcggucuugccaga

SEQ ID NO: 36640 - RNA, 22 nt, Pseudomonas putida KT2440
ccagcccucgaccuuccaugcc

SEQ ID NO: 36641 - RNA, 22 nt, Pseudomonas putida KT2440
ccagccuuggcguucggcgggu

SEQ ID NO: 36642 - RNA, 22 nt, Pseudomonas putida KT2440
ccagcgaacacuggcaaggccc

SEQ ID NO: 36643 - RNA, 22 nt, Pseudomonas putida KT2440
ccagcucggcguguuggccggu

SEQ ID NO: 36644 - RNA, 22 nt, Pseudomonas putida KT2440
ccaggaucaacucauccuugau

SEQ ID NO: 36645 - RNA, 22 nt, Pseudomonas putida KT2440
ccaggcauggaucgcccacugu

SEQ ID NO: 36646 - RNA, 20 nt, Pseudomonas putida KT2440
ccaggcuggacgaggccaug

SEQ ID NO: 36647 - RNA, 22 nt, Pseudomonas putida KT2440
ccagguacagcaccgcacccgc

SEQ ID NO: 36648 - RNA, 22 nt, Pseudomonas putida KT2440
ccagguggagacccugggugcc

SEQ ID NO: 36649 - RNA, 22 nt, Pseudomonas putida KT2440
ccaguaccugaucgagcauuug

SEQ ID NO: 36650 - RNA, 22 nt, Pseudomonas putida KT2440
ccaguacgaccuggaugccccg

SEQ ID NO: 36651 - RNA, 22 nt, Pseudomonas putida KT2440
ccaguacugcucgaugaacagu

SEQ ID NO: 36652 - RNA, 22 nt, Pseudomonas putida KT2440
ccagugcagugggccugggcgc

SEQ ID NO: 36653 - RNA, 22 nt, Pseudomonas putida KT2440
ccaguucaccgcgcauggcgcg

SEQ ID NO: 36654 - RNA, 22 nt, Pseudomonas putida KT2440
ccaguugaauggcccggcgguu

SEQ ID NO: 36655 - RNA, 22 nt, Pseudomonas putida KT2440
ccaucgacaaggucgaguucuu

SEQ ID NO: 36656 - RNA, 22 nt, Pseudomonas putida KT2440
ccaugcucauccugcuguuccu

SEQ ID NO: 36657 - RNA, 22 nt, Pseudomonas putida KT2440
cccagcguuugaugccgagcua

SEQ ID NO: 36658 - RNA, 22 nt, Pseudomonas putida KT2440
cccgaucgcucgggcugcuguu

SEQ ID NO: 36659 - RNA, 22 nt, Pseudomonas putida KT2440
cccgcgaaacaagcgacgcggu

SEQ ID NO: 36660 - RNA, 22 nt, Pseudomonas putida KT2440
cccgcgaacaccggcaaugccg

SEQ ID NO: 36661 - RNA, 22 nt, Pseudomonas putida KT2440
cccgcgaacaccggcuacgccg

SEQ ID NO: 36662 - RNA, 22 nt, Pseudomonas putida KT2440
ccgaaucgcagugaggaucugc

SEQ ID NO: 36663 - RNA, 22 nt, Pseudomonas putida KT2440
ccgacagacgcacgaugaccuu

SEQ ID NO: 36664 - RNA, 22 nt, Pseudomonas putida KT2440
ccgaccagguugagaucagccu

SEQ ID NO: 36665 - RNA, 22 nt, Pseudomonas putida KT2440
ccgagcucggacuugaguguga

SEQ ID NO: 36666 - RNA, 23 nt, Pseudomonas putida KT2440
ccgagcuugucaggucggcuggc

SEQ ID NO: 36667 - RNA, 22 nt, Pseudomonas putida KT2440
ccgaucaaugucggagcgggcu

SEQ ID NO: 36668 - RNA, 22 nt, Pseudomonas putida KT2440
ccgcagcacugccugaagagcc

SEQ ID NO: 36669 - RNA, 22 nt, Pseudomonas putida KT2440
ccgcagucaccugugucggugc

SEQ ID NO: 36670 - RNA, 22 nt, Pseudomonas putida KT2440
ccgcuguucuaccucaagcgcu

SEQ ID NO: 36671 - RNA, 22 nt, Pseudomonas putida KT2440
ccgcuuugacggccugcugcga

SEQ ID NO: 36672 - RNA, 22 nt, Pseudomonas putida KT2440
ccggaucugccggcugucguag

SEQ ID NO: 36673 - RNA, 22 nt, Pseudomonas putida KT2440
ccggcaagccagcgccacaggu

SEQ ID NO: 36674 - RNA, 19 nt, Pseudomonas putida KT2440
ccggccaaucugagcuucg

SEQ ID NO: 36675 - RNA, 22 nt, Pseudomonas putida KT2440
ccggcguugaccgcguugcucg

SEQ ID NO: 36676 - RNA, 22 nt, Pseudomonas putida KT2440
ccggcguuuucggcgacguugc

SEQ ID NO: 36677 - RNA, 22 nt, Pseudomonas putida KT2440
ccgggauugcccuggcggcggu

SEQ ID NO: 36678 - RNA, 22 nt, Pseudomonas putida KT2440
ccgggauugcgggugccuucgg

SEQ ID NO: 36679 - RNA, 22 nt, Pseudomonas putida KT2440
ccggguaacgcuuguacuuggc

SEQ ID NO: 36680 - RNA, 22 nt, Pseudomonas putida KT2440
ccggugugggcuugcccagcca

SEQ ID NO: 36681 - RNA, 22 nt, Pseudomonas putida KT2440
ccgguuacaaauggaaccgguu

SEQ ID NO: 36682 - RNA, 22 nt, Pseudomonas putida KT2440
ccguggcugggccaaugcggcg

SEQ ID NO: 36683 - RNA, 22 nt, Pseudomonas putida KT2440
ccguguucgccgccuugcggcu

SEQ ID NO: 36684 - RNA, 22 nt, Pseudomonas putida KT2440
ccugaaucuccacguggcgugg

SEQ ID NO: 36685 - RNA, 22 nt, Pseudomonas putida KT2440
ccugaccgacaacgagcuggcc

SEQ ID NO: 36686 - RNA, 22 nt, Pseudomonas putida KT2440
ccugccacgugacaccuucaug

SEQ ID NO: 36687 - RNA, 22 nt, Pseudomonas putida KT2440
ccuggccaguguacugcccgag

SEQ ID NO: 36688 - RNA, 22 nt, Pseudomonas putida KT2440
ccuggcgagucagcagcgccag

SEQ ID NO: 36689 - RNA, 22 nt, Pseudomonas putida KT2440
ccuggcucaagaagcuggcucg

SEQ ID NO: 36690 - RNA, 23 nt, Pseudomonas putida KT2440
ccuggcucaggcuauguaccaau

SEQ ID NO: 36691 - RNA, 22 nt, Pseudomonas putida KT2440
ccugggucaagccccagcgcgc

SEQ ID NO: 36692 - RNA, 22 nt, Pseudomonas putida KT2440
ccuguaggagcgggucuacccg

SEQ ID NO: 36693 - RNA, 22 nt, Pseudomonas putida KT2440
ccuguggcagcagcggucuugu

SEQ ID NO: 36694 - RNA, 22 nt, Pseudomonas putida KT2440
ccuuuagcgggcgcgcccgcuc

SEQ ID NO: 36695 - RNA, 23 nt, Pseudomonas putida KT2440
cgaacgccacgaccgaugcagcc

SEQ ID NO: 36696 - RNA, 22 nt, Pseudomonas putida KT2440
cgaacggaucaaggccuugcgc

SEQ ID NO: 36697 - RNA, 22 nt, Pseudomonas putida KT2440
cgaagaguugcuguuccucagc

SEQ ID NO: 36698 - RNA, 22 nt, Pseudomonas putida KT2440
cgaagccaccggggccuuguug

SEQ ID NO: 36699 - RNA, 22 nt, Pseudomonas putida KT2440
cgaagugcucaauauugccagc

SEQ ID NO: 36700 - RNA, 22 nt, Pseudomonas putida KT2440
cgaccgaggaugaagacgauca

SEQ ID NO: 36701 - RNA, 22 nt, Pseudomonas putida KT2440
cgaccugcagguucucgaaguu

SEQ ID NO: 36702 - RNA, 22 nt, Pseudomonas putida KT2440
cgaccuggacgagaagaccagc

SEQ ID NO: 36703 - RNA, 22 nt, Pseudomonas putida KT2440
cgacugguacaagaagagcacc

SEQ ID NO: 36704 - RNA, 22 nt, Pseudomonas putida KT2440
cgaggcauugauggaaugcauu

SEQ ID NO: 36705 - RNA, 22 nt, Pseudomonas putida KT2440
cgagugaaaggccuugagcugg

SEQ ID NO: 36706 - RNA, 22 nt, Pseudomonas putida KT2440
cgaguuauuggccguauuugca

SEQ ID NO: 36707 - RNA, 22 nt, Pseudomonas putida KT2440
cgaucguugguugagugccacu

SEQ ID NO: 36708 - RNA, 22 nt, Pseudomonas putida KT2440
cgaugcccagcgccucggccug

SEQ ID NO: 36709 - RNA, 22 nt, Pseudomonas putida KT2440
cgaugguagagaacccgaggca

SEQ ID NO: 36710 - RNA, 22 nt, Pseudomonas putida KT2440
cgauggugaaggccgcgugcac

SEQ ID NO: 36711 - RNA, 22 nt, Pseudomonas putida KT2440
cgaugguguccacgcccagcgc

SEQ ID NO: 36712 - RNA, 22 nt, Pseudomonas putida KT2440
cgauguaguugcgcgaacugga

SEQ ID NO: 36713 - RNA, 22 nt, Pseudomonas putida KT2440
cgauuaccaggacagcccggcg

SEQ ID NO: 36714 - RNA, 22 nt, Pseudomonas putida KT2440
cgcaacgugccucgacccgcuu

SEQ ID NO: 36715 - RNA, 22 nt, Pseudomonas putida KT2440
cgcacuguucaaagaaccggaa

SEQ ID NO: 36716 - RNA, 22 nt, Pseudomonas putida KT2440
cgcagguugacccggcggcgga

SEQ ID NO: 36717 - RNA, 22 nt, Pseudomonas putida KT2440
cgcauagggcucuuggccguug

SEQ ID NO: 36718 - RNA, 22 nt, Pseudomonas putida KT2440
cgcauggugucucuccuuucau

SEQ ID NO: 36719 - RNA, 22 nt, Pseudomonas putida KT2440
cgcauucgcggguaaacccgcu

SEQ ID NO: 36720 - RNA, 22 nt, Pseudomonas putida KT2440
cgcauucgcgggugaacccgcu

SEQ ID NO: 36721 - RNA, 22 nt, Pseudomonas putida KT2440
cgccagcuccaucagugggaac

SEQ ID NO: 36722 - RNA, 22 nt, Pseudomonas putida KT2440
cgccaguuucaucagcgcacgg

SEQ ID NO: 36723 - RNA, 22 nt, Pseudomonas putida KT2440
cuccuacauugacugcgcgaug

SEQ ID NO: 36724 - RNA, 22 nt, Pseudomonas putida KT2440
cucgaucuggcaggcgcugcaa

SEQ ID NO: 36725 - RNA, 22 nt, Pseudomonas putida KT2440
cucgccaugcaccaggcggcuu

SEQ ID NO: 36726 - RNA, 22 nt, Pseudomonas putida KT2440
cucgcgcagguugagguugugg

SEQ ID NO: 36727 - RNA, 22 nt, Pseudomonas putida KT2440
cucggaagucaggucuggcaag

SEQ ID NO: 36728 - RNA, 22 nt, Pseudomonas putida KT2440
cucgguguucgccaagcugccc

SEQ ID NO: 36729 - RNA, 22 nt, Pseudomonas putida KT2440
cucucgauuuucccagaggcca

SEQ ID NO: 36730 - RNA, 22 nt, Pseudomonas putida KT2440
cugacuuccuagaugcuuccaa

SEQ ID NO: 36731 - RNA, 22 nt, Pseudomonas putida KT2440
cugagccggcgcacccuggacg

SEQ ID NO: 36732 - RNA, 20 nt, Pseudomonas putida KT2440
cugaucaucgucgcgggucg

SEQ ID NO: 36733 - RNA, 22 nt, Pseudomonas putida KT2440
cugaugaacggcuuccugucga

SEQ ID NO: 36734 - RNA, 22 nt, Pseudomonas putida KT2440
cugauuggucgcauucgcgggc

SEQ ID NO: 36735 - RNA, 22 nt, Pseudomonas putida KT2440
cugcacgguggugcccgguucg

SEQ ID NO: 36736 - RNA, 22 nt, Pseudomonas putida KT2440
cugcagccguccacguaggcgu

SEQ ID NO: 36737 - RNA, 22 nt, Pseudomonas putida KT2440
cugcagugauccugugggagcg

SEQ ID NO: 36738 - RNA, 22 nt, Pseudomonas putida KT2440
cugcaguuucguagcgaaggcg

SEQ ID NO: 36739 - RNA, 22 nt, Pseudomonas putida KT2440
cugccgaggaagagggccuugc

SEQ ID NO: 36740 - RNA, 22 nt, Pseudomonas putida KT2440
cugccugggcggcgcuguucgc

SEQ ID NO: 36741 - RNA, 22 nt, Pseudomonas putida KT2440
cugccuggucagcgaacgaagg

SEQ ID NO: 36742 - RNA, 22 nt, Pseudomonas putida KT2440
cugcgcagcuguucaccggccu

SEQ ID NO: 36743 - RNA, 22 nt, Pseudomonas putida KT2440
cugcgcgaucacugugggagcg

SEQ ID NO: 36744 - RNA, 22 nt, Pseudomonas putida KT2440
cugcgucagguggugaccaagu

SEQ ID NO: 36745 - RNA, 22 nt, Pseudomonas putida KT2440
cugcgucugcuucugcuuuugc

SEQ ID NO: 36746 - RNA, 19 nt, Pseudomonas putida KT2440
cugcucgucgcucaguggu

SEQ ID NO: 36747 - RNA, 22 nt, Pseudomonas putida KT2440
cugcugaagaaaaauccgaacg

SEQ ID NO: 36748 - RNA, 22 nt, Pseudomonas putida KT2440
cugcugcuggaaugggcggcca

SEQ ID NO: 36749 - RNA, 22 nt, Pseudomonas putida KT2440
cugcugugcguggagggugucg

SEQ ID NO: 36750 - RNA, 22 nt, Pseudomonas putida KT2440
cuggaacacgaacccgaaggcc

SEQ ID NO: 36751 - RNA, 22 nt, Pseudomonas putida KT2440
cuggacugccgcgacggcgcuu

SEQ ID NO: 36752 - RNA, 22 nt, Pseudomonas putida KT2440
cuggaggucucguucgcugugg

SEQ ID NO: 36753 - RNA, 22 nt, Pseudomonas putida KT2440
cuggaucgacgccgcuucgucc

SEQ ID NO: 36754 - RNA, 22 nt, Pseudomonas putida KT2440
cuggccaccacuggccauggca

SEQ ID NO: 36755 - RNA, 22 nt, Pseudomonas putida KT2440
cuggccagcuugcgggagcagg

SEQ ID NO: 36756 - RNA, 22 nt, Pseudomonas putida KT2440
cuggccguugcugcgugugucc

SEQ ID NO: 36757 - RNA, 22 nt, Pseudomonas putida KT2440
cuggcgcaccugguagccguau

SEQ ID NO: 36758 - RNA, 22 nt, Pseudomonas putida KT2440
cuggcgcugacguugaucggcc

SEQ ID NO: 36759 - RNA, 23 nt, Pseudomonas putida KT2440
cuggcgguucuggguggcguagc

SEQ ID NO: 36760 - RNA, 22 nt, Pseudomonas putida KT2440
cuggcugcggugcaagcagaag

SEQ ID NO: 36761 - RNA, 22 nt, Pseudomonas putida KT2440
cugggcaacgaagagauggcgc

SEQ ID NO: 36762 - RNA, 22 nt, Pseudomonas putida KT2440
cugggcguagcccuguccaaaa

SEQ ID NO: 36763 - RNA, 22 nt, Pseudomonas putida KT2440
cuggguaugacccagcguguau

SEQ ID NO: 36764 - RNA, 22 nt, Pseudomonas putida KT2440
cugggucugagaaccaucgggg

SEQ ID NO: 36765 - RNA, 22 nt, Pseudomonas putida KT2440
cugggugaggugucuucggcgg

SEQ ID NO: 36766 - RNA, 22 nt, Pseudomonas putida KT2440
cuggugaacaguggcugggccg

SEQ ID NO: 36767 - RNA, 22 nt, Pseudomonas putida KT2440
cugguugaacuccaaccugggc

SEQ ID NO: 36768 - RNA, 22 nt, Pseudomonas putida KT2440
cugguugcgcaugugcuggggc

SEQ ID NO: 36769 - RNA, 21 nt, Pseudomonas putida KT2440
cuguacggaggugaucgaacc

SEQ ID NO: 36770 - RNA, 20 nt, Pseudomonas putida KT2440
cuguagccugcuuguuaugc

SEQ ID NO: 36771 - RNA, 22 nt, Pseudomonas putida KT2440
cugucgccuuggcuggugucug

SEQ ID NO: 36772 - RNA, 22 nt, Pseudomonas putida KT2440
cugucgggccgaccagcccacc

SEQ ID NO: 36773 - RNA, 22 nt, Pseudomonas putida KT2440
cugugcaggcguguuagccgug

SEQ ID NO: 36774 - RNA, 22 nt, Pseudomonas putida KT2440
cuguggccuucaacgaugucga

SEQ ID NO: 36775 - RNA, 22 nt, Pseudomonas putida KT2440
cugugggaacgggcaagcccgc

SEQ ID NO: 36776 - RNA, 22 nt, Pseudomonas putida KT2440
cuucagccugagccugcagcuu

SEQ ID NO: 36777 - RNA, 22 nt, Pseudomonas putida KT2440
cuucauggccaaggaccgcauc

SEQ ID NO: 36778 - RNA, 23 nt, Pseudomonas putida KT2440
cuuccugaccgaugaccugcuca

SEQ ID NO: 36779 - RNA, 22 nt, Pseudomonas putida KT2440
cuucgcggcuaaagccgcuccu

SEQ ID NO: 36780 - RNA, 22 nt, Pseudomonas putida KT2440
cuucgcgggcaagcccgcuccu

SEQ ID NO: 36781 - RNA, 22 nt, Pseudomonas putida KT2440
cuucgcgggugaacccgcuccu

SEQ ID NO: 36782 - RNA, 22 nt, Pseudomonas putida KT2440
cuucggucgcgugcugucggcc

SEQ ID NO: 36783 - RNA, 22 nt, Pseudomonas putida KT2440
cuugaacagguagaccgccgcc

SEQ ID NO: 36784 - RNA, 22 nt, Pseudomonas putida KT2440
cuugagcacgagugccauagca

SEQ ID NO: 36785 - RNA, 22 nt, Pseudomonas putida KT2440
cuugagcacugggccgcgaaug

SEQ ID NO: 36786 - RNA, 22 nt, Pseudomonas putida KT2440
cuugcccgcucccacaaguacu

SEQ ID NO: 36787 - RNA, 22 nt, Pseudomonas putida KT2440
cuugccggccagcagguggccg

SEQ ID NO: 36788 - RNA, 22 nt, Pseudomonas putida KT2440
cuuucgcggcugaagccgcucc

SEQ ID NO: 36789 - RNA, 22 nt, Pseudomonas putida KT2440
cuuugcaguacuugugggagcg

SEQ ID NO: 36790 - RNA, 22 nt, Pseudomonas putida KT2440
cuuugcugacgggcugugcagg

SEQ ID NO: 36791 - RNA, 22 nt, Pseudomonas putida KT2440
gaacggguuuacccgcgaaugc

SEQ ID NO: 36792 - RNA, 22 nt, Pseudomonas putida KT2440
gaagcucaguacaacaucgacc

SEQ ID NO: 36793 - RNA, 22 nt, Pseudomonas putida KT2440
gaaguuggcguggucggugaaa

SEQ ID NO: 36794 - RNA, 23 nt, Pseudomonas putida KT2440
gacaccaucgcccuuaaugcugg

SEQ ID NO: 36795 - RNA, 22 nt, Pseudomonas putida KT2440
gaccaggacgcuaucgaauaca

SEQ ID NO: 36796 - RNA, 22 nt, Pseudomonas putida KT2440
gacccguugucggugaucguug

SEQ ID NO: 36797 - RNA, 22 nt, Pseudomonas putida KT2440
gaccgcuacuucaagcagaucg

SEQ ID NO: 36798 - RNA, 22 nt, Pseudomonas putida KT2440
gaccggcacgggugaagccggu

SEQ ID NO: 36799 - RNA, 22 nt, Pseudomonas putida KT2440
gaccgugcaguguucauuaccc

SEQ ID NO: 36800 - RNA, 22 nt, Pseudomonas putida KT2440
gacgaagucaaaggccuggugg

SEQ ID NO: 36801 - RNA, 22 nt, Pseudomonas putida KT2440
gacgcgaucacccuuauugcca

SEQ ID NO: 36802 - RNA, 22 nt, Pseudomonas putida KT2440
gacgcuggucuuuagcggguau

SEQ ID NO: 36803 - RNA, 22 nt, Pseudomonas putida KT2440
gacgguggugccggccugauua

SEQ ID NO: 36804 - RNA, 22 nt, Pseudomonas putida KT2440
gacguuaccgcacgcuugccgg

SEQ ID NO: 36805 - RNA, 22 nt, Pseudomonas putida KT2440
gacugugugaaaacggcugacc

SEQ ID NO: 36806 - RNA, 22 nt, Pseudomonas putida KT2440
gagcacggaaccgaccauaccg

SEQ ID NO: 36807 - RNA, 22 nt, Pseudomonas putida KT2440
gagcagcacuuccgugaagacc

SEQ ID NO: 36808 - RNA, 22 nt, Rickettsia prowazekii
agguauuagugguauuagaucu

SEQ ID NO: 36809 - RNA, 22 nt, Rickettsia prowazekii
auugcaucgguuaaagugguua

SEQ ID NO: 36810 - RNA, 22 nt, Rickettsia prowazekii
cucuuggcaauaugggugaaga

SEQ ID NO: 36811 - RNA, 23 nt, Rickettsia prowazekii
cugcaucauuaaaaugugcaggu

SEQ ID NO: 36812 - RNA, 22 nt, Rickettsia prowazekii
ucaaagaauuaucauagcaaga

SEQ ID NO: 36813 - RNA, 22 nt, Rickettsia prowazekii
ucaggcuguaagugcaccugua

SEQ ID NO: 36814 - RNA, 22 nt, Rickettsia prowazekii
ugucucaucuauuauauugcua

SEQ ID NO: 36815 - RNA, 22 nt, Rickettsia prowazekii
uugaauagcuaagguuuuugug

SEQ ID NO: 36816 - RNA, 22 nt, Rickettsia prowazekii
uugguaaaagucguagucauau

SEQ ID NO: 36817 - RNA, 22 nt, Rickettsia prowazekii
acuugucuugauaaugaugaug

SEQ ID NO: 36818 - RNA, 22 nt, Rickettsia prowazekii
aguucauaguuuuacuaagauu

SEQ ID NO: 36819 - RNA, 22 nt, Rickettsia prowazekii
aucaaguguuuuauaacuccug

SEQ ID NO: 36820 - RNA, 22 nt, Rickettsia prowazekii
caguaaauuguuggaaaauuua

SEQ ID NO: 36821 - RNA, 22 nt, Rickettsia prowazekii
ggcucaagccuuaguuguagca

SEQ ID NO: 36822 - RNA, 22 nt, Rickettsia prowazekii
uagauucuuucuguguaaagag

SEQ ID NO: 36823 - RNA, 22 nt, Rickettsia prowazekii
uguaugaaccacgggaucuaau

SEQ ID NO: 36824 - RNA, 22 nt, Rickettsia prowazekii
uguucaagugugaagaauccuu

SEQ ID NO: 36825 - RNA, 22 nt, Salmonella enterica enterica serovar Typhi
aaaccguaauauucgccucguu

SEQ ID NO: 36826 - RNA, 22 nt, Salmonella enterica enterica serovar Typhi
aaacgccggcgugaucgucgcu

SEQ ID NO: 36827 - RNA, 22 nt, Salmonella enterica enterica serovar Typhi
aaacguacuuugcacggcgcau

SEQ ID NO: 36828 - RNA, 22 nt, Salmonella enterica enterica serovar Typhi
aaagcguaggccugauaagcgc

SEQ ID NO: 36829 - RNA, 22 nt, Salmonella enterica enterica serovar Typhi
aaagcuggguagcgcgcguugc

SEQ ID NO: 36830 - RNA, 22 nt, Salmonella enterica enterica serovar Typhi
aaagugguuagaguauuuuucg

SEQ ID NO: 36831 - RNA, 22 nt, Salmonella enterica enterica serovar Typhi
aaaucgcagguaucguuuccuu

SEQ ID NO: 36832 - RNA, 22 nt, Salmonella enterica enterica serovar Typhi
aaauguacagaauacguggaua

SEQ ID NO: 36833 - RNA, 22 nt, Salmonella enterica enterica serovar Typhi
aaauguuggcgaccugaugcag

SEQ ID NO: 36834 - RNA, 22 nt, Salmonella enterica enterica serovar Typhi
aacagaucgacacgcacaauau

SEQ ID NO: 36835 - RNA, 22 nt, Salmonella enterica enterica serovar Typhi
aaccuucagacucaugguagaa

SEQ ID NO: 36836 - RNA, 22 nt, Salmonella enterica enterica serovar Typhi
aacgaucagcuuuuugccgaaa

SEQ ID NO: 36837 - RNA, 22 nt, Salmonella enterica enterica serovar Typhi
aacgccaugaucaucggcaccg

SEQ ID NO: 36838 - RNA, 22 nt, Salmonella enterica enterica serovar Typhi
aacgcgaccaggugauugagca

SEQ ID NO: 36839 - RNA, 22 nt, Salmonella enterica enterica serovar Typhi
aacgcgucuuauccggccuaca

SEQ ID NO: 36840 - RNA, 22 nt, Salmonella enterica enterica serovar Typhi
aacgugaugauacagaauggug

SEQ ID NO: 36841 - RNA, 22 nt, Salmonella enterica enterica serovar Typhi
aacuggcgcaaugguuaggaua

SEQ ID NO: 36842 - RNA, 22 nt, Salmonella enterica enterica serovar Typhi
aagaccuugcgggucgugacgu

SEQ ID NO: 36843 - RNA, 22 nt, Salmonella enterica enterica serovar Typhi
aagcaacggacaacgagaaucu

SEQ ID NO: 36844 - RNA, 23 nt, Salmonella enterica enterica serovar Typhi
aagcgguuccacaacaaugaaaa

SEQ ID NO: 36845 - RNA, 22 nt, Salmonella enterica enterica serovar Typhi
aagcgucgccgggggauauaac

SEQ ID NO: 36846 - RNA, 22 nt, Salmonella enterica enterica serovar Typhi
aagcugauccugcaaagaagaa

SEQ ID NO: 36847 - RNA, 22 nt, Salmonella enterica enterica serovar Typhi
aagcuuaauaagacagguucug

SEQ ID NO: 36848 - RNA, 22 nt, Salmonella enterica enterica serovar Typhi
aaggccaucacuucccggacgu

SEQ ID NO: 36849 - RNA, 22 nt, Salmonella enterica enterica serovar Typhi
aaggccuuugaccacuauuucg

SEQ ID NO: 36850 - RNA, 22 nt, Salmonella enterica enterica serovar Typhi
aaguacgcacguucggcagcgc

SEQ ID NO: 36851 - RNA, 22 nt, Salmonella enterica enterica serovar Typhi
aagucgauuuccgcuuccugcg

SEQ ID NO: 36852 - RNA, 22 nt, Salmonella enterica enterica serovar Typhi
aagugcgagaauaaucuucacg

SEQ ID NO: 36853 - RNA, 19 nt, Salmonella enterica enterica serovar Typhi
aagugcgcgccauucgccg

SEQ ID NO: 36854 - RNA, 22 nt, Salmonella enterica enterica serovar Typhi
aaguggcugggguacgaggauu

SEQ ID NO: 36855 - RNA, 22 nt, Salmonella enterica enterica serovar Typhi
aauagcgaaauguaacguuuug

SEQ ID NO: 36856 - RNA, 22 nt, Salmonella enterica enterica serovar Typhi
aauccagaguauuaauuuucgu

SEQ ID NO: 36857 - RNA, 22 nt, Salmonella enterica enterica serovar Typhi
aaucguuggggauaaucuggug

SEQ ID NO: 36858 - RNA, 22 nt, Salmonella enterica enterica serovar Typhi
aaucucugugcuaucaaauccc

SEQ ID NO: 36859 - RNA, 20 nt, Salmonella enterica enterica serovar Typhi
aaugacgggcugguugaccc

SEQ ID NO: 36860 - RNA, 22 nt, Salmonella enterica enterica serovar Typhi
aaugcaguagucgcugcggagg

SEQ ID NO: 36861 - RNA, 23 nt, Salmonella enterica enterica serovar Typhi
aaugccaaccgcugccgccacuu

SEQ ID NO: 36862 - RNA, 22 nt, Salmonella enterica enterica serovar Typhi
aaugguuaccagccgcugcgaa

SEQ ID NO: 36863 - RNA, 22 nt, Salmonella enterica enterica serovar Typhi
aaugucgccaucaaaggucagg

SEQ ID NO: 36864 - RNA, 22 nt, Salmonella enterica enterica serovar Typhi
aauguucacugccguuauuaug

SEQ ID NO: 36865 - RNA, 22 nt, Salmonella enterica enterica serovar Typhi
aauguugauuaucaggggcguc

SEQ ID NO: 36866 - RNA, 22 nt, Salmonella enterica enterica serovar Typhi
acaaccugaucgugcugacgcc

SEQ ID NO: 36867 - RNA, 22 nt, Salmonella enterica enterica serovar Typhi
acaaucagcgugaaacgggggc

SEQ ID NO: 36868 - RNA, 22 nt, Salmonella enterica enterica serovar Typhi
acacagagaacuggugaaagcc

SEQ ID NO: 36869 - RNA, 22 nt, Salmonella enterica enterica serovar Typhi
acagaauggcauccgccugcuc

SEQ ID NO: 36870 - RNA, 22 nt, Salmonella enterica enterica serovar Typhi
acagauuaugcgucauucgcua

SEQ ID NO: 36871 - RNA, 22 nt, Salmonella enterica enterica serovar Typhi
acagcgacauucccgcuucgga

SEQ ID NO: 36872 - RNA, 20 nt, Salmonella enterica enterica serovar Typhi
acauaauccggguaaagacc

SEQ ID NO: 36873 - RNA, 22 nt, Salmonella enterica enterica serovar Typhi
accgccugguaaucgguuuuca

SEQ ID NO: 36874 - RNA, 20 nt, Salmonella enterica enterica serovar Typhi
accggcugcgauuacgcugg

SEQ ID NO: 36875 - RNA, 22 nt, Salmonella enterica enterica serovar Typhi
accggcuguugcggcugcugau

SEQ ID NO: 36876 - RNA, 22 nt, Salmonella enterica enterica serovar Typhi
accgucggugauaucgaaucgc

SEQ ID NO: 36877 - RNA, 23 nt, Salmonella enterica enterica serovar Typhi
accugcugauggcggcagccguc

SEQ ID NO: 36878 - RNA, 22 nt, Salmonella enterica enterica serovar Typhi
acgaauggccgcccguuuuauu

SEQ ID NO: 36879 - RNA, 22 nt, Salmonella enterica enterica serovar Typhi
acgaugacuguaauguuucccg

SEQ ID NO: 36880 - RNA, 22 nt, Salmonella enterica enterica serovar Typhi
acgcaauucuggcuggugacgc

SEQ ID NO: 36881 - RNA, 20 nt, Salmonella enterica enterica serovar Typhi
acgccgcacgccgucucagc

SEQ ID NO: 36882 - RNA, 23 nt, Salmonella enterica enterica serovar Typhi
acgccgcaggcgauggaucugcu

SEQ ID NO: 36883 - RNA, 22 nt, Salmonella enterica enterica serovar Typhi
acgcgugacggcgacuauuuua

SEQ ID NO: 36884 - RNA, 22 nt, Salmonella enterica enterica serovar Typhi
acgcgugaguguaccauuucca

SEQ ID NO: 36885 - RNA, 22 nt, Salmonella enterica enterica serovar Typhi
acgcucgggaucggcguggucg

SEQ ID NO: 36886 - RNA, 22 nt, Salmonella enterica enterica serovar Typhi
acgcuggcuucuggcuguucgg

SEQ ID NO: 36887 - RNA, 22 nt, Salmonella enterica enterica serovar Typhi
acgcuuaucaggccuacagaau

SEQ ID NO: 36888 - RNA, 22 nt, Salmonella enterica enterica serovar Typhi
acggcuaucagucuuugcacac

SEQ ID NO: 36889 - RNA, 22 nt, Salmonella enterica enterica serovar Typhi
acggguuauguuaucauuugua

SEQ ID NO: 36890 - RNA, 22 nt, Salmonella enterica enterica serovar Typhi
acgguauuucauucacagugug

SEQ ID NO: 36891 - RNA, 22 nt, Salmonella enterica enterica serovar Typhi
acggucaugaaaaucgugccgc

SEQ ID NO: 36892 - RNA, 22 nt, Salmonella enterica enterica serovar Typhi
acgucuuaucuggccuacguga

SEQ ID NO: 36893 - RNA, 22 nt, Salmonella enterica enterica serovar Typhi
acguggugcgcggcagccguuu

SEQ ID NO: 36894 - RNA, 22 nt, Salmonella enterica enterica serovar Typhi
acugcgguacagcagcgcuauc

SEQ ID NO: 36895 - RNA, 22 nt, Salmonella enterica enterica serovar Typhi
acuggcagucugaguguuaauc

SEQ ID NO: 36896 - RNA, 22 nt, Salmonella enterica enterica serovar Typhi
acuggcuggaaaguaauacagu

SEQ ID NO: 36897 - RNA, 22 nt, Salmonella enterica enterica serovar Typhi
acugugguccugcggacgagca

SEQ ID NO: 36898 - RNA, 22 nt, Salmonella enterica enterica serovar Typhi
acuuucuggcccacuucgauga

SEQ ID NO: 36899 - RNA, 22 nt, Salmonella enterica enterica serovar Typhi
agaacgcacggucagcauugau

SEQ ID NO: 36900 - RNA, 22 nt, Salmonella enterica enterica serovar Typhi
agacggcgaaggcguuagguau

SEQ ID NO: 36901 - RNA, 22 nt, Salmonella enterica enterica serovar Typhi
agacuuugcugggcggccuccc

SEQ ID NO: 36902 - RNA, 22 nt, Salmonella enterica enterica serovar Typhi
agagccaguucguucacguguc

SEQ ID NO: 36903 - RNA, 22 nt, Salmonella enterica enterica serovar Typhi
agauagcgccuggcaggaggau

SEQ ID NO: 36904 - RNA, 22 nt, Salmonella enterica enterica serovar Typhi
agaugcucuggcugcucacguu

SEQ ID NO: 36905 - RNA, 22 nt, Salmonella enterica enterica serovar Typhi
agaugggcaaagccacggugga

SEQ ID NO: 36906 - RNA, 22 nt, Salmonella enterica enterica serovar Typhi
agauuugcuauauuugcgcccc

SEQ ID NO: 36907 - RNA, 22 nt, Salmonella enterica enterica serovar Typhi
agcaacaucaggcccuguaaag

SEQ ID NO: 36908 - RNA, 22 nt, Salmonella enterica enterica serovar Typhi
agcaaucgcaagcggaagcgcg

SEQ ID NO: 36909 - RNA, 22 nt, Salmonella enterica enterica serovar Typhi
agcagcagcgccuucaguuuga

SEQ ID NO: 36910 - RNA, 22 nt, Salmonella enterica enterica serovar Typhi
agcagccgcaaauuaccagcgc

SEQ ID NO: 36911 - RNA, 19 nt, Salmonella enterica enterica serovar Typhi
agcaggauaaguucauuag

SEQ ID NO: 36912 - RNA, 22 nt, Salmonella enterica enterica serovar Typhi
agcaguuuaauaagguucuggc

SEQ ID NO: 36913 - RNA, 22 nt, Salmonella enterica enterica serovar Typhi
agcccauguugcugaugagcgu

SEQ ID NO: 36914 - RNA, 22 nt, Salmonella enterica enterica serovar Typhi
agccgguuuuugcugauguggu

SEQ ID NO: 36915 - RNA, 22 nt, Salmonella enterica enterica serovar Typhi
agccguuuuccgggucgcgcag

SEQ ID NO: 36916 - RNA, 23 nt, Salmonella enterica enterica serovar Typhi
agccugaguuugcgugagguggc

SEQ ID NO: 36917 - RNA, 22 nt, Salmonella enterica enterica serovar Typhi
agcgacagggucuguugugaag

SEQ ID NO: 36918 - RNA, 22 nt, Salmonella enterica enterica serovar Typhi
agcgaguuuaccccacuuacua

SEQ ID NO: 36919 - RNA, 22 nt, Salmonella enterica enterica serovar Typhi
agcgauaaccugcugaugauca

SEQ ID NO: 36920 - RNA, 22 nt, Salmonella enterica enterica serovar Typhi
agcgccgucuacaaaaaagccc

SEQ ID NO: 36921 - RNA, 22 nt, Salmonella enterica enterica serovar Typhi
agcgcgguaucgcugagcuccu

SEQ ID NO: 36922 - RNA, 22 nt, Salmonella enterica enterica serovar Typhi
agcggcaucggccuguuuaucg

SEQ ID NO: 36923 - RNA, 22 nt, Salmonella enterica enterica serovar Typhi
agcggccugcuggucucauugu

SEQ ID NO: 36924 - RNA, 22 nt, Salmonella enterica enterica serovar Typhi
agcggguuuuaccauuaccgau

SEQ ID NO: 36925 - RNA, 22 nt, Salmonella enterica enterica serovar Typhi
agcgguuuuauuuacguugcuc

SEQ ID NO: 36926 - RNA, 21 nt, Salmonella enterica enterica serovar Typhi
agcgucaauugccaggagcga

SEQ ID NO: 36927 - RNA, 22 nt, Salmonella enterica enterica serovar Typhi
agcguugaugugcugguuaccg

SEQ ID NO: 36928 - RNA, 22 nt, Salmonella enterica enterica serovar Typhi
agcuauucggccagcgccaccg

SEQ ID NO: 36929 - RNA, 21 nt, Salmonella enterica enterica serovar Typhi
agcuggguggcggugucgccg

SEQ ID NO: 36930 - RNA, 22 nt, Salmonella enterica enterica serovar Typhi
aggaacgccuccugaggcagcu

SEQ ID NO: 36931 - RNA, 22 nt, Salmonella enterica enterica serovar Typhi
aggccggauaagcgaagcgcca

SEQ ID NO: 36932 - RNA, 22 nt, Salmonella enterica enterica serovar Typhi
aggccgguauuuucuccaucag

SEQ ID NO: 36933 - RNA, 22 nt, Salmonella enterica enterica serovar Typhi
aggccugauaagcgcagcgcca

SEQ ID NO: 36934 - RNA, 22 nt, Salmonella enterica enterica serovar Typhi
augugcaguuugcgaucgaauu

SEQ ID NO: 36935 - RNA, 22 nt, Salmonella enterica enterica serovar Typhi
augugcaugacagacgagaaug

SEQ ID NO: 36936 - RNA, 22 nt, Salmonella enterica enterica serovar Typhi
augugcgucugcugucggugaa

SEQ ID NO: 36937 - RNA, 22 nt, Salmonella enterica enterica serovar Typhi
auguggucgauaucuucauuac

SEQ ID NO: 36938 - RNA, 22 nt, Salmonella enterica enterica serovar Typhi
auguugagcagcuuucgcuguu

SEQ ID NO: 36939 - RNA, 21 nt, Salmonella enterica enterica serovar Typhi
auuagccguuuuuuugcaugg

SEQ ID NO: 36940 - RNA, 22 nt, Salmonella enterica enterica serovar Typhi
auuauggauguccagggcagcg

SEQ ID NO: 36941 - RNA, 22 nt, Salmonella enterica enterica serovar Typhi
auucagaugauugcacacgguu

SEQ ID NO: 36942 - RNA, 22 nt, Salmonella enterica enterica serovar Typhi
auucgcaaugagaguuugguag

SEQ ID NO: 36943 - RNA, 22 nt, Salmonella enterica enterica serovar Typhi
auugagaaucagucuuccggcg

SEQ ID NO: 36944 - RNA, 22 nt, Salmonella enterica enterica serovar Typhi
auugauguggguaaagugaugg

SEQ ID NO: 36945 - RNA, 22 nt, Salmonella enterica enterica serovar Typhi
auuguuacacgauccccuuuuc

SEQ ID NO: 36946 - RNA, 22 nt, Salmonella enterica enterica serovar Typhi
auuuagugaugacaaaggacga

SEQ ID NO: 36947 - RNA, 22 nt, Salmonella enterica enterica serovar Typhi
auuuguaguguucaaagagcuc

SEQ ID NO: 36948 - RNA, 22 nt, Salmonella enterica enterica serovar Typhi
caacggcauaggugugguccug

SEQ ID NO: 36949 - RNA, 22 nt, Salmonella enterica enterica serovar Typhi
caacuuaacgcuggcuacuucu

SEQ ID NO: 36950 - RNA, 22 nt, Salmonella enterica enterica serovar Typhi
caccgguaucgucaugacaggc

SEQ ID NO: 36951 - RNA, 22 nt, Salmonella enterica enterica serovar Typhi
caccgguguccuggcaggaagg

SEQ ID NO: 36952 - RNA, 22 nt, Salmonella enterica enterica serovar Typhi
cagaacuggguagcggggcuuc

SEQ ID NO: 36953 - RNA, 22 nt, Salmonella enterica enterica serovar Typhi
cagaccaguaaauuaaguaagg

SEQ ID NO: 36954 - RNA, 22 nt, Salmonella enterica enterica serovar Typhi
cagacgcugaaacaacgcuggg

SEQ ID NO: 36955 - RNA, 22 nt, Salmonella enterica enterica serovar Typhi
cagauagcgccggaaaugauug

SEQ ID NO: 36956 - RNA, 22 nt, Salmonella enterica enterica serovar Typhi
cagauaguuauucgcaucgcgc

SEQ ID NO: 36957 - RNA, 19 nt, Salmonella enterica enterica serovar Typhi
cagauuguuguuuaucuca

SEQ ID NO: 36958 - RNA, 21 nt, Salmonella enterica enterica serovar Typhi
cagcaguucguuguucggcgc

SEQ ID NO: 36959 - RNA, 22 nt, Salmonella enterica enterica serovar Typhi
cagccaucacuauggcguaaaa

SEQ ID NO: 36960 - RNA, 22 nt, Salmonella enterica enterica serovar Typhi
cagcgccuuuggaaucgacgau

SEQ ID NO: 36961 - RNA, 22 nt, Salmonella enterica enterica serovar Typhi
cagcgguauugacgugauggcu

SEQ ID NO: 36962 - RNA, 22 nt, Salmonella enterica enterica serovar Typhi
cagcguauggcugcaagacggu

SEQ ID NO: 36963 - RNA, 22 nt, Salmonella enterica enterica serovar Typhi
cagcuaacgguugcauaaucug

SEQ ID NO: 36964 - RNA, 22 nt, Salmonella enterica enterica serovar Typhi
caggcccugcagccgcaggugg

SEQ ID NO: 36965 - RNA, 22 nt, Salmonella enterica enterica serovar Typhi
cagguuguugggauguuucaga

SEQ ID NO: 36966 - RNA, 22 nt, Salmonella enterica enterica serovar Typhi
cagucgcuggaugacaacgcgc

SEQ ID NO: 36967 - RNA, 22 nt, Salmonella enterica enterica serovar Typhi
cagucguaagcgacggcugguu

SEQ ID NO: 36968 - RNA, 22 nt, Salmonella enterica enterica serovar Typhi
cauagcauaacaaagaugcgaa

SEQ ID NO: 36969 - RNA, 22 nt, Salmonella enterica enterica serovar Typhi
caucauccagaucuuucgcgcc

SEQ ID NO: 36970 - RNA, 22 nt, Salmonella enterica enterica serovar Typhi
caucgccuuaauuuuauccagc

SEQ ID NO: 36971 - RNA, 22 nt, Salmonella enterica enterica serovar Typhi
caucggcaauaccugguuaaag

SEQ ID NO: 36972 - RNA, 22 nt, Salmonella enterica enterica serovar Typhi
caucgucgggcacguuuaccuc

SEQ ID NO: 36973 - RNA, 22 nt, Salmonella enterica enterica serovar Typhi
caucguuuugauaucgaagcgg

SEQ ID NO: 36974 - RNA, 22 nt, Salmonella enterica enterica serovar Typhi
caucuuuaccuuuguguugggc

SEQ ID NO: 36975 - RNA, 17 nt, Salmonella enterica enterica serovar Typhi
caucuuugugaacuuua

SEQ ID NO: 36976 - RNA, 22 nt, Salmonella enterica enterica serovar Typhi
cauggagcugaaugcaccauca

SEQ ID NO: 36977 - RNA, 22 nt, Salmonella enterica enterica serovar Typhi
cauguuuacucuacuggccgua

SEQ ID NO: 36978 - RNA, 22 nt, Salmonella enterica enterica serovar Typhi
cauuaugcgcugguggaugagg

SEQ ID NO: 36979 - RNA, 22 nt, Salmonella enterica enterica serovar Typhi
cauucuuaccucuaugcacaau

SEQ ID NO: 36980 - RNA, 22 nt, Salmonella enterica enterica serovar Typhi
cauugaguaacaggugaggggc

SEQ ID NO: 36981 - RNA, 22 nt, Salmonella enterica enterica serovar Typhi
cauuucugaaagucagagcaca

SEQ ID NO: 36982 - RNA, 22 nt, Salmonella enterica enterica serovar Typhi
ccaagggccggucgaucuguuc

SEQ ID NO: 36983 - RNA, 22 nt, Salmonella enterica enterica serovar Typhi
ccagagauugcuaggugacugu

SEQ ID NO: 36984 - RNA, 22 nt, Salmonella enterica enterica serovar Typhi
ccagccaggccucguuuucguc

SEQ ID NO: 36985 - RNA, 22 nt, Salmonella enterica enterica serovar Typhi
ccagccagugcgcuaauacuau

SEQ ID NO: 36986 - RNA, 22 nt, Salmonella enterica enterica serovar Typhi
ccgacucuaaagcgauugcuca

SEQ ID NO: 36987 - RNA, 23 nt, Salmonella enterica enterica serovar Typhi
ccgcaacgauugccaguagcggu

SEQ ID NO: 36988 - RNA, 22 nt, Salmonella enterica enterica serovar Typhi
ccgcguaugaagagcggugagc

SEQ ID NO: 36989 - RNA, 22 nt, Salmonella enterica enterica serovar Typhi
ccggaaagcuugcuguccauac

SEQ ID NO: 36990 - RNA, 22 nt, Salmonella enterica enterica serovar Typhi
ccggauaaggcgaagcugccau

SEQ ID NO: 36991 - RNA, 22 nt, Salmonella enterica enterica serovar Typhi
ccggcgauaucguaccggacug

SEQ ID NO: 36992 - RNA, 22 nt, Salmonella enterica enterica serovar Typhi
ccgggucugccagccgccguua

SEQ ID NO: 36993 - RNA, 21 nt, Salmonella enterica enterica serovar Typhi
ccguggcuuuauccgcgucga

SEQ ID NO: 36994 - RNA, 22 nt, Salmonella enterica enterica serovar Typhi
ccguugcgcacuuuuuuaaguu

SEQ ID NO: 36995 - RNA, 23 nt, Salmonella enterica enterica serovar Typhi
ccugaccgcugaccacggcugug

SEQ ID NO: 36996 - RNA, 22 nt, Salmonella enterica enterica serovar Typhi
ccugaucccgaugguggauuuu

SEQ ID NO: 36997 - RNA, 22 nt, Salmonella enterica enterica serovar Typhi
ccugaugcuguugcaugauggu

SEQ ID NO: 36998 - RNA, 22 nt, Salmonella enterica enterica serovar Typhi
ccugucgguacggcgcgccugc

SEQ ID NO: 36999 - RNA, 22 nt, Salmonella enterica enterica serovar Typhi
ccuguuaaugaaauacuggcgc

SEQ ID NO: 37000 - RNA, 22 nt, Salmonella enterica enterica serovar Typhi
cgaacguacuaacgucaccggc

SEQ ID NO: 37001 - RNA, 22 nt, Salmonella enterica enterica serovar Typhi
cgacagauucaggcggugaagg

SEQ ID NO: 37002 - RNA, 22 nt, Salmonella enterica enterica serovar Typhi
cgaguacggaaaaaggguccgc

SEQ ID NO: 37003 - RNA, 22 nt, Salmonella enterica enterica serovar Typhi
cgagugucugagaucagcgugg

SEQ ID NO: 37004 - RNA, 22 nt, Salmonella enterica enterica serovar Typhi
cgaguguugacugccguuuuag

SEQ ID NO: 37005 - RNA, 18 nt, Salmonella enterica enterica serovar Typhi
cgauaucuucugauugga

SEQ ID NO: 37006 - RNA, 19 nt, Salmonella enterica enterica serovar Typhi
cuggcauaguaagaaguau

SEQ ID NO: 37007 - RNA, 22 nt, Salmonella enterica enterica serovar Typhi
cuggcguaacgcauuauacuuu

SEQ ID NO: 37008 - RNA, 22 nt, Salmonella enterica enterica serovar Typhi
cuggcugaaaacuugauugcca

SEQ ID NO: 37009 - RNA, 22 nt, Salmonella enterica enterica serovar Typhi
cuggcuggagucucagggcgca

SEQ ID NO: 37010 - RNA, 22 nt, Salmonella enterica enterica serovar Typhi
cuggcuguagacucgcuuuccc

SEQ ID NO: 37011 - RNA, 22 nt, Salmonella enterica enterica serovar Typhi
cuggcuuuucuugggauucagg

SEQ ID NO: 37012 - RNA, 22 nt, Salmonella enterica enterica serovar Typhi
cuggguuaucgcgcgucguaau

SEQ ID NO: 37013 - RNA, 22 nt, Salmonella enterica enterica serovar Typhi
cuguguaugauucauccggaga

SEQ ID NO: 37014 - RNA, 22 nt, Salmonella enterica enterica serovar Typhi
cuguguccugugcgguaaucug

SEQ ID NO: 37015 - RNA, 22 nt, Salmonella enterica enterica serovar Typhi
cuguuuaucgccagcaugguug

SEQ ID NO: 37016 - RNA, 22 nt, Salmonella enterica enterica serovar Typhi
cuuacugucgaaaucauuaaag

SEQ ID NO: 37017 - RNA, 22 nt, Salmonella enterica enterica serovar Typhi
cuugaucgaugaauucauuuuc

SEQ ID NO: 37018 - RNA, 21 nt, Salmonella enterica enterica serovar Typhi
cuuguuaacaguugcgauggc

SEQ ID NO: 37019 - RNA, 22 nt, Salmonella enterica enterica serovar Typhi
gaaaugguugcuuuugccccug

SEQ ID NO: 37020 - RNA, 20 nt, Salmonella enterica enterica serovar Typhi
gaacaucggucaucuccggc

SEQ ID NO: 37021 - RNA, 22 nt, Salmonella enterica enterica serovar Typhi
gaacauugaugagcaaaacguc

SEQ ID NO: 37022 - RNA, 22 nt, Salmonella enterica enterica serovar Typhi
gaaccgugaguucgcggcagua

SEQ ID NO: 37023 - RNA, 22 nt, Salmonella enterica enterica serovar Typhi
gaacgugauaagcgcccgugag

SEQ ID NO: 37024 - RNA, 22 nt, Salmonella enterica enterica serovar Typhi
gaagcguaacaagcaggccugg

SEQ ID NO: 37025 - RNA, 22 nt, Salmonella enterica enterica serovar Typhi
gaaguacgcuauaugccgagug

SEQ ID NO: 37026 - RNA, 22 nt, Salmonella enterica enterica serovar Typhi
gaauaacgacgcugugauaccg

SEQ ID NO: 37027 - RNA, 22 nt, Salmonella enterica enterica serovar Typhi
gaaucgccacgaucucuaucuc

SEQ ID NO: 37028 - RNA, 22 nt, Salmonella enterica enterica serovar Typhi
gaauggcugccaguugcggcgg

SEQ ID NO: 37029 - RNA, 22 nt, Salmonella enterica enterica serovar Typhi
gaaugucugaagacagaggagu

SEQ ID NO: 37030 - RNA, 22 nt, Salmonella enterica enterica serovar Typhi
gacaacuggauagccgugugga

SEQ ID NO: 37031 - RNA, 22 nt, Salmonella enterica enterica serovar Typhi
gacagcgcuucccugcuggugg

SEQ ID NO: 37032 - RNA, 22 nt, Salmonella enterica enterica serovar Typhi
gaccggaaauagucggcauacg

SEQ ID NO: 37033 - RNA, 23 nt, Salmonella enterica enterica serovar Typhi
gaccgugagacggcgcgcuuacg

SEQ ID NO: 37034 - RNA, 22 nt, Salmonella enterica enterica serovar Typhi
gacgaugggcaaucagccgcuc

SEQ ID NO: 37035 - RNA, 22 nt, Salmonella enterica enterica serovar Typhi
gacguuucgcuuaucaggccua

SEQ ID NO: 37036 - RNA, 22 nt, Salmonella enterica enterica serovar Typhi
gagauugaauaacaucugucug

SEQ ID NO: 37037 - RNA, 22 nt, Salmonella enterica enterica serovar Typhi
gagcagguuuuugacgcaaaga

SEQ ID NO: 37038 - RNA, 22 nt, Salmonella enterica enterica serovar Typhi
gagcugguuaacguguuccgcg

SEQ ID NO: 37039 - RNA, 22 nt, Salmonella enterica enterica serovar Typhi
gagcuucaauacggcgaucggc

SEQ ID NO: 37040 - RNA, 22 nt, Salmonella enterica enterica serovar Typhi
gaggauucacugggaauggaag

SEQ ID NO: 37041 - RNA, 22 nt, Salmonella enterica enterica serovar Typhi
gaggcguugaaguucuggaauc

SEQ ID NO: 37042 - RNA, 22 nt, Salmonella enterica enterica serovar Typhi
gauaauguguugacggauacug

SEQ ID NO: 37043 - RNA, 22 nt, Salmonella enterica enterica serovar Typhi
gauaccgcuaaucgcgacgguc

SEQ ID NO: 37044 - RNA, 22 nt, Salmonella enterica enterica serovar Typhi
gauagggcgaucgccgguuuug

SEQ ID NO: 37045 - RNA, 22 nt, Salmonella enterica enterica serovar Typhi
gauauugaugccgaugugguga

SEQ ID NO: 37046 - RNA, 22 nt, Salmonella enterica enterica serovar Typhi
gaucagcuuaaagggauuauca

SEQ ID NO: 37047 - RNA, 22 nt, Salmonella enterica enterica serovar Typhi
gaucaggucgguaaucaauagc

SEQ ID NO: 37048 - RNA, 22 nt, Salmonella enterica enterica serovar Typhi
gaucgcuaaaacguuuuuaugu

SEQ ID NO: 37049 - RNA, 22 nt, Salmonella enterica enterica serovar Typhi
gaugccggauggcgguuggccu

SEQ ID NO: 37050 - RNA, 22 nt, Salmonella enterica enterica serovar Typhi
gaugcuggaugaauuacgcagc

SEQ ID NO: 37051 - RNA, 22 nt, Salmonella enterica enterica serovar Typhi
gauggcggaggucaggccuucc

SEQ ID NO: 37052 - RNA, 21 nt, Salmonella enterica enterica serovar Typhi
gauggcuggaccuucacgccg

SEQ ID NO: 37053 - RNA, 22 nt, Salmonella enterica enterica serovar Typhi
gauggugaugaccgucaaugcc

SEQ ID NO: 37054 - RNA, 22 nt, Salmonella enterica enterica serovar Typhi
gauguaggccugauaagcguag

SEQ ID NO: 37055 - RNA, 22 nt, Salmonella enterica enterica serovar Typhi
gaugucgauacgcuggcggaua

SEQ ID NO: 37056 - RNA, 22 nt, Salmonella enterica enterica serovar Typhi
gauuaacaucuggacggcuauu

SEQ ID NO: 37057 - RNA, 22 nt, Salmonella enterica enterica serovar Typhi
gauuacccgggagcaauguugu

SEQ ID NO: 37058 - RNA, 22 nt, Salmonella enterica enterica serovar Typhi
gauuccucaggaguacgccauu

SEQ ID NO: 37059 - RNA, 22 nt, Salmonella enterica enterica serovar Typhi
gauugcauccggaagaguuagg

SEQ ID NO: 37060 - RNA, 22 nt, Salmonella enterica enterica serovar Typhi
gauuucgcuggaucgucaggaa

SEQ ID NO: 37061 - RNA, 22 nt, Salmonella enterica enterica serovar Typhi
gcaauguugcaaccagagcccu

SEQ ID NO: 37062 - RNA, 21 nt, Salmonella enterica enterica serovar Typhi
gcacaucgaaucaguguuguu

SEQ ID NO: 37063 - RNA, 22 nt, Salmonella enterica enterica serovar Typhi
gcagcgguuguuaccaaagccc

SEQ ID NO: 37064 - RNA, 22 nt, Salmonella enterica enterica serovar Typhi
gcagcguauucucacguucggg

SEQ ID NO: 37065 - RNA, 22 nt, Salmonella enterica enterica serovar Typhi
gcaggucagcauagauacgacg

SEQ ID NO: 37066 - RNA, 22 nt, Salmonella enterica enterica serovar Typhi
gcaguagcguuaauugugguua

SEQ ID NO: 37067 - RNA, 22 nt, Salmonella enterica enterica serovar Typhi
gcaguguuauggguuauuuugu

SEQ ID NO: 37068 - RNA, 22 nt, Salmonella enterica enterica serovar Typhi
gcauggccaacaccggauggcc

SEQ ID NO: 37069 - RNA, 22 nt, Salmonella enterica enterica serovar Typhi
gcauuucaccgucgaucguuug

SEQ ID NO: 37070 - RNA, 22 nt, Salmonella enterica enterica serovar Typhi
gccaccaucgcuuuuaccaucu

SEQ ID NO: 37071 - RNA, 19 nt, Salmonella enterica enterica serovar Typhi
gccacggucuugagccagc

SEQ ID NO: 37072 - RNA, 22 nt, Salmonella enterica enterica serovar Typhi
gccagcguaaauagcccggauc

SEQ ID NO: 37073 - RNA, 22 nt, Salmonella enterica enterica serovar Typhi
gccaucuugcccgccagcggac

SEQ ID NO: 37074 - RNA, 22 nt, Salmonella enterica enterica serovar Typhi
gccauugugucucugucuccaa

SEQ ID NO: 37075 - RNA, 22 nt, Salmonella enterica enterica serovar Typhi
gccauuugccgcugucguuauu

SEQ ID NO: 37076 - RNA, 22 nt, Salmonella enterica enterica serovar Typhi
gccgaucaauaauagaaacgac

SEQ ID NO: 37077 - RNA, 21 nt, Salmonella enterica enterica serovar Typhi
gccgaugcaaaugcugccagu

SEQ ID NO: 37078 - RNA, 22 nt, Salmonella enterica enterica serovar Typhi
gggaaacuggugcgacggcgua

SEQ ID NO: 37079 - RNA, 22 nt, Salmonella enterica enterica serovar Typhi
gggacguuauaagcuggcagac

SEQ ID NO: 37080 - RNA, 22 nt, Salmonella enterica enterica serovar Typhi
gggauacggugcugguugaaaa

SEQ ID NO: 37081 - RNA, 21 nt, Salmonella enterica enterica serovar Typhi
gggauacugguugccguuauc

SEQ ID NO: 37082 - RNA, 22 nt, Salmonella enterica enterica serovar Typhi
gggaucaguauaccucgucaga

SEQ ID NO: 37083 - RNA, 22 nt, Salmonella enterica enterica serovar Typhi
gggcagcaugauguauccuggc

SEQ ID NO: 37084 - RNA, 19 nt, Salmonella enterica enterica serovar Typhi
gggcuuaauggcuaucggg

SEQ ID NO: 37085 - RNA, 22 nt, Salmonella enterica enterica serovar Typhi
gggcuuaugcacuaaauaagaa

SEQ ID NO: 37086 - RNA, 22 nt, Salmonella enterica enterica serovar Typhi
gggcuucuuugcguguguggua

SEQ ID NO: 37087 - RNA, 22 nt, Salmonella enterica enterica serovar Typhi
gggugacuauggucgcgucuau

SEQ ID NO: 37088 - RNA, 22 nt, Salmonella enterica enterica serovar Typhi
gguauucgaaauugucuuuauc

SEQ ID NO: 37089 - RNA, 22 nt, Salmonella enterica enterica serovar Typhi
ggucgcuggacgccauccugca

SEQ ID NO: 37090 - RNA, 22 nt, Salmonella enterica enterica serovar Typhi
ggugaauuccggauuaugaugu

SEQ ID NO: 37091 - RNA, 19 nt, Salmonella enterica enterica serovar Typhi
ggugcgaugaugcuuggcc

SEQ ID NO: 37092 - RNA, 22 nt, Salmonella enterica enterica serovar Typhi
gguucugacggaaacgacccug

SEQ ID NO: 37093 - RNA, 22 nt, Salmonella enterica enterica serovar Typhi
guacucugggggaggguauugc

SEQ ID NO: 37094 - RNA, 20 nt, Salmonella enterica enterica serovar Typhi
guacugaugcuucguccguu

SEQ ID NO: 37095 - RNA, 22 nt, Salmonella enterica enterica serovar Typhi
guagaacguggugaugugauuu

SEQ ID NO: 37096 - RNA, 22 nt, Salmonella enterica enterica serovar Typhi
guagauuccagccguuugaaug

SEQ ID NO: 37097 - RNA, 22 nt, Salmonella enterica enterica serovar Typhi
guagcgggcgguauccggucaa

SEQ ID NO: 37098 - RNA, 22 nt, Salmonella enterica enterica serovar Typhi
guagggcguuacaguaucauac

SEQ ID NO: 37099 - RNA, 22 nt, Salmonella enterica enterica serovar Typhi
guauagccgaaguugaccgcuu

SEQ ID NO: 37100 - RNA, 22 nt, Salmonella enterica enterica serovar Typhi
guaucguccagaaucagcgcuu

SEQ ID NO: 37101 - RNA, 22 nt, Salmonella enterica enterica serovar Typhi
guaugcgccuucagaucggagu

SEQ ID NO: 37102 - RNA, 22 nt, Salmonella enterica enterica serovar Typhi
guauggacagcaagcuuuccgg

SEQ ID NO: 37103 - RNA, 22 nt, Salmonella enterica enterica serovar Typhi
guauggcgugccauuguugccu

SEQ ID NO: 37104 - RNA, 22 nt, Salmonella enterica enterica serovar Typhi
gucauggcggcguggcgcugcg

SEQ ID NO: 37105 - RNA, 22 nt, Salmonella enterica enterica serovar Typhi
guccagcagugguuucauacuc

SEQ ID NO: 37106 - RNA, 22 nt, Salmonella enterica enterica serovar Typhi
gucccguuacccuuuuucaggu

SEQ ID NO: 37107 - RNA, 22 nt, Salmonella enterica enterica serovar Typhi
guccgacucaaacugaaaucgu

SEQ ID NO: 37108 - RNA, 22 nt, Salmonella enterica enterica serovar Typhi
guccgcuauuggcacagaccug

SEQ ID NO: 37109 - RNA, 22 nt, Salmonella enterica enterica serovar Typhi
gucgaagaugacggcuucgccg

SEQ ID NO: 37110 - RNA, 22 nt, Salmonella enterica enterica serovar Typhi
gucgaggaaauuaucgcugaaa

SEQ ID NO: 37111 - RNA, 22 nt, Salmonella enterica enterica serovar Typhi
gucgauagcuauuaccgcacau

SEQ ID NO: 37112 - RNA, 22 nt, Salmonella enterica enterica serovar Typhi
gucgcugguaaagaugacgaug

SEQ ID NO: 37113 - RNA, 22 nt, Salmonella enterica enterica serovar Typhi
gucggccaguauuugucugcca

SEQ ID NO: 37114 - RNA, 22 nt, Salmonella enterica enterica serovar Typhi
gucggguaaggcguagccgcca

SEQ ID NO: 37115 - RNA, 22 nt, Salmonella enterica enterica serovar Typhi
gucugcaucccuacgcgggcaa

SEQ ID NO: 37116 - RNA, 22 nt, Salmonella enterica enterica serovar Typhi
gucuguuauggcuuccagugcg

SEQ ID NO: 37117 - RNA, 22 nt, Salmonella enterica enterica serovar Typhi
gugaauaaucacccggcggcgc

SEQ ID NO: 37118 - RNA, 22 nt, Salmonella enterica enterica serovar Typhi
gugauccgauucgcguuaaugu

SEQ ID NO: 37119 - RNA, 22 nt, Salmonella enterica enterica serovar Typhi
gugaugauuuccgucacgccug

SEQ ID NO: 37120 - RNA, 22 nt, Salmonella enterica enterica serovar Typhi
gugccggauaacuuccugugcc

SEQ ID NO: 37121 - RNA, 22 nt, Salmonella enterica enterica serovar Typhi
gugcgccauauucucgacuggg

SEQ ID NO: 37122 - RNA, 22 nt, Salmonella enterica enterica serovar Typhi
gugcgcgugcgcgaugaacauc

SEQ ID NO: 37123 - RNA, 22 nt, Salmonella enterica enterica serovar Typhi
gugcgcuucuucaccgaacaga

SEQ ID NO: 37124 - RNA, 22 nt, Salmonella enterica enterica serovar Typhi
guggcggauauggguuaugaca

SEQ ID NO: 37125 - RNA, 22 nt, Salmonella enterica enterica serovar Typhi
guggcgucguugaccggcggga

SEQ ID NO: 37126 - RNA, 22 nt, Salmonella enterica enterica serovar Typhi
gugguaauuagugaggauggcg

SEQ ID NO: 37127 - RNA, 22 nt, Salmonella enterica enterica serovar Typhi
guguuacgccuuauccggccua

SEQ ID NO: 37128 - RNA, 22 nt, Salmonella enterica enterica serovar Typhi
guuacgccgccaucaggcaaaa

SEQ ID NO: 37129 - RNA, 22 nt, Salmonella enterica enterica serovar Typhi
guuacugagaaaucaaaagcga

SEQ ID NO: 37130 - RNA, 22 nt, Salmonella enterica enterica serovar Typhi
guuacugucggcgauauagcgc

SEQ ID NO: 37131 - RNA, 22 nt, Salmonella enterica enterica serovar Typhi
guucgcauggucaacuucuauc

SEQ ID NO: 37132 - RNA, 22 nt, Salmonella enterica enterica serovar Typhi
guugcagacuguccagacgccc

SEQ ID NO: 37133 - RNA, 22 nt, Salmonella enterica enterica serovar Typhi
guugccgcacgggcagaagcag

SEQ ID NO: 37134 - RNA, 22 nt, Salmonella enterica enterica serovar Typhi
guugcgcuggugguuuacguca

SEQ ID NO: 37135 - RNA, 22 nt, Salmonella enterica enterica serovar Typhi
guugucgcuucgcuuaaaccgc

SEQ ID NO: 37136 - RNA, 21 nt, Salmonella enterica enterica serovar Typhi
guugugccgccggcgaagcuu

SEQ ID NO: 37137 - RNA, 22 nt, Salmonella enterica enterica serovar Typhi
guuuaucgaaggccagaucguc

SEQ ID NO: 37138 - RNA, 22 nt, Salmonella enterica enterica serovar Typhi
guuugacgccgcgcggcagaau

SEQ ID NO: 37139 - RNA, 22 nt, Salmonella enterica enterica serovar Typhi
guuugcaaaaugccguugccga

SEQ ID NO: 37140 - RNA, 22 nt, Salmonella enterica enterica serovar Typhi
guuugcaacgguuccgguagua

SEQ ID NO: 37141 - RNA, 22 nt, Salmonella enterica enterica serovar Typhi
uaaagcaauauucgguuuaacu

SEQ ID NO: 37142 - RNA, 22 nt, Salmonella enterica enterica serovar Typhi
uaaauggguaauaaguauugau

SEQ ID NO: 37143 - RNA, 22 nt, Salmonella enterica enterica serovar Typhi
uaacaacggagaacaguaucuu

SEQ ID NO: 37144 - RNA, 22 nt, Salmonella enterica enterica serovar Typhi
uaagagauaaagaccgaggcga

SEQ ID NO: 37145 - RNA, 22 nt, Salmonella enterica enterica serovar Typhi
uaagaguaggugaguacgccgu

SEQ ID NO: 37146 - RNA, 22 nt, Salmonella enterica enterica serovar Typhi
uaagaugagucgugcgggccug

SEQ ID NO: 37147 - RNA, 22 nt, Salmonella enterica enterica serovar Typhi
uaaugccguuaacgguaauuuc

SEQ ID NO: 37148 - RNA, 22 nt, Salmonella enterica enterica serovar Typhi
uacaaacggcgguauaacauga

SEQ ID NO: 37149 - RNA, 22 nt, Salmonella enterica enterica serovar Typhi
uacaucgauuguugcgaauauu

SEQ ID NO: 37150 - RNA, 22 nt, Salmonella enterica enterica serovar Typhi
ucggugauggucauaucaccgu

SEQ ID NO: 37151 - RNA, 22 nt, Salmonella enterica enterica serovar Typhi
ucguucagucccaugugccgga

SEQ ID NO: 37152 - RNA, 19 nt, Salmonella enterica enterica serovar Typhi
ucuaccauaacggugagau

SEQ ID NO: 37153 - RNA, 22 nt, Salmonella enterica enterica serovar Typhi
ucuacgcuuuuuucgcgcaggc

SEQ ID NO: 37154 - RNA, 22 nt, Salmonella enterica enterica serovar Typhi
ucucguuggugguucuuagcau

SEQ ID NO: 37155 - RNA, 20 nt, Salmonella enterica enterica serovar Typhi
ucugaagcagugcgugguaa

SEQ ID NO: 37156 - RNA, 21 nt, Salmonella enterica enterica serovar Typhi
ucugauugacgucaaucuggg

SEQ ID NO: 37157 - RNA, 22 nt, Salmonella enterica enterica serovar Typhi
ucugcaaacguaggaaaagggu

SEQ ID NO: 37158 - RNA, 22 nt, Salmonella enterica enterica serovar Typhi
ucugccgguuaugauggcggcg

SEQ ID NO: 37159 - RNA, 17 nt, Salmonella enterica enterica serovar Typhi
ucugccugauuaucagg

SEQ ID NO: 37160 - RNA, 22 nt, Salmonella enterica enterica serovar Typhi
ucuggcgguucuguacggcgcg

SEQ ID NO: 37161 - RNA, 22 nt, Salmonella enterica enterica serovar Typhi
ucugguuaaucgcgcugggugg

SEQ ID NO: 37162 - RNA, 22 nt, Salmonella enterica enterica serovar Typhi
ucuguaggcccgguaagcguca

SEQ ID NO: 37163 - RNA, 22 nt, Salmonella enterica enterica serovar Typhi
ucuguaucgggaagcggcgcgc

SEQ ID NO: 37164 - RNA, 19 nt, Salmonella enterica enterica serovar Typhi
ucuugauccugacguggug

SEQ ID NO: 37165 - RNA, 22 nt, Salmonella enterica enterica serovar Typhi
ugaacgccuuguccggccuaca

SEQ ID NO: 37166 - RNA, 22 nt, Salmonella enterica enterica serovar Typhi
ugaacggcgcuauugucgggau

SEQ ID NO: 37167 - RNA, 22 nt, Salmonella enterica enterica serovar Typhi
ugaacguuuucugagcggucgu

SEQ ID NO: 37168 - RNA, 22 nt, Salmonella enterica enterica serovar Typhi
ugaacuucgcgaacaguacggu

SEQ ID NO: 37169 - RNA, 22 nt, Salmonella enterica enterica serovar Typhi
ugaccucugaaggacgcgugau

SEQ ID NO: 37170 - RNA, 22 nt, Salmonella enterica enterica serovar Typhi
ugacgcgccugcgcuaccgcug

SEQ ID NO: 37171 - RNA, 22 nt, Salmonella enterica enterica serovar Typhi
ugacgcugaaguugcugccgca

SEQ ID NO: 37172 - RNA, 22 nt, Salmonella enterica enterica serovar Typhi
ugacggagaucguccgcggcgc

SEQ ID NO: 37173 - RNA, 22 nt, Salmonella enterica enterica serovar Typhi
ugacuaucugcgcuggugcuua

SEQ ID NO: 37174 - RNA, 23 nt, Salmonella enterica enterica serovar Typhi
ugacugggacaggggccuguguc

SEQ ID NO: 37175 - RNA, 22 nt, Salmonella enterica enterica serovar Typhi
ugacuuucaggccgcuggccug

SEQ ID NO: 37176 - RNA, 21 nt, Salmonella enterica enterica serovar Typhi
ugacuuucccgguccgcuggc

SEQ ID NO: 37177 - RNA, 22 nt, Salmonella enterica enterica serovar Typhi
ugagaauuuucguugcaagggu

SEQ ID NO: 37178 - RNA, 22 nt, Salmonella enterica enterica serovar Typhi
ugagaucgauauacggcauauu

SEQ ID NO: 37179 - RNA, 21 nt, Salmonella enterica enterica serovar Typhi
ugauaacggguuaacaggcgu

SEQ ID NO: 37180 - RNA, 22 nt, Salmonella enterica enterica serovar Typhi
ugauaagguuggugaccauauu

SEQ ID NO: 37181 - RNA, 22 nt, Salmonella enterica enterica serovar Typhi
ugauauagcggguuagccaugu

SEQ ID NO: 37182 - RNA, 22 nt, Salmonella enterica enterica serovar Typhi
ugauaucuggcccagguccgau

SEQ ID NO: 37183 - RNA, 22 nt, Salmonella enterica enterica serovar Typhi
ugaugcagugcgacuggcccau

SEQ ID NO: 37184 - RNA, 22 nt, Salmonella enterica enterica serovar Typhi
ugauggucguggaauaugcugc

SEQ ID NO: 37185 - RNA, 22 nt, Salmonella enterica enterica serovar Typhi
ugauugaaaaaaccuggcguau

SEQ ID NO: 37186 - RNA, 22 nt, Salmonella enterica enterica serovar Typhi
ugauuguacgguagguaaucgc

SEQ ID NO: 37187 - RNA, 22 nt, Salmonella enterica enterica serovar Typhi
ugcaggauggcguccagcgacc

SEQ ID NO: 37188 - RNA, 22 nt, Salmonella enterica enterica serovar Typhi
ugcagguuccaggucacucgcg

SEQ ID NO: 37189 - RNA, 22 nt, Salmonella enterica enterica serovar Typhi
ugcccgauaauauuuaccgauu

SEQ ID NO: 37190 - RNA, 22 nt, Salmonella enterica enterica serovar Typhi
ugccgggaugggcgacucgauu

SEQ ID NO: 37191 - RNA, 22 nt, Salmonella enterica enterica serovar Typhi
ugcgcaacaguacgaagcgaaa

SEQ ID NO: 37192 - RNA, 22 nt, Salmonella enterica enterica serovar Typhi
ugcgcacguccagaccacggau

SEQ ID NO: 37193 - RNA, 22 nt, Salmonella enterica enterica serovar Typhi
ugcgccucaaccgcuuucgccu

SEQ ID NO: 37194 - RNA, 22 nt, Salmonella enterica enterica serovar Typhi
ugcgcugauggccguguuuuuc

SEQ ID NO: 37195 - RNA, 22 nt, Salmonella enterica enterica serovar Typhi
ugcgcuuauccggucuacguaa

SEQ ID NO: 37196 - RNA, 22 nt, Salmonella enterica enterica serovar Typhi
ugcggcaagcuggcgaucguuc

SEQ ID NO: 37197 - RNA, 22 nt, Salmonella enterica enterica serovar Typhi
ugcguagaauauccgcgcuggu

SEQ ID NO: 37198 - RNA, 22 nt, Salmonella enterica enterica serovar Typhi
ugcgucugccugagcuggugca

SEQ ID NO: 37199 - RNA, 22 nt, Salmonella enterica enterica serovar Typhi
ugcgucuuauccggccuacgga

SEQ ID NO: 37200 - RNA, 22 nt, Salmonella enterica enterica serovar Typhi
ugcgugacauguucgaacaagc

SEQ ID NO: 37201 - RNA, 22 nt, Salmonella enterica enterica serovar Typhi
ugcugauauuuuccgccuuuau

SEQ ID NO: 37202 - RNA, 22 nt, Salmonella enterica enterica serovar Typhi
ugcugccaucuuuaggcguaau

SEQ ID NO: 37203 - RNA, 22 nt, Salmonella enterica enterica serovar Typhi
ugcugccgcugacgcuggccau

SEQ ID NO: 37204 - RNA, 22 nt, Salmonella enterica enterica serovar Typhi
ugcugccggaaaugucugcgga

SEQ ID NO: 37205 - RNA, 22 nt, Salmonella enterica enterica serovar Typhi
ugcuggacaccgacgauaacug

SEQ ID NO: 37206 - RNA, 22 nt, Salmonella enterica enterica serovar Typhi
ugcuggauaaaauuaaggcgau

SEQ ID NO: 37207 - RNA, 22 nt, Salmonella enterica enterica serovar Typhi
ugcugguaugacgcgccguuaa

SEQ ID NO: 37208 - RNA, 22 nt, Salmonella enterica enterica serovar Typhi
ugcuguuaguguucguuaucgg

SEQ ID NO: 37209 - RNA, 22 nt, Salmonella enterica enterica serovar Typhi
ugcuguucgugguauggucaac

SEQ ID NO: 37210 - RNA, 22 nt, Salmonella enterica enterica serovar Typhi
uggaccugcguacuuucucgcu

SEQ ID NO: 37211 - RNA, 22 nt, Salmonella enterica enterica serovar Typhi
uggauaaagacaauuucgaaua

SEQ ID NO: 37212 - RNA, 22 nt, Salmonella enterica enterica serovar Typhi
uggcacugcuccagcuuuaccu

SEQ ID NO: 37213 - RNA, 22 nt, Salmonella enterica enterica serovar Typhi
uggcagcuucgccuuauccggc

SEQ ID NO: 37214 - RNA, 22 nt, Salmonella enterica enterica serovar Typhi
uggccgugguggucgacgauca

SEQ ID NO: 37215 - RNA, 22 nt, Salmonella enterica enterica serovar Typhi
uggccuggaguaauucgcugau

SEQ ID NO: 37216 - RNA, 22 nt, Salmonella enterica enterica serovar Typhi
uggcgagagaccuucgcaacug

SEQ ID NO: 37217 - RNA, 22 nt, Salmonella enterica enterica serovar Typhi
uggcgcgaucaguucuugcagg

SEQ ID NO: 37218 - RNA, 22 nt, Salmonella enterica enterica serovar Typhi
uggcgcugcgcuuuccggccua

SEQ ID NO: 37219 - RNA, 22 nt, Salmonella enterica enterica serovar Typhi
uggcgcugucgaucaacuucaa

SEQ ID NO: 37220 - RNA, 22 nt, Salmonella enterica enterica serovar Typhi
uggcggaguacaaauuucgaau

SEQ ID NO: 37221 - RNA, 22 nt, Salmonella enterica enterica serovar Typhi
uggcguucuucggcgacccguc

SEQ ID NO: 37222 - RNA, 22 nt, Salmonella enterica enterica serovar Typhi
aaacgcaucgguaugauugcgc

SEQ ID NO: 37223 - RNA, 22 nt, Salmonella enterica enterica serovar Typhi
aaaucgcuauagaugauuucgg

SEQ ID NO: 37224 - RNA, 22 nt, Salmonella enterica enterica serovar Typhi
aaaugccuuauccggccuacuc

SEQ ID NO: 37225 - RNA, 22 nt, Salmonella enterica enterica serovar Typhi
aacagcauaggagcgguugauu

SEQ ID NO: 37226 - RNA, 22 nt, Salmonella enterica enterica serovar Typhi
aacaggguaaaggaggccggag

SEQ ID NO: 37227 - RNA, 19 nt, Salmonella enterica enterica serovar Typhi
aacauucagauuguuggaa

SEQ ID NO: 37228 - RNA, 22 nt, Salmonella enterica enterica serovar Typhi
aaccggcuggccuggcgaacga

SEQ ID NO: 37229 - RNA, 21 nt, Salmonella enterica enterica serovar Typhi
aaccgucuggaugucuaaacu

SEQ ID NO: 37230 - RNA, 22 nt, Salmonella enterica enterica serovar Typhi
aacgacucgucuaucaccggca

SEQ ID NO: 37231 - RNA, 22 nt, Salmonella enterica enterica serovar Typhi
aacgccugaagucgugacucgg

SEQ ID NO: 37232 - RNA, 22 nt, Salmonella enterica enterica serovar Typhi
aacgcgaagguaaaauuaucgu

SEQ ID NO: 37233 - RNA, 22 nt, Salmonella enterica enterica serovar Typhi
aacgcugugucaugccgguauu

SEQ ID NO: 37234 - RNA, 22 nt, Salmonella enterica enterica serovar Typhi
aacggauugcuucgcuguuagu

SEQ ID NO: 37235 - RNA, 22 nt, Salmonella enterica enterica serovar Typhi
aacggucaucugcacaaaggcg

SEQ ID NO: 37236 - RNA, 22 nt, Salmonella enterica enterica serovar Typhi
aacgugaugccauacggcgagu

SEQ ID NO: 37237 - RNA, 18 nt, Salmonella enterica enterica serovar Typhi
aacugggcgucaggcaac

SEQ ID NO: 37238 - RNA, 22 nt, Salmonella enterica enterica serovar Typhi
aacuucaccauggaagauuaua

SEQ ID NO: 37239 - RNA, 22 nt, Salmonella enterica enterica serovar Typhi
aagacgcgucgccaucuggcuc

SEQ ID NO: 37240 - RNA, 22 nt, Salmonella enterica enterica serovar Typhi
aagaucggucggcgccuuaugu

SEQ ID NO: 37241 - RNA, 22 nt, Salmonella enterica enterica serovar Typhi
aagauguucuguucgugauggc

SEQ ID NO: 37242 - RNA, 22 nt, Salmonella enterica enterica serovar Typhi
aaggcguaaaagcgcuucuggc

SEQ ID NO: 37243 - RNA, 22 nt, Salmonella enterica enterica serovar Typhi
aaguucagcuucagaagcugga

SEQ ID NO: 37244 - RNA, 22 nt, Salmonella enterica enterica serovar Typhi
aauaacgcgugaugcuugucag

SEQ ID NO: 37245 - RNA, 20 nt, Salmonella enterica enterica serovar Typhi
aauccggugccuuaccgcuu

SEQ ID NO: 37246 - RNA, 22 nt, Salmonella enterica enterica serovar Typhi
aaucgcccugucauuucaggcg

SEQ ID NO: 37247 - RNA, 22 nt, Salmonella enterica enterica serovar Typhi
aaucuguugcgucguacuuuuu

SEQ ID NO: 37248 - RNA, 22 nt, Salmonella enterica enterica serovar Typhi
aauguccugacauuaaccggcc

SEQ ID NO: 37249 - RNA, 22 nt, Salmonella enterica enterica serovar Typhi
aauucgcuccguuaagccuaug

SEQ ID NO: 37250 - RNA, 22 nt, Salmonella enterica enterica serovar Typhi
aauuguguuugucgauauucgu

SEQ ID NO: 37251 - RNA, 22 nt, Salmonella enterica enterica serovar Typhi
aauuugcaaauggugaaaugau

SEQ ID NO: 37252 - RNA, 22 nt, Salmonella enterica enterica serovar Typhi
acagagccugucucagcaauga

SEQ ID NO: 37253 - RNA, 22 nt, Salmonella enterica enterica serovar Typhi
acaggcagcuuaaagcgcuguu

SEQ ID NO: 37254 - RNA, 22 nt, Salmonella enterica enterica serovar Typhi
acaggccgcgccauccggcacg

SEQ ID NO: 37255 - RNA, 22 nt, Salmonella enterica enterica serovar Typhi
acaguacuggcacugaagucgc

SEQ ID NO: 37256 - RNA, 22 nt, Salmonella enterica enterica serovar Typhi
acaguaguuaaauguagaggga

SEQ ID NO: 37257 - RNA, 22 nt, Salmonella enterica enterica serovar Typhi
acaguuccggcacuuucaccga

SEQ ID NO: 37258 - RNA, 22 nt, Salmonella enterica enterica serovar Typhi
acaguuugaucgcaaaggcaug

SEQ ID NO: 37259 - RNA, 22 nt, Salmonella enterica enterica serovar Typhi
acauccgucaacggaaaaacgc

SEQ ID NO: 37260 - RNA, 22 nt, Salmonella enterica enterica serovar Typhi
acaucgagauggauuuuugggu

SEQ ID NO: 37261 - RNA, 22 nt, Salmonella enterica enterica serovar Typhi
acauugagggcgaaaucucaua

SEQ ID NO: 37262 - RNA, 18 nt, Salmonella enterica enterica serovar Typhi
acccgcugaugccggugu

SEQ ID NO: 37263 - RNA, 22 nt, Salmonella enterica enterica serovar Typhi
accgaacgggaaagugguuaac

SEQ ID NO: 37264 - RNA, 22 nt, Salmonella enterica enterica serovar Typhi
accgcagcagcuugcaguuuau

SEQ ID NO: 37265 - RNA, 22 nt, Salmonella enterica enterica serovar Typhi
accgugaaaacuucagccagcg

SEQ ID NO: 37266 - RNA, 16 nt, Salmonella enterica enterica serovar Typhi
accguugacggucuua

SEQ ID NO: 37267 - RNA, 23 nt, Salmonella enterica enterica serovar Typhi
accugcugucgcgauacgguuga

SEQ ID NO: 37268 - RNA, 22 nt, Salmonella enterica enterica serovar Typhi
accuguuugaacuuaccuggcg

SEQ ID NO: 37269 - RNA, 22 nt, Salmonella enterica enterica serovar Typhi
acgaaggcgacauuagcagccg

SEQ ID NO: 37270 - RNA, 22 nt, Salmonella enterica enterica serovar Typhi
acgaugagaaugcugggagaag

SEQ ID NO: 37271 - RNA, 22 nt, Salmonella enterica enterica serovar Typhi
acgcaggaucaguugccuucgc

SEQ ID NO: 37272 - RNA, 22 nt, Salmonella enterica enterica serovar Typhi
acgcccauuagcauuccgcccg

SEQ ID NO: 37273 - RNA, 22 nt, Salmonella enterica enterica serovar Typhi
acgcccuggaacagcaggcggu

SEQ ID NO: 37274 - RNA, 23 nt, Salmonella enterica enterica serovar Typhi
acgcggaacacguuaaccagcuc

SEQ ID NO: 37275 - RNA, 20 nt, Salmonella enterica enterica serovar Typhi
acgcugugcacuauggcgcu

SEQ ID NO: 37276 - RNA, 22 nt, Salmonella enterica enterica serovar Typhi
acggucugucccagucggcgcu

SEQ ID NO: 37277 - RNA, 21 nt, Salmonella enterica enterica serovar Typhi
acguugaccaucgguacgccu

SEQ ID NO: 37278 - RNA, 22 nt, Salmonella enterica enterica serovar Typhi
acguugaugugaacuauucaga

SEQ ID NO: 37279 - RNA, 22 nt, Salmonella enterica enterica serovar Typhi
acguuucucaaccuaugcgauu

SEQ ID NO: 37280 - RNA, 22 nt, Salmonella enterica enterica serovar Typhi
acuacgccgccgauagcaucgg

SEQ ID NO: 37281 - RNA, 22 nt, Salmonella enterica enterica serovar Typhi
acuacgcugaaaaauggacggc

SEQ ID NO: 37282 - RNA, 22 nt, Salmonella enterica enterica serovar Typhi
acuccguuggcucaacgucggc

SEQ ID NO: 37283 - RNA, 22 nt, Salmonella enterica enterica serovar Typhi
acucuuaacaaauagaaauuac

SEQ ID NO: 37284 - RNA, 22 nt, Salmonella enterica enterica serovar Typhi
acugcugcgguaaugcagagua

SEQ ID NO: 37285 - RNA, 22 nt, Salmonella enterica enterica serovar Typhi
acugcuugaugaggccgaacgu

SEQ ID NO: 37286 - RNA, 22 nt, Salmonella enterica enterica serovar Typhi
acuggcaucgccauccacaggu

SEQ ID NO: 37287 - RNA, 22 nt, Salmonella enterica enterica serovar Typhi
acuggcggauuagcgaaggcac

SEQ ID NO: 37288 - RNA, 22 nt, Salmonella enterica enterica serovar Typhi
acuguucaaucugcgucucgcc

SEQ ID NO: 37289 - RNA, 22 nt, Salmonella enterica enterica serovar Typhi
acuucuaccaugcgcucgguuu

SEQ ID NO: 37290 - RNA, 22 nt, Salmonella enterica enterica serovar Typhi
agacaacggcccuuugcaggcg

SEQ ID NO: 37291 - RNA, 22 nt, Salmonella enterica enterica serovar Typhi
agacugcauuucaauggcuucc

SEQ ID NO: 37292 - RNA, 22 nt, Salmonella enterica enterica serovar Typhi
agagcggcuggcgaaacuggcg

SEQ ID NO: 37293 - RNA, 22 nt, Salmonella enterica enterica serovar Typhi
agaggcuaauuaucugccagcc

SEQ ID NO: 37294 - RNA, 22 nt, Salmonella enterica enterica serovar Typhi
agagguucaugaugcgccugca

SEQ ID NO: 37295 - RNA, 22 nt, Salmonella enterica enterica serovar Typhi
agauacuguucuccguuguuaa

SEQ ID NO: 37296 - RNA, 22 nt, Salmonella enterica enterica serovar Typhi
agaugcggcuucagguuaauuu

SEQ ID NO: 37297 - RNA, 22 nt, Salmonella enterica enterica serovar Typhi
agauuugcuugaguuguuuagc

SEQ ID NO: 37298 - RNA, 22 nt, Salmonella enterica enterica serovar Typhi
agcaggacuggggccaucagca

SEQ ID NO: 37299 - RNA, 22 nt, Salmonella enterica enterica serovar Typhi
agcaggguuucugaauuugguc

SEQ ID NO: 37300 - RNA, 22 nt, Salmonella enterica enterica serovar Typhi
agcagguuggcgucgcgaagcc

SEQ ID NO: 37301 - RNA, 22 nt, Salmonella enterica enterica serovar Typhi
agcaugcucuugcaaacugggu

SEQ ID NO: 37302 - RNA, 22 nt, Salmonella enterica enterica serovar Typhi
agccagccaguucgaugauuuu

SEQ ID NO: 37303 - RNA, 22 nt, Salmonella enterica enterica serovar Typhi
agccgcguugaagccuaucccu

SEQ ID NO: 37304 - RNA, 22 nt, Salmonella enterica enterica serovar Typhi
agccgcuauaucugggggcgca

SEQ ID NO: 37305 - RNA, 22 nt, Salmonella enterica enterica serovar Typhi
agccggucuguucauucugugu

SEQ ID NO: 37306 - RNA, 22 nt, Salmonella enterica enterica serovar Typhi
agcgacuucagugccaguacug

SEQ ID NO: 37307 - RNA, 22 nt, Salmonella enterica enterica serovar Typhi
agcgcaccauuuauaaaaagua

SEQ ID NO: 37308 - RNA, 22 nt, Salmonella enterica enterica serovar Typhi
agcgcggacgacaguggugucc

SEQ ID NO: 37309 - RNA, 19 nt, Salmonella enterica enterica serovar Typhi
agcgcuguacugauugcgu

SEQ ID NO: 37310 - RNA, 22 nt, Salmonella enterica enterica serovar Typhi
agcuuaucguugcauccaucgc

SEQ ID NO: 37311 - RNA, 23 nt, Salmonella enterica enterica serovar Typhi
agcuuguugaugucgcggcgcgc

SEQ ID NO: 37312 - RNA, 22 nt, Salmonella enterica enterica serovar Typhi
agcuuuaucucuaaagcgggca

SEQ ID NO: 37313 - RNA, 22 nt, Salmonella enterica enterica serovar Typhi
aggcgugaguuuucaauaucgg

SEQ ID NO: 37314 - RNA, 22 nt, Salmonella enterica enterica serovar Typhi
aggguaucagcagggcaggcuu

SEQ ID NO: 37315 - RNA, 22 nt, Salmonella enterica enterica serovar Typhi
aguaagauggggaaagcaugag

SEQ ID NO: 37316 - RNA, 22 nt, Salmonella enterica enterica serovar Typhi
aguaauccucugaaacuucggg

SEQ ID NO: 37317 - RNA, 22 nt, Salmonella enterica enterica serovar Typhi
aguaucuaucgaugcauuaaau

SEQ ID NO: 37318 - RNA, 22 nt, Salmonella enterica enterica serovar Typhi
agucaauauuuauucauggaau

SEQ ID NO: 37319 - RNA, 22 nt, Salmonella enterica enterica serovar Typhi
agucaggaucugacgagcgcga

SEQ ID NO: 37320 - RNA, 22 nt, Salmonella enterica enterica serovar Typhi
agugagccgucuggauaucgug

SEQ ID NO: 37321 - RNA, 22 nt, Salmonella enterica enterica serovar Typhi
agugaucagcguguuuuuguug

SEQ ID NO: 37322 - RNA, 22 nt, Salmonella enterica enterica serovar Typhi
aguggaaucagccaggagucgg

SEQ ID NO: 37323 - RNA, 22 nt, Salmonella enterica enterica serovar Typhi
aguggcguacaugguggaaggu

SEQ ID NO: 37324 - RNA, 22 nt, Salmonella enterica enterica serovar Typhi
agugggcguuuaaucgggaaga

SEQ ID NO: 37325 - RNA, 22 nt, Salmonella enterica enterica serovar Typhi
aguggucagcauugagcugccg

SEQ ID NO: 37326 - RNA, 22 nt, Salmonella enterica enterica serovar Typhi
aguuccugcgcgccgaugaauc

SEQ ID NO: 37327 - RNA, 22 nt, Salmonella enterica enterica serovar Typhi
auaacgauauuucauccccauu

SEQ ID NO: 37328 - RNA, 22 nt, Salmonella enterica enterica serovar Typhi
auacagggcggacggguaguaa

SEQ ID NO: 37329 - RNA, 19 nt, Salmonella enterica enterica serovar Typhi
auaccguuggccuugaugu

SEQ ID NO: 37330 - RNA, 21 nt, Salmonella enterica enterica serovar Typhi
auagaacaauuggucauucgu

SEQ ID NO: 37331 - RNA, 22 nt, Salmonella enterica enterica serovar Typhi
auagcgacaggaaucuguguga

SEQ ID NO: 37332 - RNA, 22 nt, Salmonella enterica enterica serovar Typhi
auaucguaaugcgggcgauacc

SEQ ID NO: 37333 - RNA, 22 nt, Salmonella enterica enterica serovar Typhi
auaugcguauuuucuggcggag

SEQ ID NO: 37334 - RNA, 22 nt, Salmonella enterica enterica serovar Typhi
auauggugcgcggcaccacgca

SEQ ID NO: 37335 - RNA, 22 nt, Salmonella enterica enterica serovar Typhi
aucaaccgucgucugggguuga

SEQ ID NO: 37336 - RNA, 22 nt, Salmonella enterica enterica serovar Typhi
aucaccguauuggcgccgcugg

SEQ ID NO: 37337 - RNA, 22 nt, Salmonella enterica enterica serovar Typhi
aucaggcgguaguaucagggaa

SEQ ID NO: 37338 - RNA, 19 nt, Salmonella enterica enterica serovar Typhi
aucauccaggcuggacgua

SEQ ID NO: 37339 - RNA, 22 nt, Salmonella enterica enterica serovar Typhi
aucaugagcucgucgauuugcg

SEQ ID NO: 37340 - RNA, 20 nt, Salmonella enterica enterica serovar Typhi
aucauugcgccgaaccugca

SEQ ID NO: 37341 - RNA, 22 nt, Salmonella enterica enterica serovar Typhi
auccgaaauccgucuguaucuc

SEQ ID NO: 37342 - RNA, 22 nt, Salmonella enterica enterica serovar Typhi
auccggugaugauggcaaccgc

SEQ ID NO: 37343 - RNA, 22 nt, Salmonella enterica enterica serovar Typhi
auccucagaugaagcgggcgcu

SEQ ID NO: 37344 - RNA, 22 nt, Salmonella enterica enterica serovar Typhi
auccugaucccguuuaucgugg

SEQ ID NO: 37345 - RNA, 22 nt, Salmonella enterica enterica serovar Typhi
auccuucgcugagcguaugauu

SEQ ID NO: 37346 - RNA, 22 nt, Salmonella enterica enterica serovar Typhi
aucgccauacggcagacgcgcg

SEQ ID NO: 37347 - RNA, 19 nt, Salmonella enterica enterica serovar Typhi
aucgcccaggaugugaugc

SEQ ID NO: 37348 - RNA, 22 nt, Salmonella enterica enterica serovar Typhi
aucgcucuauaaucguuguaua

SEQ ID NO: 37349 - RNA, 22 nt, Salmonella enterica enterica serovar Typhi
aucggcgagguucuuuaaugca

SEQ ID NO: 37350 - RNA, 23 nt, Salmonella enterica enterica serovar Typhi
aucgucacgauggucguagcugg

SEQ ID NO: 37351 - RNA, 21 nt, Salmonella enterica enterica serovar Typhi
aucgucucgaagcgcacguca

SEQ ID NO: 37352 - RNA, 22 nt, Salmonella enterica enterica serovar Typhi
aucguguaaaucguccagcgcc

SEQ ID NO: 37353 - RNA, 19 nt, Salmonella enterica enterica serovar Typhi
aucguuggagagacccgcu

SEQ ID NO: 37354 - RNA, 22 nt, Salmonella enterica enterica serovar Typhi
aucugcgcaacuggaagcgauc

SEQ ID NO: 37355 - RNA, 22 nt, Salmonella enterica enterica serovar Typhi
aucugcggcucauuaucgcguu

SEQ ID NO: 37356 - RNA, 22 nt, Salmonella enterica enterica serovar Typhi
aucuggcaugcagggccggaag

SEQ ID NO: 37357 - RNA, 22 nt, Salmonella enterica enterica serovar Typhi
aucuucaugguuaauggucuga

SEQ ID NO: 37358 - RNA, 22 nt, Salmonella enterica enterica serovar Typhi
aucuugauugcagccagaguuu

SEQ ID NO: 37359 - RNA, 22 nt, Salmonella enterica enterica serovar Typhi
augaccgccggugaaaucgcug

SEQ ID NO: 37360 - RNA, 22 nt, Salmonella enterica enterica serovar Typhi
augagauuaauacacuggagau

SEQ ID NO: 37361 - RNA, 22 nt, Salmonella enterica enterica serovar Typhi
augaucgaaauccgugaagguc

SEQ ID NO: 37362 - RNA, 22 nt, Salmonella enterica enterica serovar Typhi
augaugaugcugacguuacugc

SEQ ID NO: 37363 - RNA, 22 nt, Salmonella enterica enterica serovar Typhi
augaugcacaucggcauccauu

SEQ ID NO: 37364 - RNA, 22 nt, Salmonella enterica enterica serovar Typhi
augcagaugaggaaaaugcugc

SEQ ID NO: 37365 - RNA, 22 nt, Salmonella enterica enterica serovar Typhi
augcauaaaagcagcggcuaau

SEQ ID NO: 37366 - RNA, 22 nt, Salmonella enterica enterica serovar Typhi
augcccgucugggagccgcugc

SEQ ID NO: 37367 - RNA, 22 nt, Salmonella enterica enterica serovar Typhi
augccgauagcuaacagcagga

SEQ ID NO: 37368 - RNA, 22 nt, Salmonella enterica enterica serovar Typhi
augccgcgucgcuuagugauua

SEQ ID NO: 37369 - RNA, 22 nt, Salmonella enterica enterica serovar Typhi
augccuuauccggccuacaacg

SEQ ID NO: 37370 - RNA, 22 nt, Salmonella enterica enterica serovar Typhi
augcgccuucuccgccccgguu

SEQ ID NO: 37371 - RNA, 22 nt, Salmonella enterica enterica serovar Typhi
augcgcuuguugcgucaggcua

SEQ ID NO: 37372 - RNA, 22 nt, Salmonella enterica enterica serovar Typhi
augcgucucugaacaggcggcc

SEQ ID NO: 37373 - RNA, 22 nt, Salmonella enterica enterica serovar Typhi
augcguuauuugaccgccuggg

SEQ ID NO: 37374 - RNA, 22 nt, Salmonella enterica enterica serovar Typhi
augcguuucacgccauuuuggg

SEQ ID NO: 37375 - RNA, 22 nt, Salmonella enterica enterica serovar Typhi
augcugaccgaccagugguacg

SEQ ID NO: 37376 - RNA, 20 nt, Salmonella enterica enterica serovar Typhi
augcugcugauguucaucau

SEQ ID NO: 37377 - RNA, 22 nt, Salmonella enterica enterica serovar Typhi
auggaaauugugaauauugacu

SEQ ID NO: 37378 - RNA, 22 nt, Salmonella enterica enterica serovar Typhi
auggcagggacgcccggugugu

SEQ ID NO: 37379 - RNA, 22 nt, Salmonella enterica enterica serovar Typhi
auggcgauauagucuuucacgc

SEQ ID NO: 37380 - RNA, 22 nt, Salmonella enterica enterica serovar Typhi
auggcgauuucauagcccgcuu

SEQ ID NO: 37381 - RNA, 22 nt, Salmonella enterica enterica serovar Typhi
auggcgccuguucgauaaauca

SEQ ID NO: 37382 - RNA, 22 nt, Salmonella enterica enterica serovar Typhi
auggcggcuccgccuuauccgg

SEQ ID NO: 37383 - RNA, 22 nt, Salmonella enterica enterica serovar Typhi
auggcggcuucgccuuauccgg

SEQ ID NO: 37384 - RNA, 22 nt, Salmonella enterica enterica serovar Typhi
augggcuaucuggacagauuga

SEQ ID NO: 37385 - RNA, 22 nt, Salmonella enterica enterica serovar Typhi
auggucgucgucauggugguga

SEQ ID NO: 37386 - RNA, 22 nt, Salmonella enterica enterica serovar Typhi
auggugaacggcaggaaauggu

SEQ ID NO: 37387 - RNA, 22 nt, Salmonella enterica enterica serovar Typhi
augucgcuaaagcccggcacca

SEQ ID NO: 37388 - RNA, 22 nt, Salmonella enterica enterica serovar Typhi
augucguaugaugcccguguuc

SEQ ID NO: 37389 - RNA, 22 nt, Salmonella enterica enterica serovar Typhi
augugaaucugaacucggugcu

SEQ ID NO: 37390 - RNA, 22 nt, Salmonella enterica enterica serovar Typhi
augugcuguucgauguagccaa

SEQ ID NO: 37391 - RNA, 19 nt, Salmonella enterica enterica serovar Typhi
auguggagcaacuauggga

SEQ ID NO: 37392 - RNA, 22 nt, Salmonella enterica enterica serovar Typhi
auuagcgcgucguucuuauggu

SEQ ID NO: 37393 - RNA, 22 nt, Salmonella enterica enterica serovar Typhi
auuaucgaugaaugccagcgag

SEQ ID NO: 37394 - RNA, 22 nt, Salmonella enterica enterica serovar Typhi
auuauggcgcgggggaaaagau

SEQ ID NO: 37395 - RNA, 22 nt, Salmonella enterica enterica serovar Typhi
auucaaucaaauuaagaucaca

SEQ ID NO: 37396 - RNA, 22 nt, Salmonella enterica enterica serovar Typhi
auuccaggaauaaguauccaga

SEQ ID NO: 37397 - RNA, 22 nt, Salmonella enterica enterica serovar Typhi
auucgcgcaucgcgucgagcag

SEQ ID NO: 37398 - RNA, 22 nt, Salmonella enterica enterica serovar Typhi
auucucgucugucaugcacauc

SEQ ID NO: 37399 - RNA, 22 nt, Salmonella enterica enterica serovar Typhi
auugacgauaucggcauugacg

SEQ ID NO: 37400 - RNA, 22 nt, Salmonella enterica enterica serovar Typhi
auugcaccaauguggugcuuaa

SEQ ID NO: 37401 - RNA, 20 nt, Salmonella enterica enterica serovar Typhi
auugccgauggugguauaca

SEQ ID NO: 37402 - RNA, 22 nt, Salmonella enterica enterica serovar Typhi
auugccggauggcgccguaggc

SEQ ID NO: 37403 - RNA, 22 nt, Salmonella enterica enterica serovar Typhi
auuggacuugccgggauuauuc

SEQ ID NO: 37404 - RNA, 22 nt, Salmonella enterica enterica serovar Typhi
auuggcgcgguacuggaagucg

SEQ ID NO: 37405 - RNA, 22 nt, Salmonella enterica enterica serovar Typhi
auuggugacgauagccuguuug

SEQ ID NO: 37406 - RNA, 22 nt, Salmonella enterica enterica serovar Typhi
auugucugaaaagaggaugcug

SEQ ID NO: 37407 - RNA, 22 nt, Salmonella enterica enterica serovar Typhi
auuucugucaccuguugcuguu

SEQ ID NO: 37408 - RNA, 22 nt, Salmonella enterica enterica serovar Typhi
caacagguucgguuguacaguc

SEQ ID NO: 37409 - RNA, 22 nt, Salmonella enterica enterica serovar Typhi
caacaguauuagccacggcauu

SEQ ID NO: 37410 - RNA, 22 nt, Salmonella enterica enterica serovar Typhi
caacauagauaugagguucacu

SEQ ID NO: 37411 - RNA, 22 nt, Salmonella enterica enterica serovar Typhi
caaccugggaacaagagccauu

SEQ ID NO: 37412 - RNA, 22 nt, Salmonella enterica enterica serovar Typhi
caauaucuacaaaggucgugua

SEQ ID NO: 37413 - RNA, 22 nt, Salmonella enterica enterica serovar Typhi
caaucugaagucugcgucccgu

SEQ ID NO: 37414 - RNA, 22 nt, Salmonella enterica enterica serovar Typhi
cacaggagauucgucaggcggc

SEQ ID NO: 37415 - RNA, 22 nt, Salmonella enterica enterica serovar Typhi
cacgcgcugcuucaacauugua

SEQ ID NO: 37416 - RNA, 22 nt, Salmonella enterica enterica serovar Typhi
cacguuaucuauuuguauggcu

SEQ ID NO: 37417 - RNA, 22 nt, Salmonella enterica enterica serovar Typhi
cacuggaucuugggcugguggu

SEQ ID NO: 37418 - RNA, 22 nt, Salmonella enterica enterica serovar Typhi
cagaaacgguguaggccggaua

SEQ ID NO: 37419 - RNA, 22 nt, Salmonella enterica enterica serovar Typhi
cagaaccuggcucaucagugau

SEQ ID NO: 37420 - RNA, 22 nt, Salmonella enterica enterica serovar Typhi
cagaauaucuggugauaagcgg

SEQ ID NO: 37421 - RNA, 22 nt, Salmonella enterica enterica serovar Typhi
cagaaucgcaaacaacgucuga

SEQ ID NO: 37422 - RNA, 22 nt, Salmonella enterica enterica serovar Typhi
cagacguaaaacacgacuuauu

SEQ ID NO: 37423 - RNA, 22 nt, Salmonella enterica enterica serovar Typhi
cagauaucgcuaacaguauaua

SEQ ID NO: 37424 - RNA, 22 nt, Salmonella enterica enterica serovar Typhi
cagaugagcuucccgcuauuug

SEQ ID NO: 37425 - RNA, 22 nt, Salmonella enterica enterica serovar Typhi
cagaugccugauccagacgaau

SEQ ID NO: 37426 - RNA, 22 nt, Salmonella enterica enterica serovar Typhi
cagcacgcgcugaaugucgccg

SEQ ID NO: 37427 - RNA, 22 nt, Salmonella enterica enterica serovar Typhi
cagccggaagccgucaacgacg

SEQ ID NO: 37428 - RNA, 22 nt, Salmonella enterica enterica serovar Typhi
cagcgaggcaccaucauugaaa

SEQ ID NO: 37429 - RNA, 22 nt, Salmonella enterica enterica serovar Typhi
cagcgcuacgcgcagauaggca

SEQ ID NO: 37430 - RNA, 22 nt, Salmonella enterica enterica serovar Typhi
cagcgguagaaaagccagugau

SEQ ID NO: 37431 - RNA, 22 nt, Salmonella enterica enterica serovar Typhi
cagcgucagaaauaacugaaga

SEQ ID NO: 37432 - RNA, 22 nt, Salmonella enterica enterica serovar Typhi
cagcuuccagcagcaguugucg

SEQ ID NO: 37433 - RNA, 22 nt, Salmonella enterica enterica serovar Typhi
caggaagucacgcugccagcga

SEQ ID NO: 37434 - RNA, 22 nt, Salmonella enterica enterica serovar Typhi
caggacugaaggagcugauugu

SEQ ID NO: 37435 - RNA, 22 nt, Salmonella enterica enterica serovar Typhi
caggcaagggaagaagugagga

SEQ ID NO: 37436 - RNA, 22 nt, Salmonella enterica enterica serovar Typhi
caggcgauuacgcgcgaacgaa

SEQ ID NO: 37437 - RNA, 22 nt, Salmonella enterica enterica serovar Typhi
caggcgugaaugugucugcgug

SEQ ID NO: 37438 - RNA, 22 nt, Salmonella enterica enterica serovar Typhi
cagugaggacgcuaaugccgcu

SEQ ID NO: 37439 - RNA, 22 nt, Salmonella enterica enterica serovar Typhi
caguugacgguuuuucgccagc

SEQ ID NO: 37440 - RNA, 22 nt, Salmonella enterica enterica serovar Typhi
cauaaugaccucuuauuucccg

SEQ ID NO: 37441 - RNA, 22 nt, Salmonella enterica enterica serovar Typhi
cauaccguggugcagggcauug

SEQ ID NO: 37442 - RNA, 22 nt, Salmonella enterica enterica serovar Typhi
caucacggccuuuauuuucgcc

SEQ ID NO: 37443 - RNA, 22 nt, Salmonella enterica enterica serovar Typhi
caucagacaagugaagaagccc

SEQ ID NO: 37444 - RNA, 19 nt, Salmonella enterica enterica serovar Typhi
caucagcguauccgugaag

SEQ ID NO: 37445 - RNA, 22 nt, Salmonella enterica enterica serovar Typhi
caucagcgucaaccguuggcga

SEQ ID NO: 37446 - RNA, 22 nt, Salmonella enterica enterica serovar Typhi
caucggcuggcggagcgucuuc

SEQ ID NO: 37447 - RNA, 22 nt, Salmonella enterica enterica serovar Typhi
caucuucaaaacgcugcaugag

SEQ ID NO: 37448 - RNA, 22 nt, Salmonella enterica enterica serovar Typhi
caugcgccgagaucggcgaaga

SEQ ID NO: 37449 - RNA, 22 nt, Salmonella enterica enterica serovar Typhi
cauggucgcggcgauuuuauca

SEQ ID NO: 37450 - RNA, 22 nt, Salmonella enterica enterica serovar Typhi
caugucgauuuugcgccuaaua

SEQ ID NO: 37451 - RNA, 22 nt, Salmonella enterica enterica serovar Typhi
cauucgcagauacuguguuccc

SEQ ID NO: 37452 - RNA, 20 nt, Salmonella enterica enterica serovar Typhi
cauucgugaugucgauagcu

SEQ ID NO: 37453 - RNA, 22 nt, Salmonella enterica enterica serovar Typhi
cauuggcaauagauaaucgucc

SEQ ID NO: 37454 - RNA, 22 nt, Salmonella enterica enterica serovar Typhi
cauuucauuaugaccaaacugg

SEQ ID NO: 37455 - RNA, 22 nt, Salmonella enterica enterica serovar Typhi
ccacgauauuaccggucaucau

SEQ ID NO: 37456 - RNA, 22 nt, Salmonella enterica enterica serovar Typhi
ccagcagcaggaugccgaaagc

SEQ ID NO: 37457 - RNA, 22 nt, Salmonella enterica enterica serovar Typhi
ccagccagguaaaccgcccguu

SEQ ID NO: 37458 - RNA, 22 nt, Salmonella enterica enterica serovar Typhi
ccagcguguugaucucgccguc

SEQ ID NO: 37459 - RNA, 21 nt, Salmonella enterica enterica serovar Typhi
ccaggcgaccacgcguaucuu

SEQ ID NO: 37460 - RNA, 22 nt, Salmonella enterica enterica serovar Typhi
ccaggguuugacguuuccacuu

SEQ ID NO: 37461 - RNA, 22 nt, Salmonella enterica enterica serovar Typhi
ccaugcugugcgucauggcgcu

SEQ ID NO: 37462 - RNA, 22 nt, Salmonella enterica enterica serovar Typhi
ccauuggugguacugagcugcu

SEQ ID NO: 37463 - RNA, 22 nt, Salmonella enterica enterica serovar Typhi
cccgacgaucggcgguauuggc

SEQ ID NO: 37464 - RNA, 22 nt, Salmonella enterica enterica serovar Typhi
cccggaaaccaucauggaugcg

SEQ ID NO: 37465 - RNA, 22 nt, Salmonella enterica enterica serovar Typhi
cccuugcgucaugaaaacgacg

SEQ ID NO: 37466 - RNA, 22 nt, Salmonella enterica enterica serovar Typhi
ccgaccuggcgucgacggcggc

SEQ ID NO: 37467 - RNA, 22 nt, Salmonella enterica enterica serovar Typhi
ccgagccuguucuugcgcggug

SEQ ID NO: 37468 - RNA, 22 nt, Salmonella enterica enterica serovar Typhi
ccgagcguugacugcgcguaga

SEQ ID NO: 37469 - RNA, 22 nt, Salmonella enterica enterica serovar Typhi
ccgcgcuuugggggagugcaac

SEQ ID NO: 37470 - RNA, 19 nt, Salmonella enterica enterica serovar Typhi
ccgcguucauccaugcaga

SEQ ID NO: 37471 - RNA, 22 nt, Salmonella enterica enterica serovar Typhi
ccgcuuaauuuacggcuuccug

SEQ ID NO: 37472 - RNA, 22 nt, Salmonella enterica enterica serovar Typhi
ccggauaaggcggagccgccau

SEQ ID NO: 37473 - RNA, 22 nt, Salmonella enterica enterica serovar Typhi
ccggauauccuggcacugguac

SEQ ID NO: 37474 - RNA, 22 nt, Salmonella enterica enterica serovar Typhi
ccggaugaagucguuaauaagu

SEQ ID NO: 37475 - RNA, 22 nt, Salmonella enterica enterica serovar Typhi
ccggauggcguguagcgauccg

SEQ ID NO: 37476 - RNA, 22 nt, Salmonella enterica enterica serovar Typhi
ccggccuacaagauuugcaaua

SEQ ID NO: 37477 - RNA, 22 nt, Salmonella enterica enterica serovar Typhi
ccggccuacucacugcaacgcg

SEQ ID NO: 37478 - RNA, 22 nt, Salmonella enterica enterica serovar Typhi
ccggcgaagauagcgguacugu

SEQ ID NO: 37479 - RNA, 22 nt, Salmonella enterica enterica serovar Typhi
ccgggcaacguagagcauuauu

SEQ ID NO: 37480 - RNA, 22 nt, Salmonella enterica enterica serovar Typhi
ccgguagcaaacuggugaacgc

SEQ ID NO: 37481 - RNA, 22 nt, Salmonella enterica enterica serovar Typhi
ccggucucccgauguaccgcac

SEQ ID NO: 37482 - RNA, 22 nt, Salmonella enterica enterica serovar Typhi
ccguaggccugauaagcgcagc

SEQ ID NO: 37483 - RNA, 22 nt, Salmonella enterica enterica serovar Typhi
ccguggugaucgugacccauaa

SEQ ID NO: 37484 - RNA, 19 nt, Salmonella enterica enterica serovar Typhi
ccguuacuguuuuaucagg

SEQ ID NO: 37485 - RNA, 22 nt, Salmonella enterica enterica serovar Typhi
ccguucggggaaaagaugauua

SEQ ID NO: 37486 - RNA, 23 nt, Salmonella enterica enterica serovar Typhi
ccugaucgaugaagcgcguacgc

SEQ ID NO: 37487 - RNA, 22 nt, Salmonella enterica enterica serovar Typhi
ccugccgacccggacuggccgg

SEQ ID NO: 37488 - RNA, 22 nt, Salmonella enterica enterica serovar Typhi
ccugcguucgucaauauggggg

SEQ ID NO: 37489 - RNA, 21 nt, Salmonella enterica enterica serovar Typhi
ccuggcuggcacccgcaucaa

SEQ ID NO: 37490 - RNA, 22 nt, Salmonella enterica enterica serovar Typhi
ccuguugguuuacguuauggcu

SEQ ID NO: 37491 - RNA, 22 nt, Salmonella enterica enterica serovar Typhi
cgacgccugcuacagcccugua

SEQ ID NO: 37492 - RNA, 22 nt, Salmonella enterica enterica serovar Typhi
cgacgguuugcaaaugggugau

SEQ ID NO: 37493 - RNA, 22 nt, Salmonella enterica enterica serovar Typhi
cgauaaagcuauguuggaagug

SEQ ID NO: 37494 - RNA, 23 nt, Salmonella enterica enterica serovar Typhi
cgaucaaucaauuuaccguuauu

SEQ ID NO: 37495 - RNA, 20 nt, Salmonella enterica enterica serovar Typhi
cgaucgcucugcgagacgcu

SEQ ID NO: 37496 - RNA, 22 nt, Salmonella enterica enterica serovar Typhi
cgaugauaugccacccgaggau

SEQ ID NO: 37497 - RNA, 22 nt, Salmonella enterica enterica serovar Typhi
cgaugcaaaugagcgagagccg

SEQ ID NO: 37498 - RNA, 22 nt, Salmonella enterica enterica serovar Typhi
cgauuacgcccucuuugauuga

SEQ ID NO: 37499 - RNA, 20 nt, Salmonella enterica enterica serovar Typhi
cgauugauaccuaccguuau

SEQ ID NO: 37500 - RNA, 22 nt, Salmonella enterica enterica serovar Typhi
cgcaggaauacauaggacacca

SEQ ID NO: 37501 - RNA, 17 nt, Salmonella enterica enterica serovar Typhi
cgcauauucucgaagug

SEQ ID NO: 37502 - RNA, 21 nt, Salmonella enterica enterica serovar Typhi
cgcaucagggcuccgguccgu

SEQ ID NO: 37503 - RNA, 22 nt, Salmonella enterica enterica serovar Typhi
cgcauucagccaacugagcgcu

SEQ ID NO: 37504 - RNA, 22 nt, Salmonella enterica enterica serovar Typhi
cgccaacgccgugggagguauc

SEQ ID NO: 37505 - RNA, 22 nt, Salmonella enterica enterica serovar Typhi
cgccagguuuuccaguuuguga

SEQ ID NO: 37506 - RNA, 22 nt, Salmonella enterica enterica serovar Typhi
cgccauaagccuugcugacugc

SEQ ID NO: 37507 - RNA, 22 nt, Salmonella enterica enterica serovar Typhi
cgccgcaagggacggaggucuc

SEQ ID NO: 37508 - RNA, 22 nt, Salmonella enterica enterica serovar Typhi
cgccugcugaauuugggcgaac

SEQ ID NO: 37509 - RNA, 22 nt, Salmonella enterica enterica serovar Typhi
cgccugguuuuauagccgcauu

SEQ ID NO: 37510 - RNA, 22 nt, Salmonella enterica enterica serovar Typhi
cgcgaaguaaugccagaagaua

SEQ ID NO: 37511 - RNA, 22 nt, Salmonella enterica enterica serovar Typhi
cgcgaugauggcauccagaucg

SEQ ID NO: 37512 - RNA, 22 nt, Salmonella enterica enterica serovar Typhi
cgcgaugggcguaaacaucaac

SEQ ID NO: 37513 - RNA, 22 nt, Salmonella enterica enterica serovar Typhi
cgcgcgaacuucuucgauguug

SEQ ID NO: 37514 - RNA, 22 nt, Salmonella enterica enterica serovar Typhi
cgcggauaaaaugacgcuggcg

SEQ ID NO: 37515 - RNA, 22 nt, Salmonella enterica enterica serovar Typhi
cgcucagaaccacggccuacgg

SEQ ID NO: 37516 - RNA, 22 nt, Salmonella enterica enterica serovar Typhi
cgcuccugcuccugcuccaucc

SEQ ID NO: 37517 - RNA, 21 nt, Salmonella enterica enterica serovar Typhi
cgcucgacaggcuguuaagcc

SEQ ID NO: 37518 - RNA, 22 nt, Salmonella enterica enterica serovar Typhi
cgcuggaugucaccguacaugc

SEQ ID NO: 37519 - RNA, 22 nt, Salmonella enterica enterica serovar Typhi
cgcuuuauccuguuugcugaug

SEQ ID NO: 37520 - RNA, 22 nt, Salmonella enterica enterica serovar Typhi
cggacgaacuggugccgcuucc

SEQ ID NO: 37521 - RNA, 22 nt, Salmonella enterica enterica serovar Typhi
cggagcugauggagcugguggg

SEQ ID NO: 37522 - RNA, 22 nt, Salmonella enterica enterica serovar Typhi
cggauuguguccuggaagaagg

SEQ ID NO: 37523 - RNA, 23 nt, Salmonella enterica enterica serovar Typhi
cggcagcaaguauuauggcuggc

SEQ ID NO: 37524 - RNA, 22 nt, Salmonella enterica enterica serovar Typhi
cggcggaacauucguuggcgua

SEQ ID NO: 37525 - RNA, 22 nt, Salmonella enterica enterica serovar Typhi
cggcguucgugccaaccacgua

SEQ ID NO: 37526 - RNA, 22 nt, Salmonella enterica enterica serovar Typhi
cgggucgaggaucgccauaucc

SEQ ID NO: 37527 - RNA, 22 nt, Salmonella enterica enterica serovar Typhi
cggguugccagcacuacggcag

SEQ ID NO: 37528 - RNA, 20 nt, Salmonella enterica enterica serovar Typhi
cgguaagcgaagcgccaccg

SEQ ID NO: 37529 - RNA, 19 nt, Salmonella enterica enterica serovar Typhi
cgguaaguuuuauuuccuc

SEQ ID NO: 37530 - RNA, 22 nt, Salmonella enterica enterica serovar Typhi
cgguaguuuuguugccggaugg

SEQ ID NO: 37531 - RNA, 22 nt, Salmonella enterica enterica serovar Typhi
cgguccuggcgaucaaaaccgu

SEQ ID NO: 37532 - RNA, 16 nt, Salmonella enterica enterica serovar Typhi
cggucugaauacgcau

SEQ ID NO: 37533 - RNA, 23 nt, Salmonella enterica enterica serovar Typhi
cggucugcaaacaauucccccgg

SEQ ID NO: 37534 - RNA, 22 nt, Salmonella enterica enterica serovar Typhi
cggugaacccugcgcgucagga

SEQ ID NO: 37535 - RNA, 19 nt, Salmonella enterica enterica serovar Typhi
cgguuacugggauagagac

SEQ ID NO: 37536 - RNA, 22 nt, Salmonella enterica enterica serovar Typhi
cgguugaaaccuuacagcgccu

SEQ ID NO: 37537 - RNA, 22 nt, Salmonella enterica enterica serovar Typhi
cgguugaugguuugugcgugcg

SEQ ID NO: 37538 - RNA, 22 nt, Salmonella enterica enterica serovar Typhi
cguaccggcaaaacagcgucgc

SEQ ID NO: 37539 - RNA, 22 nt, Salmonella enterica enterica serovar Typhi
cgucaauaucagcuuucgcguc

SEQ ID NO: 37540 - RNA, 22 nt, Salmonella enterica enterica serovar Typhi
cgucaaugaaaugacuuccagc

SEQ ID NO: 37541 - RNA, 22 nt, Salmonella enterica enterica serovar Typhi
cgucagcgcgugaggcaguuaa

SEQ ID NO: 37542 - RNA, 20 nt, Salmonella enterica enterica serovar Typhi
cgucuggcgccgcaggaacu

SEQ ID NO: 37543 - RNA, 22 nt, Salmonella enterica enterica serovar Typhi
cgugaugaagucgccgcgggcc

SEQ ID NO: 37544 - RNA, 22 nt, Salmonella enterica enterica serovar Typhi
cgugccugauggcgcugugcuu

SEQ ID NO: 37545 - RNA, 22 nt, Salmonella enterica enterica serovar Typhi
cguggaagaagagcuggaucgc

SEQ ID NO: 37546 - RNA, 22 nt, Salmonella enterica enterica serovar Typhi
cguggcugaaacguauucgccu

SEQ ID NO: 37547 - RNA, 22 nt, Salmonella enterica enterica serovar Typhi
cguuacgucuguaucugcaccc

SEQ ID NO: 37548 - RNA, 21 nt, Salmonella enterica enterica serovar Typhi
cguuccaccuuuaucagcagu

SEQ ID NO: 37549 - RNA, 22 nt, Salmonella enterica enterica serovar Typhi
cguuggcgucaucgacauuaac

SEQ ID NO: 37550 - RNA, 22 nt, Salmonella enterica enterica serovar Typhi
cguugucacguggcgauucgaa

SEQ ID NO: 37551 - RNA, 22 nt, Salmonella enterica enterica serovar Typhi
cucauugcggcgaugcgcaggg

SEQ ID NO: 37552 - RNA, 22 nt, Salmonella enterica enterica serovar Typhi
cuccugaaaccguugaugcggc

SEQ ID NO: 37553 - RNA, 22 nt, Salmonella enterica enterica serovar Typhi
cucgaugcauccagaaugauuu

SEQ ID NO: 37554 - RNA, 22 nt, Salmonella enterica enterica serovar Typhi
cucgcugcacuugcucgaucca

SEQ ID NO: 37555 - RNA, 22 nt, Salmonella enterica enterica serovar Typhi
cucgugaagauuagcagagcgg

SEQ ID NO: 37556 - RNA, 22 nt, Salmonella enterica enterica serovar Typhi
cugacggguaguaucgcucuau

SEQ ID NO: 37557 - RNA, 22 nt, Salmonella enterica enterica serovar Typhi
cugacugcucagccggaagaac

SEQ ID NO: 37558 - RNA, 22 nt, Salmonella enterica enterica serovar Typhi
cugauuaucccguguccugucc

SEQ ID NO: 37559 - RNA, 22 nt, Salmonella enterica enterica serovar Typhi
cugcaagcagcucgaugcguuu

SEQ ID NO: 37560 - RNA, 22 nt, Salmonella enterica enterica serovar Typhi
cugcauaagcugauggaugaag

SEQ ID NO: 37561 - RNA, 21 nt, Salmonella enterica enterica serovar Typhi
cugcauaaucgcaaagguauc

SEQ ID NO: 37562 - RNA, 22 nt, Salmonella enterica enterica serovar Typhi
cugcauuugaugguaugccagu

SEQ ID NO: 37563 - RNA, 22 nt, Salmonella enterica enterica serovar Typhi
cugcgguucaggccaguuguua

SEQ ID NO: 37564 - RNA, 22 nt, Salmonella enterica enterica serovar Typhi
cuggaagaagccacuauccaac

SEQ ID NO: 37565 - RNA, 22 nt, Salmonella enterica enterica serovar Typhi
cuggcggaugcguuagggaugg

SEQ ID NO: 37566 - RNA, 22 nt, Salmonella enterica enterica serovar Typhi
cuggcugcugacgguccuguua

SEQ ID NO: 37567 - RNA, 20 nt, Salmonella enterica enterica serovar Typhi
cuguaggcccgguaaggcgu

SEQ ID NO: 37568 - RNA, 22 nt, Salmonella enterica enterica serovar Typhi
cugugucaguuuauucuuuccu

SEQ ID NO: 37569 - RNA, 22 nt, Salmonella enterica enterica serovar Typhi
cuguucaagcucuauccguggg

SEQ ID NO: 37570 - RNA, 22 nt, Salmonella enterica enterica serovar Typhi
cuguugcacugcggaaaaaguu

SEQ ID NO: 37571 - RNA, 22 nt, Salmonella enterica enterica serovar Typhi
cuuaccgguaugacgcgcuaaa

SEQ ID NO: 37572 - RNA, 22 nt, Salmonella enterica enterica serovar Typhi
cuuaucuguauugaugauaaac

SEQ ID NO: 37573 - RNA, 22 nt, Salmonella enterica enterica serovar Typhi
cuuaugcagaucgccauuggcg

SEQ ID NO: 37574 - RNA, 22 nt, Salmonella enterica enterica serovar Typhi
cuucaccaacguggcgugcagg

SEQ ID NO: 37575 - RNA, 22 nt, Salmonella enterica enterica serovar Typhi
cuucgcgucaugcguuauauca

SEQ ID NO: 37576 - RNA, 22 nt, Salmonella enterica enterica serovar Typhi
cuuguaggucggauaaggcgca

SEQ ID NO: 37577 - RNA, 22 nt, Salmonella enterica enterica serovar Typhi
gaaauguucgugggugucggcg

SEQ ID NO: 37578 - RNA, 22 nt, Salmonella enterica enterica serovar Typhi
gaaauucccaauccgagcgcgg

SEQ ID NO: 37579 - RNA, 22 nt, Salmonella enterica enterica serovar Typhi
gaacccggcaaguucaacgucu

SEQ ID NO: 37580 - RNA, 22 nt, Salmonella enterica enterica serovar Typhi
gaaccggcgugaggcaggucug

SEQ ID NO: 37581 - RNA, 21 nt, Salmonella enterica enterica serovar Typhi
gaacgggcuuuucagggugua

SEQ ID NO: 37582 - RNA, 22 nt, Salmonella enterica enterica serovar Typhi
gaagcaacgguaagguagguuu

SEQ ID NO: 37583 - RNA, 22 nt, Salmonella enterica enterica serovar Typhi
gaagcagugaugacaccgaggc

SEQ ID NO: 37584 - RNA, 22 nt, Salmonella enterica enterica serovar Typhi
gacaacaucccagaaaaugacg

SEQ ID NO: 37585 - RNA, 22 nt, Salmonella enterica enterica serovar Typhi
gacaguguaaguaaaccugcua

SEQ ID NO: 37586 - RNA, 22 nt, Salmonella enterica enterica serovar Typhi
gaccauccgcacauucaucugc

SEQ ID NO: 37587 - RNA, 22 nt, Salmonella enterica enterica serovar Typhi
gacgaacauuucguucguuaua

SEQ ID NO: 37588 - RNA, 22 nt, Salmonella enterica enterica serovar Typhi
gacgccaugaagcguggguaca

SEQ ID NO: 37589 - RNA, 22 nt, Salmonella enterica enterica serovar Typhi
gacgguacguugacuacgccgg

SEQ ID NO: 37590 - RNA, 22 nt, Salmonella enterica enterica serovar Typhi
gacugcugaaccagaacgacgu

SEQ ID NO: 37591 - RNA, 22 nt, Salmonella enterica enterica serovar Typhi
gacugguucuucuguuauaggg

SEQ ID NO: 37592 - RNA, 22 nt, Salmonella enterica enterica serovar Typhi
gacuucauggagucgaguugca

SEQ ID NO: 37593 - RNA, 22 nt, Salmonella enterica enterica serovar Typhi
gacuuuacuugauuccaacaua

SEQ ID NO: 37594 - RNA, 19 nt, Salmonella enterica enterica serovar Typhi
gagacggcaaaucaucgac

SEQ ID NO: 37595 - RNA, 19 nt, Salmonella enterica enterica serovar Typhi
gagauacacagcguuuacc

SEQ ID NO: 37596 - RNA, 22 nt, Salmonella enterica enterica serovar Typhi
gagcguuuuuaacguugggguu

SEQ ID NO: 37597 - RNA, 22 nt, Salmonella enterica enterica serovar Typhi
gaggauuugcacgaugugaaua

SEQ ID NO: 37598 - RNA, 22 nt, Salmonella enterica enterica serovar Typhi
gagugcggauguucggcuaccu

SEQ ID NO: 37599 - RNA, 22 nt, Salmonella enterica enterica serovar Typhi
gagugcgggcuggauauggaau

SEQ ID NO: 37600 - RNA, 22 nt, Salmonella enterica enterica serovar Typhi
gaguuuaucuucaacagugaaa

SEQ ID NO: 37601 - RNA, 20 nt, Salmonella enterica enterica serovar Typhi
gauaaacagcucuucccgcg

SEQ ID NO: 37602 - RNA, 22 nt, Salmonella enterica enterica serovar Typhi
gauaacgguagguaucaaucgc

SEQ ID NO: 37603 - RNA, 22 nt, Salmonella enterica enterica serovar Typhi
gaucagcgugcuauuuuuuucg

SEQ ID NO: 37604 - RNA, 22 nt, Salmonella enterica enterica serovar Typhi
gauccguuuguuguuucaaaau

SEQ ID NO: 37605 - RNA, 22 nt, Salmonella enterica enterica serovar Typhi
gaucgguuaggccgggcaggua

SEQ ID NO: 37606 - RNA, 22 nt, Salmonella enterica enterica serovar Typhi
gaucugguucccgcugugcagc

SEQ ID NO: 37607 - RNA, 22 nt, Salmonella enterica enterica serovar Typhi
gaugaacauacguuuggucacg

SEQ ID NO: 37608 - RNA, 22 nt, Salmonella enterica enterica serovar Typhi
gaugauggcaaugguauuccua

SEQ ID NO: 37609 - RNA, 22 nt, Salmonella enterica enterica serovar Typhi
gaugcuggauaaauauuucgau

SEQ ID NO: 37610 - RNA, 22 nt, Salmonella enterica enterica serovar Typhi
gaugcuggcguugcgaacauuu

SEQ ID NO: 37611 - RNA, 22 nt, Salmonella enterica enterica serovar Typhi
gauggcauuuuugucggcccua

SEQ ID NO: 37612 - RNA, 22 nt, Salmonella enterica enterica serovar Typhi
gaugggcuguuuaaggaaaccu

SEQ ID NO: 37613 - RNA, 22 nt, Salmonella enterica enterica serovar Typhi
gauguauaucguuugcuauaca

SEQ ID NO: 37614 - RNA, 22 nt, Salmonella enterica enterica serovar Typhi
gauuaucugaaaaauccggccu

SEQ ID NO: 37615 - RNA, 22 nt, Salmonella enterica enterica serovar Typhi
gauugccuguaauaccgccagu

SEQ ID NO: 37616 - RNA, 22 nt, Salmonella enterica enterica serovar Typhi
gauuuccgcaacguggugcugg

SEQ ID NO: 37617 - RNA, 22 nt, Salmonella enterica enterica serovar Typhi
gcaaugacgccggaagugguac

SEQ ID NO: 37618 - RNA, 21 nt, Salmonella enterica enterica serovar Typhi
gcacgcaguuccgccaguggg

SEQ ID NO: 37619 - RNA, 22 nt, Salmonella enterica enterica serovar Typhi
gcacgcuaugguacggcguguu

SEQ ID NO: 37620 - RNA, 23 nt, Salmonella enterica enterica serovar Typhi
gcagauccuggccgggcaguaug

SEQ ID NO: 37621 - RNA, 22 nt, Salmonella enterica enterica serovar Typhi
gcagcaugauaauucacguugg

SEQ ID NO: 37622 - RNA, 22 nt, Salmonella enterica enterica serovar Typhi
gccacgcucagucuucacggau

SEQ ID NO: 37623 - RNA, 21 nt, Salmonella enterica enterica serovar Typhi
gccacuggugacgcucaagaa

SEQ ID NO: 37624 - RNA, 22 nt, Salmonella enterica enterica serovar Typhi
gccagaccaaaggcgucgccug

SEQ ID NO: 37625 - RNA, 22 nt, Salmonella enterica enterica serovar Typhi
gccaggaacagcagcgcuuuaa

SEQ ID NO: 37626 - RNA, 22 nt, Salmonella enterica enterica serovar Typhi
gccaggaaguuaugcggguuug

SEQ ID NO: 37627 - RNA, 22 nt, Salmonella enterica enterica serovar Typhi
gccaguuguuuuagugugguaa

SEQ ID NO: 37628 - RNA, 22 nt, Salmonella enterica enterica serovar Typhi
gccaucguuuuuguaccguauc

SEQ ID NO: 37629 - RNA, 23 nt, Salmonella enterica enterica serovar Typhi
gccauggcgggacacagucuaug

SEQ ID NO: 37630 - RNA, 22 nt, Salmonella enterica enterica serovar Typhi
gccauugcguuguuagagaagu

SEQ ID NO: 37631 - RNA, 22 nt, Salmonella enterica enterica serovar Typhi
gcccgauuucagcgccuuucag

SEQ ID NO: 37632 - RNA, 22 nt, Salmonella enterica enterica serovar Typhi
gcccgguagguggaugcugagu

SEQ ID NO: 37633 - RNA, 19 nt, Salmonella enterica enterica serovar Typhi
gcccuacguccgcacgcgg

SEQ ID NO: 37634 - RNA, 22 nt, Salmonella enterica enterica serovar Typhi
gccgccaucagcagguugauca

SEQ ID NO: 37635 - RNA, 22 nt, Salmonella enterica enterica serovar Typhi
gccgcgaaaugacucgauauuc

SEQ ID NO: 37636 - RNA, 22 nt, Salmonella enterica enterica serovar Typhi
gccgcguagcguccggcguaau

SEQ ID NO: 37637 - RNA, 22 nt, Salmonella enterica enterica serovar Typhi
gccggaugucaucaccagcggg

SEQ ID NO: 37638 - RNA, 22 nt, Salmonella enterica enterica serovar Typhi
gccguaacgugcuugcugacgu

SEQ ID NO: 37639 - RNA, 22 nt, Salmonella enterica enterica serovar Typhi
gccgucuuuaacgagguacugg

SEQ ID NO: 37640 - RNA, 22 nt, Salmonella enterica enterica serovar Typhi
gccgugauuacggcgguaggua

SEQ ID NO: 37641 - RNA, 22 nt, Salmonella enterica enterica serovar Typhi
gccguggaaaagcucggggcgu

SEQ ID NO: 37642 - RNA, 22 nt, Salmonella enterica enterica serovar Typhi
gccugcucaauaugaccgccgc

SEQ ID NO: 37643 - RNA, 21 nt, Salmonella enterica enterica serovar Typhi
gccugcugauggggaaauuuc

SEQ ID NO: 37644 - RNA, 22 nt, Salmonella enterica enterica serovar Typhi
gccugugggugaauccggacug

SEQ ID NO: 37645 - RNA, 22 nt, Salmonella enterica enterica serovar Typhi
gcgaauaauggagauauucuga

SEQ ID NO: 37646 - RNA, 22 nt, Salmonella enterica enterica serovar Typhi
gcgacgacauuagacauguuca

SEQ ID NO: 37647 - RNA, 22 nt, Salmonella enterica enterica serovar Typhi
gcgacgcaaagaguacuggaug

SEQ ID NO: 37648 - RNA, 20 nt, Salmonella enterica enterica serovar Typhi
gcgcacuuuaaucgccauga

SEQ ID NO: 37649 - RNA, 22 nt, Salmonella enterica enterica serovar Typhi
gcgcagaauaagguucaacgua

SEQ ID NO: 37650 - RNA, 22 nt, Salmonella enterica enterica serovar Typhi
gcgcauccuccaguuggcuguu

SEQ ID NO: 37651 - RNA, 22 nt, Salmonella enterica enterica serovar Typhi
gcgccguuaagguuaaucagag

SEQ ID NO: 37652 - RNA, 22 nt, Salmonella enterica enterica serovar Typhi
gcgcgcaugauuauucccgccg

SEQ ID NO: 37653 - RNA, 22 nt, Salmonella enterica enterica serovar Typhi
gcgcgguuggccggugaucguu

SEQ ID NO: 37654 - RNA, 22 nt, Salmonella enterica enterica serovar Typhi
gcgcuauuacgauauucaggag

SEQ ID NO: 37655 - RNA, 22 nt, Salmonella enterica enterica serovar Typhi
gcgcucugucugcggacgucac

SEQ ID NO: 37656 - RNA, 22 nt, Salmonella enterica enterica serovar Typhi
gcggauaucgaaguggaucugg

SEQ ID NO: 37657 - RNA, 22 nt, Salmonella enterica enterica serovar Typhi
gcggauuguucagguacaggua

SEQ ID NO: 37658 - RNA, 19 nt, Salmonella enterica enterica serovar Typhi
gcggcuuuuguagauauug

SEQ ID NO: 37659 - RNA, 22 nt, Salmonella enterica enterica serovar Typhi
gcgguagaagacaaugguugaa

SEQ ID NO: 37660 - RNA, 22 nt, Salmonella enterica enterica serovar Typhi
gcguaggcccgccauucggcau

SEQ ID NO: 37661 - RNA, 22 nt, Salmonella enterica enterica serovar Typhi
gcguaucaucaacccgaugcgc

SEQ ID NO: 37662 - RNA, 22 nt, Salmonella enterica enterica serovar Typhi
gcgucauucuuacccggcgaua

SEQ ID NO: 37663 - RNA, 22 nt, Salmonella enterica enterica serovar Typhi
ugccgguugucgaugaagaaca

SEQ ID NO: 37664 - RNA, 22 nt, Salmonella enterica enterica serovar Typhi
ugccgucguaccuaaugcuucg

SEQ ID NO: 37665 - RNA, 22 nt, Salmonella enterica enterica serovar Typhi
ugccuguaacgacgcgccacau

SEQ ID NO: 37666 - RNA, 22 nt, Salmonella enterica enterica serovar Typhi
ugcgcagaucauauucacaugc

SEQ ID NO: 37667 - RNA, 22 nt, Salmonella enterica enterica serovar Typhi
ugcgcagcgccggagacgaaga

SEQ ID NO: 37668 - RNA, 22 nt, Salmonella enterica enterica serovar Typhi
ugcgcccugcgccaguuguucc

SEQ ID NO: 37669 - RNA, 22 nt, Salmonella enterica enterica serovar Typhi
ugcgcgaguauuucgaucugcu

SEQ ID NO: 37670 - RNA, 22 nt, Salmonella enterica enterica serovar Typhi
ugcguauuacccgauuagcguu

SEQ ID NO: 37671 - RNA, 22 nt, Salmonella enterica enterica serovar Typhi
ugcgucuggacguggugaaccu

SEQ ID NO: 37672 - RNA, 22 nt, Salmonella enterica enterica serovar Typhi
uugauucgccgcaucgcguaag

SEQ ID NO: 37673 - RNA, 22 nt, Salmonella enterica enterica serovar Typhi
uugcaaauuagcuucguccauu

SEQ ID NO: 37674 - RNA, 22 nt, Salmonella enterica enterica serovar Typhi
uugcaguuggcuaauaugcugc

SEQ ID NO: 37675 - RNA, 23 nt, Salmonella enterica enterica serovar Typhi
uugccggcgagaugauggcagga

SEQ ID NO: 37676 - RNA, 22 nt, Salmonella enterica enterica serovar Typhi
uugccgucgucagugacguaca

SEQ ID NO: 37677 - RNA, 22 nt, Salmonella enterica enterica serovar Typhi
uugcugauacggcgaaucgcuu

SEQ ID NO: 37678 - RNA, 22 nt, Salmonella enterica enterica serovar Typhi
uuggacguauugcaaaaucgca

SEQ ID NO: 37679 - RNA, 22 nt, Salmonella enterica enterica serovar Typhi
uuggcaaugaggcuacauuagu

SEQ ID NO: 37680 - RNA, 22 nt, Salmonella enterica enterica serovar Typhi
uuggccucagauuaauguuaag

SEQ ID NO: 37681 - RNA, 22 nt, Salmonella enterica enterica serovar Typhi
uuggcugacgaauauuauuaaa

SEQ ID NO: 37682 - RNA, 22 nt, Salmonella enterica enterica serovar Typhi
uuguaaaguacuggaauacgcg

SEQ ID NO: 37683 - RNA, 22 nt, Salmonella enterica enterica serovar Typhi
uugugccggauggcggcgccug

SEQ ID NO: 37684 - RNA, 22 nt, Salmonella enterica enterica serovar Typhi
uuguuccgaucauacggcguuu

SEQ ID NO: 37685 - RNA, 22 nt, Salmonella enterica enterica serovar Typhi
uuuaccauuaaaaagugaugug

SEQ ID NO: 37686 - RNA, 22 nt, Salmonella enterica enterica serovar Typhi
uuuacgagaaagagacgcuacg

SEQ ID NO: 37687 - RNA, 22 nt, Salmonella enterica enterica serovar Typhi
uuuacgcaucaucgcgcaacgc

SEQ ID NO: 37688 - RNA, 22 nt, Salmonella enterica enterica serovar Typhi
uuuacggaucugcaggaucagg

SEQ ID NO: 37689 - RNA, 17 nt, Salmonella enterica enterica serovar Typhi
uuuacggcuauaaccag

SEQ ID NO: 37690 - RNA, 22 nt, Salmonella enterica enterica serovar Typhi
uuuaugcgccgcaaaugccugc

SEQ ID NO: 37691 - RNA, 17 nt, Salmonella enterica enterica serovar Typhi
uuucaccauccgcauuc

SEQ ID NO: 37692 - RNA, 22 nt, Salmonella enterica enterica serovar Typhi
uuucaugcauuggacagcacgc

SEQ ID NO: 37693 - RNA, 22 nt, Salmonella enterica enterica serovar Typhi
uuucauuguuguggaaccgcuu

SEQ ID NO: 37694 - RNA, 22 nt, Salmonella enterica enterica serovar Typhi
uuuccgcgacaaauucaucacc

SEQ ID NO: 37695 - RNA, 22 nt, Salmonella enterica enterica serovar Typhi
uuucugcgcgcuguccggcccc

SEQ ID NO: 37696 - RNA, 22 nt, Salmonella enterica enterica serovar Typhi
uuugcccgguaagacuuccugc

SEQ ID NO: 37697 - RNA, 22 nt, Salmonella enterica enterica serovar Typhi
uuugcuaacuacugucuggcgg

SEQ ID NO: 37698 - RNA, 22 nt, Salmonella enterica enterica serovar Typhi
uuugucauuuccgguuugacga

SEQ ID NO: 37699 - RNA, 22 nt, Salmonella enterica enterica serovar Typhi
guauuaccaggaagagcucaau

SEQ ID NO: 37700 - RNA, 22 nt, Salmonella enterica enterica serovar Typhi
gucggaguaggccagauacgcc

SEQ ID NO: 37701 - RNA, 22 nt, Salmonella enterica enterica serovar Typhi
gucguaccacaauuagcguauu

SEQ ID NO: 37702 - RNA, 23 nt, Salmonella enterica enterica serovar Typhi
gucgucugaaggaugaagcguaa

SEQ ID NO: 37703 - RNA, 22 nt, Salmonella enterica enterica serovar Typhi
gucugaugagcgccggauucug

SEQ ID NO: 37704 - RNA, 22 nt, Salmonella enterica enterica serovar Typhi
gucugcccgcagacauggucgu

SEQ ID NO: 37705 - RNA, 20 nt, Salmonella enterica enterica serovar Typhi
gucugcggcgacuggcggcg

SEQ ID NO: 37706 - RNA, 18 nt, Salmonella enterica enterica serovar Typhi
gucuggagcgauuucgug

SEQ ID NO: 37707 - RNA, 22 nt, Salmonella enterica enterica serovar Typhi
gucuuaucgauaugcuggaaga

SEQ ID NO: 37708 - RNA, 21 nt, Salmonella enterica enterica serovar Typhi
ucauugcugagacaggcucug

SEQ ID NO: 37709 - RNA, 22 nt, Salmonella enterica enterica serovar Typhi
ucauuucgaaggccugcagcga

SEQ ID NO: 37710 - RNA, 22 nt, Salmonella enterica enterica serovar Typhi
ucccgacaaugucgucgugaua

SEQ ID NO: 37711 - RNA, 22 nt, Salmonella enterica enterica serovar Typhi
ucccugauaaaacaguaacggc

SEQ ID NO: 37712 - RNA, 22 nt, Salmonella enterica enterica serovar Typhi
uccgacaugugcugcaaccgcu

SEQ ID NO: 37713 - RNA, 22 nt, Salmonella enterica enterica serovar Typhi
uccgcaggcguucgaaaagggu

SEQ ID NO: 37714 - RNA, 18 nt, Salmonella enterica enterica serovar Typhi
uccgcuggacucccugaa

SEQ ID NO: 37715 - RNA, 19 nt, Salmonella enterica enterica serovar Typhi
uccggaugacgaacuggcc

SEQ ID NO: 37716 - RNA, 22 nt, Salmonella enterica enterica serovar Typhi
uccgggaucgccuccagcagca

SEQ ID NO: 37717 - RNA, 22 nt, Salmonella enterica enterica serovar Typhi
uccguaaauuagaagaacguag

SEQ ID NO: 37718 - RNA, 19 nt, Salmonella enterica enterica serovar Typhi
ucgaacgcugcgaauuuau

SEQ ID NO: 37719 - RNA, 22 nt, Salmonella enterica enterica serovar Typhi
ucgacgcgggcaaagcuggcgu

SEQ ID NO: 37720 - RNA, 22 nt, Salmonella enterica enterica serovar Typhi
ucgagcacugcccggcccuaaa

SEQ ID NO: 37721 - RNA, 22 nt, Salmonella enterica enterica serovar Typhi
ucgagcguuucgaauacgcugu

SEQ ID NO: 37722 - RNA, 22 nt, Salmonella enterica enterica serovar Typhi
ucgccguggcugcuggcgcugg

SEQ ID NO: 37723 - RNA, 22 nt, Salmonella enterica enterica serovar Typhi
ucgcggcugaggucguuuaugg

SEQ ID NO: 37724 - RNA, 22 nt, Salmonella enterica enterica serovar Typhi
ucgcuggaaaguauucgccagc

SEQ ID NO: 37725 - RNA, 22 nt, Salmonella enterica enterica serovar Typhi
ucgcuucaccuugcugccguug

SEQ ID NO: 37726 - RNA, 22 nt, Salmonella enterica enterica serovar Typhi
ucggcguuuaccguaggcgacc

SEQ ID NO: 37727 - RNA, 22 nt, Salmonella enterica enterica serovar Typhi
ucgguauggcaugaugcggaau

SEQ ID NO: 37728 - RNA, 22 nt, Salmonella enterica enterica serovar Typhi
ucggucauugagaucuguugga

SEQ ID NO: 37729 - RNA, 22 nt, Salmonella enterica enterica serovar Typhi
ucggugcuaaugcuggcgggca

SEQ ID NO: 37730 - RNA, 23 nt, Salmonella enterica enterica serovar Typhi
ucgugcugccagcggacaaaugu

SEQ ID NO: 37731 - RNA, 22 nt, Salmonella enterica enterica serovar Typhi
ucguuaaguucauuaaugcguu

SEQ ID NO: 37732 - RNA, 22 nt, Salmonella enterica enterica serovar Typhi
ucguuauaccgcugggccgcgc

SEQ ID NO: 37733 - RNA, 22 nt, Salmonella enterica enterica serovar Typhi
ucugaauuuaaaaauccugaac

SEQ ID NO: 37734 - RNA, 22 nt, Salmonella enterica enterica serovar Typhi
ucugacugaugggaugcgcuga

SEQ ID NO: 37735 - RNA, 22 nt, Salmonella enterica enterica serovar Typhi
ucugauucagggaucggggacg

SEQ ID NO: 37736 - RNA, 22 nt, Salmonella enterica enterica serovar Typhi
ucugcauccccacgcgggugac

SEQ ID NO: 37737 - RNA, 22 nt, Salmonella enterica enterica serovar Typhi
ucugcguuaguuggcaaaccuu

SEQ ID NO: 37738 - RNA, 22 nt, Salmonella enterica enterica serovar Typhi
ucuguaggccggauaaggcguu

SEQ ID NO: 37739 - RNA, 22 nt, Salmonella enterica enterica serovar Typhi
ucuguaggccugauaagcgcag

SEQ ID NO: 37740 - RNA, 22 nt, Salmonella enterica enterica serovar Typhi
ucugucauucgacgaaugauua

SEQ ID NO: 37741 - RNA, 22 nt, Salmonella enterica enterica serovar Typhi
ucuuggcgcgcuaauuggucug

SEQ ID NO: 37742 - RNA, 22 nt, Salmonella enterica enterica serovar Typhi
ugaagaucagcagcgauuugau

SEQ ID NO: 37743 - RNA, 22 nt, Salmonella enterica enterica serovar Typhi
ugaagcguucuuguaaaaauga

SEQ ID NO: 37744 - RNA, 22 nt, Salmonella enterica enterica serovar Typhi
ugaaguuuaucaaaggugacgc

SEQ ID NO: 37745 - RNA, 22 nt, Salmonella enterica enterica serovar Typhi
ugaccucgauugcuggcgguac

SEQ ID NO: 37746 - RNA, 22 nt, Salmonella enterica enterica serovar Typhi
ugaccugcggcaguaucccaga

SEQ ID NO: 37747 - RNA, 21 nt, Salmonella enterica enterica serovar Typhi
ugacgcgcgcccuggcuuauc

SEQ ID NO: 37748 - RNA, 22 nt, Salmonella enterica enterica serovar Typhi
ugacuaauuaucgcccucacua

SEQ ID NO: 37749 - RNA, 22 nt, Salmonella enterica enterica serovar Typhi
ugagaagugaaaaucugcauca

SEQ ID NO: 37750 - RNA, 22 nt, Salmonella enterica enterica serovar Typhi
ugagagauauuggauuuuacuu

SEQ ID NO: 37751 - RNA, 22 nt, Salmonella enterica enterica serovar Typhi
ugauacugaggauuuucgcguu

SEQ ID NO: 37752 - RNA, 22 nt, Salmonella enterica enterica serovar Typhi
ugaucaauuucaaagaagcgac

SEQ ID NO: 37753 - RNA, 21 nt, Salmonella enterica enterica serovar Typhi
ugaugaccugccguccaaccc

SEQ ID NO: 37754 - RNA, 22 nt, Salmonella enterica enterica serovar Typhi
ugaugcagacgacgacaugcgc

SEQ ID NO: 37755 - RNA, 22 nt, Salmonella enterica enterica serovar Typhi
ugaugcgcuguguucgcguuau

SEQ ID NO: 37756 - RNA, 22 nt, Salmonella enterica enterica serovar Typhi
ugauggcgcagcgcauugaugu

SEQ ID NO: 37757 - RNA, 22 nt, Salmonella enterica enterica serovar Typhi
ugcaaccuuuuuaugcgcgguu

SEQ ID NO: 37758 - RNA, 22 nt, Salmonella enterica enterica serovar Typhi
ugcaacgcuuuaugguggcgau

SEQ ID NO: 37759 - RNA, 22 nt, Salmonella enterica enterica serovar Typhi
ugcacgucggcgaagcgccaaa

SEQ ID NO: 37760 - RNA, 22 nt, Salmonella enterica enterica serovar Typhi
ugcaggaugucgcgccggguac

SEQ ID NO: 37761 - RNA, 22 nt, Salmonella enterica enterica serovar Typhi
ugcaggucacucuccagcgccc

SEQ ID NO: 37762 - RNA, 22 nt, Salmonella enterica enterica serovar Typhi
ugcaucucuugaggcuauguuu

SEQ ID NO: 37763 - RNA, 21 nt, Salmonella enterica enterica serovar Typhi
ugcccgcuuuauguagugguu

SEQ ID NO: 37764 - RNA, 22 nt, Salmonella enterica enterica serovar Typhi
ugcccgucuacgauaaaccgau

SEQ ID NO: 37765 - RNA, 22 nt, Salmonella enterica enterica serovar Typhi
ugccgauuuuggucccggcggc

SEQ ID NO: 37766 - RNA, 22 nt, Salmonella enterica enterica serovar Typhi
ugccgcaagccgcuuucccuga

SEQ ID NO: 37767 - RNA, 22 nt, Salmonella enterica enterica serovar Typhi
ugccgcauggcgcuacgcuugu

SEQ ID NO: 37768 - RNA, 22 nt, Salmonella enterica enterica serovar Typhi
ugccggaaagacggcagcgcca

SEQ ID NO: 37769 - RNA, 22 nt, Salmonella enterica enterica serovar Typhi
ugccggagaugaccgauguuca

SEQ ID NO: 37770 - RNA, 22 nt, Salmonella enterica enterica serovar Typhi
ugccggauggcgguguaaacgu

SEQ ID NO: 37771 - RNA, 22 nt, Salmonella enterica enterica serovar Typhi
gcgucgcagcgacuggcguauc

SEQ ID NO: 37772 - RNA, 22 nt, Salmonella enterica enterica serovar Typhi
gcgucgcagcuuucauggcgua

SEQ ID NO: 37773 - RNA, 22 nt, Salmonella enterica enterica serovar Typhi
gcgugaaagacuauaucgccau

SEQ ID NO: 37774 - RNA, 22 nt, Salmonella enterica enterica serovar Typhi
gcguggaugccccgcugaauau

SEQ ID NO: 37775 - RNA, 22 nt, Salmonella enterica enterica serovar Typhi
gcguucugaucugucugcggac

SEQ ID NO: 37776 - RNA, 22 nt, Salmonella enterica enterica serovar Typhi
gcguuuccggccuggaugcguu

SEQ ID NO: 37777 - RNA, 22 nt, Salmonella enterica enterica serovar Typhi
gcuaaaggcuugcaagaacugg

SEQ ID NO: 37778 - RNA, 22 nt, Salmonella enterica enterica serovar Typhi
gcuaucaaagaagcgaacaacc

SEQ ID NO: 37779 - RNA, 22 nt, Salmonella enterica enterica serovar Typhi
gcuauuucuggugguucaguau

SEQ ID NO: 37780 - RNA, 22 nt, Salmonella enterica enterica serovar Typhi
gcugagccugauuuuaccgcug

SEQ ID NO: 37781 - RNA, 22 nt, Salmonella enterica enterica serovar Typhi
gcugauacugcucguucaacgc

SEQ ID NO: 37782 - RNA, 22 nt, Salmonella enterica enterica serovar Typhi
gcugaugaccgauaagcugcaa

SEQ ID NO: 37783 - RNA, 22 nt, Salmonella enterica enterica serovar Typhi
gcugauuauugacuuucuggcg

SEQ ID NO: 37784 - RNA, 22 nt, Salmonella enterica enterica serovar Typhi
gcugcgucguauuaucccgcca

SEQ ID NO: 37785 - RNA, 22 nt, Salmonella enterica enterica serovar Typhi
gcuggacguugggggcuaccgg

SEQ ID NO: 37786 - RNA, 22 nt, Salmonella enterica enterica serovar Typhi
gcuggcagaagaaauggcagac

SEQ ID NO: 37787 - RNA, 22 nt, Salmonella enterica enterica serovar Typhi
gcuggucgagaaugguuugcac

SEQ ID NO: 37788 - RNA, 22 nt, Salmonella enterica enterica serovar Typhi
gcuguagcgccagauggaugug

SEQ ID NO: 37789 - RNA, 22 nt, Salmonella enterica enterica serovar Typhi
ggaauauggucugccgcaugug

SEQ ID NO: 37790 - RNA, 22 nt, Salmonella enterica enterica serovar Typhi
ggauucugccgaaacugaucgg

SEQ ID NO: 37791 - RNA, 22 nt, Salmonella enterica enterica serovar Typhi
ggcagaccauuuucugcggcgu

SEQ ID NO: 37792 - RNA, 22 nt, Salmonella enterica enterica serovar Typhi
ggcaguggaugaccaugauugu

SEQ ID NO: 37793 - RNA, 22 nt, Salmonella enterica enterica serovar Typhi
ggcaucgaaguccgaucaaccc

SEQ ID NO: 37794 - RNA, 22 nt, Salmonella enterica enterica serovar Typhi
ggccaucauugaagaacagcug

SEQ ID NO: 37795 - RNA, 21 nt, Salmonella enterica enterica serovar Typhi
ggccaugacaucuauccuauc

SEQ ID NO: 37796 - RNA, 22 nt, Salmonella enterica enterica serovar Typhi
ggccuacaagaauuuaucgcaa

SEQ ID NO: 37797 - RNA, 22 nt, Salmonella enterica enterica serovar Typhi
ggccugauaagcgcagcgccau

SEQ ID NO: 37798 - RNA, 22 nt, Salmonella enterica enterica serovar Typhi
ggccugauuccccagcauuguu

SEQ ID NO: 37799 - RNA, 22 nt, Salmonella enterica enterica serovar Typhi
ggcgacauucagcgcgugcugu

SEQ ID NO: 37800 - RNA, 22 nt, Salmonella enterica enterica serovar Typhi
ggcgagaugaugaaguuuaccg

SEQ ID NO: 37801 - RNA, 22 nt, Salmonella enterica enterica serovar Typhi
ggcgauuugcggcggcgugaag

SEQ ID NO: 37802 - RNA, 22 nt, Salmonella enterica enterica serovar Typhi
ggcgcgaugcuggcgaaggucu

SEQ ID NO: 37803 - RNA, 22 nt, Salmonella enterica enterica serovar Typhi
ggcgcguaaaaaacugucugaa

SEQ ID NO: 37804 - RNA, 22 nt, Salmonella enterica enterica serovar Typhi
ggcgguaaagguaauggauuca

SEQ ID NO: 37805 - RNA, 22 nt, Salmonella enterica enterica serovar Typhi
ggcgucagcgguuccgcggcgg

SEQ ID NO: 37806 - RNA, 22 nt, Salmonella enterica enterica serovar Typhi
ggcgucuuccaguggcacgccg

SEQ ID NO: 37807 - RNA, 22 nt, Salmonella enterica enterica serovar Typhi
ggcguggacguccuguugaacg

SEQ ID NO: 37808 - RNA, 22 nt, Salmonella enterica enterica serovar Typhi
ggcuacaacgccauugccgccg

SEQ ID NO: 37809 - RNA, 19 nt, Salmonella enterica enterica serovar Typhi
ggcugcguggaaaccgcgc

SEQ ID NO: 37810 - RNA, 22 nt, Salmonella enterica enterica serovar Typhi
ggcugcugaagguguucugcgc

SEQ ID NO: 37811 - RNA, 22 nt, Salmonella enterica enterica serovar Typhi
ggcuggauauuauuaagcgcga

SEQ ID NO: 37812 - RNA, 22 nt, Salmonella enterica enterica serovar Typhi
ggcugggaugaguucaguauuc

SEQ ID NO: 37813 - RNA, 22 nt, Salmonella enterica enterica serovar Typhi
ggcuuacaccugucagcggcga

SEQ ID NO: 37814 - RNA, 22 nt, Salmonella enterica enterica serovar Typhi
gggcgcauguuuugaguaaaac

SEQ ID NO: 37815 - RNA, 18 nt, Salmonella enterica enterica serovar Typhi
gggcugaugcugugggcg

SEQ ID NO: 37816 - RNA, 22 nt, Salmonella enterica enterica serovar Typhi
gggcugcuauucguggcguuuu

SEQ ID NO: 37817 - RNA, 22 nt, Salmonella enterica enterica serovar Typhi
ggguauaucugacggagcguga

SEQ ID NO: 37818 - RNA, 22 nt, Salmonella enterica enterica serovar Typhi
gggucuccaccaguugcagcac

SEQ ID NO: 37819 - RNA, 22 nt, Salmonella enterica enterica serovar Typhi
gguaaacgcuguguaucucucu

SEQ ID NO: 37820 - RNA, 22 nt, Salmonella enterica enterica serovar Typhi
gguacugccagaggucugacgg

SEQ ID NO: 37821 - RNA, 22 nt, Salmonella enterica enterica serovar Typhi
ggucacguuuacgcugucgcca

SEQ ID NO: 37822 - RNA, 22 nt, Salmonella enterica enterica serovar Typhi
ggucauguggguggacgcggua

SEQ ID NO: 37823 - RNA, 22 nt, Salmonella enterica enterica serovar Typhi
ggugaaacgcugaaugucuccc

SEQ ID NO: 37824 - RNA, 22 nt, Salmonella enterica enterica serovar Typhi
ggugcucguugugguccaucug

SEQ ID NO: 37825 - RNA, 22 nt, Salmonella enterica enterica serovar Typhi
ggugcugaaggguucguaguga

SEQ ID NO: 37826 - RNA, 22 nt, Salmonella enterica enterica serovar Typhi
gguggacgugcgcggcgauacg

SEQ ID NO: 37827 - RNA, 22 nt, Salmonella enterica enterica serovar Typhi
ggugguaaaacccgaccagaua

SEQ ID NO: 37828 - RNA, 22 nt, Salmonella enterica enterica serovar Typhi
gguuucauuuguugccguuaug

SEQ ID NO: 37829 - RNA, 22 nt, Salmonella enterica enterica serovar Typhi
guaaagacggcgauaaaagucg

SEQ ID NO: 37830 - RNA, 22 nt, Salmonella enterica enterica serovar Typhi
guaaugaugccuugcugugccg

SEQ ID NO: 37831 - RNA, 22 nt, Salmonella enterica enterica serovar Typhi
guaggccggauaaucguagcgc

SEQ ID NO: 37832 - RNA, 21 nt, Salmonella enterica enterica serovar Typhi
guaucaguaguaccgcaguga

SEQ ID NO: 37833 - RNA, 22 nt, Salmonella enterica enterica serovar Typhi
guaucggccuaaaugaucggca

SEQ ID NO: 37834 - RNA, 22 nt, Salmonella enterica enterica serovar Typhi
gugacgauuauuacugacauuu

SEQ ID NO: 37835 - RNA, 22 nt, Salmonella enterica enterica serovar Typhi
gugcaggaugacucggcuucgc

SEQ ID NO: 37836 - RNA, 22 nt, Salmonella enterica enterica serovar Typhi
gugccgucgccauuggugucuc

SEQ ID NO: 37837 - RNA, 22 nt, Salmonella enterica enterica serovar Typhi
gugcgaaugcgcgacuugccga

SEQ ID NO: 37838 - RNA, 22 nt, Salmonella enterica enterica serovar Typhi
guggaagccggauuacuggcgc

SEQ ID NO: 37839 - RNA, 22 nt, Salmonella enterica enterica serovar Typhi
guggcgauaaacagaucgcccg

SEQ ID NO: 37840 - RNA, 22 nt, Salmonella enterica enterica serovar Typhi
guggcgcuagcgcuuacccgac

SEQ ID NO: 37841 - RNA, 22 nt, Salmonella enterica enterica serovar Typhi
guggcggaggugauucaacgcu

SEQ ID NO: 37842 - RNA, 22 nt, Salmonella enterica enterica serovar Typhi
gugguuaacgaggaaaauaaua

SEQ ID NO: 37843 - RNA, 22 nt, Salmonella enterica enterica serovar Typhi
gugguuaaucaacgugacuucg

SEQ ID NO: 37844 - RNA, 22 nt, Salmonella enterica enterica serovar Typhi
guguaaagcgcauugucugcag

SEQ ID NO: 37845 - RNA, 22 nt, Salmonella enterica enterica serovar Typhi
gugugcaaagacugauagccgu

SEQ ID NO: 37846 - RNA, 21 nt, Salmonella enterica enterica serovar Typhi
gugugccacggcauuccggau

SEQ ID NO: 37847 - RNA, 22 nt, Salmonella enterica enterica serovar Typhi
guugaaaucucugaaggguuag

SEQ ID NO: 37848 - RNA, 22 nt, Salmonella enterica enterica serovar Typhi
guugcgccagcccgacguggcc

SEQ ID NO: 37849 - RNA, 22 nt, Salmonella enterica enterica serovar Typhi
guugcgcucaaugaccuggcca

SEQ ID NO: 37850 - RNA, 22 nt, Salmonella enterica enterica serovar Typhi
guugcggauaauccagcguaaa

SEQ ID NO: 37851 - RNA, 22 nt, Salmonella enterica enterica serovar Typhi
guuggaacgguuaaacugauga

SEQ ID NO: 37852 - RNA, 22 nt, Salmonella enterica enterica serovar Typhi
guuggauaguggcuucuuccag

SEQ ID NO: 37853 - RNA, 22 nt, Salmonella enterica enterica serovar Typhi
uaaagcaccgcggccuuuuuug

SEQ ID NO: 37854 - RNA, 22 nt, Salmonella enterica enterica serovar Typhi
uaaagugaaauaauucagucag

SEQ ID NO: 37855 - RNA, 22 nt, Salmonella enterica enterica serovar Typhi
uaaauggugggagugcgccucc

SEQ ID NO: 37856 - RNA, 22 nt, Salmonella enterica enterica serovar Typhi
uaacagccccagcccuggcgua

SEQ ID NO: 37857 - RNA, 23 nt, Salmonella enterica enterica serovar Typhi
uaacugaggggauuaugaccuuc

SEQ ID NO: 37858 - RNA, 22 nt, Salmonella enterica enterica serovar Typhi
uaaugcuuauccggccuacagg

SEQ ID NO: 37859 - RNA, 22 nt, Salmonella enterica enterica serovar Typhi
uacaauguugaagcagcgcgug

SEQ ID NO: 37860 - RNA, 22 nt, Salmonella enterica enterica serovar Typhi
uacacgccggauaaggcgcagc

SEQ ID NO: 37861 - RNA, 22 nt, Salmonella enterica enterica serovar Typhi
uacagaauauccaucagcggcu

SEQ ID NO: 37862 - RNA, 22 nt, Salmonella enterica enterica serovar Typhi
uacaggauguucggcguaucgu

SEQ ID NO: 37863 - RNA, 22 nt, Salmonella enterica enterica serovar Typhi
uaccacuuccggcccugcaugc

SEQ ID NO: 37864 - RNA, 22 nt, Salmonella enterica enterica serovar Typhi
uaccguucccgccuauuucgau

SEQ ID NO: 37865 - RNA, 22 nt, Salmonella enterica enterica serovar Typhi
uaccugugcuggcgcugaccgc

SEQ ID NO: 37866 - RNA, 22 nt, Salmonella enterica enterica serovar Typhi
uacgcgaacaacuggaggucag

SEQ ID NO: 37867 - RNA, 22 nt, Salmonella enterica enterica serovar Typhi
uacgcuccagaccaucaugcau

SEQ ID NO: 37868 - RNA, 22 nt, Salmonella enterica enterica serovar Typhi
uacguaugggguaugaggcggu

SEQ ID NO: 37869 - RNA, 22 nt, Salmonella enterica enterica serovar Typhi
uacguuugccgaggugaucgua

SEQ ID NO: 37870 - RNA, 22 nt, Salmonella enterica enterica serovar Typhi
uacuacguugucgacgccgguu

SEQ ID NO: 37871 - RNA, 22 nt, Salmonella enterica enterica serovar Typhi
uacugguauccagaaacuaucu

SEQ ID NO: 37872 - RNA, 22 nt, Salmonella enterica enterica serovar Typhi
uacugugcgcgcugucggucuu

SEQ ID NO: 37873 - RNA, 22 nt, Salmonella enterica enterica serovar Typhi
uagcggaaaauugggcuauagc

SEQ ID NO: 37874 - RNA, 22 nt, Salmonella enterica enterica serovar Typhi
uagcgugauuacgaccggcgag

SEQ ID NO: 37875 - RNA, 22 nt, Salmonella enterica enterica serovar Typhi
uaggccaaccgccauccggcau

SEQ ID NO: 37876 - RNA, 22 nt, Salmonella enterica enterica serovar Typhi
uaggccugguaagcgaagcgcc

SEQ ID NO: 37877 - RNA, 22 nt, Salmonella enterica enterica serovar Typhi
uaggucuggucuaucucuuuuu

SEQ ID NO: 37878 - RNA, 22 nt, Salmonella enterica enterica serovar Typhi
uaguacgauggaaggccgcaaa

SEQ ID NO: 37879 - RNA, 22 nt, Salmonella enterica enterica serovar Typhi
uaguucuucguaagccgucaug

SEQ ID NO: 37880 - RNA, 22 nt, Salmonella enterica enterica serovar Typhi
uauagcgaaaccacccugaccg

SEQ ID NO: 37881 - RNA, 22 nt, Salmonella enterica enterica serovar Typhi
uaucaagucugaagcgaaaacu

SEQ ID NO: 37882 - RNA, 23 nt, Salmonella enterica enterica serovar Typhi
uauccggccuacagaacugcacg

SEQ ID NO: 37883 - RNA, 22 nt, Salmonella enterica enterica serovar Typhi
uauccggcuaauaacgucucaa

SEQ ID NO: 37884 - RNA, 22 nt, Salmonella enterica enterica serovar Typhi
uaucguucagcuucuaugcuaa

SEQ ID NO: 37885 - RNA, 23 nt, Salmonella enterica enterica serovar Typhi
uaucucuggcuuugcggcgaauc

SEQ ID NO: 37886 - RNA, 21 nt, Salmonella enterica enterica serovar Typhi
uauggcgaccaccugcuggac

SEQ ID NO: 37887 - RNA, 22 nt, Salmonella enterica enterica serovar Typhi
uauggcgguugcguggccgccu

SEQ ID NO: 37888 - RNA, 23 nt, Salmonella enterica enterica serovar Typhi
uauggcuauuaggguagacgggu

SEQ ID NO: 37889 - RNA, 22 nt, Salmonella enterica enterica serovar Typhi
uauggcuucccaacggauguug

SEQ ID NO: 37890 - RNA, 22 nt, Salmonella enterica enterica serovar Typhi
uauuccggugaucuuugucucc

SEQ ID NO: 37891 - RNA, 22 nt, Salmonella enterica enterica serovar Typhi
uauugcgcgccgaaauuggcca

SEQ ID NO: 37892 - RNA, 18 nt, Salmonella enterica enterica serovar Typhi
ucaacuucagcagauacc

SEQ ID NO: 37893 - RNA, 22 nt, Salmonella enterica enterica serovar Typhi
ucacgccgucacgcguguugcc

SEQ ID NO: 37894 - RNA, 22 nt, Salmonella enterica enterica serovar Typhi
ucacgcuuuuuccugacccuga

SEQ ID NO: 37895 - RNA, 22 nt, Salmonella enterica enterica serovar Typhi
ucacuuuaucgccguggcucau

SEQ ID NO: 37896 - RNA, 22 nt, Salmonella enterica enterica serovar Typhi
ucagaauaucuccauuauucgc

SEQ ID NO: 37897 - RNA, 22 nt, Salmonella enterica enterica serovar Typhi
ucagacguuacgcgcggaguau

SEQ ID NO: 37898 - RNA, 22 nt, Salmonella enterica enterica serovar Typhi
ucagauagauauucgcauccgg

SEQ ID NO: 37899 - RNA, 22 nt, Salmonella enterica enterica serovar Typhi
ucagggugauacuggcguugca

SEQ ID NO: 37900 - RNA, 22 nt, Salmonella enterica enterica serovar Typhi
ucaggguggugauguaguagua

SEQ ID NO: 37901 - RNA, 22 nt, Salmonella enterica enterica serovar Typhi
ucagguaaagcgcccguggcga

SEQ ID NO: 37902 - RNA, 22 nt, Salmonella enterica enterica serovar Typhi
ucaguaauauugaugagcgcgu

SEQ ID NO: 37903 - RNA, 21 nt, Salmonella enterica enterica serovar Typhi
ucauccagccaacaaacucaa

SEQ ID NO: 37904 - RNA, 22 nt, Salmonella enterica enterica serovar Typhi
ucaugccugcgcgccgggcuuu

SEQ ID NO: 37905 - RNA, 23 nt, Salmonella enterica enterica serovar Typhi
ucauggaaauuuuagauaacccg

SEQ ID NO: 37906 - RNA, 22 nt, Salmonella enterica enterica serovar Typhi
ugcguggccucgcccagccgca

SEQ ID NO: 37907 - RNA, 22 nt, Salmonella enterica enterica serovar Typhi
ugcguucgguuauugcggaaga

SEQ ID NO: 37908 - RNA, 22 nt, Salmonella enterica enterica serovar Typhi
ugcucagcaccaccaccugcuc

SEQ ID NO: 37909 - RNA, 22 nt, Salmonella enterica enterica serovar Typhi
ugcugaauccgauaaauggguu

SEQ ID NO: 37910 - RNA, 22 nt, Salmonella enterica enterica serovar Typhi
ugcugagucucaguuaugugcu

SEQ ID NO: 37911 - RNA, 22 nt, Salmonella enterica enterica serovar Typhi
ugcuggaagacgcguuuucgua

SEQ ID NO: 37912 - RNA, 22 nt, Salmonella enterica enterica serovar Typhi
ugcugucgcucagugguuucgc

SEQ ID NO: 37913 - RNA, 22 nt, Salmonella enterica enterica serovar Typhi
ugcuuuaaaugcugcgcuaacu

SEQ ID NO: 37914 - RNA, 20 nt, Salmonella enterica enterica serovar Typhi
uggaaucagugugaaagguc

SEQ ID NO: 37915 - RNA, 22 nt, Salmonella enterica enterica serovar Typhi
uggacaggacacgggauaauca

SEQ ID NO: 37916 - RNA, 22 nt, Salmonella enterica enterica serovar Typhi
uggaccgcaugggcgcgaacuu

SEQ ID NO: 37917 - RNA, 22 nt, Salmonella enterica enterica serovar Typhi
uggauaagugaaacgccauccg

SEQ ID NO: 37918 - RNA, 22 nt, Salmonella enterica enterica serovar Typhi
uggaucugccuauuuugaaaac

SEQ ID NO: 37919 - RNA, 22 nt, Salmonella enterica enterica serovar Typhi
uggaugaacuuuguaugaucuc

SEQ ID NO: 37920 - RNA, 22 nt, Salmonella enterica enterica serovar Typhi
uggaugacaccaugaccuaccg

SEQ ID NO: 37921 - RNA, 22 nt, Salmonella enterica enterica serovar Typhi
uggaugaucucaaggcgcugua

SEQ ID NO: 37922 - RNA, 18 nt, Salmonella enterica enterica serovar Typhi
uggcagcguucuucacgu

SEQ ID NO: 37923 - RNA, 22 nt, Salmonella enterica enterica serovar Typhi
uggcaugugguauugauccuga

SEQ ID NO: 37924 - RNA, 22 nt, Salmonella enterica enterica serovar Typhi
uggcgcaguaucgugaacuggc

SEQ ID NO: 37925 - RNA, 22 nt, Salmonella enterica enterica serovar Typhi
uggcgcaguuggaauuccgccg

SEQ ID NO: 37926 - RNA, 22 nt, Salmonella enterica enterica serovar Typhi
uggcgcguggccacaucaucaa

SEQ ID NO: 37927 - RNA, 22 nt, Salmonella enterica enterica serovar Typhi
uggcgcuacgcuuaucaggccu

SEQ ID NO: 37928 - RNA, 22 nt, Salmonella enterica enterica serovar Typhi
uggcgcugaugaaacgcauucu

SEQ ID NO: 37929 - RNA, 22 nt, Salmonella enterica enterica serovar Typhi
uggcgcugugcuuacccggccu

SEQ ID NO: 37930 - RNA, 22 nt, Salmonella enterica enterica serovar Typhi
uggcgcuucgcuuauccgaccu

SEQ ID NO: 37931 - RNA, 22 nt, Salmonella enterica enterica serovar Typhi
uggcggcaaucggugcugcgau

SEQ ID NO: 37932 - RNA, 22 nt, Salmonella enterica enterica serovar Typhi
uggcggcaauggcgauagauuu

SEQ ID NO: 37933 - RNA, 22 nt, Salmonella enterica enterica serovar Typhi
uggcgguagcgauaagcgccug

SEQ ID NO: 37934 - RNA, 22 nt, Salmonella enterica enterica serovar Typhi
uggcuaucgccauuacgcauug

SEQ ID NO: 37935 - RNA, 21 nt, Salmonella enterica enterica serovar Typhi
uggcugcuguucaucugcgug

SEQ ID NO: 37936 - RNA, 22 nt, Salmonella enterica enterica serovar Typhi
ugggaucaccuugaucaaguac

SEQ ID NO: 37937 - RNA, 22 nt, Salmonella enterica enterica serovar Typhi
ugggcguacucgucuauuaaug

SEQ ID NO: 37938 - RNA, 22 nt, Salmonella enterica enterica serovar Typhi
ugguaccguuaugacgaucugc

SEQ ID NO: 37939 - RNA, 22 nt, Salmonella enterica enterica serovar Typhi
uggucacggcgauagaaaacgg

SEQ ID NO: 37940 - RNA, 22 nt, Salmonella enterica enterica serovar Typhi
uggucagggauauaugccgguu

SEQ ID NO: 37941 - RNA, 22 nt, Salmonella enterica enterica serovar Typhi
ugguccauagacuuuauugucc

SEQ ID NO: 37942 - RNA, 22 nt, Salmonella enterica enterica serovar Typhi
uggucgacgaugccaucguggu

SEQ ID NO: 37943 - RNA, 22 nt, Salmonella enterica enterica serovar Typhi
uggucgagaggguuucaauauu

SEQ ID NO: 37944 - RNA, 22 nt, Salmonella enterica enterica serovar Typhi
uguaaagcaaaugcuauacaag

SEQ ID NO: 37945 - RNA, 22 nt, Salmonella enterica enterica serovar Typhi
uguagcgcgucucaugcguugc

SEQ ID NO: 37946 - RNA, 22 nt, Salmonella enterica enterica serovar Typhi
uguaggccggacaaggcguuca

SEQ ID NO: 37947 - RNA, 22 nt, Salmonella enterica enterica serovar Typhi
uguaggccggauaagcauuagc

SEQ ID NO: 37948 - RNA, 22 nt, Salmonella enterica enterica serovar Typhi
ugucgcuggaaaaguaucgcga

SEQ ID NO: 37949 - RNA, 16 nt, Salmonella enterica enterica serovar Typhi
ugucggcucauucuug

SEQ ID NO: 37950 - RNA, 21 nt, Salmonella enterica enterica serovar Typhi
ugucugaccauccugaccggu

SEQ ID NO: 37951 - RNA, 22 nt, Salmonella enterica enterica serovar Typhi
ugucuguacguuuccauuugag

SEQ ID NO: 37952 - RNA, 22 nt, Salmonella enterica enterica serovar Typhi
ugucugucccucggccuugaua

SEQ ID NO: 37953 - RNA, 22 nt, Salmonella enterica enterica serovar Typhi
ugugaauggaaaaacguacgaa

SEQ ID NO: 37954 - RNA, 22 nt, Salmonella enterica enterica serovar Typhi
uguuggacgcgccggacguguc

SEQ ID NO: 37955 - RNA, 18 nt, Salmonella enterica enterica serovar Typhi
uuaaccgccgugaauagc

SEQ ID NO: 37956 - RNA, 22 nt, Salmonella enterica enterica serovar Typhi
uuaacguuugucagcgauuuua

SEQ ID NO: 37957 - RNA, 23 nt, Salmonella enterica enterica serovar Typhi
uuaagcaccacauuggugcaaua

SEQ ID NO: 37958 - RNA, 22 nt, Salmonella enterica enterica serovar Typhi
uuaaucagcaaggcguuggcga

SEQ ID NO: 37959 - RNA, 22 nt, Salmonella enterica enterica serovar Typhi
uuacacuuaaguuggaugauuu

SEQ ID NO: 37960 - RNA, 22 nt, Salmonella enterica enterica serovar Typhi
uuaccguuugccaucuggccgc

SEQ ID NO: 37961 - RNA, 22 nt, Salmonella enterica enterica serovar Typhi
uuacgcgcuuugcguaaggucg

SEQ ID NO: 37962 - RNA, 22 nt, Salmonella enterica enterica serovar Typhi
uuagccagcucaaaggcguaga

SEQ ID NO: 37963 - RNA, 22 nt, Salmonella enterica enterica serovar Typhi
uuagccgggcauucaccgcaca

SEQ ID NO: 37964 - RNA, 22 nt, Salmonella enterica enterica serovar Typhi
uuauccgcaagcugaacgcgcc

SEQ ID NO: 37965 - RNA, 22 nt, Salmonella enterica enterica serovar Typhi
uuauccgggcauuaaaguuucc

SEQ ID NO: 37966 - RNA, 22 nt, Salmonella enterica enterica serovar Typhi
uuaucgacaaauugccguuuac

SEQ ID NO: 37967 - RNA, 21 nt, Salmonella enterica enterica serovar Typhi
uucaaggaaauugccgcuugu

SEQ ID NO: 37968 - RNA, 22 nt, Salmonella enterica enterica serovar Typhi
uucagauacaaaaaacccugcu

SEQ ID NO: 37969 - RNA, 22 nt, Salmonella enterica enterica serovar Typhi
uucagugguaacggugucauug

SEQ ID NO: 37970 - RNA, 22 nt, Salmonella enterica enterica serovar Typhi
uuccgcacaacaguuugagcua

SEQ ID NO: 37971 - RNA, 22 nt, Salmonella enterica enterica serovar Typhi
uuccggcgucauugccguggau

SEQ ID NO: 37972 - RNA, 22 nt, Salmonella enterica enterica serovar Typhi
uucgcgauggugcuggcgaucg

SEQ ID NO: 37973 - RNA, 22 nt, Salmonella enterica enterica serovar Typhi
uucgugagcuacgucaaaaugu

SEQ ID NO: 37974 - RNA, 22 nt, Salmonella enterica enterica serovar Typhi
uucuggcucaguaucaggccgc

SEQ ID NO: 37975 - RNA, 20 nt, Salmonella enterica enterica serovar Typhi
uugaccaucucuuccgcggu

SEQ ID NO: 37976 - RNA, 22 nt, Salmonella enterica enterica serovar Typhi
uugacuuugggucugcgcgucg

SEQ ID NO: 37977 - RNA, 22 nt, Salmonella enterica enterica serovar Typhi
uugaggcgcgguuaaccggcgc

SEQ ID NO: 37978 - RNA, 22 nt, Salmonella enterica enterica serovar Typhi
aggcgaucguugaucauguucc

SEQ ID NO: 37979 - RNA, 22 nt, Salmonella enterica enterica serovar Typhi
aggcgcaucagaaaaaccuccg

SEQ ID NO: 37980 - RNA, 22 nt, Salmonella enterica enterica serovar Typhi
aggcgcauuuccgguauccaua

SEQ ID NO: 37981 - RNA, 23 nt, Salmonella enterica enterica serovar Typhi
agggcgucuggaugaagcauugu

SEQ ID NO: 37982 - RNA, 22 nt, Salmonella enterica enterica serovar Typhi
agggugaugaucagcgccagac

SEQ ID NO: 37983 - RNA, 22 nt, Salmonella enterica enterica serovar Typhi
aggucgccauccggcaaaaugu

SEQ ID NO: 37984 - RNA, 22 nt, Salmonella enterica enterica serovar Typhi
agguuauugccaaucagcacca

SEQ ID NO: 37985 - RNA, 22 nt, Salmonella enterica enterica serovar Typhi
agguucgcggcauguuaaaggg

SEQ ID NO: 37986 - RNA, 22 nt, Salmonella enterica enterica serovar Typhi
aguaccggggauuaccgcggcu

SEQ ID NO: 37987 - RNA, 22 nt, Salmonella enterica enterica serovar Typhi
aguaugguaagcagcuaucuuu

SEQ ID NO: 37988 - RNA, 22 nt, Salmonella enterica enterica serovar Typhi
aguccagggcaaaggugugguu

SEQ ID NO: 37989 - RNA, 22 nt, Salmonella enterica enterica serovar Typhi
aguccguugaagagaucacugg

SEQ ID NO: 37990 - RNA, 22 nt, Salmonella enterica enterica serovar Typhi
agugauuauuacgcagcauaug

SEQ ID NO: 37991 - RNA, 22 nt, Salmonella enterica enterica serovar Typhi
aguuaaugaugaaacuaaggug

SEQ ID NO: 37992 - RNA, 22 nt, Salmonella enterica enterica serovar Typhi
aguuaucaacggaagauuagua

SEQ ID NO: 37993 - RNA, 22 nt, Salmonella enterica enterica serovar Typhi
aguucaaaccguuauuaauuaa

SEQ ID NO: 37994 - RNA, 22 nt, Salmonella enterica enterica serovar Typhi
aguuucucgcugcauauggcgg

SEQ ID NO: 37995 - RNA, 22 nt, Salmonella enterica enterica serovar Typhi
auaacgauaaucucagggguuu

SEQ ID NO: 37996 - RNA, 22 nt, Salmonella enterica enterica serovar Typhi
auaacgguaaauugauugaucg

SEQ ID NO: 37997 - RNA, 22 nt, Salmonella enterica enterica serovar Typhi
auaaucggcugaccagccugcc

SEQ ID NO: 37998 - RNA, 22 nt, Salmonella enterica enterica serovar Typhi
auaccgcuuuggcggcgaacug

SEQ ID NO: 37999 - RNA, 22 nt, Salmonella enterica enterica serovar Typhi
auacgcaucaggcgcugacgaa

SEQ ID NO: 38000 - RNA, 22 nt, Salmonella enterica enterica serovar Typhi
auacuuacaugacuaaugagac

SEQ ID NO: 38001 - RNA, 22 nt, Salmonella enterica enterica serovar Typhi
auagagauugggcgcguggaga

SEQ ID NO: 38002 - RNA, 22 nt, Salmonella enterica enterica serovar Typhi
auaggccaguacguucgaaucg

SEQ ID NO: 38003 - RNA, 22 nt, Salmonella enterica enterica serovar Typhi
auagguggcguaaaauccgaac

SEQ ID NO: 38004 - RNA, 22 nt, Salmonella enterica enterica serovar Typhi
auauagugucaaacagucucga

SEQ ID NO: 38005 - RNA, 21 nt, Salmonella enterica enterica serovar Typhi
auaucgagucauuucgcggcg

SEQ ID NO: 38006 - RNA, 21 nt, Salmonella enterica enterica serovar Typhi
aucagcaacugaccgagcucg

SEQ ID NO: 38007 - RNA, 22 nt, Salmonella enterica enterica serovar Typhi
aucagcaagcgcugugcaaguu

SEQ ID NO: 38008 - RNA, 22 nt, Salmonella enterica enterica serovar Typhi
aucagcguaucuucauuuucgc

SEQ ID NO: 38009 - RNA, 22 nt, Salmonella enterica enterica serovar Typhi
aucaggcagguuugccggauau

SEQ ID NO: 38010 - RNA, 18 nt, Salmonella enterica enterica serovar Typhi
aucaggguggauuccggg

SEQ ID NO: 38011 - RNA, 22 nt, Salmonella enterica enterica serovar Typhi
aucaguuucaggaugaagaccg

SEQ ID NO: 38012 - RNA, 22 nt, Salmonella enterica enterica serovar Typhi
aucaugaugaucacggaugccg

SEQ ID NO: 38013 - RNA, 22 nt, Salmonella enterica enterica serovar Typhi
auccaucugaccuuuguccugu

SEQ ID NO: 38014 - RNA, 22 nt, Salmonella enterica enterica serovar Typhi
aucccgccagcgaaagcgucug

SEQ ID NO: 38015 - RNA, 22 nt, Salmonella enterica enterica serovar Typhi
aucccgcgacgacccguucgau

SEQ ID NO: 38016 - RNA, 22 nt, Salmonella enterica enterica serovar Typhi
auccgcagauccagcacggccu

SEQ ID NO: 38017 - RNA, 22 nt, Salmonella enterica enterica serovar Typhi
auccgcguuuauugauaugccg

SEQ ID NO: 38018 - RNA, 22 nt, Salmonella enterica enterica serovar Typhi
auccgcugcgcauugguuuauc

SEQ ID NO: 38019 - RNA, 22 nt, Salmonella enterica enterica serovar Typhi
auccggacgacuuacagcgggu

SEQ ID NO: 38020 - RNA, 22 nt, Salmonella enterica enterica serovar Typhi
auccggguaacuaugaugagua

SEQ ID NO: 38021 - RNA, 23 nt, Salmonella enterica enterica serovar Typhi
auccgugacauuacucguuuacc

SEQ ID NO: 38022 - RNA, 22 nt, Salmonella enterica enterica serovar Typhi
auccuuaucuggucagcggcga

SEQ ID NO: 38023 - RNA, 21 nt, Salmonella enterica enterica serovar Typhi
aucgaaggucacugcaaauug

SEQ ID NO: 38024 - RNA, 22 nt, Salmonella enterica enterica serovar Typhi
aucgcagauagcaaaaaagcgc

SEQ ID NO: 38025 - RNA, 22 nt, Salmonella enterica enterica serovar Typhi
aucgccaucuuaugcuuuuucu

SEQ ID NO: 38026 - RNA, 22 nt, Salmonella enterica enterica serovar Typhi
aucgcccgcgauauccuuaccu

SEQ ID NO: 38027 - RNA, 21 nt, Salmonella enterica enterica serovar Typhi
aucgcccuaugaugccgagga

SEQ ID NO: 38028 - RNA, 21 nt, Salmonella enterica enterica serovar Typhi
aucgccgguuucugccgcggu

SEQ ID NO: 38029 - RNA, 22 nt, Salmonella enterica enterica serovar Typhi
aucgcuggucaguuugcuguac

SEQ ID NO: 38030 - RNA, 22 nt, Salmonella enterica enterica serovar Typhi
aucgguugauuaacggugguau

SEQ ID NO: 38031 - RNA, 22 nt, Salmonella enterica enterica serovar Typhi
aucgucaucuuuaccagcgaca

SEQ ID NO: 38032 - RNA, 22 nt, Salmonella enterica enterica serovar Typhi
aucgucaugcuguggcuggucg

SEQ ID NO: 38033 - RNA, 22 nt, Salmonella enterica enterica serovar Typhi
aucguugcauuuauggauaacg

SEQ ID NO: 38034 - RNA, 22 nt, Salmonella enterica enterica serovar Typhi
aucugcuucaugcguuucuuac

SEQ ID NO: 38035 - RNA, 22 nt, Salmonella enterica enterica serovar Typhi
aucugguugaauuugaucagga

SEQ ID NO: 38036 - RNA, 22 nt, Salmonella enterica enterica serovar Typhi
augacaacauuaaaugggagaa

SEQ ID NO: 38037 - RNA, 22 nt, Salmonella enterica enterica serovar Typhi
augaccguuuugauaucagugu

SEQ ID NO: 38038 - RNA, 22 nt, Salmonella enterica enterica serovar Typhi
augacgguaacauuuuguuggc

SEQ ID NO: 38039 - RNA, 22 nt, Salmonella enterica enterica serovar Typhi
augagcugaccacugacgaaaa

SEQ ID NO: 38040 - RNA, 22 nt, Salmonella enterica enterica serovar Typhi
augagucuuaccgagcgcguug

SEQ ID NO: 38041 - RNA, 22 nt, Salmonella enterica enterica serovar Typhi
augauaccuuguucugacagca

SEQ ID NO: 38042 - RNA, 22 nt, Salmonella enterica enterica serovar Typhi
augccgggucggugccuucugc

SEQ ID NO: 38043 - RNA, 22 nt, Salmonella enterica enterica serovar Typhi
augcgcuguacaaugucgcgau

SEQ ID NO: 38044 - RNA, 22 nt, Salmonella enterica enterica serovar Typhi
auggcagcauuaugggcauuaa

SEQ ID NO: 38045 - RNA, 22 nt, Salmonella enterica enterica serovar Typhi
auggcgcugcgcuuaucaggcc

SEQ ID NO: 38046 - RNA, 20 nt, Salmonella enterica enterica serovar Typhi
auggcguuaucagccgcgcu

SEQ ID NO: 38047 - RNA, 22 nt, Salmonella enterica enterica serovar Typhi
auggcguuguauuauugagguu

SEQ ID NO: 38048 - RNA, 22 nt, Salmonella enterica enterica serovar Typhi
augguucgacgagcgcggcauc

SEQ ID NO: 38049 - RNA, 22 nt, Salmonella enterica enterica serovar Typhi
augugaauuacguugcgauagg

SEQ ID NO: 38050 - RNA, 22 nt, Salmonella enterica enterica serovar Typhi
cgauauucacggcuguuuuuca

SEQ ID NO: 38051 - RNA, 23 nt, Salmonella enterica enterica serovar Typhi
cgcaauuuacucucagucgcggc

SEQ ID NO: 38052 - RNA, 22 nt, Salmonella enterica enterica serovar Typhi
cgcaggauacgaaacgggugcu

SEQ ID NO: 38053 - RNA, 23 nt, Salmonella enterica enterica serovar Typhi
cgcauaucugccuguucugcuau

SEQ ID NO: 38054 - RNA, 20 nt, Salmonella enterica enterica serovar Typhi
cgccaaagaaaaacgccugu

SEQ ID NO: 38055 - RNA, 22 nt, Salmonella enterica enterica serovar Typhi
cgccagucaggauugcgaggac

SEQ ID NO: 38056 - RNA, 22 nt, Salmonella enterica enterica serovar Typhi
cgccaucacguuaauacucaau

SEQ ID NO: 38057 - RNA, 17 nt, Salmonella enterica enterica serovar Typhi
cgccauuuugcaacugg

SEQ ID NO: 38058 - RNA, 22 nt, Salmonella enterica enterica serovar Typhi
cgcccguagcgaucagcuucug

SEQ ID NO: 38059 - RNA, 22 nt, Salmonella enterica enterica serovar Typhi
cgccguugaguaauacggcucc

SEQ ID NO: 38060 - RNA, 22 nt, Salmonella enterica enterica serovar Typhi
cgcgaaugauuuaggggauaaa

SEQ ID NO: 38061 - RNA, 22 nt, Salmonella enterica enterica serovar Typhi
cgcgcagugaggacauauuugu

SEQ ID NO: 38062 - RNA, 22 nt, Salmonella enterica enterica serovar Typhi
cgcggacuucuaguccggcuug

SEQ ID NO: 38063 - RNA, 22 nt, Salmonella enterica enterica serovar Typhi
cgcguuguuaacgaaagcgcug

SEQ ID NO: 38064 - RNA, 22 nt, Salmonella enterica enterica serovar Typhi
cgcuaaggccuuauugugccgc

SEQ ID NO: 38065 - RNA, 22 nt, Salmonella enterica enterica serovar Typhi
cgcuauccgggauguguugaug

SEQ ID NO: 38066 - RNA, 21 nt, Salmonella enterica enterica serovar Typhi
cgcuauucgcgcuaccuuugg

SEQ ID NO: 38067 - RNA, 22 nt, Salmonella enterica enterica serovar Typhi
cgcugauugauuaugauacguu

SEQ ID NO: 38068 - RNA, 23 nt, Salmonella enterica enterica serovar Typhi
cgcuggaugauuuuugucagagc

SEQ ID NO: 38069 - RNA, 22 nt, Salmonella enterica enterica serovar Typhi
cggaacuguuccgucguauucg

SEQ ID NO: 38070 - RNA, 22 nt, Salmonella enterica enterica serovar Typhi
cggacgauuuuggucgcggcga

SEQ ID NO: 38071 - RNA, 22 nt, Salmonella enterica enterica serovar Typhi
cggagcauuaauggugucgcgc

SEQ ID NO: 38072 - RNA, 22 nt, Salmonella enterica enterica serovar Typhi
cggaggauauuuauuuuaugcg

SEQ ID NO: 38073 - RNA, 22 nt, Salmonella enterica enterica serovar Typhi
cggauaagcauagcgccauccg

SEQ ID NO: 38074 - RNA, 20 nt, Salmonella enterica enterica serovar Typhi
cggauggcgacguggcagcg

SEQ ID NO: 38075 - RNA, 22 nt, Salmonella enterica enterica serovar Typhi
cggauggcgcuaugcuuauccg

SEQ ID NO: 38076 - RNA, 22 nt, Salmonella enterica enterica serovar Typhi
cggauguauuugacugcgcgcu

SEQ ID NO: 38077 - RNA, 23 nt, Salmonella enterica enterica serovar Typhi
cggcaaauuuuuaccguggaugu

SEQ ID NO: 38078 - RNA, 22 nt, Salmonella enterica enterica serovar Typhi
cggcgagauugucaucgacccg

SEQ ID NO: 38079 - RNA, 22 nt, Salmonella enterica enterica serovar Typhi
cggcgaguacgauagcgccgau

SEQ ID NO: 38080 - RNA, 22 nt, Salmonella enterica enterica serovar Typhi
cggcgaucgucggcauccagau

SEQ ID NO: 38081 - RNA, 22 nt, Salmonella enterica enterica serovar Typhi
cggcgugacagacaccuaucag

SEQ ID NO: 38082 - RNA, 22 nt, Salmonella enterica enterica serovar Typhi
cggcuguaugacgcggugcaau

SEQ ID NO: 38083 - RNA, 21 nt, Salmonella enterica enterica serovar Typhi
cggucguaugcugugcccggg

SEQ ID NO: 38084 - RNA, 22 nt, Salmonella enterica enterica serovar Typhi
cgguuggccggaaacccgcgcg

SEQ ID NO: 38085 - RNA, 23 nt, Salmonella enterica enterica serovar Typhi
cguaauguuaacuggggcuuuuc

SEQ ID NO: 38086 - RNA, 23 nt, Salmonella enterica enterica serovar Typhi
cguauugagauggcuauaauaga

SEQ ID NO: 38087 - RNA, 22 nt, Salmonella enterica enterica serovar Typhi
cgucaagguaaaacgcagguga

SEQ ID NO: 38088 - RNA, 22 nt, Salmonella enterica enterica serovar Typhi
cguccgaaaaaguguuagaucg

SEQ ID NO: 38089 - RNA, 22 nt, Salmonella enterica enterica serovar Typhi
cgucggcauuaaccaggaugau

SEQ ID NO: 38090 - RNA, 22 nt, Salmonella enterica enterica serovar Typhi
cgucuuauccggccuacgagug

SEQ ID NO: 38091 - RNA, 22 nt, Salmonella enterica enterica serovar Typhi
cgugaacaaacugcuguuucuc

SEQ ID NO: 38092 - RNA, 22 nt, Salmonella enterica enterica serovar Typhi
cguguaggcccgguaagcgcag

SEQ ID NO: 38093 - RNA, 22 nt, Salmonella enterica enterica serovar Typhi
cguguaggccggauuaggcgcu

SEQ ID NO: 38094 - RNA, 22 nt, Salmonella enterica enterica serovar Typhi
cguguugcugcgcuggcugaau

SEQ ID NO: 38095 - RNA, 22 nt, Salmonella enterica enterica serovar Typhi
cguugucguaugagcgaucgcu

SEQ ID NO: 38096 - RNA, 22 nt, Salmonella enterica enterica serovar Typhi
cuacgcuuaucaggccuacagg

SEQ ID NO: 38097 - RNA, 22 nt, Salmonella enterica enterica serovar Typhi
cuacguuuaccuggccuacaga

SEQ ID NO: 38098 - RNA, 22 nt, Salmonella enterica enterica serovar Typhi
cucaaugcuaacuacgcgaugg

SEQ ID NO: 38099 - RNA, 22 nt, Salmonella enterica enterica serovar Typhi
cucaguaagggaauagugugau

SEQ ID NO: 38100 - RNA, 22 nt, Salmonella enterica enterica serovar Typhi
cucauuuagcgcucgcguuuug

SEQ ID NO: 38101 - RNA, 22 nt, Salmonella enterica enterica serovar Typhi
cuccaguuggcugauguuguau

SEQ ID NO: 38102 - RNA, 22 nt, Salmonella enterica enterica serovar Typhi
cucgaugccugacuucgacguu

SEQ ID NO: 38103 - RNA, 22 nt, Salmonella enterica enterica serovar Typhi
cucgcggacgucgaggaucugg

SEQ ID NO: 38104 - RNA, 22 nt, Salmonella enterica enterica serovar Typhi
cucgcugucggcuaccgcguuc

SEQ ID NO: 38105 - RNA, 22 nt, Salmonella enterica enterica serovar Typhi
cucuugcaggcgccgcuuauug

SEQ ID NO: 38106 - RNA, 22 nt, Salmonella enterica enterica serovar Typhi
cugaccuuugauggcgacauuc

SEQ ID NO: 38107 - RNA, 21 nt, Salmonella enterica enterica serovar Typhi
cugacgccgcuguuuucacuc

SEQ ID NO: 38108 - RNA, 22 nt, Salmonella enterica enterica serovar Typhi
cugaucacuucacuuugcguuc

SEQ ID NO: 38109 - RNA, 22 nt, Salmonella enterica enterica serovar Typhi
cugccguauaucgcgcugggua

SEQ ID NO: 38110 - RNA, 22 nt, Salmonella enterica enterica serovar Typhi
cugcgauagcugcugacguaga

SEQ ID NO: 38111 - RNA, 23 nt, Salmonella enterica enterica serovar Typhi
cugcgcauauuacgccggcguuu

SEQ ID NO: 38112 - RNA, 22 nt, Salmonella enterica enterica serovar Typhi
cugcguaauggacuauggcgcc

SEQ ID NO: 38113 - RNA, 22 nt, Salmonella enterica enterica serovar Typhi
cugcgucaggguggggcgaaua

SEQ ID NO: 38114 - RNA, 22 nt, Salmonella enterica enterica serovar Typhi
cugcuguacauggcugccgcug

SEQ ID NO: 38115 - RNA, 22 nt, Salmonella enterica enterica serovar Typhi
cugcuguuucucgugaugaagg

SEQ ID NO: 38116 - RNA, 22 nt, Salmonella enterica enterica serovar Typhi
cuggaguuuauagauuugcccc

SEQ ID NO: 38117 - RNA, 22 nt, Salmonella enterica enterica serovar Typhi
cuggauuaagcgggcugcgugu

SEQ ID NO: 38118 - RNA, 22 nt, Salmonella enterica enterica serovar Typhi
cuggcaaagaaucguacaugcg

SEQ ID NO: 38119 - RNA, 22 nt, Salmonella enterica enterica serovar Typhi
cuggcaggcgggauggacauua

SEQ ID NO: 38120 - RNA, 18 nt, Salmonella enterica enterica serovar Typhi
cuggcaguagugaaagua

SEQ ID NO: 38121 - RNA, 22 nt, Salmonella enterica enterica serovar Typhi
cuggcagugcgucugauacugc

SEQ ID NO: 38122 - RNA, 22 nt, Salmonella enterica enterica serovar Typhi
gccggucuauaaaauugcgcug

SEQ ID NO: 38123 - RNA, 22 nt, Salmonella enterica enterica serovar Typhi
gccgguuaucaguuuaucggga

SEQ ID NO: 38124 - RNA, 22 nt, Salmonella enterica enterica serovar Typhi
gccguccaccguggcgguggaa

SEQ ID NO: 38125 - RNA, 18 nt, Salmonella enterica enterica serovar Typhi
gccgucugaagugcuggu

SEQ ID NO: 38126 - RNA, 22 nt, Salmonella enterica enterica serovar Typhi
gccguuuauaaguauuacgaca

SEQ ID NO: 38127 - RNA, 22 nt, Salmonella enterica enterica serovar Typhi
gccuucgcgauccagccagacg

SEQ ID NO: 38128 - RNA, 22 nt, Salmonella enterica enterica serovar Typhi
gcgaccguggcggcguaguuau

SEQ ID NO: 38129 - RNA, 22 nt, Salmonella enterica enterica serovar Typhi
gcgagcaaaguaaggcgaaugg

SEQ ID NO: 38130 - RNA, 22 nt, Salmonella enterica enterica serovar Typhi
gcgauccuguucagggaacuca

SEQ ID NO: 38131 - RNA, 22 nt, Salmonella enterica enterica serovar Typhi
gcgaugcgguucaucaacguua

SEQ ID NO: 38132 - RNA, 21 nt, Salmonella enterica enterica serovar Typhi
gcgauucgucaauuggcggua

SEQ ID NO: 38133 - RNA, 22 nt, Salmonella enterica enterica serovar Typhi
gcgauugacgccgacgcuaaag

SEQ ID NO: 38134 - RNA, 22 nt, Salmonella enterica enterica serovar Typhi
gcgauugauaucuggaacguga

SEQ ID NO: 38135 - RNA, 22 nt, Salmonella enterica enterica serovar Typhi
gcgcaaaucagucauagcggcu

SEQ ID NO: 38136 - RNA, 21 nt, Salmonella enterica enterica serovar Typhi
gcgcaucggguuauuguucac

SEQ ID NO: 38137 - RNA, 22 nt, Salmonella enterica enterica serovar Typhi
gcgcgauugauaugaauauauu

SEQ ID NO: 38138 - RNA, 22 nt, Salmonella enterica enterica serovar Typhi
gcgcggaugauggcgucggccg

SEQ ID NO: 38139 - RNA, 22 nt, Salmonella enterica enterica serovar Typhi
gcgcgguuugaugaucuccacc

SEQ ID NO: 38140 - RNA, 22 nt, Salmonella enterica enterica serovar Typhi
gcgcgucagggaagcgagguga

SEQ ID NO: 38141 - RNA, 22 nt, Salmonella enterica enterica serovar Typhi
gcgcuacgauuauccgcccuac

SEQ ID NO: 38142 - RNA, 22 nt, Salmonella enterica enterica serovar Typhi
gcgcuuuaacagcagccgaggu

SEQ ID NO: 38143 - RNA, 18 nt, Salmonella enterica enterica serovar Typhi
gcggauaagcgcagcgcc

SEQ ID NO: 38144 - RNA, 22 nt, Salmonella enterica enterica serovar Typhi
gcgguaauuuaagcggcaaucc

SEQ ID NO: 38145 - RNA, 21 nt, Salmonella enterica enterica serovar Typhi
gcgguucccaguaccacacca

SEQ ID NO: 38146 - RNA, 22 nt, Salmonella enterica enterica serovar Typhi
gcgguugcugcugcgguugaag

SEQ ID NO: 38147 - RNA, 22 nt, Salmonella enterica enterica serovar Typhi
gcgugaauaauguugcucucua

SEQ ID NO: 38148 - RNA, 21 nt, Salmonella enterica enterica serovar Typhi
gcgugaugugguucagcgcgc

SEQ ID NO: 38149 - RNA, 21 nt, Salmonella enterica enterica serovar Typhi
gcguuacgccgcgagcuuggc

SEQ ID NO: 38150 - RNA, 22 nt, Salmonella enterica enterica serovar Typhi
gcguugaaguucgucauaucgu

SEQ ID NO: 38151 - RNA, 22 nt, Salmonella enterica enterica serovar Typhi
gcguugacgagucgcugauucu

SEQ ID NO: 38152 - RNA, 22 nt, Salmonella enterica enterica serovar Typhi
gcguugcuggaugucgauggcg

SEQ ID NO: 38153 - RNA, 22 nt, Salmonella enterica enterica serovar Typhi
gcuacaccugugaugcccugaa

SEQ ID NO: 38154 - RNA, 22 nt, Salmonella enterica enterica serovar Typhi
gcuacgccuuacccgaccuaca

SEQ ID NO: 38155 - RNA, 22 nt, Salmonella enterica enterica serovar Typhi
gcuagcgcuuaccgggccuaca

SEQ ID NO: 38156 - RNA, 22 nt, Salmonella enterica enterica serovar Typhi
gcuauggagccaaagcgcuggu

SEQ ID NO: 38157 - RNA, 22 nt, Salmonella enterica enterica serovar Typhi
gcucacgguaacucauugcgug

SEQ ID NO: 38158 - RNA, 23 nt, Salmonella enterica enterica serovar Typhi
gcucaucagcgcggguauguuca

SEQ ID NO: 38159 - RNA, 22 nt, Salmonella enterica enterica serovar Typhi
gcucgugcgcauuagucagguu

SEQ ID NO: 38160 - RNA, 22 nt, Salmonella enterica enterica serovar Typhi
gcucugcuugccgcugccgguu

SEQ ID NO: 38161 - RNA, 22 nt, Salmonella enterica enterica serovar Typhi
gcugacgcaacguuauccuuca

SEQ ID NO: 38162 - RNA, 22 nt, Salmonella enterica enterica serovar Typhi
gcugauaagcaggugaucggcc

SEQ ID NO: 38163 - RNA, 22 nt, Salmonella enterica enterica serovar Typhi
gcugaucagcugcauuggguuc

SEQ ID NO: 38164 - RNA, 22 nt, Salmonella enterica enterica serovar Typhi
gcugcggauuuuuaacgccugg

SEQ ID NO: 38165 - RNA, 22 nt, Salmonella enterica enterica serovar Typhi
gcuggaaauacuaucauucuca

SEQ ID NO: 38166 - RNA, 22 nt, Salmonella enterica enterica serovar Typhi
gcuggcaagauggaagguacgu

SEQ ID NO: 38167 - RNA, 22 nt, Salmonella enterica enterica serovar Typhi
gcuucguauauggcgcguaucg

SEQ ID NO: 38168 - RNA, 22 nt, Salmonella enterica enterica serovar Typhi
gcuuucaggccuccuggugugg

SEQ ID NO: 38169 - RNA, 23 nt, Salmonella enterica enterica serovar Typhi
gcuuucgcaggugagcguaugca

SEQ ID NO: 38170 - RNA, 22 nt, Salmonella enterica enterica serovar Typhi
gcuuucugcgcgcacgccggag

SEQ ID NO: 38171 - RNA, 22 nt, Salmonella enterica enterica serovar Typhi
gcuuugcggaucaggcccccau

SEQ ID NO: 38172 - RNA, 22 nt, Salmonella enterica enterica serovar Typhi
ggaaccauuuugacuuuacgaa

SEQ ID NO: 38173 - RNA, 22 nt, Salmonella enterica enterica serovar Typhi
ggaaucaacgcgaccaggcgcg

SEQ ID NO: 38174 - RNA, 20 nt, Salmonella enterica enterica serovar Typhi
ggacggauugaccgucgucg

SEQ ID NO: 38175 - RNA, 22 nt, Salmonella enterica enterica serovar Typhi
ggacguugaccucgaugguccg

SEQ ID NO: 38176 - RNA, 22 nt, Salmonella enterica enterica serovar Typhi
ggagccugcaucgucggcgcgc

SEQ ID NO: 38177 - RNA, 22 nt, Salmonella enterica enterica serovar Typhi
ggauaacauaguguaagauccu

SEQ ID NO: 38178 - RNA, 22 nt, Salmonella enterica enterica serovar Typhi
ggauacuugaugccuuuauccg

SEQ ID NO: 38179 - RNA, 22 nt, Salmonella enterica enterica serovar Typhi
ggauuucaugucgacgcaaggg

SEQ ID NO: 38180 - RNA, 22 nt, Salmonella enterica enterica serovar Typhi
ggcaguugcugagcgcguugau

SEQ ID NO: 38181 - RNA, 22 nt, Salmonella enterica enterica serovar Typhi
ggcauuggcgcgcagauucgca

SEQ ID NO: 38182 - RNA, 22 nt, Salmonella enterica enterica serovar Typhi
ggcauuuaucgauggcgcagga

SEQ ID NO: 38183 - RNA, 22 nt, Salmonella enterica enterica serovar Typhi
ggccaguuuucaugaugcggua

SEQ ID NO: 38184 - RNA, 22 nt, Salmonella enterica enterica serovar Typhi
ggccauuaucgcuacaggcgua

SEQ ID NO: 38185 - RNA, 22 nt, Salmonella enterica enterica serovar Typhi
ggcgagguguaagaaagcagaa

SEQ ID NO: 38186 - RNA, 22 nt, Salmonella enterica enterica serovar Typhi
ggcgauaugugugauagcuauc

SEQ ID NO: 38187 - RNA, 22 nt, Salmonella enterica enterica serovar Typhi
ggcgcugacguugcgccauacu

SEQ ID NO: 38188 - RNA, 22 nt, Salmonella enterica enterica serovar Typhi
ggcgcugugcugguaucuguug

SEQ ID NO: 38189 - RNA, 22 nt, Salmonella enterica enterica serovar Typhi
ggcggaauuauugucgucaugc

SEQ ID NO: 38190 - RNA, 22 nt, Salmonella enterica enterica serovar Typhi
ggcggcuacgcuuauccgcuca

SEQ ID NO: 38191 - RNA, 22 nt, Salmonella enterica enterica serovar Typhi
ggcguugaacgagcaguaucag

SEQ ID NO: 38192 - RNA, 22 nt, Salmonella enterica enterica serovar Typhi
ggcucuauuugcgcacgcagau

SEQ ID NO: 38193 - RNA, 20 nt, Salmonella enterica enterica serovar Typhi
ggcuucaucggugaggagau

SEQ ID NO: 38194 - RNA, 22 nt, Salmonella enterica enterica serovar Typhi
uaccgcgguggucacggcgauu

SEQ ID NO: 38195 - RNA, 22 nt, Salmonella enterica enterica serovar Typhi
uaccguguauggaggcgauagc

SEQ ID NO: 38196 - RNA, 21 nt, Salmonella enterica enterica serovar Typhi
uacgacgcacuuuaugagguc

SEQ ID NO: 38197 - RNA, 22 nt, Salmonella enterica enterica serovar Typhi
uacgacgcacuuuaugaggucc

SEQ ID NO: 38198 - RNA, 22 nt, Salmonella enterica enterica serovar Typhi
uacgaggucaacggcgcggaca

SEQ ID NO: 38199 - RNA, 22 nt, Salmonella enterica enterica serovar Typhi
uacgcauauggcggaucuggau

SEQ ID NO: 38200 - RNA, 22 nt, Salmonella enterica enterica serovar Typhi
uacgccgcgaccacgccgaucg

SEQ ID NO: 38201 - RNA, 22 nt, Salmonella enterica enterica serovar Typhi
uagcaccagcaaaacccgcucc

SEQ ID NO: 38202 - RNA, 22 nt, Salmonella enterica enterica serovar Typhi
uagccguggcggacaacggcgc

SEQ ID NO: 38203 - RNA, 21 nt, Salmonella enterica enterica serovar Typhi
uagcuccauuacgaucaccac

SEQ ID NO: 38204 - RNA, 22 nt, Salmonella enterica enterica serovar Typhi
uaggccggauaaggcguuagcc

SEQ ID NO: 38205 - RNA, 22 nt, Salmonella enterica enterica serovar Typhi
uaggccggaugagcguuagcgc

SEQ ID NO: 38206 - RNA, 22 nt, Salmonella enterica enterica serovar Typhi
uaggccugaaagcggcgcguca

SEQ ID NO: 38207 - RNA, 22 nt, Salmonella enterica enterica serovar Typhi
uaggccugauaagguaaagccg

SEQ ID NO: 38208 - RNA, 22 nt, Salmonella enterica enterica serovar Typhi
uagggccgggcagugcucgaaa

SEQ ID NO: 38209 - RNA, 22 nt, Salmonella enterica enterica serovar Typhi
uagggcuuauccggccugcaaa

SEQ ID NO: 38210 - RNA, 20 nt, Salmonella enterica enterica serovar Typhi
uagucuuccuggcauccagc

SEQ ID NO: 38211 - RNA, 22 nt, Salmonella enterica enterica serovar Typhi
uaguugccgccguuuugccgcu

SEQ ID NO: 38212 - RNA, 22 nt, Salmonella enterica enterica serovar Typhi
uauaggcgcuaagcugauccgg

SEQ ID NO: 38213 - RNA, 22 nt, Salmonella enterica enterica serovar Typhi
uaucacagccagaaaagggcua

SEQ ID NO: 38214 - RNA, 22 nt, Salmonella enterica enterica serovar Typhi
uauccgccccugcgucugcgcg

SEQ ID NO: 38215 - RNA, 22 nt, Salmonella enterica enterica serovar Typhi
uaucgccgucgugaugggagcg

SEQ ID NO: 38216 - RNA, 22 nt, Salmonella enterica enterica serovar Typhi
uaucguucguccuggauuaucg

SEQ ID NO: 38217 - RNA, 22 nt, Salmonella enterica enterica serovar Typhi
uaucugcaauaaagguugcccg

SEQ ID NO: 38218 - RNA, 22 nt, Salmonella enterica enterica serovar Typhi
uaucuggcaauuuauugcguug

SEQ ID NO: 38219 - RNA, 22 nt, Salmonella enterica enterica serovar Typhi
uaugaguuugucgaugccgaua

SEQ ID NO: 38220 - RNA, 22 nt, Salmonella enterica enterica serovar Typhi
uauggaugacugugccugcgcu

SEQ ID NO: 38221 - RNA, 22 nt, Salmonella enterica enterica serovar Typhi
uauugcgauaaauucuuguagg

SEQ ID NO: 38222 - RNA, 22 nt, Salmonella enterica enterica serovar Typhi
uauugucggccuggugcuguug

SEQ ID NO: 38223 - RNA, 22 nt, Salmonella enterica enterica serovar Typhi
uauugugcauagagguaagaau

SEQ ID NO: 38224 - RNA, 22 nt, Salmonella enterica enterica serovar Typhi
ucaaucuucauccgcgcgccca

SEQ ID NO: 38225 - RNA, 22 nt, Salmonella enterica enterica serovar Typhi
ucaccgucggcucggcggcgua

SEQ ID NO: 38226 - RNA, 22 nt, Salmonella enterica enterica serovar Typhi
ucacugaugagccagguucugg

SEQ ID NO: 38227 - RNA, 22 nt, Salmonella enterica enterica serovar Typhi
ucacugcaggacaacaguaaaa

SEQ ID NO: 38228 - RNA, 22 nt, Salmonella enterica enterica serovar Typhi
ucagaccuucuucgauuucgcg

SEQ ID NO: 38229 - RNA, 22 nt, Salmonella enterica enterica serovar Typhi
ucagauccagcucuucuucugu

SEQ ID NO: 38230 - RNA, 22 nt, Salmonella enterica enterica serovar Typhi
ucagccgccgacagaugccauu

SEQ ID NO: 38231 - RNA, 22 nt, Salmonella enterica enterica serovar Typhi
ucagcgccugggugucaaucug

SEQ ID NO: 38232 - RNA, 22 nt, Salmonella enterica enterica serovar Typhi
ucagcgcuuucacuuccugguc

SEQ ID NO: 38233 - RNA, 22 nt, Salmonella enterica enterica serovar Typhi
ucaugcgcgccuguuaugcgcu

SEQ ID NO: 38234 - RNA, 22 nt, Salmonella enterica enterica serovar Typhi
ucauggugauacagggugaaua

SEQ ID NO: 38235 - RNA, 22 nt, Salmonella enterica enterica serovar Typhi
ucauuacccgugaugaagaugc

SEQ ID NO: 38236 - RNA, 22 nt, Salmonella enterica enterica serovar Typhi
uccagcaaaaaucuuucuuugg

SEQ ID NO: 38237 - RNA, 21 nt, Salmonella enterica enterica serovar Typhi
uccagcacuugcuucauugcu

SEQ ID NO: 38238 - RNA, 22 nt, Salmonella enterica enterica serovar Typhi
uccagcgugccguagcgcugcc

SEQ ID NO: 38239 - RNA, 22 nt, Salmonella enterica enterica serovar Typhi
uccagguuuuugcacaacguuu

SEQ ID NO: 38240 - RNA, 22 nt, Salmonella enterica enterica serovar Typhi
uccaugauuuugucuggugcca

SEQ ID NO: 38241 - RNA, 22 nt, Salmonella enterica enterica serovar Typhi
uccgcaucuucgaagaagaaga

SEQ ID NO: 38242 - RNA, 22 nt, Salmonella enterica enterica serovar Typhi
uccgccaggcgcugaacgucgc

SEQ ID NO: 38243 - RNA, 22 nt, Salmonella enterica enterica serovar Typhi
uccggcgucauggggcgcaggc

SEQ ID NO: 38244 - RNA, 22 nt, Salmonella enterica enterica serovar Typhi
uccggcuuuuggucugcugauc

SEQ ID NO: 38245 - RNA, 22 nt, Salmonella enterica enterica serovar Typhi
uccgggcucauauuaucaaggu

SEQ ID NO: 38246 - RNA, 22 nt, Salmonella enterica enterica serovar Typhi
uccguaaccgucuggcggaguc

SEQ ID NO: 38247 - RNA, 22 nt, Salmonella enterica enterica serovar Typhi
uccugaccugaugcgcgagaag

SEQ ID NO: 38248 - RNA, 17 nt, Salmonella enterica enterica serovar Typhi
uccuggaacgccgcauc

SEQ ID NO: 38249 - RNA, 22 nt, Salmonella enterica enterica serovar Typhi
ucgacacgguggugaucguucu

SEQ ID NO: 38250 - RNA, 22 nt, Salmonella enterica enterica serovar Typhi
ucgacgaacugcaagagcggau

SEQ ID NO: 38251 - RNA, 18 nt, Salmonella enterica enterica serovar Typhi
ucgacguguuugucgguc

SEQ ID NO: 38252 - RNA, 22 nt, Salmonella enterica enterica serovar Typhi
ucgaugcugacgguauccugca

SEQ ID NO: 38253 - RNA, 22 nt, Salmonella enterica enterica serovar Typhi
ucgccgacuaauucaggaucaa

SEQ ID NO: 38254 - RNA, 21 nt, Salmonella enterica enterica serovar Typhi
ucgccgcagccagcucacgcc

SEQ ID NO: 38255 - RNA, 22 nt, Salmonella enterica enterica serovar Typhi
ucgccggugaugugagcaccgg

SEQ ID NO: 38256 - RNA, 22 nt, Salmonella enterica enterica serovar Typhi
ucgcgcaaauuauguauaugca

SEQ ID NO: 38257 - RNA, 22 nt, Salmonella enterica enterica serovar Typhi
ucgcguuuauuaaacaguggca

SEQ ID NO: 38258 - RNA, 22 nt, Salmonella enterica enterica serovar Typhi
ucgcuaucaggaugaggaccgc

SEQ ID NO: 38259 - RNA, 22 nt, Salmonella enterica enterica serovar Typhi
ucgcucaagcuggaugacaauc

SEQ ID NO: 38260 - RNA, 22 nt, Salmonella enterica enterica serovar Typhi
ucgcucagcgucugggaggcua

SEQ ID NO: 38261 - RNA, 23 nt, Salmonella enterica enterica serovar Typhi
ucgcucauacacucgguaaugca

SEQ ID NO: 38262 - RNA, 22 nt, Salmonella enterica enterica serovar Typhi
ucggcagaaaagucgagcugcg

SEQ ID NO: 38263 - RNA, 22 nt, Salmonella enterica enterica serovar Typhi
ucggcagcgaaaaauucacugc

SEQ ID NO: 38264 - RNA, 22 nt, Salmonella enterica enterica serovar Typhi
ucggccuggccaggcgcucuau

SEQ ID NO: 38265 - RNA, 22 nt, Salmonella enterica enterica serovar Typhi
ucggcguaguacuuauccugaa

SEQ ID NO: 38266 - RNA, 22 nt, Salmonella enterica enterica serovar Typhi
uggcucuuuugcggcguggaau

SEQ ID NO: 38267 - RNA, 23 nt, Salmonella enterica enterica serovar Typhi
uggcugucauagggcugaucgcc

SEQ ID NO: 38268 - RNA, 22 nt, Salmonella enterica enterica serovar Typhi
ugguaaagcaaucgucaaaacc

SEQ ID NO: 38269 - RNA, 22 nt, Salmonella enterica enterica serovar Typhi
ugguacugcagucagcaucauu

SEQ ID NO: 38270 - RNA, 22 nt, Salmonella enterica enterica serovar Typhi
ugguaucaacgauagcaaauac

SEQ ID NO: 38271 - RNA, 22 nt, Salmonella enterica enterica serovar Typhi
uggucaaacuggcggagacgaa

SEQ ID NO: 38272 - RNA, 22 nt, Salmonella enterica enterica serovar Typhi
uggucacccaggaugucgcauu

SEQ ID NO: 38273 - RNA, 22 nt, Salmonella enterica enterica serovar Typhi
uggugccgcccgccuggcagaa

SEQ ID NO: 38274 - RNA, 22 nt, Salmonella enterica enterica serovar Typhi
ugguuuaaaguggcaaugaagg

SEQ ID NO: 38275 - RNA, 22 nt, Salmonella enterica enterica serovar Typhi
uguaggcagcauaagcguuagc

SEQ ID NO: 38276 - RNA, 22 nt, Salmonella enterica enterica serovar Typhi
uguaggccggauaagacgcguu

SEQ ID NO: 38277 - RNA, 20 nt, Salmonella enterica enterica serovar Typhi
uguccgacuguuaacguaaa

SEQ ID NO: 38278 - RNA, 22 nt, Salmonella enterica enterica serovar Typhi
ugucgcagccgauaucgcuaug

SEQ ID NO: 38279 - RNA, 21 nt, Salmonella enterica enterica serovar Typhi
ugucgcaguuaccgccguucc

SEQ ID NO: 38280 - RNA, 22 nt, Salmonella enterica enterica serovar Typhi
ugucggucggguaagcgcuagc

SEQ ID NO: 38281 - RNA, 22 nt, Salmonella enterica enterica serovar Typhi
ugucugaacggagaaaaggugc

SEQ ID NO: 38282 - RNA, 22 nt, Salmonella enterica enterica serovar Typhi
ugugaccauuaucgggcaauca

SEQ ID NO: 38283 - RNA, 20 nt, Salmonella enterica enterica serovar Typhi
ugugccgauuauucgcgcua

SEQ ID NO: 38284 - RNA, 22 nt, Salmonella enterica enterica serovar Typhi
ugugccgccaguacgaugcgca

SEQ ID NO: 38285 - RNA, 20 nt, Salmonella enterica enterica serovar Typhi
uguggaaaaccugguuuauc

SEQ ID NO: 38286 - RNA, 18 nt, Salmonella enterica enterica serovar Typhi
uguggcgccugcagcguc

SEQ ID NO: 38287 - RNA, 22 nt, Salmonella enterica enterica serovar Typhi
uguucacacuguucaccucugg

SEQ ID NO: 38288 - RNA, 23 nt, Salmonella enterica enterica serovar Typhi
uguugcgcagaucauauucacau

SEQ ID NO: 38289 - RNA, 20 nt, Salmonella enterica enterica serovar Typhi
uguuuacgcgggacauuuua

SEQ ID NO: 38290 - RNA, 22 nt, Salmonella enterica enterica serovar Typhi
uuaaucacuuuggcgcugauaa

SEQ ID NO: 38291 - RNA, 22 nt, Salmonella enterica enterica serovar Typhi
uuaaugguauccaucaugcggu

SEQ ID NO: 38292 - RNA, 22 nt, Salmonella enterica enterica serovar Typhi
uuacacaugcucgcgcucagca

SEQ ID NO: 38293 - RNA, 22 nt, Salmonella enterica enterica serovar Typhi
uuaccaccaugaugguaaucau

SEQ ID NO: 38294 - RNA, 22 nt, Salmonella enterica enterica serovar Typhi
uuacgccaucucuucuggcggc

SEQ ID NO: 38295 - RNA, 22 nt, Salmonella enterica enterica serovar Typhi
uuacgcgggcaacgagcacaac

SEQ ID NO: 38296 - RNA, 22 nt, Salmonella enterica enterica serovar Typhi
uuagcgccgguauuuuuggcgg

SEQ ID NO: 38297 - RNA, 22 nt, Salmonella enterica enterica serovar Typhi
uuagcguuacgcuacugucucc

SEQ ID NO: 38298 - RNA, 22 nt, Salmonella enterica enterica serovar Typhi
uuaucagucuacaaauuacuuu

SEQ ID NO: 38299 - RNA, 21 nt, Salmonella enterica enterica serovar Typhi
uuauccggccuacaaacccaa

SEQ ID NO: 38300 - RNA, 22 nt, Salmonella enterica enterica serovar Typhi
uucagcaugguacguacauauu

SEQ ID NO: 38301 - RNA, 22 nt, Salmonella enterica enterica serovar Typhi
uucagccguuuucaggacgcug

SEQ ID NO: 38302 - RNA, 20 nt, Salmonella enterica enterica serovar Typhi
uucaggucgaugucaucaau

SEQ ID NO: 38303 - RNA, 22 nt, Salmonella enterica enterica serovar Typhi
uucauuacuuugaauggcggaa

SEQ ID NO: 38304 - RNA, 22 nt, Salmonella enterica enterica serovar Typhi
uuccaggcuucuauguuggcuu

SEQ ID NO: 38305 - RNA, 22 nt, Salmonella enterica enterica serovar Typhi
uuccgcgauucaggaaguggag

SEQ ID NO: 38306 - RNA, 22 nt, Salmonella enterica enterica serovar Typhi
uuccgguauugguaaaucaggu

SEQ ID NO: 38307 - RNA, 22 nt, Salmonella enterica enterica serovar Typhi
uucuaacaaaacuaauguugag

SEQ ID NO: 38308 - RNA, 22 nt, Salmonella enterica enterica serovar Typhi
uucugcugcaaaaaacguucgg

SEQ ID NO: 38309 - RNA, 22 nt, Salmonella enterica enterica serovar Typhi
uucuggcgucguuuucgccgcc

SEQ ID NO: 38310 - RNA, 22 nt, Salmonella enterica enterica serovar Typhi
uugaagcacuauuuuggugcaa

SEQ ID NO: 38311 - RNA, 22 nt, Salmonella enterica enterica serovar Typhi
uugaccgugcuggcauucgccg

SEQ ID NO: 38312 - RNA, 22 nt, Salmonella enterica enterica serovar Typhi
uugacggcggcuaaaggcguau

SEQ ID NO: 38313 - RNA, 22 nt, Salmonella enterica enterica serovar Typhi
uugaugcuggucuacggcugcg

SEQ ID NO: 38314 - RNA, 22 nt, Salmonella enterica enterica serovar Typhi
uugcaccaaaauagugcuucaa

SEQ ID NO: 38315 - RNA, 22 nt, Salmonella enterica enterica serovar Typhi
uugccaggccugcggcgcguua

SEQ ID NO: 38316 - RNA, 21 nt, Salmonella enterica enterica serovar Typhi
uugcccugaccgaauucuuua

SEQ ID NO: 38317 - RNA, 22 nt, Salmonella enterica enterica serovar Typhi
uugccggucauccaagccgcaa

SEQ ID NO: 38318 - RNA, 22 nt, Salmonella enterica enterica serovar Typhi
uugcggcugucuucgcggcuca

SEQ ID NO: 38319 - RNA, 22 nt, Salmonella enterica enterica serovar Typhi
uugcgggacagcuugucgauau

SEQ ID NO: 38320 - RNA, 22 nt, Salmonella enterica enterica serovar Typhi
uugcugaacaguugccgggcga

SEQ ID NO: 38321 - RNA, 20 nt, Salmonella enterica enterica serovar Typhi
uugcuggccugcucucuacu

SEQ ID NO: 38322 - RNA, 22 nt, Salmonella enterica enterica serovar Typhi
uuggccagauacaccggcguca

SEQ ID NO: 38323 - RNA, 22 nt, Salmonella enterica enterica serovar Typhi
uuggcgacaaagaaauauuugg

SEQ ID NO: 38324 - RNA, 22 nt, Salmonella enterica enterica serovar Typhi
uugucaaucgcacgcucugguu

SEQ ID NO: 38325 - RNA, 22 nt, Salmonella enterica enterica serovar Typhi
uuguccgugcugcugguaauca

SEQ ID NO: 38326 - RNA, 22 nt, Salmonella enterica enterica serovar Typhi
uuguucaaaguguaguaacguu

SEQ ID NO: 38327 - RNA, 22 nt, Salmonella enterica enterica serovar Typhi
uuguucaacagucgguagcuga

SEQ ID NO: 38328 - RNA, 22 nt, Salmonella enterica enterica serovar Typhi
uuuaccguuugauuucaaucgc

SEQ ID NO: 38329 - RNA, 22 nt, Salmonella enterica enterica serovar Typhi
uuuaggucugugccauagcuau

SEQ ID NO: 38330 - RNA, 22 nt, Salmonella enterica enterica serovar Typhi
uuuaucugcggggacguuaugg

SEQ ID NO: 38331 - RNA, 22 nt, Salmonella enterica enterica serovar Typhi
uuuccagaugauucagacaggg

SEQ ID NO: 38332 - RNA, 19 nt, Salmonella enterica enterica serovar Typhi
uuugacgauugcuuuacca

SEQ ID NO: 38333 - RNA, 22 nt, Salmonella enterica enterica serovar Typhi
uuugaugaggugcugaucugcc

SEQ ID NO: 38334 - RNA, 22 nt, Salmonella enterica enterica serovar Typhi
uuuguucaacgacuuguguggc

SEQ ID NO: 38335 - RNA, 22 nt, Salmonella enterica enterica serovar Typhi Ty2
aaacguacuuugcacggcgcau

SEQ ID NO: 38336 - RNA, 22 nt, Salmonella enterica enterica serovar Typhi Ty2
aaagcuggguagcgcgcguugc

SEQ ID NO: 38337 - RNA, 22 nt, Salmonella enterica enterica serovar Typhi Ty2
aaaucgcagguaucguuuccuu

SEQ ID NO: 38338 - RNA, 22 nt, Salmonella enterica enterica serovar Typhi Ty2
agagcggcuuugcuuccaggag

SEQ ID NO: 38339 - RNA, 22 nt, Salmonella enterica enterica serovar Typhi Ty2
agaucgucugcgaaggcugucg

SEQ ID NO: 38340 - RNA, 22 nt, Salmonella enterica enterica serovar Typhi Ty2
agaugcggcuucagguuaauuu

SEQ ID NO: 38341 - RNA, 22 nt, Salmonella enterica enterica serovar Typhi Ty2
agauucaucuaauuugauuacu

SEQ ID NO: 38342 - RNA, 22 nt, Salmonella enterica enterica serovar Typhi Ty2
agauuugcuugaguuguuuagc

SEQ ID NO: 38343 - RNA, 22 nt, Salmonella enterica enterica serovar Typhi Ty2
agcaacaucaggcccuguaaag

SEQ ID NO: 38344 - RNA, 22 nt, Salmonella enterica enterica serovar Typhi Ty2
agcaauaccggccugacgaugc

SEQ ID NO: 38345 - RNA, 22 nt, Salmonella enterica enterica serovar Typhi Ty2
agcaaucgcaagcggaagcgcg

SEQ ID NO: 38346 - RNA, 22 nt, Salmonella enterica enterica serovar Typhi Ty2
agcagcagcgccuucaguuuga

SEQ ID NO: 38347 - RNA, 22 nt, Salmonella enterica enterica serovar Typhi Ty2
agcaggguuucugaauuugguc

SEQ ID NO: 38348 - RNA, 22 nt, Salmonella enterica enterica serovar Typhi Ty2
agcagguuggcgucgcgaagcc

SEQ ID NO: 38349 - RNA, 22 nt, Salmonella enterica enterica serovar Typhi Ty2
agcaguuuaauaagguucuggc

SEQ ID NO: 38350 - RNA, 22 nt, Salmonella enterica enterica serovar Typhi Ty2
agccguuuuccgggucgcgcag

SEQ ID NO: 38351 - RNA, 22 nt, Salmonella enterica enterica serovar Typhi Ty2
agcgacaggaaucugugugagg

SEQ ID NO: 38352 - RNA, 22 nt, Salmonella enterica enterica serovar Typhi Ty2
agcgacgcgcucuucgauguuu

SEQ ID NO: 38353 - RNA, 22 nt, Salmonella enterica enterica serovar Typhi Ty2
agcgacggcgcugccaaguacg

SEQ ID NO: 38354 - RNA, 22 nt, Salmonella enterica enterica serovar Typhi Ty2
agcgccgucuacaaaaaagccc

SEQ ID NO: 38355 - RNA, 22 nt, Salmonella enterica enterica serovar Typhi Ty2
agcgcgaggaacuguugcggau

SEQ ID NO: 38356 - RNA, 22 nt, Salmonella enterica enterica serovar Typhi Ty2
agcgcgguaucgcugagcuccu

SEQ ID NO: 38357 - RNA, 22 nt, Salmonella enterica enterica serovar Typhi Ty2
agcggccugcuggucucauugu

SEQ ID NO: 38358 - RNA, 22 nt, Salmonella enterica enterica serovar Typhi Ty2
agcggguuuuaccauuaccgau

SEQ ID NO: 38359 - RNA, 22 nt, Salmonella enterica enterica serovar Typhi Ty2
agcgucaaaauuucauguauau

SEQ ID NO: 38360 - RNA, 21 nt, Salmonella enterica enterica serovar Typhi Ty2
agcgucaauugccaggagcga

SEQ ID NO: 38361 - RNA, 20 nt, Salmonella enterica enterica serovar Typhi Ty2
agcugcugcgcuuuccaggc

SEQ ID NO: 38362 - RNA, 21 nt, Salmonella enterica enterica serovar Typhi Ty2
agcuggguggcggugucgccg

SEQ ID NO: 38363 - RNA, 22 nt, Salmonella enterica enterica serovar Typhi Ty2
agcuggucgccaguugcguuaa

SEQ ID NO: 38364 - RNA, 22 nt, Salmonella enterica enterica serovar Typhi Ty2
aggaucuuccacugaugauucg

SEQ ID NO: 38365 - RNA, 22 nt, Salmonella enterica enterica serovar Typhi Ty2
aggccgguauuuucuccaucag

SEQ ID NO: 38366 - RNA, 22 nt, Salmonella enterica enterica serovar Typhi Ty2
agggaguuaaaacguacugcgu

SEQ ID NO: 38367 - RNA, 22 nt, Salmonella enterica enterica serovar Typhi Ty2
aggguaucagcagggcaggcuu

SEQ ID NO: 38368 - RNA, 22 nt, Salmonella enterica enterica serovar Typhi Ty2
agguucgcggcauguuaaaggg

SEQ ID NO: 38369 - RNA, 22 nt, Salmonella enterica enterica serovar Typhi Ty2
agguugcugcaccgucaugaga

SEQ ID NO: 38370 - RNA, 22 nt, Salmonella enterica enterica serovar Typhi Ty2
aguaauccucugaaacuucggg

SEQ ID NO: 38371 - RNA, 22 nt, Salmonella enterica enterica serovar Typhi Ty2
aguaugguaagcagcuaucuuu

SEQ ID NO: 38372 - RNA, 22 nt, Salmonella enterica enterica serovar Typhi Ty2
aguccguugaagagaucacugg

SEQ ID NO: 38373 - RNA, 22 nt, Salmonella enterica enterica serovar Typhi Ty2
agucgcuguacugcgcgagcag

SEQ ID NO: 38374 - RNA, 22 nt, Salmonella enterica enterica serovar Typhi Ty2
agucgucuuuugacgaugccca

SEQ ID NO: 38375 - RNA, 22 nt, Salmonella enterica enterica serovar Typhi Ty2
agugagccgucuggauaucgug

SEQ ID NO: 38376 - RNA, 22 nt, Salmonella enterica enterica serovar Typhi Ty2
agugaucagcguguuuuuguug

SEQ ID NO: 38377 - RNA, 22 nt, Salmonella enterica enterica serovar Typhi Ty2
aguggaaucagccaggagucgg

SEQ ID NO: 38378 - RNA, 22 nt, Salmonella enterica enterica serovar Typhi Ty2
aguggauauggcguggcacgag

SEQ ID NO: 38379 - RNA, 22 nt, Salmonella enterica enterica serovar Typhi Ty2
aguggcguacaugguggaaggu

SEQ ID NO: 38380 - RNA, 22 nt, Salmonella enterica enterica serovar Typhi Ty2
aguguugacugccguuuuaguu

SEQ ID NO: 38381 - RNA, 22 nt, Salmonella enterica enterica serovar Typhi Ty2
aguucaaaccguuauuaauuaa

SEQ ID NO: 38382 - RNA, 22 nt, Salmonella enterica enterica serovar Typhi Ty2
aguuccugcgcgccgaugaauc

SEQ ID NO: 38383 - RNA, 22 nt, Salmonella enterica enterica serovar Typhi Ty2
auaacgauaaucucagggguuu

SEQ ID NO: 38384 - RNA, 22 nt, Salmonella enterica enterica serovar Typhi Ty2
auaacgguaaauugauugaucg

SEQ ID NO: 38385 - RNA, 22 nt, Salmonella enterica enterica serovar Typhi Ty2
auaaucggcugaccagccugcc

SEQ ID NO: 38386 - RNA, 23 nt, Salmonella enterica enterica serovar Typhi Ty2
auacagggcggacggguaguaag

SEQ ID NO: 38387 - RNA, 22 nt, Salmonella enterica enterica serovar Typhi Ty2
auaccagcuugaacuacguuua

SEQ ID NO: 38388 - RNA, 19 nt, Salmonella enterica enterica serovar Typhi Ty2
auaccguuggccuugaugu

SEQ ID NO: 38389 - RNA, 22 nt, Salmonella enterica enterica serovar Typhi Ty2
auaccuauaacgaaccgggucg

SEQ ID NO: 38390 - RNA, 22 nt, Salmonella enterica enterica serovar Typhi Ty2
auagccgauuuuuuccggauuc

SEQ ID NO: 38391 - RNA, 22 nt, Salmonella enterica enterica serovar Typhi Ty2
auagguggcguaaaauccgaac

SEQ ID NO: 38392 - RNA, 22 nt, Salmonella enterica enterica serovar Typhi Ty2
auagugucuuauucggcaauug

SEQ ID NO: 38393 - RNA, 22 nt, Salmonella enterica enterica serovar Typhi Ty2
auaucguaaugcgggcgauacc

SEQ ID NO: 38394 - RNA, 22 nt, Salmonella enterica enterica serovar Typhi Ty2
auaucuucgcacaugcuuguaa

SEQ ID NO: 38395 - RNA, 22 nt, Salmonella enterica enterica serovar Typhi Ty2
auaugcuggucgugcgcgaggc

SEQ ID NO: 38396 - RNA, 20 nt, Salmonella enterica enterica serovar Typhi Ty2
aucaaccgucgucugggguu

SEQ ID NO: 38397 - RNA, 22 nt, Salmonella enterica enterica serovar Typhi Ty2
aucaacguuaugauaauaauga

SEQ ID NO: 38398 - RNA, 22 nt, Salmonella enterica enterica serovar Typhi Ty2
aucaagaauuaauauuugcggg

SEQ ID NO: 38399 - RNA, 22 nt, Salmonella enterica enterica serovar Typhi Ty2
aucaccguauuggcgccgcugg

SEQ ID NO: 38400 - RNA, 21 nt, Salmonella enterica enterica serovar Typhi Ty2
aucagcaacugaccgagcucg

SEQ ID NO: 38401 - RNA, 22 nt, Salmonella enterica enterica serovar Typhi Ty2
aucagcaagcgcugugcaaguu

SEQ ID NO: 38402 - RNA, 22 nt, Salmonella enterica enterica serovar Typhi Ty2
aucagcguaucuucauuuucgc

SEQ ID NO: 38403 - RNA, 22 nt, Salmonella enterica enterica serovar Typhi Ty2
aucaggcgguaguaucagggaa

SEQ ID NO: 38404 - RNA, 22 nt, Salmonella enterica enterica serovar Typhi Ty2
aucaucgcgcgcguaaaguuag

SEQ ID NO: 38405 - RNA, 20 nt, Salmonella enterica enterica serovar Typhi Ty2
aucauugcgccgaaccugca

SEQ ID NO: 38406 - RNA, 22 nt, Salmonella enterica enterica serovar Typhi Ty2
aucccgcgacgacccguucgau

SEQ ID NO: 38407 - RNA, 18 nt, Salmonella enterica enterica serovar Typhi Ty2
cagaccaguaaauuaagu

SEQ ID NO: 38408 - RNA, 22 nt, Salmonella enterica enterica serovar Typhi Ty2
cagauagcgccggaaaugauug

SEQ ID NO: 38409 - RNA, 22 nt, Salmonella enterica enterica serovar Typhi Ty2
cagaugagcuucccgcuauuug

SEQ ID NO: 38410 - RNA, 22 nt, Salmonella enterica enterica serovar Typhi Ty2
cagaugccugauccagacgaau

SEQ ID NO: 38411 - RNA, 19 nt, Salmonella enterica enterica serovar Typhi Ty2
cagauuguuguuuaucuca

SEQ ID NO: 38412 - RNA, 21 nt, Salmonella enterica enterica serovar Typhi Ty2
cagcaguucguuguucggcgc

SEQ ID NO: 38413 - RNA, 22 nt, Salmonella enterica enterica serovar Typhi Ty2
cagcgcuacgcgcagauaggca

SEQ ID NO: 38414 - RNA, 22 nt, Salmonella enterica enterica serovar Typhi Ty2
cagcgguagaaaagccagugau

SEQ ID NO: 38415 - RNA, 22 nt, Salmonella enterica enterica serovar Typhi Ty2
cagcucauugguaauaauucuu

SEQ ID NO: 38416 - RNA, 22 nt, Salmonella enterica enterica serovar Typhi Ty2
cagcuccugguccguaaccugg

SEQ ID NO: 38417 - RNA, 21 nt, Salmonella enterica enterica serovar Typhi Ty2
caggacagugagccagaacca

SEQ ID NO: 38418 - RNA, 22 nt, Salmonella enterica enterica serovar Typhi Ty2
caggauguaguugaauuugccu

SEQ ID NO: 38419 - RNA, 22 nt, Salmonella enterica enterica serovar Typhi Ty2
caggcccugcagccgcaggugg

SEQ ID NO: 38420 - RNA, 22 nt, Salmonella enterica enterica serovar Typhi Ty2
cagggcguugauggcuuuggcg

SEQ ID NO: 38421 - RNA, 22 nt, Salmonella enterica enterica serovar Typhi Ty2
cagguuguugggauguuucaga

SEQ ID NO: 38422 - RNA, 22 nt, Salmonella enterica enterica serovar Typhi Ty2
caguauauaucguuucaugcuu

SEQ ID NO: 38423 - RNA, 22 nt, Salmonella enterica enterica serovar Typhi Ty2
cagucgcuggaugacaacgcgc

SEQ ID NO: 38424 - RNA, 22 nt, Salmonella enterica enterica serovar Typhi Ty2
cauaccguggugcagggcauug

SEQ ID NO: 38425 - RNA, 22 nt, Salmonella enterica enterica serovar Typhi Ty2
caucaaugaacagcgugcuaca

SEQ ID NO: 38426 - RNA, 19 nt, Salmonella enterica enterica serovar Typhi Ty2
caucagcguauccgugaag

SEQ ID NO: 38427 - RNA, 21 nt, Salmonella enterica enterica serovar Typhi Ty2
caucauauuuaugagcagggc

SEQ ID NO: 38428 - RNA, 22 nt, Salmonella enterica enterica serovar Typhi Ty2
cauccguggugauuucaucaau

SEQ ID NO: 38429 - RNA, 22 nt, Salmonella enterica enterica serovar Typhi Ty2
caucggcgcuguuucgccagua

SEQ ID NO: 38430 - RNA, 22 nt, Salmonella enterica enterica serovar Typhi Ty2
caucggcuggcggagcgucuuc

SEQ ID NO: 38431 - RNA, 22 nt, Salmonella enterica enterica serovar Typhi Ty2
cauuccuguuuuucgucuguca

SEQ ID NO: 38432 - RNA, 22 nt, Salmonella enterica enterica serovar Typhi Ty2
ccacguuucccgcgcccggacu

SEQ ID NO: 38433 - RNA, 22 nt, Salmonella enterica enterica serovar Typhi Ty2
ccagagauugcuaggugacugu

SEQ ID NO: 38434 - RNA, 22 nt, Salmonella enterica enterica serovar Typhi Ty2
ccagcagcaggaugccgaaagc

SEQ ID NO: 38435 - RNA, 22 nt, Salmonella enterica enterica serovar Typhi Ty2
ccagccagugcgcuaauacuau

SEQ ID NO: 38436 - RNA, 22 nt, Salmonella enterica enterica serovar Typhi Ty2
ccaugcggauguugauaucuuc

SEQ ID NO: 38437 - RNA, 22 nt, Salmonella enterica enterica serovar Typhi Ty2
ccauggcugccuggcgcugacu

SEQ ID NO: 38438 - RNA, 22 nt, Salmonella enterica enterica serovar Typhi Ty2
cccggaaaccaucauggaugcg

SEQ ID NO: 38439 - RNA, 22 nt, Salmonella enterica enterica serovar Typhi Ty2
cccuugcgucaugaaaacgacg

SEQ ID NO: 38440 - RNA, 22 nt, Salmonella enterica enterica serovar Typhi Ty2
ccgaccuggcgucgacggcggc

SEQ ID NO: 38441 - RNA, 22 nt, Salmonella enterica enterica serovar Typhi Ty2
ccgacucuaaagcgauugcuca

SEQ ID NO: 38442 - RNA, 20 nt, Salmonella enterica enterica serovar Typhi Ty2
ccgcgauugccgccugacga

SEQ ID NO: 38443 - RNA, 22 nt, Salmonella enterica enterica serovar Typhi Ty2
ccgcguaugaagagcggugagc

SEQ ID NO: 38444 - RNA, 19 nt, Salmonella enterica enterica serovar Typhi Ty2
ccgcguucauccaugcaga

SEQ ID NO: 38445 - RNA, 22 nt, Salmonella enterica enterica serovar Typhi Ty2
ccggaaagcuugcuguccauac

SEQ ID NO: 38446 - RNA, 22 nt, Salmonella enterica enterica serovar Typhi Ty2
ccggagcagcuucuugcuggcc

SEQ ID NO: 38447 - RNA, 22 nt, Salmonella enterica enterica serovar Typhi Ty2
ccggauaaggcgaagccgccau

SEQ ID NO: 38448 - RNA, 22 nt, Salmonella enterica enterica serovar Typhi Ty2
ccggauaaggcgaagcugccau

SEQ ID NO: 38449 - RNA, 22 nt, Salmonella enterica enterica serovar Typhi Ty2
ccggaugaagucguuaauaagu

SEQ ID NO: 38450 - RNA, 22 nt, Salmonella enterica enterica serovar Typhi Ty2
ccggauggcguguagcgauccg

SEQ ID NO: 38451 - RNA, 22 nt, Salmonella enterica enterica serovar Typhi Ty2
ccggccuacucacugcaacgcg

SEQ ID NO: 38452 - RNA, 22 nt, Salmonella enterica enterica serovar Typhi Ty2
ccgggcaacgggcgaaaaucgc

SEQ ID NO: 38453 - RNA, 22 nt, Salmonella enterica enterica serovar Typhi Ty2
ccgguagcaaacuggugaacgc

SEQ ID NO: 38454 - RNA, 22 nt, Salmonella enterica enterica serovar Typhi Ty2
ccggugaucccaccagcaguug

SEQ ID NO: 38455 - RNA, 22 nt, Salmonella enterica enterica serovar Typhi Ty2
ccguaggccugauaagcgcagc

SEQ ID NO: 38456 - RNA, 22 nt, Salmonella enterica enterica serovar Typhi Ty2
ccguggaaucaggucggcacaa

SEQ ID NO: 38457 - RNA, 21 nt, Salmonella enterica enterica serovar Typhi Ty2
ccguggcuuuauccgcgucga

SEQ ID NO: 38458 - RNA, 19 nt, Salmonella enterica enterica serovar Typhi Ty2
ccguuacuguuuuaucagg

SEQ ID NO: 38459 - RNA, 22 nt, Salmonella enterica enterica serovar Typhi Ty2
ccguucaucuacggcaaacugg

SEQ ID NO: 38460 - RNA, 22 nt, Salmonella enterica enterica serovar Typhi Ty2
ccuguggaauggcggucagauc

SEQ ID NO: 38461 - RNA, 22 nt, Salmonella enterica enterica serovar Typhi Ty2
ccuguuggaaguaccaggcgug

SEQ ID NO: 38462 - RNA, 22 nt, Salmonella enterica enterica serovar Typhi Ty2
cgacgccugcuacagcccugua

SEQ ID NO: 38463 - RNA, 23 nt, Salmonella enterica enterica serovar Typhi Ty2
cgacgcugaacgaacucagcgaa

SEQ ID NO: 38464 - RNA, 23 nt, Salmonella enterica enterica serovar Typhi Ty2
cgaucaaucaauuuaccguuauu

SEQ ID NO: 38465 - RNA, 22 nt, Salmonella enterica enterica serovar Typhi Ty2
cgaugaguugcguuaccgcgaa

SEQ ID NO: 38466 - RNA, 20 nt, Salmonella enterica enterica serovar Typhi Ty2
cgaugccuccggugauauac

SEQ ID NO: 38467 - RNA, 20 nt, Salmonella enterica enterica serovar Typhi Ty2
cgauugauaccuaccguuau

SEQ ID NO: 38468 - RNA, 19 nt, Salmonella enterica enterica serovar Typhi Ty2
cgcaggucaaugguuuuca

SEQ ID NO: 38469 - RNA, 22 nt, Salmonella enterica enterica serovar Typhi Ty2
cgcauauccugugggauuaguc

SEQ ID NO: 38470 - RNA, 17 nt, Salmonella enterica enterica serovar Typhi Ty2
cgccauuuugcaacugg

SEQ ID NO: 38471 - RNA, 22 nt, Salmonella enterica enterica serovar Typhi Ty2
cgcccguagcgaucagcuucug

SEQ ID NO: 38472 - RNA, 22 nt, Salmonella enterica enterica serovar Typhi Ty2
cgccugcugaauuugggcgaac

SEQ ID NO: 38473 - RNA, 18 nt, Salmonella enterica enterica serovar Typhi Ty2
cgccugguaagucgcagg

SEQ ID NO: 38474 - RNA, 22 nt, Salmonella enterica enterica serovar Typhi Ty2
cgcgauggcuuucauuuccagc

SEQ ID NO: 38475 - RNA, 22 nt, Salmonella enterica enterica serovar Typhi Ty2
cgcgaugggcguaaacaucaac

SEQ ID NO: 38476 - RNA, 22 nt, Salmonella enterica enterica serovar Typhi Ty2
cgcgcaagagaggguaacagcg

SEQ ID NO: 38477 - RNA, 22 nt, Salmonella enterica enterica serovar Typhi Ty2
gaccguuaucugcugcugccgc

SEQ ID NO: 38478 - RNA, 22 nt, Salmonella enterica enterica serovar Typhi Ty2
gacgaacauuucguucguuaua

SEQ ID NO: 38479 - RNA, 22 nt, Salmonella enterica enterica serovar Typhi Ty2
gacgcaugauuaaagugcugau

SEQ ID NO: 38480 - RNA, 22 nt, Salmonella enterica enterica serovar Typhi Ty2
gacgccaugaagcguggguaca

SEQ ID NO: 38481 - RNA, 22 nt, Salmonella enterica enterica serovar Typhi Ty2
gacguuucgcuuaucaggccua

SEQ ID NO: 38482 - RNA, 22 nt, Salmonella enterica enterica serovar Typhi Ty2
gacugcugaaccagaacgacgu

SEQ ID NO: 38483 - RNA, 22 nt, Salmonella enterica enterica serovar Typhi Ty2
gacugggugaggcggcuacgcu

SEQ ID NO: 38484 - RNA, 22 nt, Salmonella enterica enterica serovar Typhi Ty2
gacuucauggagucgaguugca

SEQ ID NO: 38485 - RNA, 22 nt, Salmonella enterica enterica serovar Typhi Ty2
gagcguaucggcgauucccugu

SEQ ID NO: 38486 - RNA, 22 nt, Salmonella enterica enterica serovar Typhi Ty2
gagcugcacuggcguaucacgu

SEQ ID NO: 38487 - RNA, 22 nt, Salmonella enterica enterica serovar Typhi Ty2
gagcugguuaacguguuccgcg

SEQ ID NO: 38488 - RNA, 22 nt, Salmonella enterica enterica serovar Typhi Ty2
gagcuucaauacggcgaucggc

SEQ ID NO: 38489 - RNA, 22 nt, Salmonella enterica enterica serovar Typhi Ty2
gaggauuugcacgaugugaaua

SEQ ID NO: 38490 - RNA, 22 nt, Salmonella enterica enterica serovar Typhi Ty2
gaggcguugaaguucuggaauc

SEQ ID NO: 38491 - RNA, 22 nt, Salmonella enterica enterica serovar Typhi Ty2
gagugcgggcuggauauggaau

SEQ ID NO: 38492 - RNA, 22 nt, Salmonella enterica enterica serovar Typhi Ty2
gauaacgguagguaucaaucgc

SEQ ID NO: 38493 - RNA, 22 nt, Salmonella enterica enterica serovar Typhi Ty2
gauaccacguguauucaccuuc

SEQ ID NO: 38494 - RNA, 22 nt, Salmonella enterica enterica serovar Typhi Ty2
gaucaggucgguaaucaauagc

SEQ ID NO: 38495 - RNA, 22 nt, Salmonella enterica enterica serovar Typhi Ty2
gaucgcuaaaacguuuuuaugu

SEQ ID NO: 38496 - RNA, 22 nt, Salmonella enterica enterica serovar Typhi Ty2
gaucgcucagaacucgauuggc

SEQ ID NO: 38497 - RNA, 22 nt, Salmonella enterica enterica serovar Typhi Ty2
gaucugguucccgcugugcagc

SEQ ID NO: 38498 - RNA, 22 nt, Salmonella enterica enterica serovar Typhi Ty2
gaugccggauggcgguuggccu

SEQ ID NO: 38499 - RNA, 22 nt, Salmonella enterica enterica serovar Typhi Ty2
gauggcauuuuugucggcccua

SEQ ID NO: 38500 - RNA, 22 nt, Salmonella enterica enterica serovar Typhi Ty2
gauggugaugaccgucaaugcc

SEQ ID NO: 38501 - RNA, 22 nt, Salmonella enterica enterica serovar Typhi Ty2
gauguauaucguuugcuauaca

SEQ ID NO: 38502 - RNA, 22 nt, Salmonella enterica enterica serovar Typhi Ty2
gauuuccgcaacguggugcugg

SEQ ID NO: 38503 - RNA, 23 nt, Salmonella enterica enterica serovar Typhi Ty2
gcaagcuggcaaguugcaacagc

SEQ ID NO: 38504 - RNA, 22 nt, Salmonella enterica enterica serovar Typhi Ty2
gcaaucgcauguuaugccacug

SEQ ID NO: 38505 - RNA, 22 nt, Salmonella enterica enterica serovar Typhi Ty2
gcaauguugcaaccagagcccu

SEQ ID NO: 38506 - RNA, 22 nt, Salmonella enterica enterica serovar Typhi Ty2
gcagccagauagcgcuugcuaa

SEQ ID NO: 38507 - RNA, 22 nt, Salmonella enterica enterica serovar Typhi Ty2
gcagcguauucucacguucggg

SEQ ID NO: 38508 - RNA, 21 nt, Salmonella enterica enterica serovar Typhi Ty2
gcauguuuuucaccguugugc

SEQ ID NO: 38509 - RNA, 22 nt, Salmonella enterica enterica serovar Typhi Ty2
gcauuucaccgucgaucguuug

SEQ ID NO: 38510 - RNA, 22 nt, Salmonella enterica enterica serovar Typhi Ty2
gccaaugacauaagggauggcc

SEQ ID NO: 38511 - RNA, 23 nt, Salmonella enterica enterica serovar Typhi Ty2
gccaauguauuuaugcgcgcguu

SEQ ID NO: 38512 - RNA, 21 nt, Salmonella enterica enterica serovar Typhi Ty2
gccagccuuuuuuuguauagc

SEQ ID NO: 38513 - RNA, 22 nt, Salmonella enterica enterica serovar Typhi Ty2
gccaggaaguuaugcggguuug

SEQ ID NO: 38514 - RNA, 21 nt, Salmonella enterica enterica serovar Typhi Ty2
gccauggcgggacacagucua

SEQ ID NO: 38515 - RNA, 22 nt, Salmonella enterica enterica serovar Typhi Ty2
gccauugugucucugucuccaa

SEQ ID NO: 38516 - RNA, 19 nt, Salmonella enterica enterica serovar Typhi Ty2
gcccuacguccgcacgcgg

SEQ ID NO: 38517 - RNA, 22 nt, Salmonella enterica enterica serovar Typhi Ty2
gccgauaaagucgugguuaccc

SEQ ID NO: 38518 - RNA, 22 nt, Salmonella enterica enterica serovar Typhi Ty2
gccgaucucuaccugcgcguac

SEQ ID NO: 38519 - RNA, 22 nt, Salmonella enterica enterica serovar Typhi Ty2
gccgccuugcgcaauaucauug

SEQ ID NO: 38520 - RNA, 22 nt, Salmonella enterica enterica serovar Typhi Ty2
gccgcgaaaugacucgauauuc

SEQ ID NO: 38521 - RNA, 22 nt, Salmonella enterica enterica serovar Typhi Ty2
gccgguuaucaguuuaucggga

SEQ ID NO: 38522 - RNA, 22 nt, Salmonella enterica enterica serovar Typhi Ty2
gccguuaucuguuaugccagca

SEQ ID NO: 38523 - RNA, 22 nt, Salmonella enterica enterica serovar Typhi Ty2
gcgaauaauggagauauucuga

SEQ ID NO: 38524 - RNA, 22 nt, Salmonella enterica enterica serovar Typhi Ty2
gcgacgacauuagacauguuca

SEQ ID NO: 38525 - RNA, 22 nt, Salmonella enterica enterica serovar Typhi Ty2
gcgacgcaaagaguacuggaug

SEQ ID NO: 38526 - RNA, 22 nt, Salmonella enterica enterica serovar Typhi Ty2
gcgaugcgguucaucaacguua

SEQ ID NO: 38527 - RNA, 22 nt, Salmonella enterica enterica serovar Typhi Ty2
gcgauugacgccgacgcuaaag

SEQ ID NO: 38528 - RNA, 22 nt, Salmonella enterica enterica serovar Typhi Ty2
gcgcaccagaucaucgcuguga

SEQ ID NO: 38529 - RNA, 22 nt, Salmonella enterica enterica serovar Typhi Ty2
gcgcaggaaaguauugcggagc

SEQ ID NO: 38530 - RNA, 22 nt, Salmonella enterica enterica serovar Typhi Ty2
gcgcauccuccaguuggcuguu

SEQ ID NO: 38531 - RNA, 22 nt, Salmonella enterica enterica serovar Typhi Ty2
gcgcgauugauaugaauauauu

SEQ ID NO: 38532 - RNA, 22 nt, Salmonella enterica enterica serovar Typhi Ty2
gcgcgcaugauuauucccgccg

SEQ ID NO: 38533 - RNA, 22 nt, Salmonella enterica enterica serovar Typhi Ty2
gcgcggaugauggcgucggccg

SEQ ID NO: 38534 - RNA, 22 nt, Salmonella enterica enterica serovar Typhi Ty2
gcgcuacgauuauccgcccuac

SEQ ID NO: 38535 - RNA, 21 nt, Salmonella enterica enterica serovar Typhi Ty2
gcgcugauggucgugccgcuc

SEQ ID NO: 38536 - RNA, 22 nt, Salmonella enterica enterica serovar Typhi Ty2
gcgcuggaaagcggcaggugau

SEQ ID NO: 38537 - RNA, 22 nt, Salmonella enterica enterica serovar Typhi Ty2
gcgcuuuaacagcagccgaggu

SEQ ID NO: 38538 - RNA, 22 nt, Salmonella enterica enterica serovar Typhi Ty2
gcggaacugaaaaaauuugguu

SEQ ID NO: 38539 - RNA, 22 nt, Salmonella enterica enterica serovar Typhi Ty2
gcgguaauuuaagcggcaaucc

SEQ ID NO: 38540 - RNA, 22 nt, Salmonella enterica enterica serovar Typhi Ty2
gcgguugcugcugcgguugaag

SEQ ID NO: 38541 - RNA, 22 nt, Salmonella enterica enterica serovar Typhi Ty2
gcguaggcccgccauucggcau

SEQ ID NO: 38542 - RNA, 22 nt, Salmonella enterica enterica serovar Typhi Ty2
gcguugaaguucgucauaucgu

SEQ ID NO: 38543 - RNA, 22 nt, Salmonella enterica enterica serovar Typhi Ty2
gcuagcgcuuaccgggccuaca

SEQ ID NO: 38544 - RNA, 22 nt, Salmonella enterica enterica serovar Typhi Ty2
gcuauugauuuuccggaugagg

SEQ ID NO: 38545 - RNA, 22 nt, Salmonella enterica enterica serovar Typhi Ty2
gcucacgguaacucauugcgug

SEQ ID NO: 38546 - RNA, 22 nt, Salmonella enterica enterica serovar Typhi Ty2
gucccguuacccuuuuucaggu

SEQ ID NO: 38547 - RNA, 22 nt, Salmonella enterica enterica serovar Typhi Ty2
gucgagaauauggcguaccaac

SEQ ID NO: 38548 - RNA, 22 nt, Salmonella enterica enterica serovar Typhi Ty2
gucgauacgcagauaguggcgg

SEQ ID NO: 38549 - RNA, 22 nt, Salmonella enterica enterica serovar Typhi Ty2
gucgcugguaaagaugacgaug

SEQ ID NO: 38550 - RNA, 22 nt, Salmonella enterica enterica serovar Typhi Ty2
gucugaugagcgccggauucug

SEQ ID NO: 38551 - RNA, 22 nt, Salmonella enterica enterica serovar Typhi Ty2
gucugcccgcagacauggucgu

SEQ ID NO: 38552 - RNA, 22 nt, Salmonella enterica enterica serovar Typhi Ty2
gugaaucggcaugagaguguga

SEQ ID NO: 38553 - RNA, 22 nt, Salmonella enterica enterica serovar Typhi Ty2
gugacgauuauuacugacauuu

SEQ ID NO: 38554 - RNA, 22 nt, Salmonella enterica enterica serovar Typhi Ty2
gugauuaccguacaaggacauu

SEQ ID NO: 38555 - RNA, 22 nt, Salmonella enterica enterica serovar Typhi Ty2
gugcgaaugcgcgacuugccga

SEQ ID NO: 38556 - RNA, 22 nt, Salmonella enterica enterica serovar Typhi Ty2
gugcgccauauucucgacuggg

SEQ ID NO: 38557 - RNA, 22 nt, Salmonella enterica enterica serovar Typhi Ty2
gugcgcuucuucaccgaacaga

SEQ ID NO: 38558 - RNA, 22 nt, Salmonella enterica enterica serovar Typhi Ty2
guggcgauaaacagaucgcccg

SEQ ID NO: 38559 - RNA, 22 nt, Salmonella enterica enterica serovar Typhi Ty2
gugguaauuagugaggauggcg

SEQ ID NO: 38560 - RNA, 22 nt, Salmonella enterica enterica serovar Typhi Ty2
gugguuaaucaacgugacuucg

SEQ ID NO: 38561 - RNA, 22 nt, Salmonella enterica enterica serovar Typhi Ty2
guuaccagguucugcucaccgc

SEQ ID NO: 38562 - RNA, 22 nt, Salmonella enterica enterica serovar Typhi Ty2
guuacugucggcgauauagcgc

SEQ ID NO: 38563 - RNA, 22 nt, Salmonella enterica enterica serovar Typhi Ty2
guuagcgcgggaaaaucugcgg

SEQ ID NO: 38564 - RNA, 22 nt, Salmonella enterica enterica serovar Typhi Ty2
guucgaaaucccagguugccca

SEQ ID NO: 38565 - RNA, 22 nt, Salmonella enterica enterica serovar Typhi Ty2
guugaucugcuuugccgaaauc

SEQ ID NO: 38566 - RNA, 22 nt, Salmonella enterica enterica serovar Typhi Ty2
guugccgcacgggcagaagcag

SEQ ID NO: 38567 - RNA, 21 nt, Salmonella enterica enterica serovar Typhi Ty2
guugugccgccggcgaagcuu

SEQ ID NO: 38568 - RNA, 22 nt, Salmonella enterica enterica serovar Typhi Ty2
guuugcaacgguuccgguagua

SEQ ID NO: 38569 - RNA, 22 nt, Salmonella enterica enterica serovar Typhi Ty2
uaaagcaauauucgguuuaacu

SEQ ID NO: 38570 - RNA, 22 nt, Salmonella enterica enterica serovar Typhi Ty2
uaacaacggagaacaguaucuu

SEQ ID NO: 38571 - RNA, 22 nt, Salmonella enterica enterica serovar Typhi Ty2
uaacagccccagcccuggcgua

SEQ ID NO: 38572 - RNA, 22 nt, Salmonella enterica enterica serovar Typhi Ty2
uaacggcuaugggaaggaugug

SEQ ID NO: 38573 - RNA, 22 nt, Salmonella enterica enterica serovar Typhi Ty2
uaacgguagugauuauacgacc

SEQ ID NO: 38574 - RNA, 22 nt, Salmonella enterica enterica serovar Typhi Ty2
uaagagauaaagaccgaggcga

SEQ ID NO: 38575 - RNA, 22 nt, Salmonella enterica enterica serovar Typhi Ty2
uaaugccguuaacgguaauuuc

SEQ ID NO: 38576 - RNA, 22 nt, Salmonella enterica enterica serovar Typhi Ty2
uaaugcuuauccggccuacagg

SEQ ID NO: 38577 - RNA, 22 nt, Salmonella enterica enterica serovar Typhi Ty2
uacaauguugaagcagcgcgug

SEQ ID NO: 38578 - RNA, 22 nt, Salmonella enterica enterica serovar Typhi Ty2
uacacgccggauaaggcgcagc

SEQ ID NO: 38579 - RNA, 22 nt, Salmonella enterica enterica serovar Typhi Ty2
uacagaauauccaucagcggcu

SEQ ID NO: 38580 - RNA, 22 nt, Salmonella enterica enterica serovar Typhi Ty2
uacaucgauuguugcgaauauu

SEQ ID NO: 38581 - RNA, 22 nt, Salmonella enterica enterica serovar Typhi Ty2
uaccacuuccggcccugcaugc

SEQ ID NO: 38582 - RNA, 22 nt, Salmonella enterica enterica serovar Typhi Ty2
uaccguguauggaggcgauagc

SEQ ID NO: 38583 - RNA, 21 nt, Salmonella enterica enterica serovar Typhi Ty2
uacgacgcacuuuaugagguc

SEQ ID NO: 38584 - RNA, 22 nt, Salmonella enterica enterica serovar Typhi Ty2
uacgcauauggcggaucuggau

SEQ ID NO: 38585 - RNA, 22 nt, Salmonella enterica enterica serovar Typhi Ty2
uacgccgcgaccacgccgaucg

SEQ ID NO: 38586 - RNA, 22 nt, Salmonella enterica enterica serovar Typhi Ty2
uacgcgaacaacuggaggucag

SEQ ID NO: 38587 - RNA, 22 nt, Salmonella enterica enterica serovar Typhi Ty2
uacgcucaauccccauaucgcu

SEQ ID NO: 38588 - RNA, 22 nt, Salmonella enterica enterica serovar Typhi Ty2
uacguaugggguaugaggcggu

SEQ ID NO: 38589 - RNA, 22 nt, Salmonella enterica enterica serovar Typhi Ty2
uacgucuauccuuaguccguag

SEQ ID NO: 38590 - RNA, 22 nt, Salmonella enterica enterica serovar Typhi Ty2
uacugguauccagaaacuaucu

SEQ ID NO: 38591 - RNA, 22 nt, Salmonella enterica enterica serovar Typhi Ty2
uacugugcgcgcugucggucuu

SEQ ID NO: 38592 - RNA, 22 nt, Salmonella enterica enterica serovar Typhi Ty2
uagaugaggugguaauugccac

SEQ ID NO: 38593 - RNA, 22 nt, Salmonella enterica enterica serovar Typhi Ty2
uagcaccagcaaaacccgcucc

SEQ ID NO: 38594 - RNA, 22 nt, Salmonella enterica enterica serovar Typhi Ty2
uagccgguaauagcgccacuag

SEQ ID NO: 38595 - RNA, 22 nt, Salmonella enterica enterica serovar Typhi Ty2
uagccguggcggacaacggcgc

SEQ ID NO: 38596 - RNA, 22 nt, Salmonella enterica enterica serovar Typhi Ty2
uagcggaaaauugggcuauagc

SEQ ID NO: 38597 - RNA, 21 nt, Salmonella enterica enterica serovar Typhi Ty2
uagcguaaaaaaauugaugau

SEQ ID NO: 38598 - RNA, 22 nt, Salmonella enterica enterica serovar Typhi Ty2
uaggaaaccagcguuuucccca

SEQ ID NO: 38599 - RNA, 22 nt, Salmonella enterica enterica serovar Typhi Ty2
uaggccugaaagcggcgcguca

SEQ ID NO: 38600 - RNA, 22 nt, Salmonella enterica enterica serovar Typhi Ty2
uaggccugauaagguaaagccg

SEQ ID NO: 38601 - RNA, 22 nt, Salmonella enterica enterica serovar Typhi Ty2
uaggcugagucccccaaagguu

SEQ ID NO: 38602 - RNA, 22 nt, Salmonella enterica enterica serovar Typhi Ty2
uaggcuuucguaacgugaucgg

SEQ ID NO: 38603 - RNA, 22 nt, Salmonella enterica enterica serovar Typhi Ty2
uagggccgggcagugcucgaaa

SEQ ID NO: 38604 - RNA, 22 nt, Salmonella enterica enterica serovar Typhi Ty2
uagggcuuauccggccugcaaa

SEQ ID NO: 38605 - RNA, 22 nt, Salmonella enterica enterica serovar Typhi Ty2
uaguacgauggaaggccgcaaa

SEQ ID NO: 38606 - RNA, 20 nt, Salmonella enterica enterica serovar Typhi Ty2
uagucuuccuggcauccagc

SEQ ID NO: 38607 - RNA, 22 nt, Salmonella enterica enterica serovar Typhi Ty2
uagugguaaauacauuuauuuu

SEQ ID NO: 38608 - RNA, 20 nt, Salmonella enterica enterica serovar Typhi Ty2
uauagcgaaaccacccugac

SEQ ID NO: 38609 - RNA, 22 nt, Salmonella enterica enterica serovar Typhi Ty2
uaucaagucugaagcgaaaacu

SEQ ID NO: 38610 - RNA, 22 nt, Salmonella enterica enterica serovar Typhi Ty2
uaucacagccagaaaagggcua

SEQ ID NO: 38611 - RNA, 22 nt, Salmonella enterica enterica serovar Typhi Ty2
uauccaaugguuaacguucugg

SEQ ID NO: 38612 - RNA, 22 nt, Salmonella enterica enterica serovar Typhi Ty2
uauccgccccugcgucugcgcg

SEQ ID NO: 38613 - RNA, 22 nt, Salmonella enterica enterica serovar Typhi Ty2
uauccggauggauagacucaag

SEQ ID NO: 38614 - RNA, 17 nt, Salmonella enterica enterica serovar Typhi Ty2
uaucgacaccguaaugg

SEQ ID NO: 38615 - RNA, 22 nt, Salmonella enterica enterica serovar Typhi Ty2
ugauggucguggaauaugcugc

SEQ ID NO: 38616 - RNA, 21 nt, Salmonella enterica enterica serovar Typhi Ty2
ugauuucaauauccagccaga

SEQ ID NO: 38617 - RNA, 22 nt, Salmonella enterica enterica serovar Typhi Ty2
ugcaacgcuuuaugguggcgau

SEQ ID NO: 38618 - RNA, 22 nt, Salmonella enterica enterica serovar Typhi Ty2
ugcaggauggcguccagcgacc

SEQ ID NO: 38619 - RNA, 19 nt, Salmonella enterica enterica serovar Typhi Ty2
ugcaucugauccgcucguu

SEQ ID NO: 38620 - RNA, 22 nt, Salmonella enterica enterica serovar Typhi Ty2
ugcccgauaauauuuaccgauu

SEQ ID NO: 38621 - RNA, 22 nt, Salmonella enterica enterica serovar Typhi Ty2
ugcccgucuacgauaaaccgau

SEQ ID NO: 38622 - RNA, 19 nt, Salmonella enterica enterica serovar Typhi Ty2
ugccgcaaaaucggcagcc

SEQ ID NO: 38623 - RNA, 22 nt, Salmonella enterica enterica serovar Typhi Ty2
ugccgcaagccgcuuucccuga

SEQ ID NO: 38624 - RNA, 22 nt, Salmonella enterica enterica serovar Typhi Ty2
ugccgcguaaagcacgaacggg

SEQ ID NO: 38625 - RNA, 19 nt, Salmonella enterica enterica serovar Typhi Ty2
ugccggaaaaaggcaagcc

SEQ ID NO: 38626 - RNA, 22 nt, Salmonella enterica enterica serovar Typhi Ty2
ugccggagaugaccgauguuca

SEQ ID NO: 38627 - RNA, 22 nt, Salmonella enterica enterica serovar Typhi Ty2
ugccggauggcgguguaaacgu

SEQ ID NO: 38628 - RNA, 22 nt, Salmonella enterica enterica serovar Typhi Ty2
ugccgggaugggcgacucgauu

SEQ ID NO: 38629 - RNA, 22 nt, Salmonella enterica enterica serovar Typhi Ty2
ugccgguugucgaugaagaaca

SEQ ID NO: 38630 - RNA, 22 nt, Salmonella enterica enterica serovar Typhi Ty2
ugccguugaauccagcgccgca

SEQ ID NO: 38631 - RNA, 22 nt, Salmonella enterica enterica serovar Typhi Ty2
ugcgacgcaccauauucaggaa

SEQ ID NO: 38632 - RNA, 22 nt, Salmonella enterica enterica serovar Typhi Ty2
ugcgcacguccagaccacggau

SEQ ID NO: 38633 - RNA, 22 nt, Salmonella enterica enterica serovar Typhi Ty2
ugcgcugauggccguguuuuuc

SEQ ID NO: 38634 - RNA, 18 nt, Salmonella enterica enterica serovar Typhi Ty2
ugcggcaaugagcuguug

SEQ ID NO: 38635 - RNA, 22 nt, Salmonella enterica enterica serovar Typhi Ty2
ugcgguaaacaaggcuguaucg

SEQ ID NO: 38636 - RNA, 22 nt, Salmonella enterica enterica serovar Typhi Ty2
ugcgucuuauccggccuacgga

SEQ ID NO: 38637 - RNA, 22 nt, Salmonella enterica enterica serovar Typhi Ty2
ugcgugacauguucgaacaagc

SEQ ID NO: 38638 - RNA, 22 nt, Salmonella enterica enterica serovar Typhi Ty2
ugcguggccucgcccagccgca

SEQ ID NO: 38639 - RNA, 22 nt, Salmonella enterica enterica serovar Typhi Ty2
ugcguuccgccagguuuacccg

SEQ ID NO: 38640 - RNA, 22 nt, Salmonella enterica enterica serovar Typhi Ty2
ugcuccaguuuccacggcgggu

SEQ ID NO: 38641 - RNA, 22 nt, Salmonella enterica enterica serovar Typhi Ty2
ugcugauauuuuccgccuuuau

SEQ ID NO: 38642 - RNA, 22 nt, Salmonella enterica enterica serovar Typhi Ty2
ugcugauuaaaauccuuguuca

SEQ ID NO: 38643 - RNA, 22 nt, Salmonella enterica enterica serovar Typhi Ty2
ugcugccaucuuuaggcguaau

SEQ ID NO: 38644 - RNA, 19 nt, Salmonella enterica enterica serovar Typhi Ty2
ugcugcgucaugccucgcc

SEQ ID NO: 38645 - RNA, 22 nt, Salmonella enterica enterica serovar Typhi Ty2
uggacaggacacgggauaauca

SEQ ID NO: 38646 - RNA, 22 nt, Salmonella enterica enterica serovar Typhi Ty2
uggauaagugaaacgccauccg

SEQ ID NO: 38647 - RNA, 22 nt, Salmonella enterica enterica serovar Typhi Ty2
uggcaugugguauugauccuga

SEQ ID NO: 38648 - RNA, 22 nt, Salmonella enterica enterica serovar Typhi Ty2
uggcgagagaccuucgcaacug

SEQ ID NO: 38649 - RNA, 22 nt, Salmonella enterica enterica serovar Typhi Ty2
uggcggcaaucggugcugcgau

SEQ ID NO: 38650 - RNA, 22 nt, Salmonella enterica enterica serovar Typhi Ty2
uggcggcaauggcgauagauuu

SEQ ID NO: 38651 - RNA, 22 nt, Salmonella enterica enterica serovar Typhi Ty2
uggcggcaccuuccagaacgaa

SEQ ID NO: 38652 - RNA, 22 nt, Salmonella enterica enterica serovar Typhi Ty2
uggcgguagcgauaagcgccug

SEQ ID NO: 38653 - RNA, 21 nt, Salmonella enterica enterica serovar Typhi Ty2
uggcugcuguucaucugcgug

SEQ ID NO: 38654 - RNA, 22 nt, Salmonella enterica enterica serovar Typhi Ty2
uggcuuuagcagguaaugccgc

SEQ ID NO: 38655 - RNA, 22 nt, Salmonella enterica enterica serovar Typhi Ty2
ugggcaccagguacugauuagu

SEQ ID NO: 38656 - RNA, 22 nt, Salmonella enterica enterica serovar Typhi Ty2
ugggcguacucgucuauuaaug

SEQ ID NO: 38657 - RNA, 22 nt, Salmonella enterica enterica serovar Typhi Ty2
ugguaaagcaaucgucaaaacc

SEQ ID NO: 38658 - RNA, 22 nt, Salmonella enterica enterica serovar Typhi Ty2
ugguaccguuaugacgaucugc

SEQ ID NO: 38659 - RNA, 22 nt, Salmonella enterica enterica serovar Typhi Ty2
uggucagggauauaugccgguu

SEQ ID NO: 38660 - RNA, 22 nt, Salmonella enterica enterica serovar Typhi Ty2
uggucgaucaggcgaaggcgcg

SEQ ID NO: 38661 - RNA, 20 nt, Salmonella enterica enterica serovar Typhi Ty2
uggugccgcccgccuggcag

SEQ ID NO: 38662 - RNA, 23 nt, Salmonella enterica enterica serovar Typhi Ty2
uggugccguucagcaggauguuc

SEQ ID NO: 38663 - RNA, 22 nt, Salmonella enterica enterica serovar Typhi Ty2
ugguggaagaguucggcuugcg

SEQ ID NO: 38664 - RNA, 22 nt, Salmonella enterica enterica serovar Typhi Ty2
ugguuuaaaguggcaaugaagg

SEQ ID NO: 38665 - RNA, 22 nt, Salmonella enterica enterica serovar Typhi Ty2
uguaaagcaaaugcuauacaag

SEQ ID NO: 38666 - RNA, 22 nt, Salmonella enterica enterica serovar Typhi Ty2
uguaaagggcauacguaucgcg

SEQ ID NO: 38667 - RNA, 22 nt, Salmonella enterica enterica serovar Typhi Ty2
uguaggcagcauaagcguuagc

SEQ ID NO: 38668 - RNA, 22 nt, Salmonella enterica enterica serovar Typhi Ty2
uguaggccggauaagacgcguc

SEQ ID NO: 38669 - RNA, 22 nt, Salmonella enterica enterica serovar Typhi Ty2
uguaggccggauaagcauuagc

SEQ ID NO: 38670 - RNA, 20 nt, Salmonella enterica enterica serovar Typhi Ty2
uguccgacuguuaacguaaa

SEQ ID NO: 38671 - RNA, 22 nt, Salmonella enterica enterica serovar Typhi Ty2
uguccgcguuuguagauuacaa

SEQ ID NO: 38672 - RNA, 22 nt, Salmonella enterica enterica serovar Typhi Ty2
ugucugaacggagaaaaggugc

SEQ ID NO: 38673 - RNA, 22 nt, Salmonella enterica enterica serovar Typhi Ty2
ugucuguacguuuccauuugag

SEQ ID NO: 38674 - RNA, 22 nt, Salmonella enterica enterica serovar Typhi Ty2
ugugaccauuaucgggcaauca

SEQ ID NO: 38675 - RNA, 20 nt, Salmonella enterica enterica serovar Typhi Ty2
ugugccgauuauucgcgcua

SEQ ID NO: 38676 - RNA, 22 nt, Salmonella enterica enterica serovar Typhi Ty2
uguguccucauuuugcgggagc

SEQ ID NO: 38677 - RNA, 22 nt, Salmonella enterica enterica serovar Typhi Ty2
uguucugaaaaaugaagaucug

SEQ ID NO: 38678 - RNA, 20 nt, Salmonella enterica enterica serovar Typhi Ty2
uguuuacgcgggacauuuua

SEQ ID NO: 38679 - RNA, 18 nt, Salmonella enterica enterica serovar Typhi Ty2
uuaaccgccgugaauagc

SEQ ID NO: 38680 - RNA, 23 nt, Salmonella enterica enterica serovar Typhi Ty2
uuaagcaccacauuggugcaaua

SEQ ID NO: 38681 - RNA, 22 nt, Salmonella enterica enterica serovar Typhi Ty2
uuaaugguauccaucaugcggu

SEQ ID NO: 38682 - RNA, 22 nt, Salmonella enterica enterica serovar Typhi Ty2
uuacacuuaaguuggaugauuu

SEQ ID NO: 38683 - RNA, 22 nt, Salmonella enterica enterica serovar Typhi Ty2
uuaccgcuaugccgaugaacau

SEQ ID NO: 38684 - RNA, 20 nt, Salmonella enterica enterica serovar Typhi Ty2
accggcugcgauuacgcugg

SEQ ID NO: 38685 - RNA, 22 nt, Salmonella enterica enterica serovar Typhi Ty2
accgugaaaacuucagccagcg

SEQ ID NO: 38686 - RNA, 22 nt, Salmonella enterica enterica serovar Typhi Ty2
accugcugugcagccacgguag

SEQ ID NO: 38687 - RNA, 22 nt, Salmonella enterica enterica serovar Typhi Ty2
acgaaggcgacauuagcagccg

SEQ ID NO: 38688 - RNA, 22 nt, Salmonella enterica enterica serovar Typhi Ty2
acgcaggaucaguugccuucgc

SEQ ID NO: 38689 - RNA, 22 nt, Salmonella enterica enterica serovar Typhi Ty2
acgcauuuguuggccggauaag

SEQ ID NO: 38690 - RNA, 22 nt, Salmonella enterica enterica serovar Typhi Ty2
acgcgcuugccauccagcucgu

SEQ ID NO: 38691 - RNA, 18 nt, Salmonella enterica enterica serovar Typhi Ty2
acgcugcccacgucuggg

SEQ ID NO: 38692 - RNA, 20 nt, Salmonella enterica enterica serovar Typhi Ty2
acgcuuagcgccauuaguau

SEQ ID NO: 38693 - RNA, 22 nt, Salmonella enterica enterica serovar Typhi Ty2
acggcuaucagucuuugcacac

SEQ ID NO: 38694 - RNA, 22 nt, Salmonella enterica enterica serovar Typhi Ty2
acgggcguugucuccuugcugc

SEQ ID NO: 38695 - RNA, 22 nt, Salmonella enterica enterica serovar Typhi Ty2
acggguuauguuaucauuugua

SEQ ID NO: 38696 - RNA, 22 nt, Salmonella enterica enterica serovar Typhi Ty2
acggucaugaaaaucgugccgc

SEQ ID NO: 38697 - RNA, 22 nt, Salmonella enterica enterica serovar Typhi Ty2
acggucugcacggugguggugg

SEQ ID NO: 38698 - RNA, 22 nt, Salmonella enterica enterica serovar Typhi Ty2
acggucugucccagucggcgcu

SEQ ID NO: 38699 - RNA, 22 nt, Salmonella enterica enterica serovar Typhi Ty2
acgucuuaucuggccuacguga

SEQ ID NO: 38700 - RNA, 21 nt, Salmonella enterica enterica serovar Typhi Ty2
acguugaccaucgguacgccu

SEQ ID NO: 38701 - RNA, 22 nt, Salmonella enterica enterica serovar Typhi Ty2
acguugaugugaacuauucaga

SEQ ID NO: 38702 - RNA, 22 nt, Salmonella enterica enterica serovar Typhi Ty2
acucuuaacaaauagaaauuac

SEQ ID NO: 38703 - RNA, 22 nt, Salmonella enterica enterica serovar Typhi Ty2
acugcugcgguaaugcagagua

SEQ ID NO: 38704 - RNA, 22 nt, Salmonella enterica enterica serovar Typhi Ty2
acugcuugaugaggccgaacgu

SEQ ID NO: 38705 - RNA, 22 nt, Salmonella enterica enterica serovar Typhi Ty2
acuggcuggaaaguaauacagu

SEQ ID NO: 38706 - RNA, 22 nt, Salmonella enterica enterica serovar Typhi Ty2
acuuucuggcccacuucgauga

SEQ ID NO: 38707 - RNA, 22 nt, Salmonella enterica enterica serovar Typhi Ty2
agacaacggcccuuugcaggcg

SEQ ID NO: 38708 - RNA, 22 nt, Salmonella enterica enterica serovar Typhi Ty2
agacggcgaaggcguuagguau

SEQ ID NO: 38709 - RNA, 22 nt, Salmonella enterica enterica serovar Typhi Ty2
agaggcuaauuaucugccagcc

SEQ ID NO: 38710 - RNA, 22 nt, Salmonella enterica enterica serovar Typhi Ty2
agagguucaugaugcgccugca

SEQ ID NO: 38711 - RNA, 22 nt, Salmonella enterica enterica serovar Typhi Ty2
agaugggcaaagccacggugga

SEQ ID NO: 38712 - RNA, 22 nt, Salmonella enterica enterica serovar Typhi Ty2
agauucauguaugauugccggg

SEQ ID NO: 38713 - RNA, 22 nt, Salmonella enterica enterica serovar Typhi Ty2
agauuugcuauauuugcgcccc

SEQ ID NO: 38714 - RNA, 22 nt, Salmonella enterica enterica serovar Typhi Ty2
agcagaauggguagguuuuucu

SEQ ID NO: 38715 - RNA, 23 nt, Salmonella enterica enterica serovar Typhi Ty2
agcaguucuucagauggcaaugu

SEQ ID NO: 38716 - RNA, 17 nt, Salmonella enterica enterica serovar Typhi Ty2
agcaugauguacggauu

SEQ ID NO: 38717 - RNA, 22 nt, Salmonella enterica enterica serovar Typhi Ty2
agcaugcucuugcaaacugggu

SEQ ID NO: 38718 - RNA, 22 nt, Salmonella enterica enterica serovar Typhi Ty2
agccagacgcuguuaccuaagu

SEQ ID NO: 38719 - RNA, 22 nt, Salmonella enterica enterica serovar Typhi Ty2
agccagccaguucgaugauuuu

SEQ ID NO: 38720 - RNA, 22 nt, Salmonella enterica enterica serovar Typhi Ty2
agccgguuuuugcugauguggu

SEQ ID NO: 38721 - RNA, 22 nt, Salmonella enterica enterica serovar Typhi Ty2
agcgacuucagugccaguacug

SEQ ID NO: 38722 - RNA, 22 nt, Salmonella enterica enterica serovar Typhi Ty2
agcgauaaccugcugaugauca

SEQ ID NO: 38723 - RNA, 22 nt, Salmonella enterica enterica serovar Typhi Ty2
agcgccuggcaacucacggcau

SEQ ID NO: 38724 - RNA, 22 nt, Salmonella enterica enterica serovar Typhi Ty2
agcgcggacgacaguggugucc

SEQ ID NO: 38725 - RNA, 22 nt, Salmonella enterica enterica serovar Typhi Ty2
agcggcaucggccuguuuaucg

SEQ ID NO: 38726 - RNA, 22 nt, Salmonella enterica enterica serovar Typhi Ty2
agcgguuuuauuuacguugcuc

SEQ ID NO: 38727 - RNA, 22 nt, Salmonella enterica enterica serovar Typhi Ty2
agcguauggcugcaagacggua

SEQ ID NO: 38728 - RNA, 22 nt, Salmonella enterica enterica serovar Typhi Ty2
agcguugaugugcugguuaccg

SEQ ID NO: 38729 - RNA, 22 nt, Salmonella enterica enterica serovar Typhi Ty2
agcguugcuugaucgccugccg

SEQ ID NO: 38730 - RNA, 22 nt, Salmonella enterica enterica serovar Typhi Ty2
agcuauuauguacggccgccaa

SEQ ID NO: 38731 - RNA, 22 nt, Salmonella enterica enterica serovar Typhi Ty2
agcuauucggccagcgccaccg

SEQ ID NO: 38732 - RNA, 22 nt, Salmonella enterica enterica serovar Typhi Ty2
agcucaccacugcacgaaaaug

SEQ ID NO: 38733 - RNA, 22 nt, Salmonella enterica enterica serovar Typhi Ty2
agcuuuaucucuaaagcgggca

SEQ ID NO: 38734 - RNA, 22 nt, Salmonella enterica enterica serovar Typhi Ty2
aggaacgccuccugaggcagcu

SEQ ID NO: 38735 - RNA, 22 nt, Salmonella enterica enterica serovar Typhi Ty2
aggauaugagauuaugaguacc

SEQ ID NO: 38736 - RNA, 22 nt, Salmonella enterica enterica serovar Typhi Ty2
aggccugauaagcgcagcgcca

SEQ ID NO: 38737 - RNA, 22 nt, Salmonella enterica enterica serovar Typhi Ty2
aggcguguucaaggcgggcuuu

SEQ ID NO: 38738 - RNA, 23 nt, Salmonella enterica enterica serovar Typhi Ty2
agggcgucuggaugaagcauugu

SEQ ID NO: 38739 - RNA, 17 nt, Salmonella enterica enterica serovar Typhi Ty2
aggugccgggauuagcc

SEQ ID NO: 38740 - RNA, 22 nt, Salmonella enterica enterica serovar Typhi Ty2
agguuauugccaaucagcacca

SEQ ID NO: 38741 - RNA, 22 nt, Salmonella enterica enterica serovar Typhi Ty2
agucaauauuuauucauggaau

SEQ ID NO: 38742 - RNA, 22 nt, Salmonella enterica enterica serovar Typhi Ty2
agucaggaucugacgagcgcga

SEQ ID NO: 38743 - RNA, 22 nt, Salmonella enterica enterica serovar Typhi Ty2
aguggucagcauugagcugccg

SEQ ID NO: 38744 - RNA, 22 nt, Salmonella enterica enterica serovar Typhi Ty2
aucaguuucaggaugaagaccg

SEQ ID NO: 38745 - RNA, 19 nt, Salmonella enterica enterica serovar Typhi Ty2
aucauccaggcuggacgua

SEQ ID NO: 38746 - RNA, 22 nt, Salmonella enterica enterica serovar Typhi Ty2
aucaugagcucgucgauuugcg

SEQ ID NO: 38747 - RNA, 22 nt, Salmonella enterica enterica serovar Typhi Ty2
auccaugcggcagucgcuucug

SEQ ID NO: 38748 - RNA, 22 nt, Salmonella enterica enterica serovar Typhi Ty2
auccgcagauccagcacggccu

SEQ ID NO: 38749 - RNA, 22 nt, Salmonella enterica enterica serovar Typhi Ty2
auccgcguuuauugauaugccg

SEQ ID NO: 38750 - RNA, 22 nt, Salmonella enterica enterica serovar Typhi Ty2
auccgcugcgcauugguuuauc

SEQ ID NO: 38751 - RNA, 22 nt, Salmonella enterica enterica serovar Typhi Ty2
auccggacgacuuacagcgggu

SEQ ID NO: 38752 - RNA, 22 nt, Salmonella enterica enterica serovar Typhi Ty2
auccggguaauguaaaaaaucu

SEQ ID NO: 38753 - RNA, 21 nt, Salmonella enterica enterica serovar Typhi Ty2
aucgaaggucacugcaaauug

SEQ ID NO: 38754 - RNA, 22 nt, Salmonella enterica enterica serovar Typhi Ty2
aucgccaauggaaguuaauagg

SEQ ID NO: 38755 - RNA, 22 nt, Salmonella enterica enterica serovar Typhi Ty2
aucgccauacggcagacgcgcg

SEQ ID NO: 38756 - RNA, 22 nt, Salmonella enterica enterica serovar Typhi Ty2
aucgccaucuuaugcuuuuucu

SEQ ID NO: 38757 - RNA, 22 nt, Salmonella enterica enterica serovar Typhi Ty2
aucgccauuaugaucgggaugc

SEQ ID NO: 38758 - RNA, 22 nt, Salmonella enterica enterica serovar Typhi Ty2
aucgcccgcgauauccuuaccu

SEQ ID NO: 38759 - RNA, 21 nt, Salmonella enterica enterica serovar Typhi Ty2
aucgcccuaugaugccgagga

SEQ ID NO: 38760 - RNA, 22 nt, Salmonella enterica enterica serovar Typhi Ty2
aucgcuggucaguuugcuguac

SEQ ID NO: 38761 - RNA, 22 nt, Salmonella enterica enterica serovar Typhi Ty2
aucggaugggcuuuaauaaucu

SEQ ID NO: 38762 - RNA, 22 nt, Salmonella enterica enterica serovar Typhi Ty2
aucggugacuuugucauuaauu

SEQ ID NO: 38763 - RNA, 23 nt, Salmonella enterica enterica serovar Typhi Ty2
aucgucacgauggucguagcugg

SEQ ID NO: 38764 - RNA, 22 nt, Salmonella enterica enterica serovar Typhi Ty2
aucgucagcguguggaggugcu

SEQ ID NO: 38765 - RNA, 22 nt, Salmonella enterica enterica serovar Typhi Ty2
aucguggugcuggcgcagauca

SEQ ID NO: 38766 - RNA, 19 nt, Salmonella enterica enterica serovar Typhi Ty2
aucguuggagagacccgcu

SEQ ID NO: 38767 - RNA, 22 nt, Salmonella enterica enterica serovar Typhi Ty2
aucugguugaauuugaucagga

SEQ ID NO: 38768 - RNA, 22 nt, Salmonella enterica enterica serovar Typhi Ty2
aucuucaugguuaauggucuga

SEQ ID NO: 38769 - RNA, 22 nt, Salmonella enterica enterica serovar Typhi Ty2
augaauacacaggauuugacga

SEQ ID NO: 38770 - RNA, 22 nt, Salmonella enterica enterica serovar Typhi Ty2
augaccguuuugauaucagugu

SEQ ID NO: 38771 - RNA, 22 nt, Salmonella enterica enterica serovar Typhi Ty2
augagcugaccacugacgaaaa

SEQ ID NO: 38772 - RNA, 22 nt, Salmonella enterica enterica serovar Typhi Ty2
augaucgaaauccgugaagguc

SEQ ID NO: 38773 - RNA, 22 nt, Salmonella enterica enterica serovar Typhi Ty2
augaugaagggcgcgaucaguu

SEQ ID NO: 38774 - RNA, 22 nt, Salmonella enterica enterica serovar Typhi Ty2
augcagaugaggaaaaugcugc

SEQ ID NO: 38775 - RNA, 21 nt, Salmonella enterica enterica serovar Typhi Ty2
augcaggaaaauauaucuggc

SEQ ID NO: 38776 - RNA, 22 nt, Salmonella enterica enterica serovar Typhi Ty2
augccgcgucgcuuagugauua

SEQ ID NO: 38777 - RNA, 22 nt, Salmonella enterica enterica serovar Typhi Ty2
augccuuauccggccuacaacg

SEQ ID NO: 38778 - RNA, 22 nt, Salmonella enterica enterica serovar Typhi Ty2
augcgcuggugaugggaaaggc

SEQ ID NO: 38779 - RNA, 22 nt, Salmonella enterica enterica serovar Typhi Ty2
augcguuauuugaccgccuggg

SEQ ID NO: 38780 - RNA, 22 nt, Salmonella enterica enterica serovar Typhi Ty2
augcugaugaugagcgcaggcu

SEQ ID NO: 38781 - RNA, 22 nt, Salmonella enterica enterica serovar Typhi Ty2
augcugugaauucagucggguu

SEQ ID NO: 38782 - RNA, 22 nt, Salmonella enterica enterica serovar Typhi Ty2
auggcgauuucauagcccgcuu

SEQ ID NO: 38783 - RNA, 22 nt, Salmonella enterica enterica serovar Typhi Ty2
auggcgcugcgcuuaucaggcc

SEQ ID NO: 38784 - RNA, 22 nt, Salmonella enterica enterica serovar Typhi Ty2
auggcggcuucgccuuauccgg

SEQ ID NO: 38785 - RNA, 22 nt, Salmonella enterica enterica serovar Typhi Ty2
auggcguuaucagccgcgcuuu

SEQ ID NO: 38786 - RNA, 22 nt, Salmonella enterica enterica serovar Typhi Ty2
auggcguuguauuauugagguu

SEQ ID NO: 38787 - RNA, 22 nt, Salmonella enterica enterica serovar Typhi Ty2
auggcugcccggcgccuguaac

SEQ ID NO: 38788 - RNA, 22 nt, Salmonella enterica enterica serovar Typhi Ty2
augguaaauaagcggauuuucu

SEQ ID NO: 38789 - RNA, 22 nt, Salmonella enterica enterica serovar Typhi Ty2
auggucauagcggcagcgccag

SEQ ID NO: 38790 - RNA, 22 nt, Salmonella enterica enterica serovar Typhi Ty2
augucguaugaugcccguguuc

SEQ ID NO: 38791 - RNA, 22 nt, Salmonella enterica enterica serovar Typhi Ty2
augugcuguucgauguagccaa

SEQ ID NO: 38792 - RNA, 22 nt, Salmonella enterica enterica serovar Typhi Ty2
auucaaucaaauuaagaucaca

SEQ ID NO: 38793 - RNA, 22 nt, Salmonella enterica enterica serovar Typhi Ty2
auucgcgcaucgcgucgagcag

SEQ ID NO: 38794 - RNA, 22 nt, Salmonella enterica enterica serovar Typhi Ty2
auugaagccgaugccggugaaa

SEQ ID NO: 38795 - RNA, 22 nt, Salmonella enterica enterica serovar Typhi Ty2
auugacgauaucggcauugacg

SEQ ID NO: 38796 - RNA, 22 nt, Salmonella enterica enterica serovar Typhi Ty2
auugaugacaucgaccugaacc

SEQ ID NO: 38797 - RNA, 22 nt, Salmonella enterica enterica serovar Typhi Ty2
auugauguggguaaagugaugg

SEQ ID NO: 38798 - RNA, 20 nt, Salmonella enterica enterica serovar Typhi Ty2
auugccgauggugguauaca

SEQ ID NO: 38799 - RNA, 22 nt, Salmonella enterica enterica serovar Typhi Ty2
auugccggauggcgccguaggc

SEQ ID NO: 38800 - RNA, 22 nt, Salmonella enterica enterica serovar Typhi Ty2
auugcguugucccugcuguaug

SEQ ID NO: 38801 - RNA, 22 nt, Salmonella enterica enterica serovar Typhi Ty2
auugcucgcgaggcccacguga

SEQ ID NO: 38802 - RNA, 22 nt, Salmonella enterica enterica serovar Typhi Ty2
auuggacuugccgggauuauuc

SEQ ID NO: 38803 - RNA, 22 nt, Salmonella enterica enterica serovar Typhi Ty2
auuggcgacgauaaaucgguuc

SEQ ID NO: 38804 - RNA, 22 nt, Salmonella enterica enterica serovar Typhi Ty2
auuggcgcgguacuggaagucg

SEQ ID NO: 38805 - RNA, 22 nt, Salmonella enterica enterica serovar Typhi Ty2
auuguggcgauggcgggcaucg

SEQ ID NO: 38806 - RNA, 22 nt, Salmonella enterica enterica serovar Typhi Ty2
auuuguaguguucaaagagcuc

SEQ ID NO: 38807 - RNA, 22 nt, Salmonella enterica enterica serovar Typhi Ty2
caacagguucgguuguacaguc

SEQ ID NO: 38808 - RNA, 22 nt, Salmonella enterica enterica serovar Typhi Ty2
caacaguauuagccacggcauu

SEQ ID NO: 38809 - RNA, 22 nt, Salmonella enterica enterica serovar Typhi Ty2
caacauagauaugagguucacu

SEQ ID NO: 38810 - RNA, 22 nt, Salmonella enterica enterica serovar Typhi Ty2
caauacgcugaacguguaugga

SEQ ID NO: 38811 - RNA, 22 nt, Salmonella enterica enterica serovar Typhi Ty2
cacaggagauucgucaggcggc

SEQ ID NO: 38812 - RNA, 22 nt, Salmonella enterica enterica serovar Typhi Ty2
caccaugacccaggaggauauu

SEQ ID NO: 38813 - RNA, 22 nt, Salmonella enterica enterica serovar Typhi Ty2
cacggcgauuacgugaacgaca

SEQ ID NO: 38814 - RNA, 22 nt, Salmonella enterica enterica serovar Typhi Ty2
cacguggagauggcggcggcgu

SEQ ID NO: 38815 - RNA, 22 nt, Salmonella enterica enterica serovar Typhi Ty2
cacguuagcgggugauguaugg

SEQ ID NO: 38816 - RNA, 22 nt, Salmonella enterica enterica serovar Typhi Ty2
cacuggugaaaucgccuuccgg

SEQ ID NO: 38817 - RNA, 21 nt, Salmonella enterica enterica serovar Typhi Ty2
cagaaaguuugcuaucagucu

SEQ ID NO: 38818 - RNA, 22 nt, Salmonella enterica enterica serovar Typhi Ty2
cagauaucgcuaacaguauaua

SEQ ID NO: 38819 - RNA, 22 nt, Salmonella enterica enterica serovar Typhi Ty2
cagcacgcgcugaaugucgccg

SEQ ID NO: 38820 - RNA, 22 nt, Salmonella enterica enterica serovar Typhi Ty2
cagccaucacuauggcguaaaa

SEQ ID NO: 38821 - RNA, 22 nt, Salmonella enterica enterica serovar Typhi Ty2
cagcgaggcaccaucauugaaa

SEQ ID NO: 38822 - RNA, 22 nt, Salmonella enterica enterica serovar Typhi Ty2
cagcgccaauagcuguuuuugc

SEQ ID NO: 38823 - RNA, 22 nt, Salmonella enterica enterica serovar Typhi Ty2
cagcgcuuucguuaacaacgcg

SEQ ID NO: 38824 - RNA, 22 nt, Salmonella enterica enterica serovar Typhi Ty2
cagcguauggcugcaagacggu

SEQ ID NO: 38825 - RNA, 22 nt, Salmonella enterica enterica serovar Typhi Ty2
cagcuaacgguugcauaaucug

SEQ ID NO: 38826 - RNA, 20 nt, Salmonella enterica enterica serovar Typhi Ty2
cagcuccaccugcagcccgu

SEQ ID NO: 38827 - RNA, 22 nt, Salmonella enterica enterica serovar Typhi Ty2
caggaagucacgcugccagcga

SEQ ID NO: 38828 - RNA, 22 nt, Salmonella enterica enterica serovar Typhi Ty2
caggacugaaggagcugauugu

SEQ ID NO: 38829 - RNA, 22 nt, Salmonella enterica enterica serovar Typhi Ty2
caggcaagggaagaagugagga

SEQ ID NO: 38830 - RNA, 22 nt, Salmonella enterica enterica serovar Typhi Ty2
caguaccuggugcccacgggac

SEQ ID NO: 38831 - RNA, 22 nt, Salmonella enterica enterica serovar Typhi Ty2
caguauggaggagauagcgaca

SEQ ID NO: 38832 - RNA, 22 nt, Salmonella enterica enterica serovar Typhi Ty2
cagucguaagcgacggcugguu

SEQ ID NO: 38833 - RNA, 22 nt, Salmonella enterica enterica serovar Typhi Ty2
cagugaggacgcuaaugccgcu

SEQ ID NO: 38834 - RNA, 22 nt, Salmonella enterica enterica serovar Typhi Ty2
caguugacgguuuuucgccagc

SEQ ID NO: 38835 - RNA, 22 nt, Salmonella enterica enterica serovar Typhi Ty2
cauaaugaccucuuauuucccg

SEQ ID NO: 38836 - RNA, 22 nt, Salmonella enterica enterica serovar Typhi Ty2
cauagcauaacaaagaugcgaa

SEQ ID NO: 38837 - RNA, 22 nt, Salmonella enterica enterica serovar Typhi Ty2
caucacggccuuuauuuucgcc

SEQ ID NO: 38838 - RNA, 22 nt, Salmonella enterica enterica serovar Typhi Ty2
caucagacaagugaagaagccc

SEQ ID NO: 38839 - RNA, 22 nt, Salmonella enterica enterica serovar Typhi Ty2
caucagcgucaaccguuggcga

SEQ ID NO: 38840 - RNA, 22 nt, Salmonella enterica enterica serovar Typhi Ty2
caucauccagaucuuucgcgcc

SEQ ID NO: 38841 - RNA, 22 nt, Salmonella enterica enterica serovar Typhi Ty2
caucgccuuaauuuuauccagc

SEQ ID NO: 38842 - RNA, 22 nt, Salmonella enterica enterica serovar Typhi Ty2
caucuuuaccuuuguguugggc

SEQ ID NO: 38843 - RNA, 17 nt, Salmonella enterica enterica serovar Typhi Ty2
caucuuugugaacuuua

SEQ ID NO: 38844 - RNA, 22 nt, Salmonella enterica enterica serovar Typhi Ty2
caugcacauuaaaagaaugguu

SEQ ID NO: 38845 - RNA, 22 nt, Salmonella enterica enterica serovar Typhi Ty2
cauggagcugaaugcaccauca

SEQ ID NO: 38846 - RNA, 19 nt, Salmonella enterica enterica serovar Typhi Ty2
cauggcggcauaacacaca

SEQ ID NO: 38847 - RNA, 22 nt, Salmonella enterica enterica serovar Typhi Ty2
cauguuuacucuacuggccgua

SEQ ID NO: 38848 - RNA, 22 nt, Salmonella enterica enterica serovar Typhi Ty2
cauuaugcgcugguggaugagg

SEQ ID NO: 38849 - RNA, 20 nt, Salmonella enterica enterica serovar Typhi Ty2
cauucgugaugucgauagcu

SEQ ID NO: 38850 - RNA, 22 nt, Salmonella enterica enterica serovar Typhi Ty2
cauucugagacgcaugcugugg

SEQ ID NO: 38851 - RNA, 22 nt, Salmonella enterica enterica serovar Typhi Ty2
cauuggcaauagauaaucgucc

SEQ ID NO: 38852 - RNA, 22 nt, Salmonella enterica enterica serovar Typhi Ty2
cauuucugaaagucagagcaca

SEQ ID NO: 38853 - RNA, 22 nt, Salmonella enterica enterica serovar Typhi Ty2
ccagaagcggaaaccgucuuua

SEQ ID NO: 38854 - RNA, 22 nt, Salmonella enterica enterica serovar Typhi Ty2
ccagccaggccucguuuucguc

SEQ ID NO: 38855 - RNA, 22 nt, Salmonella enterica enterica serovar Typhi Ty2
ccagcgcuucgguauggcgggu

SEQ ID NO: 38856 - RNA, 22 nt, Salmonella enterica enterica serovar Typhi Ty2
ccaggguuugacguuuccacuu

SEQ ID NO: 38857 - RNA, 22 nt, Salmonella enterica enterica serovar Typhi Ty2
ccaugcugugcgucauggcgcu

SEQ ID NO: 38858 - RNA, 22 nt, Salmonella enterica enterica serovar Typhi Ty2
ccauuggguugucggcgaagaa

SEQ ID NO: 38859 - RNA, 22 nt, Salmonella enterica enterica serovar Typhi Ty2
ccauuggugguacugagcugcu

SEQ ID NO: 38860 - RNA, 22 nt, Salmonella enterica enterica serovar Typhi Ty2
cccggcaugggcggcguuugca

SEQ ID NO: 38861 - RNA, 22 nt, Salmonella enterica enterica serovar Typhi Ty2
ccgaacagguuauuguugcuac

SEQ ID NO: 38862 - RNA, 22 nt, Salmonella enterica enterica serovar Typhi Ty2
ccgacgucgcgcuggacgccuu

SEQ ID NO: 38863 - RNA, 22 nt, Salmonella enterica enterica serovar Typhi Ty2
ccgagccuguucuugcgcggug

SEQ ID NO: 38864 - RNA, 20 nt, Salmonella enterica enterica serovar Typhi Ty2
ccgaugagccacggucaaac

SEQ ID NO: 38865 - RNA, 22 nt, Salmonella enterica enterica serovar Typhi Ty2
ccgcgguaucgcggugaagucc

SEQ ID NO: 38866 - RNA, 22 nt, Salmonella enterica enterica serovar Typhi Ty2
ccgcugcaaccguuacccgcuu

SEQ ID NO: 38867 - RNA, 22 nt, Salmonella enterica enterica serovar Typhi Ty2
ccggaccuuugucaucggcugg

SEQ ID NO: 38868 - RNA, 22 nt, Salmonella enterica enterica serovar Typhi Ty2
ccggauaaggcggagccgccau

SEQ ID NO: 38869 - RNA, 22 nt, Salmonella enterica enterica serovar Typhi Ty2
ccggccuacaagauuugcaaua

SEQ ID NO: 38870 - RNA, 22 nt, Salmonella enterica enterica serovar Typhi Ty2
ccggcgaagauagcgguacugu

SEQ ID NO: 38871 - RNA, 22 nt, Salmonella enterica enterica serovar Typhi Ty2
ccgggcaacguagagcauuauu

SEQ ID NO: 38872 - RNA, 22 nt, Salmonella enterica enterica serovar Typhi Ty2
ccggucucccgauguaccgcac

SEQ ID NO: 38873 - RNA, 22 nt, Salmonella enterica enterica serovar Typhi Ty2
ccgucgaugauuuuggucaugg

SEQ ID NO: 38874 - RNA, 22 nt, Salmonella enterica enterica serovar Typhi Ty2
ccgugguguuuauugcugugcu

SEQ ID NO: 38875 - RNA, 22 nt, Salmonella enterica enterica serovar Typhi Ty2
ccguuaguccugcucugugaca

SEQ ID NO: 38876 - RNA, 20 nt, Salmonella enterica enterica serovar Typhi Ty2
ccguuauuguugugcccuac

SEQ ID NO: 38877 - RNA, 22 nt, Salmonella enterica enterica serovar Typhi Ty2
ccguuugccgcgaacgcgcuuu

SEQ ID NO: 38878 - RNA, 23 nt, Salmonella enterica enterica serovar Typhi Ty2
ccugaucgaugaagcgcguacgc

SEQ ID NO: 38879 - RNA, 22 nt, Salmonella enterica enterica serovar Typhi Ty2
ccugaugcuguugcaugauggu

SEQ ID NO: 38880 - RNA, 22 nt, Salmonella enterica enterica serovar Typhi Ty2
ccugcgcagcgccggagacgaa

SEQ ID NO: 38881 - RNA, 22 nt, Salmonella enterica enterica serovar Typhi Ty2
ccugucgguacggcgcgccugc

SEQ ID NO: 38882 - RNA, 22 nt, Salmonella enterica enterica serovar Typhi Ty2
ccuguugguuuacguuauggcu

SEQ ID NO: 38883 - RNA, 22 nt, Salmonella enterica enterica serovar Typhi Ty2
ccuuugaaggucggcagcaggg

SEQ ID NO: 38884 - RNA, 22 nt, Salmonella enterica enterica serovar Typhi Ty2
cgaacguacuaacgucaccggc

SEQ ID NO: 38885 - RNA, 22 nt, Salmonella enterica enterica serovar Typhi Ty2
cgacgcagcgucugaauguuau

SEQ ID NO: 38886 - RNA, 22 nt, Salmonella enterica enterica serovar Typhi Ty2
cgacgguuugcaaaugggugau

SEQ ID NO: 38887 - RNA, 22 nt, Salmonella enterica enterica serovar Typhi Ty2
cgaguacggaaaaaggguccgc

SEQ ID NO: 38888 - RNA, 19 nt, Salmonella enterica enterica serovar Typhi Ty2
cgaucauuuacaucccggu

SEQ ID NO: 38889 - RNA, 20 nt, Salmonella enterica enterica serovar Typhi Ty2
cgaucgccucaaguuucugg

SEQ ID NO: 38890 - RNA, 22 nt, Salmonella enterica enterica serovar Typhi Ty2
cgaucuuguuuggucguuauga

SEQ ID NO: 38891 - RNA, 22 nt, Salmonella enterica enterica serovar Typhi Ty2
cgauuacgcccucuuugauuga

SEQ ID NO: 38892 - RNA, 22 nt, Salmonella enterica enterica serovar Typhi Ty2
cgcacggucugcacgucacuuc

SEQ ID NO: 38893 - RNA, 19 nt, Salmonella enterica enterica serovar Typhi Ty2
cgcaggaauggcagaccgg

SEQ ID NO: 38894 - RNA, 22 nt, Salmonella enterica enterica serovar Typhi Ty2
cgcauaucugccuguucugcua

SEQ ID NO: 38895 - RNA, 22 nt, Salmonella enterica enterica serovar Typhi Ty2
cgcaucuucgaagaagaagaag

SEQ ID NO: 38896 - RNA, 22 nt, Salmonella enterica enterica serovar Typhi Ty2
cgccaacgccgugggagguauc

SEQ ID NO: 38897 - RNA, 22 nt, Salmonella enterica enterica serovar Typhi Ty2
cgccauaagccuugcugacugc

SEQ ID NO: 38898 - RNA, 22 nt, Salmonella enterica enterica serovar Typhi Ty2
cgccaucacguuaauacucaau

SEQ ID NO: 38899 - RNA, 22 nt, Salmonella enterica enterica serovar Typhi Ty2
cgccgauguaguacagcgccug

SEQ ID NO: 38900 - RNA, 22 nt, Salmonella enterica enterica serovar Typhi Ty2
cgccgcaagggacggaggucuc

SEQ ID NO: 38901 - RNA, 22 nt, Salmonella enterica enterica serovar Typhi Ty2
cgccgugaagcgauucgcgaau

SEQ ID NO: 38902 - RNA, 22 nt, Salmonella enterica enterica serovar Typhi Ty2
cgccugguuuuauagccgcauu

SEQ ID NO: 38903 - RNA, 22 nt, Salmonella enterica enterica serovar Typhi Ty2
cgcgaaguaaugccagaagaua

SEQ ID NO: 38904 - RNA, 22 nt, Salmonella enterica enterica serovar Typhi Ty2
cgcgaugauggcauccagaucg

SEQ ID NO: 38905 - RNA, 22 nt, Salmonella enterica enterica serovar Typhi Ty2
cgcggcuuggcauucuuggcgg

SEQ ID NO: 38906 - RNA, 22 nt, Salmonella enterica enterica serovar Typhi Ty2
cgcgguauuaaugcucacccua

SEQ ID NO: 38907 - RNA, 22 nt, Salmonella enterica enterica serovar Typhi Ty2
cgcguugucauccagcgacugg

SEQ ID NO: 38908 - RNA, 22 nt, Salmonella enterica enterica serovar Typhi Ty2
cgcuauccgggauguguugaug

SEQ ID NO: 38909 - RNA, 21 nt, Salmonella enterica enterica serovar Typhi Ty2
cgcuauucgcgcuaccuuugg

SEQ ID NO: 38910 - RNA, 22 nt, Salmonella enterica enterica serovar Typhi Ty2
cgcuccugcuccugcuccaucc

SEQ ID NO: 38911 - RNA, 21 nt, Salmonella enterica enterica serovar Typhi Ty2
cgcucgacaggcuguuaagcc

SEQ ID NO: 38912 - RNA, 22 nt, Salmonella enterica enterica serovar Typhi Ty2
cgcugacggucucgcuguuuca

SEQ ID NO: 38913 - RNA, 22 nt, Salmonella enterica enterica serovar Typhi Ty2
cgcugauugauuaugauacguu

SEQ ID NO: 38914 - RNA, 22 nt, Salmonella enterica enterica serovar Typhi Ty2
cggauaagcauagcgccauccg

SEQ ID NO: 38915 - RNA, 22 nt, Salmonella enterica enterica serovar Typhi Ty2
cggauaaggcgcuugcgccauc

SEQ ID NO: 38916 - RNA, 22 nt, Salmonella enterica enterica serovar Typhi Ty2
cggauguauuugacugcgcgcu

SEQ ID NO: 38917 - RNA, 22 nt, Salmonella enterica enterica serovar Typhi Ty2
cggauucacauaggcguagcug

SEQ ID NO: 38918 - RNA, 22 nt, Salmonella enterica enterica serovar Typhi Ty2
cggauuguguccuggaagaagg

SEQ ID NO: 38919 - RNA, 22 nt, Salmonella enterica enterica serovar Typhi Ty2
cggcaauuuucuuacucaugcg

SEQ ID NO: 38920 - RNA, 22 nt, Salmonella enterica enterica serovar Typhi Ty2
cggcaugacguugacgucgcua

SEQ ID NO: 38921 - RNA, 22 nt, Salmonella enterica enterica serovar Typhi Ty2
cgggucgaggaucgccauaucc

SEQ ID NO: 38922 - RNA, 22 nt, Salmonella enterica enterica serovar Typhi Ty2
cggguugccagcacuacggcag

SEQ ID NO: 38923 - RNA, 16 nt, Salmonella enterica enterica serovar Typhi Ty2
cggucugaauacgcau

SEQ ID NO: 38924 - RNA, 23 nt, Salmonella enterica enterica serovar Typhi Ty2
cggucugcaaacaauucccccgg

SEQ ID NO: 38925 - RNA, 22 nt, Salmonella enterica enterica serovar Typhi Ty2
cggugaacccugcgcgucagga

SEQ ID NO: 38926 - RNA, 19 nt, Salmonella enterica enterica serovar Typhi Ty2
cgguuacugggauagagac

SEQ ID NO: 38927 - RNA, 22 nt, Salmonella enterica enterica serovar Typhi Ty2
cgguuggccggaaacccgcgcg

SEQ ID NO: 38928 - RNA, 22 nt, Salmonella enterica enterica serovar Typhi Ty2
cguagcuacguuacagaacguu

SEQ ID NO: 38929 - RNA, 20 nt, Salmonella enterica enterica serovar Typhi Ty2
cguagggcacaaugaaaugc

SEQ ID NO: 38930 - RNA, 22 nt, Salmonella enterica enterica serovar Typhi Ty2
cguccgaaaaaguguuagaucg

SEQ ID NO: 38931 - RNA, 22 nt, Salmonella enterica enterica serovar Typhi Ty2
cgucggguaaggcaaauuuucc

SEQ ID NO: 38932 - RNA, 20 nt, Salmonella enterica enterica serovar Typhi Ty2
cgucuggcgccgcaggaacu

SEQ ID NO: 38933 - RNA, 22 nt, Salmonella enterica enterica serovar Typhi Ty2
cgucuuauccggccuacgagug

SEQ ID NO: 38934 - RNA, 22 nt, Salmonella enterica enterica serovar Typhi Ty2
cgugaacaaacugcuguuucuc

SEQ ID NO: 38935 - RNA, 22 nt, Salmonella enterica enterica serovar Typhi Ty2
cgugacgucgaaaccaucgucc

SEQ ID NO: 38936 - RNA, 22 nt, Salmonella enterica enterica serovar Typhi Ty2
cguguaggcccgguaagcgcag

SEQ ID NO: 38937 - RNA, 22 nt, Salmonella enterica enterica serovar Typhi Ty2
cguuacgucuguaucugcaccc

SEQ ID NO: 38938 - RNA, 20 nt, Salmonella enterica enterica serovar Typhi Ty2
cguuccggcgguguuuguca

SEQ ID NO: 38939 - RNA, 22 nt, Salmonella enterica enterica serovar Typhi Ty2
cguuggcgucaucgacauuaac

SEQ ID NO: 38940 - RNA, 22 nt, Salmonella enterica enterica serovar Typhi Ty2
cguugucguaugagcgaucgcu

SEQ ID NO: 38941 - RNA, 22 nt, Salmonella enterica enterica serovar Typhi Ty2
cuacguuuaccuggccuacaga

SEQ ID NO: 38942 - RNA, 22 nt, Salmonella enterica enterica serovar Typhi Ty2
cucauugcggcgaugcgcaggg

SEQ ID NO: 38943 - RNA, 22 nt, Salmonella enterica enterica serovar Typhi Ty2
cucauuuagcgcucgcguuuug

SEQ ID NO: 38944 - RNA, 22 nt, Salmonella enterica enterica serovar Typhi Ty2
cuccaguuggcugauguuguau

SEQ ID NO: 38945 - RNA, 22 nt, Salmonella enterica enterica serovar Typhi Ty2
cuccugauaucacggauaugcg

SEQ ID NO: 38946 - RNA, 18 nt, Salmonella enterica enterica serovar Typhi Ty2
cucgaaggauuucaggau

SEQ ID NO: 38947 - RNA, 22 nt, Salmonella enterica enterica serovar Typhi Ty2
cucgcggacgucgaggaucugg

SEQ ID NO: 38948 - RNA, 22 nt, Salmonella enterica enterica serovar Typhi Ty2
cucgcugcacuugcucgaucca

SEQ ID NO: 38949 - RNA, 22 nt, Salmonella enterica enterica serovar Typhi Ty2
cucgugaagauuagcagagcgg

SEQ ID NO: 38950 - RNA, 22 nt, Salmonella enterica enterica serovar Typhi Ty2
cugaacgccgaagcguauuuag

SEQ ID NO: 38951 - RNA, 22 nt, Salmonella enterica enterica serovar Typhi Ty2
cugacggguaguaucgcucuau

SEQ ID NO: 38952 - RNA, 22 nt, Salmonella enterica enterica serovar Typhi Ty2
cugacugcucagccggaagaac

SEQ ID NO: 38953 - RNA, 22 nt, Salmonella enterica enterica serovar Typhi Ty2
cugaugacgcugcgcuuauccg

SEQ ID NO: 38954 - RNA, 22 nt, Salmonella enterica enterica serovar Typhi Ty2
cugauucaaauugagcgucuua

SEQ ID NO: 38955 - RNA, 22 nt, Salmonella enterica enterica serovar Typhi Ty2
cugcaagcagcucgaugcguuu

SEQ ID NO: 38956 - RNA, 22 nt, Salmonella enterica enterica serovar Typhi Ty2
cugcaggacucugcaacgucug

SEQ ID NO: 38957 - RNA, 22 nt, Salmonella enterica enterica serovar Typhi Ty2
cugccguauaucgcgcugggua

SEQ ID NO: 38958 - RNA, 23 nt, Salmonella enterica enterica serovar Typhi Ty2
cugcgcauauuacgccggcguuu

SEQ ID NO: 38959 - RNA, 22 nt, Salmonella enterica enterica serovar Typhi Ty2
cugcguaauggacuauggcgcc

SEQ ID NO: 38960 - RNA, 22 nt, Salmonella enterica enterica serovar Typhi Ty2
cugcgucaggguggggcgaaua

SEQ ID NO: 38961 - RNA, 22 nt, Salmonella enterica enterica serovar Typhi Ty2
cugcgugguaguguagguauca

SEQ ID NO: 38962 - RNA, 22 nt, Salmonella enterica enterica serovar Typhi Ty2
cugcuguacauggcugccgcug

SEQ ID NO: 38963 - RNA, 22 nt, Salmonella enterica enterica serovar Typhi Ty2
cuggaagaagccacuauccaac

SEQ ID NO: 38964 - RNA, 22 nt, Salmonella enterica enterica serovar Typhi Ty2
cuggcaggcgacguauggcacg

SEQ ID NO: 38965 - RNA, 22 nt, Salmonella enterica enterica serovar Typhi Ty2
cuggcaggcgggauggacauua

SEQ ID NO: 38966 - RNA, 22 nt, Salmonella enterica enterica serovar Typhi Ty2
cuggcagugcgucugauacugc

SEQ ID NO: 38967 - RNA, 22 nt, Salmonella enterica enterica serovar Typhi Ty2
cuggcguaacgcauuauacuuu

SEQ ID NO: 38968 - RNA, 22 nt, Salmonella enterica enterica serovar Typhi Ty2
cuggcugcugacgguccuguua

SEQ ID NO: 38969 - RNA, 22 nt, Salmonella enterica enterica serovar Typhi Ty2
cuggcuggagucucagggcgca

SEQ ID NO: 38970 - RNA, 20 nt, Salmonella enterica enterica serovar Typhi Ty2
cugggcguugaugauggcgu

SEQ ID NO: 38971 - RNA, 22 nt, Salmonella enterica enterica serovar Typhi Ty2
cuggguuaucgcgcgucguaau

SEQ ID NO: 38972 - RNA, 22 nt, Salmonella enterica enterica serovar Typhi Ty2
cuggucuuuauucagccugaca

SEQ ID NO: 38973 - RNA, 22 nt, Salmonella enterica enterica serovar Typhi Ty2
cugguuccguaccggucaucgc

SEQ ID NO: 38974 - RNA, 22 nt, Salmonella enterica enterica serovar Typhi Ty2
cuguguaugauucauccggaga

SEQ ID NO: 38975 - RNA, 22 nt, Salmonella enterica enterica serovar Typhi Ty2
cuuaccgguaugacgcgcuaaa

SEQ ID NO: 38976 - RNA, 22 nt, Salmonella enterica enterica serovar Typhi Ty2
cuuacugucgaaaucauuaaag

SEQ ID NO: 38977 - RNA, 22 nt, Salmonella enterica enterica serovar Typhi Ty2
cuuaucuguauugaugauaaac

SEQ ID NO: 38978 - RNA, 22 nt, Salmonella enterica enterica serovar Typhi Ty2
cuucgcgucaugcguuauauca

SEQ ID NO: 38979 - RNA, 22 nt, Salmonella enterica enterica serovar Typhi Ty2
cuucggcaucaaagguaucggc

SEQ ID NO: 38980 - RNA, 21 nt, Salmonella enterica enterica serovar Typhi Ty2
cuuguuaacaguugcgauggc

SEQ ID NO: 38981 - RNA, 22 nt, Salmonella enterica enterica serovar Typhi Ty2
gaaaugguugcuuuugccccug

SEQ ID NO: 38982 - RNA, 22 nt, Salmonella enterica enterica serovar Typhi Ty2
gaacaguuuaaaaagugcauuc

SEQ ID NO: 38983 - RNA, 20 nt, Salmonella enterica enterica serovar Typhi Ty2
gaacaucggucaucuccggc

SEQ ID NO: 38984 - RNA, 22 nt, Salmonella enterica enterica serovar Typhi Ty2
gaaccgugaguucgcggcagua

SEQ ID NO: 38985 - RNA, 22 nt, Salmonella enterica enterica serovar Typhi Ty2
gaacggcgcuauugucgggaug

SEQ ID NO: 38986 - RNA, 22 nt, Salmonella enterica enterica serovar Typhi Ty2
gaacgggcuuuucaggguguag

SEQ ID NO: 38987 - RNA, 22 nt, Salmonella enterica enterica serovar Typhi Ty2
gaagcaacgguaagguagguuu

SEQ ID NO: 38988 - RNA, 22 nt, Salmonella enterica enterica serovar Typhi Ty2
gaagcagugaugacaccgaggc

SEQ ID NO: 38989 - RNA, 22 nt, Salmonella enterica enterica serovar Typhi Ty2
gaaguacgcuauaugccgagug

SEQ ID NO: 38990 - RNA, 22 nt, Salmonella enterica enterica serovar Typhi Ty2
gaauaucuguugccaugcccac

SEQ ID NO: 38991 - RNA, 22 nt, Salmonella enterica enterica serovar Typhi Ty2
gacaacaucccagaaaaugacg

SEQ ID NO: 38992 - RNA, 22 nt, Salmonella enterica enterica serovar Typhi Ty2
gaccaacuuuauguccaauacc

SEQ ID NO: 38993 - RNA, 21 nt, Salmonella enterica enterica serovar Typhi Ty2
gacgaccgauaaacucaggaa

SEQ ID NO: 38994 - RNA, 19 nt, Salmonella enterica enterica serovar Typhi Ty2
gacgcggauaaucaugcua

SEQ ID NO: 38995 - RNA, 22 nt, Salmonella enterica enterica serovar Typhi Ty2
gacgguacguugacuacgccgg

SEQ ID NO: 38996 - RNA, 22 nt, Salmonella enterica enterica serovar Typhi Ty2
gagcuggucgacagugcgcugg

SEQ ID NO: 38997 - RNA, 22 nt, Salmonella enterica enterica serovar Typhi Ty2
gaggaucauauugucgcgguac

SEQ ID NO: 38998 - RNA, 22 nt, Salmonella enterica enterica serovar Typhi Ty2
gaguuuaucuucaacagugaaa

SEQ ID NO: 38999 - RNA, 20 nt, Salmonella enterica enterica serovar Typhi Ty2
gauaaacagcucuucccgcg

SEQ ID NO: 39000 - RNA, 22 nt, Salmonella enterica enterica serovar Typhi Ty2
gauaccgcuaaucgcgacgguc

SEQ ID NO: 39001 - RNA, 22 nt, Salmonella enterica enterica serovar Typhi Ty2
gauagggcgaucgccgguuuug

SEQ ID NO: 39002 - RNA, 22 nt, Salmonella enterica enterica serovar Typhi Ty2
gauaugcagcucauuggcggcg

SEQ ID NO: 39003 - RNA, 22 nt, Salmonella enterica enterica serovar Typhi Ty2
gaucagcgugcuauuuuuuucg

SEQ ID NO: 39004 - RNA, 22 nt, Salmonella enterica enterica serovar Typhi Ty2
gaucagcuuaaagggauuauca

SEQ ID NO: 39005 - RNA, 22 nt, Salmonella enterica enterica serovar Typhi Ty2
gauccguuuguuguuucaaaau

SEQ ID NO: 39006 - RNA, 22 nt, Salmonella enterica enterica serovar Typhi Ty2
gaucgguuaggccgggcaggua

SEQ ID NO: 39007 - RNA, 18 nt, Salmonella enterica enterica serovar Typhi Ty2
gaucguuuuaugucggcg

SEQ ID NO: 39008 - RNA, 22 nt, Salmonella enterica enterica serovar Typhi Ty2
gaugaacauacguuuggucacg

SEQ ID NO: 39009 - RNA, 22 nt, Salmonella enterica enterica serovar Typhi Ty2
gaugaugcacaucggcauccau

SEQ ID NO: 39010 - RNA, 22 nt, Salmonella enterica enterica serovar Typhi Ty2
gaugcuggauaaauauuucgau

SEQ ID NO: 39011 - RNA, 22 nt, Salmonella enterica enterica serovar Typhi Ty2
gaugcuggcguugcgaacauuu

SEQ ID NO: 39012 - RNA, 22 nt, Salmonella enterica enterica serovar Typhi Ty2
gauggcggugcugauggugcaa

SEQ ID NO: 39013 - RNA, 22 nt, Salmonella enterica enterica serovar Typhi Ty2
gauguaggccugauaagcguag

SEQ ID NO: 39014 - RNA, 22 nt, Salmonella enterica enterica serovar Typhi Ty2
gauuacccgggagcaauguugu

SEQ ID NO: 39015 - RNA, 22 nt, Salmonella enterica enterica serovar Typhi Ty2
gauugauuuaggcgacuccggu

SEQ ID NO: 39016 - RNA, 22 nt, Salmonella enterica enterica serovar Typhi Ty2
gauugccuguaauaccgccagu

SEQ ID NO: 39017 - RNA, 22 nt, Salmonella enterica enterica serovar Typhi Ty2
gauuucgcuggaucgucaggaa

SEQ ID NO: 39018 - RNA, 22 nt, Salmonella enterica enterica serovar Typhi Ty2
gcaaugacgccggaagugguac

SEQ ID NO: 39019 - RNA, 22 nt, Salmonella enterica enterica serovar Typhi Ty2
gcacaacgcguauugaaaaugc

SEQ ID NO: 39020 - RNA, 22 nt, Salmonella enterica enterica serovar Typhi Ty2
gcagcaaaaugcugugcguugg

SEQ ID NO: 39021 - RNA, 22 nt, Salmonella enterica enterica serovar Typhi Ty2
gcagcaauagcagaucaaauua

SEQ ID NO: 39022 - RNA, 22 nt, Salmonella enterica enterica serovar Typhi Ty2
gcagcaugauaauucacguugg

SEQ ID NO: 39023 - RNA, 17 nt, Salmonella enterica enterica serovar Typhi Ty2
gcagccugcccagccgg

SEQ ID NO: 39024 - RNA, 22 nt, Salmonella enterica enterica serovar Typhi Ty2
gcagcgguuguuaccaaagccc

SEQ ID NO: 39025 - RNA, 18 nt, Salmonella enterica enterica serovar Typhi Ty2
gcagggcaguaacagcgg

SEQ ID NO: 39026 - RNA, 22 nt, Salmonella enterica enterica serovar Typhi Ty2
gcagguucgcuggguuuaccug

SEQ ID NO: 39027 - RNA, 22 nt, Salmonella enterica enterica serovar Typhi Ty2
gcauugacgauuuuguacaggu

SEQ ID NO: 39028 - RNA, 22 nt, Salmonella enterica enterica serovar Typhi Ty2
gccacgcucagucuucacggau

SEQ ID NO: 39029 - RNA, 22 nt, Salmonella enterica enterica serovar Typhi Ty2
gccagauauauuuuccugcauc

SEQ ID NO: 39030 - RNA, 22 nt, Salmonella enterica enterica serovar Typhi Ty2
gccagcacuaccguuccuuugg

SEQ ID NO: 39031 - RNA, 22 nt, Salmonella enterica enterica serovar Typhi Ty2
gccaggcaaucgaucagggcag

SEQ ID NO: 39032 - RNA, 22 nt, Salmonella enterica enterica serovar Typhi Ty2
gccauugcguuguuagagaagu

SEQ ID NO: 39033 - RNA, 22 nt, Salmonella enterica enterica serovar Typhi Ty2
gccauuugccgcugucguuauu

SEQ ID NO: 39034 - RNA, 22 nt, Salmonella enterica enterica serovar Typhi Ty2
gccgaucaauaauagaaacgac

SEQ ID NO: 39035 - RNA, 22 nt, Salmonella enterica enterica serovar Typhi Ty2
gccggaacgggagaucacugcc

SEQ ID NO: 39036 - RNA, 22 nt, Salmonella enterica enterica serovar Typhi Ty2
gccgguauggucgaggagugaa

SEQ ID NO: 39037 - RNA, 22 nt, Salmonella enterica enterica serovar Typhi Ty2
gccgucuuuaacgagguacugg

SEQ ID NO: 39038 - RNA, 22 nt, Salmonella enterica enterica serovar Typhi Ty2
gccguuuauaaguauuacgaca

SEQ ID NO: 39039 - RNA, 22 nt, Salmonella enterica enterica serovar Typhi Ty2
gccugauggcgcugcgcuuacc

SEQ ID NO: 39040 - RNA, 22 nt, Salmonella enterica enterica serovar Typhi Ty2
gccuggauuuaaugcgucgcag

SEQ ID NO: 39041 - RNA, 22 nt, Salmonella enterica enterica serovar Typhi Ty2
gccugugggugaauccggacug

SEQ ID NO: 39042 - RNA, 22 nt, Salmonella enterica enterica serovar Typhi Ty2
gccuguuuuugcgcaaagaggg

SEQ ID NO: 39043 - RNA, 22 nt, Salmonella enterica enterica serovar Typhi Ty2
gcgacguuaaugacaaugauug

SEQ ID NO: 39044 - RNA, 21 nt, Salmonella enterica enterica serovar Typhi Ty2
gcgauucgucaauuggcggua

SEQ ID NO: 39045 - RNA, 22 nt, Salmonella enterica enterica serovar Typhi Ty2
gcgauugaucaucaugcugccu

SEQ ID NO: 39046 - RNA, 20 nt, Salmonella enterica enterica serovar Typhi Ty2
gcgcacuuuaaucgccauga

SEQ ID NO: 39047 - RNA, 22 nt, Salmonella enterica enterica serovar Typhi Ty2
gcgcagugaggacauauuuguu

SEQ ID NO: 39048 - RNA, 21 nt, Salmonella enterica enterica serovar Typhi Ty2
gcgcaucggguuauuguucac

SEQ ID NO: 39049 - RNA, 22 nt, Salmonella enterica enterica serovar Typhi Ty2
gcgcucaggacucguuugggaa

SEQ ID NO: 39050 - RNA, 22 nt, Salmonella enterica enterica serovar Typhi Ty2
gcgcucugucugcggacgucac

SEQ ID NO: 39051 - RNA, 18 nt, Salmonella enterica enterica serovar Typhi Ty2
gcggauaagcgcagcgcc

SEQ ID NO: 39052 - RNA, 22 nt, Salmonella enterica enterica serovar Typhi Ty2
gcggauaucgaaguggaucugg

SEQ ID NO: 39053 - RNA, 18 nt, Salmonella enterica enterica serovar Typhi Ty2
gcggauugcuuaauggug

SEQ ID NO: 39054 - RNA, 19 nt, Salmonella enterica enterica serovar Typhi Ty2
gcggcuuuuguagauauug

SEQ ID NO: 39055 - RNA, 21 nt, Salmonella enterica enterica serovar Typhi Ty2
gcgguucccaguaccacacca

SEQ ID NO: 39056 - RNA, 22 nt, Salmonella enterica enterica serovar Typhi Ty2
gcgguugcugcauacgcuuucc

SEQ ID NO: 39057 - RNA, 19 nt, Salmonella enterica enterica serovar Typhi Ty2
gcguaagcgcguuuucucc

SEQ ID NO: 39058 - RNA, 22 nt, Salmonella enterica enterica serovar Typhi Ty2
gcguaucaucaacccgaugcgc

SEQ ID NO: 39059 - RNA, 21 nt, Salmonella enterica enterica serovar Typhi Ty2
gcguauuauuuuuaccaguuc

SEQ ID NO: 39060 - RNA, 22 nt, Salmonella enterica enterica serovar Typhi Ty2
gcgucgcagcuuucauggcgua

SEQ ID NO: 39061 - RNA, 22 nt, Salmonella enterica enterica serovar Typhi Ty2
gcgugaaagacuauaucgccau

SEQ ID NO: 39062 - RNA, 21 nt, Salmonella enterica enterica serovar Typhi Ty2
gcgugaugugguucagcgcgc

SEQ ID NO: 39063 - RNA, 23 nt, Salmonella enterica enterica serovar Typhi Ty2
gcguugacaagguauuuuuacag

SEQ ID NO: 39064 - RNA, 22 nt, Salmonella enterica enterica serovar Typhi Ty2
gcguugacgagucgcugauucu

SEQ ID NO: 39065 - RNA, 22 nt, Salmonella enterica enterica serovar Typhi Ty2
gcguuggauaucaugcagauaa

SEQ ID NO: 39066 - RNA, 22 nt, Salmonella enterica enterica serovar Typhi Ty2
gcuaaaggcuugcaagaacugg

SEQ ID NO: 39067 - RNA, 22 nt, Salmonella enterica enterica serovar Typhi Ty2
gcuacaccugugaugcccugaa

SEQ ID NO: 39068 - RNA, 22 nt, Salmonella enterica enterica serovar Typhi Ty2
gcuauagaauggauuaguauua

SEQ ID NO: 39069 - RNA, 22 nt, Salmonella enterica enterica serovar Typhi Ty2
gcuauuucuggugguucaguau

SEQ ID NO: 39070 - RNA, 20 nt, Salmonella enterica enterica serovar Typhi Ty2
gcucaacccggauaucgaac

SEQ ID NO: 39071 - RNA, 22 nt, Salmonella enterica enterica serovar Typhi Ty2
gcucaucagcgcggguauguuc

SEQ ID NO: 39072 - RNA, 22 nt, Salmonella enterica enterica serovar Typhi Ty2
gcucauccaggauacgauuaag

SEQ ID NO: 39073 - RNA, 20 nt, Salmonella enterica enterica serovar Typhi Ty2
gcucggcaaguuugcacagc

SEQ ID NO: 39074 - RNA, 22 nt, Salmonella enterica enterica serovar Typhi Ty2
gcugauacugcucguucaacgc

SEQ ID NO: 39075 - RNA, 22 nt, Salmonella enterica enterica serovar Typhi Ty2
gcugaucagcugcauuggguuc

SEQ ID NO: 39076 - RNA, 22 nt, Salmonella enterica enterica serovar Typhi Ty2
gcugcggauuuuuaacgccugg

SEQ ID NO: 39077 - RNA, 22 nt, Salmonella enterica enterica serovar Typhi Ty2
gcuggcgucaguggcuggaaga

SEQ ID NO: 39078 - RNA, 22 nt, Salmonella enterica enterica serovar Typhi Ty2
gcugucgaugacgcuggguauc

SEQ ID NO: 39079 - RNA, 22 nt, Salmonella enterica enterica serovar Typhi Ty2
uggccgugguggucgacgauca

SEQ ID NO: 39080 - RNA, 22 nt, Salmonella enterica enterica serovar Typhi Ty2
uggcgauaugcguguccacugu

SEQ ID NO: 39081 - RNA, 22 nt, Salmonella enterica enterica serovar Typhi Ty2
uggcgcguggccacaucaucaa

SEQ ID NO: 39082 - RNA, 22 nt, Salmonella enterica enterica serovar Typhi Ty2
uggcgcuacgcuuaucaggccu

SEQ ID NO: 39083 - RNA, 22 nt, Salmonella enterica enterica serovar Typhi Ty2
uggcgcugaugaaacgcauucu

SEQ ID NO: 39084 - RNA, 22 nt, Salmonella enterica enterica serovar Typhi Ty2
uggcgcugcgcuuuccggccua

SEQ ID NO: 39085 - RNA, 22 nt, Salmonella enterica enterica serovar Typhi Ty2
uggcggaguacaaauuucgaau

SEQ ID NO: 39086 - RNA, 22 nt, Salmonella enterica enterica serovar Typhi Ty2
uggcucaagcucaguuaucuga

SEQ ID NO: 39087 - RNA, 22 nt, Salmonella enterica enterica serovar Typhi Ty2
uggcucuuuugcggcguggaau

SEQ ID NO: 39088 - RNA, 22 nt, Salmonella enterica enterica serovar Typhi Ty2
uggcugauuaucccguguccug

SEQ ID NO: 39089 - RNA, 19 nt, Salmonella enterica enterica serovar Typhi Ty2
ugggcgaagcguagccgcg

SEQ ID NO: 39090 - RNA, 22 nt, Salmonella enterica enterica serovar Typhi Ty2
uggguaagcgcagcgccaucag

SEQ ID NO: 39091 - RNA, 22 nt, Salmonella enterica enterica serovar Typhi Ty2
ugguacugcagucagcaucauu

SEQ ID NO: 39092 - RNA, 22 nt, Salmonella enterica enterica serovar Typhi Ty2
ugguaucaacgauagcaaauac

SEQ ID NO: 39093 - RNA, 22 nt, Salmonella enterica enterica serovar Typhi Ty2
ugguaugcagcccagcaccgga

SEQ ID NO: 39094 - RNA, 22 nt, Salmonella enterica enterica serovar Typhi Ty2
uggucacccaggaugucgcauu

SEQ ID NO: 39095 - RNA, 22 nt, Salmonella enterica enterica serovar Typhi Ty2
uggucgagaggguuucaauauu

SEQ ID NO: 39096 - RNA, 22 nt, Salmonella enterica enterica serovar Typhi Ty2
uggugacgucguucugguucag

SEQ ID NO: 39097 - RNA, 22 nt, Salmonella enterica enterica serovar Typhi Ty2
ugguguccaucgagguugccag

SEQ ID NO: 39098 - RNA, 22 nt, Salmonella enterica enterica serovar Typhi Ty2
ugguucccaaauuucucuacga

SEQ ID NO: 39099 - RNA, 22 nt, Salmonella enterica enterica serovar Typhi Ty2
uguagcgcgucucaugcguugc

SEQ ID NO: 39100 - RNA, 22 nt, Salmonella enterica enterica serovar Typhi Ty2
ugucaauauuaacggcagcuug

SEQ ID NO: 39101 - RNA, 22 nt, Salmonella enterica enterica serovar Typhi Ty2
ugucacgcuggacgacgaaauc

SEQ ID NO: 39102 - RNA, 22 nt, Salmonella enterica enterica serovar Typhi Ty2
ugucgcagccgauaucgcuaug

SEQ ID NO: 39103 - RNA, 22 nt, Salmonella enterica enterica serovar Typhi Ty2
ugucgcggauagugaccguugc

SEQ ID NO: 39104 - RNA, 22 nt, Salmonella enterica enterica serovar Typhi Ty2
ugucgcuggaaaaguaucgcga

SEQ ID NO: 39105 - RNA, 22 nt, Salmonella enterica enterica serovar Typhi Ty2
ugugaauggaaaaacguacgaa

SEQ ID NO: 39106 - RNA, 22 nt, Salmonella enterica enterica serovar Typhi Ty2
ugugcguauugccccccauggg

SEQ ID NO: 39107 - RNA, 22 nt, Salmonella enterica enterica serovar Typhi Ty2
uguuaaugcuuuuauugaaugu

SEQ ID NO: 39108 - RNA, 18 nt, Salmonella enterica enterica serovar Typhi Ty2
uguugagcugguacaggc

SEQ ID NO: 39109 - RNA, 23 nt, Salmonella enterica enterica serovar Typhi Ty2
uguugcgcagaucauauucacau

SEQ ID NO: 39110 - RNA, 22 nt, Salmonella enterica enterica serovar Typhi Ty2
uuaccgucgcccggcgguauug

SEQ ID NO: 39111 - RNA, 22 nt, Salmonella enterica enterica serovar Typhi Ty2
uuaccucgaacgaucuggugac

SEQ ID NO: 39112 - RNA, 22 nt, Salmonella enterica enterica serovar Typhi Ty2
uuacgcgggcaacgagcacaac

SEQ ID NO: 39113 - RNA, 22 nt, Salmonella enterica enterica serovar Typhi Ty2
uuagcgccgguauuuuuggcgg

SEQ ID NO: 39114 - RNA, 22 nt, Salmonella enterica enterica serovar Typhi Ty2
uuagcguuacgcuacugucucc

SEQ ID NO: 39115 - RNA, 22 nt, Salmonella enterica enterica serovar Typhi Ty2
uuaucagucuacaaauuacuuu

SEQ ID NO: 39116 - RNA, 22 nt, Salmonella enterica enterica serovar Typhi Ty2
uuauccgcaagcugaacgcgcc

SEQ ID NO: 39117 - RNA, 18 nt, Salmonella enterica enterica serovar Typhi Ty2
uuauccugucguugugcg

SEQ ID NO: 39118 - RNA, 22 nt, Salmonella enterica enterica serovar Typhi Ty2
uucagauacaaaaaacccugcu

SEQ ID NO: 39119 - RNA, 22 nt, Salmonella enterica enterica serovar Typhi Ty2
uucagcaugguacguacauauu

SEQ ID NO: 39120 - RNA, 22 nt, Salmonella enterica enterica serovar Typhi Ty2
uucagccguuuucaggacgcug

SEQ ID NO: 39121 - RNA, 22 nt, Salmonella enterica enterica serovar Typhi Ty2
uucaggccgauauuuucgacca

SEQ ID NO: 39122 - RNA, 22 nt, Salmonella enterica enterica serovar Typhi Ty2
uuccgccaugaaacgcggcgcg

SEQ ID NO: 39123 - RNA, 22 nt, Salmonella enterica enterica serovar Typhi Ty2
uuccgcgauucaggaaguggag

SEQ ID NO: 39124 - RNA, 22 nt, Salmonella enterica enterica serovar Typhi Ty2
uuccggcgucauugccguggau

SEQ ID NO: 39125 - RNA, 19 nt, Salmonella enterica enterica serovar Typhi Ty2
uucgccaaagacuuaaugg

SEQ ID NO: 39126 - RNA, 22 nt, Salmonella enterica enterica serovar Typhi Ty2
uucgcuauggcuacuaccguua

SEQ ID NO: 39127 - RNA, 22 nt, Salmonella enterica enterica serovar Typhi Ty2
uucgcugaguucguucagcguc

SEQ ID NO: 39128 - RNA, 22 nt, Salmonella enterica enterica serovar Typhi Ty2
uucuggcgucguuuucgccgcc

SEQ ID NO: 39129 - RNA, 22 nt, Salmonella enterica enterica serovar Typhi Ty2
uugacugcuaugcugagaggau

SEQ ID NO: 39130 - RNA, 22 nt, Salmonella enterica enterica serovar Typhi Ty2
uugaucaggcaggcguccgguu

SEQ ID NO: 39131 - RNA, 22 nt, Salmonella enterica enterica serovar Typhi Ty2
uugauucgccgcaucgcguaag

SEQ ID NO: 39132 - RNA, 22 nt, Salmonella enterica enterica serovar Typhi Ty2
uugcaccaaaauagugcuucaa

SEQ ID NO: 39133 - RNA, 22 nt, Salmonella enterica enterica serovar Typhi Ty2
uugccaggccugcggcgcguua

SEQ ID NO: 39134 - RNA, 23 nt, Salmonella enterica enterica serovar Typhi Ty2
uugccggcgagaugauggcagga

SEQ ID NO: 39135 - RNA, 22 nt, Salmonella enterica enterica serovar Typhi Ty2
uugccgucgucagugacguaca

SEQ ID NO: 39136 - RNA, 22 nt, Salmonella enterica enterica serovar Typhi Ty2
uugcgcgguggcuuggccgauu

SEQ ID NO: 39137 - RNA, 21 nt, Salmonella enterica enterica serovar Typhi Ty2
uugcggcgagagauuugcgaa

SEQ ID NO: 39138 - RNA, 22 nt, Salmonella enterica enterica serovar Typhi Ty2
uuggcgacaaagaaauauuugg

SEQ ID NO: 39139 - RNA, 22 nt, Salmonella enterica enterica serovar Typhi Ty2
uugguucagggcguuaucuugu

SEQ ID NO: 39140 - RNA, 22 nt, Salmonella enterica enterica serovar Typhi Ty2
uugucaaucgcacgcucugguu

SEQ ID NO: 39141 - RNA, 22 nt, Salmonella enterica enterica serovar Typhi Ty2
uuguccgugcugcugguaauca

SEQ ID NO: 39142 - RNA, 22 nt, Salmonella enterica enterica serovar Typhi Ty2
uugucgaugagacgcuggcggc

SEQ ID NO: 39143 - RNA, 22 nt, Salmonella enterica enterica serovar Typhi Ty2
uugugccggauggcggcgccug

SEQ ID NO: 39144 - RNA, 22 nt, Salmonella enterica enterica serovar Typhi Ty2
uuuaccauuaaaaagugaugug

SEQ ID NO: 39145 - RNA, 17 nt, Salmonella enterica enterica serovar Typhi Ty2
uuuacggcuauaaccag

SEQ ID NO: 39146 - RNA, 22 nt, Salmonella enterica enterica serovar Typhi Ty2
uuuaucagcuuguugagaagau

SEQ ID NO: 39147 - RNA, 22 nt, Salmonella enterica enterica serovar Typhi Ty2
uuuauccgccgcagagacugaa

SEQ ID NO: 39148 - RNA, 17 nt, Salmonella enterica enterica serovar Typhi Ty2
uuucaccauccgcauuc

SEQ ID NO: 39149 - RNA, 22 nt, Salmonella enterica enterica serovar Typhi Ty2
uuucaugcauuggacagcacgc

SEQ ID NO: 39150 - RNA, 22 nt, Salmonella enterica enterica serovar Typhi Ty2
uuuccagaugauucagacaggg

SEQ ID NO: 39151 - RNA, 22 nt, Salmonella enterica enterica serovar Typhi Ty2
uuucgcgggcuucugccauaau

SEQ ID NO: 39152 - RNA, 22 nt, Salmonella enterica enterica serovar Typhi Ty2
uuucugcacaccuggcgucagc

SEQ ID NO: 39153 - RNA, 22 nt, Salmonella enterica enterica serovar Typhi Ty2
uuucugcgacguuaucgguaaa

SEQ ID NO: 39154 - RNA, 22 nt, Salmonella enterica enterica serovar Typhi Ty2
uuucugcgcgcuguccggcccc

SEQ ID NO: 39155 - RNA, 22 nt, Salmonella enterica enterica serovar Typhi Ty2
uuugacgauugcuuuaccauug

SEQ ID NO: 39156 - RNA, 22 nt, Salmonella enterica enterica serovar Typhi Ty2
uuugcccgguaagacuuccugc

SEQ ID NO: 39157 - RNA, 22 nt, Salmonella enterica enterica serovar Typhi Ty2
uuugcuaacuacugucuggcgg

SEQ ID NO: 39158 - RNA, 22 nt, Salmonella enterica enterica serovar Typhi Ty2
gcuuucugcgcgcacgccggag

SEQ ID NO: 39159 - RNA, 22 nt, Salmonella enterica enterica serovar Typhi Ty2
ggaaccauuuugacuuuacgaa

SEQ ID NO: 39160 - RNA, 22 nt, Salmonella enterica enterica serovar Typhi Ty2
ggagcgacagggucuguuguga

SEQ ID NO: 39161 - RNA, 22 nt, Salmonella enterica enterica serovar Typhi Ty2
ggaucggcguuuuauucuuguu

SEQ ID NO: 39162 - RNA, 22 nt, Salmonella enterica enterica serovar Typhi Ty2
ggauuucaugucgacgcaaggg

SEQ ID NO: 39163 - RNA, 22 nt, Salmonella enterica enterica serovar Typhi Ty2
ggcaccagcacuucaaacugac

SEQ ID NO: 39164 - RNA, 22 nt, Salmonella enterica enterica serovar Typhi Ty2
ggcaguggaugaccaugauugu

SEQ ID NO: 39165 - RNA, 22 nt, Salmonella enterica enterica serovar Typhi Ty2
ggcaguugcugagcgcguugau

SEQ ID NO: 39166 - RNA, 22 nt, Salmonella enterica enterica serovar Typhi Ty2
ggccugauuccccagcauuguu

SEQ ID NO: 39167 - RNA, 22 nt, Salmonella enterica enterica serovar Typhi Ty2
ggcgacaauuuuccccuggcga

SEQ ID NO: 39168 - RNA, 22 nt, Salmonella enterica enterica serovar Typhi Ty2
ggcgagguguaagaaagcagaa

SEQ ID NO: 39169 - RNA, 22 nt, Salmonella enterica enterica serovar Typhi Ty2
ggcggaauuauugucgucaugc

SEQ ID NO: 39170 - RNA, 22 nt, Salmonella enterica enterica serovar Typhi Ty2
ggcggcuacgcuuauccgcuca

SEQ ID NO: 39171 - RNA, 22 nt, Salmonella enterica enterica serovar Typhi Ty2
ggcguggacguccuguugaacg

SEQ ID NO: 39172 - RNA, 22 nt, Salmonella enterica enterica serovar Typhi Ty2
ggcuaauugcgguaucuuuuac

SEQ ID NO: 39173 - RNA, 22 nt, Salmonella enterica enterica serovar Typhi Ty2
ggcugcugaagguguucugcgc

SEQ ID NO: 39174 - RNA, 22 nt, Salmonella enterica enterica serovar Typhi Ty2
ggcuuacaccugucagcggcga

SEQ ID NO: 39175 - RNA, 22 nt, Salmonella enterica enterica serovar Typhi Ty2
gggaucaguauaccucgucaga

SEQ ID NO: 39176 - RNA, 18 nt, Salmonella enterica enterica serovar Typhi Ty2
gggcugaugcugugggcg

SEQ ID NO: 39177 - RNA, 21 nt, Salmonella enterica enterica serovar Typhi Ty2
gggcuuaauggcuaucgggcu

SEQ ID NO: 39178 - RNA, 22 nt, Salmonella enterica enterica serovar Typhi Ty2
gggcuuaugcacuaaauaagaa

SEQ ID NO: 39179 - RNA, 22 nt, Salmonella enterica enterica serovar Typhi Ty2
gggcuucuuugcguguguggua

SEQ ID NO: 39180 - RNA, 22 nt, Salmonella enterica enterica serovar Typhi Ty2
ggguaacgcgcgauaguguucc

SEQ ID NO: 39181 - RNA, 22 nt, Salmonella enterica enterica serovar Typhi Ty2
gggucuccaccaguugcagcac

SEQ ID NO: 39182 - RNA, 22 nt, Salmonella enterica enterica serovar Typhi Ty2
gggugacuauggucgcgucuau

SEQ ID NO: 39183 - RNA, 22 nt, Salmonella enterica enterica serovar Typhi Ty2
gguauugagcgauaaaccaauc

SEQ ID NO: 39184 - RNA, 22 nt, Salmonella enterica enterica serovar Typhi Ty2
ggucauuggcccucccaucaga

SEQ ID NO: 39185 - RNA, 22 nt, Salmonella enterica enterica serovar Typhi Ty2
ggugaauuccggauuaugaugu

SEQ ID NO: 39186 - RNA, 22 nt, Salmonella enterica enterica serovar Typhi Ty2
ggugauccagguaucguuagag

SEQ ID NO: 39187 - RNA, 19 nt, Salmonella enterica enterica serovar Typhi Ty2
ggugaucgacgguuacggc

SEQ ID NO: 39188 - RNA, 19 nt, Salmonella enterica enterica serovar Typhi Ty2
ggugcgaugaugcuuggcc

SEQ ID NO: 39189 - RNA, 22 nt, Salmonella enterica enterica serovar Typhi Ty2
gguucugacggaaacgacccug

SEQ ID NO: 39190 - RNA, 22 nt, Salmonella enterica enterica serovar Typhi Ty2
gguugaucugcgaggcggucac

SEQ ID NO: 39191 - RNA, 22 nt, Salmonella enterica enterica serovar Typhi Ty2
guaaagacggcgauaaaagucg

SEQ ID NO: 39192 - RNA, 22 nt, Salmonella enterica enterica serovar Typhi Ty2
guagcguaacuucauuaacggc

SEQ ID NO: 39193 - RNA, 22 nt, Salmonella enterica enterica serovar Typhi Ty2
guagcuuucgucagaucgcuca

SEQ ID NO: 39194 - RNA, 22 nt, Salmonella enterica enterica serovar Typhi Ty2
guauuaccaggaagagcucaau

SEQ ID NO: 39195 - RNA, 22 nt, Salmonella enterica enterica serovar Typhi Ty2
guauuucagguggccuucacgc

SEQ ID NO: 39196 - RNA, 22 nt, Salmonella enterica enterica serovar Typhi Ty2
gucauggucugggggaugaucg

SEQ ID NO: 39197 - RNA, 22 nt, Salmonella enterica enterica serovar Typhi Ty2
gucauucgacggucgugguaac

SEQ ID NO: 39198 - RNA, 22 nt, Salmonella enterica enterica serovar Typhi Ty2
guccagcagugguuucauacuc

SEQ ID NO: 39199 - RNA, 22 nt, Salmonella enterica enterica serovar Typhi Ty2
guccgacucaaacugaaaucgu

SEQ ID NO: 39200 - RNA, 22 nt, Salmonella enterica enterica serovar Typhi Ty2
gucgauagcuauuaccgcacau

SEQ ID NO: 39201 - RNA, 22 nt, Salmonella enterica enterica serovar Typhi Ty2
gucgccaauaccgagguagcgg

SEQ ID NO: 39202 - RNA, 20 nt, Salmonella enterica enterica serovar Typhi Ty2
gucugcggcgacuggcggcg

SEQ ID NO: 39203 - RNA, 18 nt, Salmonella enterica enterica serovar Typhi Ty2
gucuggagcgauuucgug

SEQ ID NO: 39204 - RNA, 22 nt, Salmonella enterica enterica serovar Typhi Ty2
gucuggcgaguuuacacggcac

SEQ ID NO: 39205 - RNA, 22 nt, Salmonella enterica enterica serovar Typhi Ty2
gucuguuauggcuuccagugcg

SEQ ID NO: 39206 - RNA, 22 nt, Salmonella enterica enterica serovar Typhi Ty2
gugaagauucgcgguacggagg

SEQ ID NO: 39207 - RNA, 22 nt, Salmonella enterica enterica serovar Typhi Ty2
gugaauaaucacccggcggcgc

SEQ ID NO: 39208 - RNA, 22 nt, Salmonella enterica enterica serovar Typhi Ty2
gugaauuacauugacguuggcg

SEQ ID NO: 39209 - RNA, 22 nt, Salmonella enterica enterica serovar Typhi Ty2
gugauucgcuggaaugcgcaaa

SEQ ID NO: 39210 - RNA, 22 nt, Salmonella enterica enterica serovar Typhi Ty2
gugcaggaugacucggcuucgc

SEQ ID NO: 39211 - RNA, 22 nt, Salmonella enterica enterica serovar Typhi Ty2
gugccgucgccauuggugucuc

SEQ ID NO: 39212 - RNA, 22 nt, Salmonella enterica enterica serovar Typhi Ty2
gugcgucuuacccggccuacgg

SEQ ID NO: 39213 - RNA, 22 nt, Salmonella enterica enterica serovar Typhi Ty2
guggcggaggugauucaacgcu

SEQ ID NO: 39214 - RNA, 22 nt, Salmonella enterica enterica serovar Typhi Ty2
guggcggauauggguuaugaca

SEQ ID NO: 39215 - RNA, 22 nt, Salmonella enterica enterica serovar Typhi Ty2
gugugcaaagacugauagccgu

SEQ ID NO: 39216 - RNA, 21 nt, Salmonella enterica enterica serovar Typhi Ty2
gugugccacggcauuccggau

SEQ ID NO: 39217 - RNA, 22 nt, Salmonella enterica enterica serovar Typhi Ty2
guguuacgccuuauccggccua

SEQ ID NO: 39218 - RNA, 22 nt, Salmonella enterica enterica serovar Typhi Ty2
guuacgccgccaucaggcaaaa

SEQ ID NO: 39219 - RNA, 22 nt, Salmonella enterica enterica serovar Typhi Ty2
guuacugagaaaucaaaagcga

SEQ ID NO: 39220 - RNA, 22 nt, Salmonella enterica enterica serovar Typhi Ty2
guuauucugcgcucguucuauc

SEQ ID NO: 39221 - RNA, 22 nt, Salmonella enterica enterica serovar Typhi Ty2
guugcagacuguccagacgccc

SEQ ID NO: 39222 - RNA, 22 nt, Salmonella enterica enterica serovar Typhi Ty2
guugccgugauggucugaaaaa

SEQ ID NO: 39223 - RNA, 22 nt, Salmonella enterica enterica serovar Typhi Ty2
guugcgccagcccgacguggcc

SEQ ID NO: 39224 - RNA, 22 nt, Salmonella enterica enterica serovar Typhi Ty2
guugcgcuggugguuuacguca

SEQ ID NO: 39225 - RNA, 22 nt, Salmonella enterica enterica serovar Typhi Ty2
guugcggauaauccagcguaaa

SEQ ID NO: 39226 - RNA, 22 nt, Salmonella enterica enterica serovar Typhi Ty2
guuggaacgguuaaacugauga

SEQ ID NO: 39227 - RNA, 22 nt, Salmonella enterica enterica serovar Typhi Ty2
guuggauaguggcuucuuccag

SEQ ID NO: 39228 - RNA, 22 nt, Salmonella enterica enterica serovar Typhi Ty2
guugucauuuggacaacaguga

SEQ ID NO: 39229 - RNA, 22 nt, Salmonella enterica enterica serovar Typhi Ty2
guuuaucgaaggccagaucguc

SEQ ID NO: 39230 - RNA, 22 nt, Salmonella enterica enterica serovar Typhi Ty2
guuugacgccgcgcggcagaau

SEQ ID NO: 39231 - RNA, 22 nt, Salmonella enterica enterica serovar Typhi Ty2
uaaagcaccgcggccuuuuuug

SEQ ID NO: 39232 - RNA, 22 nt, Salmonella enterica enterica serovar Typhi Ty2
uaacccauuguuuuauuuggug

SEQ ID NO: 39233 - RNA, 22 nt, Salmonella enterica enterica serovar Typhi Ty2
uaagaguaggugaguacgccgu

SEQ ID NO: 39234 - RNA, 20 nt, Salmonella enterica enterica serovar Typhi Ty2
uaagcgcagcgucaucaggc

SEQ ID NO: 39235 - RNA, 22 nt, Salmonella enterica enterica serovar Typhi Ty2
uaaggucauguggguggacgcg

SEQ ID NO: 39236 - RNA, 22 nt, Salmonella enterica enterica serovar Typhi Ty2
uaaucguauccuggaugagcua

SEQ ID NO: 39237 - RNA, 22 nt, Salmonella enterica enterica serovar Typhi Ty2
uaauuccguaagcauuucagac

SEQ ID NO: 39238 - RNA, 22 nt, Salmonella enterica enterica serovar Typhi Ty2
uacaaacggcgguauaacauga

SEQ ID NO: 39239 - RNA, 22 nt, Salmonella enterica enterica serovar Typhi Ty2
uacaggauguucggcguaucgu

SEQ ID NO: 39240 - RNA, 22 nt, Salmonella enterica enterica serovar Typhi Ty2
uaccgcgguggucacggcgauu

SEQ ID NO: 39241 - RNA, 22 nt, Salmonella enterica enterica serovar Typhi Ty2
uaccgugaaaacuucagccagc

SEQ ID NO: 39242 - RNA, 22 nt, Salmonella enterica enterica serovar Typhi Ty2
uaccuggcaugggcgacgaggc

SEQ ID NO: 39243 - RNA, 22 nt, Salmonella enterica enterica serovar Typhi Ty2
uacgacgcacuuuaugaggucc

SEQ ID NO: 39244 - RNA, 22 nt, Salmonella enterica enterica serovar Typhi Ty2
uacgcuccagaccaucaugcau

SEQ ID NO: 39245 - RNA, 22 nt, Salmonella enterica enterica serovar Typhi Ty2
uacguuugccgaggugaucgua

SEQ ID NO: 39246 - RNA, 22 nt, Salmonella enterica enterica serovar Typhi Ty2
uacuacguugucgacgccgguu

SEQ ID NO: 39247 - RNA, 22 nt, Salmonella enterica enterica serovar Typhi Ty2
uagcgugauuacgaccggcgag

SEQ ID NO: 39248 - RNA, 21 nt, Salmonella enterica enterica serovar Typhi Ty2
uagcuccauuacgaucaccac

SEQ ID NO: 39249 - RNA, 22 nt, Salmonella enterica enterica serovar Typhi Ty2
uaggccaaccgccauccggcau

SEQ ID NO: 39250 - RNA, 22 nt, Salmonella enterica enterica serovar Typhi Ty2
uaggccggauaaggcguuagcc

SEQ ID NO: 39251 - RNA, 22 nt, Salmonella enterica enterica serovar Typhi Ty2
uaggccggaugagcguuagcgc

SEQ ID NO: 39252 - RNA, 22 nt, Salmonella enterica enterica serovar Typhi Ty2
uaggccugguaagcgaagcgcc

SEQ ID NO: 39253 - RNA, 22 nt, Salmonella enterica enterica serovar Typhi Ty2
uaggucuggucuaucucuuuuu

SEQ ID NO: 39254 - RNA, 22 nt, Salmonella enterica enterica serovar Typhi Ty2
uagugugagauggugcgaugcu

SEQ ID NO: 39255 - RNA, 22 nt, Salmonella enterica enterica serovar Typhi Ty2
uaguucuucguaagccgucaug

SEQ ID NO: 39256 - RNA, 22 nt, Salmonella enterica enterica serovar Typhi Ty2
uaguugccgccguuuugccgcu

SEQ ID NO: 39257 - RNA, 22 nt, Salmonella enterica enterica serovar Typhi Ty2
uauaugcauuaaugguuuaacc

SEQ ID NO: 39258 - RNA, 22 nt, Salmonella enterica enterica serovar Typhi Ty2
uaucugcgguauuuaauccaua

SEQ ID NO: 39259 - RNA, 22 nt, Salmonella enterica enterica serovar Typhi Ty2
uaucuggcaauuuauugcguug

SEQ ID NO: 39260 - RNA, 22 nt, Salmonella enterica enterica serovar Typhi Ty2
uaugaagaucguaugguucagc

SEQ ID NO: 39261 - RNA, 22 nt, Salmonella enterica enterica serovar Typhi Ty2
uaugaguuugucgaugccgaua

SEQ ID NO: 39262 - RNA, 21 nt, Salmonella enterica enterica serovar Typhi Ty2
uauggcgaccaccugcuggac

SEQ ID NO: 39263 - RNA, 22 nt, Salmonella enterica enterica serovar Typhi Ty2
uaugugaauggaaaaacguacg

SEQ ID NO: 39264 - RNA, 22 nt, Salmonella enterica enterica serovar Typhi Ty2
uauugcgauaaauucuuguagg

SEQ ID NO: 39265 - RNA, 22 nt, Salmonella enterica enterica serovar Typhi Ty2
ucaacuucagcagauaccauua

SEQ ID NO: 39266 - RNA, 22 nt, Salmonella enterica enterica serovar Typhi Ty2
ucaaucuucauccgcgcgccca

SEQ ID NO: 39267 - RNA, 20 nt, Salmonella enterica enterica serovar Typhi Ty2
ucaaugccgauaucgucaau

SEQ ID NO: 39268 - RNA, 22 nt, Salmonella enterica enterica serovar Typhi Ty2
ucaccgaacguagccugauugu

SEQ ID NO: 39269 - RNA, 22 nt, Salmonella enterica enterica serovar Typhi Ty2
ucaccgcgucgaaacggcagua

SEQ ID NO: 39270 - RNA, 22 nt, Salmonella enterica enterica serovar Typhi Ty2
ucaccgucggcucggcggcgua

SEQ ID NO: 39271 - RNA, 22 nt, Salmonella enterica enterica serovar Typhi Ty2
ucacugcaagccucucaggaug

SEQ ID NO: 39272 - RNA, 22 nt, Salmonella enterica enterica serovar Typhi Ty2
ucacugcaggacaacaguaaaa

SEQ ID NO: 39273 - RNA, 23 nt, Salmonella enterica enterica serovar Typhi Ty2
ucagggcugccgaugucgccagc

SEQ ID NO: 39274 - RNA, 22 nt, Salmonella enterica enterica serovar Typhi Ty2
ucagguaaagcgcccguggcga

SEQ ID NO: 39275 - RNA, 22 nt, Salmonella enterica enterica serovar Typhi Ty2
ucaguaauauugaugagcgcgu

SEQ ID NO: 39276 - RNA, 22 nt, Salmonella enterica enterica serovar Typhi Ty2
ucauccguaugguaaccgcgcu

SEQ ID NO: 39277 - RNA, 22 nt, Salmonella enterica enterica serovar Typhi Ty2
ucaugcgcgccuguuaugcgcu

SEQ ID NO: 39278 - RNA, 21 nt, Salmonella enterica enterica serovar Typhi Ty2
ucauugcugagacaggcucug

SEQ ID NO: 39279 - RNA, 22 nt, Salmonella enterica enterica serovar Typhi Ty2
uccagcaaaaaucuuucuuugg

SEQ ID NO: 39280 - RNA, 22 nt, Salmonella enterica enterica serovar Typhi Ty2
ucccgauuagaauuggauuaca

SEQ ID NO: 39281 - RNA, 22 nt, Salmonella enterica enterica serovar Typhi Ty2
ucccggcagaaagguccagcgu

SEQ ID NO: 39282 - RNA, 22 nt, Salmonella enterica enterica serovar Typhi Ty2
ucccugauaaaacaguaacggc

SEQ ID NO: 39283 - RNA, 19 nt, Salmonella enterica enterica serovar Typhi Ty2
uccgacgacgagcguauug

SEQ ID NO: 39284 - RNA, 19 nt, Salmonella enterica enterica serovar Typhi Ty2
uccggaugacgaacuggcc

SEQ ID NO: 39285 - RNA, 22 nt, Salmonella enterica enterica serovar Typhi Ty2
uccgguugauaaacgagcgccu

SEQ ID NO: 39286 - RNA, 22 nt, Salmonella enterica enterica serovar Typhi Ty2
uccugaccugaugcgcgagaag

SEQ ID NO: 39287 - RNA, 22 nt, Salmonella enterica enterica serovar Typhi Ty2
uccugaguuuaucggucgucug

SEQ ID NO: 39288 - RNA, 19 nt, Salmonella enterica enterica serovar Typhi Ty2
ucgaacgcugcgaauuuau

SEQ ID NO: 39289 - RNA, 22 nt, Salmonella enterica enterica serovar Typhi Ty2
ucgaccagguauucgaccuguu

SEQ ID NO: 39290 - RNA, 22 nt, Salmonella enterica enterica serovar Typhi Ty2
ucgacgaacugcaagagcggau

SEQ ID NO: 39291 - RNA, 22 nt, Salmonella enterica enterica serovar Typhi Ty2
ucgacgcgggcaaagcuggcgu

SEQ ID NO: 39292 - RNA, 18 nt, Salmonella enterica enterica serovar Typhi Ty2
ucgacguguuugucgguc

SEQ ID NO: 39293 - RNA, 22 nt, Salmonella enterica enterica serovar Typhi Ty2
ucgauugcauccggaagaguua

SEQ ID NO: 39294 - RNA, 22 nt, Salmonella enterica enterica serovar Typhi Ty2
ucgccaguucccggaaucauug

SEQ ID NO: 39295 - RNA, 22 nt, Salmonella enterica enterica serovar Typhi Ty2
ucgcccgaacguuagucgcacc

SEQ ID NO: 39296 - RNA, 19 nt, Salmonella enterica enterica serovar Typhi Ty2
ucgccgauguacagccggg

SEQ ID NO: 39297 - RNA, 22 nt, Salmonella enterica enterica serovar Typhi Ty2
ucgccguggcugcuggcgcugg

SEQ ID NO: 39298 - RNA, 22 nt, Salmonella enterica enterica serovar Typhi Ty2
ucgcguuuauuaaacaguggca

SEQ ID NO: 39299 - RNA, 18 nt, Salmonella enterica enterica serovar Typhi Ty2
ucggcgcugucaucgccg

SEQ ID NO: 39300 - RNA, 22 nt, Salmonella enterica enterica serovar Typhi Ty2
ucggcguuuaccguaggcgacc

SEQ ID NO: 39301 - RNA, 22 nt, Salmonella enterica enterica serovar Typhi Ty2
ucgggcgugcgcuauuacaucg

SEQ ID NO: 39302 - RNA, 22 nt, Salmonella enterica enterica serovar Typhi Ty2
ucggucauugagaucuguugga

SEQ ID NO: 39303 - RNA, 22 nt, Salmonella enterica enterica serovar Typhi Ty2
ucggugcuaaugcuggcgggca

SEQ ID NO: 39304 - RNA, 22 nt, Salmonella enterica enterica serovar Typhi Ty2
ucguauccgugacuuccguggc

SEQ ID NO: 39305 - RNA, 21 nt, Salmonella enterica enterica serovar Typhi Ty2
ucgucggcacgcugaugacgc

SEQ ID NO: 39306 - RNA, 22 nt, Salmonella enterica enterica serovar Typhi Ty2
ucuauauguugugcggcacuuu

SEQ ID NO: 39307 - RNA, 22 nt, Salmonella enterica enterica serovar Typhi Ty2
ucucguuauuaacgccguucca

SEQ ID NO: 39308 - RNA, 21 nt, Salmonella enterica enterica serovar Typhi Ty2
ucugaaguacaaauuuucauc

SEQ ID NO: 39309 - RNA, 22 nt, Salmonella enterica enterica serovar Typhi Ty2
ucugaauuuaaaaauccugaac

SEQ ID NO: 39310 - RNA, 22 nt, Salmonella enterica enterica serovar Typhi Ty2
ucugacugaugggaugcgcuga

SEQ ID NO: 39311 - RNA, 22 nt, Salmonella enterica enterica serovar Typhi Ty2
ucugauugacgucaaucugggc

SEQ ID NO: 39312 - RNA, 17 nt, Salmonella enterica enterica serovar Typhi Ty2
ucugccugauuaucagg

SEQ ID NO: 39313 - RNA, 22 nt, Salmonella enterica enterica serovar Typhi Ty2
ucugguuaaucgcgcugggugg

SEQ ID NO: 39314 - RNA, 22 nt, Salmonella enterica enterica serovar Typhi Ty2
ucuguaggccugauaagcgcag

SEQ ID NO: 39315 - RNA, 22 nt, Salmonella enterica enterica serovar Typhi Ty2
ucuguaucgggaagcggcgcgc

SEQ ID NO: 39316 - RNA, 22 nt, Salmonella enterica enterica serovar Typhi Ty2
ucuuaugauguagaacgugcaa

SEQ ID NO: 39317 - RNA, 22 nt, Salmonella enterica enterica serovar Typhi Ty2
ucuuggcgcgcuaauuggucug

SEQ ID NO: 39318 - RNA, 22 nt, Salmonella enterica enterica serovar Typhi Ty2
ucuuuagcguugagcgauaaua

SEQ ID NO: 39319 - RNA, 22 nt, Salmonella enterica enterica serovar Typhi Ty2
ucuuucgacuuuucgcccgaag

SEQ ID NO: 39320 - RNA, 22 nt, Salmonella enterica enterica serovar Typhi Ty2
ugaccucugaaggacgcgugau

SEQ ID NO: 39321 - RNA, 22 nt, Salmonella enterica enterica serovar Typhi Ty2
ugaccugcggcaguaucccaga

SEQ ID NO: 39322 - RNA, 22 nt, Salmonella enterica enterica serovar Typhi Ty2
ugacuaauuaucgcccucacua

SEQ ID NO: 39323 - RNA, 22 nt, Salmonella enterica enterica serovar Typhi Ty2
ugagagauauuggauuuuacuu

SEQ ID NO: 39324 - RNA, 22 nt, Salmonella enterica enterica serovar Typhi Ty2
ugaggcaucgagauaugcgacu

SEQ ID NO: 39325 - RNA, 22 nt, Salmonella enterica enterica serovar Typhi Ty2
ugagguauuaaucuguagguga

SEQ ID NO: 39326 - RNA, 21 nt, Salmonella enterica enterica serovar Typhi Ty2
ugauaacggguuaacaggcgu

SEQ ID NO: 39327 - RNA, 22 nt, Salmonella enterica enterica serovar Typhi Ty2
ugauaagguuggugaccauauu

SEQ ID NO: 39328 - RNA, 22 nt, Salmonella enterica enterica serovar Typhi Ty2
ugauacugaggauuuucgcguu

SEQ ID NO: 39329 - RNA, 22 nt, Salmonella enterica enterica serovar Typhi Ty2
ugauccagaucccgcguaucgg

SEQ ID NO: 39330 - RNA, 22 nt, Salmonella enterica enterica serovar Typhi Ty2
ugaugagguaaaagacgcccga

SEQ ID NO: 39331 - RNA, 22 nt, Salmonella enterica enterica serovar Typhi Ty2
ugaugcgcuguguucgcguuau

SEQ ID NO: 39332 - RNA, 21 nt, Salmonella enterica enterica serovar Typhi Ty2
ugaugcggcgaugacgcagcg

SEQ ID NO: 39333 - RNA, 22 nt, Salmonella enterica enterica serovar Typhi Ty2
ugauggcgcagcgcauugaugu

SEQ ID NO: 39334 - RNA, 22 nt, Salmonella enterica enterica serovar Typhi Ty2
ugauugccagcauaaccgccgc

SEQ ID NO: 39335 - RNA, 22 nt, Salmonella enterica enterica serovar Typhi Ty2
ugauuguacgguagguaaucgc

SEQ ID NO: 39336 - RNA, 22 nt, Salmonella enterica enterica serovar Typhi Ty2
ugcacgucggcgaagcgccaaa

SEQ ID NO: 39337 - RNA, 22 nt, Salmonella enterica enterica serovar Typhi Ty2
ugcauauuuaauuucuucgcug

SEQ ID NO: 39338 - RNA, 22 nt, Salmonella enterica enterica serovar Typhi Ty2
ugcaucucuugaggcuauguuu

SEQ ID NO: 39339 - RNA, 22 nt, Salmonella enterica enterica serovar Typhi Ty2
ugccgauuuuggucccggcggc

SEQ ID NO: 39340 - RNA, 22 nt, Salmonella enterica enterica serovar Typhi Ty2
ugccgcauggcgcuacgcuugu

SEQ ID NO: 39341 - RNA, 22 nt, Salmonella enterica enterica serovar Typhi Ty2
ugccgcuuauccggccuacaga

SEQ ID NO: 39342 - RNA, 22 nt, Salmonella enterica enterica serovar Typhi Ty2
ugccggaaagacggcagcgcca

SEQ ID NO: 39343 - RNA, 22 nt, Salmonella enterica enterica serovar Typhi Ty2
ugccggaaagcgauauucgcca

SEQ ID NO: 39344 - RNA, 22 nt, Salmonella enterica enterica serovar Typhi Ty2
ugccugauggcgcgcuuaucug

SEQ ID NO: 39345 - RNA, 22 nt, Salmonella enterica enterica serovar Typhi Ty2
ugcgcaacaguacgaagcgaaa

SEQ ID NO: 39346 - RNA, 21 nt, Salmonella enterica enterica serovar Typhi Ty2
ugcgcagaucauauucacaug

SEQ ID NO: 39347 - RNA, 22 nt, Salmonella enterica enterica serovar Typhi Ty2
ugcgccuuucgcuucaguguau

SEQ ID NO: 39348 - RNA, 22 nt, Salmonella enterica enterica serovar Typhi Ty2
ugcgcgaguauuucgaucugcu

SEQ ID NO: 39349 - RNA, 22 nt, Salmonella enterica enterica serovar Typhi Ty2
ugcgguaguacugacuuugagg

SEQ ID NO: 39350 - RNA, 22 nt, Salmonella enterica enterica serovar Typhi Ty2
ugcgucgauuucuggugcggua

SEQ ID NO: 39351 - RNA, 22 nt, Salmonella enterica enterica serovar Typhi Ty2
ugcgucugccugagcuggugca

SEQ ID NO: 39352 - RNA, 22 nt, Salmonella enterica enterica serovar Typhi Ty2
ugcguucgguuauugcggaaga

SEQ ID NO: 39353 - RNA, 22 nt, Salmonella enterica enterica serovar Typhi Ty2
ugcugccggaaaugucugcgga

SEQ ID NO: 39354 - RNA, 22 nt, Salmonella enterica enterica serovar Typhi Ty2
ugcuggacaccgacgauaacug

SEQ ID NO: 39355 - RNA, 22 nt, Salmonella enterica enterica serovar Typhi Ty2
ugcuggauaaaauuaaggcgau

SEQ ID NO: 39356 - RNA, 22 nt, Salmonella enterica enterica serovar Typhi Ty2
ugcugguaugacgcgccguuaa

SEQ ID NO: 39357 - RNA, 22 nt, Salmonella enterica enterica serovar Typhi Ty2
uggacgccaaucaugaguaccc

SEQ ID NO: 39358 - RNA, 23 nt, Salmonella enterica enterica serovar Typhi Ty2
uggauaacaucaacaggaugacc

SEQ ID NO: 39359 - RNA, 22 nt, Salmonella enterica enterica serovar Typhi Ty2
uggaucugccuauuuugaaaac

SEQ ID NO: 39360 - RNA, 22 nt, Salmonella enterica enterica serovar Typhi Ty2
uggaugaacuuuguaugaucuc

SEQ ID NO: 39361 - RNA, 22 nt, Salmonella enterica enterica serovar Typhi Ty2
uggaugacaccaugaccuaccg

SEQ ID NO: 39362 - RNA, 22 nt, Salmonella enterica enterica serovar Typhi Ty2
uggauuucaaaaacggcgaucc

SEQ ID NO: 39363 - RNA, 22 nt, Salmonella enterica enterica serovar Typhi Ty2
uggcacugcuccagcuuuaccu

SEQ ID NO: 39364 - RNA, 22 nt, Salmonella enterica enterica serovar Typhi Ty2
uggcagcuucgccuuauccggc

SEQ ID NO: 39365 - RNA, 22 nt, Salmonella enterica enterica serovar Typhi Ty2
aaacgcaucgguaugauugcgc

SEQ ID NO: 39366 - RNA, 22 nt, Salmonella enterica enterica serovar Typhi Ty2
aaacgccggcgugaucgucgcu

SEQ ID NO: 39367 - RNA, 22 nt, Salmonella enterica enterica serovar Typhi Ty2
aaagccgcguugaagccuaucc

SEQ ID NO: 39368 - RNA, 22 nt, Salmonella enterica enterica serovar Typhi Ty2
aaagcguaggccugauaagcgc

SEQ ID NO: 39369 - RNA, 22 nt, Salmonella enterica enterica serovar Typhi Ty2
aaagugguuagaguauuuuucg

SEQ ID NO: 39370 - RNA, 22 nt, Salmonella enterica enterica serovar Typhi Ty2
aaaugccuuauccggccuacuc

SEQ ID NO: 39371 - RNA, 21 nt, Salmonella enterica enterica serovar Typhi Ty2
aaaugguuucgccgugggaga

SEQ ID NO: 39372 - RNA, 22 nt, Salmonella enterica enterica serovar Typhi Ty2
aaauguuggcgaccugaugcag

SEQ ID NO: 39373 - RNA, 22 nt, Salmonella enterica enterica serovar Typhi Ty2
aacaugguggcggcgggcagug

SEQ ID NO: 39374 - RNA, 22 nt, Salmonella enterica enterica serovar Typhi Ty2
aaccuucagacucaugguagaa

SEQ ID NO: 39375 - RNA, 22 nt, Salmonella enterica enterica serovar Typhi Ty2
aacgacugcuucaucuggggag

SEQ ID NO: 39376 - RNA, 22 nt, Salmonella enterica enterica serovar Typhi Ty2
aacgaucagcuuuuugccgaaa

SEQ ID NO: 39377 - RNA, 22 nt, Salmonella enterica enterica serovar Typhi Ty2
aacgcaggagaucgcugugcgu

SEQ ID NO: 39378 - RNA, 22 nt, Salmonella enterica enterica serovar Typhi Ty2
aacgccugaagucgugacucgg

SEQ ID NO: 39379 - RNA, 22 nt, Salmonella enterica enterica serovar Typhi Ty2
aacgcgaccaggugauugagca

SEQ ID NO: 39380 - RNA, 22 nt, Salmonella enterica enterica serovar Typhi Ty2
aacggauugcuucgcuguuagu

SEQ ID NO: 39381 - RNA, 22 nt, Salmonella enterica enterica serovar Typhi Ty2
aagaccuugcgggucgugacgu

SEQ ID NO: 39382 - RNA, 22 nt, Salmonella enterica enterica serovar Typhi Ty2
aagacgcgucgccaucuggcuc

SEQ ID NO: 39383 - RNA, 22 nt, Salmonella enterica enterica serovar Typhi Ty2
aagcaugaaacgauauauacug

SEQ ID NO: 39384 - RNA, 22 nt, Salmonella enterica enterica serovar Typhi Ty2
aagcgucgccgggggauauaac

SEQ ID NO: 39385 - RNA, 21 nt, Salmonella enterica enterica serovar Typhi Ty2
aagcugacagaguccugaaaa

SEQ ID NO: 39386 - RNA, 23 nt, Salmonella enterica enterica serovar Typhi Ty2
aagcugcuggauacgguagggaa

SEQ ID NO: 39387 - RNA, 22 nt, Salmonella enterica enterica serovar Typhi Ty2
aaggcguaaaagcgcuucuggc

SEQ ID NO: 39388 - RNA, 22 nt, Salmonella enterica enterica serovar Typhi Ty2
aagucgauuuccgcuuccugcg

SEQ ID NO: 39389 - RNA, 22 nt, Salmonella enterica enterica serovar Typhi Ty2
aauaacgcgugaugcuugucag

SEQ ID NO: 39390 - RNA, 22 nt, Salmonella enterica enterica serovar Typhi Ty2
aaugcaguagucgcugcggagg

SEQ ID NO: 39391 - RNA, 20 nt, Salmonella enterica enterica serovar Typhi Ty2
aaugcgcugaaaaaacguuu

SEQ ID NO: 39392 - RNA, 22 nt, Salmonella enterica enterica serovar Typhi Ty2
aauggcuuuugaacacccaggu

SEQ ID NO: 39393 - RNA, 22 nt, Salmonella enterica enterica serovar Typhi Ty2
aauguccugacauuaaccggcc

SEQ ID NO: 39394 - RNA, 22 nt, Salmonella enterica enterica serovar Typhi Ty2
aaugucgugcauaucggugaac

SEQ ID NO: 39395 - RNA, 22 nt, Salmonella enterica enterica serovar Typhi Ty2
aaugugggcugucgcccagaug

SEQ ID NO: 39396 - RNA, 22 nt, Salmonella enterica enterica serovar Typhi Ty2
aauguucacugccguuauuaug

SEQ ID NO: 39397 - RNA, 22 nt, Salmonella enterica enterica serovar Typhi Ty2
aauuacgagcaguaaugguauc

SEQ ID NO: 39398 - RNA, 22 nt, Salmonella enterica enterica serovar Typhi Ty2
acagaauggcauccgccugcuc

SEQ ID NO: 39399 - RNA, 22 nt, Salmonella enterica enterica serovar Typhi Ty2
acagacaugauaggcgaagcgc

SEQ ID NO: 39400 - RNA, 22 nt, Salmonella enterica enterica serovar Typhi Ty2
acagauuaugcgucauucgcua

SEQ ID NO: 39401 - RNA, 22 nt, Salmonella enterica enterica serovar Typhi Ty2
acaggcagcuuaaagcgcuguu

SEQ ID NO: 39402 - RNA, 22 nt, Salmonella enterica enterica serovar Typhi Ty2
acaggccgcgccauccggcacg

SEQ ID NO: 39403 - RNA, 22 nt, Salmonella enterica enterica serovar Typhi Ty2
acaucguaccgauagcaucggg

SEQ ID NO: 39404 - RNA, 22 nt, Salmonella enterica enterica serovar Typhi Ty2
acauugagggcgaaaucucaua

SEQ ID NO: 39405 - RNA, 22 nt, Salmonella enterica enterica serovar Typhi Ty2
accacgcguggaaaugauguac

SEQ ID NO: 39406 - RNA, 22 nt, Salmonella enterica enterica serovar Typhi Ty2
accacgcugguugucgugcagg

SEQ ID NO: 39407 - RNA, 22 nt, Salmonella enterica enterica serovar Typhi Ty2
accgccaguaacgccgccgcuu

SEQ ID NO: 39408 - RNA, 22 nt, Salmonella enterica enterica serovar Typhi Ty2
agugucguuguugacucgccug

SEQ ID NO: 39409 - RNA, 22 nt, Salmonella enterica enterica serovar Typhi Ty2
aguuaucaacggaagauuagua

SEQ ID NO: 39410 - RNA, 22 nt, Salmonella enterica enterica serovar Typhi Ty2
aguuucucgcugcauauggcgg

SEQ ID NO: 39411 - RNA, 22 nt, Salmonella enterica enterica serovar Typhi Ty2
auaacgauauuucauccccauu

SEQ ID NO: 39412 - RNA, 22 nt, Salmonella enterica enterica serovar Typhi Ty2
auagagauugggcgcguggaga

SEQ ID NO: 39413 - RNA, 22 nt, Salmonella enterica enterica serovar Typhi Ty2
auaggccaguacguucgaaucg

SEQ ID NO: 39414 - RNA, 21 nt, Salmonella enterica enterica serovar Typhi Ty2
auaucgagucauuucgcggcg

SEQ ID NO: 39415 - RNA, 22 nt, Salmonella enterica enterica serovar Typhi Ty2
auauugccguaaaugcuaaugg

SEQ ID NO: 39416 - RNA, 22 nt, Salmonella enterica enterica serovar Typhi Ty2
aucaggcagguuugccggauau

SEQ ID NO: 39417 - RNA, 18 nt, Salmonella enterica enterica serovar Typhi Ty2
aucaggguggauuccggg

SEQ ID NO: 39418 - RNA, 22 nt, Salmonella enterica enterica serovar Typhi Ty2
aaauguacagaauacguggaua

SEQ ID NO: 39419 - RNA, 22 nt, Salmonella enterica enterica serovar Typhi Ty2
aacagaucgacacgcacaauau

SEQ ID NO: 39420 - RNA, 22 nt, Salmonella enterica enterica serovar Typhi Ty2
aacaggguaaaggaggccggag

SEQ ID NO: 39421 - RNA, 22 nt, Salmonella enterica enterica serovar Typhi Ty2
aacgacggaagcaaagaugcga

SEQ ID NO: 39422 - RNA, 22 nt, Salmonella enterica enterica serovar Typhi Ty2
aacgacucgucuaucaccggca

SEQ ID NO: 39423 - RNA, 22 nt, Salmonella enterica enterica serovar Typhi Ty2
aacgccaugaucaucggcaccg

SEQ ID NO: 39424 - RNA, 22 nt, Salmonella enterica enterica serovar Typhi Ty2
aacgccguauuuacgggaggcc

SEQ ID NO: 39425 - RNA, 22 nt, Salmonella enterica enterica serovar Typhi Ty2
aacgcgaagguaaaauuaucgu

SEQ ID NO: 39426 - RNA, 22 nt, Salmonella enterica enterica serovar Typhi Ty2
aacgcgcagauuaaucugguga

SEQ ID NO: 39427 - RNA, 22 nt, Salmonella enterica enterica serovar Typhi Ty2
aacggucaucugcacaaaggcg

SEQ ID NO: 39428 - RNA, 22 nt, Salmonella enterica enterica serovar Typhi Ty2
aacgugaugauacagaauggug

SEQ ID NO: 39429 - RNA, 22 nt, Salmonella enterica enterica serovar Typhi Ty2
aacuaucgcaaacaagaaaaga

SEQ ID NO: 39430 - RNA, 22 nt, Salmonella enterica enterica serovar Typhi Ty2
aacugacuuuguuacuggccgg

SEQ ID NO: 39431 - RNA, 18 nt, Salmonella enterica enterica serovar Typhi Ty2
aacugggcgucaggcaac

SEQ ID NO: 39432 - RNA, 22 nt, Salmonella enterica enterica serovar Typhi Ty2
aagaucggucggcgccuuaugu

SEQ ID NO: 39433 - RNA, 23 nt, Salmonella enterica enterica serovar Typhi Ty2
aagcgguuccacaacaaugaaaa

SEQ ID NO: 39434 - RNA, 22 nt, Salmonella enterica enterica serovar Typhi Ty2
aaggccuuugaccacuauuucg

SEQ ID NO: 39435 - RNA, 22 nt, Salmonella enterica enterica serovar Typhi Ty2
aagguacgaguaauaacguccu

SEQ ID NO: 39436 - RNA, 19 nt, Salmonella enterica enterica serovar Typhi Ty2
aaggucagaaacacacuau

SEQ ID NO: 39437 - RNA, 22 nt, Salmonella enterica enterica serovar Typhi Ty2
aagugcggcaauacuaucgcug

SEQ ID NO: 39438 - RNA, 22 nt, Salmonella enterica enterica serovar Typhi Ty2
aaguggcugggguacgaggauu

SEQ ID NO: 39439 - RNA, 22 nt, Salmonella enterica enterica serovar Typhi Ty2
aauccagaguauuaauuuucgu

SEQ ID NO: 39440 - RNA, 20 nt, Salmonella enterica enterica serovar Typhi Ty2
aauccggugccuuaccgcuu

SEQ ID NO: 39441 - RNA, 22 nt, Salmonella enterica enterica serovar Typhi Ty2
aaucguuggggauaaucuggug

SEQ ID NO: 39442 - RNA, 22 nt, Salmonella enterica enterica serovar Typhi Ty2
aaucuggggcguuaucgcgggu

SEQ ID NO: 39443 - RNA, 22 nt, Salmonella enterica enterica serovar Typhi Ty2
aaucugugcgugauaccaugcu

SEQ ID NO: 39444 - RNA, 22 nt, Salmonella enterica enterica serovar Typhi Ty2
aaucuguugcgucguacuuuuu

SEQ ID NO: 39445 - RNA, 22 nt, Salmonella enterica enterica serovar Typhi Ty2
aaugagcugaugaaugaacuaa

SEQ ID NO: 39446 - RNA, 22 nt, Salmonella enterica enterica serovar Typhi Ty2
aaugcgaucagauccgguagau

SEQ ID NO: 39447 - RNA, 22 nt, Salmonella enterica enterica serovar Typhi Ty2
aauggucguuaucauccagcca

SEQ ID NO: 39448 - RNA, 22 nt, Salmonella enterica enterica serovar Typhi Ty2
aauucgcuccguuaagccuaug

SEQ ID NO: 39449 - RNA, 22 nt, Salmonella enterica enterica serovar Typhi Ty2
aauuguguuugucgauauucgu

SEQ ID NO: 39450 - RNA, 22 nt, Salmonella enterica enterica serovar Typhi Ty2
aauuugcaaauggugaaaugau

SEQ ID NO: 39451 - RNA, 22 nt, Salmonella enterica enterica serovar Typhi Ty2
acagagccugucucagcaauga

SEQ ID NO: 39452 - RNA, 22 nt, Salmonella enterica enterica serovar Typhi Ty2
acaguacuggcacugaagucgc

SEQ ID NO: 39453 - RNA, 20 nt, Salmonella enterica enterica serovar Typhi Ty2
acauaauccggguaaagacc

SEQ ID NO: 39454 - RNA, 22 nt, Salmonella enterica enterica serovar Typhi Ty2
acaucgagauggauuuuugggu

SEQ ID NO: 39455 - RNA, 22 nt, Salmonella enterica enterica serovar Typhi Ty2
accagcgucagaaauaacugaa

SEQ ID NO: 39456 - RNA, 22 nt, Salmonella enterica enterica serovar Typhi Ty2
accgccugguaaucgguuuuca

SEQ ID NO: 39457 - RNA, 22 nt, Salmonella enterica enterica serovar Typhi Ty2
accggcgugccgacgggcguca

SEQ ID NO: 39458 - RNA, 22 nt, Salmonella enterica enterica serovar Typhi Ty2
accgucggugauaucgaaucgc

SEQ ID NO: 39459 - RNA, 16 nt, Salmonella enterica enterica serovar Typhi Ty2
accguugacggucuua

SEQ ID NO: 39460 - RNA, 22 nt, Salmonella enterica enterica serovar Typhi Ty2
accugccguugauugucgaugc

SEQ ID NO: 39461 - RNA, 22 nt, Salmonella enterica enterica serovar Typhi Ty2
accuguuugaacuuaccuggcg

SEQ ID NO: 39462 - RNA, 22 nt, Salmonella enterica enterica serovar Typhi Ty2
acgaugacuguaauguuucccg

SEQ ID NO: 39463 - RNA, 22 nt, Salmonella enterica enterica serovar Typhi Ty2
acgcaaguuaugaaugguauug

SEQ ID NO: 39464 - RNA, 22 nt, Salmonella enterica enterica serovar Typhi Ty2
acgcccuggaacagcaggcggu

SEQ ID NO: 39465 - RNA, 23 nt, Salmonella enterica enterica serovar Typhi Ty2
acgccgcaggcgauggaucugcu

SEQ ID NO: 39466 - RNA, 23 nt, Salmonella enterica enterica serovar Typhi Ty2
acgcggaacacguuaaccagcuc

SEQ ID NO: 39467 - RNA, 22 nt, Salmonella enterica enterica serovar Typhi Ty2
acgcuacagcgguucaucaauu

SEQ ID NO: 39468 - RNA, 22 nt, Salmonella enterica enterica serovar Typhi Ty2
acgcuuaucaggccuacagaau

SEQ ID NO: 39469 - RNA, 22 nt, Salmonella enterica enterica serovar Typhi Ty2
acgguagcugccggaggugcug

SEQ ID NO: 39470 - RNA, 21 nt, Salmonella enterica enterica serovar Typhi Ty2
acgguuggaggguugcugcag

SEQ ID NO: 39471 - RNA, 22 nt, Salmonella enterica enterica serovar Typhi Ty2
acguggugcgcggcagccguuu

SEQ ID NO: 39472 - RNA, 22 nt, Salmonella enterica enterica serovar Typhi Ty2
acguucuggugggagcuggcgc

SEQ ID NO: 39473 - RNA, 22 nt, Salmonella enterica enterica serovar Typhi Ty2
acguucuguaacguagcuacgg

SEQ ID NO: 39474 - RNA, 22 nt, Salmonella enterica enterica serovar Typhi Ty2
acguugcgacaccugcuccggc

SEQ ID NO: 39475 - RNA, 22 nt, Salmonella enterica enterica serovar Typhi Ty2
acguuucuccuccauuugacug

SEQ ID NO: 39476 - RNA, 22 nt, Salmonella enterica enterica serovar Typhi Ty2
acuacgccgccgauagcaucgg

SEQ ID NO: 39477 - RNA, 22 nt, Salmonella enterica enterica serovar Typhi Ty2
acuauucugaagaucacggcgu

SEQ ID NO: 39478 - RNA, 22 nt, Salmonella enterica enterica serovar Typhi Ty2
acugcgguacagcagcgcuauc

SEQ ID NO: 39479 - RNA, 22 nt, Salmonella enterica enterica serovar Typhi Ty2
acuggagaacaugggcgugagu

SEQ ID NO: 39480 - RNA, 22 nt, Salmonella enterica enterica serovar Typhi Ty2
acugugguccugcggacgagca

SEQ ID NO: 39481 - RNA, 22 nt, Salmonella enterica enterica serovar Typhi Ty2
acuguucaaucugcgucucgcc

SEQ ID NO: 39482 - RNA, 22 nt, Salmonella enterica enterica serovar Typhi Ty2
agaacgcacggucagcauugau

SEQ ID NO: 39483 - RNA, 22 nt, Salmonella enterica enterica serovar Typhi Ty2
agaagcguucggucagacgagg

SEQ ID NO: 39484 - RNA, 22 nt, Salmonella enterica enterica serovar Typhi Ty2
agacugcauuucaauggcuucc

SEQ ID NO: 39485 - RNA, 21 nt, Salmonella enterica enterica serovar Typhi Ty2
agacuguuguugcgaugaaga

SEQ ID NO: 39486 - RNA, 22 nt, Salmonella enterica enterica serovar Typhi Ty2
agagcggcuggcgaaacuggcg

SEQ ID NO: 39487 - RNA, 22 nt, Salmonella enterica enterica serovar Typhi Ty2
auccgaaauccgucuguaucuc

SEQ ID NO: 39488 - RNA, 22 nt, Salmonella enterica enterica serovar Typhi Ty2
auccggguaacuaugaugagua

SEQ ID NO: 39489 - RNA, 22 nt, Salmonella enterica enterica serovar Typhi Ty2
auccucagaugaagcgggcgcu

SEQ ID NO: 39490 - RNA, 22 nt, Salmonella enterica enterica serovar Typhi Ty2
auccugauacuuuccgagauag

SEQ ID NO: 39491 - RNA, 22 nt, Salmonella enterica enterica serovar Typhi Ty2
aucgcagauagcaaaaaagcgc

SEQ ID NO: 39492 - RNA, 21 nt, Salmonella enterica enterica serovar Typhi Ty2
aucgccgguuucugccgcggu

SEQ ID NO: 39493 - RNA, 22 nt, Salmonella enterica enterica serovar Typhi Ty2
aucgcucuauaaucguuguaua

SEQ ID NO: 39494 - RNA, 17 nt, Salmonella enterica enterica serovar Typhi Ty2
aucggcauauaggaaug

SEQ ID NO: 39495 - RNA, 22 nt, Salmonella enterica enterica serovar Typhi Ty2
aucgguuuuugcagaaucgucu

SEQ ID NO: 39496 - RNA, 22 nt, Salmonella enterica enterica serovar Typhi Ty2
aucgucacuuuuuuaccgcugu

SEQ ID NO: 39497 - RNA, 22 nt, Salmonella enterica enterica serovar Typhi Ty2
aucgucaucuuuaccagcgaca

SEQ ID NO: 39498 - RNA, 22 nt, Salmonella enterica enterica serovar Typhi Ty2
aucgucaugcuguggcuggucg

SEQ ID NO: 39499 - RNA, 22 nt, Salmonella enterica enterica serovar Typhi Ty2
aucgucguugcaggcgugcgcc

SEQ ID NO: 39500 - RNA, 21 nt, Salmonella enterica enterica serovar Typhi Ty2
aucgucucgaagcgcacguca

SEQ ID NO: 39501 - RNA, 22 nt, Salmonella enterica enterica serovar Typhi Ty2
aucguguaaaucguccagcgcc

SEQ ID NO: 39502 - RNA, 22 nt, Salmonella enterica enterica serovar Typhi Ty2
aucugcuucaugcguuucuuac

SEQ ID NO: 39503 - RNA, 22 nt, Salmonella enterica enterica serovar Typhi Ty2
aucuggcaugcagggccggaag

SEQ ID NO: 39504 - RNA, 22 nt, Salmonella enterica enterica serovar Typhi Ty2
aucuggcuaaaaucugaaggcg

SEQ ID NO: 39505 - RNA, 22 nt, Salmonella enterica enterica serovar Typhi Ty2
aucuguuuauucuucgucagau

SEQ ID NO: 39506 - RNA, 22 nt, Salmonella enterica enterica serovar Typhi Ty2
aucuugauugcagccagaguuu

SEQ ID NO: 39507 - RNA, 22 nt, Salmonella enterica enterica serovar Typhi Ty2
augacaacauuaaaugggagaa

SEQ ID NO: 39508 - RNA, 22 nt, Salmonella enterica enterica serovar Typhi Ty2
augacgguaacauuuuguuggc

SEQ ID NO: 39509 - RNA, 22 nt, Salmonella enterica enterica serovar Typhi Ty2
augagauuaauacacuggagau

SEQ ID NO: 39510 - RNA, 22 nt, Salmonella enterica enterica serovar Typhi Ty2
augaugaugucuuuauugucgg

SEQ ID NO: 39511 - RNA, 22 nt, Salmonella enterica enterica serovar Typhi Ty2
augcauaaaagcagcggcuaau

SEQ ID NO: 39512 - RNA, 22 nt, Salmonella enterica enterica serovar Typhi Ty2
augccgggucggugccuucugc

SEQ ID NO: 39513 - RNA, 22 nt, Salmonella enterica enterica serovar Typhi Ty2
augcgcuguacaaugucgcgau

SEQ ID NO: 39514 - RNA, 22 nt, Salmonella enterica enterica serovar Typhi Ty2
augcgcuuguugcgucaggcua

SEQ ID NO: 39515 - RNA, 22 nt, Salmonella enterica enterica serovar Typhi Ty2
augcugcugauguucaucauug

SEQ ID NO: 39516 - RNA, 22 nt, Salmonella enterica enterica serovar Typhi Ty2
auggcagcauuaugggcauuaa

SEQ ID NO: 39517 - RNA, 22 nt, Salmonella enterica enterica serovar Typhi Ty2
auggcgauauagucuuucacgc

SEQ ID NO: 39518 - RNA, 22 nt, Salmonella enterica enterica serovar Typhi Ty2
auggcggcuccgccuuauccgg

SEQ ID NO: 39519 - RNA, 22 nt, Salmonella enterica enterica serovar Typhi Ty2
augggaugugagaacggaggcc

SEQ ID NO: 39520 - RNA, 22 nt, Salmonella enterica enterica serovar Typhi Ty2
augggcuaucuggacagauuga

SEQ ID NO: 39521 - RNA, 22 nt, Salmonella enterica enterica serovar Typhi Ty2
augguauugaugguuaugucgu

SEQ ID NO: 39522 - RNA, 22 nt, Salmonella enterica enterica serovar Typhi Ty2
auggugacuugcaacuugcaga

SEQ ID NO: 39523 - RNA, 22 nt, Salmonella enterica enterica serovar Typhi Ty2
augguucgacgagcgcggcauc

SEQ ID NO: 39524 - RNA, 22 nt, Salmonella enterica enterica serovar Typhi Ty2
augugcaguuugcgaucgaauu

SEQ ID NO: 39525 - RNA, 22 nt, Salmonella enterica enterica serovar Typhi Ty2
auguuacuggcgugcugaagac

SEQ ID NO: 39526 - RNA, 22 nt, Salmonella enterica enterica serovar Typhi Ty2
auguugagcagcuuucgcuguu

SEQ ID NO: 39527 - RNA, 21 nt, Salmonella enterica enterica serovar Typhi Ty2
auuagccguuuuuuugcaugg

SEQ ID NO: 39528 - RNA, 22 nt, Salmonella enterica enterica serovar Typhi Ty2
auuaucgaugaaugccagcgag

SEQ ID NO: 39529 - RNA, 22 nt, Salmonella enterica enterica serovar Typhi Ty2
auucaggaucgagacugccgua

SEQ ID NO: 39530 - RNA, 22 nt, Salmonella enterica enterica serovar Typhi Ty2
auuccaggaauaaguauccaga

SEQ ID NO: 39531 - RNA, 22 nt, Salmonella enterica enterica serovar Typhi Ty2
auuccguagcuugagcacguug

SEQ ID NO: 39532 - RNA, 22 nt, Salmonella enterica enterica serovar Typhi Ty2
auucgcaaugagaguuugguag

SEQ ID NO: 39533 - RNA, 22 nt, Salmonella enterica enterica serovar Typhi Ty2
auucgcgguaauuaaccgucug

SEQ ID NO: 39534 - RNA, 22 nt, Salmonella enterica enterica serovar Typhi Ty2
auugcaccaauguggugcuuaa

SEQ ID NO: 39535 - RNA, 22 nt, Salmonella enterica enterica serovar Typhi Ty2
auugguacaacgcccuuucgug

SEQ ID NO: 39536 - RNA, 22 nt, Salmonella enterica enterica serovar Typhi Ty2
auuggugacgauagccuguuug

SEQ ID NO: 39537 - RNA, 22 nt, Salmonella enterica enterica serovar Typhi Ty2
auuguuacacgauccccuuuuc

SEQ ID NO: 39538 - RNA, 22 nt, Salmonella enterica enterica serovar Typhi Ty2
auuucugucaccuguugcuguu

SEQ ID NO: 39539 - RNA, 22 nt, Salmonella enterica enterica serovar Typhi Ty2
caacagauaccagcacagcgcc

SEQ ID NO: 39540 - RNA, 22 nt, Salmonella enterica enterica serovar Typhi Ty2
caaccugggaacaagagccauu

SEQ ID NO: 39541 - RNA, 22 nt, Salmonella enterica enterica serovar Typhi Ty2
caacggcauaggugugguccug

SEQ ID NO: 39542 - RNA, 22 nt, Salmonella enterica enterica serovar Typhi Ty2
caacuuaacgcuggcuacuucu

SEQ ID NO: 39543 - RNA, 22 nt, Salmonella enterica enterica serovar Typhi Ty2
caaguagcguuaauaugacuuu

SEQ ID NO: 39544 - RNA, 22 nt, Salmonella enterica enterica serovar Typhi Ty2
caauaucuacaaaggucgugua

SEQ ID NO: 39545 - RNA, 22 nt, Salmonella enterica enterica serovar Typhi Ty2
caaugcggcccaagcagcggac

SEQ ID NO: 39546 - RNA, 22 nt, Salmonella enterica enterica serovar Typhi Ty2
cacauuuccuacguuaucgagc

SEQ ID NO: 39547 - RNA, 22 nt, Salmonella enterica enterica serovar Typhi Ty2
caccgguaucgucaugacaggc

SEQ ID NO: 39548 - RNA, 22 nt, Salmonella enterica enterica serovar Typhi Ty2
caccgguguccuggcaggaagg

SEQ ID NO: 39549 - RNA, 22 nt, Salmonella enterica enterica serovar Typhi Ty2
caccucguuguaugccgccauu

SEQ ID NO: 39550 - RNA, 22 nt, Salmonella enterica enterica serovar Typhi Ty2
cacgcgcugcuucaacauugua

SEQ ID NO: 39551 - RNA, 22 nt, Salmonella enterica enterica serovar Typhi Ty2
cacuaaaucagcggcggacgcg

SEQ ID NO: 39552 - RNA, 22 nt, Salmonella enterica enterica serovar Typhi Ty2
cacuggaucuugggcugguggu

SEQ ID NO: 39553 - RNA, 22 nt, Salmonella enterica enterica serovar Typhi Ty2
cagaaccuggcucaucagugau

SEQ ID NO: 39554 - RNA, 22 nt, Salmonella enterica enterica serovar Typhi Ty2
cagaacuggguagcggggcuuc

SEQ ID NO: 39555 - RNA, 22 nt, Salmonella enterica enterica serovar Typhi Ty2
cagaauaucuggugauaagcgg

SEQ ID NO: 39556 - RNA, 22 nt, Salmonella enterica enterica serovar Typhi Ty2
cgcgcgaacuucuucgauguug

SEQ ID NO: 39557 - RNA, 22 nt, Salmonella enterica enterica serovar Typhi Ty2
cgcggacuucuaguccggcuug

SEQ ID NO: 39558 - RNA, 22 nt, Salmonella enterica enterica serovar Typhi Ty2
cgcggauaaaaugacgcuggcg

SEQ ID NO: 39559 - RNA, 22 nt, Salmonella enterica enterica serovar Typhi Ty2
cgcguuauauuugucauaaauu

SEQ ID NO: 39560 - RNA, 22 nt, Salmonella enterica enterica serovar Typhi Ty2
cgcguuguuaacgaaagcgcug

SEQ ID NO: 39561 - RNA, 22 nt, Salmonella enterica enterica serovar Typhi Ty2
cgcuaaggccuuauugugccgc

SEQ ID NO: 39562 - RNA, 22 nt, Salmonella enterica enterica serovar Typhi Ty2
cgcugaauauucugcguccgga

SEQ ID NO: 39563 - RNA, 23 nt, Salmonella enterica enterica serovar Typhi Ty2
cgcuggaugauuuuugucagagc

SEQ ID NO: 39564 - RNA, 22 nt, Salmonella enterica enterica serovar Typhi Ty2
cgcuguucaggaaggcuucaac

SEQ ID NO: 39565 - RNA, 23 nt, Salmonella enterica enterica serovar Typhi Ty2
cggacugacguugcgaaucaggu

SEQ ID NO: 39566 - RNA, 22 nt, Salmonella enterica enterica serovar Typhi Ty2
cggaugcacuggaugccgccca

SEQ ID NO: 39567 - RNA, 21 nt, Salmonella enterica enterica serovar Typhi Ty2
cggauuacuggugggaauccu

SEQ ID NO: 39568 - RNA, 23 nt, Salmonella enterica enterica serovar Typhi Ty2
cggcaaauuuuuaccguggaugu

SEQ ID NO: 39569 - RNA, 22 nt, Salmonella enterica enterica serovar Typhi Ty2
cggccuguuucuugccgugccu

SEQ ID NO: 39570 - RNA, 22 nt, Salmonella enterica enterica serovar Typhi Ty2
cggcgagauugucaucgacccg

SEQ ID NO: 39571 - RNA, 22 nt, Salmonella enterica enterica serovar Typhi Ty2
cggcggaacauucguuggcgua

SEQ ID NO: 39572 - RNA, 22 nt, Salmonella enterica enterica serovar Typhi Ty2
cgggcaguuaauggcgacgcug

SEQ ID NO: 39573 - RNA, 22 nt, Salmonella enterica enterica serovar Typhi Ty2
cggguuaagcgcggaagaugga

SEQ ID NO: 39574 - RNA, 22 nt, Salmonella enterica enterica serovar Typhi Ty2
cggucgauuguuucacgaaauc

SEQ ID NO: 39575 - RNA, 22 nt, Salmonella enterica enterica serovar Typhi Ty2
cgguuaaagggaauguaguaaa

SEQ ID NO: 39576 - RNA, 22 nt, Salmonella enterica enterica serovar Typhi Ty2
cgguugaaaccuuacagcgccu

SEQ ID NO: 39577 - RNA, 22 nt, Salmonella enterica enterica serovar Typhi Ty2
cgguugaugguuugugcgugcg

SEQ ID NO: 39578 - RNA, 22 nt, Salmonella enterica enterica serovar Typhi Ty2
cguaccggcaaaacagcgucgc

SEQ ID NO: 39579 - RNA, 22 nt, Salmonella enterica enterica serovar Typhi Ty2
cguagcguccggcguaaugccc

SEQ ID NO: 39580 - RNA, 23 nt, Salmonella enterica enterica serovar Typhi Ty2
cguauugagauggcuauaauaga

SEQ ID NO: 39581 - RNA, 22 nt, Salmonella enterica enterica serovar Typhi Ty2
cgucaauaucagcuuucgcguc

SEQ ID NO: 39582 - RNA, 22 nt, Salmonella enterica enterica serovar Typhi Ty2
cguccggaacgugauaguccau

SEQ ID NO: 39583 - RNA, 22 nt, Salmonella enterica enterica serovar Typhi Ty2
cgucgagcagauaaaaacgauu

SEQ ID NO: 39584 - RNA, 22 nt, Salmonella enterica enterica serovar Typhi Ty2
cgugccugauggcgcugugcuu

SEQ ID NO: 39585 - RNA, 22 nt, Salmonella enterica enterica serovar Typhi Ty2
cguguaggccggauuaggcgcu

SEQ ID NO: 39586 - RNA, 20 nt, Salmonella enterica enterica serovar Typhi Ty2
cguuaagguaaagaaaagug

SEQ ID NO: 39587 - RNA, 22 nt, Salmonella enterica enterica serovar Typhi Ty2
cguuaucucggcaugucgaugg

SEQ ID NO: 39588 - RNA, 21 nt, Salmonella enterica enterica serovar Typhi Ty2
cguuccaccuuuaucagcagu

SEQ ID NO: 39589 - RNA, 20 nt, Salmonella enterica enterica serovar Typhi Ty2
cguuggcuuaauacgcugug

SEQ ID NO: 39590 - RNA, 22 nt, Salmonella enterica enterica serovar Typhi Ty2
cuacgcuuaucaggccuacagg

SEQ ID NO: 39591 - RNA, 22 nt, Salmonella enterica enterica serovar Typhi Ty2
cucaaugcuaacuacgcgaugg

SEQ ID NO: 39592 - RNA, 20 nt, Salmonella enterica enterica serovar Typhi Ty2
cucagcaggccguuguccgg

SEQ ID NO: 39593 - RNA, 22 nt, Salmonella enterica enterica serovar Typhi Ty2
cucaguaagggaauagugugau

SEQ ID NO: 39594 - RNA, 22 nt, Salmonella enterica enterica serovar Typhi Ty2
cucgaugcauccagaaugauuu

SEQ ID NO: 39595 - RNA, 22 nt, Salmonella enterica enterica serovar Typhi Ty2
cucgaugccugacuucgacguu

SEQ ID NO: 39596 - RNA, 21 nt, Salmonella enterica enterica serovar Typhi Ty2
cugacgccgcuguuuucacuc

SEQ ID NO: 39597 - RNA, 22 nt, Salmonella enterica enterica serovar Typhi Ty2
cugaucacuucacuuugcguuc

SEQ ID NO: 39598 - RNA, 22 nt, Salmonella enterica enterica serovar Typhi Ty2
cuggaagucaugggcauuuaug

SEQ ID NO: 39599 - RNA, 22 nt, Salmonella enterica enterica serovar Typhi Ty2
cuggauuaagcgggcugcgugu

SEQ ID NO: 39600 - RNA, 22 nt, Salmonella enterica enterica serovar Typhi Ty2
cuggcaaagaaucguacaugcg

SEQ ID NO: 39601 - RNA, 18 nt, Salmonella enterica enterica serovar Typhi Ty2
cuggcaguagugaaagua

SEQ ID NO: 39602 - RNA, 19 nt, Salmonella enterica enterica serovar Typhi Ty2
cuggcauaguaagaaguau

SEQ ID NO: 39603 - RNA, 22 nt, Salmonella enterica enterica serovar Typhi Ty2
cuggcgcugccugcggaugaaa

SEQ ID NO: 39604 - RNA, 22 nt, Salmonella enterica enterica serovar Typhi Ty2
cuggcguuggcuaagggguaaa

SEQ ID NO: 39605 - RNA, 22 nt, Salmonella enterica enterica serovar Typhi Ty2
cuggcugaaaacuugauugcca

SEQ ID NO: 39606 - RNA, 22 nt, Salmonella enterica enterica serovar Typhi Ty2
cuggcuguagacucgcuuuccc

SEQ ID NO: 39607 - RNA, 22 nt, Salmonella enterica enterica serovar Typhi Ty2
cuggcuuuucuugggauucagg

SEQ ID NO: 39608 - RNA, 20 nt, Salmonella enterica enterica serovar Typhi Ty2
cuguaggcccgguaaggcgu

SEQ ID NO: 39609 - RNA, 22 nt, Salmonella enterica enterica serovar Typhi Ty2
cugugagacggcggauugcgug

SEQ ID NO: 39610 - RNA, 22 nt, Salmonella enterica enterica serovar Typhi Ty2
cuguguccugugcgguaaucug

SEQ ID NO: 39611 - RNA, 22 nt, Salmonella enterica enterica serovar Typhi Ty2
cuguucaagcucuauccguggg

SEQ ID NO: 39612 - RNA, 22 nt, Salmonella enterica enterica serovar Typhi Ty2
cuuaugcagaucgccauuggcg

SEQ ID NO: 39613 - RNA, 22 nt, Salmonella enterica enterica serovar Typhi Ty2
cuuccagcagacacucuuccag

SEQ ID NO: 39614 - RNA, 22 nt, Salmonella enterica enterica serovar Typhi Ty2
cuuguaggucggauaaggcgca

SEQ ID NO: 39615 - RNA, 22 nt, Salmonella enterica enterica serovar Typhi Ty2
gaaauguucgugggugucggcg

SEQ ID NO: 39616 - RNA, 22 nt, Salmonella enterica enterica serovar Typhi Ty2
gaacccggcaaguucaacgucu

SEQ ID NO: 39617 - RNA, 22 nt, Salmonella enterica enterica serovar Typhi Ty2
gaacccugcggugaaucgucuu

SEQ ID NO: 39618 - RNA, 22 nt, Salmonella enterica enterica serovar Typhi Ty2
gaacgugauaagcgcccgugag

SEQ ID NO: 39619 - RNA, 22 nt, Salmonella enterica enterica serovar Typhi Ty2
gaauaacgacgcugugauaccg

SEQ ID NO: 39620 - RNA, 22 nt, Salmonella enterica enterica serovar Typhi Ty2
gacaacuggauagccgugugga

SEQ ID NO: 39621 - RNA, 22 nt, Salmonella enterica enterica serovar Typhi Ty2
gacagcgcuucccugcuggugg

SEQ ID NO: 39622 - RNA, 22 nt, Salmonella enterica enterica serovar Typhi Ty2
gacaguguaaguaaaccugcua

SEQ ID NO: 39623 - RNA, 22 nt, Salmonella enterica enterica serovar Typhi Ty2
gaccggaaauagucggcauacg

SEQ ID NO: 39624 - RNA, 22 nt, Salmonella enterica enterica serovar Typhi Ty2
gaccggcuuaaucguucugcug

SEQ ID NO: 39625 - RNA, 22 nt, Salmonella enterica enterica serovar Typhi Ty2
gcugacgcaacguuauccuuca

SEQ ID NO: 39626 - RNA, 22 nt, Salmonella enterica enterica serovar Typhi Ty2
gcugagccugauuuuaccgcug

SEQ ID NO: 39627 - RNA, 19 nt, Salmonella enterica enterica serovar Typhi Ty2
gcugagugaguccgaaaau

SEQ ID NO: 39628 - RNA, 22 nt, Salmonella enterica enterica serovar Typhi Ty2
gcugauaagcaggugaucggcc

SEQ ID NO: 39629 - RNA, 22 nt, Salmonella enterica enterica serovar Typhi Ty2
gcugauaucaaugcuggcgagu

SEQ ID NO: 39630 - RNA, 22 nt, Salmonella enterica enterica serovar Typhi Ty2
gcugaugaccgauaagcugcaa

SEQ ID NO: 39631 - RNA, 22 nt, Salmonella enterica enterica serovar Typhi Ty2
gcugauuauugacuuucuggcg

SEQ ID NO: 39632 - RNA, 22 nt, Salmonella enterica enterica serovar Typhi Ty2
gcuggacguugggggcuaccgg

SEQ ID NO: 39633 - RNA, 22 nt, Salmonella enterica enterica serovar Typhi Ty2
gcuggaugaaacuggcuggaca

SEQ ID NO: 39634 - RNA, 22 nt, Salmonella enterica enterica serovar Typhi Ty2
gcuguagcgacucuucgccggu

SEQ ID NO: 39635 - RNA, 22 nt, Salmonella enterica enterica serovar Typhi Ty2
gcuguagcgccagauggaugug

SEQ ID NO: 39636 - RNA, 22 nt, Salmonella enterica enterica serovar Typhi Ty2
gcuuaucgccuuucugccggug

SEQ ID NO: 39637 - RNA, 22 nt, Salmonella enterica enterica serovar Typhi Ty2
gcuuucaggccuccuggugugg

SEQ ID NO: 39638 - RNA, 22 nt, Salmonella enterica enterica serovar Typhi Ty2
gcuuugcgauccagcuugccau

SEQ ID NO: 39639 - RNA, 22 nt, Salmonella enterica enterica serovar Typhi Ty2
gcuuugcggaucaggcccccau

SEQ ID NO: 39640 - RNA, 22 nt, Salmonella enterica enterica serovar Typhi Ty2
ggaacggccacaguaccagcga

SEQ ID NO: 39641 - RNA, 22 nt, Salmonella enterica enterica serovar Typhi Ty2
ggaccugaugaugcgccggauu

SEQ ID NO: 39642 - RNA, 22 nt, Salmonella enterica enterica serovar Typhi Ty2
ggagccugcaucgucggcgcgc

SEQ ID NO: 39643 - RNA, 22 nt, Salmonella enterica enterica serovar Typhi Ty2
ggauaacauaguguaagauccu

SEQ ID NO: 39644 - RNA, 22 nt, Salmonella enterica enterica serovar Typhi Ty2
ggauacuugaugccuuuauccg

SEQ ID NO: 39645 - RNA, 22 nt, Salmonella enterica enterica serovar Typhi Ty2
ggauaucuggugggauaaccgc

SEQ ID NO: 39646 - RNA, 22 nt, Salmonella enterica enterica serovar Typhi Ty2
ggaucgaguggcgaucgccuau

SEQ ID NO: 39647 - RNA, 22 nt, Salmonella enterica enterica serovar Typhi Ty2
ggcagaccauuuucugcggcgu

SEQ ID NO: 39648 - RNA, 22 nt, Salmonella enterica enterica serovar Typhi Ty2
ggcaucgaaguccgaucaaccc

SEQ ID NO: 39649 - RNA, 22 nt, Salmonella enterica enterica serovar Typhi Ty2
ggccaucauugaagaacagcug

SEQ ID NO: 39650 - RNA, 21 nt, Salmonella enterica enterica serovar Typhi Ty2
ggccaugacaucuauccuauc

SEQ ID NO: 39651 - RNA, 22 nt, Salmonella enterica enterica serovar Typhi Ty2
ggccauuaucgcuacaggcgua

SEQ ID NO: 39652 - RNA, 22 nt, Salmonella enterica enterica serovar Typhi Ty2
ggccuacaagaauuuaucgcaa

SEQ ID NO: 39653 - RNA, 22 nt, Salmonella enterica enterica serovar Typhi Ty2
ggccugauaagcgcagcgccau

SEQ ID NO: 39654 - RNA, 22 nt, Salmonella enterica enterica serovar Typhi Ty2
ggcgacauucagcgcgugcugu

SEQ ID NO: 39655 - RNA, 22 nt, Salmonella enterica enterica serovar Typhi Ty2
ggcgcgaugcuggcgaaggucu

SEQ ID NO: 39656 - RNA, 22 nt, Salmonella enterica enterica serovar Typhi Ty2
ggcgcguaaaaaacugucugaa

SEQ ID NO: 39657 - RNA, 22 nt, Salmonella enterica enterica serovar Typhi Ty2
ggcgcugugcugguaucuguug

SEQ ID NO: 39658 - RNA, 22 nt, Salmonella enterica enterica serovar Typhi Ty2
ggcguacauuacaauuuuucau

SEQ ID NO: 39659 - RNA, 21 nt, Salmonella enterica enterica serovar Typhi Ty2
ggcgucauacagcgacugagg

SEQ ID NO: 39660 - RNA, 22 nt, Salmonella enterica enterica serovar Typhi Ty2
ggcgucuuccaguggcacgccg

SEQ ID NO: 39661 - RNA, 22 nt, Salmonella enterica enterica serovar Typhi Ty2
ggcguucgcuacaauggccggu

SEQ ID NO: 39662 - RNA, 22 nt, Salmonella enterica enterica serovar Typhi Ty2
ggcuacaacgccauugccgccg

SEQ ID NO: 39663 - RNA, 22 nt, Salmonella enterica enterica serovar Typhi Ty2
ggcucuauuugcgcacgcagau

SEQ ID NO: 39664 - RNA, 22 nt, Salmonella enterica enterica serovar Typhi Ty2
ggcuucgcugcuggucggcagu

SEQ ID NO: 39665 - RNA, 22 nt, Salmonella enterica enterica serovar Typhi Ty2
gggcaguuugggcuuggcgcag

SEQ ID NO: 39666 - RNA, 22 nt, Salmonella enterica enterica serovar Typhi Ty2
gggccauacaguuugugagcgg

SEQ ID NO: 39667 - RNA, 22 nt, Salmonella enterica enterica serovar Typhi Ty2
gggccuguaaucaauuaauugu

SEQ ID NO: 39668 - RNA, 22 nt, Salmonella enterica enterica serovar Typhi Ty2
gggcgacacccugaugacgcug

SEQ ID NO: 39669 - RNA, 22 nt, Salmonella enterica enterica serovar Typhi Ty2
gggcgaugcuggaugaauuacg

SEQ ID NO: 39670 - RNA, 22 nt, Salmonella enterica enterica serovar Typhi Ty2
gggcgcauguuuugaguaaaac

SEQ ID NO: 39671 - RNA, 22 nt, Salmonella enterica enterica serovar Typhi Ty2
ggguacugagugguggaccgug

SEQ ID NO: 39672 - RNA, 22 nt, Salmonella enterica enterica serovar Typhi Ty2
gguaaugcacgcaucgaccgcu

SEQ ID NO: 39673 - RNA, 22 nt, Salmonella enterica enterica serovar Typhi Ty2
gguauucgaaauugucuuuauc

SEQ ID NO: 39674 - RNA, 22 nt, Salmonella enterica enterica serovar Typhi Ty2
ggucacguuuacgcugucgcca

SEQ ID NO: 39675 - RNA, 22 nt, Salmonella enterica enterica serovar Typhi Ty2
ggucugucauucacggaagaca

SEQ ID NO: 39676 - RNA, 22 nt, Salmonella enterica enterica serovar Typhi Ty2
ggugaccguugccagaauaucu

SEQ ID NO: 39677 - RNA, 22 nt, Salmonella enterica enterica serovar Typhi Ty2
ggugagcugugaugcacagcgg

SEQ ID NO: 39678 - RNA, 22 nt, Salmonella enterica enterica serovar Typhi Ty2
ggugguaaaacccgaccagaua

SEQ ID NO: 39679 - RNA, 22 nt, Salmonella enterica enterica serovar Typhi Ty2
gguuucauuuguugccguuaug

SEQ ID NO: 39680 - RNA, 22 nt, Salmonella enterica enterica serovar Typhi Ty2
guaaucgcugcuaaaggcuucg

SEQ ID NO: 39681 - RNA, 22 nt, Salmonella enterica enterica serovar Typhi Ty2
guaaugaugccuugcugugccg

SEQ ID NO: 39682 - RNA, 20 nt, Salmonella enterica enterica serovar Typhi Ty2
guacugaugcuucguccguu

SEQ ID NO: 39683 - RNA, 22 nt, Salmonella enterica enterica serovar Typhi Ty2
guacugauguauacgcuggccu

SEQ ID NO: 39684 - RNA, 22 nt, Salmonella enterica enterica serovar Typhi Ty2
guagauuccagccguuugaaug

SEQ ID NO: 39685 - RNA, 22 nt, Salmonella enterica enterica serovar Typhi Ty2
guagcgggcgguauccggucaa

SEQ ID NO: 39686 - RNA, 22 nt, Salmonella enterica enterica serovar Typhi Ty2
guaggccggauaaucguagcgc

SEQ ID NO: 39687 - RNA, 22 nt, Salmonella enterica enterica serovar Typhi Ty2
guauagccgaaguugaccgcuu

SEQ ID NO: 39688 - RNA, 21 nt, Salmonella enterica enterica serovar Typhi Ty2
guaucaguaguaccgcaguga

SEQ ID NO: 39689 - RNA, 22 nt, Salmonella enterica enterica serovar Typhi Ty2
guaugcgccuucagaucggagu

SEQ ID NO: 39690 - RNA, 22 nt, Salmonella enterica enterica serovar Typhi Ty2
guauggacagcaagcuuuccgg

SEQ ID NO: 39691 - RNA, 22 nt, Salmonella enterica enterica serovar Typhi Ty2
guauggcgugccauuguugccu

SEQ ID NO: 39692 - RNA, 22 nt, Salmonella enterica enterica serovar Typhi Ty2
gucacucucacuuuugugacgu

SEQ ID NO: 39693 - RNA, 22 nt, Salmonella enterica enterica serovar Typhi Ty2
gucauggcggcguggcgcugcg

SEQ ID NO: 39694 - RNA, 22 nt, Salmonella enterica enterica serovar Typhi Ty2
uaucgccaggcacggauaaggu

SEQ ID NO: 39695 - RNA, 22 nt, Salmonella enterica enterica serovar Typhi Ty2
uauggaugacugugccugcgcu

SEQ ID NO: 39696 - RNA, 22 nt, Salmonella enterica enterica serovar Typhi Ty2
uauggcgguugcguggccgccu

SEQ ID NO: 39697 - RNA, 22 nt, Salmonella enterica enterica serovar Typhi Ty2
uauugguauacguuuagguaua

SEQ ID NO: 39698 - RNA, 22 nt, Salmonella enterica enterica serovar Typhi Ty2
uauugucggccuggugcuguug

SEQ ID NO: 39699 - RNA, 22 nt, Salmonella enterica enterica serovar Typhi Ty2
uauuugccagcauauagcucag

SEQ ID NO: 39700 - RNA, 22 nt, Salmonella enterica enterica serovar Typhi Ty2
ucacgcuuuuuccugacccuga

SEQ ID NO: 39701 - RNA, 22 nt, Salmonella enterica enterica serovar Typhi Ty2
ucacugaugagccagguucugg

SEQ ID NO: 39702 - RNA, 22 nt, Salmonella enterica enterica serovar Typhi Ty2
ucagaauaucuccauuauucgc

SEQ ID NO: 39703 - RNA, 22 nt, Salmonella enterica enterica serovar Typhi Ty2
ucagaccuucuucgauuucgcg

SEQ ID NO: 39704 - RNA, 22 nt, Salmonella enterica enterica serovar Typhi Ty2
ucagccgacuucugcgucagcc

SEQ ID NO: 39705 - RNA, 22 nt, Salmonella enterica enterica serovar Typhi Ty2
ucagccgccgacagaugccauu

SEQ ID NO: 39706 - RNA, 22 nt, Salmonella enterica enterica serovar Typhi Ty2
ucagcgccaguacgcccagcaa

SEQ ID NO: 39707 - RNA, 22 nt, Salmonella enterica enterica serovar Typhi Ty2
ucagcgcuuucacuuccugguc

SEQ ID NO: 39708 - RNA, 22 nt, Salmonella enterica enterica serovar Typhi Ty2
ucagcgggaaacagagcguggc

SEQ ID NO: 39709 - RNA, 22 nt, Salmonella enterica enterica serovar Typhi Ty2
ucaggcuacguucggugagcuc

SEQ ID NO: 39710 - RNA, 22 nt, Salmonella enterica enterica serovar Typhi Ty2
ucaggguggugauguaguagua

SEQ ID NO: 39711 - RNA, 22 nt, Salmonella enterica enterica serovar Typhi Ty2
ucaucuggugccugcgacgguu

SEQ ID NO: 39712 - RNA, 22 nt, Salmonella enterica enterica serovar Typhi Ty2
ucauguucauuauuaacugcuc

SEQ ID NO: 39713 - RNA, 22 nt, Salmonella enterica enterica serovar Typhi Ty2
ucauuacccgugaugaagaugc

SEQ ID NO: 39714 - RNA, 21 nt, Salmonella enterica enterica serovar Typhi Ty2
ucauugcugccggauggcggc

SEQ ID NO: 39715 - RNA, 22 nt, Salmonella enterica enterica serovar Typhi Ty2
uccagcgugccguagcgcugcc

SEQ ID NO: 39716 - RNA, 22 nt, Salmonella enterica enterica serovar Typhi Ty2
uccagguuuuugcacaacguuu

SEQ ID NO: 39717 - RNA, 22 nt, Salmonella enterica enterica serovar Typhi Ty2
uccaugauuuugucuggugcca

SEQ ID NO: 39718 - RNA, 21 nt, Salmonella enterica enterica serovar Typhi Ty2
uccgaaauggucgucaccauc

SEQ ID NO: 39719 - RNA, 19 nt, Salmonella enterica enterica serovar Typhi Ty2
uccgcagcccugguuugcc

SEQ ID NO: 39720 - RNA, 22 nt, Salmonella enterica enterica serovar Typhi Ty2
uccgcaggcguucgaaaagggu

SEQ ID NO: 39721 - RNA, 22 nt, Salmonella enterica enterica serovar Typhi Ty2
uccgcgaccgguaguaaaaaua

SEQ ID NO: 39722 - RNA, 22 nt, Salmonella enterica enterica serovar Typhi Ty2
uccgcgaugcucgcccaccacc

SEQ ID NO: 39723 - RNA, 18 nt, Salmonella enterica enterica serovar Typhi Ty2
uccgcuggacucccugaa

SEQ ID NO: 39724 - RNA, 22 nt, Salmonella enterica enterica serovar Typhi Ty2
uccggcauuugcgcggcgaccg

SEQ ID NO: 39725 - RNA, 22 nt, Salmonella enterica enterica serovar Typhi Ty2
uccguaaccgucuggcggaguc

SEQ ID NO: 39726 - RNA, 22 nt, Salmonella enterica enterica serovar Typhi Ty2
ucgacacgguggugaucguucu

SEQ ID NO: 39727 - RNA, 18 nt, Salmonella enterica enterica serovar Typhi Ty2
ucgaccucgacaaucacc

SEQ ID NO: 39728 - RNA, 22 nt, Salmonella enterica enterica serovar Typhi Ty2
ucgagcacugcccggcccuaaa

SEQ ID NO: 39729 - RNA, 22 nt, Salmonella enterica enterica serovar Typhi Ty2
ucgagcguuucgaauacgcugu

SEQ ID NO: 39730 - RNA, 19 nt, Salmonella enterica enterica serovar Typhi Ty2
ucgaugacuaucugcaugu

SEQ ID NO: 39731 - RNA, 22 nt, Salmonella enterica enterica serovar Typhi Ty2
ucgaugcugacgguauccugca

SEQ ID NO: 39732 - RNA, 22 nt, Salmonella enterica enterica serovar Typhi Ty2
ucgcgcaaauuauguauaugca

SEQ ID NO: 39733 - RNA, 22 nt, Salmonella enterica enterica serovar Typhi Ty2
ucgcucaagcuggaugacaauc

SEQ ID NO: 39734 - RNA, 23 nt, Salmonella enterica enterica serovar Typhi Ty2
ucgcucauacacucgguaaugca

SEQ ID NO: 39735 - RNA, 22 nt, Salmonella enterica enterica serovar Typhi Ty2
ucgguauggcaugaugcggaau

SEQ ID NO: 39736 - RNA, 22 nt, Salmonella enterica enterica serovar Typhi Ty2
ucguuaaguucauuaaugcguu

SEQ ID NO: 39737 - RNA, 22 nt, Salmonella enterica enterica serovar Typhi Ty2
ucguucagucccaugugccgga

SEQ ID NO: 39738 - RNA, 21 nt, Salmonella enterica enterica serovar Typhi Ty2
ucugauucaucggccaugacc

SEQ ID NO: 39739 - RNA, 22 nt, Salmonella enterica enterica serovar Typhi Ty2
ucugcaaacguaggaaaagggu

SEQ ID NO: 39740 - RNA, 22 nt, Salmonella enterica enterica serovar Typhi Ty2
ucugcauccccacgcgggugac

SEQ ID NO: 39741 - RNA, 22 nt, Salmonella enterica enterica serovar Typhi Ty2
ucugcgcgugcuggcggaugac

SEQ ID NO: 39742 - RNA, 22 nt, Salmonella enterica enterica serovar Typhi Ty2
ucuguaggcccgguaagcguca

SEQ ID NO: 39743 - RNA, 22 nt, Salmonella enterica enterica serovar Typhi Ty2
ucugucauucgacgaaugauua

SEQ ID NO: 39744 - RNA, 22 nt, Salmonella enterica enterica serovar Typhi Ty2
ucuucagcgccaaacgcgucug

SEQ ID NO: 39745 - RNA, 22 nt, Salmonella enterica enterica serovar Typhi Ty2
ugaagaucagcagcgauuugau

SEQ ID NO: 39746 - RNA, 22 nt, Salmonella enterica enterica serovar Typhi Ty2
ugaaguuuaucaaaggugacgc

SEQ ID NO: 39747 - RNA, 22 nt, Salmonella enterica enterica serovar Typhi Ty2
ugaccucgauugcuggcgguac

SEQ ID NO: 39748 - RNA, 22 nt, Salmonella enterica enterica serovar Typhi Ty2
ugacgcugaaguugcugccgca

SEQ ID NO: 39749 - RNA, 22 nt, Salmonella enterica enterica serovar Typhi Ty2
ugacggagaucguccgcggcgc

SEQ ID NO: 39750 - RNA, 22 nt, Salmonella enterica enterica serovar Typhi Ty2
ugacguuccagcgcccacuguu

SEQ ID NO: 39751 - RNA, 22 nt, Salmonella enterica enterica serovar Typhi Ty2
ugacuaucugcgcuggugcuua

SEQ ID NO: 39752 - RNA, 21 nt, Salmonella enterica enterica serovar Typhi Ty2
ugacuuucccgguccgcuggc

SEQ ID NO: 39753 - RNA, 22 nt, Salmonella enterica enterica serovar Typhi Ty2
ugagaauuuucguugcaagggu

SEQ ID NO: 39754 - RNA, 22 nt, Salmonella enterica enterica serovar Typhi Ty2
ugagaucguacugcagcagcuc

SEQ ID NO: 39755 - RNA, 22 nt, Salmonella enterica enterica serovar Typhi Ty2
ugaggugauuaaaaucauuaug

SEQ ID NO: 39756 - RNA, 22 nt, Salmonella enterica enterica serovar Typhi Ty2
ugauaaugcugacauuaugcgc

SEQ ID NO: 39757 - RNA, 22 nt, Salmonella enterica enterica serovar Typhi Ty2
ugauacugucggcaaugcgcuu

SEQ ID NO: 39758 - RNA, 22 nt, Salmonella enterica enterica serovar Typhi Ty2
ugauaucuggcccagguccgau

SEQ ID NO: 39759 - RNA, 22 nt, Salmonella enterica enterica serovar Typhi Ty2
ugaucaauuucaaagaagcgac

SEQ ID NO: 39760 - RNA, 22 nt, Salmonella enterica enterica serovar Typhi Ty2
ugaucacgcuugcggugauggu

SEQ ID NO: 39761 - RNA, 22 nt, Salmonella enterica enterica serovar Typhi Ty2
ugaugcagacgacgacaugcgc

SEQ ID NO: 39762 - RNA, 22 nt, Salmonella enterica enterica serovar Typhi Ty2
ugaugcagugcgacuggcccau

SEQ ID NO: 39763 - RNA, 22 nt, Salmonella enterica enterica serovar Typhi Ty2
uuacgcgcuuugcguaaggucg

SEQ ID NO: 39764 - RNA, 22 nt, Salmonella enterica enterica serovar Typhi Ty2
uuacgcuggacgucauguggga

SEQ ID NO: 39765 - RNA, 22 nt, Salmonella enterica enterica serovar Typhi Ty2
uuagcagacaaaucguuguuga

SEQ ID NO: 39766 - RNA, 22 nt, Salmonella enterica enterica serovar Typhi Ty2
uuagccgggcauucaccgcaca

SEQ ID NO: 39767 - RNA, 22 nt, Salmonella enterica enterica serovar Typhi Ty2
uuauccgggcauuaaaguuucc

SEQ ID NO: 39768 - RNA, 22 nt, Salmonella enterica enterica serovar Typhi Ty2
uuaucgccggagaagcuuacca

SEQ ID NO: 39769 - RNA, 22 nt, Salmonella enterica enterica serovar Typhi Ty2
uuauggcgcgggggaaaagaug

SEQ ID NO: 39770 - RNA, 20 nt, Salmonella enterica enterica serovar Typhi Ty2
uucaggucgaugucaucaau

SEQ ID NO: 39771 - RNA, 22 nt, Salmonella enterica enterica serovar Typhi Ty2
uucauauccgcuuuaaucgcgc

SEQ ID NO: 39772 - RNA, 22 nt, Salmonella enterica enterica serovar Typhi Ty2
uucauuacuuugaauggcggaa

SEQ ID NO: 39773 - RNA, 22 nt, Salmonella enterica enterica serovar Typhi Ty2
uucauugagguuuuucucgcug

SEQ ID NO: 39774 - RNA, 22 nt, Salmonella enterica enterica serovar Typhi Ty2
uuccgcacaacaguuugagcua

SEQ ID NO: 39775 - RNA, 22 nt, Salmonella enterica enterica serovar Typhi Ty2
uuccggcgugaccagaaacugg

SEQ ID NO: 39776 - RNA, 21 nt, Salmonella enterica enterica serovar Typhi Ty2
uucgagcguaucggucaggga

SEQ ID NO: 39777 - RNA, 22 nt, Salmonella enterica enterica serovar Typhi Ty2
uucgaugagguuuguugcaacg

SEQ ID NO: 39778 - RNA, 22 nt, Salmonella enterica enterica serovar Typhi Ty2
uucgauuuaugaauggugacga

SEQ ID NO: 39779 - RNA, 22 nt, Salmonella enterica enterica serovar Typhi Ty2
uucgcaaacaacaucuuuguug

SEQ ID NO: 39780 - RNA, 22 nt, Salmonella enterica enterica serovar Typhi Ty2
uucgcgauacugcgccaacgcu

SEQ ID NO: 39781 - RNA, 22 nt, Salmonella enterica enterica serovar Typhi Ty2
uucgcuaucguuauucugguuu

SEQ ID NO: 39782 - RNA, 22 nt, Salmonella enterica enterica serovar Typhi Ty2
uucgucugccugauagcgguga

SEQ ID NO: 39783 - RNA, 22 nt, Salmonella enterica enterica serovar Typhi Ty2
uucgugagcuacgucaaaaugu

SEQ ID NO: 39784 - RNA, 22 nt, Salmonella enterica enterica serovar Typhi Ty2
uucugcugcaaaaaacguucgg

SEQ ID NO: 39785 - RNA, 22 nt, Salmonella enterica enterica serovar Typhi Ty2
uugaagcacuauuuuggugcaa

SEQ ID NO: 39786 - RNA, 22 nt, Salmonella enterica enterica serovar Typhi Ty2
uugaccgugcuggcauucgccg

SEQ ID NO: 39787 - RNA, 22 nt, Salmonella enterica enterica serovar Typhi Ty2
uugaccuugugacugagcagcg

SEQ ID NO: 39788 - RNA, 22 nt, Salmonella enterica enterica serovar Typhi Ty2
uugacgauuuuaccugaucgcu

SEQ ID NO: 39789 - RNA, 20 nt, Salmonella enterica enterica serovar Typhi Ty2
uugcaggccacggcgguuau

SEQ ID NO: 39790 - RNA, 22 nt, Salmonella enterica enterica serovar Typhi Ty2
uugcaguucacuaucaaggcaa

SEQ ID NO: 39791 - RNA, 22 nt, Salmonella enterica enterica serovar Typhi Ty2
uugcaguuggcuaauaugcugc

SEQ ID NO: 39792 - RNA, 22 nt, Salmonella enterica enterica serovar Typhi Ty2
uugccgacgagcaggcaauggu

SEQ ID NO: 39793 - RNA, 22 nt, Salmonella enterica enterica serovar Typhi Ty2
uugccggucauccaagccgcaa

SEQ ID NO: 39794 - RNA, 22 nt, Salmonella enterica enterica serovar Typhi Ty2
uugcggcagcccgccaggauuu

SEQ ID NO: 39795 - RNA, 22 nt, Salmonella enterica enterica serovar Typhi Ty2
uugcggcugucuucgcggcuca

SEQ ID NO: 39796 - RNA, 22 nt, Salmonella enterica enterica serovar Typhi Ty2
uugcgggacagcuugucgauau

SEQ ID NO: 39797 - RNA, 22 nt, Salmonella enterica enterica serovar Typhi Ty2
uugcugaacaguugccgggcga

SEQ ID NO: 39798 - RNA, 22 nt, Salmonella enterica enterica serovar Typhi Ty2
uuggcugacgaauauuauuaaa

SEQ ID NO: 39799 - RNA, 22 nt, Salmonella enterica enterica serovar Typhi Ty2
uuguaggcccggucagcgcagc

SEQ ID NO: 39800 - RNA, 22 nt, Salmonella enterica enterica serovar Typhi Ty2
uugucacagguguugccgguaa

SEQ ID NO: 39801 - RNA, 23 nt, Salmonella enterica enterica serovar Typhi Ty2
uugucaccuuuucagcuaucagc

SEQ ID NO: 39802 - RNA, 22 nt, Salmonella enterica enterica serovar Typhi Ty2
uugucucgccgaccggcacgcc

SEQ ID NO: 39803 - RNA, 22 nt, Salmonella enterica enterica serovar Typhi Ty2
uuguucaaaguguaguaacguu

SEQ ID NO: 39804 - RNA, 22 nt, Salmonella enterica enterica serovar Typhi Ty2
uuguucaacagucgguagcuga

SEQ ID NO: 39805 - RNA, 22 nt, Salmonella enterica enterica serovar Typhi Ty2
uuuaccguuugauuucaaucgc

SEQ ID NO: 39806 - RNA, 22 nt, Salmonella enterica enterica serovar Typhi Ty2
uuuacgcaucaucgcgcaacgc

SEQ ID NO: 39807 - RNA, 22 nt, Salmonella enterica enterica serovar Typhi Ty2
uuuacggaucugcaggaucagg

SEQ ID NO: 39808 - RNA, 22 nt, Salmonella enterica enterica serovar Typhi Ty2
uuucaacugcgcggcacgcuca

SEQ ID NO: 39809 - RNA, 22 nt, Salmonella enterica enterica serovar Typhi Ty2
uuucauuguuguggaaccgcuu

SEQ ID NO: 39810 - RNA, 22 nt, Salmonella enterica enterica serovar Typhi Ty2
uuucgguaauggcgugcgaaaa

SEQ ID NO: 39811 - RNA, 22 nt, Salmonella enterica enterica serovar Typhi Ty2
uuugagacuaacgccaggauag

SEQ ID NO: 39812 - RNA, 22 nt, Salmonella enterica enterica serovar Typhi Ty2
uuugauaccaauauccucaucg

SEQ ID NO: 39813 - RNA, 22 nt, Salmonella enterica enterica serovar Typhi Ty2
uuugaugaggugcugaucugcc

SEQ ID NO: 39814 - RNA, 21 nt, Salmonella enterica enterica serovar Typhi Ty2
uuuggcagucguuuaucggaa

SEQ ID NO: 39815 - RNA, 20 nt, Salmonella enterica enterica serovar Typhi Ty2
uuuggcuaucgcaguaacgu

SEQ ID NO: 39816 - RNA, 22 nt, Salmonella typhimurium LT2
aaaccagguugcgguugauggu

SEQ ID NO: 39817 - RNA, 22 nt, Salmonella typhimurium LT2
aaagcguaggccugauaagcgc

SEQ ID NO: 39818 - RNA, 22 nt, Salmonella typhimurium LT2
aaagucaggguacguuuguacu

SEQ ID NO: 39819 - RNA, 22 nt, Salmonella typhimurium LT2
aaaguguaauguucuaacaggu

SEQ ID NO: 39820 - RNA, 22 nt, Salmonella typhimurium LT2
aaaucaucuuccacuucggcgu

SEQ ID NO: 39821 - RNA, 22 nt, Salmonella typhimurium LT2
aaaucuuggacuggcagagcgc

SEQ ID NO: 39822 - RNA, 22 nt, Salmonella typhimurium LT2
aaauguacagaauacguggaua

SEQ ID NO: 39823 - RNA, 22 nt, Salmonella typhimurium LT2
aaauguuggcgaccugaugcag

SEQ ID NO: 39824 - RNA, 22 nt, Salmonella typhimurium LT2
aacccuuaccgcuaguuuuauc

SEQ ID NO: 39825 - RNA, 22 nt, Salmonella typhimurium LT2
aacgccuuauccggccuacucu

SEQ ID NO: 39826 - RNA, 22 nt, Salmonella typhimurium LT2
aacgcuggcuggaaacgauggg

SEQ ID NO: 39827 - RNA, 22 nt, Salmonella typhimurium LT2
aacgugaacuauagcgugcaga

SEQ ID NO: 39828 - RNA, 22 nt, Salmonella typhimurium LT2
aacgugaugccauacggcgagu

SEQ ID NO: 39829 - RNA, 22 nt, Salmonella typhimurium LT2
aacuccuggugggaucaccggc

SEQ ID NO: 39830 - RNA, 20 nt, Salmonella typhimurium LT2
aacuggcggaaggcuugucu

SEQ ID NO: 39831 - RNA, 22 nt, Salmonella typhimurium LT2
aagacuuugcacauuuugcuaa

SEQ ID NO: 39832 - RNA, 22 nt, Salmonella typhimurium LT2
aagcacuauuuuggugcaacau

SEQ ID NO: 39833 - RNA, 22 nt, Salmonella typhimurium LT2
aagcgcgucaagauacugguca

SEQ ID NO: 39834 - RNA, 22 nt, Salmonella typhimurium LT2
aagucgauuuccgcuuccugcg

SEQ ID NO: 39835 - RNA, 19 nt, Salmonella typhimurium LT2
aagugcgcgccauucgccg

SEQ ID NO: 39836 - RNA, 22 nt, Salmonella typhimurium LT2
agcuacgcuuaucgggccuacg

SEQ ID NO: 39837 - RNA, 22 nt, Salmonella typhimurium LT2
agcuacugacgcaaauguuugu

SEQ ID NO: 39838 - RNA, 22 nt, Salmonella typhimurium LT2
agcuauucggccagcgccaccg

SEQ ID NO: 39839 - RNA, 20 nt, Salmonella typhimurium LT2
agcugcugcgcuuuccaggc

SEQ ID NO: 39840 - RNA, 21 nt, Salmonella typhimurium LT2
agcuggguggcggugucgccg

SEQ ID NO: 39841 - RNA, 22 nt, Salmonella typhimurium LT2
agcuuugcgaacaucauuagcg

SEQ ID NO: 39842 - RNA, 22 nt, Salmonella typhimurium LT2
aggauauguccgaucugccgaa

SEQ ID NO: 39843 - RNA, 22 nt, Salmonella typhimurium LT2
aggccaucacuuuccggauguc

SEQ ID NO: 39844 - RNA, 22 nt, Salmonella typhimurium LT2
aggcccuguuugauggcguaca

SEQ ID NO: 39845 - RNA, 22 nt, Salmonella typhimurium LT2
aggccgguauuuucuccaucag

SEQ ID NO: 39846 - RNA, 22 nt, Salmonella typhimurium LT2
aggccgugcuggaucugcggau

SEQ ID NO: 39847 - RNA, 22 nt, Salmonella typhimurium LT2
aggccugauaagcgcagcgcca

SEQ ID NO: 39848 - RNA, 22 nt, Salmonella typhimurium LT2
agguuaaaggcauucgcgugac

SEQ ID NO: 39849 - RNA, 21 nt, Salmonella typhimurium LT2
agguuuaccgugauggagcgu

SEQ ID NO: 39850 - RNA, 22 nt, Salmonella typhimurium LT2
agucaauauuuauucauggaau

SEQ ID NO: 39851 - RNA, 22 nt, Salmonella typhimurium LT2
agucugcagugcuaccaccguc

SEQ ID NO: 39852 - RNA, 22 nt, Salmonella typhimurium LT2
agugagccgucuggauaucgug

SEQ ID NO: 39853 - RNA, 19 nt, Salmonella typhimurium LT2
aguggccgcauucagacug

SEQ ID NO: 39854 - RNA, 22 nt, Salmonella typhimurium LT2
aguggcguacaugguggaaggu

SEQ ID NO: 39855 - RNA, 22 nt, Salmonella typhimurium LT2
agugggcguuuaaucgggaaga

SEQ ID NO: 39856 - RNA, 22 nt, Salmonella typhimurium LT2
aguucaaaccguuauuaauuaa

SEQ ID NO: 39857 - RNA, 22 nt, Salmonella typhimurium LT2
aguucgcgauagcuaauguugg

SEQ ID NO: 39858 - RNA, 22 nt, Salmonella typhimurium LT2
aguuggcgcaguuggaauuccg

SEQ ID NO: 39859 - RNA, 22 nt, Salmonella typhimurium LT2
aguuuaucuuucaggcguucaa

SEQ ID NO: 39860 - RNA, 22 nt, Salmonella typhimurium LT2
auagguggcguaaaauccgaac

SEQ ID NO: 39861 - RNA, 22 nt, Salmonella typhimurium LT2
auauagugucaaacagucucga

SEQ ID NO: 39862 - RNA, 21 nt, Salmonella typhimurium LT2
auaucgagucauuucgcggcg

SEQ ID NO: 39863 - RNA, 22 nt, Salmonella typhimurium LT2
auaucggcaaugucauaaacaa

SEQ ID NO: 39864 - RNA, 22 nt, Salmonella typhimurium LT2
aucacgcacagauuuggcaucg

SEQ ID NO: 39865 - RNA, 22 nt, Salmonella typhimurium LT2
aucagcgcgccgguggcguugu

SEQ ID NO: 39866 - RNA, 20 nt, Salmonella typhimurium LT2
aucauugcgccggaccugca

SEQ ID NO: 39867 - RNA, 19 nt, Salmonella typhimurium LT2
auccaugaugguuuccggg

SEQ ID NO: 39868 - RNA, 22 nt, Salmonella typhimurium LT2
aucccgccagcgaaagcgucug

SEQ ID NO: 39869 - RNA, 22 nt, Salmonella typhimurium LT2
auccgcagaugaagcgggcgcu

SEQ ID NO: 39870 - RNA, 22 nt, Salmonella typhimurium LT2
auccgcuaaccguauacggacc

SEQ ID NO: 39871 - RNA, 22 nt, Salmonella typhimurium LT2
auccggacgacuuacagcgggu

SEQ ID NO: 39872 - RNA, 22 nt, Salmonella typhimurium LT2
auccggguaauguaaaaaaucu

SEQ ID NO: 39873 - RNA, 22 nt, Salmonella typhimurium LT2
aucgaucgcggcgguuuucugg

SEQ ID NO: 39874 - RNA, 22 nt, Salmonella typhimurium LT2
aucgcagauagcaaaaaagcgc

SEQ ID NO: 39875 - RNA, 22 nt, Salmonella typhimurium LT2
aucgccaggggaaaauugucgc

SEQ ID NO: 39876 - RNA, 22 nt, Salmonella typhimurium LT2
aucgccauacggcagacgcgcg

SEQ ID NO: 39877 - RNA, 22 nt, Salmonella typhimurium LT2
aucgccaucguguuaauacuca

SEQ ID NO: 39878 - RNA, 22 nt, Salmonella typhimurium LT2
aucgccaucuuaugcuuuuucu

SEQ ID NO: 39879 - RNA, 22 nt, Salmonella typhimurium LT2
aucgcggagaagucgacuucga

SEQ ID NO: 39880 - RNA, 22 nt, Salmonella typhimurium LT2
aucgcgugauaaagcgcugacc

SEQ ID NO: 39881 - RNA, 17 nt, Salmonella typhimurium LT2
aucggcauauaggaaug

SEQ ID NO: 39882 - RNA, 19 nt, Salmonella typhimurium LT2
aucguugcuguccguggcc

SEQ ID NO: 39883 - RNA, 22 nt, Salmonella typhimurium LT2
aucuggcaugcagggccggaag

SEQ ID NO: 39884 - RNA, 22 nt, Salmonella typhimurium LT2
aucuucaugguuaauggucuga

SEQ ID NO: 39885 - RNA, 22 nt, Salmonella typhimurium LT2
aucuugauugcagccagaguuu

SEQ ID NO: 39886 - RNA, 19 nt, Salmonella typhimurium LT2
aucuuugugaacuuuauug

SEQ ID NO: 39887 - RNA, 22 nt, Salmonella typhimurium LT2
augacaacauuaaaugggagaa

SEQ ID NO: 39888 - RNA, 22 nt, Salmonella typhimurium LT2
augacgguaacauuuuguuggc

SEQ ID NO: 39889 - RNA, 22 nt, Salmonella typhimurium LT2
augccuuauccggccuaccgau

SEQ ID NO: 39890 - RNA, 22 nt, Salmonella typhimurium LT2
augcggcggauggugcgugauu

SEQ ID NO: 39891 - RNA, 22 nt, Salmonella typhimurium LT2
augcgucucugaacaggcggcc

SEQ ID NO: 39892 - RNA, 22 nt, Salmonella typhimurium LT2
augcucagugccgaaaauggcg

SEQ ID NO: 39893 - RNA, 22 nt, Salmonella typhimurium LT2
augcuguucagcgaaaaagcgc

SEQ ID NO: 39894 - RNA, 22 nt, Salmonella typhimurium LT2
auggcaugggugacgccggaug

SEQ ID NO: 39895 - RNA, 22 nt, Salmonella typhimurium LT2
auggcgauagacauaaaccggu

SEQ ID NO: 39896 - RNA, 22 nt, Salmonella typhimurium LT2
auggcgcgaaacuauccgcaac

SEQ ID NO: 39897 - RNA, 22 nt, Salmonella typhimurium LT2
auggcgcugcgcuuaucaggcc

SEQ ID NO: 39898 - RNA, 22 nt, Salmonella typhimurium LT2
auggcggcuucgccuuauccgg

SEQ ID NO: 39899 - RNA, 22 nt, Salmonella typhimurium LT2
auggcuggagauaggcgcgcuu

SEQ ID NO: 39900 - RNA, 22 nt, Salmonella typhimurium LT2
augguaaauaagcggauuuucu

SEQ ID NO: 39901 - RNA, 22 nt, Salmonella typhimurium LT2
auggugaacggcaggaaauggu

SEQ ID NO: 39902 - RNA, 22 nt, Salmonella typhimurium LT2
augucgcuaaagcccggcacca

SEQ ID NO: 39903 - RNA, 22 nt, Salmonella typhimurium LT2
augugcaguuugcgaucgaauu

SEQ ID NO: 39904 - RNA, 22 nt, Salmonella typhimurium LT2
augugcaugacagacgagaaug

SEQ ID NO: 39905 - RNA, 20 nt, Salmonella typhimurium LT2
augugccaugauugauuuac

SEQ ID NO: 39906 - RNA, 22 nt, Salmonella typhimurium LT2
augugcuguucgauguagccaa

SEQ ID NO: 39907 - RNA, 22 nt, Salmonella typhimurium LT2
auguugagcagcuuucgcuguu

SEQ ID NO: 39908 - RNA, 20 nt, Salmonella typhimurium LT2
auucaagucggugcgacgau

SEQ ID NO: 39909 - RNA, 22 nt, Salmonella typhimurium LT2
auucaaucaaauuaagaucaca

SEQ ID NO: 39910 - RNA, 22 nt, Salmonella typhimurium LT2
auucacuacaugauugccgccg

SEQ ID NO: 39911 - RNA, 22 nt, Salmonella typhimurium LT2
auucaguagcagauagaugcgc

SEQ ID NO: 39912 - RNA, 22 nt, Salmonella typhimurium LT2
auucgcgcaucgcgucgagcag

SEQ ID NO: 39913 - RNA, 22 nt, Salmonella typhimurium LT2
auucucgucugucaugcacauc

SEQ ID NO: 39914 - RNA, 22 nt, Salmonella typhimurium LT2
auugagugcgauuacgcucaac

SEQ ID NO: 39915 - RNA, 22 nt, Salmonella typhimurium LT2
auugccggauggcgccguaggc

SEQ ID NO: 39916 - RNA, 22 nt, Salmonella typhimurium LT2
auugccuuucagcgccagacug

SEQ ID NO: 39917 - RNA, 22 nt, Salmonella typhimurium LT2
auuggcaccgacacgcuggcug

SEQ ID NO: 39918 - RNA, 22 nt, Salmonella typhimurium LT2
auuggcgcgguacuggaagucg

SEQ ID NO: 39919 - RNA, 22 nt, Salmonella typhimurium LT2
auuuagcgguggucggguuugg

SEQ ID NO: 39920 - RNA, 22 nt, Salmonella typhimurium LT2
cgccaacgccgugggagguauc

SEQ ID NO: 39921 - RNA, 22 nt, Salmonella typhimurium LT2
cgccaucagugccgccucuucg

SEQ ID NO: 39922 - RNA, 22 nt, Salmonella typhimurium LT2
cgccugguuuuauagccguauu

SEQ ID NO: 39923 - RNA, 22 nt, Salmonella typhimurium LT2
cgcgaaguaaugccagaagaua

SEQ ID NO: 39924 - RNA, 22 nt, Salmonella typhimurium LT2
cgcgacguuucguccagcggca

SEQ ID NO: 39925 - RNA, 22 nt, Salmonella typhimurium LT2
cgcgguuauauuggcgauaauu

SEQ ID NO: 39926 - RNA, 22 nt, Salmonella typhimurium LT2
cgcguuauauuugucauaaauu

SEQ ID NO: 39927 - RNA, 22 nt, Salmonella typhimurium LT2
cgcguugucauccagcgacugg

SEQ ID NO: 39928 - RNA, 22 nt, Salmonella typhimurium LT2
cgcugauugauuaugauacguu

SEQ ID NO: 39929 - RNA, 22 nt, Salmonella typhimurium LT2
cgcuggaugucaccguacaugc

SEQ ID NO: 39930 - RNA, 22 nt, Salmonella typhimurium LT2
cgcugguguuugaccuuucgcu

SEQ ID NO: 39931 - RNA, 22 nt, Salmonella typhimurium LT2
cgcuuucgagcgauacaucauc

SEQ ID NO: 39932 - RNA, 22 nt, Salmonella typhimurium LT2
cggaaugcaaucuaauaauggc

SEQ ID NO: 39933 - RNA, 22 nt, Salmonella typhimurium LT2
cggacgaacuggugccgcuucc

SEQ ID NO: 39934 - RNA, 22 nt, Salmonella typhimurium LT2
cggacgauuuuggucgcggcga

SEQ ID NO: 39935 - RNA, 22 nt, Salmonella typhimurium LT2
cggacuugauccauucuggcgc

SEQ ID NO: 39936 - RNA, 22 nt, Salmonella typhimurium LT2
cggauaacgccaccgugguuau

SEQ ID NO: 39937 - RNA, 22 nt, Salmonella typhimurium LT2
cggauggcgcuacgcuuauccg

SEQ ID NO: 39938 - RNA, 22 nt, Salmonella typhimurium LT2
cggauuucuggcgcuguuguug

SEQ ID NO: 39939 - RNA, 23 nt, Salmonella typhimurium LT2
cggcaacguuuugauggucagcc

SEQ ID NO: 39940 - RNA, 22 nt, Salmonella typhimurium LT2
cggcgaauguacugcuggaggu

SEQ ID NO: 39941 - RNA, 22 nt, Salmonella typhimurium LT2
cggcgagauugucaucgacccg

SEQ ID NO: 39942 - RNA, 22 nt, Salmonella typhimurium LT2
cggcguucuggcagccgugauu

SEQ ID NO: 39943 - RNA, 22 nt, Salmonella typhimurium LT2
cggcuacgggcagaagucaggu

SEQ ID NO: 39944 - RNA, 22 nt, Salmonella typhimurium LT2
cggcuguaugacgcggugcaau

SEQ ID NO: 39945 - RNA, 22 nt, Salmonella typhimurium LT2
cggcuguuucccggccauccca

SEQ ID NO: 39946 - RNA, 22 nt, Salmonella typhimurium LT2
cggguccuuuuuuggcgaauaa

SEQ ID NO: 39947 - RNA, 22 nt, Salmonella typhimurium LT2
cgggucgaggaucgccauaucc

SEQ ID NO: 39948 - RNA, 20 nt, Salmonella typhimurium LT2
cgguaagcgaagcgccaccg

SEQ ID NO: 39949 - RNA, 22 nt, Salmonella typhimurium LT2
cgguagaaaacuuucuagcgcc

SEQ ID NO: 39950 - RNA, 22 nt, Salmonella typhimurium LT2
cgguuaaagggaauguaguaaa

SEQ ID NO: 39951 - RNA, 19 nt, Salmonella typhimurium LT2
cgguuacugggauagagac

SEQ ID NO: 39952 - RNA, 17 nt, Salmonella typhimurium LT2
cguagggcacaaugaaa

SEQ ID NO: 39953 - RNA, 22 nt, Salmonella typhimurium LT2
cgucaagguaaaacgcagguga

SEQ ID NO: 39954 - RNA, 22 nt, Salmonella typhimurium LT2
cgucaauaucagcuuucgcguc

SEQ ID NO: 39955 - RNA, 22 nt, Salmonella typhimurium LT2
cgucaugguauugauggcgccu

SEQ ID NO: 39956 - RNA, 22 nt, Salmonella typhimurium LT2
cgucggugauguucaucaucga

SEQ ID NO: 39957 - RNA, 22 nt, Salmonella typhimurium LT2
cgucuuauccggccuacgagug

SEQ ID NO: 39958 - RNA, 22 nt, Salmonella typhimurium LT2
cgugaacaaacugcuguuucuc

SEQ ID NO: 39959 - RNA, 22 nt, Salmonella typhimurium LT2
cgugaugaaaucggcgcgcaua

SEQ ID NO: 39960 - RNA, 22 nt, Salmonella typhimurium LT2
cgugaugcaacguuggaucgcc

SEQ ID NO: 39961 - RNA, 22 nt, Salmonella typhimurium LT2
cgugcgaaugcgguacugagac

SEQ ID NO: 39962 - RNA, 22 nt, Salmonella typhimurium LT2
cguguaggccggauuaggcguu

SEQ ID NO: 39963 - RNA, 22 nt, Salmonella typhimurium LT2
cguuaucgucgaaaccgccguc

SEQ ID NO: 39964 - RNA, 20 nt, Salmonella typhimurium LT2
cguuggcuuaauacgcugug

SEQ ID NO: 39965 - RNA, 22 nt, Salmonella typhimurium LT2
cuaacuuacuuaauuaaggcaa

SEQ ID NO: 39966 - RNA, 22 nt, Salmonella typhimurium LT2
cuacgcuuaucaggccuacggg

SEQ ID NO: 39967 - RNA, 22 nt, Salmonella typhimurium LT2
cuacgcuugccauucuuaucac

SEQ ID NO: 39968 - RNA, 22 nt, Salmonella typhimurium LT2
cucaggugucggggaggcuggu

SEQ ID NO: 39969 - RNA, 22 nt, Salmonella typhimurium LT2
cucauuuagcgcucgcguuuug

SEQ ID NO: 39970 - RNA, 22 nt, Salmonella typhimurium LT2
cucgcggacgucgaggaucugg

SEQ ID NO: 39971 - RNA, 22 nt, Salmonella typhimurium LT2
cucuuugacuauuuucccugcc

SEQ ID NO: 39972 - RNA, 22 nt, Salmonella typhimurium LT2
cugacgccccugaugcuggaug

SEQ ID NO: 39973 - RNA, 22 nt, Salmonella typhimurium LT2
cugacggguaguaucgcucuau

SEQ ID NO: 39974 - RNA, 22 nt, Salmonella typhimurium LT2
cugauucguaaugucggaaaag

SEQ ID NO: 39975 - RNA, 22 nt, Salmonella typhimurium LT2
cugauugccgccaacgucaacg

SEQ ID NO: 39976 - RNA, 22 nt, Salmonella typhimurium LT2
cugauuuauuugaagcuccagg

SEQ ID NO: 39977 - RNA, 22 nt, Salmonella typhimurium LT2
cugcauaagcugauggaugaag

SEQ ID NO: 39978 - RNA, 21 nt, Salmonella typhimurium LT2
cugcauaaucgcaaagguauc

SEQ ID NO: 39979 - RNA, 22 nt, Salmonella typhimurium LT2
cugccguauaucgcgcugggua

SEQ ID NO: 39980 - RNA, 22 nt, Salmonella typhimurium LT2
cugcgacgaucuguugccggaa

SEQ ID NO: 39981 - RNA, 23 nt, Salmonella typhimurium LT2
cugcgcauauuacgccggcguuu

SEQ ID NO: 39982 - RNA, 22 nt, Salmonella typhimurium LT2
cugcgcuuaucaggccuacgua

SEQ ID NO: 39983 - RNA, 22 nt, Salmonella typhimurium LT2
cugcguuuaccuggccuacaga

SEQ ID NO: 39984 - RNA, 22 nt, Salmonella typhimurium LT2
cugcuguacauggcugccgcug

SEQ ID NO: 39985 - RNA, 21 nt, Salmonella typhimurium LT2
cugcuuggcgauauuacuauc

SEQ ID NO: 39986 - RNA, 22 nt, Salmonella typhimurium LT2
cuggaagaagccacuauccaac

SEQ ID NO: 39987 - RNA, 22 nt, Salmonella typhimurium LT2
cuggaagcggcgcugaucuuug

SEQ ID NO: 39988 - RNA, 22 nt, Salmonella typhimurium LT2
cuggaagucaugggcauuuaug

SEQ ID NO: 39989 - RNA, 22 nt, Salmonella typhimurium LT2
cuggaggccgcuaaucugaguc

SEQ ID NO: 39990 - RNA, 22 nt, Salmonella typhimurium LT2
cuggcaaagaaucguacaugcg

SEQ ID NO: 39991 - RNA, 18 nt, Salmonella typhimurium LT2
cuggcaguagugaaagua

SEQ ID NO: 39992 - RNA, 19 nt, Salmonella typhimurium LT2
cuggcauaguaagaaguau

SEQ ID NO: 39993 - RNA, 22 nt, Salmonella typhimurium LT2
cuggcgaugcugcaucgcgcuu

SEQ ID NO: 39994 - RNA, 22 nt, Salmonella typhimurium LT2
cuggcguugaaaccacuacugg

SEQ ID NO: 39995 - RNA, 22 nt, Salmonella typhimurium LT2
cuggcguuggcuaagggguaaa

SEQ ID NO: 39996 - RNA, 22 nt, Salmonella typhimurium LT2
cuggcugcugacgguccuguua

SEQ ID NO: 39997 - RNA, 22 nt, Salmonella typhimurium LT2
cuggcuggagucucagggcgca

SEQ ID NO: 39998 - RNA, 22 nt, Salmonella typhimurium LT2
cugggcauuuuccugucgccgc

SEQ ID NO: 39999 - RNA, 22 nt, Salmonella typhimurium LT2
cugguggcuuuccgggcagccg

SEQ ID NO: 40000 - RNA, 22 nt, Salmonella typhimurium LT2
cuguaugguuauaaaaaggaug

SEQ ID NO: 40001 - RNA, 22 nt, Salmonella typhimurium LT2
cuguucaagcucuauccguggg

SEQ ID NO: 40002 - RNA, 22 nt, Salmonella typhimurium LT2
cuguugcaccaauguggugcuu

SEQ ID NO: 40003 - RNA, 22 nt, Salmonella typhimurium LT2
cuucagguuuccccagacggcg

SEQ ID NO: 40004 - RNA, 22 nt, Salmonella typhimurium LT2
gcguuuccggccuggaugcguu

SEQ ID NO: 40005 - RNA, 22 nt, Salmonella typhimurium LT2
gcuaacgcuuaccgggccuaca

SEQ ID NO: 40006 - RNA, 22 nt, Salmonella typhimurium LT2
gcuacgccuuacccggccuaca

SEQ ID NO: 40007 - RNA, 23 nt, Salmonella typhimurium LT2
gcuaucgacggcagcguggcgga

SEQ ID NO: 40008 - RNA, 23 nt, Salmonella typhimurium LT2
gcucaaagaggccugguuugccg

SEQ ID NO: 40009 - RNA, 22 nt, Salmonella typhimurium LT2
gcucacgguaacucauugcgug

SEQ ID NO: 40010 - RNA, 19 nt, Salmonella typhimurium LT2
gcuccugcuggcggucucc

SEQ ID NO: 40011 - RNA, 23 nt, Salmonella typhimurium LT2
gcugacgcaacguuauccuucac

SEQ ID NO: 40012 - RNA, 22 nt, Salmonella typhimurium LT2
gcugauuaucgacuuucuggcg

SEQ ID NO: 40013 - RNA, 22 nt, Salmonella typhimurium LT2
gcugccuuauccggccuacaag

SEQ ID NO: 40014 - RNA, 22 nt, Salmonella typhimurium LT2
gcugccuugcuugauacuggcu

SEQ ID NO: 40015 - RNA, 22 nt, Salmonella typhimurium LT2
gcuggcaagauggaagguacgu

SEQ ID NO: 40016 - RNA, 22 nt, Salmonella typhimurium LT2
gcuguagcgacucuucgccggu

SEQ ID NO: 40017 - RNA, 22 nt, Salmonella typhimurium LT2
gcuguuaacgcauuuccgcgac

SEQ ID NO: 40018 - RNA, 22 nt, Salmonella typhimurium LT2
gcuguuaucaucaaggcguggc

SEQ ID NO: 40019 - RNA, 22 nt, Salmonella typhimurium LT2
ggaaacuucggucgcguagucg

SEQ ID NO: 40020 - RNA, 22 nt, Salmonella typhimurium LT2
ggaagccaaagccuuuuuccgu

SEQ ID NO: 40021 - RNA, 22 nt, Salmonella typhimurium LT2
ggaauugauaugaaugacaugu

SEQ ID NO: 40022 - RNA, 22 nt, Salmonella typhimurium LT2
ggaccugaugaugcgccggauu

SEQ ID NO: 40023 - RNA, 22 nt, Salmonella typhimurium LT2
ggagccuguaucgucggcgcgc

SEQ ID NO: 40024 - RNA, 22 nt, Salmonella typhimurium LT2
ggaucgaucgcgccacgcgacu

SEQ ID NO: 40025 - RNA, 22 nt, Salmonella typhimurium LT2
ggaugcgcaccauggcuucugc

SEQ ID NO: 40026 - RNA, 22 nt, Salmonella typhimurium LT2
ggauuucaugucgacgcaaggg

SEQ ID NO: 40027 - RNA, 22 nt, Salmonella typhimurium LT2
ggcaaguaaccccagauuugcg

SEQ ID NO: 40028 - RNA, 22 nt, Salmonella typhimurium LT2
ggcagguuugccggauaucagc

SEQ ID NO: 40029 - RNA, 20 nt, Salmonella typhimurium LT2
ggcaucgcucuccauuggca

SEQ ID NO: 40030 - RNA, 22 nt, Salmonella typhimurium LT2
ggcauucagcaauugagucagu

SEQ ID NO: 40031 - RNA, 22 nt, Salmonella typhimurium LT2
ggcauuuaucgauggcgcagga

SEQ ID NO: 40032 - RNA, 22 nt, Salmonella typhimurium LT2
ggccuuugaccacuauuucggu

SEQ ID NO: 40033 - RNA, 22 nt, Salmonella typhimurium LT2
ggcgacaauuuuccccuggcga

SEQ ID NO: 40034 - RNA, 22 nt, Salmonella typhimurium LT2
ggcgauaauguguugacggaua

SEQ ID NO: 40035 - RNA, 22 nt, Salmonella typhimurium LT2
ggcgauagccgucgucauagcc

SEQ ID NO: 40036 - RNA, 22 nt, Salmonella typhimurium LT2
ggcgauauucacggcuguuuuu

SEQ ID NO: 40037 - RNA, 20 nt, Salmonella typhimurium LT2
ggcgaucguugaguugggca

SEQ ID NO: 40038 - RNA, 22 nt, Salmonella typhimurium LT2
ggcgcguaaaaaacugucugaa

SEQ ID NO: 40039 - RNA, 22 nt, Salmonella typhimurium LT2
ggcgcuagaaaguuuucuaccg

SEQ ID NO: 40040 - RNA, 22 nt, Salmonella typhimurium LT2
ggcgcugaggaaaucgucaucc

SEQ ID NO: 40041 - RNA, 22 nt, Salmonella typhimurium LT2
ggcgcugugcgugucaggccua

SEQ ID NO: 40042 - RNA, 22 nt, Salmonella typhimurium LT2
ggcggaauaaguagauaagcaa

SEQ ID NO: 40043 - RNA, 22 nt, Salmonella typhimurium LT2
ggcguugaaguucgucauaucg

SEQ ID NO: 40044 - RNA, 22 nt, Salmonella typhimurium LT2
ggcguugcuggaugucgauggc

SEQ ID NO: 40045 - RNA, 22 nt, Salmonella typhimurium LT2
ggcugauacaguuucauugccg

SEQ ID NO: 40046 - RNA, 22 nt, Salmonella typhimurium LT2
ggcuggaugugugacgugcugg

SEQ ID NO: 40047 - RNA, 22 nt, Salmonella typhimurium LT2
ggcuuuaccguguuccccgcgc

SEQ ID NO: 40048 - RNA, 22 nt, Salmonella typhimurium LT2
gggcuuaugcacuaaauaagac

SEQ ID NO: 40049 - RNA, 22 nt, Salmonella typhimurium LT2
ggucgcagauacgauuuugcuc

SEQ ID NO: 40050 - RNA, 22 nt, Salmonella typhimurium LT2
ggugaaacgcugaaugucuccc

SEQ ID NO: 40051 - RNA, 22 nt, Salmonella typhimurium LT2
ggugacggggcgugagcaugaa

SEQ ID NO: 40052 - RNA, 22 nt, Salmonella typhimurium LT2
ggugagacgcguggauaacgga

SEQ ID NO: 40053 - RNA, 22 nt, Salmonella typhimurium LT2
ggugcaguauuuggcaagcuga

SEQ ID NO: 40054 - RNA, 22 nt, Salmonella typhimurium LT2
ggugcauguucgggacuugcug

SEQ ID NO: 40055 - RNA, 22 nt, Salmonella typhimurium LT2
gguggcaacggacgcuucuuuc

SEQ ID NO: 40056 - RNA, 22 nt, Salmonella typhimurium LT2
gguggcauggcuugccgguccg

SEQ ID NO: 40057 - RNA, 22 nt, Salmonella typhimurium LT2
gguuguaaaugacuuuuaugca

SEQ ID NO: 40058 - RNA, 22 nt, Salmonella typhimurium LT2
guacuuucacuacugccagaau

SEQ ID NO: 40059 - RNA, 22 nt, Salmonella typhimurium LT2
guagauuccagccguuugaaug

SEQ ID NO: 40060 - RNA, 22 nt, Salmonella typhimurium LT2
guagggcguuacaguaucauac

SEQ ID NO: 40061 - RNA, 22 nt, Salmonella typhimurium LT2
guauggacagcaagcuuuccgg

SEQ ID NO: 40062 - RNA, 22 nt, Salmonella typhimurium LT2
guauuggcgaaguaggacuggc

SEQ ID NO: 40063 - RNA, 22 nt, Salmonella typhimurium LT2
gucaacggccaguagauccuga

SEQ ID NO: 40064 - RNA, 22 nt, Salmonella typhimurium LT2
gucacuuccgugaacauuggcg

SEQ ID NO: 40065 - RNA, 22 nt, Salmonella typhimurium LT2
gucagcaacauguucagcgcgg

SEQ ID NO: 40066 - RNA, 22 nt, Salmonella typhimurium LT2
gucagggcugccgaugucgcca

SEQ ID NO: 40067 - RNA, 19 nt, Salmonella typhimurium LT2
gucaugcauggugaaguca

SEQ ID NO: 40068 - RNA, 22 nt, Salmonella typhimurium LT2
gucauuuaugauaagcguuugu

SEQ ID NO: 40069 - RNA, 22 nt, Salmonella typhimurium LT2
guccaacugcgcggcaagauua

SEQ ID NO: 40070 - RNA, 22 nt, Salmonella typhimurium LT2
guccaugaaguccaugccaucu

SEQ ID NO: 40071 - RNA, 22 nt, Salmonella typhimurium LT2
guccgacucaaacugaaaucgu

SEQ ID NO: 40072 - RNA, 22 nt, Salmonella typhimurium LT2
gucgaagaugacggcuuugccg

SEQ ID NO: 40073 - RNA, 22 nt, Salmonella typhimurium LT2
gucgacaauguugaugccaucg

SEQ ID NO: 40074 - RNA, 22 nt, Salmonella typhimurium LT2
gucgauagcuauuaccgcacau

SEQ ID NO: 40075 - RNA, 19 nt, Salmonella typhimurium LT2
gucgauggcaaauuugugc

SEQ ID NO: 40076 - RNA, 22 nt, Salmonella typhimurium LT2
gucgccaauaccgagguagcgg

SEQ ID NO: 40077 - RNA, 22 nt, Salmonella typhimurium LT2
gucgccuuuaaugaccuugagg

SEQ ID NO: 40078 - RNA, 22 nt, Salmonella typhimurium LT2
gucgcguggcgcgaucgauccc

SEQ ID NO: 40079 - RNA, 20 nt, Salmonella typhimurium LT2
gucugcggcgacuggcggcg

SEQ ID NO: 40080 - RNA, 22 nt, Salmonella typhimurium LT2
gucugcuaugcagccggucgau

SEQ ID NO: 40081 - RNA, 22 nt, Salmonella typhimurium LT2
gucuguuauggcuuccagugcg

SEQ ID NO: 40082 - RNA, 22 nt, Salmonella typhimurium LT2
gugacgauugucaucccaauaa

SEQ ID NO: 40083 - RNA, 22 nt, Salmonella typhimurium LT2
gugacgcguuuugguaaauuca

SEQ ID NO: 40084 - RNA, 22 nt, Salmonella typhimurium LT2
gugacguugauggugcagguuu

SEQ ID NO: 40085 - RNA, 22 nt, Salmonella typhimurium LT2
gugagggcgucgauggcccggc

SEQ ID NO: 40086 - RNA, 22 nt, Salmonella typhimurium LT2
gugaugaugaccgggauggucu

SEQ ID NO: 40087 - RNA, 22 nt, Salmonella typhimurium LT2
gugccggauggcggcgccugca

SEQ ID NO: 40088 - RNA, 21 nt, Salmonella typhimurium LT2
ucgauucagaagcgacuuuuu

SEQ ID NO: 40089 - RNA, 22 nt, Salmonella typhimurium LT2
ucgauuguugauguuaacgcug

SEQ ID NO: 40090 - RNA, 22 nt, Salmonella typhimurium LT2
ucgcagcgccacaccgccauga

SEQ ID NO: 40091 - RNA, 22 nt, Salmonella typhimurium LT2
ucgcgcguggcaaaaaccggaa

SEQ ID NO: 40092 - RNA, 19 nt, Salmonella typhimurium LT2
ucgcgcuuacacagacugc

SEQ ID NO: 40093 - RNA, 22 nt, Salmonella typhimurium LT2
ucgcuggaaaguauucgccagc

SEQ ID NO: 40094 - RNA, 23 nt, Salmonella typhimurium LT2
ucggcguuuaccguaggcgacca

SEQ ID NO: 40095 - RNA, 22 nt, Salmonella typhimurium LT2
ucgguagcauugcgccggguaa

SEQ ID NO: 40096 - RNA, 22 nt, Salmonella typhimurium LT2
ucgguaguaaccagcucuauug

SEQ ID NO: 40097 - RNA, 22 nt, Salmonella typhimurium LT2
ucgucaauguucgguuccuggg

SEQ ID NO: 40098 - RNA, 22 nt, Salmonella typhimurium LT2
ucgugaaauacaucaagcgucu

SEQ ID NO: 40099 - RNA, 23 nt, Salmonella typhimurium LT2
ucgugcugccagcggacaaaugu

SEQ ID NO: 40100 - RNA, 22 nt, Salmonella typhimurium LT2
ucguuauaccgcugggccgcgc

SEQ ID NO: 40101 - RNA, 21 nt, Salmonella typhimurium LT2
ucguucagucccaugugccgg

SEQ ID NO: 40102 - RNA, 22 nt, Salmonella typhimurium LT2
ucuauccggcucgcgcuaucgg

SEQ ID NO: 40103 - RNA, 22 nt, Salmonella typhimurium LT2
ucucguuggugguucuuagcau

SEQ ID NO: 40104 - RNA, 22 nt, Salmonella typhimurium LT2
ucugccgguuaugauggcggcg

SEQ ID NO: 40105 - RNA, 23 nt, Salmonella typhimurium LT2
ucugcuggccgcugccgguuuug

SEQ ID NO: 40106 - RNA, 22 nt, Salmonella typhimurium LT2
ucuggaaaccguugaucauuuu

SEQ ID NO: 40107 - RNA, 22 nt, Salmonella typhimurium LT2
ucuguaggcccgguaagcguua

SEQ ID NO: 40108 - RNA, 22 nt, Salmonella typhimurium LT2
ucuguaggccggauaaggcgga

SEQ ID NO: 40109 - RNA, 22 nt, Salmonella typhimurium LT2
ucuguaggccggguaaggcguu

SEQ ID NO: 40110 - RNA, 22 nt, Salmonella typhimurium LT2
ucugucauucgacgaaugauua

SEQ ID NO: 40111 - RNA, 20 nt, Salmonella typhimurium LT2
ucuuggcgcgcuaauugguc

SEQ ID NO: 40112 - RNA, 22 nt, Salmonella typhimurium LT2
ugaacgccuuguccggccuaca

SEQ ID NO: 40113 - RNA, 22 nt, Salmonella typhimurium LT2
ugaccgggcagcacggcgugau

SEQ ID NO: 40114 - RNA, 22 nt, Salmonella typhimurium LT2
ugaccgugcuggcauuagccgu

SEQ ID NO: 40115 - RNA, 23 nt, Salmonella typhimurium LT2
ugaccguugccagaauaucugcg

SEQ ID NO: 40116 - RNA, 22 nt, Salmonella typhimurium LT2
ugaccucaauuuucugcucaau

SEQ ID NO: 40117 - RNA, 22 nt, Salmonella typhimurium LT2
ugacgccggaauauucagguug

SEQ ID NO: 40118 - RNA, 22 nt, Salmonella typhimurium LT2
ugacgcgccugcgcuaccgcug

SEQ ID NO: 40119 - RNA, 22 nt, Salmonella typhimurium LT2
ugacgcugaaguugcugccgca

SEQ ID NO: 40120 - RNA, 22 nt, Salmonella typhimurium LT2
ugacggagaucguccgcggcgc

SEQ ID NO: 40121 - RNA, 23 nt, Salmonella typhimurium LT2
ugacugggacaggggccuguguc

SEQ ID NO: 40122 - RNA, 22 nt, Salmonella typhimurium LT2
ugagaaucaauccaacccgcgc

SEQ ID NO: 40123 - RNA, 22 nt, Salmonella typhimurium LT2
ugagcaagugacagacuuauug

SEQ ID NO: 40124 - RNA, 22 nt, Salmonella typhimurium LT2
ugagcggcuggcgaaacuggcg

SEQ ID NO: 40125 - RNA, 22 nt, Salmonella typhimurium LT2
ugaguaaggcaagagcgcuuuu

SEQ ID NO: 40126 - RNA, 21 nt, Salmonella typhimurium LT2
ugauaacggguuaacaggcgu

SEQ ID NO: 40127 - RNA, 22 nt, Salmonella typhimurium LT2
ugauacugaggauuuucgcguc

SEQ ID NO: 40128 - RNA, 22 nt, Salmonella typhimurium LT2
ugaugcagacgacgacaugcgc

SEQ ID NO: 40129 - RNA, 22 nt, Salmonella typhimurium LT2
ugauggcauuuuugucggccca

SEQ ID NO: 40130 - RNA, 22 nt, Salmonella typhimurium LT2
ugauggcgguaaccccuuccgu

SEQ ID NO: 40131 - RNA, 22 nt, Salmonella typhimurium LT2
ugauugaagccgaugccgguga

SEQ ID NO: 40132 - RNA, 22 nt, Salmonella typhimurium LT2
ugcaaaguaauaggguuuucuu

SEQ ID NO: 40133 - RNA, 22 nt, Salmonella typhimurium LT2
ugcagccgggacaauacgccgc

SEQ ID NO: 40134 - RNA, 22 nt, Salmonella typhimurium LT2
ugcagggccuuuucucccgcca

SEQ ID NO: 40135 - RNA, 22 nt, Salmonella typhimurium LT2
ugccauuuagcugagaaaagau

SEQ ID NO: 40136 - RNA, 22 nt, Salmonella typhimurium LT2
ugccgcuaucacccacggcgau

SEQ ID NO: 40137 - RNA, 22 nt, Salmonella typhimurium LT2
ugccggagaugaccgauguuca

SEQ ID NO: 40138 - RNA, 22 nt, Salmonella typhimurium LT2
ugccggugguaaaggcacugcg

SEQ ID NO: 40139 - RNA, 22 nt, Salmonella typhimurium LT2
ugcgccaguugcgcuucuauga

SEQ ID NO: 40140 - RNA, 22 nt, Salmonella typhimurium LT2
ugcgcuagaaaguuuucuaccg

SEQ ID NO: 40141 - RNA, 22 nt, Salmonella typhimurium LT2
ugcgcugauggccguguuuuuc

SEQ ID NO: 40142 - RNA, 22 nt, Salmonella typhimurium LT2
ugcgcugcuugaaaagcaucag

SEQ ID NO: 40143 - RNA, 19 nt, Salmonella typhimurium LT2
ugcguacccgaaaaaugcc

SEQ ID NO: 40144 - RNA, 22 nt, Salmonella typhimurium LT2
ugcguauagcauuuacgauguc

SEQ ID NO: 40145 - RNA, 22 nt, Salmonella typhimurium LT2
ugcguuauaguguuuucaucau

SEQ ID NO: 40146 - RNA, 22 nt, Salmonella typhimurium LT2
ugcguucaguuauugcggaaga

SEQ ID NO: 40147 - RNA, 22 nt, Salmonella typhimurium LT2
ugcuggcagaagaaauggcaga

SEQ ID NO: 40148 - RNA, 22 nt, Salmonella typhimurium LT2
ugcuuuaaaugcugcgcuaacu

SEQ ID NO: 40149 - RNA, 22 nt, Salmonella typhimurium LT2
uggacaggacacgggauaauca

SEQ ID NO: 40150 - RNA, 22 nt, Salmonella typhimurium LT2
uggaccugcguacuuucucgcu

SEQ ID NO: 40151 - RNA, 20 nt, Salmonella typhimurium LT2
uggacgaauggcgcgcgcug

SEQ ID NO: 40152 - RNA, 22 nt, Salmonella typhimurium LT2
uggaucauucugaacgcgauuu

SEQ ID NO: 40153 - RNA, 22 nt, Salmonella typhimurium LT2
uggaugaacuuuguaugaucuc

SEQ ID NO: 40154 - RNA, 22 nt, Salmonella typhimurium LT2
uggcaacgucauaggcggcuuu

SEQ ID NO: 40155 - RNA, 20 nt, Salmonella typhimurium LT2
uggcacgaaaauaaucugcu

SEQ ID NO: 40156 - RNA, 22 nt, Salmonella typhimurium LT2
uggccugcuauuuauguggcug

SEQ ID NO: 40157 - RNA, 22 nt, Salmonella typhimurium LT2
uggcgagagacuuucgcgacug

SEQ ID NO: 40158 - RNA, 22 nt, Salmonella typhimurium LT2
uggcgauuuagcgaugaaggcu

SEQ ID NO: 40159 - RNA, 22 nt, Salmonella typhimurium LT2
uggcgcaaggccugguuuuccg

SEQ ID NO: 40160 - RNA, 22 nt, Salmonella typhimurium LT2
uggcgcacgcgucacuaaugcc

SEQ ID NO: 40161 - RNA, 22 nt, Salmonella typhimurium LT2
uggcgcuacgcuuauccgcccu

SEQ ID NO: 40162 - RNA, 22 nt, Salmonella typhimurium LT2
uggcgcugauucagcagcaguc

SEQ ID NO: 40163 - RNA, 22 nt, Salmonella typhimurium LT2
uggcgcugcgcuuaucaggccu

SEQ ID NO: 40164 - RNA, 22 nt, Salmonella typhimurium LT2
uggcgcuuauuuuugugcuacu

SEQ ID NO: 40165 - RNA, 22 nt, Salmonella typhimurium LT2
uggcggcaaucggugcugcgau

SEQ ID NO: 40166 - RNA, 22 nt, Salmonella typhimurium LT2
uggcggcaauggcgauagauuu

SEQ ID NO: 40167 - RNA, 22 nt, Salmonella typhimurium LT2
uggcguaaauagagggucguug

SEQ ID NO: 40168 - RNA, 22 nt, Salmonella typhimurium LT2
uggcgugcuggccagcagccug

SEQ ID NO: 40169 - RNA, 22 nt, Salmonella typhimurium LT2
uggcuaucgccauuacgcauug

SEQ ID NO: 40170 - RNA, 22 nt, Salmonella typhimurium LT2
uggcucuuuugcggcguggaau

SEQ ID NO: 40171 - RNA, 22 nt, Salmonella typhimurium LT2
uggcugaaugaagccuuagcgg

SEQ ID NO: 40172 - RNA, 22 nt, Salmonella typhimurium LT2
ccuguugguuuacguuauggcu

SEQ ID NO: 40173 - RNA, 22 nt, Salmonella typhimurium LT2
cgaaacauguuacuuaauggca

SEQ ID NO: 40174 - RNA, 22 nt, Salmonella typhimurium LT2
cgaacgcauucgcgccaccauu

SEQ ID NO: 40175 - RNA, 22 nt, Salmonella typhimurium LT2
cgaaggcgacaucagcagccgu

SEQ ID NO: 40176 - RNA, 22 nt, Salmonella typhimurium LT2
cgacauggucacgaugauuauu

SEQ ID NO: 40177 - RNA, 22 nt, Salmonella typhimurium LT2
cgacgcaaagaguacuggaugu

SEQ ID NO: 40178 - RNA, 22 nt, Salmonella typhimurium LT2
cgacgguuugcaaaugggugau

SEQ ID NO: 40179 - RNA, 22 nt, Salmonella typhimurium LT2
cgagauggguggcgaugauuuc

SEQ ID NO: 40180 - RNA, 22 nt, Salmonella typhimurium LT2
cgagcgaguacaaagugcaguu

SEQ ID NO: 40181 - RNA, 22 nt, Salmonella typhimurium LT2
cgauagagcaacugguucuggu

SEQ ID NO: 40182 - RNA, 22 nt, Salmonella typhimurium LT2
cgaucagcuuuuugccgaaauu

SEQ ID NO: 40183 - RNA, 22 nt, Salmonella typhimurium LT2
cgauccaguugcguaucaaaga

SEQ ID NO: 40184 - RNA, 22 nt, Salmonella typhimurium LT2
cgaugaaguuuaucaaagguga

SEQ ID NO: 40185 - RNA, 22 nt, Salmonella typhimurium LT2
cgaugcaaaugagcgagagccg

SEQ ID NO: 40186 - RNA, 22 nt, Salmonella typhimurium LT2
cgccagagucgucauauuaucc

SEQ ID NO: 40187 - RNA, 22 nt, Salmonella typhimurium LT2
cgccgguugagauggagaacgg

SEQ ID NO: 40188 - RNA, 22 nt, Salmonella typhimurium LT2
cgccguaguuaucuggauaaaa

SEQ ID NO: 40189 - RNA, 22 nt, Salmonella typhimurium LT2
cgccugagcuguaacggcagag

SEQ ID NO: 40190 - RNA, 22 nt, Salmonella typhimurium LT2
cgccugcugaauuugggcgaac

SEQ ID NO: 40191 - RNA, 22 nt, Salmonella typhimurium LT2
cgcgaaugauuuaggggauaaa

SEQ ID NO: 40192 - RNA, 22 nt, Salmonella typhimurium LT2
cgcgaugaucggcugguuuggc

SEQ ID NO: 40193 - RNA, 22 nt, Salmonella typhimurium LT2
cgcgaugggcguaaacaucaac

SEQ ID NO: 40194 - RNA, 22 nt, Salmonella typhimurium LT2
cgcgcuuucuaccaggcagcca

SEQ ID NO: 40195 - RNA, 22 nt, Salmonella typhimurium LT2
cgcgugaugcggcgguaaagau

SEQ ID NO: 40196 - RNA, 22 nt, Salmonella typhimurium LT2
cgcguuguuaacgaaagcgcug

SEQ ID NO: 40197 - RNA, 22 nt, Salmonella typhimurium LT2
cgcuccugcuccugcuccaucc

SEQ ID NO: 40198 - RNA, 22 nt, Salmonella typhimurium LT2
cgcuggaagagcaggccagccg

SEQ ID NO: 40199 - RNA, 22 nt, Salmonella typhimurium LT2
cgcuggacgaacgcgugcugaa

SEQ ID NO: 40200 - RNA, 23 nt, Salmonella typhimurium LT2
cgcuggaugauuuuugucagagc

SEQ ID NO: 40201 - RNA, 22 nt, Salmonella typhimurium LT2
cgcugucgucgaugucgcccac

SEQ ID NO: 40202 - RNA, 22 nt, Salmonella typhimurium LT2
cggaacgcacagccuuucgucg

SEQ ID NO: 40203 - RNA, 22 nt, Salmonella typhimurium LT2
cggagcauuaauggugucgcgc

SEQ ID NO: 40204 - RNA, 22 nt, Salmonella typhimurium LT2
cggagugcgcgauguuggcggc

SEQ ID NO: 40205 - RNA, 22 nt, Salmonella typhimurium LT2
cggauaagcauagcgccauccg

SEQ ID NO: 40206 - RNA, 21 nt, Salmonella typhimurium LT2
cggaucugcugaaggcagcgg

SEQ ID NO: 40207 - RNA, 20 nt, Salmonella typhimurium LT2
cggauggcgacguggcagcg

SEQ ID NO: 40208 - RNA, 22 nt, Salmonella typhimurium LT2
cggauggcgcuaugcuuauccg

SEQ ID NO: 40209 - RNA, 22 nt, Salmonella typhimurium LT2
cggauuguguccuggaagaagg

SEQ ID NO: 40210 - RNA, 21 nt, Salmonella typhimurium LT2
cggcaacuuaagcggcaaucc

SEQ ID NO: 40211 - RNA, 22 nt, Salmonella typhimurium LT2
cgguagaaaacuuucuagcgca

SEQ ID NO: 40212 - RNA, 21 nt, Salmonella typhimurium LT2
cgguaucgucaccuacggcgc

SEQ ID NO: 40213 - RNA, 22 nt, Salmonella typhimurium LT2
cggugagcugugaugcacggcg

SEQ ID NO: 40214 - RNA, 19 nt, Salmonella typhimurium LT2
cggugccugguggcggaga

SEQ ID NO: 40215 - RNA, 22 nt, Salmonella typhimurium LT2
cgguuggccggaaacccgcgcg

SEQ ID NO: 40216 - RNA, 22 nt, Salmonella typhimurium LT2
cguaaagcuguugugucccggu

SEQ ID NO: 40217 - RNA, 22 nt, Salmonella typhimurium LT2
cguaaggcauuacaaggcgaua

SEQ ID NO: 40218 - RNA, 22 nt, Salmonella typhimurium LT2
cguagaaacgagcgguaacugg

SEQ ID NO: 40219 - RNA, 22 nt, Salmonella typhimurium LT2
cgucaaguugcaacugauauuc

SEQ ID NO: 40220 - RNA, 22 nt, Salmonella typhimurium LT2
cgucgagcagauaaaaacgauu

SEQ ID NO: 40221 - RNA, 22 nt, Salmonella typhimurium LT2
cgucguggcauuugccggccca

SEQ ID NO: 40222 - RNA, 22 nt, Salmonella typhimurium LT2
cgucugaccggaugaugcguuu

SEQ ID NO: 40223 - RNA, 22 nt, Salmonella typhimurium LT2
cgugccugauggcgcugugcuu

SEQ ID NO: 40224 - RNA, 22 nt, Salmonella typhimurium LT2
cguguaggccugguaagcgcag

SEQ ID NO: 40225 - RNA, 22 nt, Salmonella typhimurium LT2
cguuccaccuuuaucagcagug

SEQ ID NO: 40226 - RNA, 18 nt, Salmonella typhimurium LT2
cguucgucugcaacgcau

SEQ ID NO: 40227 - RNA, 22 nt, Salmonella typhimurium LT2
cuaacgcuuaugcugccuacaa

SEQ ID NO: 40228 - RNA, 22 nt, Salmonella typhimurium LT2
cuaacggcgcaugugguauugu

SEQ ID NO: 40229 - RNA, 22 nt, Salmonella typhimurium LT2
cuacgcuuaucaggccuacagg

SEQ ID NO: 40230 - RNA, 22 nt, Salmonella typhimurium LT2
cuacgguacugcccaccuucgc

SEQ ID NO: 40231 - RNA, 22 nt, Salmonella typhimurium LT2
cuaucggcaaucgagcgugaag

SEQ ID NO: 40232 - RNA, 22 nt, Salmonella typhimurium LT2
cucgcgcuuaacaguacguugg

SEQ ID NO: 40233 - RNA, 22 nt, Salmonella typhimurium LT2
cugaauuucuccggcgcgcaga

SEQ ID NO: 40234 - RNA, 21 nt, Salmonella typhimurium LT2
cugacgccgcuguuuucacuc

SEQ ID NO: 40235 - RNA, 22 nt, Salmonella typhimurium LT2
cugaggccgcugguggcgacuu

SEQ ID NO: 40236 - RNA, 22 nt, Salmonella typhimurium LT2
cugaucgaggucguuacgcuca

SEQ ID NO: 40237 - RNA, 22 nt, Salmonella typhimurium LT2
cugaugauggaaaacgcgcuga

SEQ ID NO: 40238 - RNA, 22 nt, Salmonella typhimurium LT2
cugauucgcuacuuucgccuuu

SEQ ID NO: 40239 - RNA, 23 nt, Salmonella typhimurium LT2
cugauugacgucaaucugggcga

SEQ ID NO: 40240 - RNA, 22 nt, Salmonella typhimurium LT2
cugcgcuuaccaggccuacacg

SEQ ID NO: 40241 - RNA, 22 nt, Salmonella typhimurium LT2
cugcgcuuaucaggccuacgag

SEQ ID NO: 40242 - RNA, 22 nt, Salmonella typhimurium LT2
cugcgguucaggccaguuguua

SEQ ID NO: 40243 - RNA, 22 nt, Salmonella typhimurium LT2
cugcugcucaauaauacguuua

SEQ ID NO: 40244 - RNA, 22 nt, Salmonella typhimurium LT2
cuggaacuuuguaguagcgauc

SEQ ID NO: 40245 - RNA, 22 nt, Salmonella typhimurium LT2
cuggaagcgcucgguguuuggc

SEQ ID NO: 40246 - RNA, 22 nt, Salmonella typhimurium LT2
cuggauuaagcgggcugcgugu

SEQ ID NO: 40247 - RNA, 23 nt, Salmonella typhimurium LT2
cuggcgcauaaagagcucgacca

SEQ ID NO: 40248 - RNA, 22 nt, Salmonella typhimurium LT2
cuggcggaugcguuagggaugg

SEQ ID NO: 40249 - RNA, 22 nt, Salmonella typhimurium LT2
cuggcguaacgcauuauacuuu

SEQ ID NO: 40250 - RNA, 22 nt, Salmonella typhimurium LT2
cugggagcaggcucgauuuaug

SEQ ID NO: 40251 - RNA, 22 nt, Salmonella typhimurium LT2
cuggugcacgagguggaacaua

SEQ ID NO: 40252 - RNA, 22 nt, Salmonella typhimurium LT2
cugucgcguuaaaacugggucu

SEQ ID NO: 40253 - RNA, 22 nt, Salmonella typhimurium LT2
cugugagacggcggauugcgug

SEQ ID NO: 40254 - RNA, 22 nt, Salmonella typhimurium LT2
cuguguaugauucauccggaga

SEQ ID NO: 40255 - RNA, 22 nt, Salmonella typhimurium LT2
cuuaccgguaugacgcgcuaaa

SEQ ID NO: 40256 - RNA, 20 nt, Salmonella typhimurium LT2
gcgucaugcggcugcguuuc

SEQ ID NO: 40257 - RNA, 22 nt, Salmonella typhimurium LT2
gcgugcaggaaaucuuuaacgu

SEQ ID NO: 40258 - RNA, 22 nt, Salmonella typhimurium LT2
gcguuauucugcgcgcgcucua

SEQ ID NO: 40259 - RNA, 22 nt, Salmonella typhimurium LT2
gcguucgaguuaggcgaucaug

SEQ ID NO: 40260 - RNA, 22 nt, Salmonella typhimurium LT2
gcguucugaucugucugcggac

SEQ ID NO: 40261 - RNA, 22 nt, Salmonella typhimurium LT2
gcguugacgagucgcugauucu

SEQ ID NO: 40262 - RNA, 22 nt, Salmonella typhimurium LT2
gcuaaauccuuauaugcgcguu

SEQ ID NO: 40263 - RNA, 22 nt, Salmonella typhimurium LT2
gcuaccaacauccaguccgucg

SEQ ID NO: 40264 - RNA, 22 nt, Salmonella typhimurium LT2
gcuaccagacgcggcucaaugc

SEQ ID NO: 40265 - RNA, 22 nt, Salmonella typhimurium LT2
gcuacgcgcagauaggcugcgu

SEQ ID NO: 40266 - RNA, 22 nt, Salmonella typhimurium LT2
gcuagcgcuuaccugaccuaca

SEQ ID NO: 40267 - RNA, 22 nt, Salmonella typhimurium LT2
gcuauaccacgggaagaugguc

SEQ ID NO: 40268 - RNA, 22 nt, Salmonella typhimurium LT2
gcuauuucuggugguucaguau

SEQ ID NO: 40269 - RNA, 22 nt, Salmonella typhimurium LT2
gcucgacuggacggacagacau

SEQ ID NO: 40270 - RNA, 20 nt, Salmonella typhimurium LT2
gcucgccaggauuagccugu

SEQ ID NO: 40271 - RNA, 22 nt, Salmonella typhimurium LT2
gcucgugcgcauuagucagguu

SEQ ID NO: 40272 - RNA, 22 nt, Salmonella typhimurium LT2
gcugagccugauuuuaccgcug

SEQ ID NO: 40273 - RNA, 22 nt, Salmonella typhimurium LT2
gcugauaagcaggugaucggcc

SEQ ID NO: 40274 - RNA, 22 nt, Salmonella typhimurium LT2
gcugaugaccgauaagcugcaa

SEQ ID NO: 40275 - RNA, 22 nt, Salmonella typhimurium LT2
gcuggacguugggggcuaccgg

SEQ ID NO: 40276 - RNA, 20 nt, Salmonella typhimurium LT2
gcugucucgccagacgcagc

SEQ ID NO: 40277 - RNA, 22 nt, Salmonella typhimurium LT2
gcuuaacagcggaauggucgca

SEQ ID NO: 40278 - RNA, 19 nt, Salmonella typhimurium LT2
gcuucggugugccgacgcu

SEQ ID NO: 40279 - RNA, 22 nt, Salmonella typhimurium LT2
gcuuucacgcccauuuucggga

SEQ ID NO: 40280 - RNA, 22 nt, Salmonella typhimurium LT2
gcuuucaggccuccuggugugg

SEQ ID NO: 40281 - RNA, 22 nt, Salmonella typhimurium LT2
ggaaccauuuugacuuuacgaa

SEQ ID NO: 40282 - RNA, 22 nt, Salmonella typhimurium LT2
ggaaugcaacgccugauuugcc

SEQ ID NO: 40283 - RNA, 21 nt, Salmonella typhimurium LT2
ggaauguuacugcauuggcaa

SEQ ID NO: 40284 - RNA, 22 nt, Salmonella typhimurium LT2
ggaauucuguucaguggcguag

SEQ ID NO: 40285 - RNA, 22 nt, Salmonella typhimurium LT2
ggacagcguugcgugguguuuu

SEQ ID NO: 40286 - RNA, 22 nt, Salmonella typhimurium LT2
ggacuguuuaucgcuauuauua

SEQ ID NO: 40287 - RNA, 23 nt, Salmonella typhimurium LT2
ggauacuugaugccuuuauccgg

SEQ ID NO: 40288 - RNA, 22 nt, Salmonella typhimurium LT2
ggauauugaugcggcgaucauu

SEQ ID NO: 40289 - RNA, 22 nt, Salmonella typhimurium LT2
ggaugaauuugugcacugccug

SEQ ID NO: 40290 - RNA, 22 nt, Salmonella typhimurium LT2
ggauucugccgaaacugaucgg

SEQ ID NO: 40291 - RNA, 22 nt, Salmonella typhimurium LT2
ggauugccauuggacuugccgg

SEQ ID NO: 40292 - RNA, 22 nt, Salmonella typhimurium LT2
ggcaguggaugaccaugauugu

SEQ ID NO: 40293 - RNA, 22 nt, Salmonella typhimurium LT2
ggcauuaugcgguauuauaucu

SEQ ID NO: 40294 - RNA, 21 nt, Salmonella typhimurium LT2
ggccaugacaucuauccuauc

SEQ ID NO: 40295 - RNA, 22 nt, Salmonella typhimurium LT2
ggccuacaagaauuuaucgcaa

SEQ ID NO: 40296 - RNA, 22 nt, Salmonella typhimurium LT2
ggccugacacgcacagcgccau

SEQ ID NO: 40297 - RNA, 22 nt, Salmonella typhimurium LT2
ggccugauaagcgcagcgccau

SEQ ID NO: 40298 - RNA, 22 nt, Salmonella typhimurium LT2
ggccugauccgcaaagccggga

SEQ ID NO: 40299 - RNA, 22 nt, Salmonella typhimurium LT2
ggcgagguguaagaaagcagaa

SEQ ID NO: 40300 - RNA, 22 nt, Salmonella typhimurium LT2
ggcgcugaacugaacgaugaag

SEQ ID NO: 40301 - RNA, 21 nt, Salmonella typhimurium LT2
ggcguacauuacaauuuuuca

SEQ ID NO: 40302 - RNA, 22 nt, Salmonella typhimurium LT2
ggcguccagaucgcccucaucg

SEQ ID NO: 40303 - RNA, 22 nt, Salmonella typhimurium LT2
ggcgucuuccaguggcacgccg

SEQ ID NO: 40304 - RNA, 22 nt, Salmonella typhimurium LT2
ggcgugaguuccggcggcgcgg

SEQ ID NO: 40305 - RNA, 17 nt, Salmonella typhimurium LT2
ggcuggcaacggccagc

SEQ ID NO: 40306 - RNA, 22 nt, Salmonella typhimurium LT2
gggauacggugcugguugaaaa

SEQ ID NO: 40307 - RNA, 22 nt, Salmonella typhimurium LT2
gggaucaguauaccucgucaga

SEQ ID NO: 40308 - RNA, 20 nt, Salmonella typhimurium LT2
gggcaugaagcacuauguug

SEQ ID NO: 40309 - RNA, 22 nt, Salmonella typhimurium LT2
gggcgcauguuuugaguaaaac

SEQ ID NO: 40310 - RNA, 18 nt, Salmonella typhimurium LT2
gggcuaucaccccuucgc

SEQ ID NO: 40311 - RNA, 22 nt, Salmonella typhimurium LT2
ggguaucgacaccaucauauug

SEQ ID NO: 40312 - RNA, 22 nt, Salmonella typhimurium LT2
gguaauggucuggucaagggga

SEQ ID NO: 40313 - RNA, 22 nt, Salmonella typhimurium LT2
gguauggcgucaauuucaccca

SEQ ID NO: 40314 - RNA, 19 nt, Salmonella typhimurium LT2
ggucagcgaacuggcguua

SEQ ID NO: 40315 - RNA, 22 nt, Salmonella typhimurium LT2
ggucgccagccagcgugucggu

SEQ ID NO: 40316 - RNA, 22 nt, Salmonella typhimurium LT2
ggucgcuggacgccauccugca

SEQ ID NO: 40317 - RNA, 22 nt, Salmonella typhimurium LT2
ggugcggaagauaagguguuua

SEQ ID NO: 40318 - RNA, 23 nt, Salmonella typhimurium LT2
gguuaauguugcggugucggagg

SEQ ID NO: 40319 - RNA, 22 nt, Salmonella typhimurium LT2
gguuucauuuguugccguuaug

SEQ ID NO: 40320 - RNA, 22 nt, Salmonella typhimurium LT2
guaaugaugccuugcugugccg

SEQ ID NO: 40321 - RNA, 22 nt, Salmonella typhimurium LT2
guagcgggcggcauccggucaa

SEQ ID NO: 40322 - RNA, 22 nt, Salmonella typhimurium LT2
guagcgugaaauaauuagcgcu

SEQ ID NO: 40323 - RNA, 22 nt, Salmonella typhimurium LT2
guaucguacaggcgguggccgg

SEQ ID NO: 40324 - RNA, 22 nt, Salmonella typhimurium LT2
guauuaccaggaagagcucaau

SEQ ID NO: 40325 - RNA, 22 nt, Salmonella typhimurium LT2
gucaacagccauauggcgcguu

SEQ ID NO: 40326 - RNA, 21 nt, Salmonella typhimurium LT2
gucagcgcuuuaucacgcgau

SEQ ID NO: 40327 - RNA, 22 nt, Salmonella typhimurium LT2
gucaggcuuguggcugauaucg

SEQ ID NO: 40328 - RNA, 22 nt, Salmonella typhimurium LT2
gucaguaucgcgcaguuuggcg

SEQ ID NO: 40329 - RNA, 22 nt, Salmonella typhimurium LT2
gucagugccuuuggcggcagcc

SEQ ID NO: 40330 - RNA, 23 nt, Salmonella typhimurium LT2
gucgucugaaggaugaagcguaa

SEQ ID NO: 40331 - RNA, 18 nt, Salmonella typhimurium LT2
gucugccugauuaucagg

SEQ ID NO: 40332 - RNA, 22 nt, Salmonella typhimurium LT2
gugaagaucagcagagcgggga

SEQ ID NO: 40333 - RNA, 22 nt, Salmonella typhimurium LT2
gugaaggcauccgcaugaauag

SEQ ID NO: 40334 - RNA, 22 nt, Salmonella typhimurium LT2
gugaauaagcgguagaguaaac

SEQ ID NO: 40335 - RNA, 20 nt, Salmonella typhimurium LT2
gugauaaaugacaaguggga

SEQ ID NO: 40336 - RNA, 20 nt, Salmonella typhimurium LT2
gugauggaaaucagcuugua

SEQ ID NO: 40337 - RNA, 22 nt, Salmonella typhimurium LT2
gugcaggaugacucggcuucgc

SEQ ID NO: 40338 - RNA, 22 nt, Salmonella typhimurium LT2
gugcgacaaacguucgggcgau

SEQ ID NO: 40339 - RNA, 22 nt, Salmonella typhimurium LT2
gugcgcgugcgcgaugaacauc

SEQ ID NO: 40340 - RNA, 22 nt, Salmonella typhimurium LT2
gugcuggaaaaacagggcucca

SEQ ID NO: 40341 - RNA, 23 nt, Salmonella typhimurium LT2
guguaccauaauccacugcaucc

SEQ ID NO: 40342 - RNA, 22 nt, Salmonella typhimurium LT2
guguuacgccuuauccggccua

SEQ ID NO: 40343 - RNA, 22 nt, Salmonella typhimurium LT2
guuacgcgccaucaggcaaaac

SEQ ID NO: 40344 - RNA, 22 nt, Salmonella typhimurium LT2
guucagauccagcguacgcacc

SEQ ID NO: 40345 - RNA, 22 nt, Salmonella typhimurium LT2
guuccgguuaucuaugcgccag

SEQ ID NO: 40346 - RNA, 22 nt, Salmonella typhimurium LT2
guugaucugguaguuauugcga

SEQ ID NO: 40347 - RNA, 22 nt, Salmonella typhimurium LT2
guugcgcucaaugaccuggcca

SEQ ID NO: 40348 - RNA, 22 nt, Salmonella typhimurium LT2
guuggauaguggcuucuuccag

SEQ ID NO: 40349 - RNA, 22 nt, Salmonella typhimurium LT2
guuguaucuuuaaugcuauucg

SEQ ID NO: 40350 - RNA, 22 nt, Salmonella typhimurium LT2
guuugcaacgguuccgguagua

SEQ ID NO: 40351 - RNA, 22 nt, Salmonella typhimurium LT2
uaaagcaccgcggccuuuuuug

SEQ ID NO: 40352 - RNA, 22 nt, Salmonella typhimurium LT2
uaagccgccagcguuaugcuga

SEQ ID NO: 40353 - RNA, 22 nt, Salmonella typhimurium LT2
uaagucgagcucaauaugguug

SEQ ID NO: 40354 - RNA, 22 nt, Salmonella typhimurium LT2
uaauacugucagucugacgccg

SEQ ID NO: 40355 - RNA, 22 nt, Salmonella typhimurium LT2
uaaugcuuauccggccuacagg

SEQ ID NO: 40356 - RNA, 22 nt, Salmonella typhimurium LT2
uacaaacggcgguauaacauga

SEQ ID NO: 40357 - RNA, 22 nt, Salmonella typhimurium LT2
uacaaaugauaacauaacccgu

SEQ ID NO: 40358 - RNA, 22 nt, Salmonella typhimurium LT2
uacaucgauuguugcgaauauu

SEQ ID NO: 40359 - RNA, 21 nt, Salmonella typhimurium LT2
uacgacgcacuuuaugagguc

SEQ ID NO: 40360 - RNA, 22 nt, Salmonella typhimurium LT2
uacgacgcacuuuaugaggucc

SEQ ID NO: 40361 - RNA, 22 nt, Salmonella typhimurium LT2
uacgcgaacaacuggaggucgg

SEQ ID NO: 40362 - RNA, 22 nt, Salmonella typhimurium LT2
uacggcagucucgauccugaau

SEQ ID NO: 40363 - RNA, 22 nt, Salmonella typhimurium LT2
uacguaugggguaugaggcggu

SEQ ID NO: 40364 - RNA, 22 nt, Salmonella typhimurium LT2
uacgugauuugagcggcuggcg

SEQ ID NO: 40365 - RNA, 22 nt, Salmonella typhimurium LT2
uacucggccacagcgggaauga

SEQ ID NO: 40366 - RNA, 22 nt, Salmonella typhimurium LT2
uacugucgccaccacuguugca

SEQ ID NO: 40367 - RNA, 22 nt, Salmonella typhimurium LT2
uagauaucgguaaacgucaucg

SEQ ID NO: 40368 - RNA, 22 nt, Salmonella typhimurium LT2
uagaucaucgggaagugcuggc

SEQ ID NO: 40369 - RNA, 22 nt, Salmonella typhimurium LT2
uagcccuguuguuuuuucaugu

SEQ ID NO: 40370 - RNA, 22 nt, Salmonella typhimurium LT2
uagcggaaaauugggcuauagc

SEQ ID NO: 40371 - RNA, 22 nt, Salmonella typhimurium LT2
uaggccaaccgccauccggcau

SEQ ID NO: 40372 - RNA, 22 nt, Salmonella typhimurium LT2
uaggccggauaagacguuaguc

SEQ ID NO: 40373 - RNA, 22 nt, Salmonella typhimurium LT2
uaggccgggcaaggcacagccg

SEQ ID NO: 40374 - RNA, 22 nt, Salmonella typhimurium LT2
uaggcgugcccgcgcaggccuc

SEQ ID NO: 40375 - RNA, 22 nt, Salmonella typhimurium LT2
uaguccuuaugacaaugucaaa

SEQ ID NO: 40376 - RNA, 20 nt, Salmonella typhimurium LT2
uagucuuccuggcauccagc

SEQ ID NO: 40377 - RNA, 22 nt, Salmonella typhimurium LT2
uauaggcgcuaagcugauccgg

SEQ ID NO: 40378 - RNA, 22 nt, Salmonella typhimurium LT2
uauaucagcgaccaucuggcgg

SEQ ID NO: 40379 - RNA, 22 nt, Salmonella typhimurium LT2
uaucacagccagaaaagggcua

SEQ ID NO: 40380 - RNA, 22 nt, Salmonella typhimurium LT2
uauccgcagauccagcacggcc

SEQ ID NO: 40381 - RNA, 22 nt, Salmonella typhimurium LT2
uauccggauggauagacucaag

SEQ ID NO: 40382 - RNA, 22 nt, Salmonella typhimurium LT2
uauccuggcguuagucucaaag

SEQ ID NO: 40383 - RNA, 22 nt, Salmonella typhimurium LT2
uaucgcgucgugucccagcgug

SEQ ID NO: 40384 - RNA, 22 nt, Salmonella typhimurium LT2
uaucuccauaucaucguggguc

SEQ ID NO: 40385 - RNA, 22 nt, Salmonella typhimurium LT2
uaucuggcaauuuauugcguug

SEQ ID NO: 40386 - RNA, 19 nt, Salmonella typhimurium LT2
uaugaaaccacugcuggac

SEQ ID NO: 40387 - RNA, 22 nt, Salmonella typhimurium LT2
uaugaagaucguaugguucagc

SEQ ID NO: 40388 - RNA, 22 nt, Salmonella typhimurium LT2
uaugaguuugucgaugccgaua

SEQ ID NO: 40389 - RNA, 21 nt, Salmonella typhimurium LT2
uaugcggcaaugauuucaacg

SEQ ID NO: 40390 - RNA, 22 nt, Salmonella typhimurium LT2
uaugugauccaucgugacuauc

SEQ ID NO: 40391 - RNA, 22 nt, Salmonella typhimurium LT2
uauuaccgucgauacugcugac

SEQ ID NO: 40392 - RNA, 22 nt, Salmonella typhimurium LT2
ucaagucaccgguuacagcguc

SEQ ID NO: 40393 - RNA, 22 nt, Salmonella typhimurium LT2
ucacugaugagccagguucugg

SEQ ID NO: 40394 - RNA, 22 nt, Salmonella typhimurium LT2
ucacuggaguaugaaacaaucg

SEQ ID NO: 40395 - RNA, 22 nt, Salmonella typhimurium LT2
ucagaauaucuccauuauucgc

SEQ ID NO: 40396 - RNA, 22 nt, Salmonella typhimurium LT2
ucagaccuucuucgauuucgcg

SEQ ID NO: 40397 - RNA, 22 nt, Salmonella typhimurium LT2
ucagauagauauucgcauccgg

SEQ ID NO: 40398 - RNA, 22 nt, Salmonella typhimurium LT2
ucagcgccugggugucaaucug

SEQ ID NO: 40399 - RNA, 22 nt, Salmonella typhimurium LT2
ucagcggcguguucccgacgcu

SEQ ID NO: 40400 - RNA, 22 nt, Salmonella typhimurium LT2
ucaggaaaaccaacaugaugua

SEQ ID NO: 40401 - RNA, 22 nt, Salmonella typhimurium LT2
ucaggguauugccaacgccguc

SEQ ID NO: 40402 - RNA, 22 nt, Salmonella typhimurium LT2
ucagggugauuuuguccagcuu

SEQ ID NO: 40403 - RNA, 22 nt, Salmonella typhimurium LT2
ucaguacgaucugauugucacu

SEQ ID NO: 40404 - RNA, 22 nt, Salmonella typhimurium LT2
ucaucagaccgauguugccuuc

SEQ ID NO: 40405 - RNA, 21 nt, Salmonella typhimurium LT2
ucauccagccaacaaacucaa

SEQ ID NO: 40406 - RNA, 22 nt, Salmonella typhimurium LT2
ucaucggcgcccguaugcgcau

SEQ ID NO: 40407 - RNA, 22 nt, Salmonella typhimurium LT2
ucaugccugcgcgccgggcuuu

SEQ ID NO: 40408 - RNA, 22 nt, Salmonella typhimurium LT2
ucauguucauuauuaacugcuc

SEQ ID NO: 40409 - RNA, 22 nt, Salmonella typhimurium LT2
ucauucgccaucagccggcaau

SEQ ID NO: 40410 - RNA, 22 nt, Salmonella typhimurium LT2
ucauugcugagacaggcucugu

SEQ ID NO: 40411 - RNA, 22 nt, Salmonella typhimurium LT2
ucauuugucagccagggagaaa

SEQ ID NO: 40412 - RNA, 22 nt, Salmonella typhimurium LT2
uccaacaguugcguaaucugau

SEQ ID NO: 40413 - RNA, 22 nt, Salmonella typhimurium LT2
uccaccgcaaaugcaucgugac

SEQ ID NO: 40414 - RNA, 22 nt, Salmonella typhimurium LT2
ugcgucgauuucuggugcggua

SEQ ID NO: 40415 - RNA, 22 nt, Salmonella typhimurium LT2
ugcgucugccugagcuggugca

SEQ ID NO: 40416 - RNA, 22 nt, Salmonella typhimurium LT2
ugcgucuuauccggccuacgga

SEQ ID NO: 40417 - RNA, 22 nt, Salmonella typhimurium LT2
ugcucacggauugcugaagggg

SEQ ID NO: 40418 - RNA, 22 nt, Salmonella typhimurium LT2
ugcuccaguuuccacggcgggu

SEQ ID NO: 40419 - RNA, 22 nt, Salmonella typhimurium LT2
ugcugaauccgauaaauggguu

SEQ ID NO: 40420 - RNA, 22 nt, Salmonella typhimurium LT2
ugcugacccguucuuacgguga

SEQ ID NO: 40421 - RNA, 20 nt, Salmonella typhimurium LT2
ugcugcauaaagggaugagc

SEQ ID NO: 40422 - RNA, 22 nt, Salmonella typhimurium LT2
ugcugccgcugacgcuggccau

SEQ ID NO: 40423 - RNA, 22 nt, Salmonella typhimurium LT2
uugcuggagcgauuucaggagg

SEQ ID NO: 40424 - RNA, 22 nt, Salmonella typhimurium LT2
uuguaagaaagcgcuuugcccu

SEQ ID NO: 40425 - RNA, 21 nt, Salmonella typhimurium LT2
uugucgcgagguaaucgucau

SEQ ID NO: 40426 - RNA, 22 nt, Salmonella typhimurium LT2
uugugccauuccugagcaauua

SEQ ID NO: 40427 - RNA, 22 nt, Salmonella typhimurium LT2
uuguucaaagugugguaacguu

SEQ ID NO: 40428 - RNA, 22 nt, Salmonella typhimurium LT2
uuuaccguuugauuucaaucgc

SEQ ID NO: 40429 - RNA, 22 nt, Salmonella typhimurium LT2
uuucauuguuguggaaccgcuu

SEQ ID NO: 40430 - RNA, 22 nt, Salmonella typhimurium LT2
uuucgacaguagcuuauaugug

SEQ ID NO: 40431 - RNA, 22 nt, Salmonella typhimurium LT2
uuucgcauguucgaccguggcg

SEQ ID NO: 40432 - RNA, 22 nt, Salmonella typhimurium LT2
uuucgcgcuggauuuguugaug

SEQ ID NO: 40433 - RNA, 22 nt, Salmonella typhimurium LT2
uuucgguaauggcgugcgaaaa

SEQ ID NO: 40434 - RNA, 22 nt, Salmonella typhimurium LT2
uuugaacccgcaucacugccga

SEQ ID NO: 40435 - RNA, 22 nt, Salmonella typhimurium LT2
uuugaugaucagauccguggcc

SEQ ID NO: 40436 - RNA, 22 nt, Salmonella typhimurium LT2
uuugcgccuguggggcaaccgu

SEQ ID NO: 40437 - RNA, 21 nt, Salmonella typhimurium LT2
uuuggcagucguuuaucggaa

SEQ ID NO: 40438 - RNA, 22 nt, Salmonella typhimurium LT2
aaaccgucgguaacaccauccg

SEQ ID NO: 40439 - RNA, 22 nt, Salmonella typhimurium LT2
aaacgcaucgguaugauugcgc

SEQ ID NO: 40440 - RNA, 22 nt, Salmonella typhimurium LT2
aaacggugcgauaucggcuuca

SEQ ID NO: 40441 - RNA, 22 nt, Salmonella typhimurium LT2
aaacucagugcgcauuaauucg

SEQ ID NO: 40442 - RNA, 22 nt, Salmonella typhimurium LT2
aaagcguggggcgugccgcugu

SEQ ID NO: 40443 - RNA, 22 nt, Salmonella typhimurium LT2
aaagcuggguggcgcgcguugc

SEQ ID NO: 40444 - RNA, 22 nt, Salmonella typhimurium LT2
aaaggcuuucuuuauaggaguc

SEQ ID NO: 40445 - RNA, 22 nt, Salmonella typhimurium LT2
aaagugccauugcaaucgcgug

SEQ ID NO: 40446 - RNA, 22 nt, Salmonella typhimurium LT2
aaaucgcuauagaugauuucgg

SEQ ID NO: 40447 - RNA, 21 nt, Salmonella typhimurium LT2
aaaugguuucgccgugggaga

SEQ ID NO: 40448 - RNA, 22 nt, Salmonella typhimurium LT2
aacaugguggcggcgggcagug

SEQ ID NO: 40449 - RNA, 22 nt, Salmonella typhimurium LT2
aaccaggaaucguuaacgucgg

SEQ ID NO: 40450 - RNA, 22 nt, Salmonella typhimurium LT2
aaccugcugugcagccacggua

SEQ ID NO: 40451 - RNA, 22 nt, Salmonella typhimurium LT2
aacgccugugaacuguugcaaa

SEQ ID NO: 40452 - RNA, 22 nt, Salmonella typhimurium LT2
aacgcgcagauuaaucugguga

SEQ ID NO: 40453 - RNA, 22 nt, Salmonella typhimurium LT2
aacgcgucuuauccggccuaca

SEQ ID NO: 40454 - RNA, 22 nt, Salmonella typhimurium LT2
aacgcugugucaugccgguauu

SEQ ID NO: 40455 - RNA, 22 nt, Salmonella typhimurium LT2
aacggcuaucugacagaaguag

SEQ ID NO: 40456 - RNA, 22 nt, Salmonella typhimurium LT2
aacgugaugauacagaauggug

SEQ ID NO: 40457 - RNA, 22 nt, Salmonella typhimurium LT2
aacguguaggccugguaagcga

SEQ ID NO: 40458 - RNA, 23 nt, Salmonella typhimurium LT2
aacucucucuuguugaagagggg

SEQ ID NO: 40459 - RNA, 22 nt, Salmonella typhimurium LT2
aacugcggcccgccuguugagc

SEQ ID NO: 40460 - RNA, 22 nt, Salmonella typhimurium LT2
aacugcuugaugaggccgaacg

SEQ ID NO: 40461 - RNA, 18 nt, Salmonella typhimurium LT2
aacugggcgucaggcaau

SEQ ID NO: 40462 - RNA, 22 nt, Salmonella typhimurium LT2
aagaccagauacguuauuacau

SEQ ID NO: 40463 - RNA, 22 nt, Salmonella typhimurium LT2
aagacgcgucgccaucuggcuc

SEQ ID NO: 40464 - RNA, 22 nt, Salmonella typhimurium LT2
aagaucggucggcgccuuaugu

SEQ ID NO: 40465 - RNA, 22 nt, Salmonella typhimurium LT2
aagcauauuacucagcccuuga

SEQ ID NO: 40466 - RNA, 23 nt, Salmonella typhimurium LT2
aagcgguuccacaacaaugaaaa

SEQ ID NO: 40467 - RNA, 22 nt, Salmonella typhimurium LT2
aagcgucuggaagguuaccgua

SEQ ID NO: 40468 - RNA, 22 nt, Salmonella typhimurium LT2
aagguuaugcuauucauuuauc

SEQ ID NO: 40469 - RNA, 22 nt, Salmonella typhimurium LT2
aagguugagcguugggaagucg

SEQ ID NO: 40470 - RNA, 20 nt, Salmonella typhimurium LT2
aagugccugcgccuugcuua

SEQ ID NO: 40471 - RNA, 22 nt, Salmonella typhimurium LT2
aagugcgagaauaaucuucacg

SEQ ID NO: 40472 - RNA, 22 nt, Salmonella typhimurium LT2
aaguugauccgcccgugaucgg

SEQ ID NO: 40473 - RNA, 22 nt, Salmonella typhimurium LT2
aauaccugccggauaacccgaa

SEQ ID NO: 40474 - RNA, 22 nt, Salmonella typhimurium LT2
aaucaguuggcuggccgccggg

SEQ ID NO: 40475 - RNA, 22 nt, Salmonella typhimurium LT2
aaucuggggcguuaucgcgggu

SEQ ID NO: 40476 - RNA, 22 nt, Salmonella typhimurium LT2
aaugaacagugaugaaaacgag

SEQ ID NO: 40477 - RNA, 22 nt, Salmonella typhimurium LT2
aaugaacaugauggaaggcacg

SEQ ID NO: 40478 - RNA, 22 nt, Salmonella typhimurium LT2
aaugaccguuuuaugucggcgc

SEQ ID NO: 40479 - RNA, 22 nt, Salmonella typhimurium LT2
aaugccgcaggcggacgaguag

SEQ ID NO: 40480 - RNA, 22 nt, Salmonella typhimurium LT2
aaugcuuugggcaccaccgauu

SEQ ID NO: 40481 - RNA, 23 nt, Salmonella typhimurium LT2
aauggcaauauagucuuucaccc

SEQ ID NO: 40482 - RNA, 22 nt, Salmonella typhimurium LT2
aauggcuuuugaacacccaggu

SEQ ID NO: 40483 - RNA, 22 nt, Salmonella typhimurium LT2
aauuacgagcaguaaugguauc

SEQ ID NO: 40484 - RNA, 22 nt, Salmonella typhimurium LT2
aauucgcuccguuaagccuaug

SEQ ID NO: 40485 - RNA, 22 nt, Salmonella typhimurium LT2
acaaaguuuuaccagaagaagc

SEQ ID NO: 40486 - RNA, 22 nt, Salmonella typhimurium LT2
acaaucugaacauuaagucaug

SEQ ID NO: 40487 - RNA, 22 nt, Salmonella typhimurium LT2
acaaugcgggcacugaauacgc

SEQ ID NO: 40488 - RNA, 22 nt, Salmonella typhimurium LT2
acaauggacgccgccgaagcgu

SEQ ID NO: 40489 - RNA, 22 nt, Salmonella typhimurium LT2
acagcgcuucccugcugguggc

SEQ ID NO: 40490 - RNA, 22 nt, Salmonella typhimurium LT2
acagugguugaauguagaggga

SEQ ID NO: 40491 - RNA, 22 nt, Salmonella typhimurium LT2
acaguugguauuuuucucuaga

SEQ ID NO: 40492 - RNA, 22 nt, Salmonella typhimurium LT2
acaguuugaucgcaagggcaug

SEQ ID NO: 40493 - RNA, 22 nt, Salmonella typhimurium LT2
acauccgcuuuuccacggcccg

SEQ ID NO: 40494 - RNA, 22 nt, Salmonella typhimurium LT2
acauuaacuaugguaaaggaga

SEQ ID NO: 40495 - RNA, 22 nt, Salmonella typhimurium LT2
acauugugaugccugaugacga

SEQ ID NO: 40496 - RNA, 22 nt, Salmonella typhimurium LT2
accaccugcccggcuuuguuca

SEQ ID NO: 40497 - RNA, 22 nt, Salmonella typhimurium LT2
accacgcguggaaaugauguac

SEQ ID NO: 40498 - RNA, 20 nt, Salmonella typhimurium LT2
accagcagcgcggcgaccgc

SEQ ID NO: 40499 - RNA, 20 nt, Salmonella typhimurium LT2
accagccuggggcggcgcug

SEQ ID NO: 40500 - RNA, 22 nt, Salmonella typhimurium LT2
accaggaagugaaagcgcugau

SEQ ID NO: 40501 - RNA, 22 nt, Salmonella typhimurium LT2
accaugaucaccaucuucacau

SEQ ID NO: 40502 - RNA, 22 nt, Salmonella typhimurium LT2
acccugccggaaacggugacac

SEQ ID NO: 40503 - RNA, 22 nt, Salmonella typhimurium LT2
accgcagcagcuugcaguuuau

SEQ ID NO: 40504 - RNA, 20 nt, Salmonella typhimurium LT2
accggcguacugaucgccaa

SEQ ID NO: 40505 - RNA, 22 nt, Salmonella typhimurium LT2
accggcugcgauuacgcuggcg

SEQ ID NO: 40506 - RNA, 22 nt, Salmonella typhimurium LT2
accgguuuccaguccagcguac

SEQ ID NO: 40507 - RNA, 22 nt, Salmonella typhimurium LT2
accugccguugauugucgaugc

SEQ ID NO: 40508 - RNA, 22 nt, Salmonella typhimurium LT2
accuguggcagauugaauggau

SEQ ID NO: 40509 - RNA, 22 nt, Salmonella typhimurium LT2
acgacccgauagauucucugga

SEQ ID NO: 40510 - RNA, 22 nt, Salmonella typhimurium LT2
acgcccugcuucagggcauggg

SEQ ID NO: 40511 - RNA, 23 nt, Salmonella typhimurium LT2
acgcggaacacguuaaccagcuc

SEQ ID NO: 40512 - RNA, 22 nt, Salmonella typhimurium LT2
acgcgugacggcgacuauuuua

SEQ ID NO: 40513 - RNA, 22 nt, Salmonella typhimurium LT2
acgcguugcugaaccgguagau

SEQ ID NO: 40514 - RNA, 21 nt, Salmonella typhimurium LT2
acggacgauuuccguuuuugc

SEQ ID NO: 40515 - RNA, 22 nt, Salmonella typhimurium LT2
acggcgcuggacuauuucagcc

SEQ ID NO: 40516 - RNA, 22 nt, Salmonella typhimurium LT2
acgguuacucauaugcguaacu

SEQ ID NO: 40517 - RNA, 22 nt, Salmonella typhimurium LT2
acguggugcgcggcagccguuu

SEQ ID NO: 40518 - RNA, 22 nt, Salmonella typhimurium LT2
acguuucucaaccuaugcgauu

SEQ ID NO: 40519 - RNA, 22 nt, Salmonella typhimurium LT2
acuccuguuaaacccgcuaacg

SEQ ID NO: 40520 - RNA, 22 nt, Salmonella typhimurium LT2
acucuuaacaaauagaaauuac

SEQ ID NO: 40521 - RNA, 22 nt, Salmonella typhimurium LT2
acucuugagauuugguauucau

SEQ ID NO: 40522 - RNA, 18 nt, Salmonella typhimurium LT2
acugcggaccgucgcggc

SEQ ID NO: 40523 - RNA, 22 nt, Salmonella typhimurium LT2
acuggcauaccuaucuccauga

SEQ ID NO: 40524 - RNA, 22 nt, Salmonella typhimurium LT2
acuggcggauuagcgaaggcac

SEQ ID NO: 40525 - RNA, 22 nt, Salmonella typhimurium LT2
acuguaaugccgguguuuuuuc

SEQ ID NO: 40526 - RNA, 22 nt, Salmonella typhimurium LT2
acuguggaauaaagguuagcgc

SEQ ID NO: 40527 - RNA, 22 nt, Salmonella typhimurium LT2
acuuugcuaucggcucccaucc

SEQ ID NO: 40528 - RNA, 22 nt, Salmonella typhimurium LT2
agaacgcacggucagcauugau

SEQ ID NO: 40529 - RNA, 22 nt, Salmonella typhimurium LT2
agaagugccgguuggcuucaaa

SEQ ID NO: 40530 - RNA, 22 nt, Salmonella typhimurium LT2
agacaucgcuaacaguauauau

SEQ ID NO: 40531 - RNA, 22 nt, Salmonella typhimurium LT2
agacggcgaaggcguuagguau

SEQ ID NO: 40532 - RNA, 22 nt, Salmonella typhimurium LT2
agacgguacguugacuacgccg

SEQ ID NO: 40533 - RNA, 22 nt, Salmonella typhimurium LT2
agagguucaugaugcgccugca

SEQ ID NO: 40534 - RNA, 22 nt, Salmonella typhimurium LT2
agauaaugagauaucauccaua

SEQ ID NO: 40535 - RNA, 22 nt, Salmonella typhimurium LT2
agaucucgaacacccgaucgaa

SEQ ID NO: 40536 - RNA, 22 nt, Salmonella typhimurium LT2
agauucauguaugauugccggg

SEQ ID NO: 40537 - RNA, 22 nt, Salmonella typhimurium LT2
agauugguaaugaugguuuauu

SEQ ID NO: 40538 - RNA, 22 nt, Salmonella typhimurium LT2
agauuugcuugaguuguuuagc

SEQ ID NO: 40539 - RNA, 22 nt, Salmonella typhimurium LT2
agcaaucgcaagcggaagcgcg

SEQ ID NO: 40540 - RNA, 22 nt, Salmonella typhimurium LT2
agcaccucuggcacaucaugcg

SEQ ID NO: 40541 - RNA, 22 nt, Salmonella typhimurium LT2
agcagaccauuuucugcggcgu

SEQ ID NO: 40542 - RNA, 22 nt, Salmonella typhimurium LT2
agcagaugaaugugcggauggu

SEQ ID NO: 40543 - RNA, 22 nt, Salmonella typhimurium LT2
agcaggacuggagccaucagca

SEQ ID NO: 40544 - RNA, 22 nt, Salmonella typhimurium LT2
agcaguuuaauaagguucuggc

SEQ ID NO: 40545 - RNA, 22 nt, Salmonella typhimurium LT2
agccgguuucccgggcgcggaa

SEQ ID NO: 40546 - RNA, 22 nt, Salmonella typhimurium LT2
agcgaccuguuuguugccgggu

SEQ ID NO: 40547 - RNA, 22 nt, Salmonella typhimurium LT2
agcgauaaccugcugaugauca

SEQ ID NO: 40548 - RNA, 22 nt, Salmonella typhimurium LT2
agcggcaucgauaucgcgcugu

SEQ ID NO: 40549 - RNA, 22 nt, Salmonella typhimurium LT2
agcggccugcuggucucgcugu

SEQ ID NO: 40550 - RNA, 22 nt, Salmonella typhimurium LT2
agcggguuaugcgacgugcgug

SEQ ID NO: 40551 - RNA, 22 nt, Salmonella typhimurium LT2
agcguugcuugaucgccugccg

SEQ ID NO: 40552 - RNA, 22 nt, Salmonella typhimurium LT2
agcugccucaggaagcguuccu

SEQ ID NO: 40553 - RNA, 23 nt, Salmonella typhimurium LT2
agcuggugauuuccggugccgau

SEQ ID NO: 40554 - RNA, 22 nt, Salmonella typhimurium LT2
aggaaucacaggcggcuuaucu

SEQ ID NO: 40555 - RNA, 22 nt, Salmonella typhimurium LT2
aggauaugagauuaugaguacc

SEQ ID NO: 40556 - RNA, 22 nt, Salmonella typhimurium LT2
aggauauugaguauuaugacua

SEQ ID NO: 40557 - RNA, 22 nt, Salmonella typhimurium LT2
aggcaaacgucgucuggugauu

SEQ ID NO: 40558 - RNA, 22 nt, Salmonella typhimurium LT2
aggccggauaagcguagcgcca

SEQ ID NO: 40559 - RNA, 22 nt, Salmonella typhimurium LT2
agguaccgcguaacacugcgcc

SEQ ID NO: 40560 - RNA, 22 nt, Salmonella typhimurium LT2
agguucuaccuccggcgcgacg

SEQ ID NO: 40561 - RNA, 22 nt, Salmonella typhimurium LT2
aguacgcuauaugccgaguggc

SEQ ID NO: 40562 - RNA, 22 nt, Salmonella typhimurium LT2
agucaggaucugacgagcgcga

SEQ ID NO: 40563 - RNA, 22 nt, Salmonella typhimurium LT2
agucagguaacgaugccuguau

SEQ ID NO: 40564 - RNA, 21 nt, Salmonella typhimurium LT2
agucaugcaggaucuggcgga

SEQ ID NO: 40565 - RNA, 22 nt, Salmonella typhimurium LT2
agucgauuagcgucggcgaucg

SEQ ID NO: 40566 - RNA, 22 nt, Salmonella typhimurium LT2
agucgcuguacugcgcgagcag

SEQ ID NO: 40567 - RNA, 22 nt, Salmonella typhimurium LT2
agugauuauuacgcagcauaug

SEQ ID NO: 40568 - RNA, 22 nt, Salmonella typhimurium LT2
agugccggggauuaccgcggcu

SEQ ID NO: 40569 - RNA, 22 nt, Salmonella typhimurium LT2
agugccgguacaguaugggggc

SEQ ID NO: 40570 - RNA, 22 nt, Salmonella typhimurium LT2
aguggaaucagccaggagucgg

SEQ ID NO: 40571 - RNA, 22 nt, Salmonella typhimurium LT2
aguguccgggcaccgaaguacg

SEQ ID NO: 40572 - RNA, 22 nt, Salmonella typhimurium LT2
aguguugacugccguuuuaguu

SEQ ID NO: 40573 - RNA, 22 nt, Salmonella typhimurium LT2
auaacgauauuucauccccauu

SEQ ID NO: 40574 - RNA, 22 nt, Salmonella typhimurium LT2
auaacggacucuucuuccgaau

SEQ ID NO: 40575 - RNA, 22 nt, Salmonella typhimurium LT2
auaagacugauauccaucggag

SEQ ID NO: 40576 - RNA, 22 nt, Salmonella typhimurium LT2
auagagauaucgccauugcacu

SEQ ID NO: 40577 - RNA, 22 nt, Salmonella typhimurium LT2
auauggcugucgcccgugccgg

SEQ ID NO: 40578 - RNA, 22 nt, Salmonella typhimurium LT2
auauggugcgcggcaccacgca

SEQ ID NO: 40579 - RNA, 22 nt, Salmonella typhimurium LT2
auauucccggcucaagcgcucg

SEQ ID NO: 40580 - RNA, 22 nt, Salmonella typhimurium LT2
auauuggugaagacgcaccugu

SEQ ID NO: 40581 - RNA, 20 nt, Salmonella typhimurium LT2
aucagacgauaagcugugga

SEQ ID NO: 40582 - RNA, 22 nt, Salmonella typhimurium LT2
aucagcguaucuucauuuucgc

SEQ ID NO: 40583 - RNA, 22 nt, Salmonella typhimurium LT2
aucaggcgguaguaucagggaa

SEQ ID NO: 40584 - RNA, 22 nt, Salmonella typhimurium LT2
aucaggcuauccggcuuuuaac

SEQ ID NO: 40585 - RNA, 22 nt, Salmonella typhimurium LT2
aucaggugucgguugcggaucu

SEQ ID NO: 40586 - RNA, 22 nt, Salmonella typhimurium LT2
aucaguuucaggaugaagaccg

SEQ ID NO: 40587 - RNA, 22 nt, Salmonella typhimurium LT2
aucaucgccuucaucuucaugu

SEQ ID NO: 40588 - RNA, 22 nt, Salmonella typhimurium LT2
aucauucugaacgcgauuugcg

SEQ ID NO: 40589 - RNA, 20 nt, Salmonella typhimurium LT2
auccggguaaagaccaaaga

SEQ ID NO: 40590 - RNA, 22 nt, Salmonella typhimurium LT2
auccggguaacuaugaugagua

SEQ ID NO: 40591 - RNA, 22 nt, Salmonella typhimurium LT2
auccugaucccguuuaucgugg

SEQ ID NO: 40592 - RNA, 22 nt, Salmonella typhimurium LT2
auccugcaaugcgcugacgccg

SEQ ID NO: 40593 - RNA, 22 nt, Salmonella typhimurium LT2
aucgauaaaguaaugacccgcc

SEQ ID NO: 40594 - RNA, 22 nt, Salmonella typhimurium LT2
aucgcgcucgucagauccugac

SEQ ID NO: 40595 - RNA, 22 nt, Salmonella typhimurium LT2
aucuggcuaaaaucugaaggcg

SEQ ID NO: 40596 - RNA, 22 nt, Salmonella typhimurium LT2
aucugguugaauuugaucagga

SEQ ID NO: 40597 - RNA, 22 nt, Salmonella typhimurium LT2
augaccguuuugauaucagugu

SEQ ID NO: 40598 - RNA, 22 nt, Salmonella typhimurium LT2
augagauuaauacacuggagau

SEQ ID NO: 40599 - RNA, 22 nt, Salmonella typhimurium LT2
augaugaugcugacguuacugc

SEQ ID NO: 40600 - RNA, 22 nt, Salmonella typhimurium LT2
augcagaugaggaaaaugcugc

SEQ ID NO: 40601 - RNA, 22 nt, Salmonella typhimurium LT2
augcagcguuaacuggaaggcg

SEQ ID NO: 40602 - RNA, 22 nt, Salmonella typhimurium LT2
augcaguggauuaugguacacc

SEQ ID NO: 40603 - RNA, 22 nt, Salmonella typhimurium LT2
augcauguuauauucgccguga

SEQ ID NO: 40604 - RNA, 22 nt, Salmonella typhimurium LT2
augcccgucugggagccgcugc

SEQ ID NO: 40605 - RNA, 22 nt, Salmonella typhimurium LT2
augccgcgcccggaagcguuug

SEQ ID NO: 40606 - RNA, 22 nt, Salmonella typhimurium LT2
augccgcguaaagcacgaacgg

SEQ ID NO: 40607 - RNA, 22 nt, Salmonella typhimurium LT2
augccgcgucgcuuagugauua

SEQ ID NO: 40608 - RNA, 22 nt, Salmonella typhimurium LT2
augccggagauagaggcuuuca

SEQ ID NO: 40609 - RNA, 22 nt, Salmonella typhimurium LT2
augcgcuuguugcgucaggcua

SEQ ID NO: 40610 - RNA, 22 nt, Salmonella typhimurium LT2
auggcgacaggaaucuguguga

SEQ ID NO: 40611 - RNA, 22 nt, Salmonella typhimurium LT2
auggcgauaaugccgcgguuag

SEQ ID NO: 40612 - RNA, 22 nt, Salmonella typhimurium LT2
auggcggcuccgccuuauccgg

SEQ ID NO: 40613 - RNA, 22 nt, Salmonella typhimurium LT2
auggcuguuggggaucuuugcc

SEQ ID NO: 40614 - RNA, 22 nt, Salmonella typhimurium LT2
auggugaaauugcuggaagcga

SEQ ID NO: 40615 - RNA, 19 nt, Salmonella typhimurium LT2
auguggagcaacuauggga

SEQ ID NO: 40616 - RNA, 22 nt, Salmonella typhimurium LT2
augugggauuacuucgauggga

SEQ ID NO: 40617 - RNA, 22 nt, Salmonella typhimurium LT2
auguguccugggauggccgggu

SEQ ID NO: 40618 - RNA, 22 nt, Salmonella typhimurium LT2
augugucuggcuuugagcuggc

SEQ ID NO: 40619 - RNA, 22 nt, Salmonella typhimurium LT2
auguucucccgcauaagguacu

SEQ ID NO: 40620 - RNA, 22 nt, Salmonella typhimurium LT2
auuauggauguccagggcagcg

SEQ ID NO: 40621 - RNA, 22 nt, Salmonella typhimurium LT2
auuccaggaauaaguauccaga

SEQ ID NO: 40622 - RNA, 22 nt, Salmonella typhimurium LT2
auucgcaaugagaguuugguag

SEQ ID NO: 40623 - RNA, 22 nt, Salmonella typhimurium LT2
auucgccagggacacugugagg

SEQ ID NO: 40624 - RNA, 22 nt, Salmonella typhimurium LT2
auugacgauaucggcauugacg

SEQ ID NO: 40625 - RNA, 22 nt, Salmonella typhimurium LT2
auugacgccgaugugauggagu

SEQ ID NO: 40626 - RNA, 22 nt, Salmonella typhimurium LT2
auugaugacaucgaccugaacc

SEQ ID NO: 40627 - RNA, 20 nt, Salmonella typhimurium LT2
auugccgauggugguauaca

SEQ ID NO: 40628 - RNA, 22 nt, Salmonella typhimurium LT2
auugcuuaucuacuuauuccgc

SEQ ID NO: 40629 - RNA, 22 nt, Salmonella typhimurium LT2
auuucugucaccuguugcuguu

SEQ ID NO: 40630 - RNA, 22 nt, Salmonella typhimurium LT2
caacggcauaggugugguccug

SEQ ID NO: 40631 - RNA, 20 nt, Salmonella typhimurium LT2
caagaaauuuuaagcccggg

SEQ ID NO: 40632 - RNA, 22 nt, Salmonella typhimurium LT2
caagcauaguguuuugcuaacu

SEQ ID NO: 40633 - RNA, 22 nt, Salmonella typhimurium LT2
caaugucaccggcgaaauuggu

SEQ ID NO: 40634 - RNA, 23 nt, Salmonella typhimurium LT2
cacauuccaguacaguugaaaua

SEQ ID NO: 40635 - RNA, 22 nt, Salmonella typhimurium LT2
caccgguaucgucaugacaggc

SEQ ID NO: 40636 - RNA, 22 nt, Salmonella typhimurium LT2
cacgcgcugcuucaacauugua

SEQ ID NO: 40637 - RNA, 22 nt, Salmonella typhimurium LT2
cacuggugaaaucgccuuccgg

SEQ ID NO: 40638 - RNA, 22 nt, Salmonella typhimurium LT2
cagauagcgccggaaaugauug

SEQ ID NO: 40639 - RNA, 22 nt, Salmonella typhimurium LT2
cagaugagcuucccgcuauuug

SEQ ID NO: 40640 - RNA, 22 nt, Salmonella typhimurium LT2
cagcaugugguucaacauguuc

SEQ ID NO: 40641 - RNA, 22 nt, Salmonella typhimurium LT2
cagcccgucaaagcuuacuggc

SEQ ID NO: 40642 - RNA, 22 nt, Salmonella typhimurium LT2
cagcggcucgacaugcagaucc

SEQ ID NO: 40643 - RNA, 22 nt, Salmonella typhimurium LT2
cagcuauauuuucgccgccacg

SEQ ID NO: 40644 - RNA, 22 nt, Salmonella typhimurium LT2
cagcuccugguccguaaccugg

SEQ ID NO: 40645 - RNA, 22 nt, Salmonella typhimurium LT2
cagcuuaagugguggaggauag

SEQ ID NO: 40646 - RNA, 22 nt, Salmonella typhimurium LT2
caggcaagggaagaagugagga

SEQ ID NO: 40647 - RNA, 22 nt, Salmonella typhimurium LT2
caggcgcacugucagcauauuu

SEQ ID NO: 40648 - RNA, 22 nt, Salmonella typhimurium LT2
caguacgccggaagucaugaau

SEQ ID NO: 40649 - RNA, 22 nt, Salmonella typhimurium LT2
cagucgcuggaugacaacgcgc

SEQ ID NO: 40650 - RNA, 22 nt, Salmonella typhimurium LT2
cauagcauaacaaagaugcgaa

SEQ ID NO: 40651 - RNA, 22 nt, Salmonella typhimurium LT2
caucauccagaucuuucgcgcc

SEQ ID NO: 40652 - RNA, 22 nt, Salmonella typhimurium LT2
cauccggcgucuccugacggau

SEQ ID NO: 40653 - RNA, 22 nt, Salmonella typhimurium LT2
caucgccuuaauuuuauccagc

SEQ ID NO: 40654 - RNA, 22 nt, Salmonella typhimurium LT2
caucggcuggcggagcgucuuc

SEQ ID NO: 40655 - RNA, 22 nt, Salmonella typhimurium LT2
caucuucaaaacgcugcaugag

SEQ ID NO: 40656 - RNA, 19 nt, Salmonella typhimurium LT2
caucuuuaccuuuguguug

SEQ ID NO: 40657 - RNA, 22 nt, Salmonella typhimurium LT2
caugccgacaauccugcggaaa

SEQ ID NO: 40658 - RNA, 22 nt, Salmonella typhimurium LT2
cauguugucauuauaaaaguga

SEQ ID NO: 40659 - RNA, 22 nt, Salmonella typhimurium LT2
cauguuuacucuacuggccgua

SEQ ID NO: 40660 - RNA, 22 nt, Salmonella typhimurium LT2
cauucuuaccucuaugcacaau

SEQ ID NO: 40661 - RNA, 19 nt, Salmonella typhimurium LT2
cauugcuggauaagauuua

SEQ ID NO: 40662 - RNA, 23 nt, Salmonella typhimurium LT2
ccaacgcuggcgugcgagaaacc

SEQ ID NO: 40663 - RNA, 22 nt, Salmonella typhimurium LT2
ccaaugauuaucauuucaguuu

SEQ ID NO: 40664 - RNA, 17 nt, Salmonella typhimurium LT2
ccagcgacaguaguauc

SEQ ID NO: 40665 - RNA, 22 nt, Salmonella typhimurium LT2
ccagcgcuucaguauggcgggu

SEQ ID NO: 40666 - RNA, 22 nt, Salmonella typhimurium LT2
cccggaaaccaucauggaugcg

SEQ ID NO: 40667 - RNA, 22 nt, Salmonella typhimurium LT2
ccgacaggaagccguaaauuaa

SEQ ID NO: 40668 - RNA, 22 nt, Salmonella typhimurium LT2
ccgaccuggcgucgacggcggc

SEQ ID NO: 40669 - RNA, 22 nt, Salmonella typhimurium LT2
ccgacugcugcugaaucagcgc

SEQ ID NO: 40670 - RNA, 20 nt, Salmonella typhimurium LT2
ccgagugcgccugcauuuug

SEQ ID NO: 40671 - RNA, 22 nt, Salmonella typhimurium LT2
ccgauaagacgcagccgccauc

SEQ ID NO: 40672 - RNA, 22 nt, Salmonella typhimurium LT2
ccgcguaugaagagcggugagc

SEQ ID NO: 40673 - RNA, 22 nt, Salmonella typhimurium LT2
ccggaaccuuccugccguuggu

SEQ ID NO: 40674 - RNA, 22 nt, Salmonella typhimurium LT2
ccggaccuuugucaucggcugg

SEQ ID NO: 40675 - RNA, 22 nt, Salmonella typhimurium LT2
ccggauaaggcagcaaugugcg

SEQ ID NO: 40676 - RNA, 22 nt, Salmonella typhimurium LT2
ccggaugaagucguuaauaagu

SEQ ID NO: 40677 - RNA, 22 nt, Salmonella typhimurium LT2
ccggauggcguguagcgauccg

SEQ ID NO: 40678 - RNA, 22 nt, Salmonella typhimurium LT2
ccggccuacucacugcaacgcg

SEQ ID NO: 40679 - RNA, 22 nt, Salmonella typhimurium LT2
ccgggucugccagccgccguua

SEQ ID NO: 40680 - RNA, 22 nt, Salmonella typhimurium LT2
ccggucaguuccacaccguuag

SEQ ID NO: 40681 - RNA, 22 nt, Salmonella typhimurium LT2
ccggugcugucgguguagccca

SEQ ID NO: 40682 - RNA, 22 nt, Salmonella typhimurium LT2
ccgugaauaaagaggccaucau

SEQ ID NO: 40683 - RNA, 22 nt, Salmonella typhimurium LT2
ccguuaacguuuuacgcugccg

SEQ ID NO: 40684 - RNA, 21 nt, Salmonella typhimurium LT2
ccguucugaggauuuucuccg

SEQ ID NO: 40685 - RNA, 22 nt, Salmonella typhimurium LT2
ccugaacgguuuuauccagcga

SEQ ID NO: 40686 - RNA, 22 nt, Salmonella typhimurium LT2
ccugaaguuacagauucagggg

SEQ ID NO: 40687 - RNA, 22 nt, Salmonella typhimurium LT2
ccugaucccgaugguggauuuu

SEQ ID NO: 40688 - RNA, 22 nt, Salmonella typhimurium LT2
ccugauucagggaucggggacg

SEQ ID NO: 40689 - RNA, 22 nt, Salmonella typhimurium LT2
ccuggguguauuuccccugggu

SEQ ID NO: 40690 - RNA, 22 nt, Salmonella typhimurium LT2
ccuguaggccggauaagcauua

SEQ ID NO: 40691 - RNA, 22 nt, Salmonella typhimurium LT2
ccuguguccugugcgguaaucu

SEQ ID NO: 40692 - RNA, 22 nt, Salmonella typhimurium LT2
ccuguuggaaguaccaggcgug

SEQ ID NO: 40693 - RNA, 22 nt, Salmonella typhimurium LT2
cuuacguaaaacugcgcauggc

SEQ ID NO: 40694 - RNA, 22 nt, Salmonella typhimurium LT2
cuuaugcagaucgccguuggcg

SEQ ID NO: 40695 - RNA, 22 nt, Salmonella typhimurium LT2
cuucaccaacguggcgugcagg

SEQ ID NO: 40696 - RNA, 22 nt, Salmonella typhimurium LT2
cuuggagaugaaacauguuucu

SEQ ID NO: 40697 - RNA, 22 nt, Salmonella typhimurium LT2
gaaaucaucgccacccaucucg

SEQ ID NO: 40698 - RNA, 22 nt, Salmonella typhimurium LT2
gaaaucgcagguaucguuuccu

SEQ ID NO: 40699 - RNA, 22 nt, Salmonella typhimurium LT2
gaacauugaugagcaaaacguc

SEQ ID NO: 40700 - RNA, 22 nt, Salmonella typhimurium LT2
gaacgcuggcuaggcagcagac

SEQ ID NO: 40701 - RNA, 22 nt, Salmonella typhimurium LT2
gaagcgcucuccgaucgcgcau

SEQ ID NO: 40702 - RNA, 22 nt, Salmonella typhimurium LT2
gaaugacgcugcgcuuauucgg

SEQ ID NO: 40703 - RNA, 22 nt, Salmonella typhimurium LT2
gaaugaugcaggugcuggcgga

SEQ ID NO: 40704 - RNA, 22 nt, Salmonella typhimurium LT2
gaaugccgaaugacgggccuac

SEQ ID NO: 40705 - RNA, 22 nt, Salmonella typhimurium LT2
gaauugcaagccacgguuggug

SEQ ID NO: 40706 - RNA, 22 nt, Salmonella typhimurium LT2
gaauuucacaagcauggugguc

SEQ ID NO: 40707 - RNA, 22 nt, Salmonella typhimurium LT2
gaauuucuuaccaggagugaua

SEQ ID NO: 40708 - RNA, 22 nt, Salmonella typhimurium LT2
gacaauauucagcguaaagaag

SEQ ID NO: 40709 - RNA, 22 nt, Salmonella typhimurium LT2
gacacacucccugucauauuca

SEQ ID NO: 40710 - RNA, 22 nt, Salmonella typhimurium LT2
gacacccugaugacgcuggcgu

SEQ ID NO: 40711 - RNA, 22 nt, Salmonella typhimurium LT2
gaccauccgcacauucaucugc

SEQ ID NO: 40712 - RNA, 22 nt, Salmonella typhimurium LT2
gacccagcgcgauauaagaagg

SEQ ID NO: 40713 - RNA, 22 nt, Salmonella typhimurium LT2
gacgaacauuucguucguuaua

SEQ ID NO: 40714 - RNA, 22 nt, Salmonella typhimurium LT2
gacgaacuuauucguucgcaaa

SEQ ID NO: 40715 - RNA, 19 nt, Salmonella typhimurium LT2
gacgcggauaaucaugcua

SEQ ID NO: 40716 - RNA, 22 nt, Salmonella typhimurium LT2
gacgguaauacgcuucaccuga

SEQ ID NO: 40717 - RNA, 22 nt, Salmonella typhimurium LT2
gacgucugaaaucgugaccugg

SEQ ID NO: 40718 - RNA, 22 nt, Salmonella typhimurium LT2
gacucuggcgcguauauguuug

SEQ ID NO: 40719 - RNA, 22 nt, Salmonella typhimurium LT2
gacugcuguuccugaagcgcua

SEQ ID NO: 40720 - RNA, 22 nt, Salmonella typhimurium LT2
gagcacauuuuagacuugugcg

SEQ ID NO: 40721 - RNA, 22 nt, Salmonella typhimurium LT2
gaggaucauauugucgcgguac

SEQ ID NO: 40722 - RNA, 22 nt, Salmonella typhimurium LT2
gaggauucacugggaauggaag

SEQ ID NO: 40723 - RNA, 22 nt, Salmonella typhimurium LT2
gaggcguugaaguucuggaauc

SEQ ID NO: 40724 - RNA, 22 nt, Salmonella typhimurium LT2
gauaaggcguucacgccgccau

SEQ ID NO: 40725 - RNA, 22 nt, Salmonella typhimurium LT2
gauacucaguugcggccauacg

SEQ ID NO: 40726 - RNA, 22 nt, Salmonella typhimurium LT2
gaucagaaugcuguugcuggag

SEQ ID NO: 40727 - RNA, 22 nt, Salmonella typhimurium LT2
gaucagcuuaaagggauuauca

SEQ ID NO: 40728 - RNA, 22 nt, Salmonella typhimurium LT2
gaucgguuaggccgggcaggua

SEQ ID NO: 40729 - RNA, 22 nt, Salmonella typhimurium LT2
gaugauuaacgcauaagcgaug

SEQ ID NO: 40730 - RNA, 22 nt, Salmonella typhimurium LT2
gauguauaccguuugcuauaca

SEQ ID NO: 40731 - RNA, 22 nt, Salmonella typhimurium LT2
gaugucgaauuuaauauggaug

SEQ ID NO: 40732 - RNA, 22 nt, Salmonella typhimurium LT2
gauguugcuccagaaucgcgac

SEQ ID NO: 40733 - RNA, 22 nt, Salmonella typhimurium LT2
gauucaauugaagcgauaaaaa

SEQ ID NO: 40734 - RNA, 22 nt, Salmonella typhimurium LT2
gauuguauuuguacaccaauug

SEQ ID NO: 40735 - RNA, 22 nt, Salmonella typhimurium LT2
gauuuccgcaacguggugcugg

SEQ ID NO: 40736 - RNA, 22 nt, Salmonella typhimurium LT2
gcagcccugcgcgcagcacguu

SEQ ID NO: 40737 - RNA, 22 nt, Salmonella typhimurium LT2
gcaucagcaaaaugggaucggc

SEQ ID NO: 40738 - RNA, 22 nt, Salmonella typhimurium LT2
gcauguuugccugagcgcgaac

SEQ ID NO: 40739 - RNA, 22 nt, Salmonella typhimurium LT2
gcauuacugcacgauccccuuu

SEQ ID NO: 40740 - RNA, 22 nt, Salmonella typhimurium LT2
gccacgcucagucuucacggau

SEQ ID NO: 40741 - RNA, 22 nt, Salmonella typhimurium LT2
gccagguuacggaccaggagcu

SEQ ID NO: 40742 - RNA, 22 nt, Salmonella typhimurium LT2
gccaucgcgcgacaaucgggua

SEQ ID NO: 40743 - RNA, 22 nt, Salmonella typhimurium LT2
gccaugaaggaugacuaugugg

SEQ ID NO: 40744 - RNA, 22 nt, Salmonella typhimurium LT2
gccgaucaauaauagaaacgac

SEQ ID NO: 40745 - RNA, 22 nt, Salmonella typhimurium LT2
gccgaugcguacccgcaccauc

SEQ ID NO: 40746 - RNA, 22 nt, Salmonella typhimurium LT2
gccgcgauggcuuucauuucca

SEQ ID NO: 40747 - RNA, 22 nt, Salmonella typhimurium LT2
gccgcguagcguccggcguaau

SEQ ID NO: 40748 - RNA, 22 nt, Salmonella typhimurium LT2
gccggauggcgugcgcuucuau

SEQ ID NO: 40749 - RNA, 22 nt, Salmonella typhimurium LT2
gccguccaccguggcgguggac

SEQ ID NO: 40750 - RNA, 22 nt, Salmonella typhimurium LT2
gccgucuuuaacgagguacugg

SEQ ID NO: 40751 - RNA, 22 nt, Salmonella typhimurium LT2
gccgugagauguucgcguucuu

SEQ ID NO: 40752 - RNA, 22 nt, Salmonella typhimurium LT2
gccguggaaaagcucggggcgu

SEQ ID NO: 40753 - RNA, 22 nt, Salmonella typhimurium LT2
gccugucccgucagcuuugguc

SEQ ID NO: 40754 - RNA, 22 nt, Salmonella typhimurium LT2
gcgaacguuucucaggugaugc

SEQ ID NO: 40755 - RNA, 21 nt, Salmonella typhimurium LT2
gcgacguuauccgucgugccg

SEQ ID NO: 40756 - RNA, 20 nt, Salmonella typhimurium LT2
gcgaugagugggauagccag

SEQ ID NO: 40757 - RNA, 22 nt, Salmonella typhimurium LT2
gcgaugcgguucaucaacguua

SEQ ID NO: 40758 - RNA, 22 nt, Salmonella typhimurium LT2
gcgauucgucaauuggcgguag

SEQ ID NO: 40759 - RNA, 22 nt, Salmonella typhimurium LT2
gcgauugacgccgacgcuaaag

SEQ ID NO: 40760 - RNA, 22 nt, Salmonella typhimurium LT2
gcgauugauaucuggaacguga

SEQ ID NO: 40761 - RNA, 22 nt, Salmonella typhimurium LT2
gcgcagaaaggguauuaguauu

SEQ ID NO: 40762 - RNA, 23 nt, Salmonella typhimurium LT2
gcgcaggucaaugguuuucaacg

SEQ ID NO: 40763 - RNA, 22 nt, Salmonella typhimurium LT2
gcgcaguagacgugccuccaga

SEQ ID NO: 40764 - RNA, 22 nt, Salmonella typhimurium LT2
gcgcgucagggaagcgagguga

SEQ ID NO: 40765 - RNA, 22 nt, Salmonella typhimurium LT2
gcgcugcugaaaucaacgauac

SEQ ID NO: 40766 - RNA, 22 nt, Salmonella typhimurium LT2
gcgcuggaaagcggcaggugau

SEQ ID NO: 40767 - RNA, 22 nt, Salmonella typhimurium LT2
gcgcuugaugcgaagcggcaua

SEQ ID NO: 40768 - RNA, 22 nt, Salmonella typhimurium LT2
gcgcuuuaacagcagccgaggu

SEQ ID NO: 40769 - RNA, 22 nt, Salmonella typhimurium LT2
gcggauaucgaaguggaucugg

SEQ ID NO: 40770 - RNA, 22 nt, Salmonella typhimurium LT2
gcggauuguucagguacaggua

SEQ ID NO: 40771 - RNA, 22 nt, Salmonella typhimurium LT2
gcggcgaugagugaaucguuca

SEQ ID NO: 40772 - RNA, 22 nt, Salmonella typhimurium LT2
gcggcgauuuuucucgauaacg

SEQ ID NO: 40773 - RNA, 22 nt, Salmonella typhimurium LT2
gcggguauuugagcacggugug

SEQ ID NO: 40774 - RNA, 22 nt, Salmonella typhimurium LT2
gcgguacgcgcccccgccagag

SEQ ID NO: 40775 - RNA, 22 nt, Salmonella typhimurium LT2
gcguagauacgcuccccggcgc

SEQ ID NO: 40776 - RNA, 22 nt, Salmonella typhimurium LT2
gcguaucaucaacccgaugcgc

SEQ ID NO: 40777 - RNA, 22 nt, Salmonella typhimurium LT2
ugcugccggaaaugucugcgga

SEQ ID NO: 40778 - RNA, 22 nt, Salmonella typhimurium LT2
ugcugccggcgcuggcgaucgg

SEQ ID NO: 40779 - RNA, 22 nt, Salmonella typhimurium LT2
ugcuggacaccgacgauaacug

SEQ ID NO: 40780 - RNA, 22 nt, Salmonella typhimurium LT2
ugcuggauagagaaaacccccg

SEQ ID NO: 40781 - RNA, 22 nt, Salmonella typhimurium LT2
ugcugguaugacgcgccguuaa

SEQ ID NO: 40782 - RNA, 20 nt, Salmonella typhimurium LT2
ugcugucaggggacuguccg

SEQ ID NO: 40783 - RNA, 22 nt, Salmonella typhimurium LT2
uggaccgcaugggcgcgaacuu

SEQ ID NO: 40784 - RNA, 18 nt, Salmonella typhimurium LT2
uggacgaugcguugcagc

SEQ ID NO: 40785 - RNA, 22 nt, Salmonella typhimurium LT2
uggauaagugaaacgccauccg

SEQ ID NO: 40786 - RNA, 22 nt, Salmonella typhimurium LT2
uggaugccacuauuuuucugag

SEQ ID NO: 40787 - RNA, 22 nt, Salmonella typhimurium LT2
uggcaugugguauugauccuga

SEQ ID NO: 40788 - RNA, 22 nt, Salmonella typhimurium LT2
uggccgcuucgccuuauccggc

SEQ ID NO: 40789 - RNA, 22 nt, Salmonella typhimurium LT2
uggccgugguggucgacgauca

SEQ ID NO: 40790 - RNA, 22 nt, Salmonella typhimurium LT2
uggccuggaguaauucgcugau

SEQ ID NO: 40791 - RNA, 22 nt, Salmonella typhimurium LT2
uggcgaagauagcgguacuguu

SEQ ID NO: 40792 - RNA, 22 nt, Salmonella typhimurium LT2
uggcgcugaugaaacgcauucu

SEQ ID NO: 40793 - RNA, 22 nt, Salmonella typhimurium LT2
uggcgcugucgaucaacuucaa

SEQ ID NO: 40794 - RNA, 22 nt, Salmonella typhimurium LT2
uggcugacgaauauuauuaaaa

SEQ ID NO: 40795 - RNA, 22 nt, Salmonella typhimurium LT2
uggcugauaucuggcccagguc

SEQ ID NO: 40796 - RNA, 22 nt, Salmonella typhimurium LT2
ugggaaauuccgaaaaugcgcc

SEQ ID NO: 40797 - RNA, 21 nt, Salmonella typhimurium LT2
ugggaucuucucaucgaacgg

SEQ ID NO: 40798 - RNA, 22 nt, Salmonella typhimurium LT2
ugggcaccagguacugauuagu

SEQ ID NO: 40799 - RNA, 22 nt, Salmonella typhimurium LT2
ugggcacguuguacguagaacu

SEQ ID NO: 40800 - RNA, 22 nt, Salmonella typhimurium LT2
ugggcgcuuguaugcacauagc

SEQ ID NO: 40801 - RNA, 22 nt, Salmonella typhimurium LT2
ugggcguacucgucuauuaaug

SEQ ID NO: 40802 - RNA, 22 nt, Salmonella typhimurium LT2
ugggcuuaaugccguagagucu

SEQ ID NO: 40803 - RNA, 22 nt, Salmonella typhimurium LT2
uggguaaugcuuugauaacccg

SEQ ID NO: 40804 - RNA, 22 nt, Salmonella typhimurium LT2
ugguacaggcauucaccguuug

SEQ ID NO: 40805 - RNA, 22 nt, Salmonella typhimurium LT2
ugguagcgccuguuuuugcugc

SEQ ID NO: 40806 - RNA, 22 nt, Salmonella typhimurium LT2
ugguaggccggauaaggcguuc

SEQ ID NO: 40807 - RNA, 22 nt, Salmonella typhimurium LT2
uggucaaacuggcggagacgaa

SEQ ID NO: 40808 - RNA, 22 nt, Salmonella typhimurium LT2
ugguggaacuugcugauauuau

SEQ ID NO: 40809 - RNA, 22 nt, Salmonella typhimurium LT2
uguaaagcaaaugcuauacaag

SEQ ID NO: 40810 - RNA, 22 nt, Salmonella typhimurium LT2
uguacugguuuauuugcgucau

SEQ ID NO: 40811 - RNA, 22 nt, Salmonella typhimurium LT2
uguaggccggguaaggcguagc

SEQ ID NO: 40812 - RNA, 22 nt, Salmonella typhimurium LT2
uguaggucagguaagcgcuagc

SEQ ID NO: 40813 - RNA, 21 nt, Salmonella typhimurium LT2
uguccgacuguuaacguaaaa

SEQ ID NO: 40814 - RNA, 22 nt, Salmonella typhimurium LT2
ugucgcgcugcuaagccggggg

SEQ ID NO: 40815 - RNA, 22 nt, Salmonella typhimurium LT2
ugucgcuggaaaaguaucgcga

SEQ ID NO: 40816 - RNA, 22 nt, Salmonella typhimurium LT2
ugucguacuugccguuaauccu

SEQ ID NO: 40817 - RNA, 22 nt, Salmonella typhimurium LT2
ugucugaacggagaaaaggugc

SEQ ID NO: 40818 - RNA, 22 nt, Salmonella typhimurium LT2
ugucugucccucggccuugaua

SEQ ID NO: 40819 - RNA, 22 nt, Salmonella typhimurium LT2
ugugaccauuaucgggcaauca

SEQ ID NO: 40820 - RNA, 19 nt, Salmonella typhimurium LT2
ugugccuguuaagccggau

SEQ ID NO: 40821 - RNA, 22 nt, Salmonella typhimurium LT2
uguuccuggcuaauuuuggcuu

SEQ ID NO: 40822 - RNA, 22 nt, Salmonella typhimurium LT2
uguucgauuuuaugggcaaauc

SEQ ID NO: 40823 - RNA, 22 nt, Salmonella typhimurium LT2
uuaacaugcggcuagccgggaa

SEQ ID NO: 40824 - RNA, 23 nt, Salmonella typhimurium LT2
uuaagcaccacauuggugcaaca

SEQ ID NO: 40825 - RNA, 22 nt, Salmonella typhimurium LT2
uuaccgaugagguggucgcgca

SEQ ID NO: 40826 - RNA, 22 nt, Salmonella typhimurium LT2
uuacgccaucucuucuggcggc

SEQ ID NO: 40827 - RNA, 22 nt, Salmonella typhimurium LT2
uuagcgccgguauuuuuggcgg

SEQ ID NO: 40828 - RNA, 22 nt, Salmonella typhimurium LT2
uuagcgcgauguagcgcgguuu

SEQ ID NO: 40829 - RNA, 22 nt, Salmonella typhimurium LT2
uuaugauguucacuuuacuggc

SEQ ID NO: 40830 - RNA, 22 nt, Salmonella typhimurium LT2
uuaugcgcggcuggcggcuuuc

SEQ ID NO: 40831 - RNA, 22 nt, Salmonella typhimurium LT2
uucaaacugauaacaauguggg

SEQ ID NO: 40832 - RNA, 22 nt, Salmonella typhimurium LT2
uucacauugucagacacaugaa

SEQ ID NO: 40833 - RNA, 21 nt, Salmonella typhimurium LT2
uucaggucgaugucaucaaug

SEQ ID NO: 40834 - RNA, 22 nt, Salmonella typhimurium LT2
uuccgguagucugacaucgacg

SEQ ID NO: 40835 - RNA, 22 nt, Salmonella typhimurium LT2
uuccgguauugguaaaucaggu

SEQ ID NO: 40836 - RNA, 22 nt, Salmonella typhimurium LT2
uuccugacgauccgacgggcga

SEQ ID NO: 40837 - RNA, 22 nt, Salmonella typhimurium LT2
uucgcaaagcggguuccagcga

SEQ ID NO: 40838 - RNA, 22 nt, Salmonella typhimurium LT2
uucgcuaucaugauauaucacu

SEQ ID NO: 40839 - RNA, 22 nt, Salmonella typhimurium LT2
uucgcuuaucaggccuacgaca

SEQ ID NO: 40840 - RNA, 22 nt, Salmonella typhimurium LT2
uucgguaaacucggcuauaacu

SEQ ID NO: 40841 - RNA, 18 nt, Salmonella typhimurium LT2
uucugcugcgccgucgcc

SEQ ID NO: 40842 - RNA, 22 nt, Salmonella typhimurium LT2
uucuggcgucuggagauggaua

SEQ ID NO: 40843 - RNA, 22 nt, Salmonella typhimurium LT2
uugagcaauagccguaucaaac

SEQ ID NO: 40844 - RNA, 22 nt, Salmonella typhimurium LT2
uugaggaaugggcgaguauuug

SEQ ID NO: 40845 - RNA, 22 nt, Salmonella typhimurium LT2
uugaggaugacgacggccaucg

SEQ ID NO: 40846 - RNA, 21 nt, Salmonella typhimurium LT2
uugagucuauccauccggaua

SEQ ID NO: 40847 - RNA, 22 nt, Salmonella typhimurium LT2
uugauaccacgaaaaucgggau

SEQ ID NO: 40848 - RNA, 22 nt, Salmonella typhimurium LT2
uugauucgccgcaucgcguaag

SEQ ID NO: 40849 - RNA, 22 nt, Salmonella typhimurium LT2
uugcaaauauuguaggccggau

SEQ ID NO: 40850 - RNA, 22 nt, Salmonella typhimurium LT2
uugcaaauuagcuucguccauu

SEQ ID NO: 40851 - RNA, 22 nt, Salmonella typhimurium LT2
uugccaggccugcggcgcguua

SEQ ID NO: 40852 - RNA, 22 nt, Salmonella typhimurium LT2
uugccaguugcugauagcgcgc

SEQ ID NO: 40853 - RNA, 22 nt, Salmonella typhimurium LT2
uugcccgucuggcaggaaacgc

SEQ ID NO: 40854 - RNA, 22 nt, Salmonella typhimurium LT2
uugccgacaacaaucagcguca

SEQ ID NO: 40855 - RNA, 22 nt, Salmonella typhimurium LT2
uugcgauaacgcgauucucgca

SEQ ID NO: 40856 - RNA, 22 nt, Salmonella typhimurium LT2
uugcgaucauuuuuaucgcuuc

SEQ ID NO: 40857 - RNA, 22 nt, Salmonella typhimurium LT2
uugcgcauccaguuccugacgg

SEQ ID NO: 40858 - RNA, 22 nt, Salmonella typhimurium LT2
uugcgcggucagaauuuccagc

SEQ ID NO: 40859 - RNA, 22 nt, Salmonella typhimurium LT2
uugcgggacagcuugucgauau

SEQ ID NO: 40860 - RNA, 22 nt, Salmonella typhimurium LT2
uugcucaacguauucgccagua

SEQ ID NO: 40861 - RNA, 22 nt, Salmonella typhimurium LT2
guccagcagguggucgccauau

SEQ ID NO: 40862 - RNA, 22 nt, Salmonella typhimurium LT2
guccagcagugguuucauacuc

SEQ ID NO: 40863 - RNA, 22 nt, Salmonella typhimurium LT2
guccaggauguauaccgucugc

SEQ ID NO: 40864 - RNA, 22 nt, Salmonella typhimurium LT2
guccauauagguuucgauuucg

SEQ ID NO: 40865 - RNA, 22 nt, Salmonella typhimurium LT2
gucgacuuuaaggcaguaugua

SEQ ID NO: 40866 - RNA, 22 nt, Salmonella typhimurium LT2
gucgcccugaugccggacagua

SEQ ID NO: 40867 - RNA, 22 nt, Salmonella typhimurium LT2
gucgcugguaaagaugacgaug

SEQ ID NO: 40868 - RNA, 22 nt, Salmonella typhimurium LT2
gucggaucgucaggaaaauucu

SEQ ID NO: 40869 - RNA, 22 nt, Salmonella typhimurium LT2
gucggcgauaaaggcuguuucc

SEQ ID NO: 40870 - RNA, 22 nt, Salmonella typhimurium LT2
gucguaccacaauuagcguauu

SEQ ID NO: 40871 - RNA, 22 nt, Salmonella typhimurium LT2
gucgucgggucguugcauauug

SEQ ID NO: 40872 - RNA, 22 nt, Salmonella typhimurium LT2
uccagcaaaaaucuuucuuuag

SEQ ID NO: 40873 - RNA, 22 nt, Salmonella typhimurium LT2
uccaggcuaugugcauacaagc

SEQ ID NO: 40874 - RNA, 22 nt, Salmonella typhimurium LT2
uccgacaugugcugcaaccgcu

SEQ ID NO: 40875 - RNA, 22 nt, Salmonella typhimurium LT2
uccggcguuauccggcaacgua

SEQ ID NO: 40876 - RNA, 22 nt, Salmonella typhimurium LT2
uccggucaggauaucgugcgua

SEQ ID NO: 40877 - RNA, 22 nt, Salmonella typhimurium LT2
uccguaaccgucuggcggaguc

SEQ ID NO: 40878 - RNA, 20 nt, Salmonella typhimurium LT2
uccgucgaucauuauugacc

SEQ ID NO: 40879 - RNA, 22 nt, Salmonella typhimurium LT2
uccugaccugaugcgcgagaag

SEQ ID NO: 40880 - RNA, 22 nt, Salmonella typhimurium LT2
uccuggauagccauauuauuga

SEQ ID NO: 40881 - RNA, 22 nt, Salmonella typhimurium LT2
ucgauggagucguauuugcccc

SEQ ID NO: 40882 - RNA, 22 nt, Salmonella typhimurium LT2
ucgauggaucgggcgauagcgc

SEQ ID NO: 40883 - RNA, 22 nt, Salmonella typhimurium LT2
ucgcaauuuuccgggccugcgc

SEQ ID NO: 40884 - RNA, 22 nt, Salmonella typhimurium LT2
ucgcccgaacguuugucgcacc

SEQ ID NO: 40885 - RNA, 22 nt, Salmonella typhimurium LT2
ucgcccgucagcacguugagca

SEQ ID NO: 40886 - RNA, 22 nt, Salmonella typhimurium LT2
ucgccgcuggaucugcgccgaa

SEQ ID NO: 40887 - RNA, 22 nt, Salmonella typhimurium LT2
ucgccguggcugcuggcgcugg

SEQ ID NO: 40888 - RNA, 22 nt, Salmonella typhimurium LT2
ucgccuguacuugaugucuggc

SEQ ID NO: 40889 - RNA, 22 nt, Salmonella typhimurium LT2
ucgcggugaugggacgcgucau

SEQ ID NO: 40890 - RNA, 22 nt, Salmonella typhimurium LT2
ucgcguuuauuaaacaguggca

SEQ ID NO: 40891 - RNA, 22 nt, Salmonella typhimurium LT2
ucgcucaagcuggaugacaauc

SEQ ID NO: 40892 - RNA, 22 nt, Salmonella typhimurium LT2
ucgcucaguucuaucuuguugc

SEQ ID NO: 40893 - RNA, 22 nt, Salmonella typhimurium LT2
ucgcucauuguaguaaucucaa

SEQ ID NO: 40894 - RNA, 22 nt, Salmonella typhimurium LT2
ucgcugaugaaauccucuaugc

SEQ ID NO: 40895 - RNA, 22 nt, Salmonella typhimurium LT2
ucgcugguucaggaauccgcag

SEQ ID NO: 40896 - RNA, 22 nt, Salmonella typhimurium LT2
ucgcuuaguccgguuggugauu

SEQ ID NO: 40897 - RNA, 22 nt, Salmonella typhimurium LT2
ucggcagcgaaaaauucacugc

SEQ ID NO: 40898 - RNA, 22 nt, Salmonella typhimurium LT2
ucggcauugauguugguuuaaa

SEQ ID NO: 40899 - RNA, 22 nt, Salmonella typhimurium LT2
ucggccuggccaggcgcucuau

SEQ ID NO: 40900 - RNA, 22 nt, Salmonella typhimurium LT2
ucggcguaguacuuauccugaa

SEQ ID NO: 40901 - RNA, 22 nt, Salmonella typhimurium LT2
ucgggaacagcaacgagcugau

SEQ ID NO: 40902 - RNA, 22 nt, Salmonella typhimurium LT2
ucgguugcggaaaguguggcga

SEQ ID NO: 40903 - RNA, 22 nt, Salmonella typhimurium LT2
ucguaauagccgaccugauugc

SEQ ID NO: 40904 - RNA, 22 nt, Salmonella typhimurium LT2
ucgucauucauggcgcgcgccg

SEQ ID NO: 40905 - RNA, 22 nt, Salmonella typhimurium LT2
ucugaauuuaaaaauccugaac

SEQ ID NO: 40906 - RNA, 22 nt, Salmonella typhimurium LT2
ucugcguguuaacugcauuaac

SEQ ID NO: 40907 - RNA, 22 nt, Salmonella typhimurium LT2
ucuggcgguggcuggcgccgug

SEQ ID NO: 40908 - RNA, 22 nt, Salmonella typhimurium LT2
ucuguaggccggauaaggcgua

SEQ ID NO: 40909 - RNA, 22 nt, Salmonella typhimurium LT2
ucuguaucgccggcgguucaau

SEQ ID NO: 40910 - RNA, 22 nt, Salmonella typhimurium LT2
ucuuaucaggccuacggucuuu

SEQ ID NO: 40911 - RNA, 22 nt, Salmonella typhimurium LT2
ucuucaagcauuuccgagagau

SEQ ID NO: 40912 - RNA, 20 nt, Salmonella typhimurium LT2
ucuuccagcaaaugauggcg

SEQ ID NO: 40913 - RNA, 22 nt, Salmonella typhimurium LT2
ugaacuggaagccgacauuuau

SEQ ID NO: 40914 - RNA, 22 nt, Salmonella typhimurium LT2
ugaaugccuuacccgguuugua

SEQ ID NO: 40915 - RNA, 21 nt, Salmonella typhimurium LT2
ugacccacaucgugcagaugc

SEQ ID NO: 40916 - RNA, 22 nt, Salmonella typhimurium LT2
ugacgacgccagguuuuccagu

SEQ ID NO: 40917 - RNA, 22 nt, Salmonella typhimurium LT2
ugacgcguauuguuguucgggu

SEQ ID NO: 40918 - RNA, 22 nt, Salmonella typhimurium LT2
ugacguuaggcggcgacaacag

SEQ ID NO: 40919 - RNA, 22 nt, Salmonella typhimurium LT2
ugagagauaucggauuuuacuu

SEQ ID NO: 40920 - RNA, 22 nt, Salmonella typhimurium LT2
ugaggugauuaaaaucauuaug

SEQ ID NO: 40921 - RNA, 22 nt, Salmonella typhimurium LT2
ugaguggcaugaagauuucaua

SEQ ID NO: 40922 - RNA, 22 nt, Salmonella typhimurium LT2
ugauaagguuggugaccauauu

SEQ ID NO: 40923 - RNA, 22 nt, Salmonella typhimurium LT2
ugaucgaugaugaacaucaccg

SEQ ID NO: 40924 - RNA, 20 nt, Salmonella typhimurium LT2
ugaucgauguacguuugcag

SEQ ID NO: 40925 - RNA, 22 nt, Salmonella typhimurium LT2
ugaugcugucuggucagcgugg

SEQ ID NO: 40926 - RNA, 22 nt, Salmonella typhimurium LT2
ugauuguacgguagguaaucgc

SEQ ID NO: 40927 - RNA, 22 nt, Salmonella typhimurium LT2
ugcaaccuuuuuaugcgcgguu

SEQ ID NO: 40928 - RNA, 22 nt, Salmonella typhimurium LT2
ugcacgucggcgaagcgccaaa

SEQ ID NO: 40929 - RNA, 18 nt, Salmonella typhimurium LT2
ugcaggaacugguuauuc

SEQ ID NO: 40930 - RNA, 22 nt, Salmonella typhimurium LT2
ugcaggucacucuccagcgccc

SEQ ID NO: 40931 - RNA, 22 nt, Salmonella typhimurium LT2
ugcaggucggguaagcguauug

SEQ ID NO: 40932 - RNA, 22 nt, Salmonella typhimurium LT2
ugcauauccgguagcugcgggg

SEQ ID NO: 40933 - RNA, 22 nt, Salmonella typhimurium LT2
ugccagccgcauugucgucgau

SEQ ID NO: 40934 - RNA, 22 nt, Salmonella typhimurium LT2
ugccgacaaucugcgagguggg

SEQ ID NO: 40935 - RNA, 22 nt, Salmonella typhimurium LT2
ugccgauuuuggucccggcggc

SEQ ID NO: 40936 - RNA, 22 nt, Salmonella typhimurium LT2
ugccggauggcgguuggccuac

SEQ ID NO: 40937 - RNA, 22 nt, Salmonella typhimurium LT2
ugccgguugucgaugaagaaca

SEQ ID NO: 40938 - RNA, 22 nt, Salmonella typhimurium LT2
ugccucgcugauucaggcgugu

SEQ ID NO: 40939 - RNA, 22 nt, Salmonella typhimurium LT2
ugccuggcaaucuauuuauggu

SEQ ID NO: 40940 - RNA, 22 nt, Salmonella typhimurium LT2
ugcgccacgauauccaugguug

SEQ ID NO: 40941 - RNA, 22 nt, Salmonella typhimurium LT2
ugcgccguggcgcgaucggucu

SEQ ID NO: 40942 - RNA, 22 nt, Salmonella typhimurium LT2
ugcgcgaguauuucgaucugcu

SEQ ID NO: 40943 - RNA, 22 nt, Salmonella typhimurium LT2
ugcgcugcgcuuaucaggccua

SEQ ID NO: 40944 - RNA, 22 nt, Salmonella typhimurium LT2
ugcgcuuauccggucuacguaa

SEQ ID NO: 40945 - RNA, 22 nt, Salmonella typhimurium LT2
ugcggcaagcuggcgaucguuc

SEQ ID NO: 40946 - RNA, 22 nt, Salmonella typhimurium LT2
ugcggccuggugguugaaggcg

SEQ ID NO: 40947 - RNA, 22 nt, Salmonella typhimurium LT2
aaguucagcuucagaagcugga

SEQ ID NO: 40948 - RNA, 22 nt, Salmonella typhimurium LT2
aaguucuuuucuuaauuaccag

SEQ ID NO: 40949 - RNA, 22 nt, Salmonella typhimurium LT2
aauaccaguucaucggcgucag

SEQ ID NO: 40950 - RNA, 22 nt, Salmonella typhimurium LT2
aauccagaguauuaauuuucgu

SEQ ID NO: 40951 - RNA, 20 nt, Salmonella typhimurium LT2
aauccguccggcgacgccgc

SEQ ID NO: 40952 - RNA, 23 nt, Salmonella typhimurium LT2
aauccgucgcugucguuauacac

SEQ ID NO: 40953 - RNA, 22 nt, Salmonella typhimurium LT2
aaucgaguagcgucaguugccc

SEQ ID NO: 40954 - RNA, 22 nt, Salmonella typhimurium LT2
aaucgcccugucauuucaggcg

SEQ ID NO: 40955 - RNA, 22 nt, Salmonella typhimurium LT2
aaucgguggugcccaaagcauu

SEQ ID NO: 40956 - RNA, 22 nt, Salmonella typhimurium LT2
aaucuacuauuucacggagucu

SEQ ID NO: 40957 - RNA, 22 nt, Salmonella typhimurium LT2
aaugagauggccgcguuggguu

SEQ ID NO: 40958 - RNA, 22 nt, Salmonella typhimurium LT2
aaugcaguagucgcugcggagg

SEQ ID NO: 40959 - RNA, 22 nt, Salmonella typhimurium LT2
aaugccguguaggcucauuaaa

SEQ ID NO: 40960 - RNA, 22 nt, Salmonella typhimurium LT2
aaugcgaugaggaucagcgcga

SEQ ID NO: 40961 - RNA, 22 nt, Salmonella typhimurium LT2
aauggacuaagguaaauuguga

SEQ ID NO: 40962 - RNA, 22 nt, Salmonella typhimurium LT2
aauggcggccaggaagcgauag

SEQ ID NO: 40963 - RNA, 22 nt, Salmonella typhimurium LT2
aauggcugcuguaucgugccca

SEQ ID NO: 40964 - RNA, 22 nt, Salmonella typhimurium LT2
aaugucgacgcgcuccagcaac

SEQ ID NO: 40965 - RNA, 22 nt, Salmonella typhimurium LT2
aauguucacugccguuauuaug

SEQ ID NO: 40966 - RNA, 22 nt, Salmonella typhimurium LT2
aauguuugccggauaaagauga

SEQ ID NO: 40967 - RNA, 22 nt, Salmonella typhimurium LT2
acaaauucgccaggcuaauagu

SEQ ID NO: 40968 - RNA, 22 nt, Salmonella typhimurium LT2
acaccggguuuagcagaaaaau

SEQ ID NO: 40969 - RNA, 22 nt, Salmonella typhimurium LT2
acacgguugaaugggacgaggc

SEQ ID NO: 40970 - RNA, 22 nt, Salmonella typhimurium LT2
acacugauuggcgcuggugucg

SEQ ID NO: 40971 - RNA, 22 nt, Salmonella typhimurium LT2
acagaauggcauccgccugcuc

SEQ ID NO: 40972 - RNA, 22 nt, Salmonella typhimurium LT2
acagagccugucucagcaauga

SEQ ID NO: 40973 - RNA, 22 nt, Salmonella typhimurium LT2
acagauuaugcgucauucgcua

SEQ ID NO: 40974 - RNA, 22 nt, Salmonella typhimurium LT2
acagcguugauuuuccgcagcc

SEQ ID NO: 40975 - RNA, 22 nt, Salmonella typhimurium LT2
acaguuccggcacuuucaccga

SEQ ID NO: 40976 - RNA, 22 nt, Salmonella typhimurium LT2
acauccgucaacggaaaaacgc

SEQ ID NO: 40977 - RNA, 22 nt, Salmonella typhimurium LT2
acauugagggcgaaaucucaua

SEQ ID NO: 40978 - RNA, 22 nt, Salmonella typhimurium LT2
acauuggcuccgggcaguucac

SEQ ID NO: 40979 - RNA, 18 nt, Salmonella typhimurium LT2
accagcugaucgaaggug

SEQ ID NO: 40980 - RNA, 22 nt, Salmonella typhimurium LT2
accaggaauaucucuuuuuccu

SEQ ID NO: 40981 - RNA, 22 nt, Salmonella typhimurium LT2
accggagccagugucugucacg

SEQ ID NO: 40982 - RNA, 22 nt, Salmonella typhimurium LT2
accggcgugccgacgggcguca

SEQ ID NO: 40983 - RNA, 22 nt, Salmonella typhimurium LT2
accgucggugauaucgaaucgc

SEQ ID NO: 40984 - RNA, 22 nt, Salmonella typhimurium LT2
accugguugggauaaaaaagcg

SEQ ID NO: 40985 - RNA, 22 nt, Salmonella typhimurium LT2
accugucaucuuccuuaugcuu

SEQ ID NO: 40986 - RNA, 22 nt, Salmonella typhimurium LT2
accugugcacugccgaguuuga

SEQ ID NO: 40987 - RNA, 22 nt, Salmonella typhimurium LT2
acgcaugacuaucugcgcuggu

SEQ ID NO: 40988 - RNA, 22 nt, Salmonella typhimurium LT2
acgcccauuagcauuccgcccg

SEQ ID NO: 40989 - RNA, 22 nt, Salmonella typhimurium LT2
acgcccuggaacagcaggcggu

SEQ ID NO: 40990 - RNA, 22 nt, Salmonella typhimurium LT2
acgccgcaggcgauggaucugc

SEQ ID NO: 40991 - RNA, 22 nt, Salmonella typhimurium LT2
acgcuacagcgguucaucaauu

SEQ ID NO: 40992 - RNA, 22 nt, Salmonella typhimurium LT2
acgcuggcuucuggcuguucgg

SEQ ID NO: 40993 - RNA, 22 nt, Salmonella typhimurium LT2
acggaaauauuauugcuaucgg

SEQ ID NO: 40994 - RNA, 22 nt, Salmonella typhimurium LT2
acggacagcguuuacugaaugc

SEQ ID NO: 40995 - RNA, 22 nt, Salmonella typhimurium LT2
acggaucguuuuauuuugccgu

SEQ ID NO: 40996 - RNA, 22 nt, Salmonella typhimurium LT2
acggcuuuagcgcggauaaugu

SEQ ID NO: 40997 - RNA, 22 nt, Salmonella typhimurium LT2
acggucguugcgucagcuucga

SEQ ID NO: 40998 - RNA, 22 nt, Salmonella typhimurium LT2
acggucuguacagcguaccgcc

SEQ ID NO: 40999 - RNA, 22 nt, Salmonella typhimurium LT2
acggucugucccagucggcgcu

SEQ ID NO: 41000 - RNA, 22 nt, Salmonella typhimurium LT2
acggugauuaucgacgcgguca

SEQ ID NO: 41001 - RNA, 22 nt, Salmonella typhimurium LT2
acguaggccugauaagcgcagc

SEQ ID NO: 41002 - RNA, 22 nt, Salmonella typhimurium LT2
acgucggccuuuaaaccggaca

SEQ ID NO: 41003 - RNA, 22 nt, Salmonella typhimurium LT2
acuacgcugaaaaauggacggc

SEQ ID NO: 41004 - RNA, 22 nt, Salmonella typhimurium LT2
acucgaaagcgaccaacgucgg

SEQ ID NO: 41005 - RNA, 22 nt, Salmonella typhimurium LT2
acugcugcgguaaugcagagua

SEQ ID NO: 41006 - RNA, 22 nt, Salmonella typhimurium LT2
acuggcgaauacguugagcaau

SEQ ID NO: 41007 - RNA, 22 nt, Salmonella typhimurium LT2
acuggucacuauuuuugucacc

SEQ ID NO: 41008 - RNA, 22 nt, Salmonella typhimurium LT2
acuuuaucuaccgcgccgguuc

SEQ ID NO: 41009 - RNA, 22 nt, Salmonella typhimurium LT2
acuuucuggcccacuucgauga

SEQ ID NO: 41010 - RNA, 22 nt, Salmonella typhimurium LT2
agaaucauucuugucuuucgca

SEQ ID NO: 41011 - RNA, 22 nt, Salmonella typhimurium LT2
agaauccguaucuucgagugcc

SEQ ID NO: 41012 - RNA, 22 nt, Salmonella typhimurium LT2
agacucugcggguugauguuug

SEQ ID NO: 41013 - RNA, 22 nt, Salmonella typhimurium LT2
agacugcauuucaauggcuucc

SEQ ID NO: 41014 - RNA, 22 nt, Salmonella typhimurium LT2
agagugacgcccaucguguaag

SEQ ID NO: 41015 - RNA, 22 nt, Salmonella typhimurium LT2
agauucaucuaauuugauuacu

SEQ ID NO: 41016 - RNA, 18 nt, Salmonella typhimurium LT2
agauugcuguaucguagu

SEQ ID NO: 41017 - RNA, 22 nt, Salmonella typhimurium LT2
agauuugcuauauuugcgcccc

SEQ ID NO: 41018 - RNA, 22 nt, Salmonella typhimurium LT2
agcagguuggcgucgcgaagcc

SEQ ID NO: 41019 - RNA, 22 nt, Salmonella typhimurium LT2
agccagacgcuguuaccuaagc

SEQ ID NO: 41020 - RNA, 22 nt, Salmonella typhimurium LT2
agccagacuuaucgcuccuaug

SEQ ID NO: 41021 - RNA, 22 nt, Salmonella typhimurium LT2
agccgcuauaucugggggcgca

SEQ ID NO: 41022 - RNA, 22 nt, Salmonella typhimurium LT2
agcgauauccccuaucgccacg

SEQ ID NO: 41023 - RNA, 22 nt, Salmonella typhimurium LT2
agcgcaccauuuauaaaaagua

SEQ ID NO: 41024 - RNA, 22 nt, Salmonella typhimurium LT2
agcgccgucuacaaaaaagccc

SEQ ID NO: 41025 - RNA, 22 nt, Salmonella typhimurium LT2
agcgcgguaucgcugagcuccu

SEQ ID NO: 41026 - RNA, 22 nt, Salmonella typhimurium LT2
agcgcguuggcgcagauauugu

SEQ ID NO: 41027 - RNA, 22 nt, Salmonella typhimurium LT2
agcggguuuuaccauuaccgau

SEQ ID NO: 41028 - RNA, 22 nt, Salmonella typhimurium LT2
agcgguuuuauuuacguugcuc

SEQ ID NO: 41029 - RNA, 21 nt, Salmonella typhimurium LT2
agcgucaauugccaggagcga

SEQ ID NO: 41030 - RNA, 22 nt, Salmonella typhimurium LT2
agcgucugacuauuccgguuau

SEQ ID NO: 41031 - RNA, 22 nt, Salmonella typhimurium LT2
auuucccgcuggucaacaaaga

SEQ ID NO: 41032 - RNA, 22 nt, Salmonella typhimurium LT2
caaauuccggccuggcauagaa

SEQ ID NO: 41033 - RNA, 22 nt, Salmonella typhimurium LT2
caacaguauuagccacggcauu

SEQ ID NO: 41034 - RNA, 22 nt, Salmonella typhimurium LT2
caaccugggaacaagagccauu

SEQ ID NO: 41035 - RNA, 22 nt, Salmonella typhimurium LT2
caacgcggcaacaacgaucgcg

SEQ ID NO: 41036 - RNA, 22 nt, Salmonella typhimurium LT2
caagccauguugcccaugccag

SEQ ID NO: 41037 - RNA, 22 nt, Salmonella typhimurium LT2
caagcgucaugugcuuauacuc

SEQ ID NO: 41038 - RNA, 19 nt, Salmonella typhimurium LT2
caauaucggcgucgaaucc

SEQ ID NO: 41039 - RNA, 22 nt, Salmonella typhimurium LT2
caauaucuacaaaggucgugua

SEQ ID NO: 41040 - RNA, 22 nt, Salmonella typhimurium LT2
cacagaauuaacguugggaauu

SEQ ID NO: 41041 - RNA, 17 nt, Salmonella typhimurium LT2
cacagagaauauauuuu

SEQ ID NO: 41042 - RNA, 21 nt, Salmonella typhimurium LT2
cacagcaugcgucucagaaug

SEQ ID NO: 41043 - RNA, 22 nt, Salmonella typhimurium LT2
caccggaugaaauuguuaguga

SEQ ID NO: 41044 - RNA, 22 nt, Salmonella typhimurium LT2
cacgcuuuucccugacccugac

SEQ ID NO: 41045 - RNA, 22 nt, Salmonella typhimurium LT2
cacggcgauuacgugaacgaca

SEQ ID NO: 41046 - RNA, 22 nt, Salmonella typhimurium LT2
cacguggagauggcggcggcgu

SEQ ID NO: 41047 - RNA, 22 nt, Salmonella typhimurium LT2
cacguugaugugaacuauucug

SEQ ID NO: 41048 - RNA, 22 nt, Salmonella typhimurium LT2
cagaaugucggugcgcagguua

SEQ ID NO: 41049 - RNA, 18 nt, Salmonella typhimurium LT2
cagaccaguaaauuaagu

SEQ ID NO: 41050 - RNA, 22 nt, Salmonella typhimurium LT2
cagauucugaaggugcauaugc

SEQ ID NO: 41051 - RNA, 22 nt, Salmonella typhimurium LT2
cagcgaggcaccaucauugaaa

SEQ ID NO: 41052 - RNA, 22 nt, Salmonella typhimurium LT2
cagcgcuuucguuaacaacgcg

SEQ ID NO: 41053 - RNA, 22 nt, Salmonella typhimurium LT2
cagcuaacgguugcauaaucug

SEQ ID NO: 41054 - RNA, 22 nt, Salmonella typhimurium LT2
caggaguugcagauuuaccggu

SEQ ID NO: 41055 - RNA, 22 nt, Salmonella typhimurium LT2
caggcgugaaugugucugcgug

SEQ ID NO: 41056 - RNA, 22 nt, Salmonella typhimurium LT2
cagguuguugggauguuucaga

SEQ ID NO: 41057 - RNA, 22 nt, Salmonella typhimurium LT2
caguacuuauccgggugaauac

SEQ ID NO: 41058 - RNA, 22 nt, Salmonella typhimurium LT2
cagugaggacgcuaaugccgcu

SEQ ID NO: 41059 - RNA, 22 nt, Salmonella typhimurium LT2
caguggcgauaagacgcaaugu

SEQ ID NO: 41060 - RNA, 22 nt, Salmonella typhimurium LT2
caguugacgguuuuucgccagc

SEQ ID NO: 41061 - RNA, 22 nt, Salmonella typhimurium LT2
cauaccgcaacgggagucagcg

SEQ ID NO: 41062 - RNA, 22 nt, Salmonella typhimurium LT2
caucauuuccauaacggcggcg

SEQ ID NO: 41063 - RNA, 22 nt, Salmonella typhimurium LT2
cauccguggugauuucaucaau

SEQ ID NO: 41064 - RNA, 22 nt, Salmonella typhimurium LT2
cauccugagaggcuugcaguga

SEQ ID NO: 41065 - RNA, 21 nt, Salmonella typhimurium LT2
caucgauagggaucaccacau

SEQ ID NO: 41066 - RNA, 22 nt, Salmonella typhimurium LT2
caucgucgggcacguuuaccuc

SEQ ID NO: 41067 - RNA, 22 nt, Salmonella typhimurium LT2
caucguuuugauaucgaagcgg

SEQ ID NO: 41068 - RNA, 22 nt, Salmonella typhimurium LT2
caugaagcuuuggauaaauuug

SEQ ID NO: 41069 - RNA, 22 nt, Salmonella typhimurium LT2
caugaauuucagcaucaaaauc

SEQ ID NO: 41070 - RNA, 22 nt, Salmonella typhimurium LT2
caugagcugggcuaugaaugcc

SEQ ID NO: 41071 - RNA, 22 nt, Salmonella typhimurium LT2
cauucgcauuugcccuuaaccc

SEQ ID NO: 41072 - RNA, 22 nt, Salmonella typhimurium LT2
cauuggcaauagauaaucgucc

SEQ ID NO: 41073 - RNA, 22 nt, Salmonella typhimurium LT2
cauuucauuaugaccaaacugg

SEQ ID NO: 41074 - RNA, 22 nt, Salmonella typhimurium LT2
ccagcagcaggaugccgaaagc

SEQ ID NO: 41075 - RNA, 22 nt, Salmonella typhimurium LT2
ccaggguuugacguuuccacuu

SEQ ID NO: 41076 - RNA, 22 nt, Salmonella typhimurium LT2
ccaguucgagauccggcguaga

SEQ ID NO: 41077 - RNA, 22 nt, Salmonella typhimurium LT2
ccauauagcaauaaacuuaucc

SEQ ID NO: 41078 - RNA, 22 nt, Salmonella typhimurium LT2
cccucaguaugcaggccgcgau

SEQ ID NO: 41079 - RNA, 22 nt, Salmonella typhimurium LT2
ccgaucccuuuuuugaugccgc

SEQ ID NO: 41080 - RNA, 22 nt, Salmonella typhimurium LT2
ccgccguaagcgcgauaguuau

SEQ ID NO: 41081 - RNA, 22 nt, Salmonella typhimurium LT2
ccgcgguaccugauaggggccg

SEQ ID NO: 41082 - RNA, 20 nt, Salmonella typhimurium LT2
ccgcguucauccaugcagaa

SEQ ID NO: 41083 - RNA, 22 nt, Salmonella typhimurium LT2
ccgcugcuugcugcucuauccg

SEQ ID NO: 41084 - RNA, 22 nt, Salmonella typhimurium LT2
ccggaaagcuugcuguccauac

SEQ ID NO: 41085 - RNA, 22 nt, Salmonella typhimurium LT2
ccggauaagcccuuagcgucgc

SEQ ID NO: 41086 - RNA, 22 nt, Salmonella typhimurium LT2
ccggauaaggcgaagcggccau

SEQ ID NO: 41087 - RNA, 22 nt, Salmonella typhimurium LT2
ccggauaaggcggagccgccau

SEQ ID NO: 41088 - RNA, 20 nt, Salmonella typhimurium LT2
ccgguaagcacauugcgcag

SEQ ID NO: 41089 - RNA, 22 nt, Salmonella typhimurium LT2
ccggucucccgauguaccgcac

SEQ ID NO: 41090 - RNA, 22 nt, Salmonella typhimurium LT2
ccggugaucccaccaggaguug

SEQ ID NO: 41091 - RNA, 21 nt, Salmonella typhimurium LT2
ccgguuguggaaaaaccgcag

SEQ ID NO: 41092 - RNA, 22 nt, Salmonella typhimurium LT2
ccgucgaugauuuuggucacgg

SEQ ID NO: 41093 - RNA, 22 nt, Salmonella typhimurium LT2
ccguuaaggccuuauugugccg

SEQ ID NO: 41094 - RNA, 22 nt, Salmonella typhimurium LT2
ccguuagcguuagagauugaaa

SEQ ID NO: 41095 - RNA, 22 nt, Salmonella typhimurium LT2
ccguucggggaaaagaugauua

SEQ ID NO: 41096 - RNA, 20 nt, Salmonella typhimurium LT2
ccugaccgcugaccacggcu

SEQ ID NO: 41097 - RNA, 22 nt, Salmonella typhimurium LT2
ccugauguuguugcaugauggu

SEQ ID NO: 41098 - RNA, 22 nt, Salmonella typhimurium LT2
ccuucggaccaauuuuacgccg

SEQ ID NO: 41099 - RNA, 22 nt, Salmonella typhimurium LT2
ccuuugaaggucggcagcaggg

SEQ ID NO: 41100 - RNA, 22 nt, Salmonella typhimurium LT2
cgaaccugauuguuuuacccaa

SEQ ID NO: 41101 - RNA, 22 nt, Salmonella typhimurium LT2
cgacgccugcuacagcccugua

SEQ ID NO: 41102 - RNA, 22 nt, Salmonella typhimurium LT2
cgaguacgauagcgccgauugc

SEQ ID NO: 41103 - RNA, 22 nt, Salmonella typhimurium LT2
cgaguacggaaaaaggguccgc

SEQ ID NO: 41104 - RNA, 20 nt, Salmonella typhimurium LT2
cgaucgcucugcgagacgcu

SEQ ID NO: 41105 - RNA, 22 nt, Salmonella typhimurium LT2
cgaucguaugccgggcgaugcg

SEQ ID NO: 41106 - RNA, 22 nt, Salmonella typhimurium LT2
cgaugggcguagagacgcgcgg

SEQ ID NO: 41107 - RNA, 22 nt, Salmonella typhimurium LT2
cgauggucgacguuauuggcug

SEQ ID NO: 41108 - RNA, 22 nt, Salmonella typhimurium LT2
cgauggugaguacaaaauacua

SEQ ID NO: 41109 - RNA, 22 nt, Salmonella typhimurium LT2
cgcaaguagauaacgccuucuu

SEQ ID NO: 41110 - RNA, 22 nt, Salmonella typhimurium LT2
cgcaccaucggauagcgaauac

SEQ ID NO: 41111 - RNA, 22 nt, Salmonella typhimurium LT2
cgcagauaguguuuaucgagca

SEQ ID NO: 41112 - RNA, 22 nt, Salmonella typhimurium LT2
cgcaggaauacauaggacacca

SEQ ID NO: 41113 - RNA, 22 nt, Salmonella typhimurium LT2
cgcaggauacgaaacgggugcu

SEQ ID NO: 41114 - RNA, 22 nt, Salmonella typhimurium LT2
cgcauauucucgaaguggcccc

SEQ ID NO: 41115 - RNA, 22 nt, Salmonella typhimurium LT2
cuuccgcguuugucggcgcugu

SEQ ID NO: 41116 - RNA, 22 nt, Salmonella typhimurium LT2
cuuguaggucggauaaggcgca

SEQ ID NO: 41117 - RNA, 22 nt, Salmonella typhimurium LT2
gaacagcacgugcgagccugau

SEQ ID NO: 41118 - RNA, 22 nt, Salmonella typhimurium LT2
gaacgugauaagcgcccgugag

SEQ ID NO: 41119 - RNA, 22 nt, Salmonella typhimurium LT2
gaagcugaugauuaauaaaaag

SEQ ID NO: 41120 - RNA, 22 nt, Salmonella typhimurium LT2
gaaggcuuucauaugagcauca

SEQ ID NO: 41121 - RNA, 22 nt, Salmonella typhimurium LT2
gaaguuuauagugaaaaaaugg

SEQ ID NO: 41122 - RNA, 22 nt, Salmonella typhimurium LT2
gaaugguugccaguugcggcgg

SEQ ID NO: 41123 - RNA, 22 nt, Salmonella typhimurium LT2
gacaacguuauaucgccuccga

SEQ ID NO: 41124 - RNA, 22 nt, Salmonella typhimurium LT2
gacaagauggcauagccgucau

SEQ ID NO: 41125 - RNA, 22 nt, Salmonella typhimurium LT2
gaccggauuguggccgacaggu

SEQ ID NO: 41126 - RNA, 22 nt, Salmonella typhimurium LT2
gacgaugcuuacgcugauagau

SEQ ID NO: 41127 - RNA, 21 nt, Salmonella typhimurium LT2
gacgcguguugccggaccagc

SEQ ID NO: 41128 - RNA, 20 nt, Salmonella typhimurium LT2
gacgucgccggaaagcguag

SEQ ID NO: 41129 - RNA, 22 nt, Salmonella typhimurium LT2
gacuucauggagucgaguugca

SEQ ID NO: 41130 - RNA, 19 nt, Salmonella typhimurium LT2
gagauacacagcguuuacc

SEQ ID NO: 41131 - RNA, 22 nt, Salmonella typhimurium LT2
gagcuggacgaucugaucauuc

SEQ ID NO: 41132 - RNA, 22 nt, Salmonella typhimurium LT2
gagcugguuaacguguuccgcg

SEQ ID NO: 41133 - RNA, 22 nt, Salmonella typhimurium LT2
gagucgauuaguuuccugcgug

SEQ ID NO: 41134 - RNA, 22 nt, Salmonella typhimurium LT2
gaguuuaucuucaacagugaaa

SEQ ID NO: 41135 - RNA, 22 nt, Salmonella typhimurium LT2
gauagggcgaucgccgguuuug

SEQ ID NO: 41136 - RNA, 22 nt, Salmonella typhimurium LT2
gauauugaugccgaugugguga

SEQ ID NO: 41137 - RNA, 22 nt, Salmonella typhimurium LT2
gaucagcagcguuuccgucgug

SEQ ID NO: 41138 - RNA, 22 nt, Salmonella typhimurium LT2
gaucaggucgguaaucaauagc

SEQ ID NO: 41139 - RNA, 22 nt, Salmonella typhimurium LT2
gaucgcuaaaacguuuuuaugu

SEQ ID NO: 41140 - RNA, 22 nt, Salmonella typhimurium LT2
gaugaugucaaaguucgccagg

SEQ ID NO: 41141 - RNA, 22 nt, Salmonella typhimurium LT2
gaugauguguaggccggguaag

SEQ ID NO: 41142 - RNA, 22 nt, Salmonella typhimurium LT2
gaugccgguucgucaaagguag

SEQ ID NO: 41143 - RNA, 22 nt, Salmonella typhimurium LT2
gaugcuggaugaauuacgcagc

SEQ ID NO: 41144 - RNA, 22 nt, Salmonella typhimurium LT2
gauggacuggugcucggcaugu

SEQ ID NO: 41145 - RNA, 22 nt, Salmonella typhimurium LT2
gauggugaucagcgcuaccaga

SEQ ID NO: 41146 - RNA, 22 nt, Salmonella typhimurium LT2
gauggugaugaccgucaaugcc

SEQ ID NO: 41147 - RNA, 22 nt, Salmonella typhimurium LT2
gauguaggccugauaagcguag

SEQ ID NO: 41148 - RNA, 22 nt, Salmonella typhimurium LT2
gauuccucaggaguacgccauu

SEQ ID NO: 41149 - RNA, 22 nt, Salmonella typhimurium LT2
gauugagcguuuacuggagucg

SEQ ID NO: 41150 - RNA, 22 nt, Salmonella typhimurium LT2
gauugcauccggaagaguuagg

SEQ ID NO: 41151 - RNA, 22 nt, Salmonella typhimurium LT2
gauuggccaguguuucaaaguc

SEQ ID NO: 41152 - RNA, 22 nt, Salmonella typhimurium LT2
gauugguaacggcguugagcug

SEQ ID NO: 41153 - RNA, 22 nt, Salmonella typhimurium LT2
gauuuacuacgggaagauuucg

SEQ ID NO: 41154 - RNA, 22 nt, Salmonella typhimurium LT2
gcacagaugcagguagucgauc

SEQ ID NO: 41155 - RNA, 22 nt, Salmonella typhimurium LT2
gcacgcuaugguacggcguguu

SEQ ID NO: 41156 - RNA, 22 nt, Salmonella typhimurium LT2
gcacgcugucguccgugaguga

SEQ ID NO: 41157 - RNA, 22 nt, Salmonella typhimurium LT2
gcacugcugguguuaaugcugg

SEQ ID NO: 41158 - RNA, 22 nt, Salmonella typhimurium LT2
gcagauguccgccuucugguau

SEQ ID NO: 41159 - RNA, 22 nt, Salmonella typhimurium LT2
gcagcaaauuaaaagucagacu

SEQ ID NO: 41160 - RNA, 22 nt, Salmonella typhimurium LT2
gcagcccaucaagcugagcgug

SEQ ID NO: 41161 - RNA, 22 nt, Salmonella typhimurium LT2
gcaggucagcauagauacgacg

SEQ ID NO: 41162 - RNA, 22 nt, Salmonella typhimurium LT2
gcaguauguaccuucgcugagu

SEQ ID NO: 41163 - RNA, 22 nt, Salmonella typhimurium LT2
gcaugguugcgcccggcaucgc

SEQ ID NO: 41164 - RNA, 22 nt, Salmonella typhimurium LT2
gcauguguucuuuucucuugcu

SEQ ID NO: 41165 - RNA, 22 nt, Salmonella typhimurium LT2
gcauugacgauuuuguacaggu

SEQ ID NO: 41166 - RNA, 22 nt, Salmonella typhimurium LT2
gccaauaaguuggucugacuua

SEQ ID NO: 41167 - RNA, 22 nt, Salmonella typhimurium LT2
gccagcguaaauagcccggauc

SEQ ID NO: 41168 - RNA, 22 nt, Salmonella typhimurium LT2
gccaggaaguuaugcggguuug

SEQ ID NO: 41169 - RNA, 21 nt, Salmonella typhimurium LT2
gccaggucagcggauggguuu

SEQ ID NO: 41170 - RNA, 23 nt, Salmonella typhimurium LT2
gccauggcgggacacagucuaug

SEQ ID NO: 41171 - RNA, 22 nt, Salmonella typhimurium LT2
gccauugaccaccgauaucgcg

SEQ ID NO: 41172 - RNA, 22 nt, Salmonella typhimurium LT2
gcccagaaaggcgagaucaugc

SEQ ID NO: 41173 - RNA, 22 nt, Salmonella typhimurium LT2
gccgaacguggcgguuuauccc

SEQ ID NO: 41174 - RNA, 21 nt, Salmonella typhimurium LT2
gccgaugcaaaugcugccagu

SEQ ID NO: 41175 - RNA, 22 nt, Salmonella typhimurium LT2
gccggaugucaucaccagcggg

SEQ ID NO: 41176 - RNA, 22 nt, Salmonella typhimurium LT2
gccguacuggaugccggguaug

SEQ ID NO: 41177 - RNA, 22 nt, Salmonella typhimurium LT2
gccgucagcggugcgcgcuucc

SEQ ID NO: 41178 - RNA, 22 nt, Salmonella typhimurium LT2
gccgugauuacggcgguaggua

SEQ ID NO: 41179 - RNA, 22 nt, Salmonella typhimurium LT2
gccguuuauaaguauuacgaca

SEQ ID NO: 41180 - RNA, 22 nt, Salmonella typhimurium LT2
gccugcgucuggacguggugaa

SEQ ID NO: 41181 - RNA, 22 nt, Salmonella typhimurium LT2
gccugugggugaauccggacug

SEQ ID NO: 41182 - RNA, 22 nt, Salmonella typhimurium LT2
gccuguuuuugcguaaagaggg

SEQ ID NO: 41183 - RNA, 22 nt, Salmonella typhimurium LT2
gcgaauaauggagauauucuga

SEQ ID NO: 41184 - RNA, 22 nt, Salmonella typhimurium LT2
gcgcacuuuaaucgccaugauc

SEQ ID NO: 41185 - RNA, 22 nt, Salmonella typhimurium LT2
gcgcauccuccaguuggcuguu

SEQ ID NO: 41186 - RNA, 19 nt, Salmonella typhimurium LT2
gcgccauaacgauuuuuca

SEQ ID NO: 41187 - RNA, 22 nt, Salmonella typhimurium LT2
gcgccaucgcucugggaaucgu

SEQ ID NO: 41188 - RNA, 22 nt, Salmonella typhimurium LT2
gcgcgauugauaugaauauauu

SEQ ID NO: 41189 - RNA, 22 nt, Salmonella typhimurium LT2
gcgcguuuacccagcucaaacu

SEQ ID NO: 41190 - RNA, 23 nt, Salmonella typhimurium LT2
gcgcuucaggaacagcaguccgg

SEQ ID NO: 41191 - RNA, 19 nt, Salmonella typhimurium LT2
gcggcuuuuguagauauug

SEQ ID NO: 41192 - RNA, 22 nt, Salmonella typhimurium LT2
gcgguuaucgccgggcuaccga

SEQ ID NO: 41193 - RNA, 22 nt, Salmonella typhimurium LT2
gcgguugaucggguaguuugcg

SEQ ID NO: 41194 - RNA, 21 nt, Salmonella typhimurium LT2
gcgucgucgaugaucuucgcc

SEQ ID NO: 41195 - RNA, 22 nt, Salmonella typhimurium LT2
gcgugaauaauguugcucucua

SEQ ID NO: 41196 - RNA, 22 nt, Salmonella typhimurium LT2
gcgugcguauacguaaucuuga

SEQ ID NO: 41197 - RNA, 22 nt, Salmonella typhimurium LT2
gcguggaugccccgcugaauau

SEQ ID NO: 41198 - RNA, 22 nt, Salmonella typhimurium LT2
gcguuguauuuaucuucgugau

SEQ ID NO: 41199 - RNA, 22 nt, Salmonella typhimurium LT2
gugcgccugcuuccagcaguaa

SEQ ID NO: 41200 - RNA, 22 nt, Salmonella typhimurium LT2
gugcgcuguauauuaccuuuau

SEQ ID NO: 41201 - RNA, 22 nt, Salmonella typhimurium LT2
gugcggauaaaaugacgcuggc

SEQ ID NO: 41202 - RNA, 22 nt, Salmonella typhimurium LT2
guggcggaggugauucaacgcu

SEQ ID NO: 41203 - RNA, 22 nt, Salmonella typhimurium LT2
gugggcaacaauauuccgacuc

SEQ ID NO: 41204 - RNA, 22 nt, Salmonella typhimurium LT2
guguggaacggcagaucggaaa

SEQ ID NO: 41205 - RNA, 22 nt, Salmonella typhimurium LT2
guuaaggcauuuucgccggccu

SEQ ID NO: 41206 - RNA, 22 nt, Salmonella typhimurium LT2
guuacccaaacaacgaucguca

SEQ ID NO: 41207 - RNA, 22 nt, Salmonella typhimurium LT2
guuacgcucgguucaccgaagg

SEQ ID NO: 41208 - RNA, 22 nt, Salmonella typhimurium LT2
guuaucuucguugggcuggucg

SEQ ID NO: 41209 - RNA, 22 nt, Salmonella typhimurium LT2
guuauucagcccgcguuucugu

SEQ ID NO: 41210 - RNA, 22 nt, Salmonella typhimurium LT2
guucuacguacaacgugcccag

SEQ ID NO: 41211 - RNA, 22 nt, Salmonella typhimurium LT2
guuguacuugucuggucaauaa

SEQ ID NO: 41212 - RNA, 22 nt, Salmonella typhimurium LT2
guuugacgccgcgcggcagaau

SEQ ID NO: 41213 - RNA, 22 nt, Salmonella typhimurium LT2
uaaagcaauauucgguuuaacu

SEQ ID NO: 41214 - RNA, 22 nt, Salmonella typhimurium LT2
uaaaucugauuugcguagcggc

SEQ ID NO: 41215 - RNA, 22 nt, Salmonella typhimurium LT2
uaacagccccagcccuggcgua

SEQ ID NO: 41216 - RNA, 22 nt, Salmonella typhimurium LT2
uaagagauaaagaccgaggcga

SEQ ID NO: 41217 - RNA, 22 nt, Salmonella typhimurium LT2
uaaucguauccuggaugagcua

SEQ ID NO: 41218 - RNA, 22 nt, Salmonella typhimurium LT2
uacacccuguuccgugaugcgu

SEQ ID NO: 41219 - RNA, 22 nt, Salmonella typhimurium LT2
uacaggauguucggcguaucgu

SEQ ID NO: 41220 - RNA, 22 nt, Salmonella typhimurium LT2
uacaggccggauaaggcgcagc

SEQ ID NO: 41221 - RNA, 22 nt, Salmonella typhimurium LT2
uacagggcuguagcaggcgucg

SEQ ID NO: 41222 - RNA, 19 nt, Salmonella typhimurium LT2
uaccaguaaccaaagucaa

SEQ ID NO: 41223 - RNA, 22 nt, Salmonella typhimurium LT2
uaccgccguguuuuucauaaaa

SEQ ID NO: 41224 - RNA, 22 nt, Salmonella typhimurium LT2
uaccggaagugguggugacggc

SEQ ID NO: 41225 - RNA, 22 nt, Salmonella typhimurium LT2
uaccugugcuggcgcugaccgc

SEQ ID NO: 41226 - RNA, 22 nt, Salmonella typhimurium LT2
uaccuguuguggcguucggcag

SEQ ID NO: 41227 - RNA, 22 nt, Salmonella typhimurium LT2
uacgcauauggcggaucuggau

SEQ ID NO: 41228 - RNA, 22 nt, Salmonella typhimurium LT2
uacggccuuuaucgauaaaaau

SEQ ID NO: 41229 - RNA, 22 nt, Salmonella typhimurium LT2
uacgggcugcaugacaucgcca

SEQ ID NO: 41230 - RNA, 22 nt, Salmonella typhimurium LT2
uacgugcugaacgauauucauu

SEQ ID NO: 41231 - RNA, 22 nt, Salmonella typhimurium LT2
uacugugcgcgcugucggucuu

SEQ ID NO: 41232 - RNA, 23 nt, Salmonella typhimurium LT2
uacuucauucagggcaagguggc

SEQ ID NO: 41233 - RNA, 22 nt, Salmonella typhimurium LT2
uagccaucaccaucuucuggca

SEQ ID NO: 41234 - RNA, 22 nt, Salmonella typhimurium LT2
uagcgccgcucucauaaccaga

SEQ ID NO: 41235 - RNA, 22 nt, Salmonella typhimurium LT2
uagcgugauuacgaccggcgag

SEQ ID NO: 41236 - RNA, 22 nt, Salmonella typhimurium LT2
uaggccgacuguucaccacuac

SEQ ID NO: 41237 - RNA, 22 nt, Salmonella typhimurium LT2
uaggccggauaagcguuagcgc

SEQ ID NO: 41238 - RNA, 22 nt, Salmonella typhimurium LT2
uaggccugauaagcguagcgcc

SEQ ID NO: 41239 - RNA, 22 nt, Salmonella typhimurium LT2
uaggccugauaagguaaagccg

SEQ ID NO: 41240 - RNA, 22 nt, Salmonella typhimurium LT2
uaggucuggucuaucucuuuuu

SEQ ID NO: 41241 - RNA, 22 nt, Salmonella typhimurium LT2
uagucuggaaagcuggcuacuc

SEQ ID NO: 41242 - RNA, 22 nt, Salmonella typhimurium LT2
uaguugccgccguuuugccgcu

SEQ ID NO: 41243 - RNA, 22 nt, Salmonella typhimurium LT2
uauccgacucaagguaaauggc

SEQ ID NO: 41244 - RNA, 19 nt, Salmonella typhimurium LT2
uaucgaaguucacgccucc

SEQ ID NO: 41245 - RNA, 22 nt, Salmonella typhimurium LT2
uaucugcaauaaagguugcccg

SEQ ID NO: 41246 - RNA, 22 nt, Salmonella typhimurium LT2
uauggcagguuucuuuggcgcu

SEQ ID NO: 41247 - RNA, 21 nt, Salmonella typhimurium LT2
uauggcgaccaccugcuggac

SEQ ID NO: 41248 - RNA, 22 nt, Salmonella typhimurium LT2
uauggcgcgggggaaaagaugg

SEQ ID NO: 41249 - RNA, 23 nt, Salmonella typhimurium LT2
uauggcuauuaggguagacgggu

SEQ ID NO: 41250 - RNA, 22 nt, Salmonella typhimurium LT2
uauuccggugaucuuugucucc

SEQ ID NO: 41251 - RNA, 22 nt, Salmonella typhimurium LT2
uauugucggccuggugcuguug

SEQ ID NO: 41252 - RNA, 22 nt, Salmonella typhimurium LT2
uauugugcauagagguaagaau

SEQ ID NO: 41253 - RNA, 22 nt, Salmonella typhimurium LT2
ucaacgugaaugucccggaucu

SEQ ID NO: 41254 - RNA, 22 nt, Salmonella typhimurium LT2
ucaaucuucauccgcgcgccca

SEQ ID NO: 41255 - RNA, 20 nt, Salmonella typhimurium LT2
ucaaugccgauaucgucaau

SEQ ID NO: 41256 - RNA, 22 nt, Salmonella typhimurium LT2
ucaccgagaguauguuuaagcg

SEQ ID NO: 41257 - RNA, 22 nt, Salmonella typhimurium LT2
ucaccgucggcucggcggcgua

SEQ ID NO: 41258 - RNA, 22 nt, Salmonella typhimurium LT2
ucacgcggccgugcagcagugg

SEQ ID NO: 41259 - RNA, 22 nt, Salmonella typhimurium LT2
ucacgguaagaggagucaggua

SEQ ID NO: 41260 - RNA, 22 nt, Salmonella typhimurium LT2
ucacugcucggcuuguugguca

SEQ ID NO: 41261 - RNA, 22 nt, Salmonella typhimurium LT2
ucacuguugaagauaaacucuu

SEQ ID NO: 41262 - RNA, 22 nt, Salmonella typhimurium LT2
ucagagaguagugcaguuacag

SEQ ID NO: 41263 - RNA, 23 nt, Salmonella typhimurium LT2
ucagaucgguaucgccggugaug

SEQ ID NO: 41264 - RNA, 22 nt, Salmonella typhimurium LT2
ucagcacgauacuguaaugcca

SEQ ID NO: 41265 - RNA, 22 nt, Salmonella typhimurium LT2
ucagcgcguuuuuuuaucuauu

SEQ ID NO: 41266 - RNA, 22 nt, Salmonella typhimurium LT2
ucagcgcuuucacuuccugguc

SEQ ID NO: 41267 - RNA, 19 nt, Salmonella typhimurium LT2
ucagcuccauguucgccgc

SEQ ID NO: 41268 - RNA, 22 nt, Salmonella typhimurium LT2
ucagggugauacuggcguugca

SEQ ID NO: 41269 - RNA, 17 nt, Salmonella typhimurium LT2
ucaugguggauuccggg

SEQ ID NO: 41270 - RNA, 22 nt, Salmonella typhimurium LT2
ucauuacccgugaugaagaugc

SEQ ID NO: 41271 - RNA, 22 nt, Salmonella typhimurium LT2
uccagcuaccucgcggaucguc

SEQ ID NO: 41272 - RNA, 22 nt, Salmonella typhimurium LT2
uccagucugaauguugaacacg

SEQ ID NO: 41273 - RNA, 22 nt, Salmonella typhimurium LT2
uccgccaugauccaggcgugau

SEQ ID NO: 41274 - RNA, 22 nt, Salmonella typhimurium LT2
uccgcgaugcucgcccaccacc

SEQ ID NO: 41275 - RNA, 22 nt, Salmonella typhimurium LT2
uccggacgacaaacgccaggcg

SEQ ID NO: 41276 - RNA, 22 nt, Salmonella typhimurium LT2
uccggcuuuuggucugcugauc

SEQ ID NO: 41277 - RNA, 22 nt, Salmonella typhimurium LT2
uccggcuuuuuuauaucaggca

SEQ ID NO: 41278 - RNA, 22 nt, Salmonella typhimurium LT2
uccgggaucgccuccagcagca

SEQ ID NO: 41279 - RNA, 22 nt, Salmonella typhimurium LT2
uccgggcucauauuaucaaggu

SEQ ID NO: 41280 - RNA, 22 nt, Salmonella typhimurium LT2
ucgaacagugccccguuuuggc

SEQ ID NO: 41281 - RNA, 19 nt, Salmonella typhimurium LT2
ucgaacgcugcgaauuuau

SEQ ID NO: 41282 - RNA, 22 nt, Salmonella typhimurium LT2
ucgaugcugacgguauccugca

SEQ ID NO: 41283 - RNA, 22 nt, Salmonella typhimurium LT2
uggcugagguguuugccuaugc

SEQ ID NO: 41284 - RNA, 22 nt, Salmonella typhimurium LT2
uggcugauuaucccguguccug

SEQ ID NO: 41285 - RNA, 22 nt, Salmonella typhimurium LT2
ugggcaaagaagauaagcuggu

SEQ ID NO: 41286 - RNA, 22 nt, Salmonella typhimurium LT2
ugggcauuuugcacaagaaauu

SEQ ID NO: 41287 - RNA, 22 nt, Salmonella typhimurium LT2
uggguagaccgggagucuguga

SEQ ID NO: 41288 - RNA, 22 nt, Salmonella typhimurium LT2
ugguaccguuaugacgaucugc

SEQ ID NO: 41289 - RNA, 22 nt, Salmonella typhimurium LT2
uggucgucugcguaagcugaac

SEQ ID NO: 41290 - RNA, 22 nt, Salmonella typhimurium LT2
uggugccgaacaugguagccac

SEQ ID NO: 41291 - RNA, 19 nt, Salmonella typhimurium LT2
ugguguacguugauucgcg

SEQ ID NO: 41292 - RNA, 22 nt, Salmonella typhimurium LT2
uguaccagaucgcgcaggguga

SEQ ID NO: 41293 - RNA, 22 nt, Salmonella typhimurium LT2
uguaggcagcauaagcguuagc

SEQ ID NO: 41294 - RNA, 22 nt, Salmonella typhimurium LT2
uguaggcccgguaagcgucagc

SEQ ID NO: 41295 - RNA, 22 nt, Salmonella typhimurium LT2
uguaggccggacaaggcguuca

SEQ ID NO: 41296 - RNA, 22 nt, Salmonella typhimurium LT2
uguaggccggauaagacgcguc

SEQ ID NO: 41297 - RNA, 22 nt, Salmonella typhimurium LT2
uguaggccggauaagacgcguu

SEQ ID NO: 41298 - RNA, 22 nt, Salmonella typhimurium LT2
uguaggcuggauaaggcguaag

SEQ ID NO: 41299 - RNA, 22 nt, Salmonella typhimurium LT2
ugucauggagauagguaugcca

SEQ ID NO: 41300 - RNA, 22 nt, Salmonella typhimurium LT2
uguccguagugcgauuuuaaaa

SEQ ID NO: 41301 - RNA, 22 nt, Salmonella typhimurium LT2
ugucgcuuugaugaccuuugcg

SEQ ID NO: 41302 - RNA, 22 nt, Salmonella typhimurium LT2
ugugaacaucucauccggccua

SEQ ID NO: 41303 - RNA, 22 nt, Salmonella typhimurium LT2
ugugcaaagacugauagccguu

SEQ ID NO: 41304 - RNA, 22 nt, Salmonella typhimurium LT2
ugugcgcccugcgccaguuguu

SEQ ID NO: 41305 - RNA, 23 nt, Salmonella typhimurium LT2
uguggaacgccagccgcuuugug

SEQ ID NO: 41306 - RNA, 22 nt, Salmonella typhimurium LT2
uguucguaggcuggaucaggcg

SEQ ID NO: 41307 - RNA, 22 nt, Salmonella typhimurium LT2
uuaacccggauacgggcauagu

SEQ ID NO: 41308 - RNA, 18 nt, Salmonella typhimurium LT2
uuaaccgccaugaauagc

SEQ ID NO: 41309 - RNA, 20 nt, Salmonella typhimurium LT2
uuaacggcaaguacgacaug

SEQ ID NO: 41310 - RNA, 22 nt, Salmonella typhimurium LT2
uuaaugugaguaaguugcgcga

SEQ ID NO: 41311 - RNA, 22 nt, Salmonella typhimurium LT2
uuaccgacgaguuuauucgugg

SEQ ID NO: 41312 - RNA, 22 nt, Salmonella typhimurium LT2
uuaccguuugccaucuggccgc

SEQ ID NO: 41313 - RNA, 22 nt, Salmonella typhimurium LT2
uuaccucgaacgaucuggugac

SEQ ID NO: 41314 - RNA, 22 nt, Salmonella typhimurium LT2
uuacgcgggcaacgagcacaac

SEQ ID NO: 41315 - RNA, 22 nt, Salmonella typhimurium LT2
uuacuacuggcuaaugggcagc

SEQ ID NO: 41316 - RNA, 22 nt, Salmonella typhimurium LT2
uuaucagucuacaaauuacuuu

SEQ ID NO: 41317 - RNA, 22 nt, Salmonella typhimurium LT2
uuauccgcaagcugaacgcgcc

SEQ ID NO: 41318 - RNA, 21 nt, Salmonella typhimurium LT2
uuauccggccuacaaacccaa

SEQ ID NO: 41319 - RNA, 22 nt, Salmonella typhimurium LT2
uuaucgauaucgucaaugcguu

SEQ ID NO: 41320 - RNA, 21 nt, Salmonella typhimurium LT2
uucaagcguaucggucaggga

SEQ ID NO: 41321 - RNA, 21 nt, Salmonella typhimurium LT2
uucaaggaaauugccgcuugu

SEQ ID NO: 41322 - RNA, 20 nt, Salmonella typhimurium LT2
uucacgcccggcaguuugcc

SEQ ID NO: 41323 - RNA, 22 nt, Salmonella typhimurium LT2
uuccaggcuucuauguuggcuu

SEQ ID NO: 41324 - RNA, 22 nt, Salmonella typhimurium LT2
uuccggcgagagaaacuuguua

SEQ ID NO: 41325 - RNA, 22 nt, Salmonella typhimurium LT2
uuccggcgucauugccguggau

SEQ ID NO: 41326 - RNA, 22 nt, Salmonella typhimurium LT2
uuccgguagggcacguagaagc

SEQ ID NO: 41327 - RNA, 22 nt, Salmonella typhimurium LT2
uucgaugagaagaucccacucg

SEQ ID NO: 41328 - RNA, 22 nt, Salmonella typhimurium LT2
uucgguauggcaugaugcggaa

SEQ ID NO: 41329 - RNA, 22 nt, Salmonella typhimurium LT2
uucgugagcuacgucaaaaugu

SEQ ID NO: 41330 - RNA, 22 nt, Salmonella typhimurium LT2
uucugcaacaccagcggcgcau

SEQ ID NO: 41331 - RNA, 22 nt, Salmonella typhimurium LT2
uucugcugauugccgcggcgcu

SEQ ID NO: 41332 - RNA, 21 nt, Salmonella typhimurium LT2
uucuggacgcguaucgcgcug

SEQ ID NO: 41333 - RNA, 22 nt, Salmonella typhimurium LT2
uucuggacggccgccgcgaaac

SEQ ID NO: 41334 - RNA, 22 nt, Salmonella typhimurium LT2
uugaacaagaguugcuugauaa

SEQ ID NO: 41335 - RNA, 22 nt, Salmonella typhimurium LT2
uugaaugucugccggaacaggu

SEQ ID NO: 41336 - RNA, 23 nt, Salmonella typhimurium LT2
uugacgagguuuaccgcgccugc

SEQ ID NO: 41337 - RNA, 21 nt, Salmonella typhimurium LT2
uugacguuggagcgguagguc

SEQ ID NO: 41338 - RNA, 22 nt, Salmonella typhimurium LT2
uugacuuugggucugcgcgucg

SEQ ID NO: 41339 - RNA, 22 nt, Salmonella typhimurium LT2
uugagcuucaugacauuaaugu

SEQ ID NO: 41340 - RNA, 22 nt, Salmonella typhimurium LT2
uugcauuucacggucagaucga

SEQ ID NO: 41341 - RNA, 22 nt, Salmonella typhimurium LT2
uugccggcgagaugauggcagg

SEQ ID NO: 41342 - RNA, 22 nt, Salmonella typhimurium LT2
uugccggucauccaagccgcaa

SEQ ID NO: 41343 - RNA, 22 nt, Salmonella typhimurium LT2
uugccguugacgacguaagccg

SEQ ID NO: 41344 - RNA, 22 nt, Salmonella typhimurium LT2
uugccguugaugccauuagugc

SEQ ID NO: 41345 - RNA, 22 nt, Salmonella typhimurium LT2
uugcggauacgaauuaccguuu

SEQ ID NO: 41346 - RNA, 20 nt, Salmonella typhimurium LT2
uugcugacugguaggcguga

SEQ ID NO: 41347 - RNA, 22 nt, Salmonella typhimurium LT2
uugcugauuugcucuguggugg

SEQ ID NO: 41348 - RNA, 22 nt, Salmonella typhimurium LT2
uuggcggaacccgacugguuuu

SEQ ID NO: 41349 - RNA, 20 nt, Salmonella typhimurium LT2
uuguccagccgcugguagcc

SEQ ID NO: 41350 - RNA, 22 nt, Salmonella typhimurium LT2
uugucgcgauucuggagcaaca

SEQ ID NO: 41351 - RNA, 22 nt, Salmonella typhimurium LT2
uuuacggaucugcaggaucagg

SEQ ID NO: 41352 - RNA, 22 nt, Salmonella typhimurium LT2
uuuaucagcuuguugagaagau

SEQ ID NO: 41353 - RNA, 22 nt, Salmonella typhimurium LT2
uuucagguggccuucacgcugu

SEQ ID NO: 41354 - RNA, 22 nt, Salmonella typhimurium LT2
uuucaugcauuggacagcacgc

SEQ ID NO: 41355 - RNA, 19 nt, Salmonella typhimurium LT2
uuuccggcgccauuggcgu

SEQ ID NO: 41356 - RNA, 22 nt, Salmonella typhimurium LT2
uuucgccgaugguuacaacgcc

SEQ ID NO: 41357 - RNA, 18 nt, Salmonella typhimurium LT2
uuugacgauugcuuuacc

SEQ ID NO: 41358 - RNA, 22 nt, Salmonella typhimurium LT2
uuugcccggauacuucgcgugg

SEQ ID NO: 41359 - RNA, 22 nt, Salmonella typhimurium LT2
uuugcccgguaagacuuccugc

SEQ ID NO: 41360 - RNA, 22 nt, Salmonella typhimurium LT2
uuugccgucuggcuggcccugu

SEQ ID NO: 41361 - RNA, 22 nt, Salmonella typhimurium LT2
uuuggcaccauguuuagcacca

SEQ ID NO: 41362 - RNA, 22 nt, Salmonella typhimurium LT2
uuugucauuuccgguuugacga

SEQ ID NO: 41363 - RNA, 22 nt, Shigella flexneri 2a str. 2457T
aaacgcaucgguaugauugcgc

SEQ ID NO: 41364 - RNA, 21 nt, Shigella flexneri 2a str. 2457T
aaacucucggggucagcgagg

SEQ ID NO: 41365 - RNA, 22 nt, Shigella flexneri 2a str. 2457T
aaagcggugaccgcuaugucga

SEQ ID NO: 41366 - RNA, 22 nt, Shigella flexneri 2a str. 2457T
aaagcgucaauauuugcgccug

SEQ ID NO: 41367 - RNA, 22 nt, Shigella flexneri 2a str. 2457T
agaucuauaugccggauuagcg

SEQ ID NO: 41368 - RNA, 22 nt, Shigella flexneri 2a str. 2457T
agaucuuuaaugaugguaacgc

SEQ ID NO: 41369 - RNA, 22 nt, Shigella flexneri 2a str. 2457T
agaugcugugcuaucgcuaacg

SEQ ID NO: 41370 - RNA, 22 nt, Shigella flexneri 2a str. 2457T
agaugguuccggcguucgauaa

SEQ ID NO: 41371 - RNA, 22 nt, Shigella flexneri 2a str. 2457T
agcaaacugcuuucuccggagu

SEQ ID NO: 41372 - RNA, 22 nt, Shigella flexneri 2a str. 2457T
agcaaaugguugaaaucgccaa

SEQ ID NO: 41373 - RNA, 22 nt, Shigella flexneri 2a str. 2457T
agcaacguugaucugcugguga

SEQ ID NO: 41374 - RNA, 22 nt, Shigella flexneri 2a str. 2457T
agcaacugacgcuucggauccc

SEQ ID NO: 41375 - RNA, 22 nt, Shigella flexneri 2a str. 2457T
agcagacaaacagcgucgaggu

SEQ ID NO: 41376 - RNA, 22 nt, Shigella flexneri 2a str. 2457T
agcagacaacccacacauuucu

SEQ ID NO: 41377 - RNA, 22 nt, Shigella flexneri 2a str. 2457T
agcagcacggugaauaucagcg

SEQ ID NO: 41378 - RNA, 18 nt, Shigella flexneri 2a str. 2457T
agcagcggcgcaauggca

SEQ ID NO: 41379 - RNA, 22 nt, Shigella flexneri 2a str. 2457T
agcaggccacaguuccgguggu

SEQ ID NO: 41380 - RNA, 22 nt, Shigella flexneri 2a str. 2457T
agcaguuucguggcggcaccga

SEQ ID NO: 41381 - RNA, 22 nt, Shigella flexneri 2a str. 2457T
agcaucgcucaucaugaugucg

SEQ ID NO: 41382 - RNA, 22 nt, Shigella flexneri 2a str. 2457T
agcauugaggaacagcguaauc

SEQ ID NO: 41383 - RNA, 21 nt, Shigella flexneri 2a str. 2457T
agccgcuggaugaaauuggcg

SEQ ID NO: 41384 - RNA, 16 nt, Shigella flexneri 2a str. 2457T
agccggauggucgcgu

SEQ ID NO: 41385 - RNA, 22 nt, Shigella flexneri 2a str. 2457T
agcgcaggcagaacggaauuac

SEQ ID NO: 41386 - RNA, 20 nt, Shigella flexneri 2a str. 2457T
agcggcguugaugaugccgg

SEQ ID NO: 41387 - RNA, 22 nt, Shigella flexneri 2a str. 2457T
agcggcuuuccggcgagguggc

SEQ ID NO: 41388 - RNA, 22 nt, Shigella flexneri 2a str. 2457T
agcguaucaggauaucuauaca

SEQ ID NO: 41389 - RNA, 22 nt, Shigella flexneri 2a str. 2457T
agcguauuaagaaugagcugga

SEQ ID NO: 41390 - RNA, 22 nt, Shigella flexneri 2a str. 2457T
agcgugugaaugccgauaucgu

SEQ ID NO: 41391 - RNA, 21 nt, Shigella flexneri 2a str. 2457T
agcguuauggcguacgucugc

SEQ ID NO: 41392 - RNA, 18 nt, Shigella flexneri 2a str. 2457T
agcugcugcgcaucaaca

SEQ ID NO: 41393 - RNA, 22 nt, Shigella flexneri 2a str. 2457T
agcuuguucgacaaagcuuugc

SEQ ID NO: 41394 - RNA, 21 nt, Shigella flexneri 2a str. 2457T
aggaaucacggcgcugaaagc

SEQ ID NO: 41395 - RNA, 20 nt, Shigella flexneri 2a str. 2457T
aggacgguuguggcgcacgu

SEQ ID NO: 41396 - RNA, 22 nt, Shigella flexneri 2a str. 2457T
aggccgcaucaucgcuugcgau

SEQ ID NO: 41397 - RNA, 22 nt, Shigella flexneri 2a str. 2457T
aggccguugcuguuggucaagc

SEQ ID NO: 41398 - RNA, 22 nt, Shigella flexneri 2a str. 2457T
aggcgcugaacgugguggugcg

SEQ ID NO: 41399 - RNA, 22 nt, Shigella flexneri 2a str. 2457T
aggcucaguacgcagcugaaga

SEQ ID NO: 41400 - RNA, 22 nt, Shigella flexneri 2a str. 2457T
aggcuuugugcucuucugugaa

SEQ ID NO: 41401 - RNA, 22 nt, Shigella flexneri 2a str. 2457T
aggguugacguaauagagguuu

SEQ ID NO: 41402 - RNA, 22 nt, Shigella flexneri 2a str. 2457T
aggucaaugcguuugagaaugu

SEQ ID NO: 41403 - RNA, 22 nt, Shigella flexneri 2a str. 2457T
aggucagauaagcgaaacgcau

SEQ ID NO: 41404 - RNA, 22 nt, Shigella flexneri 2a str. 2457T
aggucggugguucaaguccacu

SEQ ID NO: 41405 - RNA, 19 nt, Shigella flexneri 2a str. 2457T
aggugauugaaaccgaucu

SEQ ID NO: 41406 - RNA, 22 nt, Shigella flexneri 2a str. 2457T
agguggcaaaauuugggacaaa

SEQ ID NO: 41407 - RNA, 22 nt, Shigella flexneri 2a str. 2457T
aguacacgcaucccgcccacca

SEQ ID NO: 41408 - RNA, 22 nt, Shigella flexneri 2a str. 2457T
aguagccagggcaaucagcagg

SEQ ID NO: 41409 - RNA, 22 nt, Shigella flexneri 2a str. 2457T
aguaucgacuacacccugccgc

SEQ ID NO: 41410 - RNA, 22 nt, Shigella flexneri 2a str. 2457T
aguauucuuauuuuaacaacag

SEQ ID NO: 41411 - RNA, 22 nt, Shigella flexneri 2a str. 2457T
agucaucaggcucuuucuuaaa

SEQ ID NO: 41412 - RNA, 22 nt, Shigella flexneri 2a str. 2457T
agucaugaauucacuacguccg

SEQ ID NO: 41413 - RNA, 22 nt, Shigella flexneri 2a str. 2457T
agugacgugauaaucgcuggaa

SEQ ID NO: 41414 - RNA, 22 nt, Shigella flexneri 2a str. 2457T
agugaucaggacgauauuuggu

SEQ ID NO: 41415 - RNA, 22 nt, Shigella flexneri 2a str. 2457T
aguggcgcagggcgaugauguu

SEQ ID NO: 41416 - RNA, 22 nt, Shigella flexneri 2a str. 2457T
aguguaaaagguauguaacaga

SEQ ID NO: 41417 - RNA, 22 nt, Shigella flexneri 2a str. 2457T
agugugaccuucaguagccagc

SEQ ID NO: 41418 - RNA, 22 nt, Shigella flexneri 2a str. 2457T
aguuugaucgcaaagguauggu

SEQ ID NO: 41419 - RNA, 22 nt, Shigella flexneri 2a str. 2457T
aguuugcuauugaccaggaaaa

SEQ ID NO: 41420 - RNA, 22 nt, Shigella flexneri 2a str. 2457T
auaaacgccuggcuggcugguu

SEQ ID NO: 41421 - RNA, 22 nt, Shigella flexneri 2a str. 2457T
auaaacucucaauaccgauacu

SEQ ID NO: 41422 - RNA, 22 nt, Shigella flexneri 2a str. 2457T
auaagacgcuuccgcgucgcau

SEQ ID NO: 41423 - RNA, 22 nt, Shigella flexneri 2a str. 2457T
auaggucagugacacauuauga

SEQ ID NO: 41424 - RNA, 22 nt, Shigella flexneri 2a str. 2457T
auaucacgcguaacggcggcuu

SEQ ID NO: 41425 - RNA, 22 nt, Shigella flexneri 2a str. 2457T
aucacgaauauuaucgacguaa

SEQ ID NO: 41426 - RNA, 22 nt, Shigella flexneri 2a str. 2457T
aucacgucaccucgacgcuguu

SEQ ID NO: 41427 - RNA, 22 nt, Shigella flexneri 2a str. 2457T
aucaggcaauuuggcguuugcc

SEQ ID NO: 41428 - RNA, 22 nt, Shigella flexneri 2a str. 2457T
aucaggccuacauagucccugc

SEQ ID NO: 41429 - RNA, 22 nt, Shigella flexneri 2a str. 2457T
aucaggucaucgaucacuuucu

SEQ ID NO: 41430 - RNA, 22 nt, Shigella flexneri 2a str. 2457T
aucaguaaguuggagucauuac

SEQ ID NO: 41431 - RNA, 22 nt, Shigella flexneri 2a str. 2457T
auccaauggcaguagauaaacu

SEQ ID NO: 41432 - RNA, 22 nt, Shigella flexneri 2a str. 2457T
auccaguucgauuucccgcgga

SEQ ID NO: 41433 - RNA, 22 nt, Shigella flexneri 2a str. 2457T
auccggccuacauaaucacgca

SEQ ID NO: 41434 - RNA, 22 nt, Shigella flexneri 2a str. 2457T
auccggccuuugucgauaaaga

SEQ ID NO: 41435 - RNA, 23 nt, Shigella flexneri 2a str. 2457T
auccuaucguugguguggacuuu

SEQ ID NO: 41436 - RNA, 22 nt, Shigella flexneri 2a str. 2457T
aucgcagauagcaaaaaagcgc

SEQ ID NO: 41437 - RNA, 17 nt, Shigella flexneri 2a str. 2457T
aucgccgguaaagcggu

SEQ ID NO: 41438 - RNA, 22 nt, Shigella flexneri 2a str. 2457T
aucgcgggccugucgguggcga

SEQ ID NO: 41439 - RNA, 22 nt, Shigella flexneri 2a str. 2457T
aucgcuggaagguuggcgcauu

SEQ ID NO: 41440 - RNA, 18 nt, Shigella flexneri 2a str. 2457T
aucggcauggcauucgcc

SEQ ID NO: 41441 - RNA, 22 nt, Shigella flexneri 2a str. 2457T
aucgguaaauuagccgcgcgug

SEQ ID NO: 41442 - RNA, 22 nt, Shigella flexneri 2a str. 2457T
aucggucgcuucgucaucaacc

SEQ ID NO: 41443 - RNA, 22 nt, Shigella flexneri 2a str. 2457T
aucgucgaaacgccggagcagg

SEQ ID NO: 41444 - RNA, 22 nt, Shigella flexneri 2a str. 2457T
aucguuguagaguuugaucagg

SEQ ID NO: 41445 - RNA, 22 nt, Shigella flexneri 2a str. 2457T
aucuaugugaauaaacaugacg

SEQ ID NO: 41446 - RNA, 22 nt, Shigella flexneri 2a str. 2457T
aucuugcaauaaauauuucagu

SEQ ID NO: 41447 - RNA, 22 nt, Shigella flexneri 2a str. 2457T
ccgacgacgguuuacagcauua

SEQ ID NO: 41448 - RNA, 22 nt, Shigella flexneri 2a str. 2457T
ccgagaucuuucgcugcuuuua

SEQ ID NO: 41449 - RNA, 22 nt, Shigella flexneri 2a str. 2457T
ccgauaguuaagucaaaaccga

SEQ ID NO: 41450 - RNA, 22 nt, Shigella flexneri 2a str. 2457T
ccgauaucacgcacuuuuccca

SEQ ID NO: 41451 - RNA, 22 nt, Shigella flexneri 2a str. 2457T
ccgcguacuggcgcuggauaug

SEQ ID NO: 41452 - RNA, 22 nt, Shigella flexneri 2a str. 2457T
ccgcuuugaucaccaguucaca

SEQ ID NO: 41453 - RNA, 22 nt, Shigella flexneri 2a str. 2457T
ccggaacaaucgugaauagcgc

SEQ ID NO: 41454 - RNA, 22 nt, Shigella flexneri 2a str. 2457T
ccggauucuuuuaugcacauug

SEQ ID NO: 41455 - RNA, 22 nt, Shigella flexneri 2a str. 2457T
ccggccuacaaacccuugcuaa

SEQ ID NO: 41456 - RNA, 20 nt, Shigella flexneri 2a str. 2457T
ccgguaaacgacaguuugcg

SEQ ID NO: 41457 - RNA, 22 nt, Shigella flexneri 2a str. 2457T
ccgguaucaaaguuaucgaccu

SEQ ID NO: 41458 - RNA, 22 nt, Shigella flexneri 2a str. 2457T
ccggugcugaugggcguggcga

SEQ ID NO: 41459 - RNA, 22 nt, Shigella flexneri 2a str. 2457T
ccgguuagaagaaugcuauucg

SEQ ID NO: 41460 - RNA, 22 nt, Shigella flexneri 2a str. 2457T
ccucgcugaucccaggacuucu

SEQ ID NO: 41461 - RNA, 22 nt, Shigella flexneri 2a str. 2457T
ccuggcgagcaucccccacaau

SEQ ID NO: 41462 - RNA, 22 nt, Shigella flexneri 2a str. 2457T
ccugggaaaaaaucgcuggcgg

SEQ ID NO: 41463 - RNA, 22 nt, Shigella flexneri 2a str. 2457T
ccugugggaaucucgcaucauu

SEQ ID NO: 41464 - RNA, 22 nt, Shigella flexneri 2a str. 2457T
cgaaaccguugagcgacagcaa

SEQ ID NO: 41465 - RNA, 22 nt, Shigella flexneri 2a str. 2457T
cgaacuggagcgggcguugagu

SEQ ID NO: 41466 - RNA, 22 nt, Shigella flexneri 2a str. 2457T
cgacggcaauauuguacugagu

SEQ ID NO: 41467 - RNA, 22 nt, Shigella flexneri 2a str. 2457T
cgacgguggugucauuguccag

SEQ ID NO: 41468 - RNA, 22 nt, Shigella flexneri 2a str. 2457T
cgagaucgguaccgucacgcca

SEQ ID NO: 41469 - RNA, 22 nt, Shigella flexneri 2a str. 2457T
cgaggccuguaugcucggcggg

SEQ ID NO: 41470 - RNA, 22 nt, Shigella flexneri 2a str. 2457T
cgagguuucaugggcgugauua

SEQ ID NO: 41471 - RNA, 22 nt, Shigella flexneri 2a str. 2457T
cgaguaggcgggauaaggcguu

SEQ ID NO: 41472 - RNA, 21 nt, Shigella flexneri 2a str. 2457T
cgaucgucgggaucaucgguc

SEQ ID NO: 41473 - RNA, 22 nt, Shigella flexneri 2a str. 2457T
cgaugcuggcggaagugggccu

SEQ ID NO: 41474 - RNA, 22 nt, Shigella flexneri 2a str. 2457T
cgauggaucgcugggaucaugg

SEQ ID NO: 41475 - RNA, 22 nt, Shigella flexneri 2a str. 2457T
cgcaugauaucccgcagguggc

SEQ ID NO: 41476 - RNA, 22 nt, Shigella flexneri 2a str. 2457T
cgccggaagagagauugcggua

SEQ ID NO: 41477 - RNA, 22 nt, Shigella flexneri 2a str. 2457T
cgccugauuaacguuuuuguac

SEQ ID NO: 41478 - RNA, 22 nt, Shigella flexneri 2a str. 2457T
cgcggcaaugaaaucagcuauu

SEQ ID NO: 41479 - RNA, 22 nt, Shigella flexneri 2a str. 2457T
cgcguuaacuggaaccggguga

SEQ ID NO: 41480 - RNA, 22 nt, Shigella flexneri 2a str. 2457T
cgcuaucaggggaugguagggc

SEQ ID NO: 41481 - RNA, 22 nt, Shigella flexneri 2a str. 2457T
cgcucuuauccaucugcuugcu

SEQ ID NO: 41482 - RNA, 22 nt, Shigella flexneri 2a str. 2457T
cgcugguuccugcgccauuucc

SEQ ID NO: 41483 - RNA, 22 nt, Shigella flexneri 2a str. 2457T
cgcuguugccaacgccgcaaag

SEQ ID NO: 41484 - RNA, 22 nt, Shigella flexneri 2a str. 2457T
cggaugucuuccuguugccauc

SEQ ID NO: 41485 - RNA, 18 nt, Shigella flexneri 2a str. 2457T
cggcaacuaccagaccca

SEQ ID NO: 41486 - RNA, 22 nt, Shigella flexneri 2a str. 2457T
cggcaauuucacacaccaguug

SEQ ID NO: 41487 - RNA, 21 nt, Shigella flexneri 2a str. 2457T
cggcagcaacuucaucacgga

SEQ ID NO: 41488 - RNA, 22 nt, Shigella flexneri 2a str. 2457T
cggcggauuuauuacugcaucc

SEQ ID NO: 41489 - RNA, 22 nt, Shigella flexneri 2a str. 2457T
cggcugguuaaguauuucguuu

SEQ ID NO: 41490 - RNA, 21 nt, Shigella flexneri 2a str. 2457T
cgggaacaucguuaccucuga

SEQ ID NO: 41491 - RNA, 20 nt, Shigella flexneri 2a str. 2457T
cgggaacguccguuaaggua

SEQ ID NO: 41492 - RNA, 22 nt, Shigella flexneri 2a str. 2457T
cgggcguucgagaguguucuua

SEQ ID NO: 41493 - RNA, 22 nt, Shigella flexneri 2a str. 2457T
cgggcuauuuuucaccgaguuc

SEQ ID NO: 41494 - RNA, 22 nt, Shigella flexneri 2a str. 2457T
cgggugcaguaauaucgcccug

SEQ ID NO: 41495 - RNA, 22 nt, Shigella flexneri 2a str. 2457T
cgguacgccggacgauuugaaa

SEQ ID NO: 41496 - RNA, 22 nt, Shigella flexneri 2a str. 2457T
cggugaucaacauccacuuauc

SEQ ID NO: 41497 - RNA, 22 nt, Shigella flexneri 2a str. 2457T
cggugccaguucgcgcagggua

SEQ ID NO: 41498 - RNA, 22 nt, Shigella flexneri 2a str. 2457T
cgguggucggcauucugcuggc

SEQ ID NO: 41499 - RNA, 22 nt, Shigella flexneri 2a str. 2457T
cgguuaaagauauucgcguguu

SEQ ID NO: 41500 - RNA, 22 nt, Shigella flexneri 2a str. 2457T
cgguuaaaggcaaugugauuaa

SEQ ID NO: 41501 - RNA, 22 nt, Shigella flexneri 2a str. 2457T
cgguucgaugauuggucugaau

SEQ ID NO: 41502 - RNA, 22 nt, Shigella flexneri 2a str. 2457T
cguagccgguggugugcuggcu

SEQ ID NO: 41503 - RNA, 22 nt, Shigella flexneri 2a str. 2457T
cguagcgucugauuagcggaaa

SEQ ID NO: 41504 - RNA, 22 nt, Shigella flexneri 2a str. 2457T
cguccggucgggcaggugugcu

SEQ ID NO: 41505 - RNA, 22 nt, Shigella flexneri 2a str. 2457T
cgucgccaauguucagcggcuc

SEQ ID NO: 41506 - RNA, 20 nt, Shigella flexneri 2a str. 2457T
cgugccacaucaacgaucuc

SEQ ID NO: 41507 - RNA, 22 nt, Shigella flexneri 2a str. 2457T
cgugcgucuucuauucagggga

SEQ ID NO: 41508 - RNA, 22 nt, Shigella flexneri 2a str. 2457T
cguguugccugccgcgucggua

SEQ ID NO: 41509 - RNA, 17 nt, Shigella flexneri 2a str. 2457T
cguugcaggcgcugaac

SEQ ID NO: 41510 - RNA, 22 nt, Shigella flexneri 2a str. 2457T
cuacgcauacaaccagagcaag

SEQ ID NO: 41511 - RNA, 22 nt, Shigella flexneri 2a str. 2457T
cuacgcaucuuucauuuauaaa

SEQ ID NO: 41512 - RNA, 22 nt, Shigella flexneri 2a str. 2457T
cuacgcuuaucaggccuacgca

SEQ ID NO: 41513 - RNA, 22 nt, Shigella flexneri 2a str. 2457T
cuagauccgggcugauuugcug

SEQ ID NO: 41514 - RNA, 22 nt, Shigella flexneri 2a str. 2457T
cuaucgguggucgucgagcaac

SEQ ID NO: 41515 - RNA, 22 nt, Shigella flexneri 2a str. 2457T
cuauguugagaugcuggcgcgu

SEQ ID NO: 41516 - RNA, 22 nt, Shigella flexneri 2a str. 2457T
cucgcguaauuuauccggcagg

SEQ ID NO: 41517 - RNA, 20 nt, Shigella flexneri 2a str. 2457T
cucgcguccgcgauagcgua

SEQ ID NO: 41518 - RNA, 22 nt, Shigella flexneri 2a str. 2457T
cugagaagugaugcugucagca

SEQ ID NO: 41519 - RNA, 22 nt, Shigella flexneri 2a str. 2457T
cugaugcgacgcugacgcgucu

SEQ ID NO: 41520 - RNA, 22 nt, Shigella flexneri 2a str. 2457T
cugaugcgucuuaucaggccua

SEQ ID NO: 41521 - RNA, 21 nt, Shigella flexneri 2a str. 2457T
cugcauguugcucauagugug

SEQ ID NO: 41522 - RNA, 22 nt, Shigella flexneri 2a str. 2457T
cugccgugucaccacuguucag

SEQ ID NO: 41523 - RNA, 23 nt, Shigella flexneri 2a str. 2457T
cugccguuagcgacugcgacguu

SEQ ID NO: 41524 - RNA, 22 nt, Shigella flexneri 2a str. 2457T
cugccguuuacgggccugagcg

SEQ ID NO: 41525 - RNA, 22 nt, Shigella flexneri 2a str. 2457T
cugcguacgccauuagcggugc

SEQ ID NO: 41526 - RNA, 22 nt, Shigella flexneri 2a str. 2457T
cugcuguacauggcugccgcug

SEQ ID NO: 41527 - RNA, 22 nt, Shigella flexneri 2a str. 2457T
gcgaacuuacgucugguuauuu

SEQ ID NO: 41528 - RNA, 22 nt, Shigella flexneri 2a str. 2457T
gcgaagauuuugguuauuacgc

SEQ ID NO: 41529 - RNA, 20 nt, Shigella flexneri 2a str. 2457T
gcgacgcaaucacaggucuu

SEQ ID NO: 41530 - RNA, 22 nt, Shigella flexneri 2a str. 2457T
gcgaugcccacgagcgguuuau

SEQ ID NO: 41531 - RNA, 22 nt, Shigella flexneri 2a str. 2457T
gcgaugggcaaaaagcaucuga

SEQ ID NO: 41532 - RNA, 22 nt, Shigella flexneri 2a str. 2457T
gcgauuauucaccccacguuug

SEQ ID NO: 41533 - RNA, 22 nt, Shigella flexneri 2a str. 2457T
gcgcacugcucgaaggcuuucg

SEQ ID NO: 41534 - RNA, 22 nt, Shigella flexneri 2a str. 2457T
gcgcauggacgguacgacccca

SEQ ID NO: 41535 - RNA, 22 nt, Shigella flexneri 2a str. 2457T
gcgcgaucacagugagcaagaa

SEQ ID NO: 41536 - RNA, 22 nt, Shigella flexneri 2a str. 2457T
gcguacaccaucaacauugaaa

SEQ ID NO: 41537 - RNA, 22 nt, Shigella flexneri 2a str. 2457T
gcguaucaucaacccgaugcgc

SEQ ID NO: 41538 - RNA, 22 nt, Shigella flexneri 2a str. 2457T
gcgucaugcagucacgguugaa

SEQ ID NO: 41539 - RNA, 22 nt, Shigella flexneri 2a str. 2457T
gcgucuggcauuaggaacgcug

SEQ ID NO: 41540 - RNA, 22 nt, Shigella flexneri 2a str. 2457T
gcgugcugggcgacuggucgca

SEQ ID NO: 41541 - RNA, 21 nt, Shigella flexneri 2a str. 2457T
gcguuaccaucauuaaagauc

SEQ ID NO: 41542 - RNA, 22 nt, Shigella flexneri 2a str. 2457T
gcguuaccggcuucgagaggca

SEQ ID NO: 41543 - RNA, 22 nt, Shigella flexneri 2a str. 2457T
gcguugauacuauguauggggu

SEQ ID NO: 41544 - RNA, 22 nt, Shigella flexneri 2a str. 2457T
gcguuucuucgaaaaagaacug

SEQ ID NO: 41545 - RNA, 22 nt, Shigella flexneri 2a str. 2457T
gcuaaugcagaauuucuccgau

SEQ ID NO: 41546 - RNA, 22 nt, Shigella flexneri 2a str. 2457T
gcuauaccuuacgcucuggcag

SEQ ID NO: 41547 - RNA, 22 nt, Shigella flexneri 2a str. 2457T
gcuccagucuucacuuuucgac

SEQ ID NO: 41548 - RNA, 22 nt, Shigella flexneri 2a str. 2457T
gcucgccaagcagugggaagcg

SEQ ID NO: 41549 - RNA, 22 nt, Shigella flexneri 2a str. 2457T
gcucugccuauuuugaaaacgc

SEQ ID NO: 41550 - RNA, 22 nt, Shigella flexneri 2a str. 2457T
gcucuggcacaguaucgugaac

SEQ ID NO: 41551 - RNA, 22 nt, Shigella flexneri 2a str. 2457T
gcugaacaccagccagauugau

SEQ ID NO: 41552 - RNA, 22 nt, Shigella flexneri 2a str. 2457T
gcugacaugauggaugguaugc

SEQ ID NO: 41553 - RNA, 22 nt, Shigella flexneri 2a str. 2457T
gcugaccguugauauuguugcc

SEQ ID NO: 41554 - RNA, 22 nt, Shigella flexneri 2a str. 2457T
gcugcacguucagccgcugcac

SEQ ID NO: 41555 - RNA, 22 nt, Shigella flexneri 2a str. 2457T
gcugccaggccucaaaguuaac

SEQ ID NO: 41556 - RNA, 22 nt, Shigella flexneri 2a str. 2457T
gcugccgucaaccagacgcugg

SEQ ID NO: 41557 - RNA, 22 nt, Shigella flexneri 2a str. 2457T
gcuggcguucgcuuaguugaug

SEQ ID NO: 41558 - RNA, 22 nt, Shigella flexneri 2a str. 2457T
gcuggcuuugcgcacuggcggc

SEQ ID NO: 41559 - RNA, 22 nt, Shigella flexneri 2a str. 2457T
gcugguauuuucaaucgguacg

SEQ ID NO: 41560 - RNA, 23 nt, Shigella flexneri 2a str. 2457T
gcuggucaacgaagguuacuaug

SEQ ID NO: 41561 - RNA, 22 nt, Shigella flexneri 2a str. 2457T
gcuguucaacuccaaacucucu

SEQ ID NO: 41562 - RNA, 22 nt, Shigella flexneri 2a str. 2457T
gcuucgucauuccgaaaggcua

SEQ ID NO: 41563 - RNA, 22 nt, Shigella flexneri 2a str. 2457T
gcuucugcacugugguuuuucu

SEQ ID NO: 41564 - RNA, 22 nt, Shigella flexneri 2a str. 2457T
gcuuugcggccuucaggcagaa

SEQ ID NO: 41565 - RNA, 22 nt, Shigella flexneri 2a str. 2457T
ggaaguccccgucaccaucgca

SEQ ID NO: 41566 - RNA, 22 nt, Shigella flexneri 2a str. 2457T
ggaaguguuacagcgauugcga

SEQ ID NO: 41567 - RNA, 22 nt, Shigella flexneri 2a str. 2457T
ggaauaccaucaauaucgugag

SEQ ID NO: 41568 - RNA, 22 nt, Shigella flexneri 2a str. 2457T
ggauaucacgcugauuuacgcc

SEQ ID NO: 41569 - RNA, 19 nt, Shigella flexneri 2a str. 2457T
ggcaaauccacauuguuga

SEQ ID NO: 41570 - RNA, 22 nt, Shigella flexneri 2a str. 2457T
ggcaaccgugggccgaugaauu

SEQ ID NO: 41571 - RNA, 20 nt, Shigella flexneri 2a str. 2457T
ggcacgcugauugaaaaccc

SEQ ID NO: 41572 - RNA, 22 nt, Shigella flexneri 2a str. 2457T
ggcacugaaaccguggguguua

SEQ ID NO: 41573 - RNA, 22 nt, Shigella flexneri 2a str. 2457T
ggcagcaagugcagcucgcugg

SEQ ID NO: 41574 - RNA, 22 nt, Shigella flexneri 2a str. 2457T
ggcagugaauuucuacguuauu

SEQ ID NO: 41575 - RNA, 22 nt, Shigella flexneri 2a str. 2457T
ggcagugcguagaauuuaccuu

SEQ ID NO: 41576 - RNA, 22 nt, Shigella flexneri 2a str. 2457T
ggcaucguuacgcgugucagca

SEQ ID NO: 41577 - RNA, 22 nt, Shigella flexneri 2a str. 2457T
ggcaugaccaucgaucucggcu

SEQ ID NO: 41578 - RNA, 22 nt, Shigella flexneri 2a str. 2457T
ggcauguucccaagccagaugu

SEQ ID NO: 41579 - RNA, 22 nt, Shigella flexneri 2a str. 2457T
ggccguugagauccuuuacaac

SEQ ID NO: 41580 - RNA, 22 nt, Shigella flexneri 2a str. 2457T
ggcgaauaguuucacgcuggaa

SEQ ID NO: 41581 - RNA, 22 nt, Shigella flexneri 2a str. 2457T
ggcgaccugaugagccguccga

SEQ ID NO: 41582 - RNA, 22 nt, Shigella flexneri 2a str. 2457T
ggcgauuucugugcuuuuaucg

SEQ ID NO: 41583 - RNA, 22 nt, Shigella flexneri 2a str. 2457T
ggcggaguguugucguuaaugu

SEQ ID NO: 41584 - RNA, 23 nt, Shigella flexneri 2a str. 2457T
ggcuggagagcggguagucguau

SEQ ID NO: 41585 - RNA, 22 nt, Shigella flexneri 2a str. 2457T
ggcuggauauuauggcgcuggu

SEQ ID NO: 41586 - RNA, 22 nt, Shigella flexneri 2a str. 2457T
ggcuuucaguauuuguggcaau

SEQ ID NO: 41587 - RNA, 22 nt, Shigella flexneri 2a str. 2457T
ggcuuuccaguucaccagauug

SEQ ID NO: 41588 - RNA, 22 nt, Shigella flexneri 2a str. 2457T
ggcuuucugcuggcgauagcca

SEQ ID NO: 41589 - RNA, 22 nt, Shigella flexneri 2a str. 2457T
gggagucauugcaucgucaacu

SEQ ID NO: 41590 - RNA, 22 nt, Shigella flexneri 2a str. 2457T
gggaucgucuuaccgcguucga

SEQ ID NO: 41591 - RNA, 23 nt, Shigella flexneri 2a str. 2457T
ggguauauaaaugcacgcucugc

SEQ ID NO: 41592 - RNA, 22 nt, Shigella flexneri 2a str. 2457T
gggucgcuacaaccugcaucuu

SEQ ID NO: 41593 - RNA, 20 nt, Shigella flexneri 2a str. 2457T
gguaagugaagggaguguga

SEQ ID NO: 41594 - RNA, 22 nt, Shigella flexneri 2a str. 2457T
gguaaucugaucggugucccgc

SEQ ID NO: 41595 - RNA, 22 nt, Shigella flexneri 2a str. 2457T
gguagcuuaugcccuugcacca

SEQ ID NO: 41596 - RNA, 22 nt, Shigella flexneri 2a str. 2457T
gguaguucuucacugaaauuug

SEQ ID NO: 41597 - RNA, 22 nt, Shigella flexneri 2a str. 2457T
gguauucgcuuugccuuuacga

SEQ ID NO: 41598 - RNA, 19 nt, Shigella flexneri 2a str. 2457T
ggucgugacaaguuagcgc

SEQ ID NO: 41599 - RNA, 22 nt, Shigella flexneri 2a str. 2457T
ggugauagcguuccugcaauuc

SEQ ID NO: 41600 - RNA, 22 nt, Shigella flexneri 2a str. 2457T
guaauagcacaugacaaaaaug

SEQ ID NO: 41601 - RNA, 22 nt, Shigella flexneri 2a str. 2457T
guaccagcgaagaacaacugcu

SEQ ID NO: 41602 - RNA, 20 nt, Shigella flexneri 2a str. 2457T
guaggccgcauccggcagga

SEQ ID NO: 41603 - RNA, 22 nt, Shigella flexneri 2a str. 2457T
guaguaaucaucaaucugcugc

SEQ ID NO: 41604 - RNA, 22 nt, Shigella flexneri 2a str. 2457T
gucagcaccagggugaucgcuu

SEQ ID NO: 41605 - RNA, 22 nt, Shigella flexneri 2a str. 2457T
guccggaagagaucaccgcuga

SEQ ID NO: 41606 - RNA, 22 nt, Shigella flexneri 2a str. 2457T
guccugcuugccagauacgaug

SEQ ID NO: 41607 - RNA, 22 nt, Shigella flexneri 2a str. 2457T
gucgaaauggaagcguuaaccg

SEQ ID NO: 41608 - RNA, 22 nt, Shigella flexneri 2a str. 2457T
gucgagaaaacgggauagcacc

SEQ ID NO: 41609 - RNA, 22 nt, Shigella flexneri 2a str. 2457T
gucgagaaagaagagaauggcg

SEQ ID NO: 41610 - RNA, 22 nt, Shigella flexneri 2a str. 2457T
gucgccgauaccgagguagcgg

SEQ ID NO: 41611 - RNA, 22 nt, Shigella flexneri 2a str. 2457T
gucgccugaaguugaggaggau

SEQ ID NO: 41612 - RNA, 21 nt, Shigella flexneri 2a str. 2457T
gucgcgucuucucgcggauga

SEQ ID NO: 41613 - RNA, 23 nt, Shigella flexneri 2a str. 2457T
gucggcagcguuaucaucggaua

SEQ ID NO: 41614 - RNA, 22 nt, Shigella flexneri 2a str. 2457T
gucugcugauuuugcuguuuac

SEQ ID NO: 41615 - RNA, 22 nt, Shigella flexneri 2a str. 2457T
gucuggauuuaguacgucgcug

SEQ ID NO: 41616 - RNA, 22 nt, Shigella flexneri 2a str. 2457T
gugaacguguaggccugauaag

SEQ ID NO: 41617 - RNA, 18 nt, Shigella flexneri 2a str. 2457T
gugaauggaaaaugcugg

SEQ ID NO: 41618 - RNA, 22 nt, Shigella flexneri 2a str. 2457T
gugacagugauugaacuggcgg

SEQ ID NO: 41619 - RNA, 22 nt, Shigella flexneri 2a str. 2457T
gugacgaaguugagaauaccgc

SEQ ID NO: 41620 - RNA, 22 nt, Shigella flexneri 2a str. 2457T
gugagcaaacgcaaaaagccgu

SEQ ID NO: 41621 - RNA, 22 nt, Shigella flexneri 2a str. 2457T
gugaguucaccauuacgcugga

SEQ ID NO: 41622 - RNA, 22 nt, Shigella flexneri 2a str. 2457T
gugauuauggaugaaccgacuu

SEQ ID NO: 41623 - RNA, 22 nt, Shigella flexneri 2a str. 2457T
gugauugaagagcaagaacgga

SEQ ID NO: 41624 - RNA, 22 nt, Shigella flexneri 2a str. 2457T
gugcaggcggucguuaugacgg

SEQ ID NO: 41625 - RNA, 22 nt, Shigella flexneri 2a str. 2457T
gugccguuguucuacgccgaga

SEQ ID NO: 41626 - RNA, 22 nt, Shigella flexneri 2a str. 2457T
gugccguuguugcgugacgacg

SEQ ID NO: 41627 - RNA, 20 nt, Shigella flexneri 2a str. 2457T
gugcgagucgccugaacagu

SEQ ID NO: 41628 - RNA, 22 nt, Shigella flexneri 2a str. 2457T
guggcugaugccauguagcuca

SEQ ID NO: 41629 - RNA, 22 nt, Shigella flexneri 2a str. 2457T
gugggcacaaaaaauggcguug

SEQ ID NO: 41630 - RNA, 22 nt, Shigella flexneri 2a str. 2457T
gugucgcggguagcaggguguu

SEQ ID NO: 41631 - RNA, 22 nt, Shigella flexneri 2a str. 2457T
gugugcaaagacugauagccgu

SEQ ID NO: 41632 - RNA, 22 nt, Shigella flexneri 2a str. 2457T
guguuaaaugcucauuguuugc

SEQ ID NO: 41633 - RNA, 22 nt, Shigella flexneri 2a str. 2457T
guguuaucgauauuggugaguu

SEQ ID NO: 41634 - RNA, 22 nt, Shigella flexneri 2a str. 2457T
guucagcagauuuggcgcaacu

SEQ ID NO: 41635 - RNA, 22 nt, Shigella flexneri 2a str. 2457T
guucaguuuugacgaugcgcuu

SEQ ID NO: 41636 - RNA, 22 nt, Shigella flexneri 2a str. 2457T
guuccguuggcgauugcuuguc

SEQ ID NO: 41637 - RNA, 22 nt, Shigella flexneri 2a str. 2457T
guucucaucgcucuuaccgggg

SEQ ID NO: 41638 - RNA, 22 nt, Shigella flexneri 2a str. 2457T
guugagcuguuuuagcgaaaca

SEQ ID NO: 41639 - RNA, 22 nt, Shigella flexneri 2a str. 2457T
guugcacuucaauuaauuguaa

SEQ ID NO: 41640 - RNA, 22 nt, Shigella flexneri 2a str. 2457T
guuugaucagaauacgaucguu

SEQ ID NO: 41641 - RNA, 22 nt, Shigella flexneri 2a str. 2457T
guuugcagguagagcagauuau

SEQ ID NO: 41642 - RNA, 22 nt, Shigella flexneri 2a str. 2457T
guuugcgcugaugugggcagua

SEQ ID NO: 41643 - RNA, 22 nt, Shigella flexneri 2a str. 2457T
uaaaguuccgcgcauugcguuc

SEQ ID NO: 41644 - RNA, 22 nt, Shigella flexneri 2a str. 2457T
uaaccgugauagaagaugccgg

SEQ ID NO: 41645 - RNA, 22 nt, Shigella flexneri 2a str. 2457T
uaagauugugaaugacggccgg

SEQ ID NO: 41646 - RNA, 22 nt, Shigella flexneri 2a str. 2457T
uaaggcguuuacgccgcauccg

SEQ ID NO: 41647 - RNA, 22 nt, Shigella flexneri 2a str. 2457T
uaaucccgauugaagagaaguu

SEQ ID NO: 41648 - RNA, 19 nt, Shigella flexneri 2a str. 2457T
uaaucugcguggaaaguau

SEQ ID NO: 41649 - RNA, 22 nt, Shigella flexneri 2a str. 2457T
uacccgcgugcuggcagggaug

SEQ ID NO: 41650 - RNA, 22 nt, Shigella flexneri 2a str. 2457T
uaccgugggaagucugcuuggc

SEQ ID NO: 41651 - RNA, 22 nt, Shigella flexneri 2a str. 2457T
uacgccuuauccggccuacggg

SEQ ID NO: 41652 - RNA, 22 nt, Shigella flexneri 2a str. 2457T
uacgcgucuuaucaggccuacg

SEQ ID NO: 41653 - RNA, 19 nt, Shigella flexneri 2a str. 2457T
uacggcuguuucugacggu

SEQ ID NO: 41654 - RNA, 22 nt, Shigella flexneri 2a str. 2457T
uacgugcccaauaucggcgcgg

SEQ ID NO: 41655 - RNA, 22 nt, Shigella flexneri 2a str. 2457T
uacgugccugaaaugcgcgaga

SEQ ID NO: 41656 - RNA, 21 nt, Shigella flexneri 2a str. 2457T
uacguucuacaaaccugugcc

SEQ ID NO: 41657 - RNA, 22 nt, Shigella flexneri 2a str. 2457T
uacugccauuuucgccaaaugg

SEQ ID NO: 41658 - RNA, 22 nt, Shigella flexneri 2a str. 2457T
uacuggauuggcccgccgggcg

SEQ ID NO: 41659 - RNA, 22 nt, Shigella flexneri 2a str. 2457T
uagcaacuuccgcuuccaugac

SEQ ID NO: 41660 - RNA, 22 nt, Shigella flexneri 2a str. 2457T
uagcagauuuggcugaaggcac

SEQ ID NO: 41661 - RNA, 22 nt, Shigella flexneri 2a str. 2457T
uagccggugaacuugcgccagu

SEQ ID NO: 41662 - RNA, 22 nt, Shigella flexneri 2a str. 2457T
uagcgaacugucgcugcuggaa

SEQ ID NO: 41663 - RNA, 22 nt, Shigella flexneri 2a str. 2457T
uagcucugcuacgucgcaugga

SEQ ID NO: 41664 - RNA, 22 nt, Shigella flexneri 2a str. 2457T
uaggccagauaaggcguuuacg

SEQ ID NO: 41665 - RNA, 22 nt, Shigella flexneri 2a str. 2457T
uaggccggacaaggcguucacg

SEQ ID NO: 41666 - RNA, 22 nt, Shigella flexneri 2a str. 2457T
uaggccggauaaggcguagacg

SEQ ID NO: 41667 - RNA, 22 nt, Shigella flexneri 2a str. 2457T
uaggccggauaaggcguuuacg

SEQ ID NO: 41668 - RNA, 22 nt, Shigella flexneri 2a str. 2457T
uagugcgguuaaccagcgccgc

SEQ ID NO: 41669 - RNA, 22 nt, Shigella flexneri 2a str. 2457T
uauacccuggcgcugcaucguu

SEQ ID NO: 41670 - RNA, 22 nt, Shigella flexneri 2a str. 2457T
uauaucgacguuggugcgacgu

SEQ ID NO: 41671 - RNA, 22 nt, Shigella flexneri 2a str. 2457T
uauccacugugcgccagccuuc

SEQ ID NO: 41672 - RNA, 22 nt, Shigella flexneri 2a str. 2457T
uaugcauaaaaagcagcggcug

SEQ ID NO: 41673 - RNA, 22 nt, Shigella flexneri 2a str. 2457T
uauggcaccaacgcguuacugg

SEQ ID NO: 41674 - RNA, 21 nt, Shigella flexneri 2a str. 2457T
uauuccggccuguucaauaug

SEQ ID NO: 41675 - RNA, 22 nt, Shigella flexneri 2a str. 2457T
uauuccguagcuauaucgacga

SEQ ID NO: 41676 - RNA, 22 nt, Shigella flexneri 2a str. 2457T
uauugcagccguuuuugaggau

SEQ ID NO: 41677 - RNA, 22 nt, Shigella flexneri 2a str. 2457T
uauugcuggugugaaggucugg

SEQ ID NO: 41678 - RNA, 22 nt, Shigella flexneri 2a str. 2457T
uauuggccccgauaauggaaca

SEQ ID NO: 41679 - RNA, 22 nt, Shigella flexneri 2a str. 2457T
uauuucugccccgcaggucugg

SEQ ID NO: 41680 - RNA, 22 nt, Shigella flexneri 2a str. 2457T
ucaaacucccuuuacuuaccuu

SEQ ID NO: 41681 - RNA, 19 nt, Shigella flexneri 2a str. 2457T
ucaacuggcgcaaaacugg

SEQ ID NO: 41682 - RNA, 22 nt, Shigella flexneri 2a str. 2457T
ucaauaagcgcaggcuguugag

SEQ ID NO: 41683 - RNA, 22 nt, Shigella flexneri 2a str. 2457T
ucaaugauggugccucgcuguu

SEQ ID NO: 41684 - RNA, 22 nt, Shigella flexneri 2a str. 2457T
ucacccguuagcacuaucugaa

SEQ ID NO: 41685 - RNA, 22 nt, Shigella flexneri 2a str. 2457T
ucaccgccucucgcguggcagg

SEQ ID NO: 41686 - RNA, 23 nt, Shigella flexneri 2a str. 2457T
ucaccgguauuugaggcuguuuc

SEQ ID NO: 41687 - RNA, 22 nt, Shigella flexneri 2a str. 2457T
ugcccgucagguccguguggua

SEQ ID NO: 41688 - RNA, 22 nt, Shigella flexneri 2a str. 2457T
ugccgcuggcagcagguuuuuc

SEQ ID NO: 41689 - RNA, 22 nt, Shigella flexneri 2a str. 2457T
ugcgacgaugacccaugacgau

SEQ ID NO: 41690 - RNA, 22 nt, Shigella flexneri 2a str. 2457T
ugcgagcgaugucugccggguu

SEQ ID NO: 41691 - RNA, 21 nt, Shigella flexneri 2a str. 2457T
ugcgccaccauucugaaagcc

SEQ ID NO: 41692 - RNA, 22 nt, Shigella flexneri 2a str. 2457T
ugcgcugcgcuuaucaggccua

SEQ ID NO: 41693 - RNA, 22 nt, Shigella flexneri 2a str. 2457T
ugcgcuuuguuuaugucggaug

SEQ ID NO: 41694 - RNA, 21 nt, Shigella flexneri 2a str. 2457T
ugcggcaggguggucugguga

SEQ ID NO: 41695 - RNA, 22 nt, Shigella flexneri 2a str. 2457T
ugcggugauugaacguaguauc

SEQ ID NO: 41696 - RNA, 22 nt, Shigella flexneri 2a str. 2457T
ugcguuaacgcauauguucccg

SEQ ID NO: 41697 - RNA, 22 nt, Shigella flexneri 2a str. 2457T
ugcuacgcgcuguuguugcagu

SEQ ID NO: 41698 - RNA, 22 nt, Shigella flexneri 2a str. 2457T
ugcuagaacgucaucggcuacu

SEQ ID NO: 41699 - RNA, 21 nt, Shigella flexneri 2a str. 2457T
ugcucacgcagcacgucacgc

SEQ ID NO: 41700 - RNA, 20 nt, Shigella flexneri 2a str. 2457T
ugcugcugugacaguucgau

SEQ ID NO: 41701 - RNA, 22 nt, Shigella flexneri 2a str. 2457T
ugcugucgguauuaaaagccaa

SEQ ID NO: 41702 - RNA, 22 nt, Shigella flexneri 2a str. 2457T
uggaaagucacagcccgcgccg

SEQ ID NO: 41703 - RNA, 22 nt, Shigella flexneri 2a str. 2457T
uggacgcugauuuucugcgccc

SEQ ID NO: 41704 - RNA, 18 nt, Shigella flexneri 2a str. 2457T
uggaucgcuacccguuug

SEQ ID NO: 41705 - RNA, 22 nt, Shigella flexneri 2a str. 2457T
uggcagaugauuucgccaauug

SEQ ID NO: 41706 - RNA, 20 nt, Shigella flexneri 2a str. 2457T
uggcagcauauuguguucac

SEQ ID NO: 41707 - RNA, 22 nt, Shigella flexneri 2a str. 2457T
uggcagcgauguuccauaauca

SEQ ID NO: 41708 - RNA, 22 nt, Shigella flexneri 2a str. 2457T
uggcaggccauuggguugagaa

SEQ ID NO: 41709 - RNA, 22 nt, Shigella flexneri 2a str. 2457T
uggcauucgcgugauccagcug

SEQ ID NO: 41710 - RNA, 17 nt, Shigella flexneri 2a str. 2457T
uggcauuuauuuuuacc

SEQ ID NO: 41711 - RNA, 22 nt, Shigella flexneri 2a str. 2457T
uggcauuuugccuuuaggaugu

SEQ ID NO: 41712 - RNA, 22 nt, Shigella flexneri 2a str. 2457T
uggcgauggagcuaaugaccug

SEQ ID NO: 41713 - RNA, 22 nt, Shigella flexneri 2a str. 2457T
uggcggcaaucggugcugcgau

SEQ ID NO: 41714 - RNA, 22 nt, Shigella flexneri 2a str. 2457T
uggcguauuucuaucuucuauu

SEQ ID NO: 41715 - RNA, 22 nt, Shigella flexneri 2a str. 2457T
uggcgucguguagcgaugacca

SEQ ID NO: 41716 - RNA, 22 nt, Shigella flexneri 2a str. 2457T
uggcucucccccauuuacggau

SEQ ID NO: 41717 - RNA, 22 nt, Shigella flexneri 2a str. 2457T
uggcuggcaauacuggcagcag

SEQ ID NO: 41718 - RNA, 22 nt, Shigella flexneri 2a str. 2457T
ugggugccgacacugcgugggu

SEQ ID NO: 41719 - RNA, 22 nt, Shigella flexneri 2a str. 2457T
ugguaagcgcggcaugacguau

SEQ ID NO: 41720 - RNA, 22 nt, Shigella flexneri 2a str. 2457T
uggugaaguuauuaacucagca

SEQ ID NO: 41721 - RNA, 20 nt, Shigella flexneri 2a str. 2457T
ugguuaccggcaaaacaauc

SEQ ID NO: 41722 - RNA, 18 nt, Shigella flexneri 2a str. 2457T
uguacggugucagcccag

SEQ ID NO: 41723 - RNA, 22 nt, Shigella flexneri 2a str. 2457T
uguaggcgggauaaggcguuca

SEQ ID NO: 41724 - RNA, 22 nt, Shigella flexneri 2a str. 2457T
ugucaguggcgguucaaugcgg

SEQ ID NO: 41725 - RNA, 22 nt, Shigella flexneri 2a str. 2457T
ugucgaauaugauuaucggcgc

SEQ ID NO: 41726 - RNA, 22 nt, Shigella flexneri 2a str. 2457T
ugucguuaucaauugcuccggu

SEQ ID NO: 41727 - RNA, 22 nt, Shigella flexneri 2a str. 2457T
ugugaccugcuggaagagaacu

SEQ ID NO: 41728 - RNA, 20 nt, Shigella flexneri 2a str. 2457T
uguggcgcaguauuccgcac

SEQ ID NO: 41729 - RNA, 22 nt, Shigella flexneri 2a str. 2457T
uguugaaacuguagcccguucc

SEQ ID NO: 41730 - RNA, 22 nt, Shigella flexneri 2a str. 2457T
uuaacgccauuugcgccauuga

SEQ ID NO: 41731 - RNA, 22 nt, Shigella flexneri 2a str. 2457T
uuaacugcugagccggugcguu

SEQ ID NO: 41732 - RNA, 22 nt, Shigella flexneri 2a str. 2457T
uuaaucagcgucuguuuacccu

SEQ ID NO: 41733 - RNA, 22 nt, Shigella flexneri 2a str. 2457T
uuacccgaccgagccgcgccau

SEQ ID NO: 41734 - RNA, 22 nt, Shigella flexneri 2a str. 2457T
uuacccggcgcaggcggugaag

SEQ ID NO: 41735 - RNA, 23 nt, Shigella flexneri 2a str. 2457T
uuaccgaugaauuuauucguggu

SEQ ID NO: 41736 - RNA, 22 nt, Shigella flexneri 2a str. 2457T
uuacguucggcgagcaguuguu

SEQ ID NO: 41737 - RNA, 22 nt, Shigella flexneri 2a str. 2457T
uuacugaugcgucugguagugg

SEQ ID NO: 41738 - RNA, 22 nt, Shigella flexneri 2a str. 2457T
uuacugauguugcgaaaacgcu

SEQ ID NO: 41739 - RNA, 22 nt, Shigella flexneri 2a str. 2457T
uuacugcgucagggaaaaccag

SEQ ID NO: 41740 - RNA, 18 nt, Shigella flexneri 2a str. 2457T
uuacugcgugcuuauccu

SEQ ID NO: 41741 - RNA, 22 nt, Shigella flexneri 2a str. 2457T
uuaucggcaggcggaaagccuu

SEQ ID NO: 41742 - RNA, 22 nt, Shigella flexneri 2a str. 2457T
uucagggcuucucccaguacau

SEQ ID NO: 41743 - RNA, 22 nt, Shigella flexneri 2a str. 2457T
uucaguaugcaguggauguacu

SEQ ID NO: 41744 - RNA, 22 nt, Shigella flexneri 2a str. 2457T
uucagucauuggcgugcaucag

SEQ ID NO: 41745 - RNA, 22 nt, Shigella flexneri 2a str. 2457T
uucgaacuggcgcuggcggcag

SEQ ID NO: 41746 - RNA, 22 nt, Shigella flexneri 2a str. 2457T
uucgcccguaugucauuccggu

SEQ ID NO: 41747 - RNA, 22 nt, Shigella flexneri 2a str. 2457T
uucgcggaauguguucgcugau

SEQ ID NO: 41748 - RNA, 22 nt, Shigella flexneri 2a str. 2457T
uucgguauuggucuggcgaaug

SEQ ID NO: 41749 - RNA, 22 nt, Shigella flexneri 2a str. 2457T
uucugaaaacaaccgaugguaa

SEQ ID NO: 41750 - RNA, 22 nt, Shigella flexneri 2a str. 2457T
uucuugaucaacaccugcggau

SEQ ID NO: 41751 - RNA, 22 nt, Shigella flexneri 2a str. 2457T
uugacuguuugucaaagaauga

SEQ ID NO: 41752 - RNA, 22 nt, Shigella flexneri 2a str. 2457T
uugacuuucugacccacuucga

SEQ ID NO: 41753 - RNA, 22 nt, Shigella flexneri 2a str. 2457T
uugagucgaaagucaucauuau

SEQ ID NO: 41754 - RNA, 22 nt, Shigella flexneri 2a str. 2457T
uugcaggcgcgacuggaagcgu

SEQ ID NO: 41755 - RNA, 22 nt, Shigella flexneri 2a str. 2457T
uugcccgcuuacugauuauugg

SEQ ID NO: 41756 - RNA, 22 nt, Shigella flexneri 2a str. 2457T
uugccgagugcgaccgugacag

SEQ ID NO: 41757 - RNA, 22 nt, Shigella flexneri 2a str. 2457T
uugccgcguuuucgacgagguu

SEQ ID NO: 41758 - RNA, 22 nt, Shigella flexneri 2a str. 2457T
uugcggaaguuuaucuggcgau

SEQ ID NO: 41759 - RNA, 22 nt, Shigella flexneri 2a str. 2457T
uugcucauauugaaguugacgc

SEQ ID NO: 41760 - RNA, 22 nt, Shigella flexneri 2a str. 2457T
uugcucugguuguaugcguagu

SEQ ID NO: 41761 - RNA, 18 nt, Shigella flexneri 2a str. 2457T
uugcuguaagcguucaac

SEQ ID NO: 41762 - RNA, 22 nt, Shigella flexneri 2a str. 2457T
uugcugucggaacaagguauca

SEQ ID NO: 41763 - RNA, 22 nt, Shigella flexneri 2a str. 2457T
uuggcacuacgcuuucuggcua

SEQ ID NO: 41764 - RNA, 22 nt, Shigella flexneri 2a str. 2457T
uuggccugaauaucuccacugg

SEQ ID NO: 41765 - RNA, 22 nt, Shigella flexneri 2a str. 2457T
uuguagccaucauuuagcgcuu

SEQ ID NO: 41766 - RNA, 22 nt, Shigella flexneri 2a str. 2457T
uuguaggccggauaaggcguuu

SEQ ID NO: 41767 - RNA, 22 nt, Shigella flexneri 2a str. 2457T
acggccauuuuaugugcuaugu

SEQ ID NO: 41768 - RNA, 22 nt, Shigella flexneri 2a str. 2457T
acggcgguauacaucgcgguga

SEQ ID NO: 41769 - RNA, 22 nt, Shigella flexneri 2a str. 2457T
acggcguuuacccugagccagc

SEQ ID NO: 41770 - RNA, 22 nt, Shigella flexneri 2a str. 2457T
acgguaaaaaaugccgugcgca

SEQ ID NO: 41771 - RNA, 23 nt, Shigella flexneri 2a str. 2457T
acguaagcauuaucggccauuuc

SEQ ID NO: 41772 - RNA, 21 nt, Shigella flexneri 2a str. 2457T
acguauugauacuugaggggc

SEQ ID NO: 41773 - RNA, 20 nt, Shigella flexneri 2a str. 2457T
acgucgauaauauuauuuuc

SEQ ID NO: 41774 - RNA, 22 nt, Shigella flexneri 2a str. 2457T
acguggacguagcggaauaucg

SEQ ID NO: 41775 - RNA, 22 nt, Shigella flexneri 2a str. 2457T
acguuccuccccaccagcuugu

SEQ ID NO: 41776 - RNA, 22 nt, Shigella flexneri 2a str. 2457T
acguugguagguuugugcauuu

SEQ ID NO: 41777 - RNA, 22 nt, Shigella flexneri 2a str. 2457T
acuacuucauuaugagcaaacu

SEQ ID NO: 41778 - RNA, 22 nt, Shigella flexneri 2a str. 2457T
acuaugugacccaucaacacgc

SEQ ID NO: 41779 - RNA, 22 nt, Shigella flexneri 2a str. 2457T
acuccagcaccuguuugaucug

SEQ ID NO: 41780 - RNA, 22 nt, Shigella flexneri 2a str. 2457T
acucugcuggcuugaugaauuu

SEQ ID NO: 41781 - RNA, 22 nt, Shigella flexneri 2a str. 2457T
acugaaaggcgaaggcuucaag

SEQ ID NO: 41782 - RNA, 22 nt, Shigella flexneri 2a str. 2457T
acugcaggacaacaguaaaauc

SEQ ID NO: 41783 - RNA, 22 nt, Shigella flexneri 2a str. 2457T
acugcauccagaggcgaaugca

SEQ ID NO: 41784 - RNA, 22 nt, Shigella flexneri 2a str. 2457T
acuggcaauugccagccacggu

SEQ ID NO: 41785 - RNA, 22 nt, Shigella flexneri 2a str. 2457T
acuuccuguuccgaggaggcga

SEQ ID NO: 41786 - RNA, 22 nt, Shigella flexneri 2a str. 2457T
agaaauuguugcacgccggagg

SEQ ID NO: 41787 - RNA, 22 nt, Shigella flexneri 2a str. 2457T
agaacgcggcgagcagguggca

SEQ ID NO: 41788 - RNA, 22 nt, Shigella flexneri 2a str. 2457T
agaauggcguaucggagcggug

SEQ ID NO: 41789 - RNA, 22 nt, Shigella flexneri 2a str. 2457T
agacgcgaugcauugcucugaa

SEQ ID NO: 41790 - RNA, 22 nt, Shigella flexneri 2a str. 2457T
agagccugcauuacuuucuggc

SEQ ID NO: 41791 - RNA, 22 nt, Shigella flexneri 2a str. 2457T
agagcggcggucugaucacccg

SEQ ID NO: 41792 - RNA, 22 nt, Shigella flexneri 2a str. 2457T
agauuggugucaaucauguguu

SEQ ID NO: 41793 - RNA, 22 nt, Shigella flexneri 2a str. 2457T
agcagcuggcugauggucggaa

SEQ ID NO: 41794 - RNA, 22 nt, Shigella flexneri 2a str. 2457T
agcaggcuucauggauuggcag

SEQ ID NO: 41795 - RNA, 22 nt, Shigella flexneri 2a str. 2457T
agcauucaguugaugaaaucgc

SEQ ID NO: 41796 - RNA, 22 nt, Shigella flexneri 2a str. 2457T
agccacgcgcaguugcccaaag

SEQ ID NO: 41797 - RNA, 23 nt, Shigella flexneri 2a str. 2457T
agccguaacccugcugcaucaga

SEQ ID NO: 41798 - RNA, 23 nt, Shigella flexneri 2a str. 2457T
agcgcaccagcaccgacugagcg

SEQ ID NO: 41799 - RNA, 22 nt, Shigella flexneri 2a str. 2457T
agcgcugggccugucgcagccg

SEQ ID NO: 41800 - RNA, 22 nt, Shigella flexneri 2a str. 2457T
agcggauaauaaaucaucgguu

SEQ ID NO: 41801 - RNA, 22 nt, Shigella flexneri 2a str. 2457T
agcgggauuaucucaagcuggu

SEQ ID NO: 41802 - RNA, 22 nt, Shigella flexneri 2a str. 2457T
agcgucagcguauugcuaucgc

SEQ ID NO: 41803 - RNA, 22 nt, Shigella flexneri 2a str. 2457T
agcguguuacugaauaccugac

SEQ ID NO: 41804 - RNA, 22 nt, Shigella flexneri 2a str. 2457T
agcguucugaucugucugcgga

SEQ ID NO: 41805 - RNA, 22 nt, Shigella flexneri 2a str. 2457T
agcucaauaagacagguucuac

SEQ ID NO: 41806 - RNA, 19 nt, Shigella flexneri 2a str. 2457T
agcucaaucugguacagcu

SEQ ID NO: 41807 - RNA, 22 nt, Shigella flexneri 2a str. 2457T
agcugcugacgcaccaguucua

SEQ ID NO: 41808 - RNA, 22 nt, Shigella flexneri 2a str. 2457T
agcuguaauuucccgcguuugu

SEQ ID NO: 41809 - RNA, 22 nt, Shigella flexneri 2a str. 2457T
aggaauauucaggcucugacug

SEQ ID NO: 41810 - RNA, 22 nt, Shigella flexneri 2a str. 2457T
aggaauugcaggguaaaauuca

SEQ ID NO: 41811 - RNA, 22 nt, Shigella flexneri 2a str. 2457T
aggagcgcuccagccccuucga

SEQ ID NO: 41812 - RNA, 22 nt, Shigella flexneri 2a str. 2457T
aggccggauaagcgaagcgcau

SEQ ID NO: 41813 - RNA, 22 nt, Shigella flexneri 2a str. 2457T
aggccggauaaggcguucacgc

SEQ ID NO: 41814 - RNA, 22 nt, Shigella flexneri 2a str. 2457T
aggcgcauuuccgguauccaua

SEQ ID NO: 41815 - RNA, 22 nt, Shigella flexneri 2a str. 2457T
aggcgcucuggcggcgaacuga

SEQ ID NO: 41816 - RNA, 22 nt, Shigella flexneri 2a str. 2457T
aggcuuuccgccugccgauaac

SEQ ID NO: 41817 - RNA, 22 nt, Shigella flexneri 2a str. 2457T
agggucgguugugcaguugcau

SEQ ID NO: 41818 - RNA, 22 nt, Shigella flexneri 2a str. 2457T
aggguucuacuguuauagggau

SEQ ID NO: 41819 - RNA, 19 nt, Shigella flexneri 2a str. 2457T
agguaaacgucgucugguu

SEQ ID NO: 41820 - RNA, 22 nt, Shigella flexneri 2a str. 2457T
aggugcguaauaagcugguggc

SEQ ID NO: 41821 - RNA, 22 nt, Shigella flexneri 2a str. 2457T
agucaauauuuauucauggaau

SEQ ID NO: 41822 - RNA, 22 nt, Shigella flexneri 2a str. 2457T
agucauuaccuaagauuaagau

SEQ ID NO: 41823 - RNA, 22 nt, Shigella flexneri 2a str. 2457T
agucgcgauagugcuuuuucag

SEQ ID NO: 41824 - RNA, 22 nt, Shigella flexneri 2a str. 2457T
agugaccgggguggagaaacgc

SEQ ID NO: 41825 - RNA, 22 nt, Shigella flexneri 2a str. 2457T
agugaugaaaacgaaggccgga

SEQ ID NO: 41826 - RNA, 22 nt, Shigella flexneri 2a str. 2457T
agugauuaacgucucuuucaga

SEQ ID NO: 41827 - RNA, 22 nt, Shigella flexneri 2a str. 2457T
aguggcaacgcugcguugaagc

SEQ ID NO: 41828 - RNA, 22 nt, Shigella flexneri 2a str. 2457T
aguguauaaaaaauggcgucaa

SEQ ID NO: 41829 - RNA, 22 nt, Shigella flexneri 2a str. 2457T
aguuaacguuagcgaaugaagu

SEQ ID NO: 41830 - RNA, 22 nt, Shigella flexneri 2a str. 2457T
aguuacacgcccguauccgcgc

SEQ ID NO: 41831 - RNA, 22 nt, Shigella flexneri 2a str. 2457T
aguuuacaacgcauuguuaaag

SEQ ID NO: 41832 - RNA, 22 nt, Shigella flexneri 2a str. 2457T
auaaacugccuggugcgguucu

SEQ ID NO: 41833 - RNA, 22 nt, Shigella flexneri 2a str. 2457T
auaacagucaugaugaugaggu

SEQ ID NO: 41834 - RNA, 22 nt, Shigella flexneri 2a str. 2457T
auaaccgaagccguuaccgcgc

SEQ ID NO: 41835 - RNA, 22 nt, Shigella flexneri 2a str. 2457T
auacaccgggccugcauaugga

SEQ ID NO: 41836 - RNA, 22 nt, Shigella flexneri 2a str. 2457T
auacaucguggggugccaugga

SEQ ID NO: 41837 - RNA, 22 nt, Shigella flexneri 2a str. 2457T
auacgucacuucaacuaugcug

SEQ ID NO: 41838 - RNA, 22 nt, Shigella flexneri 2a str. 2457T
auaguuacuggugucugcuucu

SEQ ID NO: 41839 - RNA, 20 nt, Shigella flexneri 2a str. 2457T
auaguugucagacguuuagc

SEQ ID NO: 41840 - RNA, 22 nt, Shigella flexneri 2a str. 2457T
auaucuguugaugccaacguau

SEQ ID NO: 41841 - RNA, 22 nt, Shigella flexneri 2a str. 2457T
auaugguaaucaacaauggccg

SEQ ID NO: 41842 - RNA, 21 nt, Shigella flexneri 2a str. 2457T
aucacgauccgcgcguugcag

SEQ ID NO: 41843 - RNA, 22 nt, Shigella flexneri 2a str. 2457T
aucacgaugguggaaaucgaug

SEQ ID NO: 41844 - RNA, 22 nt, Shigella flexneri 2a str. 2457T
aucacucaucaauaaauauuau

SEQ ID NO: 41845 - RNA, 22 nt, Shigella flexneri 2a str. 2457T
aucaucaauucaaacugaguau

SEQ ID NO: 41846 - RNA, 22 nt, Shigella flexneri 2a str. 2457T
aucccuauaacaguagaacccu

SEQ ID NO: 41847 - RNA, 22 nt, Shigella flexneri 2a str. 2457T
auccggcauauuaguuuacgcc

SEQ ID NO: 41848 - RNA, 22 nt, Shigella flexneri 2a str. 2457T
auccggcaugaagcaacguauu

SEQ ID NO: 41849 - RNA, 22 nt, Shigella flexneri 2a str. 2457T
auccgguaucguggcuuauuca

SEQ ID NO: 41850 - RNA, 22 nt, Shigella flexneri 2a str. 2457T
aucgauaaaguaaugacccgcc

SEQ ID NO: 41851 - RNA, 22 nt, Shigella flexneri 2a str. 2457T
aucgcaaucgaaacaaucggug

SEQ ID NO: 41852 - RNA, 22 nt, Shigella flexneri 2a str. 2457T
aucgcccaguucaccgcgaaga

SEQ ID NO: 41853 - RNA, 22 nt, Shigella flexneri 2a str. 2457T
aucgccucuuccugaucguggg

SEQ ID NO: 41854 - RNA, 22 nt, Shigella flexneri 2a str. 2457T
aucgcugauauuaaagccacaa

SEQ ID NO: 41855 - RNA, 22 nt, Shigella flexneri 2a str. 2457T
aucggaggaaaaaaugucucgu

SEQ ID NO: 41856 - RNA, 22 nt, Shigella flexneri 2a str. 2457T
aucggauggucgaacggcggca

SEQ ID NO: 41857 - RNA, 22 nt, Shigella flexneri 2a str. 2457T
aucggcguggcggucaugauca

SEQ ID NO: 41858 - RNA, 22 nt, Shigella flexneri 2a str. 2457T
aucggcuuuacuaacgucgaua

SEQ ID NO: 41859 - RNA, 22 nt, Shigella flexneri 2a str. 2457T
aucguuugugaccacagucagu

SEQ ID NO: 41860 - RNA, 22 nt, Shigella flexneri 2a str. 2457T
aucugacggauaaaaaucgcga

SEQ ID NO: 41861 - RNA, 22 nt, Shigella flexneri 2a str. 2457T
aucugaguuuaugggaauaaau

SEQ ID NO: 41862 - RNA, 20 nt, Shigella flexneri 2a str. 2457T
aucuggcauaaacaaagcgc

SEQ ID NO: 41863 - RNA, 22 nt, Shigella flexneri 2a str. 2457T
aucugguaucgacgcagguaug

SEQ ID NO: 41864 - RNA, 22 nt, Shigella flexneri 2a str. 2457T
aucuuugcacugcuuaaccaug

SEQ ID NO: 41865 - RNA, 22 nt, Shigella flexneri 2a str. 2457T
augaaacgcauauuuaccgcag

SEQ ID NO: 41866 - RNA, 22 nt, Shigella flexneri 2a str. 2457T
augaguauuuagacuaaagagu

SEQ ID NO: 41867 - RNA, 22 nt, Shigella flexneri 2a str. 2457T
augcaguguaaacgucuuaucc

SEQ ID NO: 41868 - RNA, 22 nt, Shigella flexneri 2a str. 2457T
augccgcuuacucaagaagaaa

SEQ ID NO: 41869 - RNA, 22 nt, Shigella flexneri 2a str. 2457T
augccgguuaacugacuauauu

SEQ ID NO: 41870 - RNA, 22 nt, Shigella flexneri 2a str. 2457T
augcgcggauauugguggugcg

SEQ ID NO: 41871 - RNA, 22 nt, Shigella flexneri 2a str. 2457T
augcgucucugaacaggcggcc

SEQ ID NO: 41872 - RNA, 22 nt, Shigella flexneri 2a str. 2457T
augcguuucagccacgcguuug

SEQ ID NO: 41873 - RNA, 22 nt, Shigella flexneri 2a str. 2457T
augcguuucgcuuaucugaccu

SEQ ID NO: 41874 - RNA, 22 nt, Shigella flexneri 2a str. 2457T
augcuggcagucacuggugggc

SEQ ID NO: 41875 - RNA, 22 nt, Shigella flexneri 2a str. 2457T
auggccgccccgguuggggacg

SEQ ID NO: 41876 - RNA, 22 nt, Shigella flexneri 2a str. 2457T
auggccuuucgcuugauuugau

SEQ ID NO: 41877 - RNA, 23 nt, Shigella flexneri 2a str. 2457T
auggcgauauggaaggcauuccg

SEQ ID NO: 41878 - RNA, 22 nt, Shigella flexneri 2a str. 2457T
auggcgaucagaucauguauau

SEQ ID NO: 41879 - RNA, 22 nt, Shigella flexneri 2a str. 2457T
auggcgauguagucuuucacgc

SEQ ID NO: 41880 - RNA, 22 nt, Shigella flexneri 2a str. 2457T
augugcggacggccuucaugca

SEQ ID NO: 41881 - RNA, 22 nt, Shigella flexneri 2a str. 2457T
auuacagacugcccgcuugugg

SEQ ID NO: 41882 - RNA, 22 nt, Shigella flexneri 2a str. 2457T
auuaucaggucaugcguaccga

SEQ ID NO: 41883 - RNA, 22 nt, Shigella flexneri 2a str. 2457T
auuccgugcgccaaagugugcc

SEQ ID NO: 41884 - RNA, 20 nt, Shigella flexneri 2a str. 2457T
auucgccgucuguugcuggu

SEQ ID NO: 41885 - RNA, 22 nt, Shigella flexneri 2a str. 2457T
auucucugccaguacguugaau

SEQ ID NO: 41886 - RNA, 22 nt, Shigella flexneri 2a str. 2457T
auugauguguauucuugcaguu

SEQ ID NO: 41887 - RNA, 22 nt, Shigella flexneri 2a str. 2457T
auuggcaucugguacaacaauu

SEQ ID NO: 41888 - RNA, 22 nt, Shigella flexneri 2a str. 2457T
auuggcgcucagcggcugggca

SEQ ID NO: 41889 - RNA, 22 nt, Shigella flexneri 2a str. 2457T
auuguucacgcuugauccacac

SEQ ID NO: 41890 - RNA, 22 nt, Shigella flexneri 2a str. 2457T
caaacguggggugaauaaucgc

SEQ ID NO: 41891 - RNA, 22 nt, Shigella flexneri 2a str. 2457T
caacgcgcggugaugaugcagg

SEQ ID NO: 41892 - RNA, 22 nt, Shigella flexneri 2a str. 2457T
caagauacgaaacgggugcuga

SEQ ID NO: 41893 - RNA, 22 nt, Shigella flexneri 2a str. 2457T
caagcgccaguugucaucuucc

SEQ ID NO: 41894 - RNA, 19 nt, Shigella flexneri 2a str. 2457T
caauagugaagaacggcug

SEQ ID NO: 41895 - RNA, 22 nt, Shigella flexneri 2a str. 2457T
cacaggcgacgaaccguuucca

SEQ ID NO: 41896 - RNA, 22 nt, Shigella flexneri 2a str. 2457T
caccgcuguuagucagaacugu

SEQ ID NO: 41897 - RNA, 22 nt, Shigella flexneri 2a str. 2457T
cagaacuggugauacagcggcu

SEQ ID NO: 41898 - RNA, 22 nt, Shigella flexneri 2a str. 2457T
cagauugauuaucaacuggaug

SEQ ID NO: 41899 - RNA, 22 nt, Shigella flexneri 2a str. 2457T
cagauuucauucacuacgccau

SEQ ID NO: 41900 - RNA, 22 nt, Shigella flexneri 2a str. 2457T
cagcaguucgcgaauacgcugc

SEQ ID NO: 41901 - RNA, 22 nt, Shigella flexneri 2a str. 2457T
cagcaugauggauguuccggua

SEQ ID NO: 41902 - RNA, 22 nt, Shigella flexneri 2a str. 2457T
cagccgguaagccugcuuuuca

SEQ ID NO: 41903 - RNA, 22 nt, Shigella flexneri 2a str. 2457T
cagcgaggcaccaucauugaga

SEQ ID NO: 41904 - RNA, 22 nt, Shigella flexneri 2a str. 2457T
cagcgucuggaaaaccgcgaau

SEQ ID NO: 41905 - RNA, 22 nt, Shigella flexneri 2a str. 2457T
cagcucgauaaacccuuuuuca

SEQ ID NO: 41906 - RNA, 22 nt, Shigella flexneri 2a str. 2457T
caggaguuggcgaugaaugacc

SEQ ID NO: 41907 - RNA, 22 nt, Shigella flexneri 2a str. 2457T
caggccuacaucgugcauugaa

SEQ ID NO: 41908 - RNA, 22 nt, Shigella flexneri 2a str. 2457T
caggccuacaugauuucugcaa

SEQ ID NO: 41909 - RNA, 22 nt, Shigella flexneri 2a str. 2457T
caggucgauaaauauaccuggc

SEQ ID NO: 41910 - RNA, 22 nt, Shigella flexneri 2a str. 2457T
caggugguuagagcgcaccccu

SEQ ID NO: 41911 - RNA, 22 nt, Shigella flexneri 2a str. 2457T
caguacguuucuauuccgguug

SEQ ID NO: 41912 - RNA, 22 nt, Shigella flexneri 2a str. 2457T
caguauuugccgccagagauga

SEQ ID NO: 41913 - RNA, 22 nt, Shigella flexneri 2a str. 2457T
cagucagugguuugcccuucuu

SEQ ID NO: 41914 - RNA, 22 nt, Shigella flexneri 2a str. 2457T
caguuaguguuucgcguugaga

SEQ ID NO: 41915 - RNA, 22 nt, Shigella flexneri 2a str. 2457T
caucagcguguaccagucuuuu

SEQ ID NO: 41916 - RNA, 22 nt, Shigella flexneri 2a str. 2457T
caucaggcaauguugcguuugu

SEQ ID NO: 41917 - RNA, 22 nt, Shigella flexneri 2a str. 2457T
cauccugagaagcuugcaguga

SEQ ID NO: 41918 - RNA, 22 nt, Shigella flexneri 2a str. 2457T
cauccugagacacgugcagugg

SEQ ID NO: 41919 - RNA, 22 nt, Shigella flexneri 2a str. 2457T
caucgcuggggauugguauuuu

SEQ ID NO: 41920 - RNA, 23 nt, Shigella flexneri 2a str. 2457T
gugauagcccgauucugauucug

SEQ ID NO: 41921 - RNA, 22 nt, Shigella flexneri 2a str. 2457T
gugauagcggguuuacucauua

SEQ ID NO: 41922 - RNA, 22 nt, Shigella flexneri 2a str. 2457T
gugauccgauucgcguuaaugc

SEQ ID NO: 41923 - RNA, 21 nt, Shigella flexneri 2a str. 2457T
gugauugccgauuguggcugc

SEQ ID NO: 41924 - RNA, 22 nt, Shigella flexneri 2a str. 2457T
gugcaaccgguuguugcggcug

SEQ ID NO: 41925 - RNA, 22 nt, Shigella flexneri 2a str. 2457T
gugcaacucaggcaucauggcg

SEQ ID NO: 41926 - RNA, 22 nt, Shigella flexneri 2a str. 2457T
gugcgcuggguaucagaaaugg

SEQ ID NO: 41927 - RNA, 22 nt, Shigella flexneri 2a str. 2457T
gugcgcuguauauuaccuuuau

SEQ ID NO: 41928 - RNA, 22 nt, Shigella flexneri 2a str. 2457T
gugcggaugagaucgugaaacu

SEQ ID NO: 41929 - RNA, 22 nt, Shigella flexneri 2a str. 2457T
gugcugccgaauccguuuuauc

SEQ ID NO: 41930 - RNA, 22 nt, Shigella flexneri 2a str. 2457T
guggauacaguaucugcugagc

SEQ ID NO: 41931 - RNA, 22 nt, Shigella flexneri 2a str. 2457T
gugggaauacgugucagcgauc

SEQ ID NO: 41932 - RNA, 22 nt, Shigella flexneri 2a str. 2457T
gugggcgacgccaggcugaaug

SEQ ID NO: 41933 - RNA, 22 nt, Shigella flexneri 2a str. 2457T
gugguuacauuguuaucguccc

SEQ ID NO: 41934 - RNA, 22 nt, Shigella flexneri 2a str. 2457T
gugucgauaaccagacuguuac

SEQ ID NO: 41935 - RNA, 22 nt, Shigella flexneri 2a str. 2457T
gugucgaugauaugcagcggca

SEQ ID NO: 41936 - RNA, 22 nt, Shigella flexneri 2a str. 2457T
guuagcgccaaucgauacguug

SEQ ID NO: 41937 - RNA, 22 nt, Shigella flexneri 2a str. 2457T
guuaucgacguauuccagacgg

SEQ ID NO: 41938 - RNA, 22 nt, Shigella flexneri 2a str. 2457T
guucaggauaagaaauuuagcg

SEQ ID NO: 41939 - RNA, 22 nt, Shigella flexneri 2a str. 2457T
guuccggcaguuauuguggcga

SEQ ID NO: 41940 - RNA, 22 nt, Shigella flexneri 2a str. 2457T
guucgaaaagcaaaaaggccau

SEQ ID NO: 41941 - RNA, 22 nt, Shigella flexneri 2a str. 2457T
guucgauucaccgauaugcauc

SEQ ID NO: 41942 - RNA, 22 nt, Shigella flexneri 2a str. 2457T
guugcagcguuuucggcaacgc

SEQ ID NO: 41943 - RNA, 22 nt, Shigella flexneri 2a str. 2457T
guuggccgcaucagauuuauca

SEQ ID NO: 41944 - RNA, 22 nt, Shigella flexneri 2a str. 2457T
guugugaaguaauacaaaacag

SEQ ID NO: 41945 - RNA, 23 nt, Shigella flexneri 2a str. 2457T
guuuacccaaugaagaugcgccg

SEQ ID NO: 41946 - RNA, 22 nt, Shigella flexneri 2a str. 2457T
guuucacuccaaccuguucaag

SEQ ID NO: 41947 - RNA, 22 nt, Shigella flexneri 2a str. 2457T
uaaaccgaugguggugaugacc

SEQ ID NO: 41948 - RNA, 22 nt, Shigella flexneri 2a str. 2457T
uaaagcaccgcggccuuuuuug

SEQ ID NO: 41949 - RNA, 22 nt, Shigella flexneri 2a str. 2457T
uaaauggugggagugcgcuucc

SEQ ID NO: 41950 - RNA, 22 nt, Shigella flexneri 2a str. 2457T
uaacccgcugcauugccaccgc

SEQ ID NO: 41951 - RNA, 22 nt, Shigella flexneri 2a str. 2457T
uaacggcagugaagauucgugg

SEQ ID NO: 41952 - RNA, 22 nt, Shigella flexneri 2a str. 2457T
uaacggcgaucgcgccagcgga

SEQ ID NO: 41953 - RNA, 23 nt, Shigella flexneri 2a str. 2457T
uaacugaggugauuaugggcuuc

SEQ ID NO: 41954 - RNA, 20 nt, Shigella flexneri 2a str. 2457T
uaaggccaaagucuucaguu

SEQ ID NO: 41955 - RNA, 22 nt, Shigella flexneri 2a str. 2457T
uacaucaacaaacuccgacgcc

SEQ ID NO: 41956 - RNA, 22 nt, Shigella flexneri 2a str. 2457T
uacaugccaaagauguuuugau

SEQ ID NO: 41957 - RNA, 23 nt, Shigella flexneri 2a str. 2457T
uaccgcuaucagcgucgccgcag

SEQ ID NO: 41958 - RNA, 19 nt, Shigella flexneri 2a str. 2457T
uaccggacaugauuacugc

SEQ ID NO: 41959 - RNA, 22 nt, Shigella flexneri 2a str. 2457T
uaccgguacucuguuacugcug

SEQ ID NO: 41960 - RNA, 22 nt, Shigella flexneri 2a str. 2457T
uaccguuacgcugcggugccag

SEQ ID NO: 41961 - RNA, 22 nt, Shigella flexneri 2a str. 2457T
uacgacgcacuuuaugaggucc

SEQ ID NO: 41962 - RNA, 22 nt, Shigella flexneri 2a str. 2457T
uacgaggucaacggagcggaca

SEQ ID NO: 41963 - RNA, 22 nt, Shigella flexneri 2a str. 2457T
uacgcuguggaagcauugccag

SEQ ID NO: 41964 - RNA, 22 nt, Shigella flexneri 2a str. 2457T
uacgcuuaucaggccuacagag

SEQ ID NO: 41965 - RNA, 22 nt, Shigella flexneri 2a str. 2457T
uacgcuuguugaguggugccga

SEQ ID NO: 41966 - RNA, 22 nt, Shigella flexneri 2a str. 2457T
uacggcaggcgaggcggaucau

SEQ ID NO: 41967 - RNA, 22 nt, Shigella flexneri 2a str. 2457T
uacgugcguucggaaaugcagg

SEQ ID NO: 41968 - RNA, 22 nt, Shigella flexneri 2a str. 2457T
uacguuauccaucaccagaauc

SEQ ID NO: 41969 - RNA, 22 nt, Shigella flexneri 2a str. 2457T
uacuauagggaguuggaguaaa

SEQ ID NO: 41970 - RNA, 22 nt, Shigella flexneri 2a str. 2457T
uacucaaacauuagcugggccu

SEQ ID NO: 41971 - RNA, 23 nt, Shigella flexneri 2a str. 2457T
uacucggcagcauuuuuaaccgg

SEQ ID NO: 41972 - RNA, 22 nt, Shigella flexneri 2a str. 2457T
uacuggagguggaagggaugaa

SEQ ID NO: 41973 - RNA, 22 nt, Shigella flexneri 2a str. 2457T
uagaagacucggucacucaggu

SEQ ID NO: 41974 - RNA, 22 nt, Shigella flexneri 2a str. 2457T
uagaugcguuuucacccgcugg

SEQ ID NO: 41975 - RNA, 22 nt, Shigella flexneri 2a str. 2457T
uagcggacgucgacuacuggaa

SEQ ID NO: 41976 - RNA, 22 nt, Shigella flexneri 2a str. 2457T
uagcgucaggcgcauugccugc

SEQ ID NO: 41977 - RNA, 22 nt, Shigella flexneri 2a str. 2457T
uagcugaaauggcaucgcgugc

SEQ ID NO: 41978 - RNA, 22 nt, Shigella flexneri 2a str. 2457T
uagucauucacaccgaccugaa

SEQ ID NO: 41979 - RNA, 22 nt, Shigella flexneri 2a str. 2457T
uaucaggccuacagcaggcauu

SEQ ID NO: 41980 - RNA, 22 nt, Shigella flexneri 2a str. 2457T
uaucaggcuugggcaguguuag

SEQ ID NO: 41981 - RNA, 23 nt, Shigella flexneri 2a str. 2457T
uauccgaccuacaaaaccgugca

SEQ ID NO: 41982 - RNA, 22 nt, Shigella flexneri 2a str. 2457T
uauccggcauacgauuuuauuc

SEQ ID NO: 41983 - RNA, 22 nt, Shigella flexneri 2a str. 2457T
uaucgagaucggcauacgccgu

SEQ ID NO: 41984 - RNA, 22 nt, Shigella flexneri 2a str. 2457T
uaucgucggguaugggcgcugc

SEQ ID NO: 41985 - RNA, 22 nt, Shigella flexneri 2a str. 2457T
uaucgucugauuaugaagagcg

SEQ ID NO: 41986 - RNA, 20 nt, Shigella flexneri 2a str. 2457T
uaucgugauuuguaaucgcc

SEQ ID NO: 41987 - RNA, 19 nt, Shigella flexneri 2a str. 2457T
uaucuggccuacaaagggc

SEQ ID NO: 41988 - RNA, 22 nt, Shigella flexneri 2a str. 2457T
uaucugugaugccagcgaugau

SEQ ID NO: 41989 - RNA, 22 nt, Shigella flexneri 2a str. 2457T
uaugcacugugaagauccgggc

SEQ ID NO: 41990 - RNA, 22 nt, Shigella flexneri 2a str. 2457T
uauucucguuccgcgcaacacg

SEQ ID NO: 41991 - RNA, 22 nt, Shigella flexneri 2a str. 2457T
ucaaugucauugguuggcagua

SEQ ID NO: 41992 - RNA, 22 nt, Shigella flexneri 2a str. 2457T
ucaccacguuucaggacaaacg

SEQ ID NO: 41993 - RNA, 17 nt, Shigella flexneri 2a str. 2457T
ucaccagcugguuauca

SEQ ID NO: 41994 - RNA, 22 nt, Shigella flexneri 2a str. 2457T
ucaccauuugccgaugcguuuu

SEQ ID NO: 41995 - RNA, 22 nt, Shigella flexneri 2a str. 2457T
ucaccguauucuggaaagcaug

SEQ ID NO: 41996 - RNA, 22 nt, Shigella flexneri 2a str. 2457T
ucaccugaucgucgccguacug

SEQ ID NO: 41997 - RNA, 22 nt, Shigella flexneri 2a str. 2457T
ucacguuaucgcccaguucaac

SEQ ID NO: 41998 - RNA, 22 nt, Shigella flexneri 2a str. 2457T
ucagcgacaacucuugcugagc

SEQ ID NO: 41999 - RNA, 22 nt, Shigella flexneri 2a str. 2457T
ucaggcaaaugccaguaaaaac

SEQ ID NO: 42000 - RNA, 22 nt, Shigella flexneri 2a str. 2457T
ugcaccuuuaacagguuagcuc

SEQ ID NO: 42001 - RNA, 22 nt, Shigella flexneri 2a str. 2457T
ugcacgcgguggaagcuuucuu

SEQ ID NO: 42002 - RNA, 22 nt, Shigella flexneri 2a str. 2457T
ugcacgcugggugagaaacugc

SEQ ID NO: 42003 - RNA, 22 nt, Shigella flexneri 2a str. 2457T
ugcacgguaaauucgccaggac

SEQ ID NO: 42004 - RNA, 22 nt, Shigella flexneri 2a str. 2457T
ugcagacguugauugaacagcu

SEQ ID NO: 42005 - RNA, 22 nt, Shigella flexneri 2a str. 2457T
ugcaggacgcacagauucugca

SEQ ID NO: 42006 - RNA, 22 nt, Shigella flexneri 2a str. 2457T
ugcaucacaaaccugaaaagaa

SEQ ID NO: 42007 - RNA, 22 nt, Shigella flexneri 2a str. 2457T
ugcaugugggugaagcgccaaa

SEQ ID NO: 42008 - RNA, 22 nt, Shigella flexneri 2a str. 2457T
ugcauuauaugcuguaggccug

SEQ ID NO: 42009 - RNA, 22 nt, Shigella flexneri 2a str. 2457T
ugcauugcugguacuuucacag

SEQ ID NO: 42010 - RNA, 22 nt, Shigella flexneri 2a str. 2457T
ugccaaugcacagcauuuugcu

SEQ ID NO: 42011 - RNA, 22 nt, Shigella flexneri 2a str. 2457T
ugccacaaauacugaaagccgc

SEQ ID NO: 42012 - RNA, 22 nt, Shigella flexneri 2a str. 2457T
ugcccuggaacuucucgucugu

SEQ ID NO: 42013 - RNA, 22 nt, Shigella flexneri 2a str. 2457T
ugccgacaggguggcugugcga

SEQ ID NO: 42014 - RNA, 22 nt, Shigella flexneri 2a str. 2457T
ugccgcaggaaagcacuuugcc

SEQ ID NO: 42015 - RNA, 22 nt, Shigella flexneri 2a str. 2457T
ugccgccaucgggauugcuaug

SEQ ID NO: 42016 - RNA, 22 nt, Shigella flexneri 2a str. 2457T
ugccgcucuucuuuaccgguug

SEQ ID NO: 42017 - RNA, 22 nt, Shigella flexneri 2a str. 2457T
ugccggaugucuggagcuggcu

SEQ ID NO: 42018 - RNA, 22 nt, Shigella flexneri 2a str. 2457T
ugccggucuggucaucggcagu

SEQ ID NO: 42019 - RNA, 20 nt, Shigella flexneri 2a str. 2457T
ugccgugggacaguuugcug

SEQ ID NO: 42020 - RNA, 22 nt, Shigella flexneri 2a str. 2457T
ugccucugauaauuagcuaagu

SEQ ID NO: 42021 - RNA, 22 nt, Shigella flexneri 2a str. 2457T
ugcgacagcguuguccucgcgg

SEQ ID NO: 42022 - RNA, 22 nt, Shigella flexneri 2a str. 2457T
ugcgugauuauguaggccggau

SEQ ID NO: 42023 - RNA, 22 nt, Shigella flexneri 2a str. 2457T
ugcucaaauccgcguucaagga

SEQ ID NO: 42024 - RNA, 22 nt, Shigella flexneri 2a str. 2457T
ugcuccauggugggaucggguu

SEQ ID NO: 42025 - RNA, 22 nt, Shigella flexneri 2a str. 2457T
ugcuccggcacguaaggcuaac

SEQ ID NO: 42026 - RNA, 22 nt, Shigella flexneri 2a str. 2457T
ugcugaguuuccgcgcuuaucu

SEQ ID NO: 42027 - RNA, 22 nt, Shigella flexneri 2a str. 2457T
ugcugaugaagaaggucauauc

SEQ ID NO: 42028 - RNA, 22 nt, Shigella flexneri 2a str. 2457T
ugcugcacgccggucauaauga

SEQ ID NO: 42029 - RNA, 22 nt, Shigella flexneri 2a str. 2457T
ugcuggauaugaccaucgaaga

SEQ ID NO: 42030 - RNA, 23 nt, Shigella flexneri 2a str. 2457T
ugcuggcgagagagugucagguu

SEQ ID NO: 42031 - RNA, 22 nt, Shigella flexneri 2a str. 2457T
uggaagcgaucaaacugcuggc

SEQ ID NO: 42032 - RNA, 22 nt, Shigella flexneri 2a str. 2457T
uggaaugauauaaaagaucgcc

SEQ ID NO: 42033 - RNA, 22 nt, Shigella flexneri 2a str. 2457T
uggagcauggcaauauuuugcc

SEQ ID NO: 42034 - RNA, 23 nt, Shigella flexneri 2a str. 2457T
uggagugaaacgauggcgauugc

SEQ ID NO: 42035 - RNA, 22 nt, Shigella flexneri 2a str. 2457T
uggcaauuggugagcuaagcgu

SEQ ID NO: 42036 - RNA, 22 nt, Shigella flexneri 2a str. 2457T
uggcacaaugguuaacguguca

SEQ ID NO: 42037 - RNA, 22 nt, Shigella flexneri 2a str. 2457T
uggcaugguguggaguauucgu

SEQ ID NO: 42038 - RNA, 22 nt, Shigella flexneri 2a str. 2457T
uggcgcguggccacaucaucaa

SEQ ID NO: 42039 - RNA, 22 nt, Shigella flexneri 2a str. 2457T
uggcucuggaagcgggguugcu

SEQ ID NO: 42040 - RNA, 22 nt, Shigella flexneri 2a str. 2457T
uggcuuaucgcgcggcagaaau

SEQ ID NO: 42041 - RNA, 22 nt, Shigella flexneri 2a str. 2457T
ugggcgaagcguuaaccggcau

SEQ ID NO: 42042 - RNA, 22 nt, Shigella flexneri 2a str. 2457T
ugguaaugacaagccgcgucuc

SEQ ID NO: 42043 - RNA, 23 nt, Shigella flexneri 2a str. 2457T
ugguugaccgcaguuuugccgcc

SEQ ID NO: 42044 - RNA, 22 nt, Shigella flexneri 2a str. 2457T
uguaccuucaccguuggcggca

SEQ ID NO: 42045 - RNA, 22 nt, Shigella flexneri 2a str. 2457T
ugucguucugccgucaguaucu

SEQ ID NO: 42046 - RNA, 22 nt, Shigella flexneri 2a str. 2457T
ugucugucucugggccuugaua

SEQ ID NO: 42047 - RNA, 20 nt, Shigella flexneri 2a str. 2457T
ugugcugccccguggcuuuu

SEQ ID NO: 42048 - RNA, 22 nt, Shigella flexneri 2a str. 2457T
uguuaugacuuacgcuuuccag

SEQ ID NO: 42049 - RNA, 22 nt, Shigella flexneri 2a str. 2457T
uguucgcuuuggucugccagcg

SEQ ID NO: 42050 - RNA, 22 nt, Shigella flexneri 2a str. 2457T
uguuggcaaucugcugcgccgu

SEQ ID NO: 42051 - RNA, 22 nt, Shigella flexneri 2a str. 2457T
uguuugccagcgauaugaguaa

SEQ ID NO: 42052 - RNA, 22 nt, Shigella flexneri 2a str. 2457T
uuaaacugaacauugaagcuaa

SEQ ID NO: 42053 - RNA, 19 nt, Shigella flexneri 2a str. 2457T
uuaacgccgaucgcaucgg

SEQ ID NO: 42054 - RNA, 22 nt, Shigella flexneri 2a str. 2457T
uuaaggaauugcugcccggaaa

SEQ ID NO: 42055 - RNA, 23 nt, Shigella flexneri 2a str. 2457T
uuaccgacaaaaugaccagcgcc

SEQ ID NO: 42056 - RNA, 22 nt, Shigella flexneri 2a str. 2457T
uuacggaacauagcacgaccca

SEQ ID NO: 42057 - RNA, 22 nt, Shigella flexneri 2a str. 2457T
uuacgugaucgccuugcucaau

SEQ ID NO: 42058 - RNA, 22 nt, Shigella flexneri 2a str. 2457T
uuacuguacgauuucagucaaa

SEQ ID NO: 42059 - RNA, 22 nt, Shigella flexneri 2a str. 2457T
uuagcaucuuuuguucagcugg

SEQ ID NO: 42060 - RNA, 22 nt, Shigella flexneri 2a str. 2457T
uuagccgaccagguggcgauga

SEQ ID NO: 42061 - RNA, 22 nt, Shigella flexneri 2a str. 2457T
uuagcgacccauuuugccgguu

SEQ ID NO: 42062 - RNA, 22 nt, Shigella flexneri 2a str. 2457T
uuagguaauaucucagcuuauc

SEQ ID NO: 42063 - RNA, 21 nt, Shigella flexneri 2a str. 2457T
uuaucgacgagcagaaagccu

SEQ ID NO: 42064 - RNA, 22 nt, Shigella flexneri 2a str. 2457T
uuaugcaauuuuuccgcgugcg

SEQ ID NO: 42065 - RNA, 22 nt, Shigella flexneri 2a str. 2457T
uucaccagcgccagcgcuucug

SEQ ID NO: 42066 - RNA, 21 nt, Shigella flexneri 2a str. 2457T
uucagccuggcgucgcccacu

SEQ ID NO: 42067 - RNA, 22 nt, Shigella flexneri 2a str. 2457T
uucagggucuggauugccugca

SEQ ID NO: 42068 - RNA, 22 nt, Shigella flexneri 2a str. 2457T
uucauugaaaagugugaaccgg

SEQ ID NO: 42069 - RNA, 22 nt, Shigella flexneri 2a str. 2457T
uuccaccguugcuguugcgucg

SEQ ID NO: 42070 - RNA, 22 nt, Shigella flexneri 2a str. 2457T
uuccguaaaacucgauacccag

SEQ ID NO: 42071 - RNA, 22 nt, Shigella flexneri 2a str. 2457T
uuccgucgcacuggguguggcu

SEQ ID NO: 42072 - RNA, 22 nt, Shigella flexneri 2a str. 2457T
uucgagagucagugguacgucu

SEQ ID NO: 42073 - RNA, 22 nt, Shigella flexneri 2a str. 2457T
uucgcaagugacaucuuuuggc

SEQ ID NO: 42074 - RNA, 22 nt, Shigella flexneri 2a str. 2457T
uucgcgaacgucgaggaucugg

SEQ ID NO: 42075 - RNA, 22 nt, Shigella flexneri 2a str. 2457T
uucgcguaaacgccaggcgugu

SEQ ID NO: 42076 - RNA, 22 nt, Shigella flexneri 2a str. 2457T
uucgcugggaaaucccugggcc

SEQ ID NO: 42077 - RNA, 22 nt, Shigella flexneri 2a str. 2457T
uucgucagucaggacaaacugc

SEQ ID NO: 42078 - RNA, 22 nt, Shigella flexneri 2a str. 2457T
uucguugcgugagguugcuggc

SEQ ID NO: 42079 - RNA, 22 nt, Shigella flexneri 2a str. 2457T
uucucgguuugcuggucacgau

SEQ ID NO: 42080 - RNA, 22 nt, Shigella flexneri 2a str. 2457T
caucggugcugacggguugauu

SEQ ID NO: 42081 - RNA, 22 nt, Shigella flexneri 2a str. 2457T
caucguuuccgauggaagcaua

SEQ ID NO: 42082 - RNA, 22 nt, Shigella flexneri 2a str. 2457T
caucugucugauaaaaaacccg

SEQ ID NO: 42083 - RNA, 22 nt, Shigella flexneri 2a str. 2457T
caucuuauccagcaaccagguc

SEQ ID NO: 42084 - RNA, 22 nt, Shigella flexneri 2a str. 2457T
caugagaaagaguaucugguga

SEQ ID NO: 42085 - RNA, 22 nt, Shigella flexneri 2a str. 2457T
cauggaguucguuggaccgggc

SEQ ID NO: 42086 - RNA, 22 nt, Shigella flexneri 2a str. 2457T
cauggcggaaguccgaccuuca

SEQ ID NO: 42087 - RNA, 22 nt, Shigella flexneri 2a str. 2457T
gcgaguauccagauuagugacc

SEQ ID NO: 42088 - RNA, 22 nt, Shigella flexneri 2a str. 2457T
gcgauacaacuggucgaauaau

SEQ ID NO: 42089 - RNA, 22 nt, Shigella flexneri 2a str. 2457T
gcgaugcaggcacaccgcuaug

SEQ ID NO: 42090 - RNA, 21 nt, Shigella flexneri 2a str. 2457T
gcgauugcuuagugccugcgc

SEQ ID NO: 42091 - RNA, 22 nt, Shigella flexneri 2a str. 2457T
gcgcacguaauugauccagaag

SEQ ID NO: 42092 - RNA, 22 nt, Shigella flexneri 2a str. 2457T
gcgcacuugaaucgcgggauug

SEQ ID NO: 42093 - RNA, 22 nt, Shigella flexneri 2a str. 2457T
gcgcagugcgacgcuugagaau

SEQ ID NO: 42094 - RNA, 19 nt, Shigella flexneri 2a str. 2457T
gcgcggauugaugccgccc

SEQ ID NO: 42095 - RNA, 22 nt, Shigella flexneri 2a str. 2457T
gcgcugguggcgauggucgggg

SEQ ID NO: 42096 - RNA, 22 nt, Shigella flexneri 2a str. 2457T
gcgcuguucugcgcuuuuucug

SEQ ID NO: 42097 - RNA, 22 nt, Shigella flexneri 2a str. 2457T
gcgcuuuguuuaugccagaugc

SEQ ID NO: 42098 - RNA, 22 nt, Shigella flexneri 2a str. 2457T
gcggaaauacucgccacggaac

SEQ ID NO: 42099 - RNA, 22 nt, Shigella flexneri 2a str. 2457T
gcggaucugcggaggcgcgguu

SEQ ID NO: 42100 - RNA, 22 nt, Shigella flexneri 2a str. 2457T
gcggcuaaugagaggcuuuacc

SEQ ID NO: 42101 - RNA, 22 nt, Shigella flexneri 2a str. 2457T
gcgggugaugacauucuugcug

SEQ ID NO: 42102 - RNA, 22 nt, Shigella flexneri 2a str. 2457T
gcguaaagcaaugauggcgcac

SEQ ID NO: 42103 - RNA, 22 nt, Shigella flexneri 2a str. 2457T
gcguaaucggcaagcgaggaau

SEQ ID NO: 42104 - RNA, 22 nt, Shigella flexneri 2a str. 2457T
gcgucuggaagaagaacgccgu

SEQ ID NO: 42105 - RNA, 22 nt, Shigella flexneri 2a str. 2457T
gcgucuuaucaggccuacgaag

SEQ ID NO: 42106 - RNA, 22 nt, Shigella flexneri 2a str. 2457T
gcgucuuaucuggccuacgaag

SEQ ID NO: 42107 - RNA, 23 nt, Shigella flexneri 2a str. 2457T
gcguuauagccgccaaauucugc

SEQ ID NO: 42108 - RNA, 22 nt, Shigella flexneri 2a str. 2457T
gcguuuccacaacguuacagcu

SEQ ID NO: 42109 - RNA, 22 nt, Shigella flexneri 2a str. 2457T
gcugaagauccguaaaauugag

SEQ ID NO: 42110 - RNA, 22 nt, Shigella flexneri 2a str. 2457T
gcugacgcaaauugguuauguu

SEQ ID NO: 42111 - RNA, 22 nt, Shigella flexneri 2a str. 2457T
gcugccguaugccguggcuccc

SEQ ID NO: 42112 - RNA, 22 nt, Shigella flexneri 2a str. 2457T
gcugcgcuuaucaggccuacag

SEQ ID NO: 42113 - RNA, 22 nt, Shigella flexneri 2a str. 2457T
gcuggaaagcaccugcgcggcg

SEQ ID NO: 42114 - RNA, 22 nt, Shigella flexneri 2a str. 2457T
gcuggcguugcgcggaguacgu

SEQ ID NO: 42115 - RNA, 22 nt, Shigella flexneri 2a str. 2457T
gcuucgucaaaauguacgguau

SEQ ID NO: 42116 - RNA, 22 nt, Shigella flexneri 2a str. 2457T
gcuuugcugaaaucgauacgga

SEQ ID NO: 42117 - RNA, 22 nt, Shigella flexneri 2a str. 2457T
ggaacuguucgccgugcaaauc

SEQ ID NO: 42118 - RNA, 22 nt, Shigella flexneri 2a str. 2457T
ggaaugaugugauacgccccgg

SEQ ID NO: 42119 - RNA, 22 nt, Shigella flexneri 2a str. 2457T
ggagacauucucgccaccgcgu

SEQ ID NO: 42120 - RNA, 22 nt, Shigella flexneri 2a str. 2457T
ggagaucagcagccccauucca

SEQ ID NO: 42121 - RNA, 22 nt, Shigella flexneri 2a str. 2457T
ggaguacaucgugcgcggcagu

SEQ ID NO: 42122 - RNA, 22 nt, Shigella flexneri 2a str. 2457T
ggaguugaucuuucgcgcguca

SEQ ID NO: 42123 - RNA, 22 nt, Shigella flexneri 2a str. 2457T
ggauaaucguuugcaugaugca

SEQ ID NO: 42124 - RNA, 22 nt, Shigella flexneri 2a str. 2457T
ggauuaacgucugggaacugau

SEQ ID NO: 42125 - RNA, 22 nt, Shigella flexneri 2a str. 2457T
ggcaaagugcauagcgucgcaa

SEQ ID NO: 42126 - RNA, 18 nt, Shigella flexneri 2a str. 2457T
ggcaaucaguuugaaucc

SEQ ID NO: 42127 - RNA, 22 nt, Shigella flexneri 2a str. 2457T
ggcacgguggauuuccggcagc

SEQ ID NO: 42128 - RNA, 22 nt, Shigella flexneri 2a str. 2457T
ggcagugccuucagcauggaag

SEQ ID NO: 42129 - RNA, 22 nt, Shigella flexneri 2a str. 2457T
ggcaguggguacgcagcgccag

SEQ ID NO: 42130 - RNA, 23 nt, Shigella flexneri 2a str. 2457T
ggccauugacgcaucgcccgguu

SEQ ID NO: 42131 - RNA, 22 nt, Shigella flexneri 2a str. 2457T
ggccgcaugcgcacuggccuac

SEQ ID NO: 42132 - RNA, 22 nt, Shigella flexneri 2a str. 2457T
ggccgguaaaucuucacucugu

SEQ ID NO: 42133 - RNA, 22 nt, Shigella flexneri 2a str. 2457T
ggccuggacguugcagggcagc

SEQ ID NO: 42134 - RNA, 22 nt, Shigella flexneri 2a str. 2457T
ggcgauggaggauggauaauga

SEQ ID NO: 42135 - RNA, 22 nt, Shigella flexneri 2a str. 2457T
ggcgcuugccugcuccccucac

SEQ ID NO: 42136 - RNA, 22 nt, Shigella flexneri 2a str. 2457T
ggcggcuucuacggcaucugcg

SEQ ID NO: 42137 - RNA, 22 nt, Shigella flexneri 2a str. 2457T
ggcguaggccgaaagcuggcaa

SEQ ID NO: 42138 - RNA, 22 nt, Shigella flexneri 2a str. 2457T
ggcguggauguucgucaguuaa

SEQ ID NO: 42139 - RNA, 22 nt, Shigella flexneri 2a str. 2457T
ggcguuaggaucguauggugag

SEQ ID NO: 42140 - RNA, 21 nt, Shigella flexneri 2a str. 2457T
ggcguugagaagaguuucgau

SEQ ID NO: 42141 - RNA, 22 nt, Shigella flexneri 2a str. 2457T
ggcugguagaacgcgccaauca

SEQ ID NO: 42142 - RNA, 23 nt, Shigella flexneri 2a str. 2457T
ggcuuccgucagggguggauggu

SEQ ID NO: 42143 - RNA, 22 nt, Shigella flexneri 2a str. 2457T
gggacauaaccacgggcauuac

SEQ ID NO: 42144 - RNA, 22 nt, Shigella flexneri 2a str. 2457T
gggccagaaaaucugugucuug

SEQ ID NO: 42145 - RNA, 22 nt, Shigella flexneri 2a str. 2457T
gggcgguaaaguuggucuguuc

SEQ ID NO: 42146 - RNA, 22 nt, Shigella flexneri 2a str. 2457T
gguaugcguggcgcgcguguuc

SEQ ID NO: 42147 - RNA, 22 nt, Shigella flexneri 2a str. 2457T
ggucagcgucaguugcugugcu

SEQ ID NO: 42148 - RNA, 22 nt, Shigella flexneri 2a str. 2457T
ggucauugacaaugcugccgcu

SEQ ID NO: 42149 - RNA, 22 nt, Shigella flexneri 2a str. 2457T
ggugacuguacuggaaggucug

SEQ ID NO: 42150 - RNA, 22 nt, Shigella flexneri 2a str. 2457T
ggugagccugcugguaagcgcc

SEQ ID NO: 42151 - RNA, 22 nt, Shigella flexneri 2a str. 2457T
gguucgaggccgagcauuuuca

SEQ ID NO: 42152 - RNA, 22 nt, Shigella flexneri 2a str. 2457T
gguucguagucgcucugaacuu

SEQ ID NO: 42153 - RNA, 22 nt, Shigella flexneri 2a str. 2457T
gguucguaguugcucugaacuu

SEQ ID NO: 42154 - RNA, 22 nt, Shigella flexneri 2a str. 2457T
gguucugcgggaauacgguuuu

SEQ ID NO: 42155 - RNA, 22 nt, Shigella flexneri 2a str. 2457T
guaccugcguucacacccaacu

SEQ ID NO: 42156 - RNA, 22 nt, Shigella flexneri 2a str. 2457T
guacuguucagcagauuaucag

SEQ ID NO: 42157 - RNA, 20 nt, Shigella flexneri 2a str. 2457T
guagcggguacggugcugug

SEQ ID NO: 42158 - RNA, 22 nt, Shigella flexneri 2a str. 2457T
guauaucaauaaaguccggcuc

SEQ ID NO: 42159 - RNA, 22 nt, Shigella flexneri 2a str. 2457T
gucaauuuuuaauugaggugga

SEQ ID NO: 42160 - RNA, 16 nt, Shigella flexneri 2a str. 2457T
aaacgcuguucuccag

SEQ ID NO: 42161 - RNA, 22 nt, Shigella flexneri 2a str. 2457T
aaacgucgauggcuuuugcgau

SEQ ID NO: 42162 - RNA, 22 nt, Shigella flexneri 2a str. 2457T
aaacguugcugaugggugacga

SEQ ID NO: 42163 - RNA, 22 nt, Shigella flexneri 2a str. 2457T
aaacugcaaaaaugcccggcgg

SEQ ID NO: 42164 - RNA, 22 nt, Shigella flexneri 2a str. 2457T
aaagaugucgaucuugaaaacu

SEQ ID NO: 42165 - RNA, 22 nt, Shigella flexneri 2a str. 2457T
aaagcgcauuuguagccagggc

SEQ ID NO: 42166 - RNA, 22 nt, Shigella flexneri 2a str. 2457T
aaauacgguuuaugaaaauagg

SEQ ID NO: 42167 - RNA, 17 nt, Shigella flexneri 2a str. 2457T
aaauggugaagaguacc

SEQ ID NO: 42168 - RNA, 22 nt, Shigella flexneri 2a str. 2457T
aaauugccgaugcacgcuggcg

SEQ ID NO: 42169 - RNA, 22 nt, Shigella flexneri 2a str. 2457T
aacaggcuuaagacgcucgaac

SEQ ID NO: 42170 - RNA, 22 nt, Shigella flexneri 2a str. 2457T
aacagguuacggucgccguaaa

SEQ ID NO: 42171 - RNA, 22 nt, Shigella flexneri 2a str. 2457T
aaccuguuuguuaccaggcugg

SEQ ID NO: 42172 - RNA, 22 nt, Shigella flexneri 2a str. 2457T
aacgagaucugcggcuugucgu

SEQ ID NO: 42173 - RNA, 22 nt, Shigella flexneri 2a str. 2457T
aacgccuuauccggccuacaaa

SEQ ID NO: 42174 - RNA, 22 nt, Shigella flexneri 2a str. 2457T
aacgcgguaauaaguuugucgg

SEQ ID NO: 42175 - RNA, 22 nt, Shigella flexneri 2a str. 2457T
aacgcuuuaauaucuuucggau

SEQ ID NO: 42176 - RNA, 22 nt, Shigella flexneri 2a str. 2457T
aacggcgaugaagugucgauca

SEQ ID NO: 42177 - RNA, 22 nt, Shigella flexneri 2a str. 2457T
aacgucggcaucgcggaaggcu

SEQ ID NO: 42178 - RNA, 22 nt, Shigella flexneri 2a str. 2457T
aacgucuugcgauugauguggc

SEQ ID NO: 42179 - RNA, 22 nt, Shigella flexneri 2a str. 2457T
aacugaaaggcugggccauguu

SEQ ID NO: 42180 - RNA, 22 nt, Shigella flexneri 2a str. 2457T
aacuggaagaacuggcgacgcg

SEQ ID NO: 42181 - RNA, 20 nt, Shigella flexneri 2a str. 2457T
aacugggcggcgagcguauc

SEQ ID NO: 42182 - RNA, 22 nt, Shigella flexneri 2a str. 2457T
aacuguccauuaagaagacgcu

SEQ ID NO: 42183 - RNA, 22 nt, Shigella flexneri 2a str. 2457T
aagcauuacuggucauugcaga

SEQ ID NO: 42184 - RNA, 17 nt, Shigella flexneri 2a str. 2457T
aagcggcgaugacuuaa

SEQ ID NO: 42185 - RNA, 22 nt, Shigella flexneri 2a str. 2457T
aagcggcguuacagauauucgg

SEQ ID NO: 42186 - RNA, 22 nt, Shigella flexneri 2a str. 2457T
aagcgguuguacccgugccggu

SEQ ID NO: 42187 - RNA, 22 nt, Shigella flexneri 2a str. 2457T
aagcgguuugcgccaggugagc

SEQ ID NO: 42188 - RNA, 22 nt, Shigella flexneri 2a str. 2457T
aagcgucccguuucgaucuuag

SEQ ID NO: 42189 - RNA, 22 nt, Shigella flexneri 2a str. 2457T
aagcgucgaucccgcucggugg

SEQ ID NO: 42190 - RNA, 22 nt, Shigella flexneri 2a str. 2457T
aagcuggaucucugaaaggauu

SEQ ID NO: 42191 - RNA, 22 nt, Shigella flexneri 2a str. 2457T
aaggugguguuccugccggauu

SEQ ID NO: 42192 - RNA, 20 nt, Shigella flexneri 2a str. 2457T
aaguccugggaucagcgagg

SEQ ID NO: 42193 - RNA, 22 nt, Shigella flexneri 2a str. 2457T
aagugccgcuguuuggucgugc

SEQ ID NO: 42194 - RNA, 22 nt, Shigella flexneri 2a str. 2457T
aauaccguggaauaugccgggg

SEQ ID NO: 42195 - RNA, 22 nt, Shigella flexneri 2a str. 2457T
aaucacuggcgcaaggagcgcg

SEQ ID NO: 42196 - RNA, 22 nt, Shigella flexneri 2a str. 2457T
aaucagcgguaucguuuccuuc

SEQ ID NO: 42197 - RNA, 22 nt, Shigella flexneri 2a str. 2457T
aaucguguaaaccggucguuac

SEQ ID NO: 42198 - RNA, 22 nt, Shigella flexneri 2a str. 2457T
aaucuccagcucgcgcaguuca

SEQ ID NO: 42199 - RNA, 22 nt, Shigella flexneri 2a str. 2457T
aaugcccugauguauuugaagu

SEQ ID NO: 42200 - RNA, 22 nt, Shigella flexneri 2a str. 2457T
aaugcguugguagugcguaaca

SEQ ID NO: 42201 - RNA, 22 nt, Shigella flexneri 2a str. 2457T
aaugcuugagaauuuguaggcc

SEQ ID NO: 42202 - RNA, 22 nt, Shigella flexneri 2a str. 2457T
aauggcgauuacauuguugauu

SEQ ID NO: 42203 - RNA, 22 nt, Shigella flexneri 2a str. 2457T
aauggcggaguguuggucaaaa

SEQ ID NO: 42204 - RNA, 22 nt, Shigella flexneri 2a str. 2457T
aauggcggcaaucuggcuuuuc

SEQ ID NO: 42205 - RNA, 22 nt, Shigella flexneri 2a str. 2457T
aauuacucauuguuuaaaaaga

SEQ ID NO: 42206 - RNA, 22 nt, Shigella flexneri 2a str. 2457T
acacgguagcgcgaccugcaac

SEQ ID NO: 42207 - RNA, 22 nt, Shigella flexneri 2a str. 2457T
acagagauguuuaauccuggcg

SEQ ID NO: 42208 - RNA, 22 nt, Shigella flexneri 2a str. 2457T
acagagcugauuuccgggaugg

SEQ ID NO: 42209 - RNA, 22 nt, Shigella flexneri 2a str. 2457T
acagcgcgugauguuugucaga

SEQ ID NO: 42210 - RNA, 22 nt, Shigella flexneri 2a str. 2457T
acauagugaaaaaaggcgugga

SEQ ID NO: 42211 - RNA, 22 nt, Shigella flexneri 2a str. 2457T
accagcgcagauagcccggaua

SEQ ID NO: 42212 - RNA, 22 nt, Shigella flexneri 2a str. 2457T
accaggaccaaaacgaaaagag

SEQ ID NO: 42213 - RNA, 22 nt, Shigella flexneri 2a str. 2457T
accaugauaccuuguuccgaca

SEQ ID NO: 42214 - RNA, 23 nt, Shigella flexneri 2a str. 2457T
acccaucgacggacgcgcggcga

SEQ ID NO: 42215 - RNA, 22 nt, Shigella flexneri 2a str. 2457T
acccgucagaaugccgggcgau

SEQ ID NO: 42216 - RNA, 18 nt, Shigella flexneri 2a str. 2457T
accgaccugcgcugacgc

SEQ ID NO: 42217 - RNA, 22 nt, Shigella flexneri 2a str. 2457T
accggaaagaauaugcgccagc

SEQ ID NO: 42218 - RNA, 22 nt, Shigella flexneri 2a str. 2457T
accggucguuguuccugccggc

SEQ ID NO: 42219 - RNA, 22 nt, Shigella flexneri 2a str. 2457T
accggugcuuuaaaguguucuu

SEQ ID NO: 42220 - RNA, 22 nt, Shigella flexneri 2a str. 2457T
accguuucuugauggcgaguau

SEQ ID NO: 42221 - RNA, 20 nt, Shigella flexneri 2a str. 2457T
accugauuaaaaauaucggc

SEQ ID NO: 42222 - RNA, 22 nt, Shigella flexneri 2a str. 2457T
acgaaacuggacggcacggcga

SEQ ID NO: 42223 - RNA, 22 nt, Shigella flexneri 2a str. 2457T
acgauuguuuagauuguguaua

SEQ ID NO: 42224 - RNA, 22 nt, Shigella flexneri 2a str. 2457T
acgcgaaguauauuuguucggc

SEQ ID NO: 42225 - RNA, 22 nt, Shigella flexneri 2a str. 2457T
acgcggcagcaccgucaggcca

SEQ ID NO: 42226 - RNA, 22 nt, Shigella flexneri 2a str. 2457T
cauucgcugcugcuuugcuucc

SEQ ID NO: 42227 - RNA, 22 nt, Shigella flexneri 2a str. 2457T
cauugcaccaauauggugcuua

SEQ ID NO: 42228 - RNA, 19 nt, Shigella flexneri 2a str. 2457T
ccagguuggcguccagcug

SEQ ID NO: 42229 - RNA, 22 nt, Shigella flexneri 2a str. 2457T
ccaguaaucaagacaguaccag

SEQ ID NO: 42230 - RNA, 22 nt, Shigella flexneri 2a str. 2457T
ccagucaacgguaauucaggcc

SEQ ID NO: 42231 - RNA, 22 nt, Shigella flexneri 2a str. 2457T
ccauccgcugacugacggcgac

SEQ ID NO: 42232 - RNA, 19 nt, Shigella flexneri 2a str. 2457T
ccaugcucguucuucugcu

SEQ ID NO: 42233 - RNA, 22 nt, Shigella flexneri 2a str. 2457T
cccacgauucauaauggcgaug

SEQ ID NO: 42234 - RNA, 22 nt, Shigella flexneri 2a str. 2457T
cccaguccaauaccagcgggcg

SEQ ID NO: 42235 - RNA, 22 nt, Shigella flexneri 2a str. 2457T
ccgaacggauaaagcgcuccgu

SEQ ID NO: 42236 - RNA, 22 nt, Shigella flexneri 2a str. 2457T
ccgaaggggcgaaaacuaaauc

SEQ ID NO: 42237 - RNA, 22 nt, Shigella flexneri 2a str. 2457T
ccgcugauugaaaggaugcguu

SEQ ID NO: 42238 - RNA, 22 nt, Shigella flexneri 2a str. 2457T
ccgcugguuauuguuauugccg

SEQ ID NO: 42239 - RNA, 22 nt, Shigella flexneri 2a str. 2457T
ccggaagacgaacuugccagcg

SEQ ID NO: 42240 - RNA, 22 nt, Shigella flexneri 2a str. 2457T
ccgggcuuaccacggguuuccc

SEQ ID NO: 42241 - RNA, 22 nt, Shigella flexneri 2a str. 2457T
ccgguaagaccaccacuuucua

SEQ ID NO: 42242 - RNA, 22 nt, Shigella flexneri 2a str. 2457T
ccguauugauggcaacgcacga

SEQ ID NO: 42243 - RNA, 22 nt, Shigella flexneri 2a str. 2457T
ccugaucuuuaccaugguguac

SEQ ID NO: 42244 - RNA, 22 nt, Shigella flexneri 2a str. 2457T
ccugccacuguuucaccauccc

SEQ ID NO: 42245 - RNA, 22 nt, Shigella flexneri 2a str. 2457T
ccugcgacaaucauucgucagg

SEQ ID NO: 42246 - RNA, 18 nt, Shigella flexneri 2a str. 2457T
ccugcugggguuacugcc

SEQ ID NO: 42247 - RNA, 22 nt, Shigella flexneri 2a str. 2457T
ccuggcugcaggaacaccaugu

SEQ ID NO: 42248 - RNA, 22 nt, Shigella flexneri 2a str. 2457T
cgaaagacggcugguuauucac

SEQ ID NO: 42249 - RNA, 22 nt, Shigella flexneri 2a str. 2457T
cgaagcgagguugcugcggaaa

SEQ ID NO: 42250 - RNA, 22 nt, Shigella flexneri 2a str. 2457T
cgaccgauuucguaacgcggcu

SEQ ID NO: 42251 - RNA, 22 nt, Shigella flexneri 2a str. 2457T
cgacgcagcagagcaaggaguu

SEQ ID NO: 42252 - RNA, 22 nt, Shigella flexneri 2a str. 2457T
cgacuacguuaacacucgccga

SEQ ID NO: 42253 - RNA, 22 nt, Shigella flexneri 2a str. 2457T
cgauuaucgaucuggcgcugca

SEQ ID NO: 42254 - RNA, 22 nt, Shigella flexneri 2a str. 2457T
cgcacaauuuucagcgcaaucu

SEQ ID NO: 42255 - RNA, 22 nt, Shigella flexneri 2a str. 2457T
cgcacguuggcaugagcgaugg

SEQ ID NO: 42256 - RNA, 22 nt, Shigella flexneri 2a str. 2457T
cgcaucgugguguggguuaucg

SEQ ID NO: 42257 - RNA, 22 nt, Shigella flexneri 2a str. 2457T
cgccacuuucuucugcgguucc

SEQ ID NO: 42258 - RNA, 22 nt, Shigella flexneri 2a str. 2457T
cgccaguugauuuugacaccgc

SEQ ID NO: 42259 - RNA, 22 nt, Shigella flexneri 2a str. 2457T
cgccauguggaugcagugcggg

SEQ ID NO: 42260 - RNA, 20 nt, Shigella flexneri 2a str. 2457T
cgccguucuggcggauguug

SEQ ID NO: 42261 - RNA, 22 nt, Shigella flexneri 2a str. 2457T
cgcgcacuguuccauuaacugg

SEQ ID NO: 42262 - RNA, 22 nt, Shigella flexneri 2a str. 2457T
cgcggaugguauggcuguuggu

SEQ ID NO: 42263 - RNA, 22 nt, Shigella flexneri 2a str. 2457T
cgcggucuucguuggcguaggc

SEQ ID NO: 42264 - RNA, 22 nt, Shigella flexneri 2a str. 2457T
cgcguucuuuaagccauggcga

SEQ ID NO: 42265 - RNA, 22 nt, Shigella flexneri 2a str. 2457T
cgcguugaaaucugccgacgua

SEQ ID NO: 42266 - RNA, 22 nt, Shigella flexneri 2a str. 2457T
cgcguuggucaucgcuucacua

SEQ ID NO: 42267 - RNA, 22 nt, Shigella flexneri 2a str. 2457T
cgcugcuggcaacccacgcgga

SEQ ID NO: 42268 - RNA, 22 nt, Shigella flexneri 2a str. 2457T
cgcuguaugccaucugcgcauc

SEQ ID NO: 42269 - RNA, 22 nt, Shigella flexneri 2a str. 2457T
cgcuucaaaggugucgucagga

SEQ ID NO: 42270 - RNA, 22 nt, Shigella flexneri 2a str. 2457T
cggaaggcgauaaagcgauuga

SEQ ID NO: 42271 - RNA, 22 nt, Shigella flexneri 2a str. 2457T
cggaaugcuggacuuguugugu

SEQ ID NO: 42272 - RNA, 22 nt, Shigella flexneri 2a str. 2457T
cggagcgaaacggcacaaccau

SEQ ID NO: 42273 - RNA, 22 nt, Shigella flexneri 2a str. 2457T
cggauaaagcguguugcauuug

SEQ ID NO: 42274 - RNA, 22 nt, Shigella flexneri 2a str. 2457T
cggauuuacgcguggugcagau

SEQ ID NO: 42275 - RNA, 22 nt, Shigella flexneri 2a str. 2457T
cggcugaaccugcucugccagg

SEQ ID NO: 42276 - RNA, 22 nt, Shigella flexneri 2a str. 2457T
cggcugauuguguaaugcacag

SEQ ID NO: 42277 - RNA, 22 nt, Shigella flexneri 2a str. 2457T
cggguagagcacauugaugccg

SEQ ID NO: 42278 - RNA, 22 nt, Shigella flexneri 2a str. 2457T
cggucaccuggauccagccugc

SEQ ID NO: 42279 - RNA, 22 nt, Shigella flexneri 2a str. 2457T
cggucgugcaacaccggcuguc

SEQ ID NO: 42280 - RNA, 22 nt, Shigella flexneri 2a str. 2457T
cggugcuggcugcugacaucgu

SEQ ID NO: 42281 - RNA, 22 nt, Shigella flexneri 2a str. 2457T
cgguuacuggaagaaguggugu

SEQ ID NO: 42282 - RNA, 22 nt, Shigella flexneri 2a str. 2457T
cgguugcuuucgucgagaaugu

SEQ ID NO: 42283 - RNA, 22 nt, Shigella flexneri 2a str. 2457T
cgguuuaagucggucaaguaau

SEQ ID NO: 42284 - RNA, 22 nt, Shigella flexneri 2a str. 2457T
cguaauguuaacuggggcuuuu

SEQ ID NO: 42285 - RNA, 23 nt, Shigella flexneri 2a str. 2457T
cguaauguuaacuggggcuuuuc

SEQ ID NO: 42286 - RNA, 22 nt, Shigella flexneri 2a str. 2457T
cguaccagcagaaagccugcca

SEQ ID NO: 42287 - RNA, 22 nt, Shigella flexneri 2a str. 2457T
cguaccaucaccgacguguuug

SEQ ID NO: 42288 - RNA, 22 nt, Shigella flexneri 2a str. 2457T
cguacgcucuccaacgccaugu

SEQ ID NO: 42289 - RNA, 22 nt, Shigella flexneri 2a str. 2457T
cguaugguugaguuugaguggc

SEQ ID NO: 42290 - RNA, 22 nt, Shigella flexneri 2a str. 2457T
cgucacgcugguggaucagggc

SEQ ID NO: 42291 - RNA, 22 nt, Shigella flexneri 2a str. 2457T
cgucgaguacuucguggaaggc

SEQ ID NO: 42292 - RNA, 22 nt, Shigella flexneri 2a str. 2457T
cgucugcuuaccauugcgugcc

SEQ ID NO: 42293 - RNA, 22 nt, Shigella flexneri 2a str. 2457T
cgucuggagguguuguaucagu

SEQ ID NO: 42294 - RNA, 22 nt, Shigella flexneri 2a str. 2457T
cgucuggcugagccgcaucgaa

SEQ ID NO: 42295 - RNA, 22 nt, Shigella flexneri 2a str. 2457T
cgugauaacuaucgucugguug

SEQ ID NO: 42296 - RNA, 22 nt, Shigella flexneri 2a str. 2457T
cgugcgugcaggugacaucguu

SEQ ID NO: 42297 - RNA, 22 nt, Shigella flexneri 2a str. 2457T
cguuccugcuccugcuccaucc

SEQ ID NO: 42298 - RNA, 22 nt, Shigella flexneri 2a str. 2457T
cguuuacagauggguaaugugu

SEQ ID NO: 42299 - RNA, 22 nt, Shigella flexneri 2a str. 2457T
cuaugauuaugaggcgaaguau

SEQ ID NO: 42300 - RNA, 22 nt, Shigella flexneri 2a str. 2457T
cucaaugcuuucgcgggugcgu

SEQ ID NO: 42301 - RNA, 22 nt, Shigella flexneri 2a str. 2457T
cuccagcuuacgguuaccagac

SEQ ID NO: 42302 - RNA, 22 nt, Shigella flexneri 2a str. 2457T
cucgacagaagccgugaagaga

SEQ ID NO: 42303 - RNA, 22 nt, Shigella flexneri 2a str. 2457T
cucgccauuuucgucuggaccg

SEQ ID NO: 42304 - RNA, 22 nt, Shigella flexneri 2a str. 2457T
cucguaggccugauaagcgcag

SEQ ID NO: 42305 - RNA, 22 nt, Shigella flexneri 2a str. 2457T
cucguucacguaucaccgcauc

SEQ ID NO: 42306 - RNA, 22 nt, Shigella flexneri 2a str. 2457T
cugaaugcagaauaggccagac

SEQ ID NO: 42307 - RNA, 22 nt, Shigella flexneri 2a str. 2457T
cugacagauguggcacuucccg

SEQ ID NO: 42308 - RNA, 23 nt, Shigella flexneri 2a str. 2457T
cugaccguaaaggucgucgugaa

SEQ ID NO: 42309 - RNA, 22 nt, Shigella flexneri 2a str. 2457T
cugccaguagugccauuguggu

SEQ ID NO: 42310 - RNA, 22 nt, Shigella flexneri 2a str. 2457T
cugccaguuccgcugauuuacg

SEQ ID NO: 42311 - RNA, 22 nt, Shigella flexneri 2a str. 2457T
cugcccugcaauguugucaguu

SEQ ID NO: 42312 - RNA, 22 nt, Shigella flexneri 2a str. 2457T
cugccggacugaaaauugauga

SEQ ID NO: 42313 - RNA, 22 nt, Shigella flexneri 2a str. 2457T
cugcgacaauggcguuuuuucg

SEQ ID NO: 42314 - RNA, 22 nt, Shigella flexneri 2a str. 2457T
cugcgagcgaagaaagugauca

SEQ ID NO: 42315 - RNA, 22 nt, Shigella flexneri 2a str. 2457T
cugcgcaaaugcagguuguuga

SEQ ID NO: 42316 - RNA, 22 nt, Shigella flexneri 2a str. 2457T
cugcgucauuccggaguuuaug

SEQ ID NO: 42317 - RNA, 22 nt, Shigella flexneri 2a str. 2457T
cuggaaccugucccauugaacu

SEQ ID NO: 42318 - RNA, 22 nt, Shigella flexneri 2a str. 2457T
cuggagauuaugcguaaagcca

SEQ ID NO: 42319 - RNA, 22 nt, Shigella flexneri 2a str. 2457T
cuggcauuaggcguugcuggcu

SEQ ID NO: 42320 - RNA, 22 nt, Shigella flexneri 2a str. 2457T
cuggcgauggucggugauggua

SEQ ID NO: 42321 - RNA, 22 nt, Shigella flexneri 2a str. 2457T
cugguagguauaacguuggcgu

SEQ ID NO: 42322 - RNA, 22 nt, Shigella flexneri 2a str. 2457T
cugugccagcagagcgagaugc

SEQ ID NO: 42323 - RNA, 22 nt, Shigella flexneri 2a str. 2457T
cugugcgccaaauccacugacc

SEQ ID NO: 42324 - RNA, 22 nt, Shigella flexneri 2a str. 2457T
cuuauggcucgccauccaguga

SEQ ID NO: 42325 - RNA, 22 nt, Shigella flexneri 2a str. 2457T
cuucacaguauauuugaaaaag

SEQ ID NO: 42326 - RNA, 22 nt, Shigella flexneri 2a str. 2457T
cuugaaguaugacgaguauagc

SEQ ID NO: 42327 - RNA, 22 nt, Shigella flexneri 2a str. 2457T
cuugccgugacaaauaaugaug

SEQ ID NO: 42328 - RNA, 22 nt, Shigella flexneri 2a str. 2457T
cuuuggcaaaccgccagcuagg

SEQ ID NO: 42329 - RNA, 22 nt, Shigella flexneri 2a str. 2457T
gaaaugaccagcguuaccggua

SEQ ID NO: 42330 - RNA, 22 nt, Shigella flexneri 2a str. 2457T
gaagcguuggucaguaguuguu

SEQ ID NO: 42331 - RNA, 22 nt, Shigella flexneri 2a str. 2457T
gaaggccagccggucaucagcg

SEQ ID NO: 42332 - RNA, 22 nt, Shigella flexneri 2a str. 2457T
gacaggcagaacuugaugguau

SEQ ID NO: 42333 - RNA, 22 nt, Shigella flexneri 2a str. 2457T
gaccgcuuccgccagcgauuuu

SEQ ID NO: 42334 - RNA, 22 nt, Shigella flexneri 2a str. 2457T
gacgcgguuuaaccgacgcgga

SEQ ID NO: 42335 - RNA, 22 nt, Shigella flexneri 2a str. 2457T
gacggcaccugguccaccggcg

SEQ ID NO: 42336 - RNA, 22 nt, Shigella flexneri 2a str. 2457T
gacuggaaacccgugccaugcu

SEQ ID NO: 42337 - RNA, 22 nt, Shigella flexneri 2a str. 2457T
gacuggccgacaacgcuugcug

SEQ ID NO: 42338 - RNA, 22 nt, Shigella flexneri 2a str. 2457T
gagaugcggguucgucaaaggu

SEQ ID NO: 42339 - RNA, 18 nt, Shigella flexneri 2a str. 2457T
gagauuguugaagaauuc

SEQ ID NO: 42340 - RNA, 22 nt, Shigella flexneri 2a str. 2457T
gagcauucccauaaacucagau

SEQ ID NO: 42341 - RNA, 21 nt, Shigella flexneri 2a str. 2457T
gagcgcaggcggaauggcggc

SEQ ID NO: 42342 - RNA, 22 nt, Shigella flexneri 2a str. 2457T
gaguaagugugaaguugccgga

SEQ ID NO: 42343 - RNA, 20 nt, Shigella flexneri 2a str. 2457T
gaguggcaucuuccugcuga

SEQ ID NO: 42344 - RNA, 22 nt, Shigella flexneri 2a str. 2457T
gauaggcuaacaauuaccggau

SEQ ID NO: 42345 - RNA, 22 nt, Shigella flexneri 2a str. 2457T
gauagguguugucgucaucuuu

SEQ ID NO: 42346 - RNA, 22 nt, Shigella flexneri 2a str. 2457T
gauauguuuaccaucaucggug

SEQ ID NO: 42347 - RNA, 22 nt, Shigella flexneri 2a str. 2457T
gaucaucugucaacugacguga

SEQ ID NO: 42348 - RNA, 22 nt, Shigella flexneri 2a str. 2457T
gaucccggcggcggauaucucc

SEQ ID NO: 42349 - RNA, 22 nt, Shigella flexneri 2a str. 2457T
gaucgacgccguucgcgcugaa

SEQ ID NO: 42350 - RNA, 22 nt, Shigella flexneri 2a str. 2457T
gaugaacccguuuugugugguu

SEQ ID NO: 42351 - RNA, 22 nt, Shigella flexneri 2a str. 2457T
gaugaacuguaggcugcugcgg

SEQ ID NO: 42352 - RNA, 22 nt, Shigella flexneri 2a str. 2457T
gaugagcguuucccgcauccgc

SEQ ID NO: 42353 - RNA, 18 nt, Shigella flexneri 2a str. 2457T
gaugauacuauguaucac

SEQ ID NO: 42354 - RNA, 22 nt, Shigella flexneri 2a str. 2457T
gaugcaacauuugucgccgcag

SEQ ID NO: 42355 - RNA, 22 nt, Shigella flexneri 2a str. 2457T
gaugcgaagcagggcggcgguu

SEQ ID NO: 42356 - RNA, 22 nt, Shigella flexneri 2a str. 2457T
gaugcggcguaaaugccuuauc

SEQ ID NO: 42357 - RNA, 22 nt, Shigella flexneri 2a str. 2457T
gaugcguaucccgaucuugauc

SEQ ID NO: 42358 - RNA, 22 nt, Shigella flexneri 2a str. 2457T
gaugugauugucugcgcugaaa

SEQ ID NO: 42359 - RNA, 22 nt, Shigella flexneri 2a str. 2457T
gauugcgggugaaaaacugacg

SEQ ID NO: 42360 - RNA, 22 nt, Shigella flexneri 2a str. 2457T
gcaacucucuacuguuucucca

SEQ ID NO: 42361 - RNA, 22 nt, Shigella flexneri 2a str. 2457T
gcaagcugguucagguucgucg

SEQ ID NO: 42362 - RNA, 20 nt, Shigella flexneri 2a str. 2457T
gcaauggcagcgaaagggga

SEQ ID NO: 42363 - RNA, 22 nt, Shigella flexneri 2a str. 2457T
gcacauaacucauacugagcaa

SEQ ID NO: 42364 - RNA, 22 nt, Shigella flexneri 2a str. 2457T
gcacccguaacauggcgguaau

SEQ ID NO: 42365 - RNA, 17 nt, Shigella flexneri 2a str. 2457T
gcaccgugcagcucuug

SEQ ID NO: 42366 - RNA, 22 nt, Shigella flexneri 2a str. 2457T
gcagcacguugcggcugcguuu

SEQ ID NO: 42367 - RNA, 22 nt, Shigella flexneri 2a str. 2457T
gcagcagaucaccacggcugau

SEQ ID NO: 42368 - RNA, 22 nt, Shigella flexneri 2a str. 2457T
gcaggagccagcucacucgcug

SEQ ID NO: 42369 - RNA, 22 nt, Shigella flexneri 2a str. 2457T
gcaggcugguaucgaacgguuu

SEQ ID NO: 42370 - RNA, 22 nt, Shigella flexneri 2a str. 2457T
gcagguuugcaaaaaugguacg

SEQ ID NO: 42371 - RNA, 22 nt, Shigella flexneri 2a str. 2457T
gcaguggcguuaauugugguua

SEQ ID NO: 42372 - RNA, 22 nt, Shigella flexneri 2a str. 2457T
gcauaagaagcuuucauuucag

SEQ ID NO: 42373 - RNA, 22 nt, Shigella flexneri 2a str. 2457T
gcauaucuuugguuugcaucgg

SEQ ID NO: 42374 - RNA, 22 nt, Shigella flexneri 2a str. 2457T
gcauucugguugaugacucagu

SEQ ID NO: 42375 - RNA, 22 nt, Shigella flexneri 2a str. 2457T
gccauauuuugucgcacgggau

SEQ ID NO: 42376 - RNA, 22 nt, Shigella flexneri 2a str. 2457T
gccauucaggauggcgugcgca

SEQ ID NO: 42377 - RNA, 22 nt, Shigella flexneri 2a str. 2457T
gcccuuuguaggccagauaaga

SEQ ID NO: 42378 - RNA, 22 nt, Shigella flexneri 2a str. 2457T
gccgacagaucguuaaccugca

SEQ ID NO: 42379 - RNA, 22 nt, Shigella flexneri 2a str. 2457T
gccgagaaagauggcugguucu

SEQ ID NO: 42380 - RNA, 22 nt, Shigella flexneri 2a str. 2457T
gccgaucauccgcagaagaaaa

SEQ ID NO: 42381 - RNA, 22 nt, Shigella flexneri 2a str. 2457T
gccgcuucuuccagcaggaucu

SEQ ID NO: 42382 - RNA, 22 nt, Shigella flexneri 2a str. 2457T
gccggacaaagacgaucugcug

SEQ ID NO: 42383 - RNA, 23 nt, Shigella flexneri 2a str. 2457T
gccgugcagucuuugcggcggaa

SEQ ID NO: 42384 - RNA, 22 nt, Shigella flexneri 2a str. 2457T
gccguggugggaucgccaguug

SEQ ID NO: 42385 - RNA, 19 nt, Shigella flexneri 2a str. 2457T
gcgaacacuucaucuuuac

SEQ ID NO: 42386 - RNA, 18 nt, Shigella flexneri 2a str. 2457T
gucaccgaugcagaaggg

SEQ ID NO: 42387 - RNA, 19 nt, Shigella flexneri 2a str. 2457T
gucaggcuuccuugcgguc

SEQ ID NO: 42388 - RNA, 22 nt, Shigella flexneri 2a str. 2457T
gucgaaauguguuuauaaagua

SEQ ID NO: 42389 - RNA, 18 nt, Shigella flexneri 2a str. 2457T
gucuugccauugaccugg

SEQ ID NO: 42390 - RNA, 22 nt, Shigella flexneri 2a str. 2457T
gugaagguuaaggcugauuuaa

SEQ ID NO: 42391 - RNA, 22 nt, Shigella flexneri 2a str. 2457T
gugagcagugcaguggugcucu

SEQ ID NO: 42392 - RNA, 22 nt, Shigella flexneri 2a str. 2457T
gugagcguauuggugaauugca

SEQ ID NO: 42393 - RNA, 22 nt, Shigella flexneri 2a str. 2457T
ucaggccuacacggagauugca

SEQ ID NO: 42394 - RNA, 22 nt, Shigella flexneri 2a str. 2457T
ucaggcugaugguggcacucgu

SEQ ID NO: 42395 - RNA, 22 nt, Shigella flexneri 2a str. 2457T
ucaggucguucugccacgaacu

SEQ ID NO: 42396 - RNA, 22 nt, Shigella flexneri 2a str. 2457T
ucaucgguuucaaugacuuuug

SEQ ID NO: 42397 - RNA, 22 nt, Shigella flexneri 2a str. 2457T
ucaucgucgaguugcagguuca

SEQ ID NO: 42398 - RNA, 22 nt, Shigella flexneri 2a str. 2457T
ucauggcgaucaggugcuggcg

SEQ ID NO: 42399 - RNA, 22 nt, Shigella flexneri 2a str. 2457T
ucaugugaccaaacaggcggcg

SEQ ID NO: 42400 - RNA, 22 nt, Shigella flexneri 2a str. 2457T
uccagcaaauugugauagcgca

SEQ ID NO: 42401 - RNA, 22 nt, Shigella flexneri 2a str. 2457T
uccaucguggcggauuauugug

SEQ ID NO: 42402 - RNA, 22 nt, Shigella flexneri 2a str. 2457T
ucccagguaguggucagcggcu

SEQ ID NO: 42403 - RNA, 22 nt, Shigella flexneri 2a str. 2457T
uccgacagccagaccagccgcg

SEQ ID NO: 42404 - RNA, 22 nt, Shigella flexneri 2a str. 2457T
uccgcgaccguggcagguuggg

SEQ ID NO: 42405 - RNA, 21 nt, Shigella flexneri 2a str. 2457T
uccgcgguguuuucagccagc

SEQ ID NO: 42406 - RNA, 22 nt, Shigella flexneri 2a str. 2457T
uccggagccauuaaagucuguu

SEQ ID NO: 42407 - RNA, 22 nt, Shigella flexneri 2a str. 2457T
uccggaugauuaauguuggccg

SEQ ID NO: 42408 - RNA, 22 nt, Shigella flexneri 2a str. 2457T
uccggcauggcauuuuuauuug

SEQ ID NO: 42409 - RNA, 22 nt, Shigella flexneri 2a str. 2457T
uccggccuacaugaucucugca

SEQ ID NO: 42410 - RNA, 22 nt, Shigella flexneri 2a str. 2457T
uccguuuauucuguugaucagg

SEQ ID NO: 42411 - RNA, 21 nt, Shigella flexneri 2a str. 2457T
uccugauuauaaauuucgcca

SEQ ID NO: 42412 - RNA, 22 nt, Shigella flexneri 2a str. 2457T
uccuggauuucagucugguuuu

SEQ ID NO: 42413 - RNA, 21 nt, Shigella flexneri 2a str. 2457T
uccuggcuugccagccaugag

SEQ ID NO: 42414 - RNA, 22 nt, Shigella flexneri 2a str. 2457T
ucgacgccaacguacgcuuucg

SEQ ID NO: 42415 - RNA, 22 nt, Shigella flexneri 2a str. 2457T
ucgauaaagcgauggccgacca

SEQ ID NO: 42416 - RNA, 22 nt, Shigella flexneri 2a str. 2457T
ucgauaccuugugcacgcaguu

SEQ ID NO: 42417 - RNA, 22 nt, Shigella flexneri 2a str. 2457T
ucgcagacgcugaaugaucugu

SEQ ID NO: 42418 - RNA, 22 nt, Shigella flexneri 2a str. 2457T
ucgccaugaucccaccgcacau

SEQ ID NO: 42419 - RNA, 22 nt, Shigella flexneri 2a str. 2457T
ucgccgcaccacaacugucagc

SEQ ID NO: 42420 - RNA, 22 nt, Shigella flexneri 2a str. 2457T
ucgcgccauuauggaacgcuug

SEQ ID NO: 42421 - RNA, 22 nt, Shigella flexneri 2a str. 2457T
ucgcgccugacgauuauucgua

SEQ ID NO: 42422 - RNA, 22 nt, Shigella flexneri 2a str. 2457T
ucgcggcuuuggugaagcggaa

SEQ ID NO: 42423 - RNA, 22 nt, Shigella flexneri 2a str. 2457T
ucgcgugauuaugguugaccau

SEQ ID NO: 42424 - RNA, 22 nt, Shigella flexneri 2a str. 2457T
ucgcguguuccaaaggucgcau

SEQ ID NO: 42425 - RNA, 22 nt, Shigella flexneri 2a str. 2457T
ucggaaggcuguaaucaccgcu

SEQ ID NO: 42426 - RNA, 23 nt, Shigella flexneri 2a str. 2457T
ucggcggugcgacggucgaauuu

SEQ ID NO: 42427 - RNA, 22 nt, Shigella flexneri 2a str. 2457T
ucggcucgcccagcggaguuuc

SEQ ID NO: 42428 - RNA, 22 nt, Shigella flexneri 2a str. 2457T
ucggucacccggaucuggugau

SEQ ID NO: 42429 - RNA, 19 nt, Shigella flexneri 2a str. 2457T
ucggugcuaaaucacguca

SEQ ID NO: 42430 - RNA, 21 nt, Shigella flexneri 2a str. 2457T
ucgguggcugaccaguuuggu

SEQ ID NO: 42431 - RNA, 22 nt, Shigella flexneri 2a str. 2457T
ucgucgcuacgcauucucgguu

SEQ ID NO: 42432 - RNA, 22 nt, Shigella flexneri 2a str. 2457T
ucgugauguucgcacuggaccc

SEQ ID NO: 42433 - RNA, 22 nt, Shigella flexneri 2a str. 2457T
ucguuaaucgccaguuucugcc

SEQ ID NO: 42434 - RNA, 22 nt, Shigella flexneri 2a str. 2457T
ucguuauucuucgguaucggca

SEQ ID NO: 42435 - RNA, 22 nt, Shigella flexneri 2a str. 2457T
ucguugaaaaauacgcgcuggu

SEQ ID NO: 42436 - RNA, 22 nt, Shigella flexneri 2a str. 2457T
ucguuguaauauuucagggugu

SEQ ID NO: 42437 - RNA, 19 nt, Shigella flexneri 2a str. 2457T
ucucgaucuggugcagaaa

SEQ ID NO: 42438 - RNA, 22 nt, Shigella flexneri 2a str. 2457T
ucucugcgauaaaaccgccugu

SEQ ID NO: 42439 - RNA, 21 nt, Shigella flexneri 2a str. 2457T
ucucugcgucgucuggagcaa

SEQ ID NO: 42440 - RNA, 22 nt, Shigella flexneri 2a str. 2457T
ucugagcguaccaaauauuauu

SEQ ID NO: 42441 - RNA, 22 nt, Shigella flexneri 2a str. 2457T
ucugauauaaaauugaacauug

SEQ ID NO: 42442 - RNA, 22 nt, Shigella flexneri 2a str. 2457T
ucugccagagcuucaaugcguu

SEQ ID NO: 42443 - RNA, 22 nt, Shigella flexneri 2a str. 2457T
ucugcggcaaauacagcgguga

SEQ ID NO: 42444 - RNA, 22 nt, Shigella flexneri 2a str. 2457T
ucugcguauuuaucuuuugcaa

SEQ ID NO: 42445 - RNA, 22 nt, Shigella flexneri 2a str. 2457T
ucuggaguaguguagucaaugg

SEQ ID NO: 42446 - RNA, 22 nt, Shigella flexneri 2a str. 2457T
ucugguaaucgcaacuuuggug

SEQ ID NO: 42447 - RNA, 22 nt, Shigella flexneri 2a str. 2457T
ucugguauggauguggcgcgua

SEQ ID NO: 42448 - RNA, 22 nt, Shigella flexneri 2a str. 2457T
ucuucacgggcgauggcgucca

SEQ ID NO: 42449 - RNA, 22 nt, Shigella flexneri 2a str. 2457T
ugaaagacugagcguuuuguug

SEQ ID NO: 42450 - RNA, 22 nt, Shigella flexneri 2a str. 2457T
ugaaccgguuguacggccugaa

SEQ ID NO: 42451 - RNA, 23 nt, Shigella flexneri 2a str. 2457T
ugaaguaguuccgcuugugcacg

SEQ ID NO: 42452 - RNA, 22 nt, Shigella flexneri 2a str. 2457T
ugaaguauagccaagacaaccc

SEQ ID NO: 42453 - RNA, 22 nt, Shigella flexneri 2a str. 2457T
ugaauacuuacuggcgacgucg

SEQ ID NO: 42454 - RNA, 22 nt, Shigella flexneri 2a str. 2457T
ugacgcauacguggcagggaau

SEQ ID NO: 42455 - RNA, 23 nt, Shigella flexneri 2a str. 2457T
ugacgcgcgaaagaucaacuccg

SEQ ID NO: 42456 - RNA, 22 nt, Shigella flexneri 2a str. 2457T
ugacugcguaauacagcccguc

SEQ ID NO: 42457 - RNA, 23 nt, Shigella flexneri 2a str. 2457T
ugagaaugcgcgggcuggcgugc

SEQ ID NO: 42458 - RNA, 22 nt, Shigella flexneri 2a str. 2457T
ugagccucagauuaauguuaag

SEQ ID NO: 42459 - RNA, 22 nt, Shigella flexneri 2a str. 2457T
ugagucugcaucuggguuugca

SEQ ID NO: 42460 - RNA, 19 nt, Shigella flexneri 2a str. 2457T
ugagugaagguacgaguaa

SEQ ID NO: 42461 - RNA, 22 nt, Shigella flexneri 2a str. 2457T
ugaguuuaucuuguuauggauu

SEQ ID NO: 42462 - RNA, 22 nt, Shigella flexneri 2a str. 2457T
ugauauagcacaugaacguaau

SEQ ID NO: 42463 - RNA, 22 nt, Shigella flexneri 2a str. 2457T
ugaucaacagaauaaacggaag

SEQ ID NO: 42464 - RNA, 22 nt, Shigella flexneri 2a str. 2457T
ugaugacgcugcggcaguucgc

SEQ ID NO: 42465 - RNA, 22 nt, Shigella flexneri 2a str. 2457T
ugauggauauucuggccacacu

SEQ ID NO: 42466 - RNA, 22 nt, Shigella flexneri 2a str. 2457T
ugauggcugccgccgucugcgc

SEQ ID NO: 42467 - RNA, 22 nt, Shigella flexneri 2a str. 2457T
ugaugggcaaggcuuccugugg

SEQ ID NO: 42468 - RNA, 22 nt, Shigella flexneri 2a str. 2457T
ugauggucaggauugugaacgc

SEQ ID NO: 42469 - RNA, 22 nt, Shigella flexneri 2a str. 2457T
ugauguagguauauucgccauu

SEQ ID NO: 42470 - RNA, 22 nt, Shigella flexneri 2a str. 2457T
ugauuaugucuggaacacggug

SEQ ID NO: 42471 - RNA, 22 nt, Shigella flexneri 2a str. 2457T
ugcaagauuuuguaggccugag

SEQ ID NO: 42472 - RNA, 22 nt, Shigella flexneri 2a str. 2457T
ugcaagugaaaaagagcggcau

SEQ ID NO: 42473 - RNA, 18 nt, Shigella flexneri 2a str. 2457T
uucugggcggcgauuucu

SEQ ID NO: 42474 - RNA, 22 nt, Shigella flexneri 2a str. 2457T
uucuguacagcacgcuucauag

SEQ ID NO: 42475 - RNA, 22 nt, Shigella flexneri 2a str. 2457T
uugagcaugaacccgguugagc

SEQ ID NO: 42476 - RNA, 22 nt, Shigella flexneri 2a str. 2457T
uugagcgugccgguggcgaaca

SEQ ID NO: 42477 - RNA, 22 nt, Shigella flexneri 2a str. 2457T
uugaugauaucgaucucaaccu

SEQ ID NO: 42478 - RNA, 21 nt, Shigella flexneri 2a str. 2457T
uugaugcgcgagcgacguucc

SEQ ID NO: 42479 - RNA, 22 nt, Shigella flexneri 2a str. 2457T
uugcaaugaacuguaggccgga

SEQ ID NO: 42480 - RNA, 22 nt, Shigella flexneri 2a str. 2457T
uugcaccguauacguuugauuu

SEQ ID NO: 42481 - RNA, 22 nt, Shigella flexneri 2a str. 2457T
uugcacgaacuuguaggccgga

SEQ ID NO: 42482 - RNA, 22 nt, Shigella flexneri 2a str. 2457T
uugcacgauuuuguaggccgga

SEQ ID NO: 42483 - RNA, 22 nt, Shigella flexneri 2a str. 2457T
uugcagaauuuguaggccggau

SEQ ID NO: 42484 - RNA, 23 nt, Shigella flexneri 2a str. 2457T
uugcagaauuuucguaggccuga

SEQ ID NO: 42485 - RNA, 22 nt, Shigella flexneri 2a str. 2457T
uugcagcgucuuaucaggccua

SEQ ID NO: 42486 - RNA, 22 nt, Shigella flexneri 2a str. 2457T
uugcaggccguaaaacgccgcu

SEQ ID NO: 42487 - RNA, 22 nt, Shigella flexneri 2a str. 2457T
uugcagggacuauguaggccug

SEQ ID NO: 42488 - RNA, 22 nt, Shigella flexneri 2a str. 2457T
uugcauggucuuguaggccaga

SEQ ID NO: 42489 - RNA, 22 nt, Shigella flexneri 2a str. 2457T
uugccacgcaaaucgguuuugc

SEQ ID NO: 42490 - RNA, 22 nt, Shigella flexneri 2a str. 2457T
uugcgcuccugucaugugcauu

SEQ ID NO: 42491 - RNA, 20 nt, Shigella flexneri 2a str. 2457T
uugcuaaccaacauauucgc

SEQ ID NO: 42492 - RNA, 22 nt, Shigella flexneri 2a str. 2457T
uugcuaccaaaccucaugggug

SEQ ID NO: 42493 - RNA, 22 nt, Shigella flexneri 2a str. 2457T
uugcuuaauuugcggcuuccug

SEQ ID NO: 42494 - RNA, 22 nt, Shigella flexneri 2a str. 2457T
uuggaagaauuuguaggccgga

SEQ ID NO: 42495 - RNA, 22 nt, Shigella flexneri 2a str. 2457T
uugggucaauuugucugcuugc

SEQ ID NO: 42496 - RNA, 22 nt, Shigella flexneri 2a str. 2457T
uugguaucguugggcugguguu

SEQ ID NO: 42497 - RNA, 21 nt, Shigella flexneri 2a str. 2457T
uuguccgcuaucuggcggcac

SEQ ID NO: 42498 - RNA, 22 nt, Shigella flexneri 2a str. 2457T
uugugccgauaacgccagcuuc

SEQ ID NO: 42499 - RNA, 19 nt, Shigella flexneri 2a str. 2457T
uuguucgcgcgguaaucgc

SEQ ID NO: 42500 - RNA, 22 nt, Shigella flexneri 2a str. 2457T
uuuaccgacggugauuuacgcc

SEQ ID NO: 42501 - RNA, 22 nt, Shigella flexneri 2a str. 2457T
uuuagcgcucgacacccuggga

SEQ ID NO: 42502 - RNA, 22 nt, Shigella flexneri 2a str. 2457T
uuuaucggguacuaaaguucug

SEQ ID NO: 42503 - RNA, 22 nt, Shigella flexneri 2a str. 2457T
uuucaccgucggccaguauuug

SEQ ID NO: 42504 - RNA, 20 nt, Shigella flexneri 2a str. 2457T
uuucaucggcguuagcccag

SEQ ID NO: 42505 - RNA, 22 nt, Shigella flexneri 2a str. 2457T
uuucgguauuaccuguucgacg

SEQ ID NO: 42506 - RNA, 22 nt, Shigella flexneri 2a str. 2457T
uuugccagccgguuuucaccca

SEQ ID NO: 42507 - RNA, 22 nt, Shigella flexneri 2a str. 2457T
uuuggcagcuucaugcauuaca

SEQ ID NO: 42508 - RNA, 22 nt, Shigella flexneri 2a str. 2457T
aaaggccaucaucgcagucaua

SEQ ID NO: 42509 - RNA, 22 nt, Shigella flexneri 2a str. 2457T
aaaggcguuauuauuaauugcc

SEQ ID NO: 42510 - RNA, 22 nt, Shigella flexneri 2a str. 2457T
aaagguuagaaugauagcuuug

SEQ ID NO: 42511 - RNA, 22 nt, Shigella flexneri 2a str. 2457T
aaaucgcauaccaaucacgggc

SEQ ID NO: 42512 - RNA, 20 nt, Shigella flexneri 2a str. 2457T
aaaucguccggggaaaccuu

SEQ ID NO: 42513 - RNA, 22 nt, Shigella flexneri 2a str. 2457T
aaauggguuauaccgaaccgga

SEQ ID NO: 42514 - RNA, 22 nt, Shigella flexneri 2a str. 2457T
aaauuggcuuuuaccaguccau

SEQ ID NO: 42515 - RNA, 22 nt, Shigella flexneri 2a str. 2457T
aaccauugcaggucaauaucac

SEQ ID NO: 42516 - RNA, 22 nt, Shigella flexneri 2a str. 2457T
aaccggauacaucuuguuccau

SEQ ID NO: 42517 - RNA, 22 nt, Shigella flexneri 2a str. 2457T
aacgacgaacgcaaacugaaug

SEQ ID NO: 42518 - RNA, 22 nt, Shigella flexneri 2a str. 2457T
aacgaugaacuuuuuugccauu

SEQ ID NO: 42519 - RNA, 22 nt, Shigella flexneri 2a str. 2457T
aacgcgguuuuaagcgaaucga

SEQ ID NO: 42520 - RNA, 23 nt, Shigella flexneri 2a str. 2457T
aacgucagaagacagcugaucga

SEQ ID NO: 42521 - RNA, 21 nt, Shigella flexneri 2a str. 2457T
aacugcuccauucguuguuga

SEQ ID NO: 42522 - RNA, 22 nt, Shigella flexneri 2a str. 2457T
aacugcugguuguuggcugcua

SEQ ID NO: 42523 - RNA, 22 nt, Shigella flexneri 2a str. 2457T
aagaugauguuaagcugcuaaa

SEQ ID NO: 42524 - RNA, 22 nt, Shigella flexneri 2a str. 2457T
aagccucaguuucuaugcaaau

SEQ ID NO: 42525 - RNA, 22 nt, Shigella flexneri 2a str. 2457T
aagcgacaucuugccuguggau

SEQ ID NO: 42526 - RNA, 22 nt, Shigella flexneri 2a str. 2457T
aaggccggugucauuugaugug

SEQ ID NO: 42527 - RNA, 22 nt, Shigella flexneri 2a str. 2457T
aaggcguugcagugcauggaug

SEQ ID NO: 42528 - RNA, 22 nt, Shigella flexneri 2a str. 2457T
aaggguauuuucgcaaaucagg

SEQ ID NO: 42529 - RNA, 22 nt, Shigella flexneri 2a str. 2457T
aagguguuaaacuggaaaaccg

SEQ ID NO: 42530 - RNA, 22 nt, Shigella flexneri 2a str. 2457T
aagucacugacaucguuacgau

SEQ ID NO: 42531 - RNA, 22 nt, Shigella flexneri 2a str. 2457T
aagugcaacggcuugcagauca

SEQ ID NO: 42532 - RNA, 22 nt, Shigella flexneri 2a str. 2457T
aaguugccagcccgcagccauu

SEQ ID NO: 42533 - RNA, 22 nt, Shigella flexneri 2a str. 2457T
aaguuugccguggcaguggcga

SEQ ID NO: 42534 - RNA, 19 nt, Shigella flexneri 2a str. 2457T
aaucagaacguggaagaac

SEQ ID NO: 42535 - RNA, 22 nt, Shigella flexneri 2a str. 2457T
aaucgguagcaguuguuugcuc

SEQ ID NO: 42536 - RNA, 22 nt, Shigella flexneri 2a str. 2457T
aaucggucacuuaugauauugc

SEQ ID NO: 42537 - RNA, 22 nt, Shigella flexneri 2a str. 2457T
aaugaccaguaaugcuuugccc

SEQ ID NO: 42538 - RNA, 22 nt, Shigella flexneri 2a str. 2457T
aaugcaguagucgcagcggaag

SEQ ID NO: 42539 - RNA, 22 nt, Shigella flexneri 2a str. 2457T
aaugccagcgccacagcgauaa

SEQ ID NO: 42540 - RNA, 23 nt, Shigella flexneri 2a str. 2457T
aaugcgccaaccuuccagcgaug

SEQ ID NO: 42541 - RNA, 22 nt, Shigella flexneri 2a str. 2457T
aaugcgcugguugaaguguuac

SEQ ID NO: 42542 - RNA, 22 nt, Shigella flexneri 2a str. 2457T
aaugguuuacccaugcagguag

SEQ ID NO: 42543 - RNA, 20 nt, Shigella flexneri 2a str. 2457T
aauugccugagaaucagcaa

SEQ ID NO: 42544 - RNA, 22 nt, Shigella flexneri 2a str. 2457T
acaacggagaacaguauccugu

SEQ ID NO: 42545 - RNA, 22 nt, Shigella flexneri 2a str. 2457T
acacgcgguugcuuuugcccaa

SEQ ID NO: 42546 - RNA, 22 nt, Shigella flexneri 2a str. 2457T
acagagccugucucagcaauga

SEQ ID NO: 42547 - RNA, 22 nt, Shigella flexneri 2a str. 2457T
acaggcaguugcguagauuucu

SEQ ID NO: 42548 - RNA, 22 nt, Shigella flexneri 2a str. 2457T
acagggcgcacuggaagcgaug

SEQ ID NO: 42549 - RNA, 22 nt, Shigella flexneri 2a str. 2457T
accaaaugucgauaauuuuguu

SEQ ID NO: 42550 - RNA, 22 nt, Shigella flexneri 2a str. 2457T
accagcagcagcguauucaguu

SEQ ID NO: 42551 - RNA, 23 nt, Shigella flexneri 2a str. 2457T
accagccgggauucagcgcagga

SEQ ID NO: 42552 - RNA, 22 nt, Shigella flexneri 2a str. 2457T
accauacggucgaugccaaucc

SEQ ID NO: 42553 - RNA, 22 nt, Shigella flexneri 2a str. 2457T
accaucugcggcauacuuucgc

SEQ ID NO: 42554 - RNA, 22 nt, Shigella flexneri 2a str. 2457T
accauugccgcagcaauagcug

SEQ ID NO: 42555 - RNA, 22 nt, Shigella flexneri 2a str. 2457T
accgaagaguaccgcggcggca

SEQ ID NO: 42556 - RNA, 22 nt, Shigella flexneri 2a str. 2457T
accgacguuagaaaucaaccau

SEQ ID NO: 42557 - RNA, 22 nt, Shigella flexneri 2a str. 2457T
accgcaucggccugguguaccg

SEQ ID NO: 42558 - RNA, 22 nt, Shigella flexneri 2a str. 2457T
accgggugaugcaaaaguagcc

SEQ ID NO: 42559 - RNA, 22 nt, Shigella flexneri 2a str. 2457T
accgggugauggcguugaccau

SEQ ID NO: 42560 - RNA, 22 nt, Shigella flexneri 2a str. 2457T
accgucaggguacggaauguac

SEQ ID NO: 42561 - RNA, 22 nt, Shigella flexneri 2a str. 2457T
accguuuggcuguuucacgccg

SEQ ID NO: 42562 - RNA, 22 nt, Shigella flexneri 2a str. 2457T
accucguuuauuauuaccgaag

SEQ ID NO: 42563 - RNA, 22 nt, Shigella flexneri 2a str. 2457T
accugcauuuccgaacgcacgu

SEQ ID NO: 42564 - RNA, 22 nt, Shigella flexneri 2a str. 2457T
accuggcauucauucuucugca

SEQ ID NO: 42565 - RNA, 22 nt, Shigella flexneri 2a str. 2457T
accuggucuuuuccaucuugcg

SEQ ID NO: 42566 - RNA, 22 nt, Shigella flexneri 2a str. 2457T
accuguuuaacguuaacgccgg

SEQ ID NO: 42567 - RNA, 23 nt, Shigella flexneri 2a str. 2457T
acgaugaagccuuccugcaacag

SEQ ID NO: 42568 - RNA, 22 nt, Shigella flexneri 2a str. 2457T
acgcacguuuugcacgccaguu

SEQ ID NO: 42569 - RNA, 22 nt, Shigella flexneri 2a str. 2457T
acgcagacgcuguuccaguucg

SEQ ID NO: 42570 - RNA, 22 nt, Shigella flexneri 2a str. 2457T
acgccuuauccggccuacaagu

SEQ ID NO: 42571 - RNA, 22 nt, Shigella flexneri 2a str. 2457T
acgcgucuuaucaggccuacaa

SEQ ID NO: 42572 - RNA, 23 nt, Shigella flexneri 2a str. 2457T
acgcuacguacuucucggggcgc

SEQ ID NO: 42573 - RNA, 22 nt, Shigella flexneri 2a str. 2457T
acgcugaauguugaaaaugcgc

SEQ ID NO: 42574 - RNA, 22 nt, Shigella flexneri 2a str. 2457T
acggugacagaacgcuaagauu

SEQ ID NO: 42575 - RNA, 22 nt, Shigella flexneri 2a str. 2457T
acggugaucguuaaugugcagg

SEQ ID NO: 42576 - RNA, 21 nt, Shigella flexneri 2a str. 2457T
acgguucuggucuggcuguug

SEQ ID NO: 42577 - RNA, 22 nt, Shigella flexneri 2a str. 2457T
acgucagcgcuggcuguuuuac

SEQ ID NO: 42578 - RNA, 22 nt, Shigella flexneri 2a str. 2457T
acucaauugcucuggagacauu

SEQ ID NO: 42579 - RNA, 20 nt, Shigella flexneri 2a str. 2457T
acugaccgacucagggcaga

SEQ ID NO: 42580 - RNA, 22 nt, Shigella flexneri 2a str. 2457T
acugauguagccauauuauccc

SEQ ID NO: 42581 - RNA, 20 nt, Shigella flexneri 2a str. 2457T
acugcacgugucucaggaug

SEQ ID NO: 42582 - RNA, 22 nt, Shigella flexneri 2a str. 2457T
acugucguggggaagaauuugc

SEQ ID NO: 42583 - RNA, 22 nt, Shigella flexneri 2a str. 2457T
acuuccugcuguaaagucgguu

SEQ ID NO: 42584 - RNA, 22 nt, Shigella flexneri 2a str. 2457T
acuuggcugguuaaguacguag

SEQ ID NO: 42585 - RNA, 22 nt, Shigella flexneri 2a str. 2457T
acuuugcgauccgccucgcgcc

SEQ ID NO: 42586 - RNA, 22 nt, Shigella flexneri 2a str. 2457T
agaagcugaaaucauacgguuu

SEQ ID NO: 42587 - RNA, 22 nt, Shigella flexneri 2a str. 2457T
agaagugugguuuuguagauau

SEQ ID NO: 42588 - RNA, 22 nt, Shigella flexneri 2a str. 2457T
aucuuggcgguucugcggguau

SEQ ID NO: 42589 - RNA, 22 nt, Shigella flexneri 2a str. 2457T
augaccggacgccuggcgcugg

SEQ ID NO: 42590 - RNA, 22 nt, Shigella flexneri 2a str. 2457T
augacguaggccugauaagcgu

SEQ ID NO: 42591 - RNA, 22 nt, Shigella flexneri 2a str. 2457T
augaugcuauacugugcaauau

SEQ ID NO: 42592 - RNA, 22 nt, Shigella flexneri 2a str. 2457T
augcaacugcacagccagauca

SEQ ID NO: 42593 - RNA, 22 nt, Shigella flexneri 2a str. 2457T
augcaaugaaaguaccguucua

SEQ ID NO: 42594 - RNA, 22 nt, Shigella flexneri 2a str. 2457T
augccauugcugaauuugagaa

SEQ ID NO: 42595 - RNA, 22 nt, Shigella flexneri 2a str. 2457T
augcgacgcggaagcgucuuau

SEQ ID NO: 42596 - RNA, 22 nt, Shigella flexneri 2a str. 2457T
augcgcuuaagcgucuggaugu

SEQ ID NO: 42597 - RNA, 22 nt, Shigella flexneri 2a str. 2457T
augcgcuucgcuuauccggccu

SEQ ID NO: 42598 - RNA, 22 nt, Shigella flexneri 2a str. 2457T
augcugaccaugggcgauucgg

SEQ ID NO: 42599 - RNA, 22 nt, Shigella flexneri 2a str. 2457T
augcuggcugaaaacaccgcgg

SEQ ID NO: 42600 - RNA, 22 nt, Shigella flexneri 2a str. 2457T
auggaauaugccuucuggaugg

SEQ ID NO: 42601 - RNA, 22 nt, Shigella flexneri 2a str. 2457T
auggaugcuugucgggaaguga

SEQ ID NO: 42602 - RNA, 22 nt, Shigella flexneri 2a str. 2457T
auggcaaucgcaucuaucuggu

SEQ ID NO: 42603 - RNA, 22 nt, Shigella flexneri 2a str. 2457T
auggcuuccugaaacaguuugg

SEQ ID NO: 42604 - RNA, 22 nt, Shigella flexneri 2a str. 2457T
augggcggauucuugcgacagg

SEQ ID NO: 42605 - RNA, 19 nt, Shigella flexneri 2a str. 2457T
auggugaugaucgauuucc

SEQ ID NO: 42606 - RNA, 17 nt, Shigella flexneri 2a str. 2457T
augguugcuuuuugcug

SEQ ID NO: 42607 - RNA, 22 nt, Shigella flexneri 2a str. 2457T
augucgaccuauguugauuaua

SEQ ID NO: 42608 - RNA, 22 nt, Shigella flexneri 2a str. 2457T
augucguucggcgaggugguga

SEQ ID NO: 42609 - RNA, 22 nt, Shigella flexneri 2a str. 2457T
augugugcguuaccacuacuga

SEQ ID NO: 42610 - RNA, 22 nt, Shigella flexneri 2a str. 2457T
auuacugaugaccagugcgccc

SEQ ID NO: 42611 - RNA, 22 nt, Shigella flexneri 2a str. 2457T
auuagcgacaacauucgugcca

SEQ ID NO: 42612 - RNA, 22 nt, Shigella flexneri 2a str. 2457T
auuccaggagugaguauucagg

SEQ ID NO: 42613 - RNA, 19 nt, Shigella flexneri 2a str. 2457T
auucgcuuaaaaccgcguu

SEQ ID NO: 42614 - RNA, 22 nt, Shigella flexneri 2a str. 2457T
auucgcuuggguauuguaaaac

SEQ ID NO: 42615 - RNA, 19 nt, Shigella flexneri 2a str. 2457T
auucugccguaugaccagu

SEQ ID NO: 42616 - RNA, 22 nt, Shigella flexneri 2a str. 2457T
auucuuugguguucgcaaacca

SEQ ID NO: 42617 - RNA, 22 nt, Shigella flexneri 2a str. 2457T
auugcaggaacgcuaucaccgu

SEQ ID NO: 42618 - RNA, 22 nt, Shigella flexneri 2a str. 2457T
auugcuguuaacgcuggugcug

SEQ ID NO: 42619 - RNA, 22 nt, Shigella flexneri 2a str. 2457T
auuggcaaucaucacgucguuu

SEQ ID NO: 42620 - RNA, 22 nt, Shigella flexneri 2a str. 2457T
auugucaucgcagguggccagg

SEQ ID NO: 42621 - RNA, 22 nt, Shigella flexneri 2a str. 2457T
auuugcucgucagccaguuuca

SEQ ID NO: 42622 - RNA, 22 nt, Shigella flexneri 2a str. 2457T
caaagugugucgucggcauggu

SEQ ID NO: 42623 - RNA, 22 nt, Shigella flexneri 2a str. 2457T
caaauaggccaguugaugcuuu

SEQ ID NO: 42624 - RNA, 22 nt, Shigella flexneri 2a str. 2457T
caagaauuuauuucugguuauu

SEQ ID NO: 42625 - RNA, 22 nt, Shigella flexneri 2a str. 2457T
caagagauugcaggugcgguug

SEQ ID NO: 42626 - RNA, 22 nt, Shigella flexneri 2a str. 2457T
caagccuuccauuacgcugacc

SEQ ID NO: 42627 - RNA, 22 nt, Shigella flexneri 2a str. 2457T
caagcgcgcuuaacgccguuuu

SEQ ID NO: 42628 - RNA, 22 nt, Shigella flexneri 2a str. 2457T
caaggcauggaagggagcguua

SEQ ID NO: 42629 - RNA, 22 nt, Shigella flexneri 2a str. 2457T
caauccgcagguguugaucaag

SEQ ID NO: 42630 - RNA, 22 nt, Shigella flexneri 2a str. 2457T
cacaacguagaagucgccaauc

SEQ ID NO: 42631 - RNA, 23 nt, Shigella flexneri 2a str. 2457T
cacgaugcaacguaaagauacgc

SEQ ID NO: 42632 - RNA, 22 nt, Shigella flexneri 2a str. 2457T
cacgcucaauaucggcaucuuc

SEQ ID NO: 42633 - RNA, 22 nt, Shigella flexneri 2a str. 2457T
cacggcugagagcaccaccaga

SEQ ID NO: 42634 - RNA, 22 nt, Shigella flexneri 2a str. 2457T
cacggugugcguuucgccagug

SEQ ID NO: 42635 - RNA, 22 nt, Shigella flexneri 2a str. 2457T
cacguuaaugaugcucgcacuu

SEQ ID NO: 42636 - RNA, 22 nt, Shigella flexneri 2a str. 2457T
cagaaguaaucccucauucccg

SEQ ID NO: 42637 - RNA, 22 nt, Shigella flexneri 2a str. 2457T
cagaauauuugccauaagggaa

SEQ ID NO: 42638 - RNA, 22 nt, Shigella flexneri 2a str. 2457T
cagauaagagugcauucccagc

SEQ ID NO: 42639 - RNA, 22 nt, Shigella flexneri 2a str. 2457T
cagcacuuuuugcugauugcca

SEQ ID NO: 42640 - RNA, 22 nt, Shigella flexneri 2a str. 2457T
cagcagugccaguucauggcau

SEQ ID NO: 42641 - RNA, 22 nt, Shigella flexneri 2a str. 2457T
cagcccguuauguacgaaggcc

SEQ ID NO: 42642 - RNA, 19 nt, Shigella flexneri 2a str. 2457T
cagccugucaggucugggc

SEQ ID NO: 42643 - RNA, 22 nt, Shigella flexneri 2a str. 2457T
cagccuuaaaauaggccggaug

SEQ ID NO: 42644 - RNA, 22 nt, Shigella flexneri 2a str. 2457T
cagcgacgcgccagcaggaaag

SEQ ID NO: 42645 - RNA, 22 nt, Shigella flexneri 2a str. 2457T
cagcgaugaggaaccauccugg

SEQ ID NO: 42646 - RNA, 22 nt, Shigella flexneri 2a str. 2457T
cagcgauuguugccguagaggu

SEQ ID NO: 42647 - RNA, 22 nt, Shigella flexneri 2a str. 2457T
cagcggaucacccaccguuuug

SEQ ID NO: 42648 - RNA, 22 nt, Shigella flexneri 2a str. 2457T
caggccuacaagaugauugcaa

SEQ ID NO: 42649 - RNA, 22 nt, Shigella flexneri 2a str. 2457T
caggcgguagcagcgaccauuc

SEQ ID NO: 42650 - RNA, 22 nt, Shigella flexneri 2a str. 2457T
caggcuuucugcucgucgauaa

SEQ ID NO: 42651 - RNA, 22 nt, Shigella flexneri 2a str. 2457T
cagucauuugcuggcuuuuacu

SEQ ID NO: 42652 - RNA, 22 nt, Shigella flexneri 2a str. 2457T
caguguuucggucugauaugga

SEQ ID NO: 42653 - RNA, 22 nt, Shigella flexneri 2a str. 2457T
cauaagagauggaaugagcauc

SEQ ID NO: 42654 - RNA, 22 nt, Shigella flexneri 2a str. 2457T
caucggcuacagcagcagccug

SEQ ID NO: 42655 - RNA, 21 nt, Shigella flexneri 2a str. 2457T
caucuugcuggcgcgcgauau

SEQ ID NO: 42656 - RNA, 22 nt, Shigella flexneri 2a str. 2457T
cauugcgcagguuuggagugau

SEQ ID NO: 42657 - RNA, 22 nt, Shigella flexneri 2a str. 2457T
ccaaagcggcaaacuucgcggu

SEQ ID NO: 42658 - RNA, 20 nt, Shigella flexneri 2a str. 2457T
ccacagcgaucuuuccacca

SEQ ID NO: 42659 - RNA, 22 nt, Shigella flexneri 2a str. 2457T
ccacgcugacgcaucaguucac

SEQ ID NO: 42660 - RNA, 22 nt, Shigella flexneri 2a str. 2457T
ccacguagucuuuaccgcuguc

SEQ ID NO: 42661 - RNA, 22 nt, Shigella flexneri 2a str. 2457T
ccagaucggaaccacggacgau

SEQ ID NO: 42662 - RNA, 22 nt, Shigella flexneri 2a str. 2457T
ccagauggcgauggcgcuagcg

SEQ ID NO: 42663 - RNA, 22 nt, Shigella flexneri 2a str. 2457T
ccagcgcuucgguauggcgggu

SEQ ID NO: 42664 - RNA, 23 nt, Shigella flexneri 2a str. 2457T
ccagcuauuugauguccgaucug

SEQ ID NO: 42665 - RNA, 22 nt, Shigella flexneri 2a str. 2457T
ccaguaauagcgcguugauccc

SEQ ID NO: 42666 - RNA, 22 nt, Shigella flexneri 2a str. 2457T
ccauuaccuuuaacggacuguc

SEQ ID NO: 42667 - RNA, 22 nt, Shigella flexneri 2a str. 2457T
ccauugucagguauaucgaugu

SEQ ID NO: 42668 - RNA, 22 nt, Shigella flexneri 2a str. 2457T
cuggagccuguugggugacacg

SEQ ID NO: 42669 - RNA, 22 nt, Shigella flexneri 2a str. 2457T
cuggaugucggugccgaugacu

SEQ ID NO: 42670 - RNA, 22 nt, Shigella flexneri 2a str. 2457T
cuggcaagauggaagguacguu

SEQ ID NO: 42671 - RNA, 22 nt, Shigella flexneri 2a str. 2457T
cuggcgauguucuaugaagugg

SEQ ID NO: 42672 - RNA, 22 nt, Shigella flexneri 2a str. 2457T
cuggcuacucaggcgauacagu

SEQ ID NO: 42673 - RNA, 22 nt, Shigella flexneri 2a str. 2457T
cugggcgaggauuacauccgca

SEQ ID NO: 42674 - RNA, 22 nt, Shigella flexneri 2a str. 2457T
cugggcuaacgccgaugaaagc

SEQ ID NO: 42675 - RNA, 22 nt, Shigella flexneri 2a str. 2457T
cugggcugacaccguacaggag

SEQ ID NO: 42676 - RNA, 22 nt, Shigella flexneri 2a str. 2457T
cugguagcgcuggggcugcaaa

SEQ ID NO: 42677 - RNA, 22 nt, Shigella flexneri 2a str. 2457T
cugguauagguauggagcuuau

SEQ ID NO: 42678 - RNA, 22 nt, Shigella flexneri 2a str. 2457T
cuguugcaggaaggcuucaucg

SEQ ID NO: 42679 - RNA, 22 nt, Shigella flexneri 2a str. 2457T
cuuacauuaaugaagcuauccg

SEQ ID NO: 42680 - RNA, 23 nt, Shigella flexneri 2a str. 2457T
cuucaacgcagcguugccacuuc

SEQ ID NO: 42681 - RNA, 22 nt, Shigella flexneri 2a str. 2457T
cuucgcgcuccagcugacggca

SEQ ID NO: 42682 - RNA, 19 nt, Shigella flexneri 2a str. 2457T
cuugcggugaagaagaggu

SEQ ID NO: 42683 - RNA, 22 nt, Shigella flexneri 2a str. 2457T
cuuucagagcaaugcaucgcgu

SEQ ID NO: 42684 - RNA, 18 nt, Shigella flexneri 2a str. 2457T
gaaaccgcaaugaaagcc

SEQ ID NO: 42685 - RNA, 22 nt, Shigella flexneri 2a str. 2457T
gaaacuuugucgcguggaccca

SEQ ID NO: 42686 - RNA, 22 nt, Shigella flexneri 2a str. 2457T
gaacgcgugcuucaggaagcgg

SEQ ID NO: 42687 - RNA, 22 nt, Shigella flexneri 2a str. 2457T
gaacgugugccagguaccauug

SEQ ID NO: 42688 - RNA, 22 nt, Shigella flexneri 2a str. 2457T
gaagguuucgguguuuauacaa

SEQ ID NO: 42689 - RNA, 21 nt, Shigella flexneri 2a str. 2457T
gaaugcugaaaaugccgcgcu

SEQ ID NO: 42690 - RNA, 22 nt, Shigella flexneri 2a str. 2457T
gaauuucauugcuuucuucugu

SEQ ID NO: 42691 - RNA, 22 nt, Shigella flexneri 2a str. 2457T
gacaccugacgauacuguguug

SEQ ID NO: 42692 - RNA, 23 nt, Shigella flexneri 2a str. 2457T
gacauuacaggguuugcgucagc

SEQ ID NO: 42693 - RNA, 22 nt, Shigella flexneri 2a str. 2457T
gacuucggucagggugucguuc

SEQ ID NO: 42694 - RNA, 22 nt, Shigella flexneri 2a str. 2457T
gagaauguagaugccgcauugc

SEQ ID NO: 42695 - RNA, 22 nt, Shigella flexneri 2a str. 2457T
gagacgugcaaucucgguagac

SEQ ID NO: 42696 - RNA, 22 nt, Shigella flexneri 2a str. 2457T
gagcacggcuugcgcugcuuca

SEQ ID NO: 42697 - RNA, 22 nt, Shigella flexneri 2a str. 2457T
gagcagaucgaaaaaguggcga

SEQ ID NO: 42698 - RNA, 22 nt, Shigella flexneri 2a str. 2457T
gagccggacuuuauugauauac

SEQ ID NO: 42699 - RNA, 22 nt, Shigella flexneri 2a str. 2457T
gagccggugacguuggugcguu

SEQ ID NO: 42700 - RNA, 22 nt, Shigella flexneri 2a str. 2457T
gagcgacguuugucacccaccg

SEQ ID NO: 42701 - RNA, 23 nt, Shigella flexneri 2a str. 2457T
gagcguggaucuggaguucagca

SEQ ID NO: 42702 - RNA, 22 nt, Shigella flexneri 2a str. 2457T
gagcuugaugaugagcgucgcg

SEQ ID NO: 42703 - RNA, 22 nt, Shigella flexneri 2a str. 2457T
gagguaaucugaaaaaggugca

SEQ ID NO: 42704 - RNA, 22 nt, Shigella flexneri 2a str. 2457T
gaguaugauggauguaccgacc

SEQ ID NO: 42705 - RNA, 22 nt, Shigella flexneri 2a str. 2457T
gaguuuaucuucuacuacguga

SEQ ID NO: 42706 - RNA, 22 nt, Shigella flexneri 2a str. 2457T
gauaaggcguucacgcugcauc

SEQ ID NO: 42707 - RNA, 22 nt, Shigella flexneri 2a str. 2457T
gauaaucccugauucgcaguca

SEQ ID NO: 42708 - RNA, 22 nt, Shigella flexneri 2a str. 2457T
gauagauuggauaagaaacgcg

SEQ ID NO: 42709 - RNA, 21 nt, Shigella flexneri 2a str. 2457T
gauagucgaggaucugccguu

SEQ ID NO: 42710 - RNA, 22 nt, Shigella flexneri 2a str. 2457T
gaucaggaauugcuuacuuggu

SEQ ID NO: 42711 - RNA, 22 nt, Shigella flexneri 2a str. 2457T
gaucaugaaaaaacuguccggu

SEQ ID NO: 42712 - RNA, 22 nt, Shigella flexneri 2a str. 2457T
gaucguuaaagaugcuaacggc

SEQ ID NO: 42713 - RNA, 22 nt, Shigella flexneri 2a str. 2457T
gaucugaguuuaugggaaugcu

SEQ ID NO: 42714 - RNA, 20 nt, Shigella flexneri 2a str. 2457T
gaugauggacggcaacagcg

SEQ ID NO: 42715 - RNA, 22 nt, Shigella flexneri 2a str. 2457T
gaugccguuuuagacgcgaucc

SEQ ID NO: 42716 - RNA, 22 nt, Shigella flexneri 2a str. 2457T
gaugccugcaaacgucuggcag

SEQ ID NO: 42717 - RNA, 22 nt, Shigella flexneri 2a str. 2457T
gaugcgacgcuggcgcgucuua

SEQ ID NO: 42718 - RNA, 22 nt, Shigella flexneri 2a str. 2457T
gaugcgccaugaguuuauuuua

SEQ ID NO: 42719 - RNA, 22 nt, Shigella flexneri 2a str. 2457T
gauggcggugguucuguucguc

SEQ ID NO: 42720 - RNA, 22 nt, Shigella flexneri 2a str. 2457T
gaugucuguuugguuucaggcg

SEQ ID NO: 42721 - RNA, 22 nt, Shigella flexneri 2a str. 2457T
gauuaucaccuguugcccuuug

SEQ ID NO: 42722 - RNA, 22 nt, Shigella flexneri 2a str. 2457T
gauucgcaugaugccgauggaa

SEQ ID NO: 42723 - RNA, 22 nt, Shigella flexneri 2a str. 2457T
gauugaugaccugagcuucucg

SEQ ID NO: 42724 - RNA, 22 nt, Shigella flexneri 2a str. 2457T
gauuuagucagugcaucucauu

SEQ ID NO: 42725 - RNA, 22 nt, Shigella flexneri 2a str. 2457T
gcacggcagcauguugacccug

SEQ ID NO: 42726 - RNA, 22 nt, Shigella flexneri 2a str. 2457T
gcaggcgagugaaacauagaga

SEQ ID NO: 42727 - RNA, 22 nt, Shigella flexneri 2a str. 2457T
gcaguacgugccuaaaaugcug

SEQ ID NO: 42728 - RNA, 22 nt, Shigella flexneri 2a str. 2457T
gcaguaucaaaacgucgggcaa

SEQ ID NO: 42729 - RNA, 22 nt, Shigella flexneri 2a str. 2457T
gcauucaucaugguucucgguu

SEQ ID NO: 42730 - RNA, 22 nt, Shigella flexneri 2a str. 2457T
gccaacaucauaggcguggugu

SEQ ID NO: 42731 - RNA, 22 nt, Shigella flexneri 2a str. 2457T
gccagacaacagggagaguaga

SEQ ID NO: 42732 - RNA, 23 nt, Shigella flexneri 2a str. 2457T
gccauuccggauauugcagaccu

SEQ ID NO: 42733 - RNA, 22 nt, Shigella flexneri 2a str. 2457T
gcccggaucgccuacgggcuga

SEQ ID NO: 42734 - RNA, 22 nt, Shigella flexneri 2a str. 2457T
gcccgucugcuggugcaaucau

SEQ ID NO: 42735 - RNA, 22 nt, Shigella flexneri 2a str. 2457T
gccgaucgacaguggcguuauu

SEQ ID NO: 42736 - RNA, 22 nt, Shigella flexneri 2a str. 2457T
gccgcagaaguggcgcuguuua

SEQ ID NO: 42737 - RNA, 22 nt, Shigella flexneri 2a str. 2457T
gccgcagaucauuaucuggcag

SEQ ID NO: 42738 - RNA, 22 nt, Shigella flexneri 2a str. 2457T
gccgcuucgcugauuuuuccgg

SEQ ID NO: 42739 - RNA, 22 nt, Shigella flexneri 2a str. 2457T
gccggucaaucgcauucugggg

SEQ ID NO: 42740 - RNA, 22 nt, Shigella flexneri 2a str. 2457T
gccguuagcaucuuuaacgauc

SEQ ID NO: 42741 - RNA, 22 nt, Shigella flexneri 2a str. 2457T
gccguuggcaccaacaccauug

SEQ ID NO: 42742 - RNA, 22 nt, Shigella flexneri 2a str. 2457T
gccguuuauuuguuguaacucg

SEQ ID NO: 42743 - RNA, 19 nt, Shigella flexneri 2a str. 2457T
gccguuugcgucaguuuuu

SEQ ID NO: 42744 - RNA, 23 nt, Shigella flexneri 2a str. 2457T
gccuacuguuaggucaugccagc

SEQ ID NO: 42745 - RNA, 23 nt, Shigella flexneri 2a str. 2457T
gccugauguacaugucuucaacc

SEQ ID NO: 42746 - RNA, 21 nt, Shigella flexneri 2a str. 2457T
gccuggacagcagcugucugc

SEQ ID NO: 42747 - RNA, 22 nt, Shigella flexneri 2a str. 2457T
gccuguccgacaugagagagca

SEQ ID NO: 42748 - RNA, 22 nt, Shigella flexneri 2a str. 2457T
ucacgauaaacagcccugcguu

SEQ ID NO: 42749 - RNA, 22 nt, Shigella flexneri 2a str. 2457T
ucacggcguuccuaucgcaugc

SEQ ID NO: 42750 - RNA, 22 nt, Shigella flexneri 2a str. 2457T
ucacugaugagccagguucugg

SEQ ID NO: 42751 - RNA, 22 nt, Shigella flexneri 2a str. 2457T
ucacugcgaucugaaagacaac

SEQ ID NO: 42752 - RNA, 22 nt, Shigella flexneri 2a str. 2457T
ucagaccuucuucgauuucgcg

SEQ ID NO: 42753 - RNA, 22 nt, Shigella flexneri 2a str. 2457T
ucagauugucgauaugaacggu

SEQ ID NO: 42754 - RNA, 22 nt, Shigella flexneri 2a str. 2457T
ucagccgcaggaguugccguug

SEQ ID NO: 42755 - RNA, 22 nt, Shigella flexneri 2a str. 2457T
ucagcuggucaacuuuagcguu

SEQ ID NO: 42756 - RNA, 22 nt, Shigella flexneri 2a str. 2457T
ucaggccuacaaaaucuugcaa

SEQ ID NO: 42757 - RNA, 22 nt, Shigella flexneri 2a str. 2457T
ucaggccuacgucauauugcaa

SEQ ID NO: 42758 - RNA, 22 nt, Shigella flexneri 2a str. 2457T
ucaggcugagguugaucgcgcu

SEQ ID NO: 42759 - RNA, 22 nt, Shigella flexneri 2a str. 2457T
ucaguugauacuccaccugcga

SEQ ID NO: 42760 - RNA, 22 nt, Shigella flexneri 2a str. 2457T
ucauaauggcgucagcacguuu

SEQ ID NO: 42761 - RNA, 22 nt, Shigella flexneri 2a str. 2457T
ucauaaugggaguuuugauacu

SEQ ID NO: 42762 - RNA, 22 nt, Shigella flexneri 2a str. 2457T
ucaucuacaucgguuguuuaaa

SEQ ID NO: 42763 - RNA, 22 nt, Shigella flexneri 2a str. 2457T
ucaugcgcgaagcgguagcgau

SEQ ID NO: 42764 - RNA, 22 nt, Shigella flexneri 2a str. 2457T
ucauguaggcggugaugagcug

SEQ ID NO: 42765 - RNA, 22 nt, Shigella flexneri 2a str. 2457T
ucauugacagaaagcagcggag

SEQ ID NO: 42766 - RNA, 22 nt, Shigella flexneri 2a str. 2457T
ucauugcugagacaggcucugu

SEQ ID NO: 42767 - RNA, 22 nt, Shigella flexneri 2a str. 2457T
uccauacugaaggcgcguauca

SEQ ID NO: 42768 - RNA, 22 nt, Shigella flexneri 2a str. 2457T
ucccaggaacugccgugauguu

SEQ ID NO: 42769 - RNA, 22 nt, Shigella flexneri 2a str. 2457T
ucccgguaaucgaugacgacga

SEQ ID NO: 42770 - RNA, 22 nt, Shigella flexneri 2a str. 2457T
uccgcaucgguauugaaaugga

SEQ ID NO: 42771 - RNA, 22 nt, Shigella flexneri 2a str. 2457T
uccggccuacaaaaucgugcaa

SEQ ID NO: 42772 - RNA, 22 nt, Shigella flexneri 2a str. 2457T
uccggccuacaaaaucgugcua

SEQ ID NO: 42773 - RNA, 22 nt, Shigella flexneri 2a str. 2457T
uccggccuacaaaguccugcag

SEQ ID NO: 42774 - RNA, 22 nt, Shigella flexneri 2a str. 2457T
uccggccuuuuuuaucucuuac

SEQ ID NO: 42775 - RNA, 22 nt, Shigella flexneri 2a str. 2457T
uccgggcucaugcuguccaggu

SEQ ID NO: 42776 - RNA, 22 nt, Shigella flexneri 2a str. 2457T
uccgguuuugggaucaccugau

SEQ ID NO: 42777 - RNA, 20 nt, Shigella flexneri 2a str. 2457T
uccguuaucuccacccgacc

SEQ ID NO: 42778 - RNA, 22 nt, Shigella flexneri 2a str. 2457T
ucgaacagccgagcgacuucug

SEQ ID NO: 42779 - RNA, 20 nt, Shigella flexneri 2a str. 2457T
ucgacggcaaauuugugcag

SEQ ID NO: 42780 - RNA, 22 nt, Shigella flexneri 2a str. 2457T
ucgauauggugcagucgcugac

SEQ ID NO: 42781 - RNA, 22 nt, Shigella flexneri 2a str. 2457T
ucgaucucuauuccgacguuga

SEQ ID NO: 42782 - RNA, 22 nt, Shigella flexneri 2a str. 2457T
ucgcaaaccgggccugacgcug

SEQ ID NO: 42783 - RNA, 22 nt, Shigella flexneri 2a str. 2457T
ucgccaaccugcaguuuauagu

SEQ ID NO: 42784 - RNA, 22 nt, Shigella flexneri 2a str. 2457T
ucgcgguaauuauuccuugcug

SEQ ID NO: 42785 - RNA, 22 nt, Shigella flexneri 2a str. 2457T
ucgcuucgguuaaaaaaaggca

SEQ ID NO: 42786 - RNA, 22 nt, Shigella flexneri 2a str. 2457T
ucgcuuugauggcugcggcauu

SEQ ID NO: 42787 - RNA, 18 nt, Shigella flexneri 2a str. 2457T
ucggugcuaaaucacguc

SEQ ID NO: 42788 - RNA, 22 nt, Shigella flexneri 2a str. 2457T
ucggugcuaaaucacgucagcg

SEQ ID NO: 42789 - RNA, 22 nt, Shigella flexneri 2a str. 2457T
ucgguucugguucuuuaaccgg

SEQ ID NO: 42790 - RNA, 22 nt, Shigella flexneri 2a str. 2457T
ucgguugauaccaggccgcaag

SEQ ID NO: 42791 - RNA, 17 nt, Shigella flexneri 2a str. 2457T
ucguaucuucguugcgc

SEQ ID NO: 42792 - RNA, 21 nt, Shigella flexneri 2a str. 2457T
ucgucugguguucgaucugca

SEQ ID NO: 42793 - RNA, 22 nt, Shigella flexneri 2a str. 2457T
ucucaccguauaagagaauugg

SEQ ID NO: 42794 - RNA, 22 nt, Shigella flexneri 2a str. 2457T
ucugaaugaagccaguaauguu

SEQ ID NO: 42795 - RNA, 22 nt, Shigella flexneri 2a str. 2457T
ucugccaucaaauaugcccgcg

SEQ ID NO: 42796 - RNA, 22 nt, Shigella flexneri 2a str. 2457T
ucugcugccugacguugcagcu

SEQ ID NO: 42797 - RNA, 22 nt, Shigella flexneri 2a str. 2457T
ucuggcgcauuccgggcugucu

SEQ ID NO: 42798 - RNA, 23 nt, Shigella flexneri 2a str. 2457T
ucuggcuuguuucugcucaccgu

SEQ ID NO: 42799 - RNA, 22 nt, Shigella flexneri 2a str. 2457T
ucugguuaaccgcgagcaggau

SEQ ID NO: 42800 - RNA, 22 nt, Shigella flexneri 2a str. 2457T
ucuuugaugcggugccagcucu

SEQ ID NO: 42801 - RNA, 19 nt, Shigella flexneri 2a str. 2457T
ugaaagcgguugcaggcgg

SEQ ID NO: 42802 - RNA, 20 nt, Shigella flexneri 2a str. 2457T
ugaacuggaucucaucggua

SEQ ID NO: 42803 - RNA, 22 nt, Shigella flexneri 2a str. 2457T
ugaacuguucguccacuucggu

SEQ ID NO: 42804 - RNA, 22 nt, Shigella flexneri 2a str. 2457T
ugaagcacuauauuggugcaac

SEQ ID NO: 42805 - RNA, 22 nt, Shigella flexneri 2a str. 2457T
ugaagcggcgagcauuguugau

SEQ ID NO: 42806 - RNA, 22 nt, Shigella flexneri 2a str. 2457T
ugaccauuggugcaauauaccu

SEQ ID NO: 42807 - RNA, 22 nt, Shigella flexneri 2a str. 2457T
ugacgauggcggaauugcugac

SEQ ID NO: 42808 - RNA, 22 nt, Shigella flexneri 2a str. 2457T
ugacgccauuuuugcuggugau

SEQ ID NO: 42809 - RNA, 22 nt, Shigella flexneri 2a str. 2457T
ugacgcugaccggcgacgucca

SEQ ID NO: 42810 - RNA, 23 nt, Shigella flexneri 2a str. 2457T
ugacuuucagcaguugcugacgg

SEQ ID NO: 42811 - RNA, 22 nt, Shigella flexneri 2a str. 2457T
ugagaacggacguuugucgcgc

SEQ ID NO: 42812 - RNA, 22 nt, Shigella flexneri 2a str. 2457T
ugagaucauguuguagcgcccg

SEQ ID NO: 42813 - RNA, 22 nt, Shigella flexneri 2a str. 2457T
ugaguaaauacuguauggccug

SEQ ID NO: 42814 - RNA, 22 nt, Shigella flexneri 2a str. 2457T
ugauagcgcggcuggucgaugg

SEQ ID NO: 42815 - RNA, 22 nt, Shigella flexneri 2a str. 2457T
ugauaucacugucaaugcgacc

SEQ ID NO: 42816 - RNA, 19 nt, Shigella flexneri 2a str. 2457T
ugaucgagaagauugcgga

SEQ ID NO: 42817 - RNA, 22 nt, Shigella flexneri 2a str. 2457T
ugaugucagccugauuuugcgu

SEQ ID NO: 42818 - RNA, 22 nt, Shigella flexneri 2a str. 2457T
ugaugugauugucugcgcugaa

SEQ ID NO: 42819 - RNA, 22 nt, Shigella flexneri 2a str. 2457T
ugauugauccuugcgcgcggca

SEQ ID NO: 42820 - RNA, 22 nt, Shigella flexneri 2a str. 2457T
ugcaauccaggcauuaggaaaa

SEQ ID NO: 42821 - RNA, 22 nt, Shigella flexneri 2a str. 2457T
ugcaaucuccguguaggccuga

SEQ ID NO: 42822 - RNA, 18 nt, Shigella flexneri 2a str. 2457T
ugcacacgauaaacaggc

SEQ ID NO: 42823 - RNA, 22 nt, Shigella flexneri 2a str. 2457T
ugcaggaagggcaacagccguc

SEQ ID NO: 42824 - RNA, 19 nt, Shigella flexneri 2a str. 2457T
ugcaggguuuuuaaucgga

SEQ ID NO: 42825 - RNA, 18 nt, Shigella flexneri 2a str. 2457T
ugcaggucagccaucggg

SEQ ID NO: 42826 - RNA, 22 nt, Shigella flexneri 2a str. 2457T
ugcaggucuugucuaaaagcga

SEQ ID NO: 42827 - RNA, 22 nt, Shigella flexneri 2a str. 2457T
ugccaggcccaacccuuucaua

SEQ ID NO: 42828 - RNA, 22 nt, Shigella flexneri 2a str. 2457T
uuguaggcuggauaaggcguuc

SEQ ID NO: 42829 - RNA, 20 nt, Shigella flexneri 2a str. 2457T
uugucaagcauucagcuuga

SEQ ID NO: 42830 - RNA, 22 nt, Shigella flexneri 2a str. 2457T
uuguccgguacuggagccaacc

SEQ ID NO: 42831 - RNA, 23 nt, Shigella flexneri 2a str. 2457T
uuguuaccggcgcgaugcauacc

SEQ ID NO: 42832 - RNA, 20 nt, Shigella flexneri 2a str. 2457T
uuguucaguugaaggugugc

SEQ ID NO: 42833 - RNA, 22 nt, Shigella flexneri 2a str. 2457T
uuuaucgacaaaggccggauug

SEQ ID NO: 42834 - RNA, 19 nt, Shigella flexneri 2a str. 2457T
uuucaggauaggugugcgc

SEQ ID NO: 42835 - RNA, 22 nt, Shigella flexneri 2a str. 2457T
uuucaucgcggucagcugcugu

SEQ ID NO: 42836 - RNA, 22 nt, Shigella flexneri 2a str. 2457T
uuugacgauggcuuucaggucg

SEQ ID NO: 42837 - RNA, 22 nt, Shigella flexneri 2a str. 2457T
uuugccgaaaguggacgguaaa

SEQ ID NO: 42838 - RNA, 22 nt, Shigella flexneri 2a str. 2457T
uuugcgauucaaaaggcguuau

SEQ ID NO: 42839 - RNA, 22 nt, Shigella flexneri 2a str. 301
aaacgaaugacugauugccgau

SEQ ID NO: 42840 - RNA, 22 nt, Shigella flexneri 2a str. 301
aaacgucgauggcuuuugcgau

SEQ ID NO: 42841 - RNA, 22 nt, Shigella flexneri 2a str. 301
aaagaugucgaucuugaaaacu

SEQ ID NO: 42842 - RNA, 22 nt, Shigella flexneri 2a str. 301
aaagcgucaauauuugcgccug

SEQ ID NO: 42843 - RNA, 22 nt, Shigella flexneri 2a str. 301
aaaggccaucaucgcagucaua

SEQ ID NO: 42844 - RNA, 22 nt, Shigella flexneri 2a str. 301
aaauacgguuuaugaaaauagg

SEQ ID NO: 42845 - RNA, 20 nt, Shigella flexneri 2a str. 301
aaaucguccggggaaaccuu

SEQ ID NO: 42846 - RNA, 22 nt, Shigella flexneri 2a str. 301
aaauggguuauaccgaaccgga

SEQ ID NO: 42847 - RNA, 22 nt, Shigella flexneri 2a str. 301
aaauugccgaugcacgcuggcg

SEQ ID NO: 42848 - RNA, 22 nt, Shigella flexneri 2a str. 301
aacaggcuuaagacgcucgaac

SEQ ID NO: 42849 - RNA, 22 nt, Shigella flexneri 2a str. 301
aacagguuacggucgccguaaa

SEQ ID NO: 42850 - RNA, 22 nt, Shigella flexneri 2a str. 301
aacagguuuauuuagcuggcau

SEQ ID NO: 42851 - RNA, 22 nt, Shigella flexneri 2a str. 301
aaccuguuuguuaccaggcugg

SEQ ID NO: 42852 - RNA, 22 nt, Shigella flexneri 2a str. 301
aacgccuuauccggccuacaaa

SEQ ID NO: 42853 - RNA, 22 nt, Shigella flexneri 2a str. 301
aacggcgaagagcugaaagcgu

SEQ ID NO: 42854 - RNA, 22 nt, Shigella flexneri 2a str. 301
aacugaauguauuuacccacgg

SEQ ID NO: 42855 - RNA, 22 nt, Shigella flexneri 2a str. 301
aacugcugguuguuggcugcua

SEQ ID NO: 42856 - RNA, 22 nt, Shigella flexneri 2a str. 301
aacuggaagaacuggcgacgcg

SEQ ID NO: 42857 - RNA, 22 nt, Shigella flexneri 2a str. 301
aagagcgucucucuucgcguca

SEQ ID NO: 42858 - RNA, 19 nt, Shigella flexneri 2a str. 301
aagauacgaaacgggugcu

SEQ ID NO: 42859 - RNA, 22 nt, Shigella flexneri 2a str. 301
aagaugauguuaagcugcuaaa

SEQ ID NO: 42860 - RNA, 22 nt, Shigella flexneri 2a str. 301
aagcauuacuggucauugcaga

SEQ ID NO: 42861 - RNA, 22 nt, Shigella flexneri 2a str. 301
aagccucaguuucuaugcaaau

SEQ ID NO: 42862 - RNA, 22 nt, Shigella flexneri 2a str. 301
aagcggcguuacagauauucgg

SEQ ID NO: 42863 - RNA, 22 nt, Shigella flexneri 2a str. 301
aagcgguuguacccgugccggu

SEQ ID NO: 42864 - RNA, 22 nt, Shigella flexneri 2a str. 301
aagcuggaucucugaaaggauu

SEQ ID NO: 42865 - RNA, 22 nt, Shigella flexneri 2a str. 301
aagcuugucgaguugacgggcg

SEQ ID NO: 42866 - RNA, 22 nt, Shigella flexneri 2a str. 301
aaguuggcgaugauggcaaagc

SEQ ID NO: 42867 - RNA, 21 nt, Shigella flexneri 2a str. 301
aaguuguuaaaaugugcacag

SEQ ID NO: 42868 - RNA, 22 nt, Shigella flexneri 2a str. 301
aauaccguggaauaugccgggg

SEQ ID NO: 42869 - RNA, 22 nt, Shigella flexneri 2a str. 301
aauaugcugcaacccggcgugu

SEQ ID NO: 42870 - RNA, 20 nt, Shigella flexneri 2a str. 301
aaucaacugaguuucucaga

SEQ ID NO: 42871 - RNA, 22 nt, Shigella flexneri 2a str. 301
aaucagaauuuauuuuagcuaa

SEQ ID NO: 42872 - RNA, 22 nt, Shigella flexneri 2a str. 301
aaucgguagcaguuguuugcuc

SEQ ID NO: 42873 - RNA, 22 nt, Shigella flexneri 2a str. 301
aaucggucacuuaugauauugc

SEQ ID NO: 42874 - RNA, 23 nt, Shigella flexneri 2a str. 301
aaugcgccaaccuuccagcgaug

SEQ ID NO: 42875 - RNA, 22 nt, Shigella flexneri 2a str. 301
aaugcgcugguugaaguguuac

SEQ ID NO: 42876 - RNA, 22 nt, Shigella flexneri 2a str. 301
aauggcggaguguuggucaaaa

SEQ ID NO: 42877 - RNA, 22 nt, Shigella flexneri 2a str. 301
aauggucguuauucaucaccca

SEQ ID NO: 42878 - RNA, 22 nt, Shigella flexneri 2a str. 301
acacgcgguugcuuuugcccaa

SEQ ID NO: 42879 - RNA, 22 nt, Shigella flexneri 2a str. 301
acacgguagcgcgaccugcaac

SEQ ID NO: 42880 - RNA, 22 nt, Shigella flexneri 2a str. 301
acagagauguuuaauccuggcg

SEQ ID NO: 42881 - RNA, 22 nt, Shigella flexneri 2a str. 301
acagcggaaaccaggguagcca

SEQ ID NO: 42882 - RNA, 22 nt, Shigella flexneri 2a str. 301
acaggcaguugcguagauuucu

SEQ ID NO: 42883 - RNA, 22 nt, Shigella flexneri 2a str. 301
acauagugaaaaaaggcgugga

SEQ ID NO: 42884 - RNA, 18 nt, Shigella flexneri 2a str. 301
accaauguauauugcgga

SEQ ID NO: 42885 - RNA, 22 nt, Shigella flexneri 2a str. 301
accagcagcagcguauucaguu

SEQ ID NO: 42886 - RNA, 23 nt, Shigella flexneri 2a str. 301
acccaucgacggacgcgcggcga

SEQ ID NO: 42887 - RNA, 22 nt, Shigella flexneri 2a str. 301
accgcucaucgcccggaacuug

SEQ ID NO: 42888 - RNA, 22 nt, Shigella flexneri 2a str. 301
accggaaagaauaugcgccagc

SEQ ID NO: 42889 - RNA, 22 nt, Shigella flexneri 2a str. 301
accggcacacugcgcgccucau

SEQ ID NO: 42890 - RNA, 22 nt, Shigella flexneri 2a str. 301
accgggugauggcguugaccau

SEQ ID NO: 42891 - RNA, 22 nt, Shigella flexneri 2a str. 301
accggugcuuuaaaguguucuu

SEQ ID NO: 42892 - RNA, 22 nt, Shigella flexneri 2a str. 301
accguuucuugauggcgaguau

SEQ ID NO: 42893 - RNA, 22 nt, Shigella flexneri 2a str. 301
accguuuggcuguuucacgccg

SEQ ID NO: 42894 - RNA, 22 nt, Shigella flexneri 2a str. 301
accugauuaaaucugcccgugu

SEQ ID NO: 42895 - RNA, 22 nt, Shigella flexneri 2a str. 301
accugcauuuccgaacgcacgu

SEQ ID NO: 42896 - RNA, 22 nt, Shigella flexneri 2a str. 301
accuggcauucauucuucugca

SEQ ID NO: 42897 - RNA, 22 nt, Shigella flexneri 2a str. 301
acgaaggcgacaucagcagccg

SEQ ID NO: 42898 - RNA, 22 nt, Shigella flexneri 2a str. 301
acgaagugaaguuuguugauuu

SEQ ID NO: 42899 - RNA, 22 nt, Shigella flexneri 2a str. 301
acgcacguuuugcacgccaguu

SEQ ID NO: 42900 - RNA, 22 nt, Shigella flexneri 2a str. 301
acgcgaaguauauuuguucggc

SEQ ID NO: 42901 - RNA, 22 nt, Shigella flexneri 2a str. 301
acgcugaaguaccgcugucuga

SEQ ID NO: 42902 - RNA, 22 nt, Shigella flexneri 2a str. 301
acgcuucauugaagccgauuuc

SEQ ID NO: 42903 - RNA, 22 nt, Shigella flexneri 2a str. 301
acgcuucccauucugguugugc

SEQ ID NO: 42904 - RNA, 22 nt, Shigella flexneri 2a str. 301
acggccauuuuaugugcuaugu

SEQ ID NO: 42905 - RNA, 22 nt, Shigella flexneri 2a str. 301
acggcuggcgcuaucaggaaca

SEQ ID NO: 42906 - RNA, 22 nt, Shigella flexneri 2a str. 301
acgguggaaggcgcggagcugg

SEQ ID NO: 42907 - RNA, 22 nt, Shigella flexneri 2a str. 301
acgguuauggcauucguugugc

SEQ ID NO: 42908 - RNA, 22 nt, Shigella flexneri 2a str. 301
acguucauuaccggcgcauaca

SEQ ID NO: 42909 - RNA, 22 nt, Shigella flexneri 2a str. 301
augaucugggcuauggcaauac

SEQ ID NO: 42910 - RNA, 22 nt, Shigella flexneri 2a str. 301
augcaaugaaaguaccguucua

SEQ ID NO: 42911 - RNA, 22 nt, Shigella flexneri 2a str. 301
augcaguguaaacgucuuaucc

SEQ ID NO: 42912 - RNA, 22 nt, Shigella flexneri 2a str. 301
augccauugcugaauuugagaa

SEQ ID NO: 42913 - RNA, 22 nt, Shigella flexneri 2a str. 301
augccgcuuacucaagaagaaa

SEQ ID NO: 42914 - RNA, 22 nt, Shigella flexneri 2a str. 301
augccguagaagccgccagugc

SEQ ID NO: 42915 - RNA, 22 nt, Shigella flexneri 2a str. 301
augcgcuuaagcgucuggaugu

SEQ ID NO: 42916 - RNA, 22 nt, Shigella flexneri 2a str. 301
augcgcuucgcuuauccggccu

SEQ ID NO: 42917 - RNA, 22 nt, Shigella flexneri 2a str. 301
augcgucucugaacaggcggcc

SEQ ID NO: 42918 - RNA, 22 nt, Shigella flexneri 2a str. 301
augcguuucagccacgcguuug

SEQ ID NO: 42919 - RNA, 22 nt, Shigella flexneri 2a str. 301
augcguuucgcuuaucugaccu

SEQ ID NO: 42920 - RNA, 22 nt, Shigella flexneri 2a str. 301
augcugaccaugggcgauucgg

SEQ ID NO: 42921 - RNA, 22 nt, Shigella flexneri 2a str. 301
augcuggcgggcguugguggua

SEQ ID NO: 42922 - RNA, 22 nt, Shigella flexneri 2a str. 301
augcuugauuaaaaaggcgcua

SEQ ID NO: 42923 - RNA, 22 nt, Shigella flexneri 2a str. 301
augcuugcuucauggcugcgga

SEQ ID NO: 42924 - RNA, 22 nt, Shigella flexneri 2a str. 301
auggagcgagaaaacccgcaca

SEQ ID NO: 42925 - RNA, 22 nt, Shigella flexneri 2a str. 301
auggaugcuugucgggaaguga

SEQ ID NO: 42926 - RNA, 22 nt, Shigella flexneri 2a str. 301
auggccgccccgguuggggacg

SEQ ID NO: 42927 - RNA, 22 nt, Shigella flexneri 2a str. 301
auggcgauguagucuuucacgc

SEQ ID NO: 42928 - RNA, 22 nt, Shigella flexneri 2a str. 301
auggcgauguguuucaccugcu

SEQ ID NO: 42929 - RNA, 22 nt, Shigella flexneri 2a str. 301
augucguucggcgaggugguga

SEQ ID NO: 42930 - RNA, 22 nt, Shigella flexneri 2a str. 301
augugugcguuaccacuacuga

SEQ ID NO: 42931 - RNA, 22 nt, Shigella flexneri 2a str. 301
auuacagacugcccgcuugugg

SEQ ID NO: 42932 - RNA, 22 nt, Shigella flexneri 2a str. 301
auuagcgacaacauucgugcca

SEQ ID NO: 42933 - RNA, 22 nt, Shigella flexneri 2a str. 301
auuaucaggucaugcguaccga

SEQ ID NO: 42934 - RNA, 21 nt, Shigella flexneri 2a str. 301
auucaagucggugcgacgaua

SEQ ID NO: 42935 - RNA, 22 nt, Shigella flexneri 2a str. 301
auucauguggcguuauuucggc

SEQ ID NO: 42936 - RNA, 22 nt, Shigella flexneri 2a str. 301
auuccaggagugaguauucagg

SEQ ID NO: 42937 - RNA, 22 nt, Shigella flexneri 2a str. 301
auuggcaaucaucacgucguuu

SEQ ID NO: 42938 - RNA, 22 nt, Shigella flexneri 2a str. 301
auuggcaucugguacaacaauu

SEQ ID NO: 42939 - RNA, 21 nt, Shigella flexneri 2a str. 301
auuggucuggaaaucaugauu

SEQ ID NO: 42940 - RNA, 22 nt, Shigella flexneri 2a str. 301
auuuccgcgaacacuucgaagc

SEQ ID NO: 42941 - RNA, 22 nt, Shigella flexneri 2a str. 301
auuucggcgcauugccgggagc

SEQ ID NO: 42942 - RNA, 22 nt, Shigella flexneri 2a str. 301
auuucuggcggcauggugccag

SEQ ID NO: 42943 - RNA, 22 nt, Shigella flexneri 2a str. 301
caaagugugucgucggcauggu

SEQ ID NO: 42944 - RNA, 22 nt, Shigella flexneri 2a str. 301
caaauaggccaguugaugcuuu

SEQ ID NO: 42945 - RNA, 22 nt, Shigella flexneri 2a str. 301
caacggugagcguagcgugcug

SEQ ID NO: 42946 - RNA, 22 nt, Shigella flexneri 2a str. 301
caagcagauugugcucuccacg

SEQ ID NO: 42947 - RNA, 22 nt, Shigella flexneri 2a str. 301
caagcgccaguugucaucuucc

SEQ ID NO: 42948 - RNA, 22 nt, Shigella flexneri 2a str. 301
caaggcauggaagggagcguua

SEQ ID NO: 42949 - RNA, 22 nt, Shigella flexneri 2a str. 301
caauccggccuacaaauucaau

SEQ ID NO: 42950 - RNA, 22 nt, Shigella flexneri 2a str. 301
caccgcuguuagucagaacugu

SEQ ID NO: 42951 - RNA, 21 nt, Shigella flexneri 2a str. 301
caccggaagguaacugcgcgg

SEQ ID NO: 42952 - RNA, 22 nt, Shigella flexneri 2a str. 301
cacgccguggcgugcagcaugg

SEQ ID NO: 42953 - RNA, 22 nt, Shigella flexneri 2a str. 301
cacggugugcguuucgccagug

SEQ ID NO: 42954 - RNA, 22 nt, Shigella flexneri 2a str. 301
cacgguuuccuguaaaguggug

SEQ ID NO: 42955 - RNA, 22 nt, Shigella flexneri 2a str. 301
cagaacuggugauacagcggcu

SEQ ID NO: 42956 - RNA, 22 nt, Shigella flexneri 2a str. 301
cagaauauuugccauaagggaa

SEQ ID NO: 42957 - RNA, 22 nt, Shigella flexneri 2a str. 301
cagauauaaacacgcgccguau

SEQ ID NO: 42958 - RNA, 22 nt, Shigella flexneri 2a str. 301
cagcagugccaguucauggcau

SEQ ID NO: 42959 - RNA, 22 nt, Shigella flexneri 2a str. 301
cagcccguuauguacgaaggcc

SEQ ID NO: 42960 - RNA, 19 nt, Shigella flexneri 2a str. 301
cagccugucaggucugggc

SEQ ID NO: 42961 - RNA, 22 nt, Shigella flexneri 2a str. 301
cagcgaaaugcuguugcagcgc

SEQ ID NO: 42962 - RNA, 22 nt, Shigella flexneri 2a str. 301
cagcgauuguugccguagaggu

SEQ ID NO: 42963 - RNA, 22 nt, Shigella flexneri 2a str. 301
caggaguuggcgaugaaugacc

SEQ ID NO: 42964 - RNA, 22 nt, Shigella flexneri 2a str. 301
caggcauggaggucacgguuga

SEQ ID NO: 42965 - RNA, 22 nt, Shigella flexneri 2a str. 301
caggccuacaagaugauugcaa

SEQ ID NO: 42966 - RNA, 22 nt, Shigella flexneri 2a str. 301
caggccuacgugguuuaugcaa

SEQ ID NO: 42967 - RNA, 22 nt, Shigella flexneri 2a str. 301
cagggcaugaccaucagggcag

SEQ ID NO: 42968 - RNA, 22 nt, Shigella flexneri 2a str. 301
caguauuugccgccagagauga

SEQ ID NO: 42969 - RNA, 22 nt, Shigella flexneri 2a str. 301
cagucagugguuugcccuucuu

SEQ ID NO: 42970 - RNA, 22 nt, Shigella flexneri 2a str. 301
caguguuucggucugauaugga

SEQ ID NO: 42971 - RNA, 22 nt, Shigella flexneri 2a str. 301
caucaggcaauguugcguuugu

SEQ ID NO: 42972 - RNA, 22 nt, Shigella flexneri 2a str. 301
cauccugagacacgugcagugg

SEQ ID NO: 42973 - RNA, 22 nt, Shigella flexneri 2a str. 301
caucgcuggggauugguauuuu

SEQ ID NO: 42974 - RNA, 22 nt, Shigella flexneri 2a str. 301
caucguuuccgauggaagcaua

SEQ ID NO: 42975 - RNA, 22 nt, Shigella flexneri 2a str. 301
caucugucugauaaaaaacccg

SEQ ID NO: 42976 - RNA, 22 nt, Shigella flexneri 2a str. 301
caucuuauccagcaaccagguc

SEQ ID NO: 42977 - RNA, 22 nt, Shigella flexneri 2a str. 301
cauggugucaauauccugcggc

SEQ ID NO: 42978 - RNA, 22 nt, Shigella flexneri 2a str. 301
cauugcaccaauauggugcuua

SEQ ID NO: 42979 - RNA, 22 nt, Shigella flexneri 2a str. 301
cauugcgcagguuuggagugau

SEQ ID NO: 42980 - RNA, 22 nt, Shigella flexneri 2a str. 301
ccacguagucuuuaccgcuguc

SEQ ID NO: 42981 - RNA, 22 nt, Shigella flexneri 2a str. 301
ccagaucggaaccacggacgau

SEQ ID NO: 42982 - RNA, 22 nt, Shigella flexneri 2a str. 301
ccagguuauugggcgauacacc

SEQ ID NO: 42983 - RNA, 22 nt, Shigella flexneri 2a str. 301
ccaguaauagcgcguugauccc

SEQ ID NO: 42984 - RNA, 22 nt, Shigella flexneri 2a str. 301
ccaguaaucaagacaguaccag

SEQ ID NO: 42985 - RNA, 22 nt, Shigella flexneri 2a str. 301
ccagucaacgguaauucaggcc

SEQ ID NO: 42986 - RNA, 18 nt, Shigella flexneri 2a str. 301
ccaguuccggcaccacag

SEQ ID NO: 42987 - RNA, 23 nt, Shigella flexneri 2a str. 301
ccauccgcgaacugucuuucacc

SEQ ID NO: 42988 - RNA, 22 nt, Shigella flexneri 2a str. 301
ccauccgggcgaagccauggac

SEQ ID NO: 42989 - RNA, 19 nt, Shigella flexneri 2a str. 301
ccaugcucguucuucugcu

SEQ ID NO: 42990 - RNA, 22 nt, Shigella flexneri 2a str. 301
ccauggcaacuaaaacguacag

SEQ ID NO: 42991 - RNA, 22 nt, Shigella flexneri 2a str. 301
cugauucugguaaccauaauuu

SEQ ID NO: 42992 - RNA, 22 nt, Shigella flexneri 2a str. 301
cugauuucccagugacaacaua

SEQ ID NO: 42993 - RNA, 22 nt, Shigella flexneri 2a str. 301
cugccgaggaauuaccugauuc

SEQ ID NO: 42994 - RNA, 22 nt, Shigella flexneri 2a str. 301
cugccggacugaaaauugauga

SEQ ID NO: 42995 - RNA, 22 nt, Shigella flexneri 2a str. 301
cugcgcaucaaaaagauaaaag

SEQ ID NO: 42996 - RNA, 23 nt, Shigella flexneri 2a str. 301
cuggagacaggaaaaauuaugcu

SEQ ID NO: 42997 - RNA, 22 nt, Shigella flexneri 2a str. 301
cuggagauuaugcguaaagcca

SEQ ID NO: 42998 - RNA, 22 nt, Shigella flexneri 2a str. 301
cuggagccuguugggugacacg

SEQ ID NO: 42999 - RNA, 22 nt, Shigella flexneri 2a str. 301
cuggaugucggugccgaugacu

SEQ ID NO: 43000 - RNA, 22 nt, Shigella flexneri 2a str. 301
cuggcgauggucggugauggua

SEQ ID NO: 43001 - RNA, 22 nt, Shigella flexneri 2a str. 301
cuggcgauguucuaugaagugg

SEQ ID NO: 43002 - RNA, 22 nt, Shigella flexneri 2a str. 301
cugggcgaggauuacauccgca

SEQ ID NO: 43003 - RNA, 22 nt, Shigella flexneri 2a str. 301
cugggcuaacgccgaugaaagc

SEQ ID NO: 43004 - RNA, 22 nt, Shigella flexneri 2a str. 301
cugggcugacaccguacaggag

SEQ ID NO: 43005 - RNA, 22 nt, Shigella flexneri 2a str. 301
cuggugauuggcgcaggcaugg

SEQ ID NO: 43006 - RNA, 22 nt, Shigella flexneri 2a str. 301
cugugcgccaaauccacugacc

SEQ ID NO: 43007 - RNA, 22 nt, Shigella flexneri 2a str. 301
cugugggcugacguacuggcgg

SEQ ID NO: 43008 - RNA, 22 nt, Shigella flexneri 2a str. 301
cuguugcaggaaggcuucaucg

SEQ ID NO: 43009 - RNA, 22 nt, Shigella flexneri 2a str. 301
cuguugcaguacuuucguggug

SEQ ID NO: 43010 - RNA, 22 nt, Shigella flexneri 2a str. 301
cuuacauuaaugaagcuauccg

SEQ ID NO: 43011 - RNA, 23 nt, Shigella flexneri 2a str. 301
cuucaacgcagcguugccacuuc

SEQ ID NO: 43012 - RNA, 22 nt, Shigella flexneri 2a str. 301
cuucacaguauauuugaaaaag

SEQ ID NO: 43013 - RNA, 22 nt, Shigella flexneri 2a str. 301
cuucgcgcuccagcugacggca

SEQ ID NO: 43014 - RNA, 22 nt, Shigella flexneri 2a str. 301
cuugagauuaaagaagaacggc

SEQ ID NO: 43015 - RNA, 22 nt, Shigella flexneri 2a str. 301
cuugccgugacaaauaaugaug

SEQ ID NO: 43016 - RNA, 22 nt, Shigella flexneri 2a str. 301
cuuuggcaaaccgccagcuagg

SEQ ID NO: 43017 - RNA, 22 nt, Shigella flexneri 2a str. 301
gaaacgcucgaaaaacuggcag

SEQ ID NO: 43018 - RNA, 23 nt, Shigella flexneri 2a str. 301
gaaauccggacgcguuaacaccg

SEQ ID NO: 43019 - RNA, 22 nt, Shigella flexneri 2a str. 301
gaaauucuucgcugaacgcgua

SEQ ID NO: 43020 - RNA, 22 nt, Shigella flexneri 2a str. 301
gaacagcccgguuuucaguugc

SEQ ID NO: 43021 - RNA, 22 nt, Shigella flexneri 2a str. 301
gaagcguuggucaguaguuguu

SEQ ID NO: 43022 - RNA, 22 nt, Shigella flexneri 2a str. 301
gaaggccagccggucaucagcg

SEQ ID NO: 43023 - RNA, 22 nt, Shigella flexneri 2a str. 301
gaagguuaacccgcugggcggc

SEQ ID NO: 43024 - RNA, 22 nt, Shigella flexneri 2a str. 301
gaagguuucgguguuuauacaa

SEQ ID NO: 43025 - RNA, 21 nt, Shigella flexneri 2a str. 301
gaaugcugaaaaugccgcgcu

SEQ ID NO: 43026 - RNA, 22 nt, Shigella flexneri 2a str. 301
gacaccugacgauacuguguug

SEQ ID NO: 43027 - RNA, 22 nt, Shigella flexneri 2a str. 301
gacacuuaaaugauugauuuua

SEQ ID NO: 43028 - RNA, 22 nt, Shigella flexneri 2a str. 301
gacgaacauuacuggcuucauu

SEQ ID NO: 43029 - RNA, 22 nt, Shigella flexneri 2a str. 301
gacgcgguuuaaccgacgcgga

SEQ ID NO: 43030 - RNA, 22 nt, Shigella flexneri 2a str. 301
gacggcaccugguccaccggcg

SEQ ID NO: 43031 - RNA, 22 nt, Shigella flexneri 2a str. 301
gacuggaaacccgugccaugcu

SEQ ID NO: 43032 - RNA, 22 nt, Shigella flexneri 2a str. 301
gacuggugacgggcguucucga

SEQ ID NO: 43033 - RNA, 22 nt, Shigella flexneri 2a str. 301
gagaugauucaggcagacuggg

SEQ ID NO: 43034 - RNA, 22 nt, Shigella flexneri 2a str. 301
gagaugcggguucgucaaaggu

SEQ ID NO: 43035 - RNA, 22 nt, Shigella flexneri 2a str. 301
gagcagaucgaaaaaguggcga

SEQ ID NO: 43036 - RNA, 22 nt, Shigella flexneri 2a str. 301
gagcauucccauaaacucagau

SEQ ID NO: 43037 - RNA, 22 nt, Shigella flexneri 2a str. 301
gagccggaacuuugcugcaaug

SEQ ID NO: 43038 - RNA, 22 nt, Shigella flexneri 2a str. 301
gagccggacuuuauugauauac

SEQ ID NO: 43039 - RNA, 21 nt, Shigella flexneri 2a str. 301
gagcgcaggcggaauggcggc

SEQ ID NO: 43040 - RNA, 22 nt, Shigella flexneri 2a str. 301
gaguaagugugaaguugccgga

SEQ ID NO: 43041 - RNA, 22 nt, Shigella flexneri 2a str. 301
gaguuuaucuucuacuacguga

SEQ ID NO: 43042 - RNA, 22 nt, Shigella flexneri 2a str. 301
gauacgcugaaugaaaucgaac

SEQ ID NO: 43043 - RNA, 22 nt, Shigella flexneri 2a str. 301
gauaggcuaacaauuaccggau

SEQ ID NO: 43044 - RNA, 21 nt, Shigella flexneri 2a str. 301
gauagucgaggaucugccguu

SEQ ID NO: 43045 - RNA, 22 nt, Shigella flexneri 2a str. 301
gaucaggaauugcuuacuuggu

SEQ ID NO: 43046 - RNA, 22 nt, Shigella flexneri 2a str. 301
gaucgacgccguucgcgcugaa

SEQ ID NO: 43047 - RNA, 22 nt, Shigella flexneri 2a str. 301
gaucugaguuuaugggaaugcu

SEQ ID NO: 43048 - RNA, 20 nt, Shigella flexneri 2a str. 301
gaugaacaguucuucucugu

SEQ ID NO: 43049 - RNA, 22 nt, Shigella flexneri 2a str. 301
gaugccugcaaacgucuggcag

SEQ ID NO: 43050 - RNA, 22 nt, Shigella flexneri 2a str. 301
gaugcgaagcagggcggcgguu

SEQ ID NO: 43051 - RNA, 22 nt, Shigella flexneri 2a str. 301
gaugcgccaugaguuuauuuua

SEQ ID NO: 43052 - RNA, 22 nt, Shigella flexneri 2a str. 301
gauggcggugguucuguucguc

SEQ ID NO: 43053 - RNA, 20 nt, Shigella flexneri 2a str. 301
gaugugccuuuagacucagc

SEQ ID NO: 43054 - RNA, 22 nt, Shigella flexneri 2a str. 301
gauugcgacucuggucguggga

SEQ ID NO: 43055 - RNA, 22 nt, Shigella flexneri 2a str. 301
gcaacucucuacuguuucucca

SEQ ID NO: 43056 - RNA, 22 nt, Shigella flexneri 2a str. 301
gcaagcugguucagguucgucg

SEQ ID NO: 43057 - RNA, 22 nt, Shigella flexneri 2a str. 301
gcacauaacucauacugagcaa

SEQ ID NO: 43058 - RNA, 17 nt, Shigella flexneri 2a str. 301
gcaccgugcagcucuug

SEQ ID NO: 43059 - RNA, 22 nt, Shigella flexneri 2a str. 301
gcagcgacgauggaaaaaggga

SEQ ID NO: 43060 - RNA, 22 nt, Shigella flexneri 2a str. 301
gcaggcgagugaaacauagaga

SEQ ID NO: 43061 - RNA, 22 nt, Shigella flexneri 2a str. 301
gcaguacgugccuaaaaugcug

SEQ ID NO: 43062 - RNA, 22 nt, Shigella flexneri 2a str. 301
gccagcgagucuucaccaacgg

SEQ ID NO: 43063 - RNA, 22 nt, Shigella flexneri 2a str. 301
gcccgcuaagcaggcgcauuac

SEQ ID NO: 43064 - RNA, 22 nt, Shigella flexneri 2a str. 301
gcccggaucgccuacgggcuga

SEQ ID NO: 43065 - RNA, 22 nt, Shigella flexneri 2a str. 301
gccgcuucuuccagcaggaucu

SEQ ID NO: 43066 - RNA, 22 nt, Shigella flexneri 2a str. 301
gccggucaaucgcauucugggg

SEQ ID NO: 43067 - RNA, 22 nt, Shigella flexneri 2a str. 301
gccgucaaguugucauaauugg

SEQ ID NO: 43068 - RNA, 22 nt, Shigella flexneri 2a str. 301
gccguggaaaucggugauugau

SEQ ID NO: 43069 - RNA, 22 nt, Shigella flexneri 2a str. 301
gccguuggcaccaacaccauug

SEQ ID NO: 43070 - RNA, 19 nt, Shigella flexneri 2a str. 301
gccguuugcgucaguuuuu

SEQ ID NO: 43071 - RNA, 23 nt, Shigella flexneri 2a str. 301
gccuacuguuaggucaugccagc

SEQ ID NO: 43072 - RNA, 22 nt, Shigella flexneri 2a str. 301
gcgaacuuacgucugguuauuu

SEQ ID NO: 43073 - RNA, 22 nt, Shigella flexneri 2a str. 301
gugggcgacgccaggcugaaug

SEQ ID NO: 43074 - RNA, 22 nt, Shigella flexneri 2a str. 301
gugugcaaagacugauagccgu

SEQ ID NO: 43075 - RNA, 22 nt, Shigella flexneri 2a str. 301
guuaaugacuaacacaccggca

SEQ ID NO: 43076 - RNA, 22 nt, Shigella flexneri 2a str. 301
guuaucgacguauuccagacgg

SEQ ID NO: 43077 - RNA, 22 nt, Shigella flexneri 2a str. 301
guucagcagauuuggcgcaacu

SEQ ID NO: 43078 - RNA, 22 nt, Shigella flexneri 2a str. 301
guucagcagauuuggcgcaccu

SEQ ID NO: 43079 - RNA, 22 nt, Shigella flexneri 2a str. 301
guucaggauaagaaauuuagcg

SEQ ID NO: 43080 - RNA, 19 nt, Shigella flexneri 2a str. 301
guuccguagauccgccgcc

SEQ ID NO: 43081 - RNA, 22 nt, Shigella flexneri 2a str. 301
guucgauucaccgauaugcauc

SEQ ID NO: 43082 - RNA, 22 nt, Shigella flexneri 2a str. 301
guucucaucgcucuuaccgggg

SEQ ID NO: 43083 - RNA, 22 nt, Shigella flexneri 2a str. 301
guugaaggauugcaggaacugg

SEQ ID NO: 43084 - RNA, 22 nt, Shigella flexneri 2a str. 301
guugagcuguuuuagcgaaaca

SEQ ID NO: 43085 - RNA, 19 nt, Shigella flexneri 2a str. 301
guugccgcuuuccagcccg

SEQ ID NO: 43086 - RNA, 22 nt, Shigella flexneri 2a str. 301
guugcgucugcuccugaaugac

SEQ ID NO: 43087 - RNA, 22 nt, Shigella flexneri 2a str. 301
guugugaaguaauacaaaacag

SEQ ID NO: 43088 - RNA, 23 nt, Shigella flexneri 2a str. 301
guuuacccaaugaagaugcgccg

SEQ ID NO: 43089 - RNA, 22 nt, Shigella flexneri 2a str. 301
guuugaucagaauacgaucguu

SEQ ID NO: 43090 - RNA, 22 nt, Shigella flexneri 2a str. 301
uaaagaugucguuuuguugcua

SEQ ID NO: 43091 - RNA, 22 nt, Shigella flexneri 2a str. 301
uaaagugaugguagucacauaa

SEQ ID NO: 43092 - RNA, 22 nt, Shigella flexneri 2a str. 301
uaacggcgaucgcgccagcgga

SEQ ID NO: 43093 - RNA, 23 nt, Shigella flexneri 2a str. 301
uaacugaggugauuaugggcuuc

SEQ ID NO: 43094 - RNA, 22 nt, Shigella flexneri 2a str. 301
uaagauugugaaugacggccgg

SEQ ID NO: 43095 - RNA, 22 nt, Shigella flexneri 2a str. 301
uaaucaguggucuguuauuuau

SEQ ID NO: 43096 - RNA, 22 nt, Shigella flexneri 2a str. 301
uaaucccgauugaagagaaguu

SEQ ID NO: 43097 - RNA, 22 nt, Shigella flexneri 2a str. 301
uacaaaugccauuauugacgau

SEQ ID NO: 43098 - RNA, 22 nt, Shigella flexneri 2a str. 301
uacccgcgugcuggcagggaug

SEQ ID NO: 43099 - RNA, 22 nt, Shigella flexneri 2a str. 301
uacccguugcggcggucaguga

SEQ ID NO: 43100 - RNA, 22 nt, Shigella flexneri 2a str. 301
uaccggugcgcuggcggugaug

SEQ ID NO: 43101 - RNA, 22 nt, Shigella flexneri 2a str. 301
uaccguuacgcugcggugccag

SEQ ID NO: 43102 - RNA, 22 nt, Shigella flexneri 2a str. 301
uacgcgcgaccaacggguagua

SEQ ID NO: 43103 - RNA, 22 nt, Shigella flexneri 2a str. 301
uacggcuguuucugacgguaag

SEQ ID NO: 43104 - RNA, 22 nt, Shigella flexneri 2a str. 301
uacgugcguucggaaaugcagg

SEQ ID NO: 43105 - RNA, 23 nt, Shigella flexneri 2a str. 301
uacucggcagcauuuuuaaccgg

SEQ ID NO: 43106 - RNA, 22 nt, Shigella flexneri 2a str. 301
uacugaauguuguugguauccu

SEQ ID NO: 43107 - RNA, 22 nt, Shigella flexneri 2a str. 301
uagaacuggugcgucagcagcu

SEQ ID NO: 43108 - RNA, 22 nt, Shigella flexneri 2a str. 301
uagaagacucggucacucaggu

SEQ ID NO: 43109 - RNA, 22 nt, Shigella flexneri 2a str. 301
uagaugcguuuucacccgcugg

SEQ ID NO: 43110 - RNA, 22 nt, Shigella flexneri 2a str. 301
uagcaagugccaugcucaguca

SEQ ID NO: 43111 - RNA, 20 nt, Shigella flexneri 2a str. 301
uagccucagcuccuuacgaa

SEQ ID NO: 43112 - RNA, 22 nt, Shigella flexneri 2a str. 301
uagcgaacugucgcugcuggaa

SEQ ID NO: 43113 - RNA, 22 nt, Shigella flexneri 2a str. 301
uagcgacccauuuugccgguuc

SEQ ID NO: 43114 - RNA, 22 nt, Shigella flexneri 2a str. 301
uagcggacgucgacuacuggaa

SEQ ID NO: 43115 - RNA, 22 nt, Shigella flexneri 2a str. 301
uaggccagauaaggcguuuacg

SEQ ID NO: 43116 - RNA, 22 nt, Shigella flexneri 2a str. 301
uaggccggacaaggcguucacg

SEQ ID NO: 43117 - RNA, 22 nt, Shigella flexneri 2a str. 301
uaggccggauaaggcguagacg

SEQ ID NO: 43118 - RNA, 22 nt, Shigella flexneri 2a str. 301
uagggcagauguauaccgacuc

SEQ ID NO: 43119 - RNA, 22 nt, Shigella flexneri 2a str. 301
uaucaauggcuggcuuauugug

SEQ ID NO: 43120 - RNA, 22 nt, Shigella flexneri 2a str. 301
uaucauguucucguucgguggu

SEQ ID NO: 43121 - RNA, 22 nt, Shigella flexneri 2a str. 301
uauccacugugcgccagccuuc

SEQ ID NO: 43122 - RNA, 23 nt, Shigella flexneri 2a str. 301
uauccgaccuacaaaaccgugca

SEQ ID NO: 43123 - RNA, 22 nt, Shigella flexneri 2a str. 301
uauccgaugguuuagccuguau

SEQ ID NO: 43124 - RNA, 22 nt, Shigella flexneri 2a str. 301
uaucgaaacgcaucuggugaug

SEQ ID NO: 43125 - RNA, 20 nt, Shigella flexneri 2a str. 301
uaucgugauuuguaaucgcc

SEQ ID NO: 43126 - RNA, 22 nt, Shigella flexneri 2a str. 301
uaucuggccuacaaagggcuaa

SEQ ID NO: 43127 - RNA, 22 nt, Shigella flexneri 2a str. 301
uaucugggaagugccaggcggu

SEQ ID NO: 43128 - RNA, 22 nt, Shigella flexneri 2a str. 301
uaugcauaaaaagcagcggcug

SEQ ID NO: 43129 - RNA, 22 nt, Shigella flexneri 2a str. 301
uauggcaccaacgcguuacugg

SEQ ID NO: 43130 - RNA, 19 nt, Shigella flexneri 2a str. 301
uauuacggcugauuugcaa

SEQ ID NO: 43131 - RNA, 21 nt, Shigella flexneri 2a str. 301
uauuccggccuguucaauaug

SEQ ID NO: 43132 - RNA, 22 nt, Shigella flexneri 2a str. 301
uauugugaggauaucaaaauga

SEQ ID NO: 43133 - RNA, 22 nt, Shigella flexneri 2a str. 301
ucaaacucccuuuacuuaccuu

SEQ ID NO: 43134 - RNA, 19 nt, Shigella flexneri 2a str. 301
ucaacuggcgcaaaacugg

SEQ ID NO: 43135 - RNA, 22 nt, Shigella flexneri 2a str. 301
ucaauaagcgcaggcuguugag

SEQ ID NO: 43136 - RNA, 22 nt, Shigella flexneri 2a str. 301
ucaaugauggugccucgcuguu

SEQ ID NO: 43137 - RNA, 22 nt, Shigella flexneri 2a str. 301
ucacggcguuccuaucgcaugc

SEQ ID NO: 43138 - RNA, 17 nt, Shigella flexneri 2a str. 301
ucacuacaccgaucucg

SEQ ID NO: 43139 - RNA, 22 nt, Shigella flexneri 2a str. 301
ucacugcgaucugaaagacaac

SEQ ID NO: 43140 - RNA, 22 nt, Shigella flexneri 2a str. 301
ucaggcaaaugccaguaaaaac

SEQ ID NO: 43141 - RNA, 22 nt, Shigella flexneri 2a str. 301
ucaggccuacacggagauugca

SEQ ID NO: 43142 - RNA, 22 nt, Shigella flexneri 2a str. 301
ucaggccuacgucauauugcaa

SEQ ID NO: 43143 - RNA, 22 nt, Shigella flexneri 2a str. 301
ucaggcguucuuccaucaguug

SEQ ID NO: 43144 - RNA, 22 nt, Shigella flexneri 2a str. 301
ucaggcugaugguggcacucgu

SEQ ID NO: 43145 - RNA, 22 nt, Shigella flexneri 2a str. 301
ucaggucguucugccacgaacu

SEQ ID NO: 43146 - RNA, 22 nt, Shigella flexneri 2a str. 301
ucaguuugcccugauauucguc

SEQ ID NO: 43147 - RNA, 22 nt, Shigella flexneri 2a str. 301
ucauaauggcgucagcacguuu

SEQ ID NO: 43148 - RNA, 22 nt, Shigella flexneri 2a str. 301
ucaucaugucuucaacacguau

SEQ ID NO: 43149 - RNA, 22 nt, Shigella flexneri 2a str. 301
ucauguaggcggugaugagcug

SEQ ID NO: 43150 - RNA, 22 nt, Shigella flexneri 2a str. 301
ucaugugaccaaacaggcggcg

SEQ ID NO: 43151 - RNA, 22 nt, Shigella flexneri 2a str. 301
ucauugcugagacaggcucugu

SEQ ID NO: 43152 - RNA, 22 nt, Shigella flexneri 2a str. 301
uccagcaaauugugauagcgca

SEQ ID NO: 43153 - RNA, 22 nt, Shigella flexneri 2a str. 301
ucccgguaaucgaugacgacga

SEQ ID NO: 43154 - RNA, 23 nt, Shigella flexneri 2a str. 301
uccgccugccaguaggcaaugaa

SEQ ID NO: 43155 - RNA, 22 nt, Shigella flexneri 2a str. 301
uggcauuuugccuuuaggaugu

SEQ ID NO: 43156 - RNA, 22 nt, Shigella flexneri 2a str. 301
uggcgcaucugcaccugaccag

SEQ ID NO: 43157 - RNA, 22 nt, Shigella flexneri 2a str. 301
uggcggcaaucggugcugcgau

SEQ ID NO: 43158 - RNA, 22 nt, Shigella flexneri 2a str. 301
uggcguacucuuuuuccagcgc

SEQ ID NO: 43159 - RNA, 20 nt, Shigella flexneri 2a str. 301
uggcguaggcaagugaaauc

SEQ ID NO: 43160 - RNA, 22 nt, Shigella flexneri 2a str. 301
uggcguauuucuaucuucuauu

SEQ ID NO: 43161 - RNA, 22 nt, Shigella flexneri 2a str. 301
uggcgucguguagcgaugacca

SEQ ID NO: 43162 - RNA, 22 nt, Shigella flexneri 2a str. 301
uggcucucccccauuuacggau

SEQ ID NO: 43163 - RNA, 22 nt, Shigella flexneri 2a str. 301
uggcuggcaauacuggcagcag

SEQ ID NO: 43164 - RNA, 22 nt, Shigella flexneri 2a str. 301
uggcuggcgacgccaagacggc

SEQ ID NO: 43165 - RNA, 22 nt, Shigella flexneri 2a str. 301
ugggcgaagcguuaaccggcau

SEQ ID NO: 43166 - RNA, 22 nt, Shigella flexneri 2a str. 301
ugggcgauaggugcgguagugc

SEQ ID NO: 43167 - RNA, 22 nt, Shigella flexneri 2a str. 301
ugguaaugacaagccgcgucuc

SEQ ID NO: 43168 - RNA, 22 nt, Shigella flexneri 2a str. 301
uggugaauuuacggaaauucua

SEQ ID NO: 43169 - RNA, 22 nt, Shigella flexneri 2a str. 301
uguaccaccgguaagcugaauu

SEQ ID NO: 43170 - RNA, 22 nt, Shigella flexneri 2a str. 301
uguaccuucaccguuggcggca

SEQ ID NO: 43171 - RNA, 18 nt, Shigella flexneri 2a str. 301
uguacggugucagcccag

SEQ ID NO: 43172 - RNA, 22 nt, Shigella flexneri 2a str. 301
ugucaggacacggggcuuguag

SEQ ID NO: 43173 - RNA, 22 nt, Shigella flexneri 2a str. 301
ugucguuaucaauugcuccggu

SEQ ID NO: 43174 - RNA, 20 nt, Shigella flexneri 2a str. 301
ugucuaugguucagagcugu

SEQ ID NO: 43175 - RNA, 22 nt, Shigella flexneri 2a str. 301
ugucugucucugggccuugaua

SEQ ID NO: 43176 - RNA, 22 nt, Shigella flexneri 2a str. 301
ugugaccugcuggaagagaacu

SEQ ID NO: 43177 - RNA, 22 nt, Shigella flexneri 2a str. 301
ugugacgaaaaccuuuaauugu

SEQ ID NO: 43178 - RNA, 20 nt, Shigella flexneri 2a str. 301
ugugcugccccguggcuuuu

SEQ ID NO: 43179 - RNA, 22 nt, Shigella flexneri 2a str. 301
uguuaccgccggauuuacgccg

SEQ ID NO: 43180 - RNA, 22 nt, Shigella flexneri 2a str. 301
uguugccacugcacauggugaa

SEQ ID NO: 43181 - RNA, 22 nt, Shigella flexneri 2a str. 301
uguugcccaucucaacguacug

SEQ ID NO: 43182 - RNA, 22 nt, Shigella flexneri 2a str. 301
uuaaacugaacauugaagcuaa

SEQ ID NO: 43183 - RNA, 22 nt, Shigella flexneri 2a str. 301
uuacccgaccgagccgcgccau

SEQ ID NO: 43184 - RNA, 23 nt, Shigella flexneri 2a str. 301
uuaccgaugaauuuauucguggu

SEQ ID NO: 43185 - RNA, 22 nt, Shigella flexneri 2a str. 301
uuacgcucuugauccuguuccg

SEQ ID NO: 43186 - RNA, 22 nt, Shigella flexneri 2a str. 301
uuacguucggcgagcaguuguu

SEQ ID NO: 43187 - RNA, 22 nt, Shigella flexneri 2a str. 301
uuacugauguugcgaaaacgcu

SEQ ID NO: 43188 - RNA, 18 nt, Shigella flexneri 2a str. 301
uuacugcgugcuuauccu

SEQ ID NO: 43189 - RNA, 22 nt, Shigella flexneri 2a str. 301
uuagccgaccagguggcgauga

SEQ ID NO: 43190 - RNA, 22 nt, Shigella flexneri 2a str. 301
uuagccguagaggcuguuucug

SEQ ID NO: 43191 - RNA, 22 nt, Shigella flexneri 2a str. 301
uuauacccuggcgcugcaucgu

SEQ ID NO: 43192 - RNA, 22 nt, Shigella flexneri 2a str. 301
uucaccagcgccagcgcuucug

SEQ ID NO: 43193 - RNA, 21 nt, Shigella flexneri 2a str. 301
uucagccuggcgucgcccacu

SEQ ID NO: 43194 - RNA, 22 nt, Shigella flexneri 2a str. 301
uucagggcuucucccaguacau

SEQ ID NO: 43195 - RNA, 22 nt, Shigella flexneri 2a str. 301
uucagggucuggauugccugca

SEQ ID NO: 43196 - RNA, 22 nt, Shigella flexneri 2a str. 301
uuccaccguugcuguugcgucg

SEQ ID NO: 43197 - RNA, 22 nt, Shigella flexneri 2a str. 301
uuccaugaagcaucgcgcaugg

SEQ ID NO: 43198 - RNA, 22 nt, Shigella flexneri 2a str. 301
uucgaucgcguuguuuugcagg

SEQ ID NO: 43199 - RNA, 22 nt, Shigella flexneri 2a str. 301
uucgcaagugacaucuuuuggc

SEQ ID NO: 43200 - RNA, 22 nt, Shigella flexneri 2a str. 301
uucgcgaacgucgaggaucugg

SEQ ID NO: 43201 - RNA, 22 nt, Shigella flexneri 2a str. 301
uucgcguaaacgccaggcgugu

SEQ ID NO: 43202 - RNA, 22 nt, Shigella flexneri 2a str. 301
uucucgguuugcuggucacgau

SEQ ID NO: 43203 - RNA, 22 nt, Shigella flexneri 2a str. 301
uucugaaaacaaccgaugguaa

SEQ ID NO: 43204 - RNA, 22 nt, Shigella flexneri 2a str. 301
uucuggucuucuuuacugacgc

SEQ ID NO: 43205 - RNA, 22 nt, Shigella flexneri 2a str. 301
uucuguacagcacgcuucauag

SEQ ID NO: 43206 - RNA, 22 nt, Shigella flexneri 2a str. 301
uucuucagucagccgcaugagc

SEQ ID NO: 43207 - RNA, 22 nt, Shigella flexneri 2a str. 301
uugacaaugacgcuguggggac

SEQ ID NO: 43208 - RNA, 22 nt, Shigella flexneri 2a str. 301
uugagaagauucgcguuauugc

SEQ ID NO: 43209 - RNA, 22 nt, Shigella flexneri 2a str. 301
uugagcaugaacccgguugagc

SEQ ID NO: 43210 - RNA, 21 nt, Shigella flexneri 2a str. 301
uugaugcgcgagcgacguucc

SEQ ID NO: 43211 - RNA, 22 nt, Shigella flexneri 2a str. 301
uugcacgaacuuguaggccgga

SEQ ID NO: 43212 - RNA, 22 nt, Shigella flexneri 2a str. 301
uugcagcgucuuaucaggccua

SEQ ID NO: 43213 - RNA, 22 nt, Shigella flexneri 2a str. 301
uugcaguugcaguccauuguuu

SEQ ID NO: 43214 - RNA, 22 nt, Shigella flexneri 2a str. 301
uugcauggucuuguaggccaga

SEQ ID NO: 43215 - RNA, 22 nt, Shigella flexneri 2a str. 301
uugcccgcuuacugauuauugg

SEQ ID NO: 43216 - RNA, 22 nt, Shigella flexneri 2a str. 301
uugccgagugcgaccgugacag

SEQ ID NO: 43217 - RNA, 22 nt, Shigella flexneri 2a str. 301
uugccgcguuuucgacgagguu

SEQ ID NO: 43218 - RNA, 22 nt, Shigella flexneri 2a str. 301
uugcgaauugccgaagugauua

SEQ ID NO: 43219 - RNA, 22 nt, Shigella flexneri 2a str. 301
uugcucugguuguaugcguagu

SEQ ID NO: 43220 - RNA, 22 nt, Shigella flexneri 2a str. 301
uugcugacuaucggaacuuuuu

SEQ ID NO: 43221 - RNA, 22 nt, Shigella flexneri 2a str. 301
uugcugaugcgcugccaggcgu

SEQ ID NO: 43222 - RNA, 18 nt, Shigella flexneri 2a str. 301
uugcuguaagcguucaac

SEQ ID NO: 43223 - RNA, 22 nt, Shigella flexneri 2a str. 301
uuggcacuacgcuuucuggcua

SEQ ID NO: 43224 - RNA, 22 nt, Shigella flexneri 2a str. 301
uuggccugaauaucuccacugg

SEQ ID NO: 43225 - RNA, 22 nt, Shigella flexneri 2a str. 301
uugggucaauuugucugcuugc

SEQ ID NO: 43226 - RNA, 22 nt, Shigella flexneri 2a str. 301
uugguaucguugggcugguguu

SEQ ID NO: 43227 - RNA, 22 nt, Shigella flexneri 2a str. 301
uuguagccaucauuuagcgcuu

SEQ ID NO: 43228 - RNA, 22 nt, Shigella flexneri 2a str. 301
uuguaggccggauaaggcguuc

SEQ ID NO: 43229 - RNA, 22 nt, Shigella flexneri 2a str. 301
uuguaggccggauugggcguuu

SEQ ID NO: 43230 - RNA, 20 nt, Shigella flexneri 2a str. 301
uuguucaguugaaggugugc

SEQ ID NO: 43231 - RNA, 22 nt, Shigella flexneri 2a str. 301
uuuaccgacggugauuuacgcc

SEQ ID NO: 43232 - RNA, 22 nt, Shigella flexneri 2a str. 301
uuuagcgcucgacacccuggga

SEQ ID NO: 43233 - RNA, 22 nt, Shigella flexneri 2a str. 301
uuuaugacaguccagacaggcg

SEQ ID NO: 43234 - RNA, 22 nt, Shigella flexneri 2a str. 301
uuucaacauagucuucuccuuu

SEQ ID NO: 43235 - RNA, 22 nt, Shigella flexneri 2a str. 301
uuucaccgucggccaguauuug

SEQ ID NO: 43236 - RNA, 20 nt, Shigella flexneri 2a str. 301
uuucaucggcguuagcccag

SEQ ID NO: 43237 - RNA, 22 nt, Shigella flexneri 2a str. 301
aaacgcaucgguaugauugcgc

SEQ ID NO: 43238 - RNA, 21 nt, Shigella flexneri 2a str. 301
aaacucucggggucagcgagg

SEQ ID NO: 43239 - RNA, 22 nt, Shigella flexneri 2a str. 301
aaagcggugaccgcuaugucga

SEQ ID NO: 43240 - RNA, 22 nt, Shigella flexneri 2a str. 301
aaaugggugagaugacaacgau

SEQ ID NO: 43241 - RNA, 22 nt, Shigella flexneri 2a str. 301
aacgagaucugcggcuugucgu

SEQ ID NO: 43242 - RNA, 22 nt, Shigella flexneri 2a str. 301
aacgaugaacuuuuuugccauu

SEQ ID NO: 43243 - RNA, 23 nt, Shigella flexneri 2a str. 301
aacgcguucuuuaguggugaaga

SEQ ID NO: 43244 - RNA, 22 nt, Shigella flexneri 2a str. 301
aacgcuuuaauaucuuucggau

SEQ ID NO: 43245 - RNA, 22 nt, Shigella flexneri 2a str. 301
aacggcgaugaagugucgauca

SEQ ID NO: 43246 - RNA, 22 nt, Shigella flexneri 2a str. 301
aacguaaaguacguagcagaga

SEQ ID NO: 43247 - RNA, 22 nt, Shigella flexneri 2a str. 301
aacgucggcaucgcggaaggcu

SEQ ID NO: 43248 - RNA, 21 nt, Shigella flexneri 2a str. 301
aacugcuccauucguuguuga

SEQ ID NO: 43249 - RNA, 20 nt, Shigella flexneri 2a str. 301
aacugggcggcgagcguauc

SEQ ID NO: 43250 - RNA, 19 nt, Shigella flexneri 2a str. 301
aacuguccaaccagcauca

SEQ ID NO: 43251 - RNA, 22 nt, Shigella flexneri 2a str. 301
aagcgacaucuugccuguggau

SEQ ID NO: 43252 - RNA, 17 nt, Shigella flexneri 2a str. 301
aagcggcgaugacuuaa

SEQ ID NO: 43253 - RNA, 22 nt, Shigella flexneri 2a str. 301
aagcgguuugcgccaggugagc

SEQ ID NO: 43254 - RNA, 16 nt, Shigella flexneri 2a str. 301
aagcugaauugugguc

SEQ ID NO: 43255 - RNA, 22 nt, Shigella flexneri 2a str. 301
aaggcguuauuauuaauugccg

SEQ ID NO: 43256 - RNA, 22 nt, Shigella flexneri 2a str. 301
aaggcguugcagugcauggaug

SEQ ID NO: 43257 - RNA, 22 nt, Shigella flexneri 2a str. 301
aaggguauuuucgcaaaucagg

SEQ ID NO: 43258 - RNA, 22 nt, Shigella flexneri 2a str. 301
aagguguuaaacuggaaaaccg

SEQ ID NO: 43259 - RNA, 22 nt, Shigella flexneri 2a str. 301
aagucacugacaucguuacgau

SEQ ID NO: 43260 - RNA, 20 nt, Shigella flexneri 2a str. 301
aaguccugggaucagcgagg

SEQ ID NO: 43261 - RNA, 22 nt, Shigella flexneri 2a str. 301
aagugcaacggcuugcagauca

SEQ ID NO: 43262 - RNA, 22 nt, Shigella flexneri 2a str. 301
aagugccgcuguuuggucgugc

SEQ ID NO: 43263 - RNA, 22 nt, Shigella flexneri 2a str. 301
aaguuugccguggcaguggcga

SEQ ID NO: 43264 - RNA, 22 nt, Shigella flexneri 2a str. 301
aaucacaguagucgaaguuuuu

SEQ ID NO: 43265 - RNA, 22 nt, Shigella flexneri 2a str. 301
aaucagcgguaucguuuccuuc

SEQ ID NO: 43266 - RNA, 22 nt, Shigella flexneri 2a str. 301
aauccagcgcaggcuacggugg

SEQ ID NO: 43267 - RNA, 22 nt, Shigella flexneri 2a str. 301
aaugaccaguaaugcuuugccc

SEQ ID NO: 43268 - RNA, 22 nt, Shigella flexneri 2a str. 301
aaugcaguagucgcagcggaag

SEQ ID NO: 43269 - RNA, 22 nt, Shigella flexneri 2a str. 301
aaugccagcgccacagcgauaa

SEQ ID NO: 43270 - RNA, 22 nt, Shigella flexneri 2a str. 301
aaugguuuacccaugcagguag

SEQ ID NO: 43271 - RNA, 22 nt, Shigella flexneri 2a str. 301
aauuccaauaagaagaacuuua

SEQ ID NO: 43272 - RNA, 20 nt, Shigella flexneri 2a str. 301
aauugccugagaaucagcaa

SEQ ID NO: 43273 - RNA, 22 nt, Shigella flexneri 2a str. 301
acaacggagaacaguauccugu

SEQ ID NO: 43274 - RNA, 22 nt, Shigella flexneri 2a str. 301
acacgucgccaauccuggaaag

SEQ ID NO: 43275 - RNA, 22 nt, Shigella flexneri 2a str. 301
acacuguugugaaugaaagcau

SEQ ID NO: 43276 - RNA, 22 nt, Shigella flexneri 2a str. 301
acagagccugucucagcaauga

SEQ ID NO: 43277 - RNA, 22 nt, Shigella flexneri 2a str. 301
acagcgcgugauguuugucaga

SEQ ID NO: 43278 - RNA, 22 nt, Shigella flexneri 2a str. 301
acagcugcugaugcugacagau

SEQ ID NO: 43279 - RNA, 22 nt, Shigella flexneri 2a str. 301
acaugccgacauauuugccgaa

SEQ ID NO: 43280 - RNA, 22 nt, Shigella flexneri 2a str. 301
accaaaugucgauaauuuuguu

SEQ ID NO: 43281 - RNA, 22 nt, Shigella flexneri 2a str. 301
accaucugcggcauacuuucgc

SEQ ID NO: 43282 - RNA, 22 nt, Shigella flexneri 2a str. 301
accaugauaccuuguuccgaca

SEQ ID NO: 43283 - RNA, 22 nt, Shigella flexneri 2a str. 301
aucaguaaguuggagucauuac

SEQ ID NO: 43284 - RNA, 19 nt, Shigella flexneri 2a str. 301
aucaguaucguuuucuucc

SEQ ID NO: 43285 - RNA, 22 nt, Shigella flexneri 2a str. 301
aucaucacaaguggucagaccu

SEQ ID NO: 43286 - RNA, 22 nt, Shigella flexneri 2a str. 301
aucccuauaacaguagaacccu

SEQ ID NO: 43287 - RNA, 22 nt, Shigella flexneri 2a str. 301
auccgacaaaacauccggcaca

SEQ ID NO: 43288 - RNA, 22 nt, Shigella flexneri 2a str. 301
auccgcgcuguguguggaaccu

SEQ ID NO: 43289 - RNA, 19 nt, Shigella flexneri 2a str. 301
auccggccuacaaaagcau

SEQ ID NO: 43290 - RNA, 22 nt, Shigella flexneri 2a str. 301
auccggccuacauaaucacgca

SEQ ID NO: 43291 - RNA, 22 nt, Shigella flexneri 2a str. 301
auccgguaucguggcuuauuca

SEQ ID NO: 43292 - RNA, 22 nt, Shigella flexneri 2a str. 301
aucgauuauaugcaggguuauc

SEQ ID NO: 43293 - RNA, 22 nt, Shigella flexneri 2a str. 301
aucgcaaucgaaacaaucggug

SEQ ID NO: 43294 - RNA, 22 nt, Shigella flexneri 2a str. 301
aucgcuggaagguuggcgcauu

SEQ ID NO: 43295 - RNA, 22 nt, Shigella flexneri 2a str. 301
aucgcuucgcggauaauuuccc

SEQ ID NO: 43296 - RNA, 22 nt, Shigella flexneri 2a str. 301
aucggauggucgaacggcggca

SEQ ID NO: 43297 - RNA, 18 nt, Shigella flexneri 2a str. 301
aucggcauggcauucgcc

SEQ ID NO: 43298 - RNA, 20 nt, Shigella flexneri 2a str. 301
aucguguaaaccggucguua

SEQ ID NO: 43299 - RNA, 22 nt, Shigella flexneri 2a str. 301
aucguuguagaguuugaucagg

SEQ ID NO: 43300 - RNA, 22 nt, Shigella flexneri 2a str. 301
aucuaugugaauaaacaugacg

SEQ ID NO: 43301 - RNA, 22 nt, Shigella flexneri 2a str. 301
aucugacggauaaaaaucgcga

SEQ ID NO: 43302 - RNA, 22 nt, Shigella flexneri 2a str. 301
aucugguugaauuugaucagga

SEQ ID NO: 43303 - RNA, 22 nt, Shigella flexneri 2a str. 301
aucuguugaugccaacguaucg

SEQ ID NO: 43304 - RNA, 22 nt, Shigella flexneri 2a str. 301
aucuugauugcagccagaguuu

SEQ ID NO: 43305 - RNA, 22 nt, Shigella flexneri 2a str. 301
augaccggacgccuggcgcugg

SEQ ID NO: 43306 - RNA, 22 nt, Shigella flexneri 2a str. 301
augacgcagaucuucacuggga

SEQ ID NO: 43307 - RNA, 20 nt, Shigella flexneri 2a str. 301
augauggacggcaacagcgg

SEQ ID NO: 43308 - RNA, 22 nt, Shigella flexneri 2a str. 301
augcaacugcacagccagauca

SEQ ID NO: 43309 - RNA, 22 nt, Shigella flexneri 2a str. 301
augcacugucagauccggcgug

SEQ ID NO: 43310 - RNA, 22 nt, Shigella flexneri 2a str. 301
augcgacgcggaagcgucuuau

SEQ ID NO: 43311 - RNA, 22 nt, Shigella flexneri 2a str. 301
augcuggcgauguacuacguca

SEQ ID NO: 43312 - RNA, 22 nt, Shigella flexneri 2a str. 301
auggauuacaaaauaaaccaca

SEQ ID NO: 43313 - RNA, 22 nt, Shigella flexneri 2a str. 301
auggcaaucgcaucuaucuggu

SEQ ID NO: 43314 - RNA, 22 nt, Shigella flexneri 2a str. 301
auggcggaaguccgaccuucag

SEQ ID NO: 43315 - RNA, 22 nt, Shigella flexneri 2a str. 301
auggcuggcagguaauuuugcg

SEQ ID NO: 43316 - RNA, 22 nt, Shigella flexneri 2a str. 301
auggcuuccugaaacaguuugg

SEQ ID NO: 43317 - RNA, 22 nt, Shigella flexneri 2a str. 301
augggcggauucuugcgacagg

SEQ ID NO: 43318 - RNA, 19 nt, Shigella flexneri 2a str. 301
auggugaugaucgauuucc

SEQ ID NO: 43319 - RNA, 22 nt, Shigella flexneri 2a str. 301
auggugcugccaucaucgguca

SEQ ID NO: 43320 - RNA, 22 nt, Shigella flexneri 2a str. 301
augucgaccuauguugauuaua

SEQ ID NO: 43321 - RNA, 22 nt, Shigella flexneri 2a str. 301
auucagcagugccgguaaugca

SEQ ID NO: 43322 - RNA, 22 nt, Shigella flexneri 2a str. 301
auucucugccaguacguugaau

SEQ ID NO: 43323 - RNA, 19 nt, Shigella flexneri 2a str. 301
auucugccguaugaccagu

SEQ ID NO: 43324 - RNA, 22 nt, Shigella flexneri 2a str. 301
auugcaggaacgcuaucaccgu

SEQ ID NO: 43325 - RNA, 22 nt, Shigella flexneri 2a str. 301
auugcauugcguaaacgcuuuu

SEQ ID NO: 43326 - RNA, 22 nt, Shigella flexneri 2a str. 301
auugcccguuuuacagcguuac

SEQ ID NO: 43327 - RNA, 22 nt, Shigella flexneri 2a str. 301
auugcuguuaacgcuggugcug

SEQ ID NO: 43328 - RNA, 22 nt, Shigella flexneri 2a str. 301
auuggcguugauuccgcaccgg

SEQ ID NO: 43329 - RNA, 22 nt, Shigella flexneri 2a str. 301
auuuccagaaacauuaucagac

SEQ ID NO: 43330 - RNA, 22 nt, Shigella flexneri 2a str. 301
auuucgauaauaucguguuggu

SEQ ID NO: 43331 - RNA, 21 nt, Shigella flexneri 2a str. 301
caaacguggggugaauaaucg

SEQ ID NO: 43332 - RNA, 22 nt, Shigella flexneri 2a str. 301
caacauuuuuugcaaguacagc

SEQ ID NO: 43333 - RNA, 22 nt, Shigella flexneri 2a str. 301
caacgcgcggugaugaugcagg

SEQ ID NO: 43334 - RNA, 22 nt, Shigella flexneri 2a str. 301
caagagauugcaggugcgguug

SEQ ID NO: 43335 - RNA, 22 nt, Shigella flexneri 2a str. 301
caagcgcgcuuaacgccguuuu

SEQ ID NO: 43336 - RNA, 22 nt, Shigella flexneri 2a str. 301
caaugaaauccggguugcugua

SEQ ID NO: 43337 - RNA, 22 nt, Shigella flexneri 2a str. 301
caccgucaggguacggaaugua

SEQ ID NO: 43338 - RNA, 22 nt, Shigella flexneri 2a str. 301
caccguggccuuuuccgguaua

SEQ ID NO: 43339 - RNA, 22 nt, Shigella flexneri 2a str. 301
cacgcgagaucgacaaaaucgc

SEQ ID NO: 43340 - RNA, 22 nt, Shigella flexneri 2a str. 301
cacgcucaauaucggcaucuuc

SEQ ID NO: 43341 - RNA, 22 nt, Shigella flexneri 2a str. 301
cacggcugagagcaccaccaga

SEQ ID NO: 43342 - RNA, 22 nt, Shigella flexneri 2a str. 301
cagaaguaaucccucauucccg

SEQ ID NO: 43343 - RNA, 22 nt, Shigella flexneri 2a str. 301
cagacguugaucuucaggcuga

SEQ ID NO: 43344 - RNA, 22 nt, Shigella flexneri 2a str. 301
cagauugauuaucaacuggaug

SEQ ID NO: 43345 - RNA, 22 nt, Shigella flexneri 2a str. 301
cagcaauagcuucuggguuacg

SEQ ID NO: 43346 - RNA, 22 nt, Shigella flexneri 2a str. 301
cagcacuuuuugcugauugcca

SEQ ID NO: 43347 - RNA, 22 nt, Shigella flexneri 2a str. 301
cagcaguucgcgaauacgcugc

SEQ ID NO: 43348 - RNA, 22 nt, Shigella flexneri 2a str. 301
cagccgguaagccugcuuuuca

SEQ ID NO: 43349 - RNA, 22 nt, Shigella flexneri 2a str. 301
cagcgacgcgccagcaggaaag

SEQ ID NO: 43350 - RNA, 22 nt, Shigella flexneri 2a str. 301
cagcggaucacccaccguuuug

SEQ ID NO: 43351 - RNA, 21 nt, Shigella flexneri 2a str. 301
caggaauugcaggguaaaauu

SEQ ID NO: 43352 - RNA, 22 nt, Shigella flexneri 2a str. 301
caggaugguaucgacauggcgu

SEQ ID NO: 43353 - RNA, 22 nt, Shigella flexneri 2a str. 301
caggccuacaugauuucugcaa

SEQ ID NO: 43354 - RNA, 22 nt, Shigella flexneri 2a str. 301
caggccuacgcguccccugcaa

SEQ ID NO: 43355 - RNA, 22 nt, Shigella flexneri 2a str. 301
caggcuuucugcucgucgauaa

SEQ ID NO: 43356 - RNA, 22 nt, Shigella flexneri 2a str. 301
caggucauucaugcggguuuuc

SEQ ID NO: 43357 - RNA, 22 nt, Shigella flexneri 2a str. 301
caggugguuagagcgcaccccu

SEQ ID NO: 43358 - RNA, 22 nt, Shigella flexneri 2a str. 301
cauccugagaagcuugcaguga

SEQ ID NO: 43359 - RNA, 22 nt, Shigella flexneri 2a str. 301
caucggcuacagcagcagccug

SEQ ID NO: 43360 - RNA, 22 nt, Shigella flexneri 2a str. 301
caucggugcugacggguugauu

SEQ ID NO: 43361 - RNA, 22 nt, Shigella flexneri 2a str. 301
caugagaaagaguaucugguga

SEQ ID NO: 43362 - RNA, 22 nt, Shigella flexneri 2a str. 301
cauggaguucguuggaccgggc

SEQ ID NO: 43363 - RNA, 22 nt, Shigella flexneri 2a str. 301
caugguguucucuauguugcug

SEQ ID NO: 43364 - RNA, 22 nt, Shigella flexneri 2a str. 301
cauguucugaggugucuuccug

SEQ ID NO: 43365 - RNA, 22 nt, Shigella flexneri 2a str. 301
cauucgcugcugcuuugcuucc

SEQ ID NO: 43366 - RNA, 20 nt, Shigella flexneri 2a str. 301
ccacagcgaucuuuccacca

SEQ ID NO: 43367 - RNA, 22 nt, Shigella flexneri 2a str. 301
ccagcgcuucgguauggcgggu

SEQ ID NO: 43368 - RNA, 20 nt, Shigella flexneri 2a str. 301
ccagcugacgccaaagugau

SEQ ID NO: 43369 - RNA, 19 nt, Shigella flexneri 2a str. 301
ccagguuggcguccagcug

SEQ ID NO: 43370 - RNA, 21 nt, Shigella flexneri 2a str. 301
ccauccgauuugauauuacgc

SEQ ID NO: 43371 - RNA, 22 nt, Shigella flexneri 2a str. 301
ccaucgccuguacgaugcgcuc

SEQ ID NO: 43372 - RNA, 22 nt, Shigella flexneri 2a str. 301
ccauuaccuuuaacggacuguc

SEQ ID NO: 43373 - RNA, 19 nt, Shigella flexneri 2a str. 301
cccagggugucgagcgcua

SEQ ID NO: 43374 - RNA, 22 nt, Shigella flexneri 2a str. 301
cccgagcuaaccuguuaaaggu

SEQ ID NO: 43375 - RNA, 22 nt, Shigella flexneri 2a str. 301
ccgagaagaagugaacauuacu

SEQ ID NO: 43376 - RNA, 22 nt, Shigella flexneri 2a str. 301
ccgauaguuaagucaaaaccga

SEQ ID NO: 43377 - RNA, 22 nt, Shigella flexneri 2a str. 301
ccgccagaacuggcgaaacuag

SEQ ID NO: 43378 - RNA, 22 nt, Shigella flexneri 2a str. 301
ccgcugcaguuaauacgccgcu

SEQ ID NO: 43379 - RNA, 22 nt, Shigella flexneri 2a str. 301
ccgcuuugaucaccaguucaca

SEQ ID NO: 43380 - RNA, 22 nt, Shigella flexneri 2a str. 301
ccggauucuuuuaugcacauug

SEQ ID NO: 43381 - RNA, 22 nt, Shigella flexneri 2a str. 301
ccggccuacaaacccuugcuaa

SEQ ID NO: 43382 - RNA, 22 nt, Shigella flexneri 2a str. 301
ccgguaagaccaccacuuucua

SEQ ID NO: 43383 - RNA, 22 nt, Shigella flexneri 2a str. 301
ccggucugccgaauaugccugg

SEQ ID NO: 43384 - RNA, 22 nt, Shigella flexneri 2a str. 301
ccggugcugaugggcguggcga

SEQ ID NO: 43385 - RNA, 23 nt, Shigella flexneri 2a str. 301
ccguaucgaccugcaaccgggcg

SEQ ID NO: 43386 - RNA, 22 nt, Shigella flexneri 2a str. 301
ccguauugauggcaacgcacga

SEQ ID NO: 43387 - RNA, 22 nt, Shigella flexneri 2a str. 301
ccguguggaauagcaauaccau

SEQ ID NO: 43388 - RNA, 22 nt, Shigella flexneri 2a str. 301
ccguugagagcaaauuguuugg

SEQ ID NO: 43389 - RNA, 22 nt, Shigella flexneri 2a str. 301
ccugaugcugguauuggugauu

SEQ ID NO: 43390 - RNA, 22 nt, Shigella flexneri 2a str. 301
ccuggcgagcaucccccacaau

SEQ ID NO: 43391 - RNA, 22 nt, Shigella flexneri 2a str. 301
ccugggaaaaaaucgcuggcgg

SEQ ID NO: 43392 - RNA, 22 nt, Shigella flexneri 2a str. 301
ccuuccggcccacagaucgcuu

SEQ ID NO: 43393 - RNA, 22 nt, Shigella flexneri 2a str. 301
cgaaagacggcugguuauucac

SEQ ID NO: 43394 - RNA, 19 nt, Shigella flexneri 2a str. 301
cgaagguaaacuguucggu

SEQ ID NO: 43395 - RNA, 22 nt, Shigella flexneri 2a str. 301
cgacgcagcagagcaaggaguu

SEQ ID NO: 43396 - RNA, 22 nt, Shigella flexneri 2a str. 301
cgagacgccguauauuaaauug

SEQ ID NO: 43397 - RNA, 22 nt, Shigella flexneri 2a str. 301
cgaguaggcgggauaaggcguu

SEQ ID NO: 43398 - RNA, 22 nt, Shigella flexneri 2a str. 301
cgauaugcuucgauugccugga

SEQ ID NO: 43399 - RNA, 22 nt, Shigella flexneri 2a str. 301
cgauaugucgcguucacguaag

SEQ ID NO: 43400 - RNA, 22 nt, Shigella flexneri 2a str. 301
cgaugcaggcacaccgcuauga

SEQ ID NO: 43401 - RNA, 19 nt, Shigella flexneri 2a str. 301
cgaugccaggcgguucggu

SEQ ID NO: 43402 - RNA, 22 nt, Shigella flexneri 2a str. 301
cgaugcuggcggaagugggccu

SEQ ID NO: 43403 - RNA, 22 nt, Shigella flexneri 2a str. 301
cgauggaucgcugggaucaugg

SEQ ID NO: 43404 - RNA, 22 nt, Shigella flexneri 2a str. 301
cgcacaauuuucagcgcaaucu

SEQ ID NO: 43405 - RNA, 22 nt, Shigella flexneri 2a str. 301
cgcacguuggcaugagcgaugg

SEQ ID NO: 43406 - RNA, 20 nt, Shigella flexneri 2a str. 301
cgcauaugaccaucgucgau

SEQ ID NO: 43407 - RNA, 19 nt, Shigella flexneri 2a str. 301
cgccagugggaucgugccg

SEQ ID NO: 43408 - RNA, 22 nt, Shigella flexneri 2a str. 301
cgccaguugauuuugacaccgc

SEQ ID NO: 43409 - RNA, 22 nt, Shigella flexneri 2a str. 301
cgcccgaaugugucaacggcaa

SEQ ID NO: 43410 - RNA, 22 nt, Shigella flexneri 2a str. 301
cgccggaagagagauugcggua

SEQ ID NO: 43411 - RNA, 22 nt, Shigella flexneri 2a str. 301
cgccguauguugauuauuaccg

SEQ ID NO: 43412 - RNA, 22 nt, Shigella flexneri 2a str. 301
cgcggaugguauggcuguuggu

SEQ ID NO: 43413 - RNA, 22 nt, Shigella flexneri 2a str. 301
cgcggucuucguuggcguaggc

SEQ ID NO: 43414 - RNA, 22 nt, Shigella flexneri 2a str. 301
cgcguuaacuggaaccggguga

SEQ ID NO: 43415 - RNA, 22 nt, Shigella flexneri 2a str. 301
cgcguucuuuaagccauggcga

SEQ ID NO: 43416 - RNA, 22 nt, Shigella flexneri 2a str. 301
cgcucauuuuuguucggugugg

SEQ ID NO: 43417 - RNA, 20 nt, Shigella flexneri 2a str. 301
cgcugauauuggcgcgcaug

SEQ ID NO: 43418 - RNA, 22 nt, Shigella flexneri 2a str. 301
cgcugcuggguaacuucguagc

SEQ ID NO: 43419 - RNA, 22 nt, Shigella flexneri 2a str. 301
cgcuguugccaacgccgcaaag

SEQ ID NO: 43420 - RNA, 22 nt, Shigella flexneri 2a str. 301
cgcuucaaaggugucgucagga

SEQ ID NO: 43421 - RNA, 22 nt, Shigella flexneri 2a str. 301
cgcuucaugcagggcuuuacga

SEQ ID NO: 43422 - RNA, 22 nt, Shigella flexneri 2a str. 301
cggaaggcgauaaagcgauuga

SEQ ID NO: 43423 - RNA, 22 nt, Shigella flexneri 2a str. 301
cggaauaaacgauacaacccag

SEQ ID NO: 43424 - RNA, 22 nt, Shigella flexneri 2a str. 301
cggaaugcuggacuuguugugu

SEQ ID NO: 43425 - RNA, 22 nt, Shigella flexneri 2a str. 301
cggacaggucugcggcugugua

SEQ ID NO: 43426 - RNA, 22 nt, Shigella flexneri 2a str. 301
cggagcgaaacggcacaaccau

SEQ ID NO: 43427 - RNA, 22 nt, Shigella flexneri 2a str. 301
cggauacgugguuuuaaaagau

SEQ ID NO: 43428 - RNA, 22 nt, Shigella flexneri 2a str. 301
cggcaauuucacacaccaguug

SEQ ID NO: 43429 - RNA, 21 nt, Shigella flexneri 2a str. 301
cggcagcaacuucaucacgga

SEQ ID NO: 43430 - RNA, 22 nt, Shigella flexneri 2a str. 301
cggcggaucaguuacaggcguu

SEQ ID NO: 43431 - RNA, 22 nt, Shigella flexneri 2a str. 301
cggcggauuuauuacugcaucc

SEQ ID NO: 43432 - RNA, 22 nt, Shigella flexneri 2a str. 301
cggcuggaaaucauucaauacu

SEQ ID NO: 43433 - RNA, 22 nt, Shigella flexneri 2a str. 301
cggcugguuaaguauuucguuu

SEQ ID NO: 43434 - RNA, 22 nt, Shigella flexneri 2a str. 301
cgggcgaaaagccagcguggca

SEQ ID NO: 43435 - RNA, 22 nt, Shigella flexneri 2a str. 301
cgggcuauuuuucaccgaguuc

SEQ ID NO: 43436 - RNA, 22 nt, Shigella flexneri 2a str. 301
cggguagagcacauugaugccg

SEQ ID NO: 43437 - RNA, 22 nt, Shigella flexneri 2a str. 301
cggguggaacugaggcaauucg

SEQ ID NO: 43438 - RNA, 22 nt, Shigella flexneri 2a str. 301
cgguacgccggacgauuugaaa

SEQ ID NO: 43439 - RNA, 22 nt, Shigella flexneri 2a str. 301
cggugcuggcugcugacaucgu

SEQ ID NO: 43440 - RNA, 22 nt, Shigella flexneri 2a str. 301
cgguuaaagauauucgcguguu

SEQ ID NO: 43441 - RNA, 22 nt, Shigella flexneri 2a str. 301
cgguuacuggaagaaguggugu

SEQ ID NO: 43442 - RNA, 22 nt, Shigella flexneri 2a str. 301
cgguucgaugauuggucugaau

SEQ ID NO: 43443 - RNA, 22 nt, Shigella flexneri 2a str. 301
cgguugcuuucgucgagaaugu

SEQ ID NO: 43444 - RNA, 22 nt, Shigella flexneri 2a str. 301
cguaaugucauccuggucacga

SEQ ID NO: 43445 - RNA, 22 nt, Shigella flexneri 2a str. 301
cguaccaucaccgacguguuug

SEQ ID NO: 43446 - RNA, 22 nt, Shigella flexneri 2a str. 301
cguaugguugaguuugaguggc

SEQ ID NO: 43447 - RNA, 22 nt, Shigella flexneri 2a str. 301
cguccggucgggcaggugugcu

SEQ ID NO: 43448 - RNA, 22 nt, Shigella flexneri 2a str. 301
cgucugcuuaccauugcgugcc

SEQ ID NO: 43449 - RNA, 22 nt, Shigella flexneri 2a str. 301
cgucuggcugagccgcaucgaa

SEQ ID NO: 43450 - RNA, 22 nt, Shigella flexneri 2a str. 301
cgugauaacuaucgucugguug

SEQ ID NO: 43451 - RNA, 22 nt, Shigella flexneri 2a str. 301
cguggcuuucagaaugguggcg

SEQ ID NO: 43452 - RNA, 22 nt, Shigella flexneri 2a str. 301
cguguugccugccgcgucggua

SEQ ID NO: 43453 - RNA, 22 nt, Shigella flexneri 2a str. 301
cguuccugcuccugcuccaucc

SEQ ID NO: 43454 - RNA, 22 nt, Shigella flexneri 2a str. 301
cguuuacagauggguaaugugu

SEQ ID NO: 43455 - RNA, 22 nt, Shigella flexneri 2a str. 301
cuacgcuuaucaggccuacgug

SEQ ID NO: 43456 - RNA, 22 nt, Shigella flexneri 2a str. 301
cuagauccgggcugauuugcug

SEQ ID NO: 43457 - RNA, 22 nt, Shigella flexneri 2a str. 301
cuaucgguggucgucgagcaac

SEQ ID NO: 43458 - RNA, 22 nt, Shigella flexneri 2a str. 301
cuauguugagaugcuggcgcgu

SEQ ID NO: 43459 - RNA, 22 nt, Shigella flexneri 2a str. 301
cucaggccuacaaaaucuugca

SEQ ID NO: 43460 - RNA, 22 nt, Shigella flexneri 2a str. 301
cucgccauuuucgucuggaccg

SEQ ID NO: 43461 - RNA, 22 nt, Shigella flexneri 2a str. 301
cugaaugcagaauaggccagac

SEQ ID NO: 43462 - RNA, 22 nt, Shigella flexneri 2a str. 301
cugaauuugucguucagccaga

SEQ ID NO: 43463 - RNA, 22 nt, Shigella flexneri 2a str. 301
cugacagauguggcacuucccg

SEQ ID NO: 43464 - RNA, 22 nt, Shigella flexneri 2a str. 301
cugagaagugaugcugucagca

SEQ ID NO: 43465 - RNA, 22 nt, Shigella flexneri 2a str. 301
cugagggacuuucagcucaaga

SEQ ID NO: 43466 - RNA, 20 nt, Shigella flexneri 2a str. 301
cugaugaacuguccaccgca

SEQ ID NO: 43467 - RNA, 22 nt, Shigella flexneri 2a str. 301
cugaugcgacgcugacgcgucu

SEQ ID NO: 43468 - RNA, 22 nt, Shigella flexneri 2a str. 301
cugccaguuccgcugauuuacg

SEQ ID NO: 43469 - RNA, 22 nt, Shigella flexneri 2a str. 301
cugccgugucaccacuguucag

SEQ ID NO: 43470 - RNA, 22 nt, Shigella flexneri 2a str. 301
cugcgagcgaagaaagugauca

SEQ ID NO: 43471 - RNA, 22 nt, Shigella flexneri 2a str. 301
cugcgcaaaugcagguuguuga

SEQ ID NO: 43472 - RNA, 22 nt, Shigella flexneri 2a str. 301
cugcgucauuccggaguuuaug

SEQ ID NO: 43473 - RNA, 22 nt, Shigella flexneri 2a str. 301
cugcuguacauggcugccgcug

SEQ ID NO: 43474 - RNA, 22 nt, Shigella flexneri 2a str. 301
cuggagauggcaaaaucgcucg

SEQ ID NO: 43475 - RNA, 22 nt, Shigella flexneri 2a str. 301
cuggcaggcuguaaauuauugc

SEQ ID NO: 43476 - RNA, 22 nt, Shigella flexneri 2a str. 301
cugguagcgcuggggcugcaaa

SEQ ID NO: 43477 - RNA, 22 nt, Shigella flexneri 2a str. 301
cugguagguauaacguuggcgu

SEQ ID NO: 43478 - RNA, 22 nt, Shigella flexneri 2a str. 301
cugguauagguauggagcuuau

SEQ ID NO: 43479 - RNA, 22 nt, Shigella flexneri 2a str. 301
cuggucgaaaccgguggagaga

SEQ ID NO: 43480 - RNA, 22 nt, Shigella flexneri 2a str. 301
cugugcguauggaacuccaggc

SEQ ID NO: 43481 - RNA, 22 nt, Shigella flexneri 2a str. 301
cuucaccggacuggugaugaug

SEQ ID NO: 43482 - RNA, 22 nt, Shigella flexneri 2a str. 301
cuugaaguaugacgaguauagc

SEQ ID NO: 43483 - RNA, 19 nt, Shigella flexneri 2a str. 301
cuugcggugaagaagaggu

SEQ ID NO: 43484 - RNA, 22 nt, Shigella flexneri 2a str. 301
cuuguucagaagccuucgcagg

SEQ ID NO: 43485 - RNA, 22 nt, Shigella flexneri 2a str. 301
cuuucagagcaaugcaucgcgu

SEQ ID NO: 43486 - RNA, 22 nt, Shigella flexneri 2a str. 301
gaacaccgauacugucgcugcg

SEQ ID NO: 43487 - RNA, 22 nt, Shigella flexneri 2a str. 301
gaaugguguuccgacuggaaau

SEQ ID NO: 43488 - RNA, 22 nt, Shigella flexneri 2a str. 301
gaauuucauugcuuucuucugu

SEQ ID NO: 43489 - RNA, 23 nt, Shigella flexneri 2a str. 301
gacauuacaggguuugcgucagc

SEQ ID NO: 43490 - RNA, 22 nt, Shigella flexneri 2a str. 301
gaccgcuuccgccagcgauuuu

SEQ ID NO: 43491 - RNA, 22 nt, Shigella flexneri 2a str. 301
gacggcuauaucuacugcguga

SEQ ID NO: 43492 - RNA, 20 nt, Shigella flexneri 2a str. 301
gacugggccgcuggagguaa

SEQ ID NO: 43493 - RNA, 22 nt, Shigella flexneri 2a str. 301
gacuucauggagucgaguugca

SEQ ID NO: 43494 - RNA, 22 nt, Shigella flexneri 2a str. 301
gagacgugcaaucucgguagac

SEQ ID NO: 43495 - RNA, 18 nt, Shigella flexneri 2a str. 301
gagauuguugaagaauuc

SEQ ID NO: 43496 - RNA, 22 nt, Shigella flexneri 2a str. 301
gagcacggcuugcgcugcuuca

SEQ ID NO: 43497 - RNA, 18 nt, Shigella flexneri 2a str. 301
gagcauugaccuuguuga

SEQ ID NO: 43498 - RNA, 22 nt, Shigella flexneri 2a str. 301
gagcgacguuugucacccaccg

SEQ ID NO: 43499 - RNA, 23 nt, Shigella flexneri 2a str. 301
gagcguggaucuggaguucagca

SEQ ID NO: 43500 - RNA, 22 nt, Shigella flexneri 2a str. 301
gagguaaucugaaaaaggugca

SEQ ID NO: 43501 - RNA, 22 nt, Shigella flexneri 2a str. 301
gagugcgugauuucgccgaagu

SEQ ID NO: 43502 - RNA, 20 nt, Shigella flexneri 2a str. 301
gaguggcaucuuccugcuga

SEQ ID NO: 43503 - RNA, 22 nt, Shigella flexneri 2a str. 301
gauaaucccugauucgcaguca

SEQ ID NO: 43504 - RNA, 22 nt, Shigella flexneri 2a str. 301
gauagauuggauaagaaacgcg

SEQ ID NO: 43505 - RNA, 22 nt, Shigella flexneri 2a str. 301
gauagguguugucgucaucuuu

SEQ ID NO: 43506 - RNA, 22 nt, Shigella flexneri 2a str. 301
gauauguuuaccaucaucggug

SEQ ID NO: 43507 - RNA, 22 nt, Shigella flexneri 2a str. 301
gaucaucugucaacugacguga

SEQ ID NO: 43508 - RNA, 22 nt, Shigella flexneri 2a str. 301
gaugagcguuucccgcauccgc

SEQ ID NO: 43509 - RNA, 22 nt, Shigella flexneri 2a str. 301
gaugaucaugaugucggcaucu

SEQ ID NO: 43510 - RNA, 22 nt, Shigella flexneri 2a str. 301
gaugcaacauuugucgccgcag

SEQ ID NO: 43511 - RNA, 22 nt, Shigella flexneri 2a str. 301
gaugccguuuuagacgcgaucc

SEQ ID NO: 43512 - RNA, 22 nt, Shigella flexneri 2a str. 301
gaugcguaucccgaucuugauc

SEQ ID NO: 43513 - RNA, 22 nt, Shigella flexneri 2a str. 301
gaugugauugucugcgcugaaa

SEQ ID NO: 43514 - RNA, 18 nt, Shigella flexneri 2a str. 301
gauguuagacucgauaaa

SEQ ID NO: 43515 - RNA, 22 nt, Shigella flexneri 2a str. 301
gauuaucaccuguugcccuuug

SEQ ID NO: 43516 - RNA, 22 nt, Shigella flexneri 2a str. 301
gauugaugaccugagcuucucg

SEQ ID NO: 43517 - RNA, 22 nt, Shigella flexneri 2a str. 301
gauugcgggugaaaaacugacg

SEQ ID NO: 43518 - RNA, 22 nt, Shigella flexneri 2a str. 301
gauuucaccaauuaagccgagg

SEQ ID NO: 43519 - RNA, 22 nt, Shigella flexneri 2a str. 301
gcagcacguugcggcugcguuu

SEQ ID NO: 43520 - RNA, 22 nt, Shigella flexneri 2a str. 301
gcagcagaucaccacggcugau

SEQ ID NO: 43521 - RNA, 22 nt, Shigella flexneri 2a str. 301
gcaggagccagcucacucgcug

SEQ ID NO: 43522 - RNA, 22 nt, Shigella flexneri 2a str. 301
gugagcguauuggugaauugca

SEQ ID NO: 43523 - RNA, 22 nt, Shigella flexneri 2a str. 301
gugaguucaccauuacgcugga

SEQ ID NO: 43524 - RNA, 22 nt, Shigella flexneri 2a str. 301
gugaugaagauugguaccgggc

SEQ ID NO: 43525 - RNA, 22 nt, Shigella flexneri 2a str. 301
gugauuauggaugaaccgacuu

SEQ ID NO: 43526 - RNA, 22 nt, Shigella flexneri 2a str. 301
gugauuucgcgaccuucccggu

SEQ ID NO: 43527 - RNA, 22 nt, Shigella flexneri 2a str. 301
gugcaaccgguuguugcggcug

SEQ ID NO: 43528 - RNA, 22 nt, Shigella flexneri 2a str. 301
accauguugauguccagggcaa

SEQ ID NO: 43529 - RNA, 22 nt, Shigella flexneri 2a str. 301
accauugccgcagcaauagcug

SEQ ID NO: 43530 - RNA, 22 nt, Shigella flexneri 2a str. 301
acccugcugcaccugcuggccg

SEQ ID NO: 43531 - RNA, 22 nt, Shigella flexneri 2a str. 301
accgaagaguaccgcggcggca

SEQ ID NO: 43532 - RNA, 22 nt, Shigella flexneri 2a str. 301
accgcaucggccugguguaccg

SEQ ID NO: 43533 - RNA, 22 nt, Shigella flexneri 2a str. 301
accgcgacgcagaccgucggag

SEQ ID NO: 43534 - RNA, 22 nt, Shigella flexneri 2a str. 301
accgggugaugcaaaaguagcc

SEQ ID NO: 43535 - RNA, 20 nt, Shigella flexneri 2a str. 301
accugcugccaucuguuguu

SEQ ID NO: 43536 - RNA, 19 nt, Shigella flexneri 2a str. 301
accugggcggcuugccugc

SEQ ID NO: 43537 - RNA, 22 nt, Shigella flexneri 2a str. 301
accuggucuuuuccaucuugcg

SEQ ID NO: 43538 - RNA, 22 nt, Shigella flexneri 2a str. 301
acgaaacuggacggcacggcga

SEQ ID NO: 43539 - RNA, 18 nt, Shigella flexneri 2a str. 301
acgaaucagcgccauaaa

SEQ ID NO: 43540 - RNA, 22 nt, Shigella flexneri 2a str. 301
acgacgcagauccugggcgauu

SEQ ID NO: 43541 - RNA, 23 nt, Shigella flexneri 2a str. 301
acgaugaagccuuccugcaacag

SEQ ID NO: 43542 - RNA, 21 nt, Shigella flexneri 2a str. 301
acgccagcuucgcgaccugcu

SEQ ID NO: 43543 - RNA, 22 nt, Shigella flexneri 2a str. 301
acgccuuauccggccuacaagu

SEQ ID NO: 43544 - RNA, 22 nt, Shigella flexneri 2a str. 301
acgcggcagcaccgucaggcca

SEQ ID NO: 43545 - RNA, 22 nt, Shigella flexneri 2a str. 301
acggcgguauacaucgcgguga

SEQ ID NO: 43546 - RNA, 22 nt, Shigella flexneri 2a str. 301
acggugacagaacgcuaagauu

SEQ ID NO: 43547 - RNA, 22 nt, Shigella flexneri 2a str. 301
acggugccgucguacuguucga

SEQ ID NO: 43548 - RNA, 21 nt, Shigella flexneri 2a str. 301
acgguucuggucuggcuguug

SEQ ID NO: 43549 - RNA, 22 nt, Shigella flexneri 2a str. 301
acgucgcggaucaccgcuuucg

SEQ ID NO: 43550 - RNA, 22 nt, Shigella flexneri 2a str. 301
acgucguuuugauauuauuaug

SEQ ID NO: 43551 - RNA, 22 nt, Shigella flexneri 2a str. 301
acgucuaguuguuguauuugaa

SEQ ID NO: 43552 - RNA, 21 nt, Shigella flexneri 2a str. 301
acgugagcuggaaggggcgcu

SEQ ID NO: 43553 - RNA, 22 nt, Shigella flexneri 2a str. 301
acguggaugcuucccguaucgu

SEQ ID NO: 43554 - RNA, 22 nt, Shigella flexneri 2a str. 301
acguuaccggucagaaucgcca

SEQ ID NO: 43555 - RNA, 22 nt, Shigella flexneri 2a str. 301
acguuccuccccaccagcuugu

SEQ ID NO: 43556 - RNA, 22 nt, Shigella flexneri 2a str. 301
acuacuucauuaugagcaaacu

SEQ ID NO: 43557 - RNA, 22 nt, Shigella flexneri 2a str. 301
acuaugugacccaucaacacgc

SEQ ID NO: 43558 - RNA, 22 nt, Shigella flexneri 2a str. 301
acuccagcaccuguuugaucug

SEQ ID NO: 43559 - RNA, 22 nt, Shigella flexneri 2a str. 301
acuggaaacuguuaccaucgcg

SEQ ID NO: 43560 - RNA, 22 nt, Shigella flexneri 2a str. 301
acuggcaauugccagccacggu

SEQ ID NO: 43561 - RNA, 22 nt, Shigella flexneri 2a str. 301
acuggcaggucuggcggugauc

SEQ ID NO: 43562 - RNA, 22 nt, Shigella flexneri 2a str. 301
acugucguggggaagaauuugc

SEQ ID NO: 43563 - RNA, 22 nt, Shigella flexneri 2a str. 301
acuuccuguuccgaggaggcga

SEQ ID NO: 43564 - RNA, 22 nt, Shigella flexneri 2a str. 301
agaagugugguuuuguagauau

SEQ ID NO: 43565 - RNA, 22 nt, Shigella flexneri 2a str. 301
agacgcgaugcauugcucugaa

SEQ ID NO: 43566 - RNA, 22 nt, Shigella flexneri 2a str. 301
agcaacugacgcuucggauccc

SEQ ID NO: 43567 - RNA, 22 nt, Shigella flexneri 2a str. 301
agcagcauaauauuucgcgcag

SEQ ID NO: 43568 - RNA, 22 nt, Shigella flexneri 2a str. 301
agcagccguauuaugcaccugc

SEQ ID NO: 43569 - RNA, 22 nt, Shigella flexneri 2a str. 301
agcaguuguuauuaaaggauac

SEQ ID NO: 43570 - RNA, 22 nt, Shigella flexneri 2a str. 301
agcaguuucguggcggcaccga

SEQ ID NO: 43571 - RNA, 22 nt, Shigella flexneri 2a str. 301
agcauucaguugaugaaaucgc

SEQ ID NO: 43572 - RNA, 22 nt, Shigella flexneri 2a str. 301
agcauugaggaacagcguaauc

SEQ ID NO: 43573 - RNA, 23 nt, Shigella flexneri 2a str. 301
agccguaacccugcugcaucaga

SEQ ID NO: 43574 - RNA, 23 nt, Shigella flexneri 2a str. 301
agcgcaccagcaccgacugagcg

SEQ ID NO: 43575 - RNA, 22 nt, Shigella flexneri 2a str. 301
agcgccguguuugguacgggua

SEQ ID NO: 43576 - RNA, 22 nt, Shigella flexneri 2a str. 301
agcgcugggccugucgcagccg

SEQ ID NO: 43577 - RNA, 22 nt, Shigella flexneri 2a str. 301
agcggauaauaaaucaucgguu

SEQ ID NO: 43578 - RNA, 22 nt, Shigella flexneri 2a str. 301
agcggcacgcugaugcgaacgg

SEQ ID NO: 43579 - RNA, 22 nt, Shigella flexneri 2a str. 301
agcggcuuuccggcgagguggc

SEQ ID NO: 43580 - RNA, 22 nt, Shigella flexneri 2a str. 301
agcguaucaggauaucuauaca

SEQ ID NO: 43581 - RNA, 22 nt, Shigella flexneri 2a str. 301
agcguauuaagaaugagcugga

SEQ ID NO: 43582 - RNA, 22 nt, Shigella flexneri 2a str. 301
agcguguuacugaauaccugac

SEQ ID NO: 43583 - RNA, 22 nt, Shigella flexneri 2a str. 301
agcucgcucgcgguuuguuuug

SEQ ID NO: 43584 - RNA, 22 nt, Shigella flexneri 2a str. 301
agcuguaauuucccgcguuugu

SEQ ID NO: 43585 - RNA, 22 nt, Shigella flexneri 2a str. 301
agcuuguucgacaaagcuuugc

SEQ ID NO: 43586 - RNA, 22 nt, Shigella flexneri 2a str. 301
aggaaacuuauuucuuaucguu

SEQ ID NO: 43587 - RNA, 22 nt, Shigella flexneri 2a str. 301
aggaauauucaggcucugacug

SEQ ID NO: 43588 - RNA, 22 nt, Shigella flexneri 2a str. 301
aggagcgcuccagccccuucga

SEQ ID NO: 43589 - RNA, 22 nt, Shigella flexneri 2a str. 301
aggauauugguaaaacguucgc

SEQ ID NO: 43590 - RNA, 22 nt, Shigella flexneri 2a str. 301
aggcgcugaacgugguggugcg

SEQ ID NO: 43591 - RNA, 22 nt, Shigella flexneri 2a str. 301
aggguugacguaauagagguuu

SEQ ID NO: 43592 - RNA, 22 nt, Shigella flexneri 2a str. 301
aggucagauaagcgaaacgcau

SEQ ID NO: 43593 - RNA, 19 nt, Shigella flexneri 2a str. 301
aggugauugaaaccgaucu

SEQ ID NO: 43594 - RNA, 22 nt, Shigella flexneri 2a str. 301
aggugcaggucagcacguugcu

SEQ ID NO: 43595 - RNA, 22 nt, Shigella flexneri 2a str. 301
aggugucgagcagauccagcgc

SEQ ID NO: 43596 - RNA, 22 nt, Shigella flexneri 2a str. 301
agguucguaccgguguggcgcg

SEQ ID NO: 43597 - RNA, 22 nt, Shigella flexneri 2a str. 301
agucaucaggcucuuucuuaaa

SEQ ID NO: 43598 - RNA, 23 nt, Shigella flexneri 2a str. 301
agucaugaauucacuacguccgg

SEQ ID NO: 43599 - RNA, 22 nt, Shigella flexneri 2a str. 301
agucgcgauagugcuuuuucag

SEQ ID NO: 43600 - RNA, 22 nt, Shigella flexneri 2a str. 301
agugaucaggacgauauuuggu

SEQ ID NO: 43601 - RNA, 22 nt, Shigella flexneri 2a str. 301
aguuccggcaguuauuguggcg

SEQ ID NO: 43602 - RNA, 22 nt, Shigella flexneri 2a str. 301
aguucuaccugcuugccgaguu

SEQ ID NO: 43603 - RNA, 22 nt, Shigella flexneri 2a str. 301
aguuugaucgcaaagguauggu

SEQ ID NO: 43604 - RNA, 22 nt, Shigella flexneri 2a str. 301
aguuugcuauugaccaggaaaa

SEQ ID NO: 43605 - RNA, 22 nt, Shigella flexneri 2a str. 301
auaaacgccuggcuggcugguu

SEQ ID NO: 43606 - RNA, 22 nt, Shigella flexneri 2a str. 301
auacaccgggccugcauaugga

SEQ ID NO: 43607 - RNA, 22 nt, Shigella flexneri 2a str. 301
auaugguaaucaacaauggccg

SEQ ID NO: 43608 - RNA, 22 nt, Shigella flexneri 2a str. 301
aucaggcaaaauaugucggaug

SEQ ID NO: 43609 - RNA, 22 nt, Shigella flexneri 2a str. 301
aucaggcuugggcaguguuaga

SEQ ID NO: 43610 - RNA, 22 nt, Shigella flexneri 2a str. 301
gugcgcuggguaucagaaaugg

SEQ ID NO: 43611 - RNA, 22 nt, Shigella flexneri 2a str. 301
gugggaauacgugucagcgauc

SEQ ID NO: 43612 - RNA, 22 nt, Shigella flexneri 2a str. 301
gugucgaugcguugcucuugca

SEQ ID NO: 43613 - RNA, 20 nt, Shigella flexneri 2a str. 301
gugugaccgccgucauauua

SEQ ID NO: 43614 - RNA, 22 nt, Shigella flexneri 2a str. 301
guguuaucgauauuggugaguu

SEQ ID NO: 43615 - RNA, 22 nt, Shigella flexneri 2a str. 301
guguugaaguucgucauaucgu

SEQ ID NO: 43616 - RNA, 22 nt, Shigella flexneri 2a str. 301
guguugaauaauuccacugcag

SEQ ID NO: 43617 - RNA, 22 nt, Shigella flexneri 2a str. 301
guuccggcaguuauuguggcga

SEQ ID NO: 43618 - RNA, 22 nt, Shigella flexneri 2a str. 301
guuucacuccaaccuguucaag

SEQ ID NO: 43619 - RNA, 22 nt, Shigella flexneri 2a str. 301
guuugcagguagagcagauuau

SEQ ID NO: 43620 - RNA, 22 nt, Shigella flexneri 2a str. 301
guuugcgcugaugugggcagua

SEQ ID NO: 43621 - RNA, 22 nt, Shigella flexneri 2a str. 301
uaaaccgaugguggugaugacc

SEQ ID NO: 43622 - RNA, 22 nt, Shigella flexneri 2a str. 301
uaaagcaccgcggccuuuuuug

SEQ ID NO: 43623 - RNA, 22 nt, Shigella flexneri 2a str. 301
uaaauggugggagugcgcuucc

SEQ ID NO: 43624 - RNA, 22 nt, Shigella flexneri 2a str. 301
uaacccgcugcauugccaccgc

SEQ ID NO: 43625 - RNA, 22 nt, Shigella flexneri 2a str. 301
uaacggcagugaagauucgugg

SEQ ID NO: 43626 - RNA, 22 nt, Shigella flexneri 2a str. 301
uaaggcaacaaaaaauggauag

SEQ ID NO: 43627 - RNA, 22 nt, Shigella flexneri 2a str. 301
uaaggcguuuacgccgcauccg

SEQ ID NO: 43628 - RNA, 22 nt, Shigella flexneri 2a str. 301
uacagguacugcguaggccuga

SEQ ID NO: 43629 - RNA, 22 nt, Shigella flexneri 2a str. 301
uacgacgcacuuuaugaggucc

SEQ ID NO: 43630 - RNA, 22 nt, Shigella flexneri 2a str. 301
uacgaggucaacggagcggaca

SEQ ID NO: 43631 - RNA, 22 nt, Shigella flexneri 2a str. 301
uacgccuuauccggccuacggg

SEQ ID NO: 43632 - RNA, 22 nt, Shigella flexneri 2a str. 301
uacgcuuaucaggccuacagag

SEQ ID NO: 43633 - RNA, 22 nt, Shigella flexneri 2a str. 301
uacggcaggcgaggcggaucau

SEQ ID NO: 43634 - RNA, 22 nt, Shigella flexneri 2a str. 301
uacgugcccaauaucggcgcgg

SEQ ID NO: 43635 - RNA, 22 nt, Shigella flexneri 2a str. 301
uacguuauccaucaccagaauc

SEQ ID NO: 43636 - RNA, 21 nt, Shigella flexneri 2a str. 301
uacguucuacaaaccugugcc

SEQ ID NO: 43637 - RNA, 22 nt, Shigella flexneri 2a str. 301
uacucaaacauuagcugggccu

SEQ ID NO: 43638 - RNA, 22 nt, Shigella flexneri 2a str. 301
uacuggugauugugcaaucgua

SEQ ID NO: 43639 - RNA, 22 nt, Shigella flexneri 2a str. 301
uagcaacuuccgcuuccaugac

SEQ ID NO: 43640 - RNA, 22 nt, Shigella flexneri 2a str. 301
uagccgcugaccacuaccuggg

SEQ ID NO: 43641 - RNA, 22 nt, Shigella flexneri 2a str. 301
uagcgucaggcgcauugccugc

SEQ ID NO: 43642 - RNA, 22 nt, Shigella flexneri 2a str. 301
uagcucugcuacgucgcaugga

SEQ ID NO: 43643 - RNA, 22 nt, Shigella flexneri 2a str. 301
uaggccggauaaggcguuuacg

SEQ ID NO: 43644 - RNA, 22 nt, Shigella flexneri 2a str. 301
uaguggacgcugauguacagga

SEQ ID NO: 43645 - RNA, 22 nt, Shigella flexneri 2a str. 301
uauagcaaccgaccauauuggu

SEQ ID NO: 43646 - RNA, 22 nt, Shigella flexneri 2a str. 301
uauaucgacguuggugcgacgu

SEQ ID NO: 43647 - RNA, 22 nt, Shigella flexneri 2a str. 301
uaucacgcacagauuuggcauc

SEQ ID NO: 43648 - RNA, 22 nt, Shigella flexneri 2a str. 301
uaucgagaucggcauacgccgu

SEQ ID NO: 43649 - RNA, 22 nt, Shigella flexneri 2a str. 301
uaucgccugcgaaucuaaauca

SEQ ID NO: 43650 - RNA, 22 nt, Shigella flexneri 2a str. 301
uaucgucugauuaugaagagcg

SEQ ID NO: 43651 - RNA, 22 nt, Shigella flexneri 2a str. 301
uaugcugcugacuacucuucgu

SEQ ID NO: 43652 - RNA, 21 nt, Shigella flexneri 2a str. 301
uauuccugcggaucgagagaa

SEQ ID NO: 43653 - RNA, 22 nt, Shigella flexneri 2a str. 301
uauucucguuccgcgcaacacg

SEQ ID NO: 43654 - RNA, 22 nt, Shigella flexneri 2a str. 301
ucaaccagaacauaucgccgcc

SEQ ID NO: 43655 - RNA, 22 nt, Shigella flexneri 2a str. 301
ucaauacuuuggucagcauggg

SEQ ID NO: 43656 - RNA, 22 nt, Shigella flexneri 2a str. 301
ucaccacguuucaggacaaacg

SEQ ID NO: 43657 - RNA, 22 nt, Shigella flexneri 2a str. 301
ucacccguuagcacuaucugaa

SEQ ID NO: 43658 - RNA, 22 nt, Shigella flexneri 2a str. 301
ucaccgccucucgcguggcagg

SEQ ID NO: 43659 - RNA, 23 nt, Shigella flexneri 2a str. 301
ucaccgguauuugaggcuguuuc

SEQ ID NO: 43660 - RNA, 22 nt, Shigella flexneri 2a str. 301
ucaccguauucuggaaagcaug

SEQ ID NO: 43661 - RNA, 22 nt, Shigella flexneri 2a str. 301
ucaccugaucgucgccguacug

SEQ ID NO: 43662 - RNA, 22 nt, Shigella flexneri 2a str. 301
ucacgauaaacagcccugcguu

SEQ ID NO: 43663 - RNA, 22 nt, Shigella flexneri 2a str. 301
ucacugaugagccagguucugg

SEQ ID NO: 43664 - RNA, 22 nt, Shigella flexneri 2a str. 301
ucacugcaagcuucucaggaug

SEQ ID NO: 43665 - RNA, 22 nt, Shigella flexneri 2a str. 301
ucagacaauugacggcuugacg

SEQ ID NO: 43666 - RNA, 22 nt, Shigella flexneri 2a str. 301
ucagaccuucuucgauuucgcg

SEQ ID NO: 43667 - RNA, 22 nt, Shigella flexneri 2a str. 301
ucagcaaugucuucguccuucg

SEQ ID NO: 43668 - RNA, 22 nt, Shigella flexneri 2a str. 301
ucagcgccagcagcagcgggau

SEQ ID NO: 43669 - RNA, 22 nt, Shigella flexneri 2a str. 301
ucaguugauacuccaccugcga

SEQ ID NO: 43670 - RNA, 22 nt, Shigella flexneri 2a str. 301
ucauaaugggaguuuugauacu

SEQ ID NO: 43671 - RNA, 22 nt, Shigella flexneri 2a str. 301
ucaucgguuucaaugacuuuug

SEQ ID NO: 43672 - RNA, 22 nt, Shigella flexneri 2a str. 301
ucaucgucgaguugcagguuca

SEQ ID NO: 43673 - RNA, 22 nt, Shigella flexneri 2a str. 301
ucaucuacaucgguuguuuaaa

SEQ ID NO: 43674 - RNA, 22 nt, Shigella flexneri 2a str. 301
ucaugcgcgaagcgguagcgau

SEQ ID NO: 43675 - RNA, 22 nt, Shigella flexneri 2a str. 301
ucauugacagaaagcagcggag

SEQ ID NO: 43676 - RNA, 22 nt, Shigella flexneri 2a str. 301
uccauacugaaggcgcguauca

SEQ ID NO: 43677 - RNA, 22 nt, Shigella flexneri 2a str. 301
ucccagguaguggucagcggcu

SEQ ID NO: 43678 - RNA, 18 nt, Shigella flexneri 2a str. 301
uccgagcuggucauucgc

SEQ ID NO: 43679 - RNA, 22 nt, Shigella flexneri 2a str. 301
uccgcgaccguggcagguuggg

SEQ ID NO: 43680 - RNA, 21 nt, Shigella flexneri 2a str. 301
uccgcgguguuuucagccagc

SEQ ID NO: 43681 - RNA, 22 nt, Shigella flexneri 2a str. 301
uccggagccauuaaagucuguu

SEQ ID NO: 43682 - RNA, 22 nt, Shigella flexneri 2a str. 301
uccggaugauuaauguuggccg

SEQ ID NO: 43683 - RNA, 22 nt, Shigella flexneri 2a str. 301
uccggccuacaaaguccugcag

SEQ ID NO: 43684 - RNA, 22 nt, Shigella flexneri 2a str. 301
uccggccuacaugaucucugca

SEQ ID NO: 43685 - RNA, 20 nt, Shigella flexneri 2a str. 301
uccguuaucuccacccgacc

SEQ ID NO: 43686 - RNA, 22 nt, Shigella flexneri 2a str. 301
ucgaaguuuauccgcaagguuu

SEQ ID NO: 43687 - RNA, 22 nt, Shigella flexneri 2a str. 301
ucgaccugauacggcgcaucga

SEQ ID NO: 43688 - RNA, 22 nt, Shigella flexneri 2a str. 301
ucgacgaauuugcuauauuugc

SEQ ID NO: 43689 - RNA, 20 nt, Shigella flexneri 2a str. 301
ucgacggcaaauuugugcag

SEQ ID NO: 43690 - RNA, 22 nt, Shigella flexneri 2a str. 301
ucgcaaaccgggccugacgcug

SEQ ID NO: 43691 - RNA, 22 nt, Shigella flexneri 2a str. 301
ucgccgcaauggaccgggaucu

SEQ ID NO: 43692 - RNA, 22 nt, Shigella flexneri 2a str. 301
ucgcgccauuauggaacgcuug

SEQ ID NO: 43693 - RNA, 22 nt, Shigella flexneri 2a str. 301
ucgcgccugacgauuauucgua

SEQ ID NO: 43694 - RNA, 22 nt, Shigella flexneri 2a str. 301
ucgcgccuggcugccagugccg

SEQ ID NO: 43695 - RNA, 22 nt, Shigella flexneri 2a str. 301
ucgcgguaauuauuccuugcug

SEQ ID NO: 43696 - RNA, 23 nt, Shigella flexneri 2a str. 301
ucggaauugccgugcaaaauccg

SEQ ID NO: 43697 - RNA, 22 nt, Shigella flexneri 2a str. 301
ucggcaccgucagcgcccaggu

SEQ ID NO: 43698 - RNA, 22 nt, Shigella flexneri 2a str. 301
ucggcucgcccagcggaguuuc

SEQ ID NO: 43699 - RNA, 22 nt, Shigella flexneri 2a str. 301
ucggugcuaaaucacgucagcg

SEQ ID NO: 43700 - RNA, 21 nt, Shigella flexneri 2a str. 301
ucgguggcugaccaguuuggu

SEQ ID NO: 43701 - RNA, 22 nt, Shigella flexneri 2a str. 301
ucgguucugguucuuuaaccgg

SEQ ID NO: 43702 - RNA, 18 nt, Shigella flexneri 2a str. 301
ucguaccgauugaaaaua

SEQ ID NO: 43703 - RNA, 22 nt, Shigella flexneri 2a str. 301
ucgucgauauagcuacggaaua

SEQ ID NO: 43704 - RNA, 22 nt, Shigella flexneri 2a str. 301
ucgucgcuacgcauucucgguu

SEQ ID NO: 43705 - RNA, 22 nt, Shigella flexneri 2a str. 301
ucguuauucuucgguaucggca

SEQ ID NO: 43706 - RNA, 22 nt, Shigella flexneri 2a str. 301
ucguuguaauauuucagggugu

SEQ ID NO: 43707 - RNA, 22 nt, Shigella flexneri 2a str. 301
ucuccgguaaggcugcgauaau

SEQ ID NO: 43708 - RNA, 22 nt, Shigella flexneri 2a str. 301
ucucgaucuggugcagaaaaaa

SEQ ID NO: 43709 - RNA, 22 nt, Shigella flexneri 2a str. 301
ucucugcgauaaaaccgccugu

SEQ ID NO: 43710 - RNA, 22 nt, Shigella flexneri 2a str. 301
ucugacuggccguggcgucacu

SEQ ID NO: 43711 - RNA, 22 nt, Shigella flexneri 2a str. 301
ucugagcguaccaaauauuauu

SEQ ID NO: 43712 - RNA, 22 nt, Shigella flexneri 2a str. 301
ucugauauaaaauugaacauug

SEQ ID NO: 43713 - RNA, 22 nt, Shigella flexneri 2a str. 301
ucugcggcaaauacagcgguga

SEQ ID NO: 43714 - RNA, 22 nt, Shigella flexneri 2a str. 301
ucugcugccugacguugcagcu

SEQ ID NO: 43715 - RNA, 23 nt, Shigella flexneri 2a str. 301
ucuggcuuguuucugcucaccgu

SEQ ID NO: 43716 - RNA, 22 nt, Shigella flexneri 2a str. 301
ucugggaauggaaguggguuau

SEQ ID NO: 43717 - RNA, 22 nt, Shigella flexneri 2a str. 301
ucugguaaucgcaacuuuggug

SEQ ID NO: 43718 - RNA, 22 nt, Shigella flexneri 2a str. 301
ucugguauggauguggcgcgua

SEQ ID NO: 43719 - RNA, 22 nt, Shigella flexneri 2a str. 301
ucuggugagauaucagaugauu

SEQ ID NO: 43720 - RNA, 22 nt, Shigella flexneri 2a str. 301
ucuugucgagcucgguggaacu

SEQ ID NO: 43721 - RNA, 22 nt, Shigella flexneri 2a str. 301
ucuuugaugcggugccagcucu

SEQ ID NO: 43722 - RNA, 19 nt, Shigella flexneri 2a str. 301
ugaaagcgguugcaggcgg

SEQ ID NO: 43723 - RNA, 19 nt, Shigella flexneri 2a str. 301
ugaaccaaaauugcuugag

SEQ ID NO: 43724 - RNA, 22 nt, Shigella flexneri 2a str. 301
ugaagcacuauauuggugcaac

SEQ ID NO: 43725 - RNA, 23 nt, Shigella flexneri 2a str. 301
ugaaguaguuccgcuugugcacg

SEQ ID NO: 43726 - RNA, 22 nt, Shigella flexneri 2a str. 301
ugaauacuuacuggcgacgucg

SEQ ID NO: 43727 - RNA, 22 nt, Shigella flexneri 2a str. 301
ugaauugauuaaaaauaagcca

SEQ ID NO: 43728 - RNA, 22 nt, Shigella flexneri 2a str. 301
ugacguugaugucgcuugccgg

SEQ ID NO: 43729 - RNA, 22 nt, Shigella flexneri 2a str. 301
ugacugcguaauacagcccguc

SEQ ID NO: 43730 - RNA, 23 nt, Shigella flexneri 2a str. 301
ugacuuucagcaguugcugacgg

SEQ ID NO: 43731 - RNA, 22 nt, Shigella flexneri 2a str. 301
ugagaacggacguuugucgcgc

SEQ ID NO: 43732 - RNA, 20 nt, Shigella flexneri 2a str. 301
ugagaagcuggaaggguuga

SEQ ID NO: 43733 - RNA, 22 nt, Shigella flexneri 2a str. 301
ugagcgcggccuguaccgccca

SEQ ID NO: 43734 - RNA, 22 nt, Shigella flexneri 2a str. 301
ugaguaaauacuguauggccug

SEQ ID NO: 43735 - RNA, 22 nt, Shigella flexneri 2a str. 301
ugagucacaucagcguccgcug

SEQ ID NO: 43736 - RNA, 22 nt, Shigella flexneri 2a str. 301
ugaguuuaucuuguuauggauu

SEQ ID NO: 43737 - RNA, 22 nt, Shigella flexneri 2a str. 301
ugauggcugccgccgucugcgc

SEQ ID NO: 43738 - RNA, 22 nt, Shigella flexneri 2a str. 301
ugaugggcaaggcuuccugugg

SEQ ID NO: 43739 - RNA, 22 nt, Shigella flexneri 2a str. 301
ugauugauccuugcgcgcggca

SEQ ID NO: 43740 - RNA, 22 nt, Shigella flexneri 2a str. 301
ugcaaguaaacagugauuugcg

SEQ ID NO: 43741 - RNA, 22 nt, Shigella flexneri 2a str. 301
ugcaagugaaaaagagcggcau

SEQ ID NO: 43742 - RNA, 22 nt, Shigella flexneri 2a str. 301
ugcaaucuccguguaggccuga

SEQ ID NO: 43743 - RNA, 22 nt, Shigella flexneri 2a str. 301
ugcaccuuuaacagguuagcuc

SEQ ID NO: 43744 - RNA, 22 nt, Shigella flexneri 2a str. 301
ugcacgcgguggaagcuuucuu

SEQ ID NO: 43745 - RNA, 22 nt, Shigella flexneri 2a str. 301
ugcacgcugggugagaaacugc

SEQ ID NO: 43746 - RNA, 22 nt, Shigella flexneri 2a str. 301
ugcagacguugauugaacagcu

SEQ ID NO: 43747 - RNA, 22 nt, Shigella flexneri 2a str. 301
ugcaggccaaaaucgucaccua

SEQ ID NO: 43748 - RNA, 22 nt, Shigella flexneri 2a str. 301
ugcauaaguucagcaacacaaa

SEQ ID NO: 43749 - RNA, 22 nt, Shigella flexneri 2a str. 301
ugcaucacaaaccugaaaagaa

SEQ ID NO: 43750 - RNA, 22 nt, Shigella flexneri 2a str. 301
ugcauuauaugcuguaggccug

SEQ ID NO: 43751 - RNA, 22 nt, Shigella flexneri 2a str. 301
ugccacaaauacugaaagccgc

SEQ ID NO: 43752 - RNA, 22 nt, Shigella flexneri 2a str. 301
ugccacguaauucugcuucgcu

SEQ ID NO: 43753 - RNA, 22 nt, Shigella flexneri 2a str. 301
ugccaggcguaauucgcugaaa

SEQ ID NO: 43754 - RNA, 22 nt, Shigella flexneri 2a str. 301
ugcccgucagguccguguggua

SEQ ID NO: 43755 - RNA, 22 nt, Shigella flexneri 2a str. 301
ugccgccaucgggauugcuaug

SEQ ID NO: 43756 - RNA, 22 nt, Shigella flexneri 2a str. 301
ugccguauuucguaccggcaac

SEQ ID NO: 43757 - RNA, 22 nt, Shigella flexneri 2a str. 301
ugccgucggagaggaaaucgau

SEQ ID NO: 43758 - RNA, 22 nt, Shigella flexneri 2a str. 301
ugccucugauaauuagcuaagu

SEQ ID NO: 43759 - RNA, 22 nt, Shigella flexneri 2a str. 301
ugcgacagcguuguccucgcgg

SEQ ID NO: 43760 - RNA, 22 nt, Shigella flexneri 2a str. 301
ugcgagcgaugucugccggguu

SEQ ID NO: 43761 - RNA, 22 nt, Shigella flexneri 2a str. 301
ugcgauuauucaccccacguuu

SEQ ID NO: 43762 - RNA, 20 nt, Shigella flexneri 2a str. 301
ugcgauuucaccguuagcgu

SEQ ID NO: 43763 - RNA, 20 nt, Shigella flexneri 2a str. 301
ugcgcagaaagucgccuucu

SEQ ID NO: 43764 - RNA, 22 nt, Shigella flexneri 2a str. 301
ugcgcugcgcuuaucaggccua

SEQ ID NO: 43765 - RNA, 22 nt, Shigella flexneri 2a str. 301
ugcgcuuuguuuaugccagaug

SEQ ID NO: 43766 - RNA, 22 nt, Shigella flexneri 2a str. 301
ugcgcuuuguuuaugucggaug

SEQ ID NO: 43767 - RNA, 20 nt, Shigella flexneri 2a str. 301
ugcguaggccugauaagcgu

SEQ ID NO: 43768 - RNA, 22 nt, Shigella flexneri 2a str. 301
ugcuaaagauuugauuaccgug

SEQ ID NO: 43769 - RNA, 22 nt, Shigella flexneri 2a str. 301
ugcuacgcgcuguuguugcagu

SEQ ID NO: 43770 - RNA, 22 nt, Shigella flexneri 2a str. 301
ugcuagaacgucaucggcuacu

SEQ ID NO: 43771 - RNA, 22 nt, Shigella flexneri 2a str. 301
ugcugaccaaaagugcguccga

SEQ ID NO: 43772 - RNA, 22 nt, Shigella flexneri 2a str. 301
ugcugcacgccggucauaauga

SEQ ID NO: 43773 - RNA, 20 nt, Shigella flexneri 2a str. 301
ugcugcugugacaguucgau

SEQ ID NO: 43774 - RNA, 22 nt, Shigella flexneri 2a str. 301
ugcuggagcuuggcaccagcga

SEQ ID NO: 43775 - RNA, 22 nt, Shigella flexneri 2a str. 301
ugcuggauaugaccaucgaaga

SEQ ID NO: 43776 - RNA, 22 nt, Shigella flexneri 2a str. 301
ugcugucgguauuaaaagccaa

SEQ ID NO: 43777 - RNA, 22 nt, Shigella flexneri 2a str. 301
uggaacggugcaggagcagguu

SEQ ID NO: 43778 - RNA, 22 nt, Shigella flexneri 2a str. 301
uggacgcugauuuucugcgccc

SEQ ID NO: 43779 - RNA, 23 nt, Shigella flexneri 2a str. 301
uggagugaaacgauggcgauugc

SEQ ID NO: 43780 - RNA, 22 nt, Shigella flexneri 2a str. 301
uggcaggccauuggguugagaa

SEQ ID NO: 43781 - RNA, 17 nt, Shigella flexneri 2a str. 301
uggcauuuauuuuuacc

SEQ ID NO: 43782 - RNA, 22 nt, Shigella flexneri 2a str. 301
uggccguuggggaagugacucc

SEQ ID NO: 43783 - RNA, 19 nt, Shigella flexneri 2a str. 301
uggcgaccauugacuucug

SEQ ID NO: 43784 - RNA, 22 nt, Shigella flexneri 2a str. 301
uggcgcguggccacaucaucaa

SEQ ID NO: 43785 - RNA, 21 nt, Shigella flexneri 2a str. 301
uggcuggaucaacggcgguau

SEQ ID NO: 43786 - RNA, 22 nt, Shigella flexneri 2a str. 301
ugguaagcgcggcaugacguau

SEQ ID NO: 43787 - RNA, 22 nt, Shigella flexneri 2a str. 301
ugguacgcacguuauguacgug

SEQ ID NO: 43788 - RNA, 22 nt, Shigella flexneri 2a str. 301
ugguaugcgcgaauuauuaccg

SEQ ID NO: 43789 - RNA, 21 nt, Shigella flexneri 2a str. 301
uggucagcaguuaucgcugac

SEQ ID NO: 43790 - RNA, 20 nt, Shigella flexneri 2a str. 301
ugguuaccggcaaaacaauc

SEQ ID NO: 43791 - RNA, 23 nt, Shigella flexneri 2a str. 301
ugguugaccgcaguuuugccgcc

SEQ ID NO: 43792 - RNA, 22 nt, Shigella flexneri 2a str. 301
ugucaguggcgguucaaugcgg

SEQ ID NO: 43793 - RNA, 22 nt, Shigella flexneri 2a str. 301
ugucgaauaugauuaucggcgc

SEQ ID NO: 43794 - RNA, 20 nt, Shigella flexneri 2a str. 301
uguggcgcaguauuccgcac

SEQ ID NO: 43795 - RNA, 22 nt, Shigella flexneri 2a str. 301
uguuaucguugaugucgugcuc

SEQ ID NO: 43796 - RNA, 22 nt, Shigella flexneri 2a str. 301
uguugaaacuguagcccguucc

SEQ ID NO: 43797 - RNA, 22 nt, Shigella flexneri 2a str. 301
uguugcuaagucuagggccgau

SEQ ID NO: 43798 - RNA, 22 nt, Shigella flexneri 2a str. 301
uguuugaauauucaggugcuug

SEQ ID NO: 43799 - RNA, 22 nt, Shigella flexneri 2a str. 301
uuaacgccauuugcgccauuga

SEQ ID NO: 43800 - RNA, 19 nt, Shigella flexneri 2a str. 301
uuaacgccgaucgcaucgg

SEQ ID NO: 43801 - RNA, 22 nt, Shigella flexneri 2a str. 301
uuaacugcugagccggugcguu

SEQ ID NO: 43802 - RNA, 21 nt, Shigella flexneri 2a str. 301
uuaaucucauucggaugucgu

SEQ ID NO: 43803 - RNA, 22 nt, Shigella flexneri 2a str. 301
uuacggaacauagcacgaccca

SEQ ID NO: 43804 - RNA, 22 nt, Shigella flexneri 2a str. 301
uuacgguaacgucguucuacuu

SEQ ID NO: 43805 - RNA, 22 nt, Shigella flexneri 2a str. 301
uuacgugaucgccuugcucaau

SEQ ID NO: 43806 - RNA, 22 nt, Shigella flexneri 2a str. 301
uuacugcgucagggaaaaccag

SEQ ID NO: 43807 - RNA, 22 nt, Shigella flexneri 2a str. 301
uuagcaucuuuuguucagcugg

SEQ ID NO: 43808 - RNA, 19 nt, Shigella flexneri 2a str. 301
uuaucaugaucgauggcgg

SEQ ID NO: 43809 - RNA, 22 nt, Shigella flexneri 2a str. 301
uuaucggcaggcggaaagccuu

SEQ ID NO: 43810 - RNA, 22 nt, Shigella flexneri 2a str. 301
uuauggcaaaacauuucacucc

SEQ ID NO: 43811 - RNA, 23 nt, Shigella flexneri 2a str. 301
uucagguugcgacuggugauggc

SEQ ID NO: 43812 - RNA, 22 nt, Shigella flexneri 2a str. 301
uucagucauuggcgugcaucag

SEQ ID NO: 43813 - RNA, 22 nt, Shigella flexneri 2a str. 301
uucccggcgaucacggcaugau

SEQ ID NO: 43814 - RNA, 22 nt, Shigella flexneri 2a str. 301
uucgagagucagugguacgucu

SEQ ID NO: 43815 - RNA, 22 nt, Shigella flexneri 2a str. 301
uucgaguugaucgucagagaug

SEQ ID NO: 43816 - RNA, 22 nt, Shigella flexneri 2a str. 301
uucgcccguaugucauuccggu

SEQ ID NO: 43817 - RNA, 22 nt, Shigella flexneri 2a str. 301
uucgccggugguuaugcggcag

SEQ ID NO: 43818 - RNA, 22 nt, Shigella flexneri 2a str. 301
uucgcggaauguguucgcugau

SEQ ID NO: 43819 - RNA, 22 nt, Shigella flexneri 2a str. 301
uucguaggcgcucugaacuugc

SEQ ID NO: 43820 - RNA, 22 nt, Shigella flexneri 2a str. 301
uucgucagucaggacaaacugc

SEQ ID NO: 43821 - RNA, 22 nt, Shigella flexneri 2a str. 301
uucguugcgugagguugcuggc

SEQ ID NO: 43822 - RNA, 22 nt, Shigella flexneri 2a str. 301
uucugaauauuccgaauaguua

SEQ ID NO: 43823 - RNA, 22 nt, Shigella flexneri 2a str. 301
uucuuguaguuucaacgcugcg

SEQ ID NO: 43824 - RNA, 22 nt, Shigella flexneri 2a str. 301
uugacuguuugucaaagaauga

SEQ ID NO: 43825 - RNA, 22 nt, Shigella flexneri 2a str. 301
uugacuuucugacccacuucga

SEQ ID NO: 43826 - RNA, 22 nt, Shigella flexneri 2a str. 301
uugagcgugccgguggcgaaca

SEQ ID NO: 43827 - RNA, 22 nt, Shigella flexneri 2a str. 301
uugaggaugugcgcacgguccg

SEQ ID NO: 43828 - RNA, 22 nt, Shigella flexneri 2a str. 301
uugagucgaaagucaucauuau

SEQ ID NO: 43829 - RNA, 22 nt, Shigella flexneri 2a str. 301
uugaucgggaugaugauauuaa

SEQ ID NO: 43830 - RNA, 22 nt, Shigella flexneri 2a str. 301
uugaugaccgguauugaugaac

SEQ ID NO: 43831 - RNA, 22 nt, Shigella flexneri 2a str. 301
uugaugauaucgaucucaaccu

SEQ ID NO: 43832 - RNA, 22 nt, Shigella flexneri 2a str. 301
uugcacgauuuuguaggccgga

SEQ ID NO: 43833 - RNA, 22 nt, Shigella flexneri 2a str. 301
uugcagggacuauguaggccug

SEQ ID NO: 43834 - RNA, 22 nt, Shigella flexneri 2a str. 301
uugcagguuuaugaaguuggca

SEQ ID NO: 43835 - RNA, 22 nt, Shigella flexneri 2a str. 301
uugccguagccgaccaccgcaa

SEQ ID NO: 43836 - RNA, 22 nt, Shigella flexneri 2a str. 301
uugcgcagcgugacuucgccgu

SEQ ID NO: 43837 - RNA, 22 nt, Shigella flexneri 2a str. 301
uugcggaaguuuaucuggcgau

SEQ ID NO: 43838 - RNA, 22 nt, Shigella flexneri 2a str. 301
uuggaagaauuuguaggccgga

SEQ ID NO: 43839 - RNA, 22 nt, Shigella flexneri 2a str. 301
uuggcgaucauccgcaaaaucc

SEQ ID NO: 43840 - RNA, 22 nt, Shigella flexneri 2a str. 301
uuggcuaaguuugcgguauugu

SEQ ID NO: 43841 - RNA, 22 nt, Shigella flexneri 2a str. 301
uuguaggccggauaaggcguuu

SEQ ID NO: 43842 - RNA, 22 nt, Shigella flexneri 2a str. 301
uuguccgguacuggagccaacc

SEQ ID NO: 43843 - RNA, 22 nt, Shigella flexneri 2a str. 301
uuuaucggguacuaaaguucug

SEQ ID NO: 43844 - RNA, 22 nt, Shigella flexneri 2a str. 301
uuuccagguguucggcgcugac

SEQ ID NO: 43845 - RNA, 22 nt, Shigella flexneri 2a str. 301
uuugacgauggcuuucaggucg

SEQ ID NO: 43846 - RNA, 22 nt, Shigella flexneri 2a str. 301
uuugccauggucaaugagcgca

SEQ ID NO: 43847 - RNA, 22 nt, Shigella flexneri 2a str. 301
uuugcgauucaaaaggcguuau

SEQ ID NO: 43848 - RNA, 22 nt, Shigella flexneri 2a str. 301
uuuggcagcuucaugcauuaca

SEQ ID NO: 43849 - RNA, 22 nt, Shigella flexneri 2a str. 301
uuugucaauaaucugaaacccc

SEQ ID NO: 43850 - RNA, 22 nt, Shigella flexneri 2a str. 301
acugaccgacucagggcagaca

SEQ ID NO: 43851 - RNA, 22 nt, Shigella flexneri 2a str. 301
acugauaguguuuuauguucag

SEQ ID NO: 43852 - RNA, 20 nt, Shigella flexneri 2a str. 301
acugcacgugucucaggaug

SEQ ID NO: 43853 - RNA, 22 nt, Shigella flexneri 2a str. 301
acugcauccagaggcgaaugca

SEQ ID NO: 43854 - RNA, 22 nt, Shigella flexneri 2a str. 301
agaagcugaaaucauacgguuu

SEQ ID NO: 43855 - RNA, 22 nt, Shigella flexneri 2a str. 301
agacguaauaguugagccaguu

SEQ ID NO: 43856 - RNA, 22 nt, Shigella flexneri 2a str. 301
agagacgccaauuuguugugcu

SEQ ID NO: 43857 - RNA, 22 nt, Shigella flexneri 2a str. 301
agagcggcggucugaucacccg

SEQ ID NO: 43858 - RNA, 22 nt, Shigella flexneri 2a str. 301
agagugauguggaugcgcuggu

SEQ ID NO: 43859 - RNA, 22 nt, Shigella flexneri 2a str. 301
agaugguuccggcguucgauaa

SEQ ID NO: 43860 - RNA, 22 nt, Shigella flexneri 2a str. 301
agauuggugucaaucauguguu

SEQ ID NO: 43861 - RNA, 22 nt, Shigella flexneri 2a str. 301
agcaaaugguugaaaucgccaa

SEQ ID NO: 43862 - RNA, 22 nt, Shigella flexneri 2a str. 301
agcacggcgcagcaggguguua

SEQ ID NO: 43863 - RNA, 22 nt, Shigella flexneri 2a str. 301
agcagacaaacagcgucgaggu

SEQ ID NO: 43864 - RNA, 18 nt, Shigella flexneri 2a str. 301
agcagcggcgcaauggca

SEQ ID NO: 43865 - RNA, 22 nt, Shigella flexneri 2a str. 301
agcaggauacgaaggcuaugug

SEQ ID NO: 43866 - RNA, 22 nt, Shigella flexneri 2a str. 301
agcaggccacaguuccgguggu

SEQ ID NO: 43867 - RNA, 22 nt, Shigella flexneri 2a str. 301
agcaggugcaucgccagcauuu

SEQ ID NO: 43868 - RNA, 22 nt, Shigella flexneri 2a str. 301
agcaucgcucaucaugaugucg

SEQ ID NO: 43869 - RNA, 22 nt, Shigella flexneri 2a str. 301
agccgcuguaucaccaguucug

SEQ ID NO: 43870 - RNA, 20 nt, Shigella flexneri 2a str. 301
agccugucacugggcgcagc

SEQ ID NO: 43871 - RNA, 22 nt, Shigella flexneri 2a str. 301
agcgcaggcagaacggaauuac

SEQ ID NO: 43872 - RNA, 20 nt, Shigella flexneri 2a str. 301
agcgccuuuuuuauaggugu

SEQ ID NO: 43873 - RNA, 22 nt, Shigella flexneri 2a str. 301
agcgggauuaucucaagcuggu

SEQ ID NO: 43874 - RNA, 22 nt, Shigella flexneri 2a str. 301
agcggugcgauaacgaaccgcu

SEQ ID NO: 43875 - RNA, 22 nt, Shigella flexneri 2a str. 301
agcgugugaaugccgauaucgu

SEQ ID NO: 43876 - RNA, 21 nt, Shigella flexneri 2a str. 301
agcguuauggcguacgucugc

SEQ ID NO: 43877 - RNA, 19 nt, Shigella flexneri 2a str. 301
agcucaaucugguacagcu

SEQ ID NO: 43878 - RNA, 22 nt, Shigella flexneri 2a str. 301
agcugcugacgcaccaguucua

SEQ ID NO: 43879 - RNA, 18 nt, Shigella flexneri 2a str. 301
agcugcugcgcaucaaca

SEQ ID NO: 43880 - RNA, 21 nt, Shigella flexneri 2a str. 301
aggaaucacggcgcugaaagc

SEQ ID NO: 43881 - RNA, 22 nt, Shigella flexneri 2a str. 301
aggccgcaucaucgcuugcgau

SEQ ID NO: 43882 - RNA, 22 nt, Shigella flexneri 2a str. 301
aggccggauaagcgaagcgcau

SEQ ID NO: 43883 - RNA, 22 nt, Shigella flexneri 2a str. 301
aggccggauaaggcguucacgc

SEQ ID NO: 43884 - RNA, 22 nt, Shigella flexneri 2a str. 301
aggccguugcuguuggucaagc

SEQ ID NO: 43885 - RNA, 22 nt, Shigella flexneri 2a str. 301
aggcgcauuuccgguauccaua

SEQ ID NO: 43886 - RNA, 22 nt, Shigella flexneri 2a str. 301
aggcuuugugcucuucugugaa

SEQ ID NO: 43887 - RNA, 19 nt, Shigella flexneri 2a str. 301
agguaaacgucgucugguu

SEQ ID NO: 43888 - RNA, 22 nt, Shigella flexneri 2a str. 301
aggucaaugcguuugagaaugu

SEQ ID NO: 43889 - RNA, 22 nt, Shigella flexneri 2a str. 301
aggugcguaauaagcugguggc

SEQ ID NO: 43890 - RNA, 22 nt, Shigella flexneri 2a str. 301
agguuugcuguucgcgcgccag

SEQ ID NO: 43891 - RNA, 22 nt, Shigella flexneri 2a str. 301
agugaccgggguggagaaacgc

SEQ ID NO: 43892 - RNA, 22 nt, Shigella flexneri 2a str. 301
agugacgugauaaucgcuggaa

SEQ ID NO: 43893 - RNA, 21 nt, Shigella flexneri 2a str. 301
agugcguuuucggguagaugg

SEQ ID NO: 43894 - RNA, 22 nt, Shigella flexneri 2a str. 301
aguggcaacgcugcguugaagc

SEQ ID NO: 43895 - RNA, 22 nt, Shigella flexneri 2a str. 301
aguggcgcagggcgaugauguu

SEQ ID NO: 43896 - RNA, 22 nt, Shigella flexneri 2a str. 301
aguuacacgcccguauccgcgc

SEQ ID NO: 43897 - RNA, 22 nt, Shigella flexneri 2a str. 301
aguugcaauugucuggucaaua

SEQ ID NO: 43898 - RNA, 21 nt, Shigella flexneri 2a str. 301
aguugcagacguacacgggug

SEQ ID NO: 43899 - RNA, 22 nt, Shigella flexneri 2a str. 301
auaagacgcuuccgcgucgcau

SEQ ID NO: 43900 - RNA, 22 nt, Shigella flexneri 2a str. 301
auacaucguggggugccaugga

SEQ ID NO: 43901 - RNA, 22 nt, Shigella flexneri 2a str. 301
auaggucagugacacauuauga

SEQ ID NO: 43902 - RNA, 23 nt, Shigella flexneri 2a str. 301
aucaauugccgcuucgacguaaa

SEQ ID NO: 43903 - RNA, 21 nt, Shigella flexneri 2a str. 301
aucacgauccgcgcguugcag

SEQ ID NO: 43904 - RNA, 22 nt, Shigella flexneri 2a str. 301
aucacgucaccucgacgcuguu

SEQ ID NO: 43905 - RNA, 22 nt, Shigella flexneri 2a str. 301
aucacucaucaauaaauauuau

SEQ ID NO: 43906 - RNA, 22 nt, Shigella flexneri 2a str. 301
aucacuuuacgcuuaguggcaa

SEQ ID NO: 43907 - RNA, 21 nt, Shigella flexneri 2a str. 301
aucaggaacaaccggcgcgac

SEQ ID NO: 43908 - RNA, 22 nt, Shigella flexneri 2a str. 301
aucaggccuacauagucccugc

SEQ ID NO: 43909 - RNA, 22 nt, Shigella flexneri 2a str. 301
aucaggucaucgaucacuuucu

SEQ ID NO: 43910 - RNA, 22 nt, Shigella flexneri 2a str. 301
auccaauggcaguagauaaacu

SEQ ID NO: 43911 - RNA, 22 nt, Shigella flexneri 2a str. 301
auccagugcuucaucaucgaca

SEQ ID NO: 43912 - RNA, 22 nt, Shigella flexneri 2a str. 301
auccauaaaagccacaaucggu

SEQ ID NO: 43913 - RNA, 22 nt, Shigella flexneri 2a str. 301
aucccgauggucgauuuccagc

SEQ ID NO: 43914 - RNA, 22 nt, Shigella flexneri 2a str. 301
auccggccuacaaaagcacgca

SEQ ID NO: 43915 - RNA, 22 nt, Shigella flexneri 2a str. 301
auccggccuacaaaaucgugca

SEQ ID NO: 43916 - RNA, 23 nt, Shigella flexneri 2a str. 301
auccuaucguugguguggacuuu

SEQ ID NO: 43917 - RNA, 22 nt, Shigella flexneri 2a str. 301
aucgacgaacaucaugcgguac

SEQ ID NO: 43918 - RNA, 22 nt, Shigella flexneri 2a str. 301
aucgcgggccugucgguggcga

SEQ ID NO: 43919 - RNA, 22 nt, Shigella flexneri 2a str. 301
aucgcugauauuaaagccacaa

SEQ ID NO: 43920 - RNA, 22 nt, Shigella flexneri 2a str. 301
aucggcguggcggucaugauca

SEQ ID NO: 43921 - RNA, 22 nt, Shigella flexneri 2a str. 301
aucgguaaauuagccgcgcgug

SEQ ID NO: 43922 - RNA, 22 nt, Shigella flexneri 2a str. 301
aucggugguguauuccgcaucg

SEQ ID NO: 43923 - RNA, 22 nt, Shigella flexneri 2a str. 301
aucgucgaaacgccggagcagg

SEQ ID NO: 43924 - RNA, 22 nt, Shigella flexneri 2a str. 301
aucguugucagaccuauuagcg

SEQ ID NO: 43925 - RNA, 22 nt, Shigella flexneri 2a str. 301
aucucggcagauaucgcugcuc

SEQ ID NO: 43926 - RNA, 22 nt, Shigella flexneri 2a str. 301
aucugaguuuaugggaauaaau

SEQ ID NO: 43927 - RNA, 20 nt, Shigella flexneri 2a str. 301
aucuggcauaaacaaagcgc

SEQ ID NO: 43928 - RNA, 22 nt, Shigella flexneri 2a str. 301
aucuuugcacugcuuaaccaug

SEQ ID NO: 43929 - RNA, 22 nt, Shigella flexneri 2a str. 301
augaaacgcauauuuaccgcag

SEQ ID NO: 43930 - RNA, 22 nt, Shigella flexneri 2a str. 301
augacguaggccugauaagcgu

SEQ ID NO: 43931 - RNA, 22 nt, Shigella flexneri 2a str. 301
augaguauuuagacuaaagagu

SEQ ID NO: 43932 - RNA, 22 nt, Shigella flexneri 2a str. 301
ccauugcccggcucacucgcua

SEQ ID NO: 43933 - RNA, 22 nt, Shigella flexneri 2a str. 301
cccaugucaccuuucaacacgg

SEQ ID NO: 43934 - RNA, 22 nt, Shigella flexneri 2a str. 301
ccgaacggauaaagcgcuccgu

SEQ ID NO: 43935 - RNA, 22 nt, Shigella flexneri 2a str. 301
ccgaaggggcgaaaacuaaauc

SEQ ID NO: 43936 - RNA, 22 nt, Shigella flexneri 2a str. 301
ccgacgacgguuuacagcauua

SEQ ID NO: 43937 - RNA, 22 nt, Shigella flexneri 2a str. 301
ccgagaucuuucgcugcuuuua

SEQ ID NO: 43938 - RNA, 22 nt, Shigella flexneri 2a str. 301
ccgauaucacgcacuuuuccca

SEQ ID NO: 43939 - RNA, 22 nt, Shigella flexneri 2a str. 301
ccgcgucuuaucaggccuacag

SEQ ID NO: 43940 - RNA, 22 nt, Shigella flexneri 2a str. 301
ccgcugguuauuguuauugccg

SEQ ID NO: 43941 - RNA, 22 nt, Shigella flexneri 2a str. 301
ccgcuguaugccaucugcgcau

SEQ ID NO: 43942 - RNA, 22 nt, Shigella flexneri 2a str. 301
ccggaacaaucgugaauagcgc

SEQ ID NO: 43943 - RNA, 22 nt, Shigella flexneri 2a str. 301
ccggaagacgaacuugccagcg

SEQ ID NO: 43944 - RNA, 22 nt, Shigella flexneri 2a str. 301
ccgguuagaagaaugcuauucg

SEQ ID NO: 43945 - RNA, 22 nt, Shigella flexneri 2a str. 301
ccgucaccgaugcagaagggga

SEQ ID NO: 43946 - RNA, 22 nt, Shigella flexneri 2a str. 301
ccguugcugaugaagcuggugg

SEQ ID NO: 43947 - RNA, 22 nt, Shigella flexneri 2a str. 301
ccucgcugaucccaggacuucu

SEQ ID NO: 43948 - RNA, 22 nt, Shigella flexneri 2a str. 301
ccugaacaaagcgcucggagug

SEQ ID NO: 43949 - RNA, 22 nt, Shigella flexneri 2a str. 301
ccugaacgauuucuucuacaac

SEQ ID NO: 43950 - RNA, 22 nt, Shigella flexneri 2a str. 301
ccugccacuguuucaccauccc

SEQ ID NO: 43951 - RNA, 19 nt, Shigella flexneri 2a str. 301
ccugcucgaugaagccaga

SEQ ID NO: 43952 - RNA, 18 nt, Shigella flexneri 2a str. 301
ccugcugggguuacugcc

SEQ ID NO: 43953 - RNA, 22 nt, Shigella flexneri 2a str. 301
ccugggaagauguaagccgcca

SEQ ID NO: 43954 - RNA, 22 nt, Shigella flexneri 2a str. 301
ccugugggaaucucgcaucauu

SEQ ID NO: 43955 - RNA, 22 nt, Shigella flexneri 2a str. 301
cgaacuggagcgggcguugagu

SEQ ID NO: 43956 - RNA, 22 nt, Shigella flexneri 2a str. 301
cgaaggugauaaucugcgauac

SEQ ID NO: 43957 - RNA, 22 nt, Shigella flexneri 2a str. 301
cgaauggauuuugugaugucag

SEQ ID NO: 43958 - RNA, 22 nt, Shigella flexneri 2a str. 301
cgacgguggugucauuguccag

SEQ ID NO: 43959 - RNA, 22 nt, Shigella flexneri 2a str. 301
cgacuacguuaacacucgccga

SEQ ID NO: 43960 - RNA, 22 nt, Shigella flexneri 2a str. 301
cgacuggccgacaacgcuugcu

SEQ ID NO: 43961 - RNA, 23 nt, Shigella flexneri 2a str. 301
cgacuucggucagggugucguuc

SEQ ID NO: 43962 - RNA, 22 nt, Shigella flexneri 2a str. 301
cgagaucgguaccgucacgcca

SEQ ID NO: 43963 - RNA, 22 nt, Shigella flexneri 2a str. 301
cgagaucuggcugaggugaaac

SEQ ID NO: 43964 - RNA, 22 nt, Shigella flexneri 2a str. 301
cgaggccuguaugcucggcggg

SEQ ID NO: 43965 - RNA, 21 nt, Shigella flexneri 2a str. 301
cgaucgucgggaucaucgguc

SEQ ID NO: 43966 - RNA, 22 nt, Shigella flexneri 2a str. 301
cgauuguggcaauuucuuccau

SEQ ID NO: 43967 - RNA, 20 nt, Shigella flexneri 2a str. 301
cgccguucuggcggauguug

SEQ ID NO: 43968 - RNA, 22 nt, Shigella flexneri 2a str. 301
cgccguugaugauacauaucaa

SEQ ID NO: 43969 - RNA, 22 nt, Shigella flexneri 2a str. 301
cgccugauuaacguuuuuguac

SEQ ID NO: 43970 - RNA, 22 nt, Shigella flexneri 2a str. 301
cgcguuaacgucuggcugcaua

SEQ ID NO: 43971 - RNA, 22 nt, Shigella flexneri 2a str. 301
cgcguugaaaucugccgacgua

SEQ ID NO: 43972 - RNA, 22 nt, Shigella flexneri 2a str. 301
cgcugcuggcaacccacgcgga

SEQ ID NO: 43973 - RNA, 22 nt, Shigella flexneri 2a str. 301
cgcuuacgcuaucgaucugcug

SEQ ID NO: 43974 - RNA, 20 nt, Shigella flexneri 2a str. 301
cggaacugggaagagcaacg

SEQ ID NO: 43975 - RNA, 18 nt, Shigella flexneri 2a str. 301
cggcaacuaccagaccca

SEQ ID NO: 43976 - RNA, 22 nt, Shigella flexneri 2a str. 301
cggcgguugcgugguggaugag

SEQ ID NO: 43977 - RNA, 22 nt, Shigella flexneri 2a str. 301
cggcugauuguguaaugcacag

SEQ ID NO: 43978 - RNA, 22 nt, Shigella flexneri 2a str. 301
cggcugcuccugggcguugauc

SEQ ID NO: 43979 - RNA, 21 nt, Shigella flexneri 2a str. 301
cgggaacaucguuaccucuga

SEQ ID NO: 43980 - RNA, 22 nt, Shigella flexneri 2a str. 301
cgggcacacgaaaggagauauu

SEQ ID NO: 43981 - RNA, 22 nt, Shigella flexneri 2a str. 301
cgggcguucgagaguguucuua

SEQ ID NO: 43982 - RNA, 22 nt, Shigella flexneri 2a str. 301
cgggugcaguaauaucgcccug

SEQ ID NO: 43983 - RNA, 22 nt, Shigella flexneri 2a str. 301
cggucaccuggauccagccugc

SEQ ID NO: 43984 - RNA, 22 nt, Shigella flexneri 2a str. 301
cggucgugcaacaccggcuguc

SEQ ID NO: 43985 - RNA, 22 nt, Shigella flexneri 2a str. 301
cggucugggugucgaugccuau

SEQ ID NO: 43986 - RNA, 22 nt, Shigella flexneri 2a str. 301
cggugaucaacauccacuuauc

SEQ ID NO: 43987 - RNA, 22 nt, Shigella flexneri 2a str. 301
cgguuuauguuucgccugugcg

SEQ ID NO: 43988 - RNA, 22 nt, Shigella flexneri 2a str. 301
cguaauguuaacuggggcuuuu

SEQ ID NO: 43989 - RNA, 23 nt, Shigella flexneri 2a str. 301
cguaauguuaacuggggcuuuuc

SEQ ID NO: 43990 - RNA, 22 nt, Shigella flexneri 2a str. 301
cgucacgcugguggaucagggc

SEQ ID NO: 43991 - RNA, 22 nt, Shigella flexneri 2a str. 301
cgucacguuccucggcgcgccg

SEQ ID NO: 43992 - RNA, 22 nt, Shigella flexneri 2a str. 301
cgucgaguacuucguggaaggc

SEQ ID NO: 43993 - RNA, 20 nt, Shigella flexneri 2a str. 301
cgucgaucagcuccagcgcc

SEQ ID NO: 43994 - RNA, 22 nt, Shigella flexneri 2a str. 301
cgucggcuggccucaccgcaga

SEQ ID NO: 43995 - RNA, 22 nt, Shigella flexneri 2a str. 301
cgugcgucuucuauucagggga

SEQ ID NO: 43996 - RNA, 22 nt, Shigella flexneri 2a str. 301
cguggaugauacuccagcugca

SEQ ID NO: 43997 - RNA, 22 nt, Shigella flexneri 2a str. 301
cguucacgaugauuacaaccgu

SEQ ID NO: 43998 - RNA, 22 nt, Shigella flexneri 2a str. 301
cguuuaggaagauuugaaauug

SEQ ID NO: 43999 - RNA, 22 nt, Shigella flexneri 2a str. 301
cuacgcaucuuucauuuauaaa

SEQ ID NO: 44000 - RNA, 22 nt, Shigella flexneri 2a str. 301
cuacgcuuaucaggccuacgca

SEQ ID NO: 44001 - RNA, 22 nt, Shigella flexneri 2a str. 301
cuaucaauauuuugcguauuca

SEQ ID NO: 44002 - RNA, 22 nt, Shigella flexneri 2a str. 301
cuauggcgcgcuuuuuauacug

SEQ ID NO: 44003 - RNA, 22 nt, Shigella flexneri 2a str. 301
cucaaugcuuucgcgggugcgu

SEQ ID NO: 44004 - RNA, 22 nt, Shigella flexneri 2a str. 301
cucagaaaagaucgcuacgagu

SEQ ID NO: 44005 - RNA, 22 nt, Shigella flexneri 2a str. 301
cucaggcaagagugguuauaca

SEQ ID NO: 44006 - RNA, 22 nt, Shigella flexneri 2a str. 301
cuccagcuuacgguuaccagac

SEQ ID NO: 44007 - RNA, 22 nt, Shigella flexneri 2a str. 301
cucgacgcugcucggucaguug

SEQ ID NO: 44008 - RNA, 22 nt, Shigella flexneri 2a str. 301
cucgcguaauuuauccggcagg

SEQ ID NO: 44009 - RNA, 22 nt, Shigella flexneri 2a str. 301
cucguaggccugauaagcgcag

SEQ ID NO: 44010 - RNA, 22 nt, Shigella flexneri 2a str. 301
cucguucacguaucaccgcauc

SEQ ID NO: 44011 - RNA, 22 nt, Shigella flexneri 2a str. 301
cucugugauggcaguaauuuuu

SEQ ID NO: 44012 - RNA, 22 nt, Shigella flexneri 2a str. 301
cugaaccaauccagauccagau

SEQ ID NO: 44013 - RNA, 22 nt, Shigella flexneri 2a str. 301
cugaugcgucuuaucaggccua

SEQ ID NO: 44014 - RNA, 22 nt, Shigella flexneri 2a str. 301
gcgaagcggcguuuuacggccu

SEQ ID NO: 44015 - RNA, 22 nt, Shigella flexneri 2a str. 301
gcgacggaaagaaggcguuuuc

SEQ ID NO: 44016 - RNA, 22 nt, Shigella flexneri 2a str. 301
gcgaugugcaaauacuucugcg

SEQ ID NO: 44017 - RNA, 22 nt, Shigella flexneri 2a str. 301
gcgcacguaauugauccagaag

SEQ ID NO: 44018 - RNA, 22 nt, Shigella flexneri 2a str. 301
gcgcacugcucgaaggcuuucg

SEQ ID NO: 44019 - RNA, 22 nt, Shigella flexneri 2a str. 301
gcgcgaucacagugagcaagaa

SEQ ID NO: 44020 - RNA, 19 nt, Shigella flexneri 2a str. 301
gcgcggauugaugccgccc

SEQ ID NO: 44021 - RNA, 22 nt, Shigella flexneri 2a str. 301
gcgcuguucugcgcuuuuucug

SEQ ID NO: 44022 - RNA, 22 nt, Shigella flexneri 2a str. 301
gcggaaauacucgccacggaac

SEQ ID NO: 44023 - RNA, 22 nt, Shigella flexneri 2a str. 301
gcggaucugcggaggcgcgguu

SEQ ID NO: 44024 - RNA, 22 nt, Shigella flexneri 2a str. 301
gcggugaccaguuaaacucucg

SEQ ID NO: 44025 - RNA, 22 nt, Shigella flexneri 2a str. 301
gcgucggaguuuguugauguaa

SEQ ID NO: 44026 - RNA, 22 nt, Shigella flexneri 2a str. 301
gcgucuggcauuaggaacgcug

SEQ ID NO: 44027 - RNA, 22 nt, Shigella flexneri 2a str. 301
gcgucuuaucuggccuacgaag

SEQ ID NO: 44028 - RNA, 22 nt, Shigella flexneri 2a str. 301
gcguuaccggcuucgagaggca

SEQ ID NO: 44029 - RNA, 23 nt, Shigella flexneri 2a str. 301
gcguuauagccgccaaauucugc

SEQ ID NO: 44030 - RNA, 22 nt, Shigella flexneri 2a str. 301
gcguuucuucgaaaaagaacug

SEQ ID NO: 44031 - RNA, 22 nt, Shigella flexneri 2a str. 301
gcuaccaccuuucgccaagauc

SEQ ID NO: 44032 - RNA, 22 nt, Shigella flexneri 2a str. 301
gcugacgcaaauugguuauguu

SEQ ID NO: 44033 - RNA, 22 nt, Shigella flexneri 2a str. 301
gcugauggccggucuugauggu

SEQ ID NO: 44034 - RNA, 22 nt, Shigella flexneri 2a str. 301
gcugaugggcgugcugccagug

SEQ ID NO: 44035 - RNA, 22 nt, Shigella flexneri 2a str. 301
gcuggaaagcaccugcgcggcg

SEQ ID NO: 44036 - RNA, 22 nt, Shigella flexneri 2a str. 301
gcuggcagguccagucguugac

SEQ ID NO: 44037 - RNA, 22 nt, Shigella flexneri 2a str. 301
gcuguucaacuccaaacucucu

SEQ ID NO: 44038 - RNA, 22 nt, Shigella flexneri 2a str. 301
gcuucugcacugugguuuuucu

SEQ ID NO: 44039 - RNA, 22 nt, Shigella flexneri 2a str. 301
gcuuugcggccuucaggcagaa

SEQ ID NO: 44040 - RNA, 22 nt, Shigella flexneri 2a str. 301
gcuuugcugaaaucgauacgga

SEQ ID NO: 44041 - RNA, 22 nt, Shigella flexneri 2a str. 301
ggaaaucacggaagaaugcgca

SEQ ID NO: 44042 - RNA, 22 nt, Shigella flexneri 2a str. 301
ggaaguguuacagcgauugcga

SEQ ID NO: 44043 - RNA, 22 nt, Shigella flexneri 2a str. 301
ggaauaccaucaauaucgugag

SEQ ID NO: 44044 - RNA, 22 nt, Shigella flexneri 2a str. 301
ggaaugaugugauacgccccgg

SEQ ID NO: 44045 - RNA, 22 nt, Shigella flexneri 2a str. 301
ggaguugaucuuucgcgcguca

SEQ ID NO: 44046 - RNA, 22 nt, Shigella flexneri 2a str. 301
ggauuaacgucugggaacugau

SEQ ID NO: 44047 - RNA, 22 nt, Shigella flexneri 2a str. 301
ggauugacuggcauugcguagc

SEQ ID NO: 44048 - RNA, 22 nt, Shigella flexneri 2a str. 301
ggcacugaaaccguggguguua

SEQ ID NO: 44049 - RNA, 22 nt, Shigella flexneri 2a str. 301
ggcagcaagugcagcucgcugg

SEQ ID NO: 44050 - RNA, 22 nt, Shigella flexneri 2a str. 301
ggcagugccuucagcauggaag

SEQ ID NO: 44051 - RNA, 22 nt, Shigella flexneri 2a str. 301
ggcagugcguagaauuuaccuu

SEQ ID NO: 44052 - RNA, 22 nt, Shigella flexneri 2a str. 301
ggccgguaaaucuucacucugu

SEQ ID NO: 44053 - RNA, 22 nt, Shigella flexneri 2a str. 301
ggccuggacguugcagggcagc

SEQ ID NO: 44054 - RNA, 22 nt, Shigella flexneri 2a str. 301
ggcgacagugcgcagcggucag

SEQ ID NO: 44055 - RNA, 22 nt, Shigella flexneri 2a str. 301
ggcgauggaggauggauaauga

SEQ ID NO: 44056 - RNA, 22 nt, Shigella flexneri 2a str. 301
ggcgcuugccugcuccccucac

SEQ ID NO: 44057 - RNA, 22 nt, Shigella flexneri 2a str. 301
ggcggcuuucaacgagaauagg

SEQ ID NO: 44058 - RNA, 22 nt, Shigella flexneri 2a str. 301
ggcguucuuuaucgccaagcgu

SEQ ID NO: 44059 - RNA, 22 nt, Shigella flexneri 2a str. 301
ggcuauuacggcgguaaagucg

SEQ ID NO: 44060 - RNA, 23 nt, Shigella flexneri 2a str. 301
ggcuggagagcggguagucguau

SEQ ID NO: 44061 - RNA, 23 nt, Shigella flexneri 2a str. 301
ggcuuccgucagggguggauggu

SEQ ID NO: 44062 - RNA, 22 nt, Shigella flexneri 2a str. 301
gggaauugugguucugggcacg

SEQ ID NO: 44063 - RNA, 22 nt, Shigella flexneri 2a str. 301
gggaucgucuuaccgcguucga

SEQ ID NO: 44064 - RNA, 22 nt, Shigella flexneri 2a str. 301
gggucgcuacaaccugcaucuu

SEQ ID NO: 44065 - RNA, 20 nt, Shigella flexneri 2a str. 301
gguaagugaagggaguguga

SEQ ID NO: 44066 - RNA, 22 nt, Shigella flexneri 2a str. 301
gguauucgcuuugccuuuacga

SEQ ID NO: 44067 - RNA, 22 nt, Shigella flexneri 2a str. 301
ggugauagcguuccugcaauuc

SEQ ID NO: 44068 - RNA, 22 nt, Shigella flexneri 2a str. 301
gguucgaggccgagcauuuuca

SEQ ID NO: 44069 - RNA, 22 nt, Shigella flexneri 2a str. 301
gguucguaguugcucugaacuu

SEQ ID NO: 44070 - RNA, 22 nt, Shigella flexneri 2a str. 301
gguuucucggugaugaucgagg

SEQ ID NO: 44071 - RNA, 22 nt, Shigella flexneri 2a str. 301
guaauagcacaugacaaaaaug

SEQ ID NO: 44072 - RNA, 22 nt, Shigella flexneri 2a str. 301
guaccaaauuccagaaaagaga

SEQ ID NO: 44073 - RNA, 22 nt, Shigella flexneri 2a str. 301
guagcgucugauuagcggaaag

SEQ ID NO: 44074 - RNA, 22 nt, Shigella flexneri 2a str. 301
gucaauuuuuaauugaggugga

SEQ ID NO: 44075 - RNA, 22 nt, Shigella flexneri 2a str. 301
guccggaagagaucaccgcuga

SEQ ID NO: 44076 - RNA, 22 nt, Shigella flexneri 2a str. 301
guccgguucuggaacgcgacgg

SEQ ID NO: 44077 - RNA, 22 nt, Shigella flexneri 2a str. 301
guccugcuugccagauacgaug

SEQ ID NO: 44078 - RNA, 22 nt, Shigella flexneri 2a str. 301
gucgagaaaacgggauagcacc

SEQ ID NO: 44079 - RNA, 22 nt, Shigella flexneri 2a str. 301
gucgagaaagaagagaauggcg

SEQ ID NO: 44080 - RNA, 22 nt, Shigella flexneri 2a str. 301
gucgccgauaccgagguagcgg

SEQ ID NO: 44081 - RNA, 22 nt, Shigella flexneri 2a str. 301
gucugcaucccuacucgggcaa

SEQ ID NO: 44082 - RNA, 22 nt, Shigella flexneri 2a str. 301
gucuggauuuaguacgucgcug

SEQ ID NO: 44083 - RNA, 18 nt, Shigella flexneri 2a str. 301
gucuugccauugaccugg

SEQ ID NO: 44084 - RNA, 22 nt, Shigella flexneri 2a str. 301
gugaagguuaaggcugauuuaa

SEQ ID NO: 44085 - RNA, 22 nt, Shigella flexneri 2a str. 301
gugaauaaucagcuccgaaccu

SEQ ID NO: 44086 - RNA, 18 nt, Shigella flexneri 2a str. 301
gugaauggaaaaugcugg

SEQ ID NO: 44087 - RNA, 22 nt, Shigella flexneri 2a str. 301
gugacagugauugaacuggcgg

SEQ ID NO: 44088 - RNA, 22 nt, Shigella flexneri 2a str. 301
gugauagcggguuuacucauua

SEQ ID NO: 44089 - RNA, 22 nt, Shigella flexneri 2a str. 301
gugcaggcggucguuaugacgg

SEQ ID NO: 44090 - RNA, 22 nt, Shigella flexneri 2a str. 301
gugccaguaacuguaaaauguu

SEQ ID NO: 44091 - RNA, 22 nt, Shigella flexneri 2a str. 301
gugccguuguucuacgccgaga

SEQ ID NO: 44092 - RNA, 20 nt, Shigella flexneri 2a str. 301
gugcgagucgccugaacagu

SEQ ID NO: 44093 - RNA, 22 nt, Shigella flexneri 2a str. 301
gugcggaugagaucgugaaacu

SEQ ID NO: 44094 - RNA, 22 nt, Shigella flexneri 2a str. 301
gugcugccgaauccguuuuauc

SEQ ID NO: 44095 - RNA, 22 nt, Shigella flexneri 2a str. 301
guggcugaugccauguagcuca

SEQ ID NO: 44096 - RNA, 22 nt, Shigella flexneri 2a str. 301
uccggcauggcauuuuuauuug

SEQ ID NO: 44097 - RNA, 22 nt, Shigella flexneri 2a str. 301
uccggccuacaaaaucgugcua

SEQ ID NO: 44098 - RNA, 16 nt, Shigella flexneri 2a str. 301
uccggccuggcaccgu

SEQ ID NO: 44099 - RNA, 22 nt, Shigella flexneri 2a str. 301
uccgguuuugggaucaccugau

SEQ ID NO: 44100 - RNA, 22 nt, Shigella flexneri 2a str. 301
uccguggaugaucucguuggcg

SEQ ID NO: 44101 - RNA, 22 nt, Shigella flexneri 2a str. 301
ucgaacagccgagcgacuucug

SEQ ID NO: 44102 - RNA, 17 nt, Shigella flexneri 2a str. 301
ucgacgaucggguugaa

SEQ ID NO: 44103 - RNA, 22 nt, Shigella flexneri 2a str. 301
ucgauauggugcagucgcugac

SEQ ID NO: 44104 - RNA, 22 nt, Shigella flexneri 2a str. 301
ucgaucagcgauuuuauuaagu

SEQ ID NO: 44105 - RNA, 22 nt, Shigella flexneri 2a str. 301
ucgcagacgcugaaugaucugu

SEQ ID NO: 44106 - RNA, 22 nt, Shigella flexneri 2a str. 301
ucgccgaugucagauaaaaccu

SEQ ID NO: 44107 - RNA, 22 nt, Shigella flexneri 2a str. 301
ucgccgcaccacaacugucagc

SEQ ID NO: 44108 - RNA, 20 nt, Shigella flexneri 2a str. 301
ucgcgaccuucauugcgguc

SEQ ID NO: 44109 - RNA, 22 nt, Shigella flexneri 2a str. 301
ucgcguguuccaaaggucgcau

SEQ ID NO: 44110 - RNA, 22 nt, Shigella flexneri 2a str. 301
ucgcuucgguuaaaaaaaggca

SEQ ID NO: 44111 - RNA, 22 nt, Shigella flexneri 2a str. 301
ucgcuuugauggcugcggcauu

SEQ ID NO: 44112 - RNA, 22 nt, Shigella flexneri 2a str. 301
ucggauacgcaacucagcugcg

SEQ ID NO: 44113 - RNA, 23 nt, Shigella flexneri 2a str. 301
ucggcggugcgacggucgaauuu

SEQ ID NO: 44114 - RNA, 22 nt, Shigella flexneri 2a str. 301
ucggucacccggaucuggugau

SEQ ID NO: 44115 - RNA, 18 nt, Shigella flexneri 2a str. 301
ucggugcuaaaucacguc

SEQ ID NO: 44116 - RNA, 23 nt, Shigella flexneri 2a str. 301
ucggugcuaaaucacgucagcgc

SEQ ID NO: 44117 - RNA, 22 nt, Shigella flexneri 2a str. 301
ucgguugauaccaggccgcaag

SEQ ID NO: 44118 - RNA, 22 nt, Shigella flexneri 2a str. 301
ucgugauguucgcacuggaccc

SEQ ID NO: 44119 - RNA, 22 nt, Shigella flexneri 2a str. 301
ucguuaaucgccaguuucugcc

SEQ ID NO: 44120 - RNA, 22 nt, Shigella flexneri 2a str. 301
ucugaagaguuauaagcaguug

SEQ ID NO: 44121 - RNA, 22 nt, Shigella flexneri 2a str. 301
ucugaaugaagccaguaauguu

SEQ ID NO: 44122 - RNA, 22 nt, Shigella flexneri 2a str. 301
ucugcagaaaagaauauggcuu

SEQ ID NO: 44123 - RNA, 22 nt, Shigella flexneri 2a str. 301
ucugccagagcuucaaugcguu

SEQ ID NO: 44124 - RNA, 22 nt, Shigella flexneri 2a str. 301
ucugccaucaaauaugcccgcg

SEQ ID NO: 44125 - RNA, 22 nt, Shigella flexneri 2a str. 301
ucugcccgaagaggugauuccu

SEQ ID NO: 44126 - RNA, 22 nt, Shigella flexneri 2a str. 301
ucugcguauuuaucuuuugcaa

SEQ ID NO: 44127 - RNA, 22 nt, Shigella flexneri 2a str. 301
ucuggcgguagugacgaucaaa

SEQ ID NO: 44128 - RNA, 22 nt, Shigella flexneri 2a str. 301
ucugguuaaccgcgagcaggau

SEQ ID NO: 44129 - RNA, 17 nt, Shigella flexneri 2a str. 301
ugaagcggagcuauuac

SEQ ID NO: 44130 - RNA, 22 nt, Shigella flexneri 2a str. 301
ugaagcggcgagcauuguugau

SEQ ID NO: 44131 - RNA, 22 nt, Shigella flexneri 2a str. 301
ugaccauuggugcaauauaccu

SEQ ID NO: 44132 - RNA, 22 nt, Shigella flexneri 2a str. 301
ugacgcugaccggcgacgucca

SEQ ID NO: 44133 - RNA, 22 nt, Shigella flexneri 2a str. 301
ugacggcguucuggacgcucuc

SEQ ID NO: 44134 - RNA, 21 nt, Shigella flexneri 2a str. 301
ugacgguacgcugaaagguuc

SEQ ID NO: 44135 - RNA, 22 nt, Shigella flexneri 2a str. 301
ugagaucauguuguagcgcccg

SEQ ID NO: 44136 - RNA, 22 nt, Shigella flexneri 2a str. 301
ugagccucagauuaauguuaag

SEQ ID NO: 44137 - RNA, 22 nt, Shigella flexneri 2a str. 301
ugagcuuuguucaugccggaug

SEQ ID NO: 44138 - RNA, 22 nt, Shigella flexneri 2a str. 301
ugauaguguuuuauguucagau

SEQ ID NO: 44139 - RNA, 22 nt, Shigella flexneri 2a str. 301
ugaugacgcugcggcaguucgc

SEQ ID NO: 44140 - RNA, 22 nt, Shigella flexneri 2a str. 301
ugauggauauucuggccacacu

SEQ ID NO: 44141 - RNA, 22 nt, Shigella flexneri 2a str. 301
ugauuaugucuggaacacggug

SEQ ID NO: 44142 - RNA, 22 nt, Shigella flexneri 2a str. 301
ugcaaaugcugaucuuuaccgu

SEQ ID NO: 44143 - RNA, 22 nt, Shigella flexneri 2a str. 301
ugcaagauuuuguaggccugag

SEQ ID NO: 44144 - RNA, 22 nt, Shigella flexneri 2a str. 301
ugcaaucaucuuguaggccuga

SEQ ID NO: 44145 - RNA, 22 nt, Shigella flexneri 2a str. 301
ugcaccaggaacgauccuugaa

SEQ ID NO: 44146 - RNA, 22 nt, Shigella flexneri 2a str. 301
ugcacgguaaauucgccaggac

SEQ ID NO: 44147 - RNA, 22 nt, Shigella flexneri 2a str. 301
ugcagagaucauguaggccgga

SEQ ID NO: 44148 - RNA, 22 nt, Shigella flexneri 2a str. 301
ugcagcagcugcuggagaucau

SEQ ID NO: 44149 - RNA, 22 nt, Shigella flexneri 2a str. 301
ugcaggaagggcaacagccguc

SEQ ID NO: 44150 - RNA, 22 nt, Shigella flexneri 2a str. 301
ugcaggacgcacagauucugca

SEQ ID NO: 44151 - RNA, 19 nt, Shigella flexneri 2a str. 301
ugcaggguuuuuaaucgga

SEQ ID NO: 44152 - RNA, 18 nt, Shigella flexneri 2a str. 301
ugcaggucagccaucggg

SEQ ID NO: 44153 - RNA, 21 nt, Shigella flexneri 2a str. 301
ugcaggugcgguuguuuuccc

SEQ ID NO: 44154 - RNA, 22 nt, Shigella flexneri 2a str. 301
ugcaugugggugaagcgccaaa

SEQ ID NO: 44155 - RNA, 22 nt, Shigella flexneri 2a str. 301
ugcauugcugguacuuucacag

SEQ ID NO: 44156 - RNA, 22 nt, Shigella flexneri 2a str. 301
ugccgacaggguggcugugcga

SEQ ID NO: 44157 - RNA, 22 nt, Shigella flexneri 2a str. 301
ugccgcaggaaagcacuuugcc

SEQ ID NO: 44158 - RNA, 22 nt, Shigella flexneri 2a str. 301
ugccgcucuucuuuaccgguug

SEQ ID NO: 44159 - RNA, 22 nt, Shigella flexneri 2a str. 301
ugccggaugucuggagcuggcu

SEQ ID NO: 44160 - RNA, 22 nt, Shigella flexneri 2a str. 301
ugccggucuggucaucggcagu

SEQ ID NO: 44161 - RNA, 22 nt, Shigella flexneri 2a str. 301
ugccggucuuccuguugggcga

SEQ ID NO: 44162 - RNA, 20 nt, Shigella flexneri 2a str. 301
ugccgugggacaguuugcug

SEQ ID NO: 44163 - RNA, 22 nt, Shigella flexneri 2a str. 301
ugcgccaagagccagcgugucg

SEQ ID NO: 44164 - RNA, 22 nt, Shigella flexneri 2a str. 301
ugcggugauugaacguaguauc

SEQ ID NO: 44165 - RNA, 22 nt, Shigella flexneri 2a str. 301
ugcgugauuauguaggccggau

SEQ ID NO: 44166 - RNA, 22 nt, Shigella flexneri 2a str. 301
ugcguuauucuuucauguuucc

SEQ ID NO: 44167 - RNA, 22 nt, Shigella flexneri 2a str. 301
ugcucaaauccgcguucaagga

SEQ ID NO: 44168 - RNA, 22 nt, Shigella flexneri 2a str. 301
ugcugacuuuaaggcaguaugu

SEQ ID NO: 44169 - RNA, 22 nt, Shigella flexneri 2a str. 301
uggaaagucacagcccgcgccg

SEQ ID NO: 44170 - RNA, 22 nt, Shigella flexneri 2a str. 301
uggaagcgaucaaacugcuggc

SEQ ID NO: 44171 - RNA, 23 nt, Shigella flexneri 2a str. 301
uggaugccacuaauacugcugug

SEQ ID NO: 44172 - RNA, 22 nt, Shigella flexneri 2a str. 301
uggcaauauuccagucgaucgg

SEQ ID NO: 44173 - RNA, 22 nt, Shigella flexneri 2a str. 301
uggcacaaugguuaacguguca

SEQ ID NO: 44174 - RNA, 22 nt, Shigella flexneri 2a str. 301
uggcagcgaaucggcguuggcg

SEQ ID NO: 44175 - RNA, 22 nt, Shigella flexneri 2a str. 301
uggcagcgauguuccauaauca

SEQ ID NO: 44176 - RNA, 22 nt, Shigella flexneri 2a str. 301
uggcauaagagauaucuuuauu

SEQ ID NO: 44177 - RNA, 22 nt, Shigella flexneri 2a str. 301
uggcauucgcgugauccagcug

SEQ ID NO: 44178 - RNA, 22 nt, Shigella flexneri 2a str. 301
uuucgguauuaccuguucgacg

SEQ ID NO: 44179 - RNA, 22 nt, Shigella flexneri 2a str. 301
uuugcacaaccaacuggcgcgu

SEQ ID NO: 44180 - RNA, 22 nt, Shigella flexneri 2a str. 301
uuugccagccgguuuucaccca

SEQ ID NO: 44181 - RNA, 22 nt, Shigella flexneri 2a str. 301
uuugccgaaaguggacgguaaa

SEQ ID NO: 44182 - RNA, 22 nt, Shigella flexneri 2a str. 301
cagguuguuucaucccacagcu

SEQ ID NO: 44183 - RNA, 22 nt, Shigella flexneri 2a str. 301
caguacguuucuauuccgguug

SEQ ID NO: 44184 - RNA, 22 nt, Shigella flexneri 2a str. 301
cagugcaauauaaugagccgcu

SEQ ID NO: 44185 - RNA, 22 nt, Shigella flexneri 2a str. 301
cagugccaguucguuuaucggc

SEQ ID NO: 44186 - RNA, 22 nt, Shigella flexneri 2a str. 301
caguuucgaggcgaugggcguu

SEQ ID NO: 44187 - RNA, 22 nt, Shigella flexneri 2a str. 301
cauaagagauggaaugagcauc

SEQ ID NO: 44188 - RNA, 22 nt, Shigella flexneri 2a str. 301
caucacgcggucuacguaguca

SEQ ID NO: 44189 - RNA, 22 nt, Shigella flexneri 2a str. 301
gcauucaucaugguucucgguu

SEQ ID NO: 44190 - RNA, 22 nt, Shigella flexneri 2a str. 301
gccaccuuccaugccaacgccu

SEQ ID NO: 44191 - RNA, 22 nt, Shigella flexneri 2a str. 301
gccacucaaacucaaccauacg

SEQ ID NO: 44192 - RNA, 22 nt, Shigella flexneri 2a str. 301
gccauugugucucugucuccaa

SEQ ID NO: 44193 - RNA, 22 nt, Shigella flexneri 2a str. 301
gcccgguagguggaugcugagu

SEQ ID NO: 44194 - RNA, 22 nt, Shigella flexneri 2a str. 301
gcccuuuguaggccagauaaga

SEQ ID NO: 44195 - RNA, 22 nt, Shigella flexneri 2a str. 301
gccgacagaucguuaaccugca

SEQ ID NO: 44196 - RNA, 22 nt, Shigella flexneri 2a str. 301
gccgaucgacaguggcguuauu

SEQ ID NO: 44197 - RNA, 22 nt, Shigella flexneri 2a str. 301
gccgcgauguacuuccgccagu

SEQ ID NO: 44198 - RNA, 22 nt, Shigella flexneri 2a str. 301
gccggguaauccggucaucugg

SEQ ID NO: 44199 - RNA, 22 nt, Shigella flexneri 2a str. 301
gccguggugggaucgccaguug

SEQ ID NO: 44200 - RNA, 22 nt, Shigella flexneri 2a str. 301
gccugauguacaugucuucaac

SEQ ID NO: 44201 - RNA, 22 nt, Shigella flexneri 2a str. 301
gccugcucaaaacucaaaccag

SEQ ID NO: 44202 - RNA, 22 nt, Shigella flexneri 2a str. 301
gccugcuugcgacucucgaacc

SEQ ID NO: 44203 - RNA, 22 nt, Shigella flexneri 2a str. 301
gcgaguauccagauuagugacc

SEQ ID NO: 44204 - RNA, 22 nt, Shigella flexneri 2a str. 301
gcgcaaugucgacacuuuuugc

SEQ ID NO: 44205 - RNA, 22 nt, Shigella flexneri 2a str. 301
gcgcugguggcgauggucgggg

SEQ ID NO: 44206 - RNA, 22 nt, Shigella flexneri 2a str. 301
gcguaucaucaacccgaugcgc

SEQ ID NO: 44207 - RNA, 20 nt, Shigella flexneri 2a str. 301
gcgucuggaagaagaacgcc

SEQ ID NO: 44208 - RNA, 22 nt, Shigella flexneri 2a str. 301
gcgucuuaucaggccuacgaag

SEQ ID NO: 44209 - RNA, 22 nt, Shigella flexneri 2a str. 301
gcgugcugggcgacuggucgca

SEQ ID NO: 44210 - RNA, 21 nt, Shigella flexneri 2a str. 301
gcguuugaacgugguucgcug

SEQ ID NO: 44211 - RNA, 22 nt, Shigella flexneri 2a str. 301
gcucaggucguuagucacaucg

SEQ ID NO: 44212 - RNA, 22 nt, Shigella flexneri 2a str. 301
gcucgauaaacccuuuuucauc

SEQ ID NO: 44213 - RNA, 22 nt, Shigella flexneri 2a str. 301
gcucugccuauuuugaaaacgc

SEQ ID NO: 44214 - RNA, 22 nt, Shigella flexneri 2a str. 301
gcucuucgacaucuuugucugc

SEQ ID NO: 44215 - RNA, 22 nt, Shigella flexneri 2a str. 301
gcugauauggcugcugcagagc

SEQ ID NO: 44216 - RNA, 22 nt, Shigella flexneri 2a str. 301
gcugccguaugccguggcuccc

SEQ ID NO: 44217 - RNA, 22 nt, Shigella flexneri 2a str. 301
gcugcgcuuaucaggccuacag

SEQ ID NO: 44218 - RNA, 22 nt, Shigella flexneri 2a str. 301
gcuggcguugcgcggaguacgu

SEQ ID NO: 44219 - RNA, 22 nt, Shigella flexneri 2a str. 301
gcugggucugguaguugccgcc

SEQ ID NO: 44220 - RNA, 22 nt, Shigella flexneri 2a str. 301
gcuucgcggagguaucggagau

SEQ ID NO: 44221 - RNA, 22 nt, Shigella flexneri 2a str. 301
ggaacuguucgccgugcaaauc

SEQ ID NO: 44222 - RNA, 22 nt, Shigella flexneri 2a str. 301
ggaaguccccgucaccaucgca

SEQ ID NO: 44223 - RNA, 22 nt, Shigella flexneri 2a str. 301
ggagacauucucgccaccgcgu

SEQ ID NO: 44224 - RNA, 22 nt, Shigella flexneri 2a str. 301
ggaguacaucgugcgcggcagu

SEQ ID NO: 44225 - RNA, 22 nt, Shigella flexneri 2a str. 301
ggcaaagugcauagcgucgcaa

SEQ ID NO: 44226 - RNA, 22 nt, Shigella flexneri 2a str. 301
ggcagugaauuucuacguuauu

SEQ ID NO: 44227 - RNA, 22 nt, Shigella flexneri 2a str. 301
ggcaguggguacgcagcgccag

SEQ ID NO: 44228 - RNA, 22 nt, Shigella flexneri 2a str. 301
ggcaucguuacgcgugucagca

SEQ ID NO: 44229 - RNA, 22 nt, Shigella flexneri 2a str. 301
ggcauguucccaagccagaugu

SEQ ID NO: 44230 - RNA, 23 nt, Shigella flexneri 2a str. 301
ggccauugacgcaucgcccgguu

SEQ ID NO: 44231 - RNA, 22 nt, Shigella flexneri 2a str. 301
ggccguugagauccuuuacaac

SEQ ID NO: 44232 - RNA, 22 nt, Shigella flexneri 2a str. 301
ggcgacaucguuauuuucaacg

SEQ ID NO: 44233 - RNA, 22 nt, Shigella flexneri 2a str. 301
ggcgauuauagccauauguugg

SEQ ID NO: 44234 - RNA, 22 nt, Shigella flexneri 2a str. 301
ggcgcagugccaggguuuugau

SEQ ID NO: 44235 - RNA, 22 nt, Shigella flexneri 2a str. 301
ggcguaggccgaaagcuggcaa

SEQ ID NO: 44236 - RNA, 22 nt, Shigella flexneri 2a str. 301
ggcguggauguucgucaguuaa

SEQ ID NO: 44237 - RNA, 22 nt, Shigella flexneri 2a str. 301
ggcugguagaacgcgccaauca

SEQ ID NO: 44238 - RNA, 22 nt, Shigella flexneri 2a str. 301
ggcuucgucauuccgaaaggcu

SEQ ID NO: 44239 - RNA, 22 nt, Shigella flexneri 2a str. 301
ggcuuuccaguucaccagauug

SEQ ID NO: 44240 - RNA, 22 nt, Shigella flexneri 2a str. 301
gggacauaaccacgggcauuac

SEQ ID NO: 44241 - RNA, 22 nt, Shigella flexneri 2a str. 301
gggagucauugcaucgucaacu

SEQ ID NO: 44242 - RNA, 22 nt, Shigella flexneri 2a str. 301
gggccagaaaaucugugucuug

SEQ ID NO: 44243 - RNA, 22 nt, Shigella flexneri 2a str. 301
gguagcuuaugcccuugcacca

SEQ ID NO: 44244 - RNA, 22 nt, Shigella flexneri 2a str. 301
gguaucggaaugauucguguau

SEQ ID NO: 44245 - RNA, 22 nt, Shigella flexneri 2a str. 301
gguaugcguggcgcgcguguuc

SEQ ID NO: 44246 - RNA, 22 nt, Shigella flexneri 2a str. 301
ggucauugacaaugcugccgcu

SEQ ID NO: 44247 - RNA, 22 nt, Shigella flexneri 2a str. 301
ggugaagucguagcgaggccag

SEQ ID NO: 44248 - RNA, 22 nt, Shigella flexneri 2a str. 301
ggugacuguacuggaaggucug

SEQ ID NO: 44249 - RNA, 22 nt, Shigella flexneri 2a str. 301
gguuaucggcaugcgaggggcu

SEQ ID NO: 44250 - RNA, 22 nt, Shigella flexneri 2a str. 301
gguucguagucgcucugaacuu

SEQ ID NO: 44251 - RNA, 22 nt, Shigella flexneri 2a str. 301
gguucugcgggaauacgguuuu

SEQ ID NO: 44252 - RNA, 20 nt, Shigella flexneri 2a str. 301
guagcggguacggugcugug

SEQ ID NO: 44253 - RNA, 22 nt, Shigella flexneri 2a str. 301
guauaucaauaaaguccggcuc

SEQ ID NO: 44254 - RNA, 22 nt, Shigella flexneri 2a str. 301
gucagcaccagggugaucgcuu

SEQ ID NO: 44255 - RNA, 22 nt, Shigella flexneri 2a str. 301
gucagcauaauggcaaagaucg

SEQ ID NO: 44256 - RNA, 19 nt, Shigella flexneri 2a str. 301
gucaggcuuccuugcgguc

SEQ ID NO: 44257 - RNA, 22 nt, Shigella flexneri 2a str. 301
gucaugaugucuucagauuguu

SEQ ID NO: 44258 - RNA, 22 nt, Shigella flexneri 2a str. 301
gucgaaauguguuuauaaagua

SEQ ID NO: 44259 - RNA, 20 nt, Shigella flexneri 2a str. 301
gucgccugaaguugaggagg

SEQ ID NO: 44260 - RNA, 21 nt, Shigella flexneri 2a str. 301
gucgcgucuucucgcggauga

SEQ ID NO: 44261 - RNA, 22 nt, Shigella flexneri 2a str. 301
gucugcugauuuugcuguuuac

SEQ ID NO: 44262 - RNA, 22 nt, Shigella flexneri 2a str. 301
gugaacguguaggccugauaag

SEQ ID NO: 44263 - RNA, 23 nt, Shigella flexneri 2a str. 301
gugaagccauccaguucguuuuc

SEQ ID NO: 44264 - RNA, 22 nt, Staphylococcus aureus subsp. aureus Mu50
aaucaaauuauauugagccguu

SEQ ID NO: 44265 - RNA, 20 nt, Staphylococcus aureus subsp. aureus Mu50
aaucacuuggacaauaauga

SEQ ID NO: 44266 - RNA, 22 nt, Staphylococcus aureus subsp. aureus Mu50
aaucaucagcgauuuaauauuu

SEQ ID NO: 44267 - RNA, 22 nt, Staphylococcus aureus subsp. aureus Mu50
aaucaucuuacugcuguuuguu

SEQ ID NO: 44268 - RNA, 22 nt, Staphylococcus aureus subsp. aureus Mu50
aaugaaaugcucccuucaaagu

SEQ ID NO: 44269 - RNA, 22 nt, Staphylococcus aureus subsp. aureus Mu50
aaugaauaugcuggucaagucg

SEQ ID NO: 44270 - RNA, 22 nt, Staphylococcus aureus subsp. aureus Mu50
aaaaaugccaagaagcaaugga

SEQ ID NO: 44271 - RNA, 21 nt, Staphylococcus aureus subsp. aureus Mu50
aaaagagcugcuugauaauuu

SEQ ID NO: 44272 - RNA, 22 nt, Staphylococcus aureus subsp. aureus Mu50
aaaagcuucuaaugugauacag

SEQ ID NO: 44273 - RNA, 22 nt, Staphylococcus aureus subsp. aureus Mu50
aaaaugaugauaaacuaguaua

SEQ ID NO: 44274 - RNA, 22 nt, Staphylococcus aureus subsp. aureus Mu50
aaacacgcggugggcgaaauca

SEQ ID NO: 44275 - RNA, 22 nt, Staphylococcus aureus subsp. aureus Mu50
aaacauguauguaugaguauau

SEQ ID NO: 44276 - RNA, 22 nt, Staphylococcus aureus subsp. aureus Mu50
aaaccccaucuguuaaaguuau

SEQ ID NO: 44277 - RNA, 22 nt, Staphylococcus aureus subsp. aureus Mu50
aaacgcauguauuaauaaguua

SEQ ID NO: 44278 - RNA, 22 nt, Staphylococcus aureus subsp. aureus Mu50
aaacuuuuuauacuggccucuu

SEQ ID NO: 44279 - RNA, 22 nt, Staphylococcus aureus subsp. aureus Mu50
aaagacacaucuauacgaugau

SEQ ID NO: 44280 - RNA, 22 nt, Staphylococcus aureus subsp. aureus Mu50
aaagaugguaacuauuauaugg

SEQ ID NO: 44281 - RNA, 22 nt, Staphylococcus aureus subsp. aureus Mu50
aaagccaaucaaugggaaaugu

SEQ ID NO: 44282 - RNA, 22 nt, Staphylococcus aureus subsp. aureus Mu50
aaagcgaccaauuuugcagugu

SEQ ID NO: 44283 - RNA, 22 nt, Staphylococcus aureus subsp. aureus Mu50
aaagcgccccaucaaauaaaca

SEQ ID NO: 44284 - RNA, 22 nt, Staphylococcus aureus subsp. aureus Mu50
aaagcgccccuucaacuuuaca

SEQ ID NO: 44285 - RNA, 22 nt, Staphylococcus aureus subsp. aureus Mu50
aaagcucucuucauaaucaugu

SEQ ID NO: 44286 - RNA, 22 nt, Staphylococcus aureus subsp. aureus Mu50
aaaggugcauguaauguugaac

SEQ ID NO: 44287 - RNA, 22 nt, Staphylococcus aureus subsp. aureus Mu50
aaaguauuuuaacauuuguauu

SEQ ID NO: 44288 - RNA, 22 nt, Staphylococcus aureus subsp. aureus Mu50
aaauaacccguccaacuaugua

SEQ ID NO: 44289 - RNA, 22 nt, Staphylococcus aureus subsp. aureus Mu50
aaauaucauuucugucccacuc

SEQ ID NO: 44290 - RNA, 22 nt, Staphylococcus aureus subsp. aureus Mu50
aaauaucguggugaauuugaag

SEQ ID NO: 44291 - RNA, 22 nt, Staphylococcus aureus subsp. aureus Mu50
aaaucauuggaugcaucgauaa

SEQ ID NO: 44292 - RNA, 22 nt, Staphylococcus aureus subsp. aureus Mu50
aaauccauuaugcuuauuuugu

SEQ ID NO: 44293 - RNA, 22 nt, Staphylococcus aureus subsp. aureus Mu50
aaaugaugguucaauuugcuuc

SEQ ID NO: 44294 - RNA, 22 nt, Staphylococcus aureus subsp. aureus Mu50
aaaugcucccuucaaaguagac

SEQ ID NO: 44295 - RNA, 22 nt, Staphylococcus aureus subsp. aureus Mu50
aaauugauauuguugccaaugg

SEQ ID NO: 44296 - RNA, 22 nt, Staphylococcus aureus subsp. aureus Mu50
aaauugaugcaucaguaaaucc

SEQ ID NO: 44297 - RNA, 22 nt, Staphylococcus aureus subsp. aureus Mu50
aacaaacaccccuaauauuguu

SEQ ID NO: 44298 - RNA, 22 nt, Staphylococcus aureus subsp. aureus Mu50
aacaaaguugagugcauauuga

SEQ ID NO: 44299 - RNA, 21 nt, Staphylococcus aureus subsp. aureus Mu50
aacaagagauuccguauccuu

SEQ ID NO: 44300 - RNA, 22 nt, Staphylococcus aureus subsp. aureus Mu50
aacaauuaaugaucuuacagaa

SEQ ID NO: 44301 - RNA, 22 nt, Staphylococcus aureus subsp. aureus Mu50
aacacuuaucaaucaagcuauu

SEQ ID NO: 44302 - RNA, 22 nt, Staphylococcus aureus subsp. aureus Mu50
aacaggaauauuguauuauaca

SEQ ID NO: 44303 - RNA, 20 nt, Staphylococcus aureus subsp. aureus Mu50
aacagggaauccauauccuu

SEQ ID NO: 44304 - RNA, 22 nt, Staphylococcus aureus subsp. aureus Mu50
aacauagaaauauuacagucgc

SEQ ID NO: 44305 - RNA, 22 nt, Staphylococcus aureus subsp. aureus Mu50
aaccauuugauguaacugaaac

SEQ ID NO: 44306 - RNA, 22 nt, Staphylococcus aureus subsp. aureus Mu50
aaccugcaauaguaaauuuucu

SEQ ID NO: 44307 - RNA, 22 nt, Staphylococcus aureus subsp. aureus Mu50
aacgcuucauauaaaggucgag

SEQ ID NO: 44308 - RNA, 22 nt, Staphylococcus aureus subsp. aureus Mu50
aacguguuauuacaccauuauc

SEQ ID NO: 44309 - RNA, 22 nt, Staphylococcus aureus subsp. aureus Mu50
aacuaauaauuugcuuaauaau

SEQ ID NO: 44310 - RNA, 22 nt, Staphylococcus aureus subsp. aureus Mu50
aacugcuagcugaaauguuaug

SEQ ID NO: 44311 - RNA, 22 nt, Staphylococcus aureus subsp. aureus Mu50
aacuggauuuguaguuggaaag

SEQ ID NO: 44312 - RNA, 23 nt, Staphylococcus aureus subsp. aureus Mu50
aacugguguaggaaacguuaaua

SEQ ID NO: 44313 - RNA, 22 nt, Staphylococcus aureus subsp. aureus Mu50
aacuuauaaaggugauguugau

SEQ ID NO: 44314 - RNA, 20 nt, Staphylococcus aureus subsp. aureus Mu50
aacuuugaucggagcuuuuu

SEQ ID NO: 44315 - RNA, 15 nt, Staphylococcus aureus subsp. aureus Mu50
aagaaguagauuggu

SEQ ID NO: 44316 - RNA, 22 nt, Staphylococcus aureus subsp. aureus Mu50
aagaccuucaacauguaggaga

SEQ ID NO: 44317 - RNA, 22 nt, Staphylococcus aureus subsp. aureus Mu50
aagacuuaucgcaagaugcuca

SEQ ID NO: 44318 - RNA, 22 nt, Staphylococcus aureus subsp. aureus Mu50
aagcacgcacgcuuuauauguc

SEQ ID NO: 44319 - RNA, 22 nt, Staphylococcus aureus subsp. aureus Mu50
aagcaguguaugacguucuuaa

SEQ ID NO: 44320 - RNA, 22 nt, Staphylococcus aureus subsp. aureus Mu50
aagcauauggcguucuauuuau

SEQ ID NO: 44321 - RNA, 22 nt, Staphylococcus aureus subsp. aureus Mu50
aagcgcauuuucguucagucaa

SEQ ID NO: 44322 - RNA, 22 nt, Staphylococcus aureus subsp. aureus Mu50
aagcuauaguguuuguaauauu

SEQ ID NO: 44323 - RNA, 22 nt, Staphylococcus aureus subsp. aureus Mu50
aaggauauggauucccuguuau

SEQ ID NO: 44324 - RNA, 22 nt, Staphylococcus aureus subsp. aureus Mu50
aaggugaaguuaccacacgugu

SEQ ID NO: 44325 - RNA, 22 nt, Staphylococcus aureus subsp. aureus Mu50
aagucucauaaagcuauugccu

SEQ ID NO: 44326 - RNA, 21 nt, Staphylococcus aureus subsp. aureus Mu50
aauaacaguuacaaaugcuga

SEQ ID NO: 44327 - RNA, 22 nt, Staphylococcus aureus subsp. aureus Mu50
aauaaucuauauuaucuuucgu

SEQ ID NO: 44328 - RNA, 22 nt, Staphylococcus aureus subsp. aureus Mu50
aauacacuaaucgcacguacuc

SEQ ID NO: 44329 - RNA, 22 nt, Staphylococcus aureus subsp. aureus Mu50
aauauauuacaggucaaacaau

SEQ ID NO: 44330 - RNA, 22 nt, Staphylococcus aureus subsp. aureus Mu50
aaucagauggucuuacaacuuc

SEQ ID NO: 44331 - RNA, 22 nt, Staphylococcus aureus subsp. aureus Mu50
aaucaguauuuccaauuuagcu

SEQ ID NO: 44332 - RNA, 22 nt, Staphylococcus aureus subsp. aureus Mu50
aaucauggagugggauagaaau

SEQ ID NO: 44333 - RNA, 19 nt, Staphylococcus aureus subsp. aureus Mu50
aaucauggcauuuaucgca

SEQ ID NO: 44334 - RNA, 23 nt, Staphylococcus aureus subsp. aureus Mu50
aaucgcuuguacgaugaguaugg

SEQ ID NO: 44335 - RNA, 22 nt, Staphylococcus aureus subsp. aureus Mu50
aaugaauaaguaagguuucaac

SEQ ID NO: 44336 - RNA, 22 nt, Staphylococcus aureus subsp. aureus Mu50
aaugagagcccccuuuaccaca

SEQ ID NO: 44337 - RNA, 22 nt, Staphylococcus aureus subsp. aureus Mu50
aaugauaagcgacaguuaauaa

SEQ ID NO: 44338 - RNA, 18 nt, Staphylococcus aureus subsp. aureus Mu50
aaugauacugucagacgu

SEQ ID NO: 44339 - RNA, 22 nt, Staphylococcus aureus subsp. aureus Mu50
aaugauggugauaaauuacuug

SEQ ID NO: 44340 - RNA, 22 nt, Staphylococcus aureus subsp. aureus Mu50
aauggaauuuaagacgcugcau

SEQ ID NO: 44341 - RNA, 20 nt, Staphylococcus aureus subsp. aureus Mu50
aauggauucgguaacaaugc

SEQ ID NO: 44342 - RNA, 22 nt, Staphylococcus aureus subsp. aureus Mu50
aauggcuaaaagcauugaagca

SEQ ID NO: 44343 - RNA, 22 nt, Staphylococcus aureus subsp. aureus Mu50
aaugggagugggacagaaauga

SEQ ID NO: 44344 - RNA, 22 nt, Staphylococcus aureus subsp. aureus Mu50
aauguauagccgauuugacaug

SEQ ID NO: 44345 - RNA, 22 nt, Staphylococcus aureus subsp. aureus Mu50
aauguaugaaaauauguauccg

SEQ ID NO: 44346 - RNA, 22 nt, Staphylococcus aureus subsp. aureus Mu50
aaugucaaagaacguacugcuu

SEQ ID NO: 44347 - RNA, 22 nt, Staphylococcus aureus subsp. aureus Mu50
aaugucguuaucaauaaauuca

SEQ ID NO: 44348 - RNA, 22 nt, Staphylococcus aureus subsp. aureus Mu50
aaugucuccuucagagcucaug

SEQ ID NO: 44349 - RNA, 19 nt, Staphylococcus aureus subsp. aureus Mu50
aauguuagggguguuuguu

SEQ ID NO: 44350 - RNA, 22 nt, Staphylococcus aureus subsp. aureus Mu50
aauguuguaaacaaaguuaguc

SEQ ID NO: 44351 - RNA, 23 nt, Staphylococcus aureus subsp. aureus Mu50
aauguuugccuuuacgccauuuu

SEQ ID NO: 44352 - RNA, 22 nt, Staphylococcus aureus subsp. aureus Mu50
aauuaacuuauacaguggugcc

SEQ ID NO: 44353 - RNA, 22 nt, Staphylococcus aureus subsp. aureus Mu50
aauuaacuuuguuaauagaguu

SEQ ID NO: 44354 - RNA, 22 nt, Staphylococcus aureus subsp. aureus Mu50
aauuacuuuagccauugcuacc

SEQ ID NO: 44355 - RNA, 22 nt, Staphylococcus aureus subsp. aureus Mu50
aauuagaaucuuacgguauuaa

SEQ ID NO: 44356 - RNA, 22 nt, Staphylococcus aureus subsp. aureus Mu50
aauuaguuguuuuauacgauuc

SEQ ID NO: 44357 - RNA, 22 nt, Staphylococcus aureus subsp. aureus Mu50
aauuguucugguguugcgaucg

SEQ ID NO: 44358 - RNA, 22 nt, Staphylococcus aureus subsp. aureus Mu50
aauuuaaauuuagauccuguag

SEQ ID NO: 44359 - RNA, 22 nt, Staphylococcus aureus subsp. aureus Mu50
aauuucagcacgacgauuaaau

SEQ ID NO: 44360 - RNA, 22 nt, Staphylococcus aureus subsp. aureus Mu50
aauuuuuguacguucaauauca

SEQ ID NO: 44361 - RNA, 22 nt, Staphylococcus aureus subsp. aureus Mu50
acaaaagaggcgccacaacaug

SEQ ID NO: 44362 - RNA, 22 nt, Staphylococcus aureus subsp. aureus Mu50
acaaguuggaacauuucgucuu

SEQ ID NO: 44363 - RNA, 22 nt, Staphylococcus aureus subsp. aureus Mu50
acaaucaauaauuuuguuaaca

SEQ ID NO: 44364 - RNA, 22 nt, Staphylococcus aureus subsp. aureus Mu50
acaaucuuucguguugauuucu

SEQ ID NO: 44365 - RNA, 22 nt, Staphylococcus aureus subsp. aureus Mu50
acaauuuuauucacaacaagca

SEQ ID NO: 44366 - RNA, 22 nt, Staphylococcus aureus subsp. aureus Mu50
acaccaacaaaacagagguuuu

SEQ ID NO: 44367 - RNA, 22 nt, Staphylococcus aureus subsp. aureus Mu50
acagaaauaugauguaauuguu

SEQ ID NO: 44368 - RNA, 22 nt, Staphylococcus aureus subsp. aureus Mu50
acagaaaugauugaaccauuua

SEQ ID NO: 44369 - RNA, 22 nt, Staphylococcus aureus subsp. aureus Mu50
acaguuuagugcgcaaauuaau

SEQ ID NO: 44370 - RNA, 23 nt, Staphylococcus aureus subsp. aureus Mu50
acaucgaaaccugcaauagauuu

SEQ ID NO: 44371 - RNA, 22 nt, Staphylococcus aureus subsp. aureus Mu50
acaugacuaaagggcaggcauu

SEQ ID NO: 44372 - RNA, 22 nt, Staphylococcus aureus subsp. aureus Mu50
acaugauagaauuuuauaugua

SEQ ID NO: 44373 - RNA, 22 nt, Staphylococcus aureus subsp. aureus Mu50
acauugggcauaaucacagcua

SEQ ID NO: 44374 - RNA, 22 nt, Staphylococcus aureus subsp. aureus Mu50
acauuuauauuuuagguaaggc

SEQ ID NO: 44375 - RNA, 22 nt, Staphylococcus aureus subsp. aureus Mu50
accaauuuguuucuuuguauua

SEQ ID NO: 44376 - RNA, 22 nt, Staphylococcus aureus subsp. aureus Mu50
accacguaucauguuuuaguau

SEQ ID NO: 44377 - RNA, 22 nt, Staphylococcus aureus subsp. aureus Mu50
accccaacuaaauuaucuaaau

SEQ ID NO: 44378 - RNA, 22 nt, Staphylococcus aureus subsp. aureus Mu50
acgauuugaaaccguauauaaa

SEQ ID NO: 44379 - RNA, 22 nt, Staphylococcus aureus subsp. aureus Mu50
acuaugauuuuauuaacggucu

SEQ ID NO: 44380 - RNA, 22 nt, Staphylococcus aureus subsp. aureus Mu50
acuauuuguuaauaaauccauu

SEQ ID NO: 44381 - RNA, 22 nt, Staphylococcus aureus subsp. aureus Mu50
acucaagcagguauuaugaaag

SEQ ID NO: 44382 - RNA, 22 nt, Staphylococcus aureus subsp. aureus Mu50
acugacuucaacgucauugagc

SEQ ID NO: 44383 - RNA, 22 nt, Staphylococcus aureus subsp. aureus Mu50
acuuaauuugaugacagaacgu

SEQ ID NO: 44384 - RNA, 19 nt, Staphylococcus aureus subsp. aureus Mu50
acuucagguaugaugucac

SEQ ID NO: 44385 - RNA, 22 nt, Staphylococcus aureus subsp. aureus Mu50
acuuugaagggagcauuuuaca

SEQ ID NO: 44386 - RNA, 22 nt, Staphylococcus aureus subsp. aureus Mu50
acuuuguauuuaugggcuauuu

SEQ ID NO: 44387 - RNA, 22 nt, Staphylococcus aureus subsp. aureus Mu50
acuuuuacugcuaaaacgucaa

SEQ ID NO: 44388 - RNA, 22 nt, Staphylococcus aureus subsp. aureus Mu50
acuuuugagaugcacauuauca

SEQ ID NO: 44389 - RNA, 22 nt, Staphylococcus aureus subsp. aureus Mu50
agaaaacagcaguaaaaucauu

SEQ ID NO: 44390 - RNA, 22 nt, Staphylococcus aureus subsp. aureus Mu50
agaaauuggacuuggugcuacg

SEQ ID NO: 44391 - RNA, 22 nt, Staphylococcus aureus subsp. aureus Mu50
agaagacuuauuuacugcguuu

SEQ ID NO: 44392 - RNA, 22 nt, Staphylococcus aureus subsp. aureus Mu50
agacagggaaagacgauuauua

SEQ ID NO: 44393 - RNA, 23 nt, Staphylococcus aureus subsp. aureus Mu50
agacauuuaaugauaaauacuga

SEQ ID NO: 44394 - RNA, 22 nt, Staphylococcus aureus subsp. aureus Mu50
agagacgggagauuucuacgag

SEQ ID NO: 44395 - RNA, 22 nt, Staphylococcus aureus subsp. aureus Mu50
agagauaaaauaaagagguacu

SEQ ID NO: 44396 - RNA, 22 nt, Staphylococcus aureus subsp. aureus Mu50
agaggcaagacguaugcuugau

SEQ ID NO: 44397 - RNA, 22 nt, Staphylococcus aureus subsp. aureus Mu50
agagguacuagcaagcgcuuug

SEQ ID NO: 44398 - RNA, 22 nt, Staphylococcus aureus subsp. aureus Mu50
agaguguuaacagauucagcag

SEQ ID NO: 44399 - RNA, 22 nt, Staphylococcus aureus subsp. aureus Mu50
agauaaauuauauuuaaucggu

SEQ ID NO: 44400 - RNA, 22 nt, Staphylococcus aureus subsp. aureus Mu50
agaugacuucauuuugagagcg

SEQ ID NO: 44401 - RNA, 22 nt, Staphylococcus aureus subsp. aureus Mu50
agcacugauaauuccuaaaaua

SEQ ID NO: 44402 - RNA, 22 nt, Staphylococcus aureus subsp. aureus Mu50
agcauuaaaugauuuugaaaac

SEQ ID NO: 44403 - RNA, 22 nt, Staphylococcus aureus subsp. aureus Mu50
agccaauguuauuuguuagugu

SEQ ID NO: 44404 - RNA, 22 nt, Staphylococcus aureus subsp. aureus Mu50
agcgaguuaucauguuaauuac

SEQ ID NO: 44405 - RNA, 22 nt, Staphylococcus aureus subsp. aureus Mu50
agcguuguaugaggcaaugauu

SEQ ID NO: 44406 - RNA, 22 nt, Staphylococcus aureus subsp. aureus Mu50
agcuacuaacaaugggugguga

SEQ ID NO: 44407 - RNA, 22 nt, Staphylococcus aureus subsp. aureus Mu50
agcuuuuuucaauucuagucaa

SEQ ID NO: 44408 - RNA, 22 nt, Staphylococcus aureus subsp. aureus Mu50
agcuuuuuucaauucuagucag

SEQ ID NO: 44409 - RNA, 22 nt, Staphylococcus aureus subsp. aureus Mu50
aggcauugggaaugauaacaac

SEQ ID NO: 44410 - RNA, 22 nt, Staphylococcus aureus subsp. aureus Mu50
agggagugggacagaaaugaua

SEQ ID NO: 44411 - RNA, 22 nt, Staphylococcus aureus subsp. aureus Mu50
agguaucguuucuguuccauaa

SEQ ID NO: 44412 - RNA, 22 nt, Staphylococcus aureus subsp. aureus Mu50
agguauguaagugaauauagaa

SEQ ID NO: 44413 - RNA, 22 nt, Staphylococcus aureus subsp. aureus Mu50
auucuaagcauuuaaaacguug

SEQ ID NO: 44414 - RNA, 22 nt, Staphylococcus aureus subsp. aureus Mu50
auugaagucgcguaauugugaa

SEQ ID NO: 44415 - RNA, 22 nt, Staphylococcus aureus subsp. aureus Mu50
auugauacauuauuuguaugua

SEQ ID NO: 44416 - RNA, 22 nt, Staphylococcus aureus subsp. aureus Mu50
auugauuuggcaucaaacuucg

SEQ ID NO: 44417 - RNA, 19 nt, Staphylococcus aureus subsp. aureus Mu50
auugcauuagcugccuaua

SEQ ID NO: 44418 - RNA, 22 nt, Staphylococcus aureus subsp. aureus Mu50
auugggaugaagcaaugaaaga

SEQ ID NO: 44419 - RNA, 22 nt, Staphylococcus aureus subsp. aureus Mu50
auuguaauaaguguaauuuguu

SEQ ID NO: 44420 - RNA, 22 nt, Staphylococcus aureus subsp. aureus Mu50
auuguauuauggguuauaggcu

SEQ ID NO: 44421 - RNA, 18 nt, Staphylococcus aureus subsp. aureus Mu50
auuuacuauugcagguuu

SEQ ID NO: 44422 - RNA, 22 nt, Staphylococcus aureus subsp. aureus Mu50
auuuagauaauuuaguuggggu

SEQ ID NO: 44423 - RNA, 22 nt, Staphylococcus aureus subsp. aureus Mu50
auuucgaguguauggaugaugu

SEQ ID NO: 44424 - RNA, 22 nt, Staphylococcus aureus subsp. aureus Mu50
auuucguugacccacuuccugc

SEQ ID NO: 44425 - RNA, 18 nt, Staphylococcus aureus subsp. aureus Mu50
auuucugucccacuccca

SEQ ID NO: 44426 - RNA, 19 nt, Staphylococcus aureus subsp. aureus Mu50
auuucugucccacucccac

SEQ ID NO: 44427 - RNA, 22 nt, Staphylococcus aureus subsp. aureus Mu50
auuugaaaggagccgauaaugg

SEQ ID NO: 44428 - RNA, 22 nt, Staphylococcus aureus subsp. aureus Mu50
auuugauuuuacugaagcggaa

SEQ ID NO: 44429 - RNA, 22 nt, Staphylococcus aureus subsp. aureus Mu50
auuuuauauaaaaagaagaucc

SEQ ID NO: 44430 - RNA, 22 nt, Staphylococcus aureus subsp. aureus Mu50
auuuuugcgagauacguuaaag

SEQ ID NO: 44431 - RNA, 22 nt, Staphylococcus aureus subsp. aureus Mu50
caaacuuucuaaacuuucauca

SEQ ID NO: 44432 - RNA, 22 nt, Staphylococcus aureus subsp. aureus Mu50
caaaugcugucgucuacuuuua

SEQ ID NO: 44433 - RNA, 22 nt, Staphylococcus aureus subsp. aureus Mu50
caaccuauagauuauuuugucg

SEQ ID NO: 44434 - RNA, 22 nt, Staphylococcus aureus subsp. aureus Mu50
caauaucgugaugaagugcagc

SEQ ID NO: 44435 - RNA, 22 nt, Staphylococcus aureus subsp. aureus Mu50
cagaaguauaaaccauaccauu

SEQ ID NO: 44436 - RNA, 22 nt, Staphylococcus aureus subsp. aureus Mu50
cagauuaaucguacauauuaga

SEQ ID NO: 44437 - RNA, 22 nt, Staphylococcus aureus subsp. aureus Mu50
caguuauuagcaggauuuuagc

SEQ ID NO: 44438 - RNA, 22 nt, Staphylococcus aureus subsp. aureus Mu50
cauaucgucauaacuauuguca

SEQ ID NO: 44439 - RNA, 22 nt, Staphylococcus aureus subsp. aureus Mu50
caucaauauaccgaaaauacag

SEQ ID NO: 44440 - RNA, 22 nt, Staphylococcus aureus subsp. aureus Mu50
caucugcagcaguaacaugggg

SEQ ID NO: 44441 - RNA, 21 nt, Staphylococcus aureus subsp. aureus Mu50
caugacauuaaggcuuuagua

SEQ ID NO: 44442 - RNA, 18 nt, Staphylococcus aureus subsp. aureus Mu50
caugaugaagagaguuuu

SEQ ID NO: 44443 - RNA, 22 nt, Staphylococcus aureus subsp. aureus Mu50
caugcaaagucuucgauacuuu

SEQ ID NO: 44444 - RNA, 22 nt, Staphylococcus aureus subsp. aureus Mu50
cauuaacaacgaaaagauuagu

SEQ ID NO: 44445 - RNA, 22 nt, Staphylococcus aureus subsp. aureus Mu50
cauuaggauuuggugaaccgua

SEQ ID NO: 44446 - RNA, 22 nt, Staphylococcus aureus subsp. aureus Mu50
cauugccaucaaacuacuuuca

SEQ ID NO: 44447 - RNA, 22 nt, Staphylococcus aureus subsp. aureus Mu50
cauuuguugcugcuugauucac

SEQ ID NO: 44448 - RNA, 20 nt, Staphylococcus aureus subsp. aureus Mu50
ccagcaguugauuuaagugu

SEQ ID NO: 44449 - RNA, 22 nt, Staphylococcus aureus subsp. aureus Mu50
ccauuaaauuguaaccauggug

SEQ ID NO: 44450 - RNA, 22 nt, Staphylococcus aureus subsp. aureus Mu50
cccuuuuaauuuaacuuagagu

SEQ ID NO: 44451 - RNA, 22 nt, Staphylococcus aureus subsp. aureus Mu50
ccguguuuuagcugaaacaagu

SEQ ID NO: 44452 - RNA, 20 nt, Staphylococcus aureus subsp. aureus Mu50
ccucaaggugaugcaggauu

SEQ ID NO: 44453 - RNA, 22 nt, Staphylococcus aureus subsp. aureus Mu50
ccuguaaucuaguuagggguuu

SEQ ID NO: 44454 - RNA, 22 nt, Staphylococcus aureus subsp. aureus Mu50
ccuuugcaaauauauuuguuua

SEQ ID NO: 44455 - RNA, 22 nt, Staphylococcus aureus subsp. aureus Mu50
cgauuuauaaaacauacauaau

SEQ ID NO: 44456 - RNA, 22 nt, Staphylococcus aureus subsp. aureus Mu50
cgcuaucguuggugguguaguu

SEQ ID NO: 44457 - RNA, 22 nt, Staphylococcus aureus subsp. aureus Mu50
cuaauaauugugaauaugcaag

SEQ ID NO: 44458 - RNA, 22 nt, Staphylococcus aureus subsp. aureus Mu50
cuaauuaauauugcagaagaga

SEQ ID NO: 44459 - RNA, 22 nt, Staphylococcus aureus subsp. aureus Mu50
cuacuuaugaacagguauguac

SEQ ID NO: 44460 - RNA, 22 nt, Staphylococcus aureus subsp. aureus Mu50
cuacuucaucaagcaauuguuu

SEQ ID NO: 44461 - RNA, 22 nt, Staphylococcus aureus subsp. aureus Mu50
cuaugaauaauucucuguuuuc

SEQ ID NO: 44462 - RNA, 22 nt, Staphylococcus aureus subsp. aureus Mu50
cucguuaaaggucauaauuaac

SEQ ID NO: 44463 - RNA, 22 nt, Staphylococcus aureus subsp. aureus Mu50
cugauaaauuuggucgcgucaa

SEQ ID NO: 44464 - RNA, 22 nt, Staphylococcus aureus subsp. aureus Mu50
cuuaugaagaugaacgcgugcu

SEQ ID NO: 44465 - RNA, 22 nt, Staphylococcus aureus subsp. aureus Mu50
cuucaaugauuuuuuauggucc

SEQ ID NO: 44466 - RNA, 22 nt, Staphylococcus aureus subsp. aureus Mu50
cuucauugauuauuuaggugcu

SEQ ID NO: 44467 - RNA, 22 nt, Staphylococcus aureus subsp. aureus Mu50
cuucuaauucacgaauauuaga

SEQ ID NO: 44468 - RNA, 22 nt, Staphylococcus aureus subsp. aureus Mu50
cuugaauagugagcguauuauu

SEQ ID NO: 44469 - RNA, 22 nt, Staphylococcus aureus subsp. aureus Mu50
cuugaugagcacuccauaaagu

SEQ ID NO: 44470 - RNA, 22 nt, Staphylococcus aureus subsp. aureus Mu50
cuuguucugucguaaugaugua

SEQ ID NO: 44471 - RNA, 22 nt, Staphylococcus aureus subsp. aureus Mu50
cuuuguugcuguaauauuaacc

SEQ ID NO: 44472 - RNA, 22 nt, Staphylococcus aureus subsp. aureus Mu50
cuuuuucacauaucauaggucu

SEQ ID NO: 44473 - RNA, 22 nt, Staphylococcus aureus subsp. aureus Mu50
gaaaaaaucgauuggcguggcu

SEQ ID NO: 44474 - RNA, 22 nt, Staphylococcus aureus subsp. aureus Mu50
gaaaguaguuauugaagugaug

SEQ ID NO: 44475 - RNA, 22 nt, Staphylococcus aureus subsp. aureus Mu50
gaaagugaucuuaaagaagggu

SEQ ID NO: 44476 - RNA, 22 nt, Staphylococcus aureus subsp. aureus Mu50
gaaaugauauaguuacagcugu

SEQ ID NO: 44477 - RNA, 22 nt, Staphylococcus aureus subsp. aureus Mu50
gaagacaauaaguguaaugaug

SEQ ID NO: 44478 - RNA, 22 nt, Staphylococcus aureus subsp. aureus Mu50
gaaggugguaauaacguuauua

SEQ ID NO: 44479 - RNA, 22 nt, Staphylococcus aureus subsp. aureus Mu50
gaauucuucacccauuguuaca

SEQ ID NO: 44480 - RNA, 22 nt, Staphylococcus aureus subsp. aureus Mu50
gacaccauuacaguuuguacuu

SEQ ID NO: 44481 - RNA, 22 nt, Staphylococcus aureus subsp. aureus Mu50
gaccaaaaggcauuaucagaag

SEQ ID NO: 44482 - RNA, 22 nt, Staphylococcus aureus subsp. aureus Mu50
gagcgcuuucuacaaaugauga

SEQ ID NO: 44483 - RNA, 22 nt, Staphylococcus aureus subsp. aureus Mu50
gaggagugguuaaaugaaaaca

SEQ ID NO: 44484 - RNA, 22 nt, Staphylococcus aureus subsp. aureus Mu50
gaguuuaaaaaagguuaaguac

SEQ ID NO: 44485 - RNA, 22 nt, Staphylococcus aureus subsp. aureus Mu50
gauaacuuauuaauacaugcgu

SEQ ID NO: 44486 - RNA, 23 nt, Staphylococcus aureus subsp. aureus Mu50
uaaauuuaauuacauaaccgaca

SEQ ID NO: 44487 - RNA, 22 nt, Staphylococcus aureus subsp. aureus Mu50
uaagaaauauucaauggggaug

SEQ ID NO: 44488 - RNA, 21 nt, Staphylococcus aureus subsp. aureus Mu50
uaagaaguuagcaacaucaac

SEQ ID NO: 44489 - RNA, 22 nt, Staphylococcus aureus subsp. aureus Mu50
uaagagugugacauuuucuaca

SEQ ID NO: 44490 - RNA, 22 nt, Staphylococcus aureus subsp. aureus Mu50
uaaguggauuguaauuauauua

SEQ ID NO: 44491 - RNA, 22 nt, Staphylococcus aureus subsp. aureus Mu50
uaauaauaaguauggucgugag

SEQ ID NO: 44492 - RNA, 18 nt, Staphylococcus aureus subsp. aureus Mu50
uaauaauggagaagguuc

SEQ ID NO: 44493 - RNA, 22 nt, Staphylococcus aureus subsp. aureus Mu50
uaauagugaagucauuuguuuc

SEQ ID NO: 44494 - RNA, 20 nt, Staphylococcus aureus subsp. aureus Mu50
uaauaguugucguucuacua

SEQ ID NO: 44495 - RNA, 22 nt, Staphylococcus aureus subsp. aureus Mu50
uaauauucgcacucauuauucc

SEQ ID NO: 44496 - RNA, 22 nt, Staphylococcus aureus subsp. aureus Mu50
uaaugcaggccaacuaaauauu

SEQ ID NO: 44497 - RNA, 22 nt, Staphylococcus aureus subsp. aureus Mu50
uacaaagagcaguaaaguuauu

SEQ ID NO: 44498 - RNA, 22 nt, Staphylococcus aureus subsp. aureus Mu50
uacaaagccuuaauaucaugca

SEQ ID NO: 44499 - RNA, 22 nt, Staphylococcus aureus subsp. aureus Mu50
uacaacugauucagcugaaucg

SEQ ID NO: 44500 - RNA, 22 nt, Staphylococcus aureus subsp. aureus Mu50
uacaagcaaaaguagcggugau

SEQ ID NO: 44501 - RNA, 22 nt, Staphylococcus aureus subsp. aureus Mu50
uacgacuuuauaugaagcguuu

SEQ ID NO: 44502 - RNA, 22 nt, Staphylococcus aureus subsp. aureus Mu50
uagaagaauuauauaaaauguc

SEQ ID NO: 44503 - RNA, 22 nt, Staphylococcus aureus subsp. aureus Mu50
uagacaccaaaaaacagagguc

SEQ ID NO: 44504 - RNA, 22 nt, Staphylococcus aureus subsp. aureus Mu50
uagauauaaagcuaaagcgaca

SEQ ID NO: 44505 - RNA, 22 nt, Staphylococcus aureus subsp. aureus Mu50
uagauguuuuaguaaauaaugc

SEQ ID NO: 44506 - RNA, 22 nt, Staphylococcus aureus subsp. aureus Mu50
uagcuaugaccauaugccaugu

SEQ ID NO: 44507 - RNA, 22 nt, Staphylococcus aureus subsp. aureus Mu50
uaggggcaguacgaucgaucgu

SEQ ID NO: 44508 - RNA, 19 nt, Staphylococcus aureus subsp. aureus Mu50
uaguacauuaggaguuuug

SEQ ID NO: 44509 - RNA, 22 nt, Staphylococcus aureus subsp. aureus Mu50
uaguagggauugggacagaaau

SEQ ID NO: 44510 - RNA, 22 nt, Staphylococcus aureus subsp. aureus Mu50
uagugguauugaaucugcugua

SEQ ID NO: 44511 - RNA, 22 nt, Staphylococcus aureus subsp. aureus Mu50
uaguugaucugccuaaguauau

SEQ ID NO: 44512 - RNA, 22 nt, Staphylococcus aureus subsp. aureus Mu50
uaguuugauaugcucucuucaa

SEQ ID NO: 44513 - RNA, 22 nt, Staphylococcus aureus subsp. aureus Mu50
uauaacagaaguugauaauuau

SEQ ID NO: 44514 - RNA, 22 nt, Staphylococcus aureus subsp. aureus Mu50
uauaugagacggggucauuucu

SEQ ID NO: 44515 - RNA, 22 nt, Staphylococcus aureus subsp. aureus Mu50
uaucacugggauuuuuaugcau

SEQ ID NO: 44516 - RNA, 19 nt, Staphylococcus aureus subsp. aureus Mu50
uaucaucagcagaauguau

SEQ ID NO: 44517 - RNA, 19 nt, Staphylococcus aureus subsp. aureus Mu50
uaucauguuagaagcuuuu

SEQ ID NO: 44518 - RNA, 22 nt, Staphylococcus aureus subsp. aureus Mu50
uaucauucuucuugaaacgucu

SEQ ID NO: 44519 - RNA, 22 nt, Staphylococcus aureus subsp. aureus Mu50
uaucauuucugucccacucccu

SEQ ID NO: 44520 - RNA, 22 nt, Staphylococcus aureus subsp. aureus Mu50
uaucgcaugaagcagcuucauu

SEQ ID NO: 44521 - RNA, 22 nt, Staphylococcus aureus subsp. aureus Mu50
uaugaaguuauggauuuagaug

SEQ ID NO: 44522 - RNA, 18 nt, Staphylococcus aureus subsp. aureus Mu50
uaugacucuaacguuuug

SEQ ID NO: 44523 - RNA, 22 nt, Staphylococcus aureus subsp. aureus Mu50
uaugauggucacaguuuauuug

SEQ ID NO: 44524 - RNA, 22 nt, Staphylococcus aureus subsp. aureus Mu50
uauuaggugcgaugccaagaca

SEQ ID NO: 44525 - RNA, 22 nt, Staphylococcus aureus subsp. aureus Mu50
uauucaacugacguuguuuguu

SEQ ID NO: 44526 - RNA, 22 nt, Staphylococcus aureus subsp. aureus Mu50
uauucauuuugcagcaacuaug

SEQ ID NO: 44527 - RNA, 22 nt, Staphylococcus aureus subsp. aureus Mu50
uauugcgcaauuuacguuuugu

SEQ ID NO: 44528 - RNA, 22 nt, Staphylococcus aureus subsp. aureus Mu50
uauuuaugagcuaaucaaacau

SEQ ID NO: 44529 - RNA, 22 nt, Staphylococcus aureus subsp. aureus Mu50
uauuuguaaaggcgaauuauuu

SEQ ID NO: 44530 - RNA, 22 nt, Staphylococcus aureus subsp. aureus Mu50
uauuuuggaaauagcaucaaau

SEQ ID NO: 44531 - RNA, 22 nt, Staphylococcus aureus subsp. aureus Mu50
ucaaauuacgugcuaaagcuug

SEQ ID NO: 44532 - RNA, 22 nt, Staphylococcus aureus subsp. aureus Mu50
ucaacaaauggauuuagaugaa

SEQ ID NO: 44533 - RNA, 22 nt, Staphylococcus aureus subsp. aureus Mu50
ucaacuaagucaaccuuauuga

SEQ ID NO: 44534 - RNA, 22 nt, Staphylococcus aureus subsp. aureus Mu50
ucacaauuuggguguuugugau

SEQ ID NO: 44535 - RNA, 22 nt, Staphylococcus aureus subsp. aureus Mu50
ucacuagagcuaugaaacuugg

SEQ ID NO: 44536 - RNA, 22 nt, Staphylococcus aureus subsp. aureus Mu50
ucacuugagagagcuugcagau

SEQ ID NO: 44537 - RNA, 22 nt, Staphylococcus aureus subsp. aureus Mu50
ucauaauagauucuauuuuuaa

SEQ ID NO: 44538 - RNA, 22 nt, Staphylococcus aureus subsp. aureus Mu50
ucaugacaccugaaaugacaca

SEQ ID NO: 44539 - RNA, 22 nt, Staphylococcus aureus subsp. aureus Mu50
ucauguguaucuuguggucaau

SEQ ID NO: 44540 - RNA, 22 nt, Staphylococcus aureus subsp. aureus Mu50
ucauuaguuccaguuccagcua

SEQ ID NO: 44541 - RNA, 22 nt, Staphylococcus aureus subsp. aureus Mu50
ucauuauaguuaauacaaugcu

SEQ ID NO: 44542 - RNA, 22 nt, Staphylococcus aureus subsp. aureus Mu50
ucggugauaagugaaucaauua

SEQ ID NO: 44543 - RNA, 22 nt, Staphylococcus aureus subsp. aureus Mu50
ucguuugucguuucaauguagc

SEQ ID NO: 44544 - RNA, 22 nt, Staphylococcus aureus subsp. aureus Mu50
ucuauuaagaagcggacagaug

SEQ ID NO: 44545 - RNA, 22 nt, Staphylococcus aureus subsp. aureus Mu50
ucuauuauucgaggaacaccaa

SEQ ID NO: 44546 - RNA, 19 nt, Staphylococcus aureus subsp. aureus Mu50
ucucaucaguucgauuuuu

SEQ ID NO: 44547 - RNA, 22 nt, Staphylococcus aureus subsp. aureus Mu50
ucugaaguugccaauaauguac

SEQ ID NO: 44548 - RNA, 22 nt, Staphylococcus aureus subsp. aureus Mu50
ucugcauuagaacauuuagaua

SEQ ID NO: 44549 - RNA, 22 nt, Staphylococcus aureus subsp. aureus Mu50
ucuugaauaugaaguuagguag

SEQ ID NO: 44550 - RNA, 22 nt, Staphylococcus aureus subsp. aureus Mu50
ucuuuaaaccaaucguaugugu

SEQ ID NO: 44551 - RNA, 22 nt, Staphylococcus aureus subsp. aureus Mu50
ucuuucgauaagauaaccauau

SEQ ID NO: 44552 - RNA, 22 nt, Staphylococcus aureus subsp. aureus Mu50
ucuuuuaaucgaccuugagaaa

SEQ ID NO: 44553 - RNA, 22 nt, Staphylococcus aureus subsp. aureus Mu50
ugaaaacaguugugaugauugu

SEQ ID NO: 44554 - RNA, 22 nt, Staphylococcus aureus subsp. aureus Mu50
ugaaagguaugacaacacaguu

SEQ ID NO: 44555 - RNA, 22 nt, Staphylococcus aureus subsp. aureus Mu50
ugaaaguguugacgguaugauu

SEQ ID NO: 44556 - RNA, 22 nt, Staphylococcus aureus subsp. aureus Mu50
ugaaauacuaacauugacuucu

SEQ ID NO: 44557 - RNA, 20 nt, Staphylococcus aureus subsp. aureus Mu50
ugaaauauugcaguuaccau

SEQ ID NO: 44558 - RNA, 22 nt, Staphylococcus aureus subsp. aureus Mu50
ugaaaucuucgguagucgagau

SEQ ID NO: 44559 - RNA, 22 nt, Staphylococcus aureus subsp. aureus Mu50
uucuuuuaguaauuuaggcaau

SEQ ID NO: 44560 - RNA, 22 nt, Staphylococcus aureus subsp. aureus Mu50
uugaaaaguaagcuaucugaga

SEQ ID NO: 44561 - RNA, 22 nt, Staphylococcus aureus subsp. aureus Mu50
uugaaaucugguugaagucguu

SEQ ID NO: 44562 - RNA, 20 nt, Staphylococcus aureus subsp. aureus Mu50
uugaagccuuauuugucguu

SEQ ID NO: 44563 - RNA, 19 nt, Staphylococcus aureus subsp. aureus Mu50
uugaagcuggcacauuaaa

SEQ ID NO: 44564 - RNA, 22 nt, Staphylococcus aureus subsp. aureus Mu50
uugaauggaguauaucagcuug

SEQ ID NO: 44565 - RNA, 22 nt, Staphylococcus aureus subsp. aureus Mu50
uugacguuuuagcaguaaaagu

SEQ ID NO: 44566 - RNA, 22 nt, Staphylococcus aureus subsp. aureus Mu50
uugacuucaguacaaucuugua

SEQ ID NO: 44567 - RNA, 22 nt, Staphylococcus aureus subsp. aureus Mu50
uugauauuaaauguuguagguu

SEQ ID NO: 44568 - RNA, 22 nt, Staphylococcus aureus subsp. aureus Mu50
uugcaauguuacuagagaagau

SEQ ID NO: 44569 - RNA, 22 nt, Staphylococcus aureus subsp. aureus Mu50
uugcagcacgugauucuggugc

SEQ ID NO: 44570 - RNA, 22 nt, Staphylococcus aureus subsp. aureus Mu50
uuggacuagaaaugguagauaa

SEQ ID NO: 44571 - RNA, 22 nt, Staphylococcus aureus subsp. aureus Mu50
uuggaggcuaguauguugaaca

SEQ ID NO: 44572 - RNA, 22 nt, Staphylococcus aureus subsp. aureus Mu50
uugggcaucgcuuaaaugguuu

SEQ ID NO: 44573 - RNA, 22 nt, Staphylococcus aureus subsp. aureus Mu50
uugguguuguuccgaagccguu

SEQ ID NO: 44574 - RNA, 22 nt, Staphylococcus aureus subsp. aureus Mu50
uuguaaaugguagaccgaagcu

SEQ ID NO: 44575 - RNA, 22 nt, Staphylococcus aureus subsp. aureus Mu50
uuguacaggugagucugcuuca

SEQ ID NO: 44576 - RNA, 22 nt, Staphylococcus aureus subsp. aureus Mu50
uuguagaugucguuucaauucc

SEQ ID NO: 44577 - RNA, 22 nt, Staphylococcus aureus subsp. aureus Mu50
uuguaguguguggaaaaugaca

SEQ ID NO: 44578 - RNA, 22 nt, Staphylococcus aureus subsp. aureus Mu50
uugugaaauauucggcgguacu

SEQ ID NO: 44579 - RNA, 22 nt, Staphylococcus aureus subsp. aureus Mu50
uugugcaauuuuauuaaaacga

SEQ ID NO: 44580 - RNA, 22 nt, Staphylococcus aureus subsp. aureus Mu50
uuguugaaccagucacugcuug

SEQ ID NO: 44581 - RNA, 22 nt, Staphylococcus aureus subsp. aureus Mu50
uuuaacgguaucaacguuugcc

SEQ ID NO: 44582 - RNA, 22 nt, Staphylococcus aureus subsp. aureus Mu50
uuuaccaauaaugaugaacauu

SEQ ID NO: 44583 - RNA, 22 nt, Staphylococcus aureus subsp. aureus Mu50
uuuaucaucaacaauuggugaa

SEQ ID NO: 44584 - RNA, 22 nt, Staphylococcus aureus subsp. aureus Mu50
uuuauuacguaaauacuaugcu

SEQ ID NO: 44585 - RNA, 23 nt, Staphylococcus aureus subsp. aureus Mu50
uuucaucaauuuggggugagaca

SEQ ID NO: 44586 - RNA, 22 nt, Staphylococcus aureus subsp. aureus Mu50
uuucguugucguauggcaaccc

SEQ ID NO: 44587 - RNA, 22 nt, Staphylococcus aureus subsp. aureus Mu50
uuugaauuacguugucgcgucc

SEQ ID NO: 44588 - RNA, 22 nt, Staphylococcus aureus subsp. aureus Mu50
uuugaauugcccaaacggcgug

SEQ ID NO: 44589 - RNA, 22 nt, Staphylococcus aureus subsp. aureus Mu50
uuugauguguacgcuauaaguu

SEQ ID NO: 44590 - RNA, 22 nt, Staphylococcus aureus subsp. aureus Mu50
uuugauucagucaguaaagaag

SEQ ID NO: 44591 - RNA, 22 nt, Staphylococcus aureus subsp. aureus Mu50
uuugccguuuggauuuuaagua

SEQ ID NO: 44592 - RNA, 22 nt, Staphylococcus aureus subsp. aureus Mu50
uuuguacaaucauaaacuggug

SEQ ID NO: 44593 - RNA, 22 nt, Staphylococcus aureus subsp. aureus Mu50
uuuguuacaggugauauuaaac

SEQ ID NO: 44594 - RNA, 22 nt, Staphylococcus aureus subsp. aureus Mu50
uuuuaguuauugcacauucgua

SEQ ID NO: 44595 - RNA, 22 nt, Staphylococcus aureus subsp. aureus Mu50
uuuuauugaucgacacgguaag

SEQ ID NO: 44596 - RNA, 22 nt, Staphylococcus aureus subsp. aureus Mu50
uuuucaauucuagucaacuuug

SEQ ID NO: 44597 - RNA, 22 nt, Staphylococcus aureus subsp. aureus Mu50
uuuuccaacuucucaguaaauu

SEQ ID NO: 44598 - RNA, 22 nt, Staphylococcus aureus subsp. aureus Mu50
uuuuccauauacugguguaguu

SEQ ID NO: 44599 - RNA, 22 nt, Staphylococcus aureus subsp. aureus Mu50
uuuucguucagucaacuacugc

SEQ ID NO: 44600 - RNA, 23 nt, Staphylococcus aureus subsp. aureus Mu50
uuuucguucagucaacuacugcc

SEQ ID NO: 44601 - RNA, 22 nt, Staphylococcus aureus subsp. aureus Mu50
aaaaacaucgagucagaugcua

SEQ ID NO: 44602 - RNA, 22 nt, Staphylococcus aureus subsp. aureus Mu50
aaaaacuucuaucacgaacgcu

SEQ ID NO: 44603 - RNA, 22 nt, Staphylococcus aureus subsp. aureus Mu50
aaaaagcgaccaguucgcaguu

SEQ ID NO: 44604 - RNA, 22 nt, Staphylococcus aureus subsp. aureus Mu50
aaaaagggcagaauauacaacu

SEQ ID NO: 44605 - RNA, 22 nt, Staphylococcus aureus subsp. aureus Mu50
aaaaauguccuccuguucauca

SEQ ID NO: 44606 - RNA, 22 nt, Staphylococcus aureus subsp. aureus Mu50
aaaacugacuaguucgcaagca

SEQ ID NO: 44607 - RNA, 22 nt, Staphylococcus aureus subsp. aureus Mu50
aaaagcaccuuuauucaucauu

SEQ ID NO: 44608 - RNA, 22 nt, Staphylococcus aureus subsp. aureus Mu50
aaaauaaugugcgcccuauaaa

SEQ ID NO: 44609 - RNA, 22 nt, Staphylococcus aureus subsp. aureus Mu50
aaaauccaagugcuaagaggua

SEQ ID NO: 44610 - RNA, 22 nt, Staphylococcus aureus subsp. aureus Mu50
aaacaguucaugaugaugcacg

SEQ ID NO: 44611 - RNA, 22 nt, Staphylococcus aureus subsp. aureus Mu50
aaacguucauuuugaaguguug

SEQ ID NO: 44612 - RNA, 22 nt, Staphylococcus aureus subsp. aureus Mu50
aaacguugugcaauaucuuuag

SEQ ID NO: 44613 - RNA, 22 nt, Staphylococcus aureus subsp. aureus Mu50
aaacugcuaauguagucaugag

SEQ ID NO: 44614 - RNA, 22 nt, Staphylococcus aureus subsp. aureus Mu50
aaagacagauuguagguggaau

SEQ ID NO: 44615 - RNA, 22 nt, Staphylococcus aureus subsp. aureus Mu50
aaagacuaguguaccuuguuuc

SEQ ID NO: 44616 - RNA, 22 nt, Staphylococcus aureus subsp. aureus Mu50
aaagacuuggucgaaucgugga

SEQ ID NO: 44617 - RNA, 22 nt, Staphylococcus aureus subsp. aureus Mu50
aaagagcaagguuaacgaguca

SEQ ID NO: 44618 - RNA, 22 nt, Staphylococcus aureus subsp. aureus Mu50
aaagcaaucugagccuguaccg

SEQ ID NO: 44619 - RNA, 22 nt, Staphylococcus aureus subsp. aureus Mu50
aaagccaaucaaacggaguguu

SEQ ID NO: 44620 - RNA, 22 nt, Staphylococcus aureus subsp. aureus Mu50
aaagccuuaaugucaugcuacg

SEQ ID NO: 44621 - RNA, 20 nt, Staphylococcus aureus subsp. aureus Mu50
aaagugguuuuaggaugccu

SEQ ID NO: 44622 - RNA, 22 nt, Staphylococcus aureus subsp. aureus Mu50
aaauaaagacaaaguaucauua

SEQ ID NO: 44623 - RNA, 22 nt, Staphylococcus aureus subsp. aureus Mu50
aaauaagguauggcuagucuuu

SEQ ID NO: 44624 - RNA, 22 nt, Staphylococcus aureus subsp. aureus Mu50
aaauaaugugcacccuaaaagu

SEQ ID NO: 44625 - RNA, 22 nt, Staphylococcus aureus subsp. aureus Mu50
aaauacuuuccauguauggugu

SEQ ID NO: 44626 - RNA, 22 nt, Staphylococcus aureus subsp. aureus Mu50
aaaucaaugguuaauggaccau

SEQ ID NO: 44627 - RNA, 22 nt, Staphylococcus aureus subsp. aureus Mu50
aaaucaucgaacaugaaugaua

SEQ ID NO: 44628 - RNA, 23 nt, Staphylococcus aureus subsp. aureus Mu50
aaaugcguuuacaagcuuugauc

SEQ ID NO: 44629 - RNA, 20 nt, Staphylococcus aureus subsp. aureus Mu50
aaauggaagcgccuauguuu

SEQ ID NO: 44630 - RNA, 22 nt, Staphylococcus aureus subsp. aureus Mu50
aaauggaaugcaaugucucuuu

SEQ ID NO: 44631 - RNA, 22 nt, Staphylococcus aureus subsp. aureus Mu50
aaauggcuauggcaaaagccca

SEQ ID NO: 44632 - RNA, 22 nt, Staphylococcus aureus subsp. aureus Mu50
aaaugguggccaugcgguaggu

SEQ ID NO: 44633 - RNA, 21 nt, Staphylococcus aureus subsp. aureus Mu50
aaaugguuggagauaucauuu

SEQ ID NO: 44634 - RNA, 22 nt, Staphylococcus aureus subsp. aureus Mu50
aaauguuguuauaucggagcgu

SEQ ID NO: 44635 - RNA, 18 nt, Staphylococcus aureus subsp. aureus Mu50
aaauuacugcccaugaua

SEQ ID NO: 44636 - RNA, 22 nt, Staphylococcus aureus subsp. aureus Mu50
aaauuaucgggcuguauuuuac

SEQ ID NO: 44637 - RNA, 22 nt, Staphylococcus aureus subsp. aureus Mu50
aacauuucccauugauuggcuu

SEQ ID NO: 44638 - RNA, 22 nt, Staphylococcus aureus subsp. aureus Mu50
aacauuuucaauaauugauucg

SEQ ID NO: 44639 - RNA, 22 nt, Staphylococcus aureus subsp. aureus Mu50
aaccuuuuucacuugguuauga

SEQ ID NO: 44640 - RNA, 22 nt, Staphylococcus aureus subsp. aureus Mu50
aacgugaaaugcuuggauugau

SEQ ID NO: 44641 - RNA, 18 nt, Staphylococcus aureus subsp. aureus Mu50
aacuaucuuuucuaaugg

SEQ ID NO: 44642 - RNA, 22 nt, Staphylococcus aureus subsp. aureus Mu50
aacuuauucagaccggguacuu

SEQ ID NO: 44643 - RNA, 22 nt, Staphylococcus aureus subsp. aureus Mu50
aacuuauuuagauacaggucaa

SEQ ID NO: 44644 - RNA, 22 nt, Staphylococcus aureus subsp. aureus Mu50
aacuucagguggucuucacggu

SEQ ID NO: 44645 - RNA, 22 nt, Staphylococcus aureus subsp. aureus Mu50
aacuugauaugaagauucaucu

SEQ ID NO: 44646 - RNA, 22 nt, Staphylococcus aureus subsp. aureus Mu50
aagaagcugaagcgacuuuguc

SEQ ID NO: 44647 - RNA, 22 nt, Staphylococcus aureus subsp. aureus Mu50
aagauaauuuggcuauauugua

SEQ ID NO: 44648 - RNA, 22 nt, Staphylococcus aureus subsp. aureus Mu50
aagaucgauauugaaagugugu

SEQ ID NO: 44649 - RNA, 22 nt, Staphylococcus aureus subsp. aureus Mu50
aagaugauuuuuuuaggaagua

SEQ ID NO: 44650 - RNA, 22 nt, Staphylococcus aureus subsp. aureus Mu50
aagaugcacaacgcgguaugga

SEQ ID NO: 44651 - RNA, 22 nt, Staphylococcus aureus subsp. aureus Mu50
aagcaauugauauuacuaagug

SEQ ID NO: 44652 - RNA, 22 nt, Staphylococcus aureus subsp. aureus Mu50
aagcacuaugauaaugguauug

SEQ ID NO: 44653 - RNA, 18 nt, Staphylococcus aureus subsp. aureus Mu50
aagcaucaucgauaaugc

SEQ ID NO: 44654 - RNA, 22 nt, Staphylococcus aureus subsp. aureus Mu50
aagcaugguuuugguaaaguua

SEQ ID NO: 44655 - RNA, 22 nt, Staphylococcus aureus subsp. aureus Mu50
aagcgauuuuacuugaagauac

SEQ ID NO: 44656 - RNA, 22 nt, Staphylococcus aureus subsp. aureus Mu50
aagcgcauuuucauucagucaa

SEQ ID NO: 44657 - RNA, 22 nt, Staphylococcus aureus subsp. aureus Mu50
aagcuagauguuacaaauauua

SEQ ID NO: 44658 - RNA, 22 nt, Staphylococcus aureus subsp. aureus Mu50
aagcuuuuuucaauucuaguca

SEQ ID NO: 44659 - RNA, 17 nt, Staphylococcus aureus subsp. aureus Mu50
aaggaaaccuccaauua

SEQ ID NO: 44660 - RNA, 22 nt, Staphylococcus aureus subsp. aureus Mu50
aaggauacggaaucucuuguug

SEQ ID NO: 44661 - RNA, 22 nt, Staphylococcus aureus subsp. aureus Mu50
aaggggcauaugcuucuuuuuc

SEQ ID NO: 44662 - RNA, 22 nt, Staphylococcus aureus subsp. aureus Mu50
aaguaaauaccuggugcauaag

SEQ ID NO: 44663 - RNA, 22 nt, Staphylococcus aureus subsp. aureus Mu50
aaguaaaugaaaguugggguau

SEQ ID NO: 44664 - RNA, 22 nt, Staphylococcus aureus subsp. aureus Mu50
aaguacauuuaaucgcuagaaa

SEQ ID NO: 44665 - RNA, 22 nt, Staphylococcus aureus subsp. aureus Mu50
aagucaugguuaaucuugacga

SEQ ID NO: 44666 - RNA, 22 nt, Staphylococcus aureus subsp. aureus Mu50
aagugcauugucuaacguauuu

SEQ ID NO: 44667 - RNA, 22 nt, Staphylococcus aureus subsp. aureus Mu50
aagugcauuuucguucagucaa

SEQ ID NO: 44668 - RNA, 22 nt, Staphylococcus aureus subsp. aureus Mu50
aauaaucgguacaaagccuuua

SEQ ID NO: 44669 - RNA, 22 nt, Staphylococcus aureus subsp. aureus Mu50
aauaaucuagugcuuuauugau

SEQ ID NO: 44670 - RNA, 22 nt, Staphylococcus aureus subsp. aureus Mu50
aauagagaacagcaguaagacg

SEQ ID NO: 44671 - RNA, 22 nt, Staphylococcus aureus subsp. aureus Mu50
aauaguuguaccgacagcgccu

SEQ ID NO: 44672 - RNA, 20 nt, Staphylococcus aureus subsp. aureus Mu50
aauauaggugugguuguauu

SEQ ID NO: 44673 - RNA, 23 nt, Staphylococcus aureus subsp. aureus Mu50
aauaugguccaagugcuuccggu

SEQ ID NO: 44674 - RNA, 22 nt, Staphylococcus aureus subsp. aureus Mu50
aaugacugguuucagagucggu

SEQ ID NO: 44675 - RNA, 22 nt, Staphylococcus aureus subsp. aureus Mu50
aaugauggaugaaauuaacgaa

SEQ ID NO: 44676 - RNA, 22 nt, Staphylococcus aureus subsp. aureus Mu50
aaugcgauugcgccuaugauug

SEQ ID NO: 44677 - RNA, 22 nt, Staphylococcus aureus subsp. aureus Mu50
aauggcuaaagaacuuguugaa

SEQ ID NO: 44678 - RNA, 22 nt, Staphylococcus aureus subsp. aureus Mu50
aauguacauguaauauauuuga

SEQ ID NO: 44679 - RNA, 22 nt, Staphylococcus aureus subsp. aureus Mu50
aauguaucgcucguugauuuag

SEQ ID NO: 44680 - RNA, 22 nt, Staphylococcus aureus subsp. aureus Mu50
aaugucaugaaaguuuagcuuu

SEQ ID NO: 44681 - RNA, 23 nt, Staphylococcus aureus subsp. aureus Mu50
aaugucuuacugcuccuuuguau

SEQ ID NO: 44682 - RNA, 23 nt, Staphylococcus aureus subsp. aureus Mu50
aauguuuuguuaacuuggcggua

SEQ ID NO: 44683 - RNA, 22 nt, Staphylococcus aureus subsp. aureus Mu50
aauuccuuaaggaacguacaga

SEQ ID NO: 44684 - RNA, 22 nt, Staphylococcus aureus subsp. aureus Mu50
aauucuacaucaauccuacagg

SEQ ID NO: 44685 - RNA, 22 nt, Staphylococcus aureus subsp. aureus Mu50
aauugauaaccuucauuaagca

SEQ ID NO: 44686 - RNA, 22 nt, Staphylococcus aureus subsp. aureus Mu50
aauugauuucauggauguuucu

SEQ ID NO: 44687 - RNA, 23 nt, Staphylococcus aureus subsp. aureus Mu50
aauuuaucuauugacgaauugca

SEQ ID NO: 44688 - RNA, 22 nt, Staphylococcus aureus subsp. aureus Mu50
aauuuuaguagggacaacauug

SEQ ID NO: 44689 - RNA, 22 nt, Staphylococcus aureus subsp. aureus Mu50
acaaaagaggugccacaaacau

SEQ ID NO: 44690 - RNA, 22 nt, Staphylococcus aureus subsp. aureus Mu50
acaaaucauggucgcuauuguu

SEQ ID NO: 44691 - RNA, 22 nt, Staphylococcus aureus subsp. aureus Mu50
acaagcaaaaauagcggugauu

SEQ ID NO: 44692 - RNA, 22 nt, Staphylococcus aureus subsp. aureus Mu50
acaaugcguuagucgaugccuu

SEQ ID NO: 44693 - RNA, 22 nt, Staphylococcus aureus subsp. aureus Mu50
acacauggugaaaagacauuaa

SEQ ID NO: 44694 - RNA, 22 nt, Staphylococcus aureus subsp. aureus Mu50
acacgaucugcuguuguagguc

SEQ ID NO: 44695 - RNA, 22 nt, Staphylococcus aureus subsp. aureus Mu50
acacugcaaaauuggucgcuuu

SEQ ID NO: 44696 - RNA, 22 nt, Staphylococcus aureus subsp. aureus Mu50
acagaaauguagcuaacauuuu

SEQ ID NO: 44697 - RNA, 22 nt, Staphylococcus aureus subsp. aureus Mu50
acagaaucuacuauuguagguu

SEQ ID NO: 44698 - RNA, 22 nt, Staphylococcus aureus subsp. aureus Mu50
acagcuggugagauagguguca

SEQ ID NO: 44699 - RNA, 23 nt, Staphylococcus aureus subsp. aureus Mu50
acaggcauuuguuuuaucggcga

SEQ ID NO: 44700 - RNA, 22 nt, Staphylococcus aureus subsp. aureus Mu50
acaggugguaaaacuuguaugu

SEQ ID NO: 44701 - RNA, 22 nt, Staphylococcus aureus subsp. aureus Mu50
acagucauaaucauuucuugug

SEQ ID NO: 44702 - RNA, 22 nt, Staphylococcus aureus subsp. aureus Mu50
acauauugaaaaaugcaccuga

SEQ ID NO: 44703 - RNA, 22 nt, Staphylococcus aureus subsp. aureus Mu50
acaucacaaugauguacaugcu

SEQ ID NO: 44704 - RNA, 22 nt, Staphylococcus aureus subsp. aureus Mu50
acaucuaacaguaaacauuuag

SEQ ID NO: 44705 - RNA, 22 nt, Staphylococcus aureus subsp. aureus Mu50
acaugaaggaaaccacuuugau

SEQ ID NO: 44706 - RNA, 22 nt, Staphylococcus aureus subsp. aureus Mu50
accaagcacagaaagaugcauu

SEQ ID NO: 44707 - RNA, 22 nt, Staphylococcus aureus subsp. aureus Mu50
accauuauucugugaagguaaa

SEQ ID NO: 44708 - RNA, 22 nt, Staphylococcus aureus subsp. aureus Mu50
accauuuauggcaauuauuuac

SEQ ID NO: 44709 - RNA, 22 nt, Staphylococcus aureus subsp. aureus Mu50
accguugaaagaggacaaagau

SEQ ID NO: 44710 - RNA, 22 nt, Staphylococcus aureus subsp. aureus Mu50
accuuuauugauguaauccuuu

SEQ ID NO: 44711 - RNA, 22 nt, Staphylococcus aureus subsp. aureus Mu50
acgaaguauuacuacgagacuu

SEQ ID NO: 44712 - RNA, 22 nt, Staphylococcus aureus subsp. aureus Mu50
acgauaucaauuuaaguuugcc

SEQ ID NO: 44713 - RNA, 22 nt, Staphylococcus aureus subsp. aureus Mu50
acgauuugggaggaaauuuuau

SEQ ID NO: 44714 - RNA, 22 nt, Staphylococcus aureus subsp. aureus Mu50
acguuugacuuauaaaaauggu

SEQ ID NO: 44715 - RNA, 22 nt, Staphylococcus aureus subsp. aureus Mu50
acuaaauuauugggcguagguu

SEQ ID NO: 44716 - RNA, 22 nt, Staphylococcus aureus subsp. aureus Mu50
acuaauaucuucuuuauuuaca

SEQ ID NO: 44717 - RNA, 22 nt, Staphylococcus aureus subsp. aureus Mu50
acuauagaauguauggugucaa

SEQ ID NO: 44718 - RNA, 22 nt, Staphylococcus aureus subsp. aureus Mu50
acugauacaguguuugacuggu

SEQ ID NO: 44719 - RNA, 22 nt, Staphylococcus aureus subsp. aureus Mu50
acugcugcgagagauaacgaua

SEQ ID NO: 44720 - RNA, 23 nt, Staphylococcus aureus subsp. aureus Mu50
acuuuauagggcgcacauuauuu

SEQ ID NO: 44721 - RNA, 19 nt, Staphylococcus aureus subsp. aureus Mu50
acuuugaagggagcauuuc

SEQ ID NO: 44722 - RNA, 22 nt, Staphylococcus aureus subsp. aureus Mu50
agaaaaaggauuggucgaauga

SEQ ID NO: 44723 - RNA, 22 nt, Staphylococcus aureus subsp. aureus Mu50
agaaagugcgguuauuuauaca

SEQ ID NO: 44724 - RNA, 22 nt, Staphylococcus aureus subsp. aureus Mu50
agaaugucucauuucauuaacu

SEQ ID NO: 44725 - RNA, 22 nt, Staphylococcus aureus subsp. aureus Mu50
agacauugaaauuguugaagaa

SEQ ID NO: 44726 - RNA, 20 nt, Staphylococcus aureus subsp. aureus Mu50
agaccucuguuuuuuggugu

SEQ ID NO: 44727 - RNA, 22 nt, Staphylococcus aureus subsp. aureus Mu50
agacguguauccaauuaaccga

SEQ ID NO: 44728 - RNA, 22 nt, Staphylococcus aureus subsp. aureus Mu50
agauauccauuaugauguagau

SEQ ID NO: 44729 - RNA, 22 nt, Staphylococcus aureus subsp. aureus Mu50
agauauuguugauauggcauuu

SEQ ID NO: 44730 - RNA, 22 nt, Staphylococcus aureus subsp. aureus Mu50
agauauuuuguacggugugaua

SEQ ID NO: 44731 - RNA, 22 nt, Staphylococcus aureus subsp. aureus Mu50
agcaagugauuugccuaauguu

SEQ ID NO: 44732 - RNA, 22 nt, Staphylococcus aureus subsp. aureus Mu50
agcaguaugcgagcgcuugacu

SEQ ID NO: 44733 - RNA, 22 nt, Staphylococcus aureus subsp. aureus Mu50
agcaucuuguagucguugauca

SEQ ID NO: 44734 - RNA, 22 nt, Staphylococcus aureus subsp. aureus Mu50
agcaugauacucaauaaaauug

SEQ ID NO: 44735 - RNA, 21 nt, Staphylococcus aureus subsp. aureus Mu50
agcauuuuuuaauuggaauga

SEQ ID NO: 44736 - RNA, 22 nt, Staphylococcus aureus subsp. aureus Mu50
agccuguauacguuugaguggu

SEQ ID NO: 44737 - RNA, 22 nt, Staphylococcus aureus subsp. aureus Mu50
agcgauaucacuacuauucauu

SEQ ID NO: 44738 - RNA, 22 nt, Staphylococcus aureus subsp. aureus Mu50
agcgguuuaugugaugauuuua

SEQ ID NO: 44739 - RNA, 22 nt, Staphylococcus aureus subsp. aureus Mu50
agcuaacaaaagcauaugauuu

SEQ ID NO: 44740 - RNA, 22 nt, Staphylococcus aureus subsp. aureus Mu50
agcuagaaguugaugagccauu

SEQ ID NO: 44741 - RNA, 22 nt, Staphylococcus aureus subsp. aureus Mu50
agcuggaacuggaacuaaugau

SEQ ID NO: 44742 - RNA, 22 nt, Staphylococcus aureus subsp. aureus Mu50
agcuguuguagcagguguaguu

SEQ ID NO: 44743 - RNA, 22 nt, Staphylococcus aureus subsp. aureus Mu50
agcuuaaaauauuauugauucc

SEQ ID NO: 44744 - RNA, 20 nt, Staphylococcus aureus subsp. aureus Mu50
agcuuugucauaauaugcgu

SEQ ID NO: 44745 - RNA, 22 nt, Staphylococcus aureus subsp. aureus Mu50
agcuuuugguguauuguucacu

SEQ ID NO: 44746 - RNA, 22 nt, Staphylococcus aureus subsp. aureus Mu50
aggcgaauggcuuucaauaaaa

SEQ ID NO: 44747 - RNA, 22 nt, Staphylococcus aureus subsp. aureus Mu50
aggcggcaguacaauaugguua

SEQ ID NO: 44748 - RNA, 22 nt, Staphylococcus aureus subsp. aureus Mu50
agguacguuaaucgguuuugga

SEQ ID NO: 44749 - RNA, 22 nt, Staphylococcus aureus subsp. aureus Mu50
aggugcuaaaaucaacgauuga

SEQ ID NO: 44750 - RNA, 22 nt, Staphylococcus aureus subsp. aureus Mu50
agguuuaacauuauuacaaauc

SEQ ID NO: 44751 - RNA, 22 nt, Staphylococcus aureus subsp. aureus Mu50
aguauaucaucuggugcugaug

SEQ ID NO: 44752 - RNA, 22 nt, Staphylococcus aureus subsp. aureus Mu50
agucagaaggagugguguuauu

SEQ ID NO: 44753 - RNA, 22 nt, Staphylococcus aureus subsp. aureus Mu50
agucaguaaaaagaccucguua

SEQ ID NO: 44754 - RNA, 22 nt, Staphylococcus aureus subsp. aureus Mu50
agucaucgauuuauuaguuaaa

SEQ ID NO: 44755 - RNA, 22 nt, Staphylococcus aureus subsp. aureus Mu50
agugauggcauaggacaaucgg

SEQ ID NO: 44756 - RNA, 22 nt, Staphylococcus aureus subsp. aureus Mu50
aguguauugguauagcauuuca

SEQ ID NO: 44757 - RNA, 22 nt, Staphylococcus aureus subsp. aureus Mu50
aguuauaacgaaguuauuaugc

SEQ ID NO: 44758 - RNA, 22 nt, Staphylococcus aureus subsp. aureus Mu50
aguuaugaguuaacaaauguua

SEQ ID NO: 44759 - RNA, 22 nt, Staphylococcus aureus subsp. aureus Mu50
aguugcugcauuauugauuuga

SEQ ID NO: 44760 - RNA, 22 nt, Staphylococcus aureus subsp. aureus Mu50
aguuugaaugauaacucauugc

SEQ ID NO: 44761 - RNA, 22 nt, Staphylococcus aureus subsp. aureus Mu50
auaaauguuaauagcgucagua

SEQ ID NO: 44762 - RNA, 22 nt, Staphylococcus aureus subsp. aureus Mu50
auaacaaagcgcuugcuaguac

SEQ ID NO: 44763 - RNA, 22 nt, Staphylococcus aureus subsp. aureus Mu50
auaacaaugugaugauuaguga

SEQ ID NO: 44764 - RNA, 22 nt, Staphylococcus aureus subsp. aureus Mu50
auaauaagucgaauugaauaug

SEQ ID NO: 44765 - RNA, 22 nt, Staphylococcus aureus subsp. aureus Mu50
auacauuagugucgauucguuu

SEQ ID NO: 44766 - RNA, 18 nt, Staphylococcus aureus subsp. aureus Mu50
auacauugauuuacaccu

SEQ ID NO: 44767 - RNA, 22 nt, Staphylococcus aureus subsp. aureus Mu50
auacauuugcuuggugacuagg

SEQ ID NO: 44768 - RNA, 22 nt, Staphylococcus aureus subsp. aureus Mu50
auagugaguuuguuacauauug

SEQ ID NO: 44769 - RNA, 22 nt, Staphylococcus aureus subsp. aureus Mu50
auauacaccccaaaaguuggau

SEQ ID NO: 44770 - RNA, 22 nt, Staphylococcus aureus subsp. aureus Mu50
auauacauuuuuaaauggcgau

SEQ ID NO: 44771 - RNA, 22 nt, Staphylococcus aureus subsp. aureus Mu50
auauagauuaaaccgcacuucu

SEQ ID NO: 44772 - RNA, 22 nt, Staphylococcus aureus subsp. aureus Mu50
auauagcguucucgcauaagua

SEQ ID NO: 44773 - RNA, 22 nt, Staphylococcus aureus subsp. aureus Mu50
auaucgcucauauguugcgaau

SEQ ID NO: 44774 - RNA, 22 nt, Staphylococcus aureus subsp. aureus Mu50
auaucguugcauucuuauaccg

SEQ ID NO: 44775 - RNA, 22 nt, Staphylococcus aureus subsp. aureus Mu50
auaugaaacuacucauuugaag

SEQ ID NO: 44776 - RNA, 22 nt, Staphylococcus aureus subsp. aureus Mu50
auaugguugaacuuauaagaga

SEQ ID NO: 44777 - RNA, 22 nt, Staphylococcus aureus subsp. aureus Mu50
auaugucauuuguaacgcguuu

SEQ ID NO: 44778 - RNA, 22 nt, Staphylococcus aureus subsp. aureus Mu50
auauuuaauguuaaggauguug

SEQ ID NO: 44779 - RNA, 22 nt, Staphylococcus aureus subsp. aureus Mu50
auauuugcuaaaaauacuuuga

SEQ ID NO: 44780 - RNA, 22 nt, Staphylococcus aureus subsp. aureus Mu50
aucaauauuuuuaaugugugua

SEQ ID NO: 44781 - RNA, 22 nt, Staphylococcus aureus subsp. aureus Mu50
aucacguuugcauacaaauccg

SEQ ID NO: 44782 - RNA, 22 nt, Staphylococcus aureus subsp. aureus Mu50
aucaguuaccacuuuuuauugu

SEQ ID NO: 44783 - RNA, 22 nt, Staphylococcus aureus subsp. aureus Mu50
aucauagcgucugaucuagagu

SEQ ID NO: 44784 - RNA, 22 nt, Staphylococcus aureus subsp. aureus Mu50
aucauuuuuuaguagcguuuga

SEQ ID NO: 44785 - RNA, 22 nt, Staphylococcus aureus subsp. aureus Mu50
aucgaauuuuugaauaguuggu

SEQ ID NO: 44786 - RNA, 22 nt, Staphylococcus aureus subsp. aureus Mu50
aucgauggcuuuaaagauacgg

SEQ ID NO: 44787 - RNA, 22 nt, Staphylococcus aureus subsp. aureus Mu50
aucuaaauacaccaaauccccu

SEQ ID NO: 44788 - RNA, 22 nt, Staphylococcus aureus subsp. aureus Mu50
aucugauggaucuggaucugua

SEQ ID NO: 44789 - RNA, 22 nt, Staphylococcus aureus subsp. aureus Mu50
aucugcaacauauugaucaauu

SEQ ID NO: 44790 - RNA, 22 nt, Staphylococcus aureus subsp. aureus Mu50
augacguacacuuuuagucgcc

SEQ ID NO: 44791 - RNA, 22 nt, Staphylococcus aureus subsp. aureus Mu50
augagagucacccuauaaaguu

SEQ ID NO: 44792 - RNA, 22 nt, Staphylococcus aureus subsp. aureus Mu50
augagcgaaugacaaggauuga

SEQ ID NO: 44793 - RNA, 22 nt, Staphylococcus aureus subsp. aureus Mu50
augaguuaaauuaagcugugau

SEQ ID NO: 44794 - RNA, 22 nt, Staphylococcus aureus subsp. aureus Mu50
augaguuauuaaauuuagauga

SEQ ID NO: 44795 - RNA, 22 nt, Staphylococcus aureus subsp. aureus Mu50
augauguuaaaaaucaucuuau

SEQ ID NO: 44796 - RNA, 20 nt, Staphylococcus aureus subsp. aureus Mu50
augcaacuacuguagcuggu

SEQ ID NO: 44797 - RNA, 22 nt, Staphylococcus aureus subsp. aureus Mu50
augcacgauuaucuuuaucucu

SEQ ID NO: 44798 - RNA, 22 nt, Staphylococcus aureus subsp. aureus Mu50
augcauacguguuuaguuuguc

SEQ ID NO: 44799 - RNA, 21 nt, Staphylococcus aureus subsp. aureus Mu50
augcaucuuucugugcuuggu

SEQ ID NO: 44800 - RNA, 22 nt, Staphylococcus aureus subsp. aureus Mu50
augccaaauacuaucgaggcga

SEQ ID NO: 44801 - RNA, 22 nt, Staphylococcus aureus subsp. aureus Mu50
augcgacaaaaguauuuacgua

SEQ ID NO: 44802 - RNA, 22 nt, Staphylococcus aureus subsp. aureus Mu50
augcuaucaaguuuagcaagcg

SEQ ID NO: 44803 - RNA, 22 nt, Staphylococcus aureus subsp. aureus Mu50
augcugauuuuggugauguuac

SEQ ID NO: 44804 - RNA, 22 nt, Staphylococcus aureus subsp. aureus Mu50
auggacaaauauuccauuggca

SEQ ID NO: 44805 - RNA, 22 nt, Staphylococcus aureus subsp. aureus Mu50
auggaugguugugauuuaucaa

SEQ ID NO: 44806 - RNA, 22 nt, Staphylococcus aureus subsp. aureus Mu50
auggcgaccauuaucgauggua

SEQ ID NO: 44807 - RNA, 22 nt, Staphylococcus aureus subsp. aureus Mu50
auggcuaaaaagauuaacgcga

SEQ ID NO: 44808 - RNA, 22 nt, Staphylococcus aureus subsp. aureus Mu50
augguacucguuggcauuguug

SEQ ID NO: 44809 - RNA, 22 nt, Staphylococcus aureus subsp. aureus Mu50
augguuaacacaugauuucaau

SEQ ID NO: 44810 - RNA, 22 nt, Staphylococcus aureus subsp. aureus Mu50
auguagcgauucuuuaucauua

SEQ ID NO: 44811 - RNA, 22 nt, Staphylococcus aureus subsp. aureus Mu50
auguaguacauaaaaaagagcg

SEQ ID NO: 44812 - RNA, 22 nt, Staphylococcus aureus subsp. aureus Mu50
augucauuuauucgugguguug

SEQ ID NO: 44813 - RNA, 22 nt, Staphylococcus aureus subsp. aureus Mu50
auguguuagucagauagcacua

SEQ ID NO: 44814 - RNA, 22 nt, Staphylococcus aureus subsp. aureus Mu50
ucagcauuguaaugaucugaaa

SEQ ID NO: 44815 - RNA, 22 nt, Staphylococcus aureus subsp. aureus Mu50
ucagucguuucaacauuuguau

SEQ ID NO: 44816 - RNA, 19 nt, Staphylococcus aureus subsp. aureus Mu50
ucauagugguuuaugcguc

SEQ ID NO: 44817 - RNA, 22 nt, Staphylococcus aureus subsp. aureus Mu50
ucaugauuaaaauauguaccug

SEQ ID NO: 44818 - RNA, 22 nt, Staphylococcus aureus subsp. aureus Mu50
ucauguucaauugucuuauauu

SEQ ID NO: 44819 - RNA, 22 nt, Staphylococcus aureus subsp. aureus Mu50
ucauuaaugucuacguaugaau

SEQ ID NO: 44820 - RNA, 19 nt, Staphylococcus aureus subsp. aureus Mu50
ucauuuuucuaaggggaug

SEQ ID NO: 44821 - RNA, 22 nt, Staphylococcus aureus subsp. aureus Mu50
uccaaugucuucuuggcauuuu

SEQ ID NO: 44822 - RNA, 22 nt, Staphylococcus aureus subsp. aureus Mu50
ucgaacaagauauugccaauuu

SEQ ID NO: 44823 - RNA, 22 nt, Staphylococcus aureus subsp. aureus Mu50
ucggcauuuuaauuguaauauu

SEQ ID NO: 44824 - RNA, 22 nt, Staphylococcus aureus subsp. aureus Mu50
ucguaaucguauaaaguuuuaa

SEQ ID NO: 44825 - RNA, 22 nt, Staphylococcus aureus subsp. aureus Mu50
ucguugaucauuuaaagcaugc

SEQ ID NO: 44826 - RNA, 19 nt, Staphylococcus aureus subsp. aureus Mu50
ucguuggagcgaauggugc

SEQ ID NO: 44827 - RNA, 22 nt, Staphylococcus aureus subsp. aureus Mu50
ucguuuuaaauagauaaacaaa

SEQ ID NO: 44828 - RNA, 22 nt, Staphylococcus aureus subsp. aureus Mu50
ucuauggaucaacuugcagcau

SEQ ID NO: 44829 - RNA, 20 nt, Staphylococcus aureus subsp. aureus Mu50
ucuccaacgugcgaauaagu

SEQ ID NO: 44830 - RNA, 22 nt, Staphylococcus aureus subsp. aureus Mu50
ucuccuacauguugaaggucuu

SEQ ID NO: 44831 - RNA, 17 nt, Staphylococcus aureus subsp. aureus Mu50
ucugacucgauguuuuu

SEQ ID NO: 44832 - RNA, 22 nt, Staphylococcus aureus subsp. aureus Mu50
ucugauauuagagcugcuggug

SEQ ID NO: 44833 - RNA, 22 nt, Staphylococcus aureus subsp. aureus Mu50
ucuuauggugagguguuuauuu

SEQ ID NO: 44834 - RNA, 22 nt, Staphylococcus aureus subsp. aureus Mu50
ucuuuauaaaaacuugucacaa

SEQ ID NO: 44835 - RNA, 22 nt, Staphylococcus aureus subsp. aureus Mu50
ucuuuuuagaacuuuguugaau

SEQ ID NO: 44836 - RNA, 22 nt, Staphylococcus aureus subsp. aureus Mu50
ugaaagcauuuaucgaacauug

SEQ ID NO: 44837 - RNA, 22 nt, Staphylococcus aureus subsp. aureus Mu50
ugaaauauaaaauuguuugagg

SEQ ID NO: 44838 - RNA, 22 nt, Staphylococcus aureus subsp. aureus Mu50
ugaauaagaaaucggacuuaug

SEQ ID NO: 44839 - RNA, 22 nt, Staphylococcus aureus subsp. aureus Mu50
ugaaucauauaagcacuacugc

SEQ ID NO: 44840 - RNA, 22 nt, Staphylococcus aureus subsp. aureus Mu50
ugaauuacuuugaagggauugu

SEQ ID NO: 44841 - RNA, 22 nt, Staphylococcus aureus subsp. aureus Mu50
ugacagaucaaauuuuucuaaa

SEQ ID NO: 44842 - RNA, 22 nt, Staphylococcus aureus subsp. aureus Mu50
ugacaugaaaacguaauugggu

SEQ ID NO: 44843 - RNA, 22 nt, Staphylococcus aureus subsp. aureus Mu50
ugacuagaauugaaaaaagcuu

SEQ ID NO: 44844 - RNA, 22 nt, Staphylococcus aureus subsp. aureus Mu50
ugacuagaguugaaaaaagcuu

SEQ ID NO: 44845 - RNA, 22 nt, Staphylococcus aureus subsp. aureus Mu50
ugauacagauaaaguauaggga

SEQ ID NO: 44846 - RNA, 22 nt, Staphylococcus aureus subsp. aureus Mu50
ugauacguauaugacacuugcu

SEQ ID NO: 44847 - RNA, 23 nt, Staphylococcus aureus subsp. aureus Mu50
ugauauaguucagaaauguuugg

SEQ ID NO: 44848 - RNA, 22 nt, Staphylococcus aureus subsp. aureus Mu50
ugauaugcauuuauugucugag

SEQ ID NO: 44849 - RNA, 20 nt, Staphylococcus aureus subsp. aureus Mu50
ugauauguuacauguaacac

SEQ ID NO: 44850 - RNA, 22 nt, Staphylococcus aureus subsp. aureus Mu50
ugaugcauuaagaguauaggga

SEQ ID NO: 44851 - RNA, 22 nt, Staphylococcus aureus subsp. aureus Mu50
ugaugcuaagaauuuuaguaag

SEQ ID NO: 44852 - RNA, 22 nt, Staphylococcus aureus subsp. aureus Mu50
ugauggugguaauacaaacuau

SEQ ID NO: 44853 - RNA, 22 nt, Staphylococcus aureus subsp. aureus Mu50
ugauugaaaauguaaauuauuu

SEQ ID NO: 44854 - RNA, 22 nt, Staphylococcus aureus subsp. aureus Mu50
ugauugguggguuuuucuucaa

SEQ ID NO: 44855 - RNA, 22 nt, Staphylococcus aureus subsp. aureus Mu50
ugauuuauucgcagcuguagga

SEQ ID NO: 44856 - RNA, 22 nt, Staphylococcus aureus subsp. aureus Mu50
ugauuucgcccaccgcguguuu

SEQ ID NO: 44857 - RNA, 21 nt, Staphylococcus aureus subsp. aureus Mu50
ugcagguguagacauuacuac

SEQ ID NO: 44858 - RNA, 22 nt, Staphylococcus aureus subsp. aureus Mu50
ugcaguuagaaagaaagccacu

SEQ ID NO: 44859 - RNA, 22 nt, Staphylococcus aureus subsp. aureus Mu50
ugcaucauugacugcuuggauu

SEQ ID NO: 44860 - RNA, 22 nt, Staphylococcus aureus subsp. aureus Mu50
ugcaugaugaacuguuugucuu

SEQ ID NO: 44861 - RNA, 22 nt, Staphylococcus aureus subsp. aureus Mu50
ugcauuaauugucuuugaaaaa

SEQ ID NO: 44862 - RNA, 22 nt, Staphylococcus aureus subsp. aureus Mu50
ugccuuauauucagauguaaac

SEQ ID NO: 44863 - RNA, 22 nt, Staphylococcus aureus subsp. aureus Mu50
ugcgaauguacuuuuacuugac

SEQ ID NO: 44864 - RNA, 22 nt, Staphylococcus aureus subsp. aureus Mu50
ugcuaaaccuucauaucauagc

SEQ ID NO: 44865 - RNA, 22 nt, Staphylococcus aureus subsp. aureus Mu50
ugcuacaaacgcuugugcauua

SEQ ID NO: 44866 - RNA, 21 nt, Staphylococcus aureus subsp. aureus Mu50
ugcuagcaagcgcuuuucuau

SEQ ID NO: 44867 - RNA, 22 nt, Staphylococcus aureus subsp. aureus Mu50
ugcuuggcguaaguauucaaaa

SEQ ID NO: 44868 - RNA, 22 nt, Staphylococcus aureus subsp. aureus Mu50
uggauaauuguguuacaagaau

SEQ ID NO: 44869 - RNA, 19 nt, Staphylococcus aureus subsp. aureus Mu50
uggauuauuaugccuuuga

SEQ ID NO: 44870 - RNA, 23 nt, Staphylococcus aureus subsp. aureus Mu50
uggcuccguuucauuacguaaua

SEQ ID NO: 44871 - RNA, 22 nt, Staphylococcus aureus subsp. aureus Mu50
uggcuucaaugguauuuuuauu

SEQ ID NO: 44872 - RNA, 22 nt, Staphylococcus aureus subsp. aureus Mu50
ugggagugggacagaaaugaua

SEQ ID NO: 44873 - RNA, 22 nt, Staphylococcus aureus subsp. aureus Mu50
ugggggaguugaaugauaaaua

SEQ ID NO: 44874 - RNA, 22 nt, Staphylococcus aureus subsp. aureus Mu50
uggggugggacgacgaaauaua

SEQ ID NO: 44875 - RNA, 22 nt, Staphylococcus aureus subsp. aureus Mu50
uggguauuucuguuguaagugg

SEQ ID NO: 44876 - RNA, 22 nt, Staphylococcus aureus subsp. aureus Mu50
ugguaaaucaauuauuaaacuu

SEQ ID NO: 44877 - RNA, 22 nt, Staphylococcus aureus subsp. aureus Mu50
ugguacauguggagguacuuga

SEQ ID NO: 44878 - RNA, 22 nt, Staphylococcus aureus subsp. aureus Mu50
ugguaguuuaguucuaggauua

SEQ ID NO: 44879 - RNA, 22 nt, Staphylococcus aureus subsp. aureus Mu50
ugguauuccagaauuagguaga

SEQ ID NO: 44880 - RNA, 22 nt, Staphylococcus aureus subsp. aureus Mu50
uggugguauugcuuacguuauc

SEQ ID NO: 44881 - RNA, 20 nt, Staphylococcus aureus subsp. aureus Mu50
uguaacacaaaugaaaauug

SEQ ID NO: 44882 - RNA, 22 nt, Staphylococcus aureus subsp. aureus Mu50
uguaagacaacauuugaacguu

SEQ ID NO: 44883 - RNA, 17 nt, Staphylococcus aureus subsp. aureus Mu50
uguacaucauugugaug

SEQ ID NO: 44884 - RNA, 22 nt, Staphylococcus aureus subsp. aureus Mu50
uguagcaagaacauuaucuguc

SEQ ID NO: 44885 - RNA, 22 nt, Staphylococcus aureus subsp. aureus Mu50
uguagguauucgauuggauucu

SEQ ID NO: 44886 - RNA, 22 nt, Staphylococcus aureus subsp. aureus Mu50
ugucaauauuggccuucauucc

SEQ ID NO: 44887 - RNA, 22 nt, Staphylococcus aureus subsp. aureus Mu50
ugucguaacuuguacgcaugaa

SEQ ID NO: 44888 - RNA, 22 nt, Staphylococcus aureus subsp. aureus Mu50
ugucuacaguugcagguggauu

SEQ ID NO: 44889 - RNA, 22 nt, Staphylococcus aureus subsp. aureus Mu50
ugucuacuuuauagggagcaua

SEQ ID NO: 44890 - RNA, 22 nt, Staphylococcus aureus subsp. aureus Mu50
ugucuaugugaguauugaaaau

SEQ ID NO: 44891 - RNA, 22 nt, Staphylococcus aureus subsp. aureus Mu50
ugucuuacugcuguuuuuaggu

SEQ ID NO: 44892 - RNA, 22 nt, Staphylococcus aureus subsp. aureus Mu50
ugugaauaagcucccuucaaag

SEQ ID NO: 44893 - RNA, 22 nt, Staphylococcus aureus subsp. aureus Mu50
ugugcaugauauuaaggcuuug

SEQ ID NO: 44894 - RNA, 23 nt, Staphylococcus aureus subsp. aureus Mu50
ugugccauuugaaaauguuauga

SEQ ID NO: 44895 - RNA, 22 nt, Staphylococcus aureus subsp. aureus Mu50
uguggguacgauuaugauugca

SEQ ID NO: 44896 - RNA, 22 nt, Staphylococcus aureus subsp. aureus Mu50
uguuaauuggaacaggaguucu

SEQ ID NO: 44897 - RNA, 22 nt, Staphylococcus aureus subsp. aureus Mu50
uguucaaguaacauaucaguaa

SEQ ID NO: 44898 - RNA, 22 nt, Staphylococcus aureus subsp. aureus Mu50
uguugaauaaauacguacaucc

SEQ ID NO: 44899 - RNA, 22 nt, Staphylococcus aureus subsp. aureus Mu50
uguuuaaucgcuuguugaccug

SEQ ID NO: 44900 - RNA, 22 nt, Staphylococcus aureus subsp. aureus Mu50
uguuugaaucgguaaaguugau

SEQ ID NO: 44901 - RNA, 22 nt, Staphylococcus aureus subsp. aureus Mu50
uguuuuauauccaccccacgau

SEQ ID NO: 44902 - RNA, 22 nt, Staphylococcus aureus subsp. aureus Mu50
uuaaaggcauaauaaccauagu

SEQ ID NO: 44903 - RNA, 22 nt, Staphylococcus aureus subsp. aureus Mu50
uuaagguuagagucauuuggau

SEQ ID NO: 44904 - RNA, 19 nt, Staphylococcus aureus subsp. aureus Mu50
uuaagugucuaucaagcau

SEQ ID NO: 44905 - RNA, 22 nt, Staphylococcus aureus subsp. aureus Mu50
uuaaguuuuuaauauggagaug

SEQ ID NO: 44906 - RNA, 22 nt, Staphylococcus aureus subsp. aureus Mu50
uuaaucaagcuaugauggaauu

SEQ ID NO: 44907 - RNA, 17 nt, Staphylococcus aureus subsp. aureus Mu50
uuaaucuuuucggucau

SEQ ID NO: 44908 - RNA, 22 nt, Staphylococcus aureus subsp. aureus Mu50
uuaaugauguaaugaaauuagu

SEQ ID NO: 44909 - RNA, 22 nt, Staphylococcus aureus subsp. aureus Mu50
uuacuaguaauuaucagcauuu

SEQ ID NO: 44910 - RNA, 22 nt, Staphylococcus aureus subsp. aureus Mu50
uuagaagcgcaccuacuauugc

SEQ ID NO: 44911 - RNA, 22 nt, Staphylococcus aureus subsp. aureus Mu50
uuagaucaagcgaugaauacgu

SEQ ID NO: 44912 - RNA, 22 nt, Staphylococcus aureus subsp. aureus Mu50
uuaggaguguggcagagaugaa

SEQ ID NO: 44913 - RNA, 22 nt, Staphylococcus aureus subsp. aureus Mu50
uuaggauuccaucuaauucggu

SEQ ID NO: 44914 - RNA, 21 nt, Staphylococcus aureus subsp. aureus Mu50
uuauaugcugauaugaggcuu

SEQ ID NO: 44915 - RNA, 22 nt, Staphylococcus aureus subsp. aureus Mu50
uuauccaguuuugugcgcuaau

SEQ ID NO: 44916 - RNA, 22 nt, Staphylococcus aureus subsp. aureus Mu50
uuaugcaaaguaaugauaugaa

SEQ ID NO: 44917 - RNA, 22 nt, Staphylococcus aureus subsp. aureus Mu50
uuauggguauaguuugcuauug

SEQ ID NO: 44918 - RNA, 22 nt, Staphylococcus aureus subsp. aureus Mu50
uuaugguaaagcugaaaguuua

SEQ ID NO: 44919 - RNA, 22 nt, Staphylococcus aureus subsp. aureus Mu50
uuauuagccgcuucaaucaugc

SEQ ID NO: 44920 - RNA, 22 nt, Staphylococcus aureus subsp. aureus Mu50
uuauucgauauaacacaucaaa

SEQ ID NO: 44921 - RNA, 22 nt, Staphylococcus aureus subsp. aureus Mu50
uuauucgcuuaacguuuuguug

SEQ ID NO: 44922 - RNA, 22 nt, Staphylococcus aureus subsp. aureus Mu50
uuauuucgucgucccaccccaa

SEQ ID NO: 44923 - RNA, 22 nt, Staphylococcus aureus subsp. aureus Mu50
uucaaaugcgaaacgcuggaau

SEQ ID NO: 44924 - RNA, 22 nt, Staphylococcus aureus subsp. aureus Mu50
uucaacauuugauguugagaug

SEQ ID NO: 44925 - RNA, 22 nt, Staphylococcus aureus subsp. aureus Mu50
uucaaccauguugcugagucau

SEQ ID NO: 44926 - RNA, 22 nt, Staphylococcus aureus subsp. aureus Mu50
uucaaggauaacggauaauacu

SEQ ID NO: 44927 - RNA, 22 nt, Staphylococcus aureus subsp. aureus Mu50
uucaauacacauuuagauuuaa

SEQ ID NO: 44928 - RNA, 22 nt, Staphylococcus aureus subsp. aureus Mu50
uucagcagcgacagcauguauu

SEQ ID NO: 44929 - RNA, 22 nt, Staphylococcus aureus subsp. aureus Mu50
uucaguuaauuuuugugcuacu

SEQ ID NO: 44930 - RNA, 22 nt, Staphylococcus aureus subsp. aureus Mu50
uucaguugguucuucaguugga

SEQ ID NO: 44931 - RNA, 23 nt, Staphylococcus aureus subsp. aureus Mu50
uucauacauuacuuuggaguaau

SEQ ID NO: 44932 - RNA, 17 nt, Staphylococcus aureus subsp. aureus Mu50
uucauaucauuacuuug

SEQ ID NO: 44933 - RNA, 22 nt, Staphylococcus aureus subsp. aureus Mu50
uucauuacauguuacugaugaa

SEQ ID NO: 44934 - RNA, 22 nt, Staphylococcus aureus subsp. aureus Mu50
uuccaaagagugagugguaucu

SEQ ID NO: 44935 - RNA, 18 nt, Staphylococcus aureus subsp. aureus Mu50
uucgaccaauccuuuucu

SEQ ID NO: 44936 - RNA, 22 nt, Staphylococcus aureus subsp. aureus Mu50
uucuagaugaguuucuuagaug

SEQ ID NO: 44937 - RNA, 22 nt, Staphylococcus aureus subsp. aureus Mu50
uucuauccagauaaagaauggg

SEQ ID NO: 44938 - RNA, 23 nt, Staphylococcus aureus subsp. aureus Mu50
uucuauggagggauuuuccguga

SEQ ID NO: 44939 - RNA, 21 nt, Staphylococcus aureus subsp. aureus Mu50
uugaagggagccuuauuuaug

SEQ ID NO: 44940 - RNA, 22 nt, Staphylococcus aureus subsp. aureus Mu50
uugacauuacgacagcacuugu

SEQ ID NO: 44941 - RNA, 22 nt, Staphylococcus aureus subsp. aureus Mu50
uugacugaaugaaaaugcgcuu

SEQ ID NO: 44942 - RNA, 22 nt, Staphylococcus aureus subsp. aureus Mu50
uugacugugauuuggaguguau

SEQ ID NO: 44943 - RNA, 23 nt, Staphylococcus aureus subsp. aureus Mu50
uugagucgugauuugauuauguu

SEQ ID NO: 44944 - RNA, 22 nt, Staphylococcus aureus subsp. aureus Mu50
uugauacagcugguacauuagu

SEQ ID NO: 44945 - RNA, 22 nt, Staphylococcus aureus subsp. aureus Mu50
uugauuaugacuucggaauuga

SEQ ID NO: 44946 - RNA, 22 nt, Staphylococcus aureus subsp. aureus Mu50
uugauuuuauugaagcaucaaa

SEQ ID NO: 44947 - RNA, 22 nt, Staphylococcus aureus subsp. aureus Mu50
uugcaaggucguuuuccgauua

SEQ ID NO: 44948 - RNA, 22 nt, Staphylococcus aureus subsp. aureus Mu50
uugcugaagaacaaggacuugu

SEQ ID NO: 44949 - RNA, 22 nt, Staphylococcus aureus subsp. aureus Mu50
uugguaaguauuuaagugaagu

SEQ ID NO: 44950 - RNA, 22 nt, Staphylococcus aureus subsp. aureus Mu50
uuggugguaaugagaucauugc

SEQ ID NO: 44951 - RNA, 22 nt, Staphylococcus aureus subsp. aureus Mu50
uuguaaauguuuuaccuuucgc

SEQ ID NO: 44952 - RNA, 22 nt, Staphylococcus aureus subsp. aureus Mu50
uuguaacgaugauacaagaugu

SEQ ID NO: 44953 - RNA, 22 nt, Staphylococcus aureus subsp. aureus Mu50
uuguagauaaauuagcguuguu

SEQ ID NO: 44954 - RNA, 22 nt, Staphylococcus aureus subsp. aureus Mu50
uuguccuaacgaguugcuaggu

SEQ ID NO: 44955 - RNA, 22 nt, Staphylococcus aureus subsp. aureus Mu50
uugucgauugugauccauuacg

SEQ ID NO: 44956 - RNA, 22 nt, Staphylococcus aureus subsp. aureus Mu50
uugugagcggaucguuaguacu

SEQ ID NO: 44957 - RNA, 22 nt, Staphylococcus aureus subsp. aureus Mu50
uuguguuguuguacgaucaucu

SEQ ID NO: 44958 - RNA, 22 nt, Staphylococcus aureus subsp. aureus Mu50
uuguuauuuagcuuugcaucgu

SEQ ID NO: 44959 - RNA, 22 nt, Staphylococcus aureus subsp. aureus Mu50
uuguucagacguuuguucaucu

SEQ ID NO: 44960 - RNA, 22 nt, Staphylococcus aureus subsp. aureus Mu50
auguuuaucguugguguuugga

SEQ ID NO: 44961 - RNA, 22 nt, Staphylococcus aureus subsp. aureus Mu50
auuaaagauuaaagauuggggc

SEQ ID NO: 44962 - RNA, 22 nt, Staphylococcus aureus subsp. aureus Mu50
auuaaguauugacgauagaggc

SEQ ID NO: 44963 - RNA, 22 nt, Staphylococcus aureus subsp. aureus Mu50
auuagguuuaguaggagaaucg

SEQ ID NO: 44964 - RNA, 22 nt, Staphylococcus aureus subsp. aureus Mu50
auuauuaauuguacuuugggga

SEQ ID NO: 44965 - RNA, 22 nt, Staphylococcus aureus subsp. aureus Mu50
auuauuuaccacuuaaacaagc

SEQ ID NO: 44966 - RNA, 22 nt, Staphylococcus aureus subsp. aureus Mu50
auuauuuaugguguauuagaug

SEQ ID NO: 44967 - RNA, 22 nt, Staphylococcus aureus subsp. aureus Mu50
auucaguagaagaauauuuagc

SEQ ID NO: 44968 - RNA, 22 nt, Staphylococcus aureus subsp. aureus Mu50
auugaaauuggugaugcaccau

SEQ ID NO: 44969 - RNA, 22 nt, Staphylococcus aureus subsp. aureus Mu50
auugagggauuuuuauaguucu

SEQ ID NO: 44970 - RNA, 22 nt, Staphylococcus aureus subsp. aureus Mu50
auugagugaauggcuugaaguu

SEQ ID NO: 44971 - RNA, 22 nt, Staphylococcus aureus subsp. aureus Mu50
auugauguaguguugcgggaua

SEQ ID NO: 44972 - RNA, 22 nt, Staphylococcus aureus subsp. aureus Mu50
auugaugugaagcggacaaucu

SEQ ID NO: 44973 - RNA, 22 nt, Staphylococcus aureus subsp. aureus Mu50
auugauugggcaauggaaguua

SEQ ID NO: 44974 - RNA, 22 nt, Staphylococcus aureus subsp. aureus Mu50
auugcguauagugaugugucuu

SEQ ID NO: 44975 - RNA, 22 nt, Staphylococcus aureus subsp. aureus Mu50
auuguacuuguggcacccauga

SEQ ID NO: 44976 - RNA, 22 nt, Staphylococcus aureus subsp. aureus Mu50
auuguauucaauauuugcugau

SEQ ID NO: 44977 - RNA, 22 nt, Staphylococcus aureus subsp. aureus Mu50
auuguguuacaagauauauaag

SEQ ID NO: 44978 - RNA, 22 nt, Staphylococcus aureus subsp. aureus Mu50
auuguuuacgacuaaccaagcc

SEQ ID NO: 44979 - RNA, 22 nt, Staphylococcus aureus subsp. aureus Mu50
auuuauuucgucgucccacccc

SEQ ID NO: 44980 - RNA, 22 nt, Staphylococcus aureus subsp. aureus Mu50
auuucguuaucccacucacaug

SEQ ID NO: 44981 - RNA, 22 nt, Staphylococcus aureus subsp. aureus Mu50
auuucugucccacucccauugg

SEQ ID NO: 44982 - RNA, 22 nt, Staphylococcus aureus subsp. aureus Mu50
auuuggaacuuuguuagguaua

SEQ ID NO: 44983 - RNA, 22 nt, Staphylococcus aureus subsp. aureus Mu50
auuuggugcaucaauggucaug

SEQ ID NO: 44984 - RNA, 22 nt, Staphylococcus aureus subsp. aureus Mu50
auuuguuuguaucguucgagga

SEQ ID NO: 44985 - RNA, 22 nt, Staphylococcus aureus subsp. aureus Mu50
auuuuaacaucuagcgguacaa

SEQ ID NO: 44986 - RNA, 22 nt, Staphylococcus aureus subsp. aureus Mu50
auuuugaugagcgugcaauacu

SEQ ID NO: 44987 - RNA, 22 nt, Staphylococcus aureus subsp. aureus Mu50
auuuuucacgucaauugaccuu

SEQ ID NO: 44988 - RNA, 22 nt, Staphylococcus aureus subsp. aureus Mu50
caaaguaauguaugaaguugug

SEQ ID NO: 44989 - RNA, 22 nt, Staphylococcus aureus subsp. aureus Mu50
caaaguugacuagaauugaaaa

SEQ ID NO: 44990 - RNA, 22 nt, Staphylococcus aureus subsp. aureus Mu50
caaauuuuacugaaaccgguuu

SEQ ID NO: 44991 - RNA, 22 nt, Staphylococcus aureus subsp. aureus Mu50
caaauuuuagguguguuuaugu

SEQ ID NO: 44992 - RNA, 22 nt, Staphylococcus aureus subsp. aureus Mu50
caacaauaacauuaucacugaa

SEQ ID NO: 44993 - RNA, 22 nt, Staphylococcus aureus subsp. aureus Mu50
caacagauggaucuggaugcac

SEQ ID NO: 44994 - RNA, 22 nt, Staphylococcus aureus subsp. aureus Mu50
caacguuuuaaaugcuuagaau

SEQ ID NO: 44995 - RNA, 22 nt, Staphylococcus aureus subsp. aureus Mu50
caacuuuagguaaugucauguu

SEQ ID NO: 44996 - RNA, 22 nt, Staphylococcus aureus subsp. aureus Mu50
caagguugacuagaauugaaaa

SEQ ID NO: 44997 - RNA, 22 nt, Staphylococcus aureus subsp. aureus Mu50
caccuuuaaauaaaaugccauu

SEQ ID NO: 44998 - RNA, 20 nt, Staphylococcus aureus subsp. aureus Mu50
cacggcucgaacaagucuuu

SEQ ID NO: 44999 - RNA, 22 nt, Staphylococcus aureus subsp. aureus Mu50
cagaugcguuacaagaacaugu

SEQ ID NO: 45000 - RNA, 22 nt, Staphylococcus aureus subsp. aureus Mu50
cagcuaaauuacuaccuucagu

SEQ ID NO: 45001 - RNA, 22 nt, Staphylococcus aureus subsp. aureus Mu50
cagguauugcacauacguacau

SEQ ID NO: 45002 - RNA, 22 nt, Staphylococcus aureus subsp. aureus Mu50
cagucguaucugguuauagugg

SEQ ID NO: 45003 - RNA, 22 nt, Staphylococcus aureus subsp. aureus Mu50
cauaacuacggcuagcaguuuu

SEQ ID NO: 45004 - RNA, 22 nt, Staphylococcus aureus subsp. aureus Mu50
cauauaaagcgugcgugcuuuu

SEQ ID NO: 45005 - RNA, 22 nt, Staphylococcus aureus subsp. aureus Mu50
caucaauugugaguucuuuauu

SEQ ID NO: 45006 - RNA, 20 nt, Staphylococcus aureus subsp. aureus Mu50
caucaguuuuuuuauacgag

SEQ ID NO: 45007 - RNA, 22 nt, Staphylococcus aureus subsp. aureus Mu50
caugauugaaagauuauuugug

SEQ ID NO: 45008 - RNA, 22 nt, Staphylococcus aureus subsp. aureus Mu50
cauuauuagucgauuacauacu

SEQ ID NO: 45009 - RNA, 22 nt, Staphylococcus aureus subsp. aureus Mu50
ccaaaagugguccgugguuaaa

SEQ ID NO: 45010 - RNA, 20 nt, Staphylococcus aureus subsp. aureus Mu50
ccagaugguuaugguuuuuu

SEQ ID NO: 45011 - RNA, 22 nt, Staphylococcus aureus subsp. aureus Mu50
ccagcguaugcacugcuuuguc

SEQ ID NO: 45012 - RNA, 22 nt, Staphylococcus aureus subsp. aureus Mu50
ccauauuauuuaucaaaugugc

SEQ ID NO: 45013 - RNA, 22 nt, Staphylococcus aureus subsp. aureus Mu50
cccaauaauuuuaaguuuugau

SEQ ID NO: 45014 - RNA, 19 nt, Staphylococcus aureus subsp. aureus Mu50
ccguuuaaaguaguugaug

SEQ ID NO: 45015 - RNA, 22 nt, Staphylococcus aureus subsp. aureus Mu50
ccugcaauaauuacagccgggu

SEQ ID NO: 45016 - RNA, 22 nt, Staphylococcus aureus subsp. aureus Mu50
cggauauuguuaugguguugcu

SEQ ID NO: 45017 - RNA, 18 nt, Staphylococcus aureus subsp. aureus Mu50
cgugugauagaaguuuuu

SEQ ID NO: 45018 - RNA, 22 nt, Staphylococcus aureus subsp. aureus Mu50
cguucugcaaguuuucggauaa

SEQ ID NO: 45019 - RNA, 22 nt, Staphylococcus aureus subsp. aureus Mu50
cguuuguugaucuugcauaaua

SEQ ID NO: 45020 - RNA, 22 nt, Staphylococcus aureus subsp. aureus Mu50
cuacgauucgaaauagguaucu

SEQ ID NO: 45021 - RNA, 22 nt, Staphylococcus aureus subsp. aureus Mu50
cuagauuuaucuaaauccaaug

SEQ ID NO: 45022 - RNA, 22 nt, Staphylococcus aureus subsp. aureus Mu50
cuagcagugauugcaaauauga

SEQ ID NO: 45023 - RNA, 22 nt, Staphylococcus aureus subsp. aureus Mu50
cuauaaauacaagugcauaugg

SEQ ID NO: 45024 - RNA, 22 nt, Staphylococcus aureus subsp. aureus Mu50
cuauacugcaauccaacaauaa

SEQ ID NO: 45025 - RNA, 22 nt, Staphylococcus aureus subsp. aureus Mu50
cuauuuguaacucuuauauuga

SEQ ID NO: 45026 - RNA, 22 nt, Staphylococcus aureus subsp. aureus Mu50
cuauuuuaaugaaaugacuuau

SEQ ID NO: 45027 - RNA, 22 nt, Staphylococcus aureus subsp. aureus Mu50
cucgcggccuuuuuuauuguaa

SEQ ID NO: 45028 - RNA, 22 nt, Staphylococcus aureus subsp. aureus Mu50
cugaacaauaaauggguauggg

SEQ ID NO: 45029 - RNA, 22 nt, Staphylococcus aureus subsp. aureus Mu50
cugacuagaauugaaaaaacuu

SEQ ID NO: 45030 - RNA, 22 nt, Staphylococcus aureus subsp. aureus Mu50
cugcaguauuaccauugcuuaa

SEQ ID NO: 45031 - RNA, 22 nt, Staphylococcus aureus subsp. aureus Mu50
cuggacgauauugcgauuauug

SEQ ID NO: 45032 - RNA, 22 nt, Staphylococcus aureus subsp. aureus Mu50
cuguauacaaucuucgguacgu

SEQ ID NO: 45033 - RNA, 22 nt, Staphylococcus aureus subsp. aureus Mu50
cuguaucacauuagaagcuuuu

SEQ ID NO: 45034 - RNA, 22 nt, Staphylococcus aureus subsp. aureus Mu50
cuuaguuaaagcgcgcacucaa

SEQ ID NO: 45035 - RNA, 22 nt, Staphylococcus aureus subsp. aureus Mu50
cuugguuugguguagucacaau

SEQ ID NO: 45036 - RNA, 22 nt, Staphylococcus aureus subsp. aureus Mu50
cuuuccaaguuaaagauuuacc

SEQ ID NO: 45037 - RNA, 22 nt, Staphylococcus aureus subsp. aureus Mu50
cuuuggguauucacucaccuuc

SEQ ID NO: 45038 - RNA, 22 nt, Staphylococcus aureus subsp. aureus Mu50
gaaaagaaagcauaugcaacuu

SEQ ID NO: 45039 - RNA, 22 nt, Staphylococcus aureus subsp. aureus Mu50
gaaaagcuccaaucaaaguuga

SEQ ID NO: 45040 - RNA, 22 nt, Staphylococcus aureus subsp. aureus Mu50
gaaaugccccuuucgaaguaga

SEQ ID NO: 45041 - RNA, 22 nt, Staphylococcus aureus subsp. aureus Mu50
gaacauguuugugggaaguagc

SEQ ID NO: 45042 - RNA, 22 nt, Staphylococcus aureus subsp. aureus Mu50
gaacgaugacaccacugauuac

SEQ ID NO: 45043 - RNA, 22 nt, Staphylococcus aureus subsp. aureus Mu50
gaauaucaagcuguccaacaag

SEQ ID NO: 45044 - RNA, 18 nt, Staphylococcus aureus subsp. aureus Mu50
gaaucaauagucgcuaga

SEQ ID NO: 45045 - RNA, 22 nt, Staphylococcus aureus subsp. aureus Mu50
gaaucagaauagauuugaugcu

SEQ ID NO: 45046 - RNA, 22 nt, Staphylococcus aureus subsp. aureus Mu50
gacauauuuuaauagugaauau

SEQ ID NO: 45047 - RNA, 22 nt, Staphylococcus aureus subsp. aureus Mu50
gacguauuuuuuaucacauuga

SEQ ID NO: 45048 - RNA, 22 nt, Staphylococcus aureus subsp. aureus Mu50
gagaaacuugguguacguuuua

SEQ ID NO: 45049 - RNA, 22 nt, Staphylococcus aureus subsp. aureus Mu50
gagauauugguaaagcuuuugc

SEQ ID NO: 45050 - RNA, 22 nt, Staphylococcus aureus subsp. aureus Mu50
gagaugucuuagcuuuaacaca

SEQ ID NO: 45051 - RNA, 22 nt, Staphylococcus aureus subsp. aureus Mu50
gaggcaauuaauccaaauaauc

SEQ ID NO: 45052 - RNA, 22 nt, Staphylococcus aureus subsp. aureus Mu50
gagguauaaacauuaucauugc

SEQ ID NO: 45053 - RNA, 22 nt, Staphylococcus aureus subsp. aureus Mu50
gauaguacauugacugauaacg

SEQ ID NO: 45054 - RNA, 22 nt, Staphylococcus aureus subsp. aureus Mu50
gauauuaaacacuauagcuuuu

SEQ ID NO: 45055 - RNA, 22 nt, Staphylococcus aureus subsp. aureus Mu50
gaucaacauuuuacaauguuug

SEQ ID NO: 45056 - RNA, 22 nt, Staphylococcus aureus subsp. aureus Mu50
gaugaauggaaagauugguuga

SEQ ID NO: 45057 - RNA, 22 nt, Staphylococcus aureus subsp. aureus Mu50
gaugacaauucauaguaguaaa

SEQ ID NO: 45058 - RNA, 22 nt, Staphylococcus aureus subsp. aureus Mu50
gaugauauuucaagauccguau

SEQ ID NO: 45059 - RNA, 22 nt, Staphylococcus aureus subsp. aureus Mu50
gaugccuauaaugcaaguccua

SEQ ID NO: 45060 - RNA, 22 nt, Staphylococcus aureus subsp. aureus Mu50
gaugccuuuaaagauuuaccgc

SEQ ID NO: 45061 - RNA, 22 nt, Staphylococcus aureus subsp. aureus Mu50
gaugcguugaguaaacugauua

SEQ ID NO: 45062 - RNA, 22 nt, Staphylococcus aureus subsp. aureus Mu50
gauggcgaaguaguuaaaguug

SEQ ID NO: 45063 - RNA, 22 nt, Staphylococcus aureus subsp. aureus Mu50
gaugguaucaauuugaugugug

SEQ ID NO: 45064 - RNA, 22 nt, Staphylococcus aureus subsp. aureus Mu50
gauguugguauguauucaaugc

SEQ ID NO: 45065 - RNA, 22 nt, Staphylococcus aureus subsp. aureus Mu50
gauuaaguucuuuaacuucauc

SEQ ID NO: 45066 - RNA, 22 nt, Staphylococcus aureus subsp. aureus Mu50
gauuauuaucaacaguaggugc

SEQ ID NO: 45067 - RNA, 22 nt, Staphylococcus aureus subsp. aureus Mu50
gauugcugcugaagagagauau

SEQ ID NO: 45068 - RNA, 22 nt, Staphylococcus aureus subsp. aureus Mu50
gauuggauuaaagcagguuuag

SEQ ID NO: 45069 - RNA, 22 nt, Staphylococcus aureus subsp. aureus Mu50
gcaaauguuacaccuguuucuu

SEQ ID NO: 45070 - RNA, 22 nt, Staphylococcus aureus subsp. aureus Mu50
gcaacaauuguaaaguuugaaa

SEQ ID NO: 45071 - RNA, 23 nt, Staphylococcus aureus subsp. aureus Mu50
gcagacuacaucuuuguugauga

SEQ ID NO: 45072 - RNA, 22 nt, Staphylococcus aureus subsp. aureus Mu50
gcaguugaugaagugguagaug

SEQ ID NO: 45073 - RNA, 22 nt, Staphylococcus aureus subsp. aureus Mu50
gcauuguauugacgacauaagu

SEQ ID NO: 45074 - RNA, 22 nt, Staphylococcus aureus subsp. aureus Mu50
gcuacuuucuugaagacaauuc

SEQ ID NO: 45075 - RNA, 22 nt, Staphylococcus aureus subsp. aureus Mu50
gcuaugauaugaagguuuagca

SEQ ID NO: 45076 - RNA, 22 nt, Staphylococcus aureus subsp. aureus Mu50
gcuugugaaaccugaaauucgu

SEQ ID NO: 45077 - RNA, 18 nt, Staphylococcus aureus subsp. aureus Mu50
gcuuugaagggagcauuu

SEQ ID NO: 45078 - RNA, 22 nt, Staphylococcus aureus subsp. aureus Mu50
gcuuuuucaccuugaaccaaag

SEQ ID NO: 45079 - RNA, 22 nt, Staphylococcus aureus subsp. aureus Mu50
ggacauuacucgauuuuuagaa

SEQ ID NO: 45080 - RNA, 22 nt, Staphylococcus aureus subsp. aureus Mu50
ggaucuauugcaucaugugaca

SEQ ID NO: 45081 - RNA, 22 nt, Staphylococcus aureus subsp. aureus Mu50
ggaugccgacaguauuccgauu

SEQ ID NO: 45082 - RNA, 22 nt, Staphylococcus aureus subsp. aureus Mu50
ggaugcuaugagagaauuuuau

SEQ ID NO: 45083 - RNA, 22 nt, Staphylococcus aureus subsp. aureus Mu50
ggggagugggacagaaaugaua

SEQ ID NO: 45084 - RNA, 22 nt, Staphylococcus aureus subsp. aureus Mu50
gguguaacuacagguuuaccau

SEQ ID NO: 45085 - RNA, 22 nt, Staphylococcus aureus subsp. aureus Mu50
ggugucgguaugauauugcgug

SEQ ID NO: 45086 - RNA, 22 nt, Staphylococcus aureus subsp. aureus Mu50
gguuuauuaauauuagcaacaa

SEQ ID NO: 45087 - RNA, 22 nt, Staphylococcus aureus subsp. aureus Mu50
guaaaaccuguugauacaacug

SEQ ID NO: 45088 - RNA, 22 nt, Staphylococcus aureus subsp. aureus Mu50
guaaaugcugagcgaauauaca

SEQ ID NO: 45089 - RNA, 22 nt, Staphylococcus aureus subsp. aureus Mu50
guaaauuacacggcauggcauu

SEQ ID NO: 45090 - RNA, 22 nt, Staphylococcus aureus subsp. aureus Mu50
guaccuguaucuuuaagaccua

SEQ ID NO: 45091 - RNA, 17 nt, Staphylococcus aureus subsp. aureus Mu50
guacuaaauauuggcua

SEQ ID NO: 45092 - RNA, 22 nt, Staphylococcus aureus subsp. aureus Mu50
guagauugaucaaguaauguac

SEQ ID NO: 45093 - RNA, 22 nt, Staphylococcus aureus subsp. aureus Mu50
guagccauauacugucaccagu

SEQ ID NO: 45094 - RNA, 22 nt, Staphylococcus aureus subsp. aureus Mu50
guaucauuuaagcugaaacgcg

SEQ ID NO: 45095 - RNA, 22 nt, Staphylococcus aureus subsp. aureus Mu50
gucaacaaguagaugccaauug

SEQ ID NO: 45096 - RNA, 22 nt, Staphylococcus aureus subsp. aureus Mu50
gucauuauaauugaguauuuga

SEQ ID NO: 45097 - RNA, 22 nt, Staphylococcus aureus subsp. aureus Mu50
gugaaaaugaacguauugaugc

SEQ ID NO: 45098 - RNA, 22 nt, Staphylococcus aureus subsp. aureus Mu50
gugauuugcguaugaugauuuc

SEQ ID NO: 45099 - RNA, 22 nt, Staphylococcus aureus subsp. aureus Mu50
gugcauuagcuguugagguauu

SEQ ID NO: 45100 - RNA, 22 nt, Staphylococcus aureus subsp. aureus Mu50
gugcuacacguucaucaccauu

SEQ ID NO: 45101 - RNA, 22 nt, Staphylococcus aureus subsp. aureus Mu50
gugcuuugauggauuuuuaaua

SEQ ID NO: 45102 - RNA, 22 nt, Staphylococcus aureus subsp. aureus Mu50
guggcuacauucgaacauauca

SEQ ID NO: 45103 - RNA, 22 nt, Staphylococcus aureus subsp. aureus Mu50
guguucguuggauguuacaugg

SEQ ID NO: 45104 - RNA, 22 nt, Staphylococcus aureus subsp. aureus Mu50
guuacuuuaugauuacuaaaaa

SEQ ID NO: 45105 - RNA, 22 nt, Staphylococcus aureus subsp. aureus Mu50
guuagaagacauuguguugaau

SEQ ID NO: 45106 - RNA, 22 nt, Staphylococcus aureus subsp. aureus Mu50
guuaugauaauucauugaauau

SEQ ID NO: 45107 - RNA, 22 nt, Staphylococcus aureus subsp. aureus Mu50
guuaugcaaauuaugguuuacu

SEQ ID NO: 45108 - RNA, 22 nt, Staphylococcus aureus subsp. aureus Mu50
guuauguaucgauuucagaaga

SEQ ID NO: 45109 - RNA, 22 nt, Staphylococcus aureus subsp. aureus Mu50
guucaagugguaacugcuacgu

SEQ ID NO: 45110 - RNA, 22 nt, Staphylococcus aureus subsp. aureus Mu50
guucgauugauuuagaagauaa

SEQ ID NO: 45111 - RNA, 22 nt, Staphylococcus aureus subsp. aureus Mu50
guucguaucuugauacucaucg

SEQ ID NO: 45112 - RNA, 22 nt, Staphylococcus aureus subsp. aureus Mu50
guugcugagauuacuaaaggga

SEQ ID NO: 45113 - RNA, 22 nt, Staphylococcus aureus subsp. aureus Mu50
guuugguguuucacuauaaugu

SEQ ID NO: 45114 - RNA, 22 nt, Staphylococcus aureus subsp. aureus Mu50
guuuguaaaauagcaguguacu

SEQ ID NO: 45115 - RNA, 22 nt, Staphylococcus aureus subsp. aureus Mu50
guuuuaguuaacguucauggug

SEQ ID NO: 45116 - RNA, 21 nt, Staphylococcus aureus subsp. aureus Mu50
guuuugauaggcuaacaagcc

SEQ ID NO: 45117 - RNA, 22 nt, Staphylococcus aureus subsp. aureus Mu50
uaaaacuccuaauguggaacua

SEQ ID NO: 45118 - RNA, 22 nt, Staphylococcus aureus subsp. aureus Mu50
uaaaauucuugugacaugacau

SEQ ID NO: 45119 - RNA, 20 nt, Staphylococcus aureus subsp. aureus Mu50
uaaagacuacuuacagcgua

SEQ ID NO: 45120 - RNA, 22 nt, Staphylococcus aureus subsp. aureus Mu50
uaaagcacgugguguuauuguu

SEQ ID NO: 45121 - RNA, 18 nt, Staphylococcus aureus subsp. aureus Mu50
uaaauagcucgcugaauu

SEQ ID NO: 45122 - RNA, 22 nt, Staphylococcus aureus subsp. aureus Mu50
uaaauuuuucaucaacuaguau

SEQ ID NO: 45123 - RNA, 17 nt, Staphylococcus aureus subsp. aureus Mu50
uaacaacaguuacagga

SEQ ID NO: 45124 - RNA, 22 nt, Staphylococcus aureus subsp. aureus Mu50
uaacuguauaguuuuucaguug

SEQ ID NO: 45125 - RNA, 22 nt, Staphylococcus aureus subsp. aureus Mu50
uaagucuuugaugaagaaaauu

SEQ ID NO: 45126 - RNA, 22 nt, Staphylococcus aureus subsp. aureus Mu50
uaagugaaauaauuauuaguau

SEQ ID NO: 45127 - RNA, 22 nt, Staphylococcus aureus subsp. aureus Mu50
uaaguggucaugaagcuaaagc

SEQ ID NO: 45128 - RNA, 22 nt, Staphylococcus aureus subsp. aureus Mu50
uaaucucaauuguaaugguagc

SEQ ID NO: 45129 - RNA, 22 nt, Staphylococcus aureus subsp. aureus Mu50
uaauugcacuaccaaugauuau

SEQ ID NO: 45130 - RNA, 22 nt, Staphylococcus aureus subsp. aureus Mu50
uaauugugaaauuacauauugc

SEQ ID NO: 45131 - RNA, 22 nt, Staphylococcus aureus subsp. aureus Mu50
uaauuuaaacaagcaguaagcu

SEQ ID NO: 45132 - RNA, 22 nt, Staphylococcus aureus subsp. aureus Mu50
uaauuuugguugcaacuauugu

SEQ ID NO: 45133 - RNA, 20 nt, Staphylococcus aureus subsp. aureus Mu50
uacagauuguuaauaaauua

SEQ ID NO: 45134 - RNA, 20 nt, Staphylococcus aureus subsp. aureus Mu50
uacagguucagacuugcuuu

SEQ ID NO: 45135 - RNA, 22 nt, Staphylococcus aureus subsp. aureus Mu50
uacauaaacaacagcaguaagg

SEQ ID NO: 45136 - RNA, 22 nt, Staphylococcus aureus subsp. aureus Mu50
uacauguguuggcggguuuguu

SEQ ID NO: 45137 - RNA, 22 nt, Staphylococcus aureus subsp. aureus Mu50
uacgauacugaauguauuugaa

SEQ ID NO: 45138 - RNA, 22 nt, Staphylococcus aureus subsp. aureus Mu50
uacgguucagucuuuaaaacug

SEQ ID NO: 45139 - RNA, 22 nt, Staphylococcus aureus subsp. aureus Mu50
uagaaacagcaguaagaugauu

SEQ ID NO: 45140 - RNA, 22 nt, Staphylococcus aureus subsp. aureus Mu50
uaggucuuaaagauacagguac

SEQ ID NO: 45141 - RNA, 22 nt, Staphylococcus aureus subsp. aureus Mu50
uaguaaagaaggacuaaauuga

SEQ ID NO: 45142 - RNA, 22 nt, Staphylococcus aureus subsp. aureus Mu50
uauaaacaugaguacccagaau

SEQ ID NO: 45143 - RNA, 22 nt, Staphylococcus aureus subsp. aureus Mu50
uauaaugacguuauuaauacaa

SEQ ID NO: 45144 - RNA, 22 nt, Staphylococcus aureus subsp. aureus Mu50
uauacguggaauugucaugcuc

SEQ ID NO: 45145 - RNA, 22 nt, Staphylococcus aureus subsp. aureus Mu50
uauagugacuggugguacgagu

SEQ ID NO: 45146 - RNA, 22 nt, Staphylococcus aureus subsp. aureus Mu50
uauauauugcaggugguguuga

SEQ ID NO: 45147 - RNA, 22 nt, Staphylococcus aureus subsp. aureus Mu50
uaucaaacauugaaugcacgcg

SEQ ID NO: 45148 - RNA, 22 nt, Staphylococcus aureus subsp. aureus Mu50
uaucacugggauuuuuaugccc

SEQ ID NO: 45149 - RNA, 22 nt, Staphylococcus aureus subsp. aureus Mu50
uaucaguaauauuaggcuuagu

SEQ ID NO: 45150 - RNA, 22 nt, Staphylococcus aureus subsp. aureus Mu50
uaucuccagaguauacaguauc

SEQ ID NO: 45151 - RNA, 22 nt, Staphylococcus aureus subsp. aureus Mu50
uaucuuuaaugaauaaaccuaa

SEQ ID NO: 45152 - RNA, 22 nt, Staphylococcus aureus subsp. aureus Mu50
uaugcugugaaguuauuaaauc

SEQ ID NO: 45153 - RNA, 22 nt, Staphylococcus aureus subsp. aureus Mu50
uauggcgaaacuaauguauuau

SEQ ID NO: 45154 - RNA, 22 nt, Staphylococcus aureus subsp. aureus Mu50
uaugucaagguuuugacuuauu

SEQ ID NO: 45155 - RNA, 23 nt, Staphylococcus aureus subsp. aureus Mu50
uauuaaucugcuuaauucuugaa

SEQ ID NO: 45156 - RNA, 22 nt, Staphylococcus aureus subsp. aureus Mu50
uauuagaacuaauggagggcaa

SEQ ID NO: 45157 - RNA, 22 nt, Staphylococcus aureus subsp. aureus Mu50
uauuaguaaucgcgucauuugu

SEQ ID NO: 45158 - RNA, 22 nt, Staphylococcus aureus subsp. aureus Mu50
uauuaugaacgaaacagacuua

SEQ ID NO: 45159 - RNA, 22 nt, Staphylococcus aureus subsp. aureus Mu50
uauuaugcuagguauggcauua

SEQ ID NO: 45160 - RNA, 22 nt, Staphylococcus aureus subsp. aureus Mu50
uauuauggaaagacaguaauuu

SEQ ID NO: 45161 - RNA, 22 nt, Staphylococcus aureus subsp. aureus Mu50
uauuauuggagaaguaacuuca

SEQ ID NO: 45162 - RNA, 22 nt, Staphylococcus aureus subsp. aureus Mu50
uauucaaugacaaugcguugau

SEQ ID NO: 45163 - RNA, 22 nt, Staphylococcus aureus subsp. aureus Mu50
uauugugauuagugcacgaaca

SEQ ID NO: 45164 - RNA, 22 nt, Staphylococcus aureus subsp. aureus Mu50
uauuuagcucaauuugaugcgg

SEQ ID NO: 45165 - RNA, 20 nt, Staphylococcus aureus subsp. aureus Mu50
uauuucaauugcuguugcug

SEQ ID NO: 45166 - RNA, 22 nt, Staphylococcus aureus subsp. aureus Mu50
uauuuguuucagguguaucaau

SEQ ID NO: 45167 - RNA, 22 nt, Staphylococcus aureus subsp. aureus Mu50
ucaaaaaugaagacauaguuaa

SEQ ID NO: 45168 - RNA, 22 nt, Staphylococcus aureus subsp. aureus Mu50
ucaaaacucaaguaucuggucg

SEQ ID NO: 45169 - RNA, 23 nt, Staphylococcus aureus subsp. aureus Mu50
ucaaacgaccgcauucuguguac

SEQ ID NO: 45170 - RNA, 22 nt, Staphylococcus aureus subsp. aureus Mu50
ucaaucguuauaucgcauaguc

SEQ ID NO: 45171 - RNA, 22 nt, Staphylococcus aureus subsp. aureus Mu50
ucaauucugauagcguagaaau

SEQ ID NO: 45172 - RNA, 22 nt, Staphylococcus aureus subsp. aureus Mu50
ucaauuguucuaucauucgcuu

SEQ ID NO: 45173 - RNA, 22 nt, Staphylococcus aureus subsp. aureus Mu50
ucaauuugaguaacacuuacuu

SEQ ID NO: 45174 - RNA, 23 nt, Staphylococcus aureus subsp. aureus Mu50
ucacaugguuuaggucuugguga

SEQ ID NO: 45175 - RNA, 22 nt, Staphylococcus aureus subsp. aureus Mu50
ucaccaaaauguuuaauacaau

SEQ ID NO: 45176 - RNA, 22 nt, Staphylococcus aureus subsp. aureus Mu50
ucacuuaacaucgcuugcauac

SEQ ID NO: 45177 - RNA, 23 nt, Staphylococcus aureus subsp. aureus Mu50
ucacuucaaaguuaguagcuuuu

SEQ ID NO: 45178 - RNA, 21 nt, Staphylococcus aureus subsp. aureus Mu50
ucagauucugacccagguuca

SEQ ID NO: 45179 - RNA, 22 nt, Staphylococcus aureus subsp. aureus Mu50
uuguucugucguaaugauguaa

SEQ ID NO: 45180 - RNA, 22 nt, Staphylococcus aureus subsp. aureus Mu50
uuguuuguuaaauagaugauuc

SEQ ID NO: 45181 - RNA, 18 nt, Staphylococcus aureus subsp. aureus Mu50
uuguuuguucaugccugc

SEQ ID NO: 45182 - RNA, 22 nt, Staphylococcus aureus subsp. aureus Mu50
uuuaagaacgcauguuauugau

SEQ ID NO: 45183 - RNA, 22 nt, Staphylococcus aureus subsp. aureus Mu50
uuuacuccuuacaauaaagaca

SEQ ID NO: 45184 - RNA, 22 nt, Staphylococcus aureus subsp. aureus Mu50
uuuacucuuuaaaggauuuaau

SEQ ID NO: 45185 - RNA, 22 nt, Staphylococcus aureus subsp. aureus Mu50
uuuauugacgcgcgugaaucuc

SEQ ID NO: 45186 - RNA, 22 nt, Staphylococcus aureus subsp. aureus Mu50
uuuauuucgucgucccacccca

SEQ ID NO: 45187 - RNA, 22 nt, Staphylococcus aureus subsp. aureus Mu50
uuuauuucgucgucccaccccg

SEQ ID NO: 45188 - RNA, 22 nt, Staphylococcus aureus subsp. aureus Mu50
uuuauuugaagcgguauauggu

SEQ ID NO: 45189 - RNA, 22 nt, Staphylococcus aureus subsp. aureus Mu50
uuucaacaacgcaaaaucggua

SEQ ID NO: 45190 - RNA, 22 nt, Staphylococcus aureus subsp. aureus Mu50
uuucacauaguuaacaauugcu

SEQ ID NO: 45191 - RNA, 22 nt, Staphylococcus aureus subsp. aureus Mu50
uuucacauuuggauauuuacga

SEQ ID NO: 45192 - RNA, 22 nt, Staphylococcus aureus subsp. aureus Mu50
uuucaggugcaaguguuacuga

SEQ ID NO: 45193 - RNA, 22 nt, Staphylococcus aureus subsp. aureus Mu50
uuucagguuuaauuucaaagcc

SEQ ID NO: 45194 - RNA, 20 nt, Staphylococcus aureus subsp. aureus Mu50
uuucaucugauucacaucca

SEQ ID NO: 45195 - RNA, 22 nt, Staphylococcus aureus subsp. aureus Mu50
uuucuuacuuugaaaggugugu

SEQ ID NO: 45196 - RNA, 22 nt, Staphylococcus aureus subsp. aureus Mu50
uuugaaacuguucaacuauggg

SEQ ID NO: 45197 - RNA, 19 nt, Staphylococcus aureus subsp. aureus Mu50
uuugaacuuguauuuguag

SEQ ID NO: 45198 - RNA, 19 nt, Staphylococcus aureus subsp. aureus Mu50
uuugaagggagcauuugau

SEQ ID NO: 45199 - RNA, 22 nt, Staphylococcus aureus subsp. aureus Mu50
uuugaugaaccuucauuagcug

SEQ ID NO: 45200 - RNA, 22 nt, Staphylococcus aureus subsp. aureus Mu50
uuugauuuaaauguucaacaua

SEQ ID NO: 45201 - RNA, 22 nt, Staphylococcus aureus subsp. aureus Mu50
uuugccauugaaagaaaagcgu

SEQ ID NO: 45202 - RNA, 22 nt, Staphylococcus aureus subsp. aureus Mu50
uuuguacuucaucauauuguug

SEQ ID NO: 45203 - RNA, 20 nt, Staphylococcus aureus subsp. aureus Mu50
uuuguaucuaguacauuggc

SEQ ID NO: 45204 - RNA, 22 nt, Staphylococcus aureus subsp. aureus Mu50
uuugucauguuaaaagaagaua

SEQ ID NO: 45205 - RNA, 22 nt, Staphylococcus aureus subsp. aureus Mu50
uuugucauuuauucuggauugu

SEQ ID NO: 45206 - RNA, 22 nt, Staphylococcus aureus subsp. aureus Mu50
uuuguucagcuaauggaaaacg

SEQ ID NO: 45207 - RNA, 22 nt, Staphylococcus aureus subsp. aureus Mu50
uuuguuguagaagguccauuau

SEQ ID NO: 45208 - RNA, 22 nt, Staphylococcus aureus subsp. aureus Mu50
uuuuagaaauugucaaugauga

SEQ ID NO: 45209 - RNA, 22 nt, Staphylococcus aureus subsp. aureus Mu50
uuuuauagugaagguaguuuga

SEQ ID NO: 45210 - RNA, 22 nt, Staphylococcus aureus subsp. aureus Mu50
uuuuaugauaaagaaggauaua

SEQ ID NO: 45211 - RNA, 23 nt, Staphylococcus aureus subsp. aureus Mu50
uuuucaauucuagucaaccuugc

SEQ ID NO: 45212 - RNA, 22 nt, Staphylococcus aureus subsp. aureus Mu50
uuuugguuaaagugauauugcu

SEQ ID NO: 45213 - RNA, 22 nt, Staphylococcus aureus subsp. aureus Mu50
uuuuuagcacucagugcauaca

SEQ ID NO: 45214 - RNA, 22 nt, Staphylococcus aureus subsp. aureus Mu50
uuuuucaaaauggcuuaaugcu

SEQ ID NO: 45215 - RNA, 22 nt, Staphylococcus aureus subsp. aureus Mu50
agguguggaacagacauguguu

SEQ ID NO: 45216 - RNA, 22 nt, Staphylococcus aureus subsp. aureus Mu50
aguacaaauuuauuuuacaggg

SEQ ID NO: 45217 - RNA, 22 nt, Staphylococcus aureus subsp. aureus Mu50
aguacggacuguuguaugauga

SEQ ID NO: 45218 - RNA, 22 nt, Staphylococcus aureus subsp. aureus Mu50
agucuucuuuccuauaaucgcu

SEQ ID NO: 45219 - RNA, 22 nt, Staphylococcus aureus subsp. aureus Mu50
agugaacuuuccucuuuuuaau

SEQ ID NO: 45220 - RNA, 22 nt, Staphylococcus aureus subsp. aureus Mu50
agugauuaauaguguacaucaa

SEQ ID NO: 45221 - RNA, 22 nt, Staphylococcus aureus subsp. aureus Mu50
agugccucuuuuauuauuuaac

SEQ ID NO: 45222 - RNA, 22 nt, Staphylococcus aureus subsp. aureus Mu50
aguuacaaagaaauggaugaug

SEQ ID NO: 45223 - RNA, 22 nt, Staphylococcus aureus subsp. aureus Mu50
aguuagauuuaagcgcauuagu

SEQ ID NO: 45224 - RNA, 22 nt, Staphylococcus aureus subsp. aureus Mu50
aguuggggugggacgacgaaau

SEQ ID NO: 45225 - RNA, 22 nt, Staphylococcus aureus subsp. aureus Mu50
auaaacauguuguuucugaaac

SEQ ID NO: 45226 - RNA, 22 nt, Staphylococcus aureus subsp. aureus Mu50
auaaaguauauggaaauuuuac

SEQ ID NO: 45227 - RNA, 22 nt, Staphylococcus aureus subsp. aureus Mu50
auaaauugauaauaggguuaaa

SEQ ID NO: 45228 - RNA, 22 nt, Staphylococcus aureus subsp. aureus Mu50
auaacuaaauagauggggguuu

SEQ ID NO: 45229 - RNA, 22 nt, Staphylococcus aureus subsp. aureus Mu50
auaaugugauaaauuuugacgg

SEQ ID NO: 45230 - RNA, 22 nt, Staphylococcus aureus subsp. aureus Mu50
auaauuauagcuacugguaugc

SEQ ID NO: 45231 - RNA, 22 nt, Staphylococcus aureus subsp. aureus Mu50
auacauugcgugcaauguauca

SEQ ID NO: 45232 - RNA, 22 nt, Staphylococcus aureus subsp. aureus Mu50
auacggucauacgauuagugug

SEQ ID NO: 45233 - RNA, 22 nt, Staphylococcus aureus subsp. aureus Mu50
auauaaguuuuggugacugaau

SEQ ID NO: 45234 - RNA, 22 nt, Staphylococcus aureus subsp. aureus Mu50
auauacacaucuuucaaaggaa

SEQ ID NO: 45235 - RNA, 22 nt, Staphylococcus aureus subsp. aureus Mu50
auauacaugaugcgugguucuu

SEQ ID NO: 45236 - RNA, 22 nt, Staphylococcus aureus subsp. aureus Mu50
auaugauugauacuacaucaga

SEQ ID NO: 45237 - RNA, 22 nt, Staphylococcus aureus subsp. aureus Mu50
auaugcaacaaauugguuaccu

SEQ ID NO: 45238 - RNA, 22 nt, Staphylococcus aureus subsp. aureus Mu50
auauggacaugauucuucuaau

SEQ ID NO: 45239 - RNA, 22 nt, Staphylococcus aureus subsp. aureus Mu50
aucaagugcuacgaaugauuga

SEQ ID NO: 45240 - RNA, 22 nt, Staphylococcus aureus subsp. aureus Mu50
aucauagguuuauuuaguggcu

SEQ ID NO: 45241 - RNA, 22 nt, Staphylococcus aureus subsp. aureus Mu50
aucauucaaaccuaaguaagcu

SEQ ID NO: 45242 - RNA, 22 nt, Staphylococcus aureus subsp. aureus Mu50
auccaaauguuacauuguucga

SEQ ID NO: 45243 - RNA, 22 nt, Staphylococcus aureus subsp. aureus Mu50
auccaaguaaacaaggucuagu

SEQ ID NO: 45244 - RNA, 22 nt, Staphylococcus aureus subsp. aureus Mu50
auccacaaaaauggcaagcacu

SEQ ID NO: 45245 - RNA, 22 nt, Staphylococcus aureus subsp. aureus Mu50
aucgacuucaucaauaaaaaua

SEQ ID NO: 45246 - RNA, 21 nt, Staphylococcus aureus subsp. aureus Mu50
aucguuaguauuaccauuaga

SEQ ID NO: 45247 - RNA, 22 nt, Staphylococcus aureus subsp. aureus Mu50
aucuagaaucgcaugauaauuu

SEQ ID NO: 45248 - RNA, 22 nt, Staphylococcus aureus subsp. aureus Mu50
aucuauuaauguuucacgguua

SEQ ID NO: 45249 - RNA, 22 nt, Staphylococcus aureus subsp. aureus Mu50
aucucuugcacugcucuuaaau

SEQ ID NO: 45250 - RNA, 22 nt, Staphylococcus aureus subsp. aureus Mu50
augaaggauucuaauaucauuu

SEQ ID NO: 45251 - RNA, 22 nt, Staphylococcus aureus subsp. aureus Mu50
augacguuguugaauuaucuuc

SEQ ID NO: 45252 - RNA, 18 nt, Staphylococcus aureus subsp. aureus Mu50
augaguaaagaugcuuuu

SEQ ID NO: 45253 - RNA, 22 nt, Staphylococcus aureus subsp. aureus Mu50
augauggaagguaaauggcaaa

SEQ ID NO: 45254 - RNA, 22 nt, Staphylococcus aureus subsp. aureus Mu50
augcacauuuauuaguuuuaga

SEQ ID NO: 45255 - RNA, 22 nt, Staphylococcus aureus subsp. aureus Mu50
augcauaaaaaucccagugaua

SEQ ID NO: 45256 - RNA, 21 nt, Staphylococcus aureus subsp. aureus Mu50
augcauaaguauugugagggu

SEQ ID NO: 45257 - RNA, 22 nt, Staphylococcus aureus subsp. aureus Mu50
augcauauucaacuagcucagg

SEQ ID NO: 45258 - RNA, 22 nt, Staphylococcus aureus subsp. aureus Mu50
augcgucacaacguaaaucagc

SEQ ID NO: 45259 - RNA, 22 nt, Staphylococcus aureus subsp. aureus Mu50
augcuguaaguaugauauuagu

SEQ ID NO: 45260 - RNA, 22 nt, Staphylococcus aureus subsp. aureus Mu50
augcuuauaucaaaguagcugg

SEQ ID NO: 45261 - RNA, 22 nt, Staphylococcus aureus subsp. aureus Mu50
augcuugcgaacuagucaguuu

SEQ ID NO: 45262 - RNA, 22 nt, Staphylococcus aureus subsp. aureus Mu50
auggaaauuagcuuuuuugaua

SEQ ID NO: 45263 - RNA, 22 nt, Staphylococcus aureus subsp. aureus Mu50
augguuauaugagacaaauaaa

SEQ ID NO: 45264 - RNA, 22 nt, Staphylococcus aureus subsp. aureus Mu50
augguuggaacaauaucuuuag

SEQ ID NO: 45265 - RNA, 22 nt, Staphylococcus aureus subsp. aureus Mu50
auguaaaaaagcugauuucuau

SEQ ID NO: 45266 - RNA, 22 nt, Staphylococcus aureus subsp. aureus Mu50
auguagagcuuguuuuuggauu

SEQ ID NO: 45267 - RNA, 22 nt, Staphylococcus aureus subsp. aureus Mu50
auguagugguucuuugucauua

SEQ ID NO: 45268 - RNA, 22 nt, Staphylococcus aureus subsp. aureus Mu50
auguaucgguggcuuauucagc

SEQ ID NO: 45269 - RNA, 22 nt, Staphylococcus aureus subsp. aureus Mu50
auguaugguggucuuacauuua

SEQ ID NO: 45270 - RNA, 22 nt, Staphylococcus aureus subsp. aureus Mu50
auguucucuacggguaaucauc

SEQ ID NO: 45271 - RNA, 22 nt, Staphylococcus aureus subsp. aureus Mu50
auguugauguguagccuaaaau

SEQ ID NO: 45272 - RNA, 22 nt, Staphylococcus aureus subsp. aureus Mu50
auguugcaagaacguuuaggga

SEQ ID NO: 45273 - RNA, 22 nt, Staphylococcus aureus subsp. aureus Mu50
auguuuguggcaccucuuuugu

SEQ ID NO: 45274 - RNA, 18 nt, Staphylococcus aureus subsp. aureus Mu50
auguuuuuauuaacagcg

SEQ ID NO: 45275 - RNA, 22 nt, Staphylococcus aureus subsp. aureus Mu50
auuaaaugauucuuuauuggua

SEQ ID NO: 45276 - RNA, 22 nt, Staphylococcus aureus subsp. aureus Mu50
auuaauguuaaauugcucaguu

SEQ ID NO: 45277 - RNA, 22 nt, Staphylococcus aureus subsp. aureus Mu50
auuagaaauagcuucaauggcu

SEQ ID NO: 45278 - RNA, 22 nt, Staphylococcus aureus subsp. aureus Mu50
auuauagaggcaauugcgcuuu

SEQ ID NO: 45279 - RNA, 22 nt, Staphylococcus aureus subsp. aureus Mu50
auuauauggauguaucgccgaa

SEQ ID NO: 45280 - RNA, 22 nt, Staphylococcus aureus subsp. aureus Mu50
auuaucaagugccauuuucgau

SEQ ID NO: 45281 - RNA, 22 nt, Staphylococcus aureus subsp. aureus Mu50
auuaucgauucuugguuuggaa

SEQ ID NO: 45282 - RNA, 22 nt, Staphylococcus aureus subsp. aureus Mu50
auuauuaaacgacuuaucgguu

SEQ ID NO: 45283 - RNA, 21 nt, Staphylococcus aureus subsp. aureus Mu50
auuauuggcgucguuucgagu

SEQ ID NO: 45284 - RNA, 22 nt, Staphylococcus aureus subsp. aureus Mu50
auuauuuaugacaauaugcagu

SEQ ID NO: 45285 - RNA, 22 nt, Staphylococcus aureus subsp. aureus Mu50
auucauccuuaacaaucugucu

SEQ ID NO: 45286 - RNA, 22 nt, Staphylococcus aureus subsp. aureus Mu50
auucaucuaaauccauuuguug

SEQ ID NO: 45287 - RNA, 22 nt, Staphylococcus aureus subsp. aureus Mu50
auucguuaugguuaucauucua

SEQ ID NO: 45288 - RNA, 22 nt, Staphylococcus aureus subsp. aureus Mu50
gauaguuauuuaugugaauggg

SEQ ID NO: 45289 - RNA, 22 nt, Staphylococcus aureus subsp. aureus Mu50
gaucaguugaguaguuguguuu

SEQ ID NO: 45290 - RNA, 22 nt, Staphylococcus aureus subsp. aureus Mu50
gaugaacaagcauaucaauugu

SEQ ID NO: 45291 - RNA, 22 nt, Staphylococcus aureus subsp. aureus Mu50
gaugaugugggaauaguuauuu

SEQ ID NO: 45292 - RNA, 22 nt, Staphylococcus aureus subsp. aureus Mu50
gaugcaauuuuguuauugaugg

SEQ ID NO: 45293 - RNA, 21 nt, Staphylococcus aureus subsp. aureus Mu50
gaugggaauuucgacagugca

SEQ ID NO: 45294 - RNA, 22 nt, Staphylococcus aureus subsp. aureus Mu50
gauuaguuauuaucgguacuua

SEQ ID NO: 45295 - RNA, 22 nt, Staphylococcus aureus subsp. aureus Mu50
gauuguccgaaaguuacuagaa

SEQ ID NO: 45296 - RNA, 22 nt, Staphylococcus aureus subsp. aureus Mu50
gcaacuuuauuuuacgcaauaa

SEQ ID NO: 45297 - RNA, 22 nt, Staphylococcus aureus subsp. aureus Mu50
gcaauacaucuuuaccaucaua

SEQ ID NO: 45298 - RNA, 22 nt, Staphylococcus aureus subsp. aureus Mu50
gcaggcaugaacaaacaagacu

SEQ ID NO: 45299 - RNA, 22 nt, Staphylococcus aureus subsp. aureus Mu50
gcaggcaugagcaaacaaccgu

SEQ ID NO: 45300 - RNA, 22 nt, Staphylococcus aureus subsp. aureus Mu50
gcauuguaguuuauuugcgagg

SEQ ID NO: 45301 - RNA, 22 nt, Staphylococcus aureus subsp. aureus Mu50
gcgauaauuuauuaaugcguau

SEQ ID NO: 45302 - RNA, 22 nt, Staphylococcus aureus subsp. aureus Mu50
gcgguuuugcaugauuauagcg

SEQ ID NO: 45303 - RNA, 22 nt, Staphylococcus aureus subsp. aureus Mu50
gcguugaagaagauaaugucuu

SEQ ID NO: 45304 - RNA, 22 nt, Staphylococcus aureus subsp. aureus Mu50
gcuaguuuaucuagauuagguu

SEQ ID NO: 45305 - RNA, 22 nt, Staphylococcus aureus subsp. aureus Mu50
gcucuauuaaugguguuaugaa

SEQ ID NO: 45306 - RNA, 22 nt, Staphylococcus aureus subsp. aureus Mu50
gcugaaaugguaauaucuuuau

SEQ ID NO: 45307 - RNA, 22 nt, Staphylococcus aureus subsp. aureus Mu50
gcuuauguccugcucuuauuau

SEQ ID NO: 45308 - RNA, 22 nt, Staphylococcus aureus subsp. aureus Mu50
gcuucaaugcuuuuagccauuu

SEQ ID NO: 45309 - RNA, 22 nt, Staphylococcus aureus subsp. aureus Mu50
gcuuuauugaugaugucuuuau

SEQ ID NO: 45310 - RNA, 22 nt, Staphylococcus aureus subsp. aureus Mu50
gcuuuuuagguguggauacauu

SEQ ID NO: 45311 - RNA, 22 nt, Staphylococcus aureus subsp. aureus Mu50
ggaggcacugagucaacuggug

SEQ ID NO: 45312 - RNA, 22 nt, Staphylococcus aureus subsp. aureus Mu50
ggcgaugauaaaguagaugaaa

SEQ ID NO: 45313 - RNA, 22 nt, Staphylococcus aureus subsp. aureus Mu50
ggcgcaugccacuaaaaugauu

SEQ ID NO: 45314 - RNA, 22 nt, Staphylococcus aureus subsp. aureus Mu50
gggagugggacagaaaugauau

SEQ ID NO: 45315 - RNA, 22 nt, Staphylococcus aureus subsp. aureus Mu50
gguaaauauuuaguucuuggag

SEQ ID NO: 45316 - RNA, 22 nt, Staphylococcus aureus subsp. aureus Mu50
gguauagguugcuuuuucguug

SEQ ID NO: 45317 - RNA, 22 nt, Staphylococcus aureus subsp. aureus Mu50
ggugauguagguaagaacuucg

SEQ ID NO: 45318 - RNA, 22 nt, Staphylococcus aureus subsp. aureus Mu50
ggugccugaucuguaauuaccu

SEQ ID NO: 45319 - RNA, 22 nt, Staphylococcus aureus subsp. aureus Mu50
ggugggacgacgaaauaaauuu

SEQ ID NO: 45320 - RNA, 19 nt, Staphylococcus aureus subsp. aureus Mu50
gguguguuauuuuugauga

SEQ ID NO: 45321 - RNA, 22 nt, Staphylococcus aureus subsp. aureus Mu50
gguuggaguaguaugcguguau

SEQ ID NO: 45322 - RNA, 22 nt, Staphylococcus aureus subsp. aureus Mu50
gguugucauuauuguguugaua

SEQ ID NO: 45323 - RNA, 22 nt, Staphylococcus aureus subsp. aureus Mu50
gguuuguuauuccaucaaagca

SEQ ID NO: 45324 - RNA, 22 nt, Staphylococcus aureus subsp. aureus Mu50
guaaagucaucgaaguugcaga

SEQ ID NO: 45325 - RNA, 22 nt, Staphylococcus aureus subsp. aureus Mu50
guaacuguugcuucaaaaauga

SEQ ID NO: 45326 - RNA, 22 nt, Staphylococcus aureus subsp. aureus Mu50
guacaggugaaccauucgauaa

SEQ ID NO: 45327 - RNA, 22 nt, Staphylococcus aureus subsp. aureus Mu50
guaguugacugaacgaaaaugc

SEQ ID NO: 45328 - RNA, 22 nt, Staphylococcus aureus subsp. aureus Mu50
guauccuacugaaaaucuagaa

SEQ ID NO: 45329 - RNA, 22 nt, Staphylococcus aureus subsp. aureus Mu50
guaugaacaguaccaauggauu

SEQ ID NO: 45330 - RNA, 22 nt, Staphylococcus aureus subsp. aureus Mu50
guauuguucaggugucgcauuu

SEQ ID NO: 45331 - RNA, 22 nt, Staphylococcus aureus subsp. aureus Mu50
gucaucauuggaaucuuuauaa

SEQ ID NO: 45332 - RNA, 22 nt, Staphylococcus aureus subsp. aureus Mu50
gucaugcaaaauauauacguau

SEQ ID NO: 45333 - RNA, 22 nt, Staphylococcus aureus subsp. aureus Mu50
gucauugaaaugaugaguguuu

SEQ ID NO: 45334 - RNA, 22 nt, Staphylococcus aureus subsp. aureus Mu50
gugaaaugcucccuucaaagcc

SEQ ID NO: 45335 - RNA, 22 nt, Staphylococcus aureus subsp. aureus Mu50
gugauaauguugaacucguugu

SEQ ID NO: 45336 - RNA, 22 nt, Staphylococcus aureus subsp. aureus Mu50
gugauuuaaaugacgcuauguu

SEQ ID NO: 45337 - RNA, 22 nt, Staphylococcus aureus subsp. aureus Mu50
gugcauauuauaaguaucucua

SEQ ID NO: 45338 - RNA, 22 nt, Staphylococcus aureus subsp. aureus Mu50
guggagaaaaaguacguuguau

SEQ ID NO: 45339 - RNA, 22 nt, Staphylococcus aureus subsp. aureus Mu50
guguauaucuagguguacauua

SEQ ID NO: 45340 - RNA, 22 nt, Staphylococcus aureus subsp. aureus Mu50
gugugggauugcauuguucacu

SEQ ID NO: 45341 - RNA, 22 nt, Staphylococcus aureus subsp. aureus Mu50
guguuacggguguaauguuagc

SEQ ID NO: 45342 - RNA, 22 nt, Staphylococcus aureus subsp. aureus Mu50
guuaacaacugagauaccggcu

SEQ ID NO: 45343 - RNA, 22 nt, Staphylococcus aureus subsp. aureus Mu50
guuaauggcgguguacuuaugg

SEQ ID NO: 45344 - RNA, 22 nt, Staphylococcus aureus subsp. aureus Mu50
guucagauuacauuagcaucua

SEQ ID NO: 45345 - RNA, 22 nt, Staphylococcus aureus subsp. aureus Mu50
guucauugacaaggacugauuu

SEQ ID NO: 45346 - RNA, 22 nt, Staphylococcus aureus subsp. aureus Mu50
guugauguugcuaacuucuuaa

SEQ ID NO: 45347 - RNA, 22 nt, Staphylococcus aureus subsp. aureus Mu50
guuggggugggacaacgaaaua

SEQ ID NO: 45348 - RNA, 21 nt, Staphylococcus aureus subsp. aureus Mu50
guuuuggagaugauuggcuuc

SEQ ID NO: 45349 - RNA, 22 nt, Staphylococcus aureus subsp. aureus Mu50
uaaaagcuucuaacaugauacg

SEQ ID NO: 45350 - RNA, 22 nt, Staphylococcus aureus subsp. aureus Mu50
uaaaauggcugaagcauuuguc

SEQ ID NO: 45351 - RNA, 22 nt, Staphylococcus aureus subsp. aureus Mu50
uaaagauauuuauacagggcua

SEQ ID NO: 45352 - RNA, 22 nt, Staphylococcus aureus subsp. aureus Mu50
uaaagcacucauuauuuaaggc

SEQ ID NO: 45353 - RNA, 20 nt, Staphylococcus aureus subsp. aureus Mu50
uaaagcagcaacgauuauga

SEQ ID NO: 45354 - RNA, 22 nt, Staphylococcus aureus subsp. aureus Mu50
uaaagcuacugauacuauguag

SEQ ID NO: 45355 - RNA, 22 nt, Staphylococcus aureus subsp. aureus Mu50
uaaaggcacgcauacuuuguag

SEQ ID NO: 45356 - RNA, 20 nt, Staphylococcus aureus subsp. aureus Mu50
uaaaguuguuaaaucuaauu

SEQ ID NO: 45357 - RNA, 22 nt, Staphylococcus aureus subsp. aureus Mu50
uaaauaaacaccucgcaaaaga

SEQ ID NO: 45358 - RNA, 22 nt, Staphylococcus aureus subsp. aureus Mu50
uaaauuaauuacuguacaggua

SEQ ID NO: 45359 - RNA, 22 nt, Staphylococcus aureus subsp. aureus Mu50
uaaauugaaugagugucaugcu

SEQ ID NO: 45360 - RNA, 22 nt, Staphylococcus aureus subsp. aureus Mu50
uaaauugguagaugaugcuauu

SEQ ID NO: 45361 - RNA, 22 nt, Staphylococcus aureus subsp. aureus Mu50
ugaacaaccgggcagaaugaaa

SEQ ID NO: 45362 - RNA, 22 nt, Staphylococcus aureus subsp. aureus Mu50
ugaagcaaguuccagcaaaaug

SEQ ID NO: 45363 - RNA, 22 nt, Staphylococcus aureus subsp. aureus Mu50
ugaaguagaugucaacgcuuua

SEQ ID NO: 45364 - RNA, 23 nt, Staphylococcus aureus subsp. aureus Mu50
ugacuucguuuuaccgcguguuu

SEQ ID NO: 45365 - RNA, 22 nt, Staphylococcus aureus subsp. aureus Mu50
ugaggaaaguagugauagcaua

SEQ ID NO: 45366 - RNA, 22 nt, Staphylococcus aureus subsp. aureus Mu50
ugauauugccgguaguguagaa

SEQ ID NO: 45367 - RNA, 22 nt, Staphylococcus aureus subsp. aureus Mu50
ugauguuaucaaacauugaagu

SEQ ID NO: 45368 - RNA, 22 nt, Staphylococcus aureus subsp. aureus Mu50
ugauuauguuauggauaugggc

SEQ ID NO: 45369 - RNA, 20 nt, Staphylococcus aureus subsp. aureus Mu50
ugauuguugggaugauuggu

SEQ ID NO: 45370 - RNA, 21 nt, Staphylococcus aureus subsp. aureus Mu50
ugauuuuagaugggaaccuac

SEQ ID NO: 45371 - RNA, 23 nt, Staphylococcus aureus subsp. aureus Mu50
ugcaaauguugagcgcauauuug

SEQ ID NO: 45372 - RNA, 22 nt, Staphylococcus aureus subsp. aureus Mu50
ugcaacauucguauaucauggc

SEQ ID NO: 45373 - RNA, 22 nt, Staphylococcus aureus subsp. aureus Mu50
ugcauaaaauugugccaaaugc

SEQ ID NO: 45374 - RNA, 22 nt, Staphylococcus aureus subsp. aureus Mu50
ugcauuagcgauuuauaugcuu

SEQ ID NO: 45375 - RNA, 22 nt, Staphylococcus aureus subsp. aureus Mu50
ugccaauagauuugauuuuugu

SEQ ID NO: 45376 - RNA, 22 nt, Staphylococcus aureus subsp. aureus Mu50
ugccugaagcgcuuggauuuuu

SEQ ID NO: 45377 - RNA, 22 nt, Staphylococcus aureus subsp. aureus Mu50
ugcguuaaaggauauuaagauu

SEQ ID NO: 45378 - RNA, 22 nt, Staphylococcus aureus subsp. aureus Mu50
ugcuuuuaagucacaugccuuu

SEQ ID NO: 45379 - RNA, 22 nt, Staphylococcus aureus subsp. aureus Mu50
uggaugaaggugauuagugaga

SEQ ID NO: 45380 - RNA, 22 nt, Staphylococcus aureus subsp. aureus Mu50
uggcauuggaugaaucauuuau

SEQ ID NO: 45381 - RNA, 22 nt, Staphylococcus aureus subsp. aureus Mu50
uggcguuacgcacuaugcugcg

SEQ ID NO: 45382 - RNA, 22 nt, Staphylococcus aureus subsp. aureus Mu50
uggggugggacgacgaaauaaa

SEQ ID NO: 45383 - RNA, 21 nt, Staphylococcus aureus subsp. aureus Mu50
uggguacuuugacagggcguc

SEQ ID NO: 45384 - RNA, 22 nt, Staphylococcus aureus subsp. aureus Mu50
uggguuugguauagucauauuc

SEQ ID NO: 45385 - RNA, 22 nt, Staphylococcus aureus subsp. aureus Mu50
uggugguauugauacucauguu

SEQ ID NO: 45386 - RNA, 22 nt, Staphylococcus aureus subsp. aureus Mu50
ugguuaaaaugauuagcaaugu

SEQ ID NO: 45387 - RNA, 22 nt, Staphylococcus aureus subsp. aureus Mu50
ugguuuaacaauagguguggcu

SEQ ID NO: 45388 - RNA, 22 nt, Staphylococcus aureus subsp. aureus Mu50
ugguuuagcuaagauuggugga

SEQ ID NO: 45389 - RNA, 22 nt, Staphylococcus aureus subsp. aureus Mu50
uguaaaccaccuaugaaagaac

SEQ ID NO: 45390 - RNA, 22 nt, Staphylococcus aureus subsp. aureus Mu50
uguaauuuucuuagcaauuuca

SEQ ID NO: 45391 - RNA, 22 nt, Staphylococcus aureus subsp. aureus Mu50
uguacauuauuguaaguuaugg

SEQ ID NO: 45392 - RNA, 22 nt, Staphylococcus aureus subsp. aureus Mu50
uguacgaaguauuucgaaaaag

SEQ ID NO: 45393 - RNA, 22 nt, Staphylococcus aureus subsp. aureus Mu50
uguacguaguauugccaauguu

SEQ ID NO: 45394 - RNA, 21 nt, Staphylococcus aureus subsp. aureus Mu50
uguaggaaucucuuugucuuu

SEQ ID NO: 45395 - RNA, 22 nt, Staphylococcus aureus subsp. aureus Mu50
uguauugaaucgucaucguuuu

SEQ ID NO: 45396 - RNA, 22 nt, Staphylococcus aureus subsp. aureus Mu50
uguauugucagaaggugucauu

SEQ ID NO: 45397 - RNA, 22 nt, Staphylococcus aureus subsp. aureus Mu50
ugucauuuaacuaaacauguaa

SEQ ID NO: 45398 - RNA, 22 nt, Staphylococcus aureus subsp. aureus Mu50
ugucuugaugaaguuaucuaug

SEQ ID NO: 45399 - RNA, 22 nt, Staphylococcus aureus subsp. aureus Mu50
ugugcuaucgcuauuuuuaguu

SEQ ID NO: 45400 - RNA, 22 nt, Staphylococcus aureus subsp. aureus Mu50
uguggagcaaguagaugcgguu

SEQ ID NO: 45401 - RNA, 18 nt, Staphylococcus aureus subsp. aureus Mu50
uguuaaugaugcauugua

SEQ ID NO: 45402 - RNA, 20 nt, Staphylococcus aureus subsp. aureus Mu50
uguuguggcgccucuuuugu

SEQ ID NO: 45403 - RNA, 22 nt, Staphylococcus aureus subsp. aureus Mu50
uguuuaucuaauaauacccuca

SEQ ID NO: 45404 - RNA, 22 nt, Staphylococcus aureus subsp. aureus Mu50
uguuuaugugggacaagucucu

SEQ ID NO: 45405 - RNA, 22 nt, Staphylococcus aureus subsp. aureus Mu50
uguuuauuugauggggcgcuuu

SEQ ID NO: 45406 - RNA, 22 nt, Staphylococcus aureus subsp. aureus Mu50
uuaaaaaagcagugaaucauuu

SEQ ID NO: 45407 - RNA, 22 nt, Staphylococcus aureus subsp. aureus Mu50
uuaaaacgauuguuuauguuga

SEQ ID NO: 45408 - RNA, 22 nt, Staphylococcus aureus subsp. aureus Mu50
uuaaaagucacaauacacauga

SEQ ID NO: 45409 - RNA, 22 nt, Staphylococcus aureus subsp. aureus Mu50
uuaaagacauucguuuuagcag

SEQ ID NO: 45410 - RNA, 22 nt, Staphylococcus aureus subsp. aureus Mu50
uuaaagcuuuaauugucaguac

SEQ ID NO: 45411 - RNA, 22 nt, Staphylococcus aureus subsp. aureus Mu50
uuaaugaagcuguaaacuuauu

SEQ ID NO: 45412 - RNA, 22 nt, Staphylococcus aureus subsp. aureus Mu50
uuaaugcgaaaguuaaauaucc

SEQ ID NO: 45413 - RNA, 22 nt, Staphylococcus aureus subsp. aureus Mu50
uuaauuguucagcuaccugcau

SEQ ID NO: 45414 - RNA, 18 nt, Staphylococcus aureus subsp. aureus Mu50
uuacagaauguaguggua

SEQ ID NO: 45415 - RNA, 22 nt, Staphylococcus aureus subsp. aureus Mu50
uuacaugagacaccaugguuau

SEQ ID NO: 45416 - RNA, 22 nt, Staphylococcus aureus subsp. aureus Mu50
uuaccgcugaaaauggaauuaa

SEQ ID NO: 45417 - RNA, 22 nt, Staphylococcus aureus subsp. aureus Mu50
uuacuuucaaacaugggucaua

SEQ ID NO: 45418 - RNA, 22 nt, Staphylococcus aureus subsp. aureus Mu50
uuaguauucauauaaauagucu

SEQ ID NO: 45419 - RNA, 22 nt, Staphylococcus aureus subsp. aureus Mu50
uuaguucuugggaugaagguuc

SEQ ID NO: 45420 - RNA, 22 nt, Staphylococcus aureus subsp. aureus Mu50
uuauaacuauuucuaagucuuc

SEQ ID NO: 45421 - RNA, 22 nt, Staphylococcus aureus subsp. aureus Mu50
uuauggucaugaauacuuugca

SEQ ID NO: 45422 - RNA, 22 nt, Staphylococcus aureus subsp. aureus Mu50
uuauguacguacuugggcuugu

SEQ ID NO: 45423 - RNA, 22 nt, Staphylococcus aureus subsp. aureus Mu50
uuaugugcagcuaugauuuuau

SEQ ID NO: 45424 - RNA, 22 nt, Staphylococcus aureus subsp. aureus Mu50
uuauuaacaugauuacgaugaa

SEQ ID NO: 45425 - RNA, 22 nt, Staphylococcus aureus subsp. aureus Mu50
uuauuuauaaggagugagugac

SEQ ID NO: 45426 - RNA, 22 nt, Staphylococcus aureus subsp. aureus Mu50
uuauuucugcagcaaguguuga

SEQ ID NO: 45427 - RNA, 21 nt, Staphylococcus aureus subsp. aureus Mu50
uucagcaaaagucuuuuuaac

SEQ ID NO: 45428 - RNA, 22 nt, Staphylococcus aureus subsp. aureus Mu50
uucaguagaagauguuauuggu

SEQ ID NO: 45429 - RNA, 22 nt, Staphylococcus aureus subsp. aureus Mu50
uucauagucuucugucauguga

SEQ ID NO: 45430 - RNA, 22 nt, Staphylococcus aureus subsp. aureus Mu50
uucauauugaguucauauuuca

SEQ ID NO: 45431 - RNA, 22 nt, Staphylococcus aureus subsp. aureus Mu50
uucauuucugccacacuccuuu

SEQ ID NO: 45432 - RNA, 23 nt, Staphylococcus aureus subsp. aureus Mu50
uuccaauuccaaaugcaauagca

SEQ ID NO: 45433 - RNA, 22 nt, Staphylococcus aureus subsp. aureus Mu50
uucggauuugccauaugacuau

SEQ ID NO: 45434 - RNA, 22 nt, Staphylococcus aureus subsp. aureus MW2
acagaauguagugguaaugaaa

SEQ ID NO: 45435 - RNA, 22 nt, Staphylococcus aureus subsp. aureus MW2
acagaucaugguaacuuuaacg

SEQ ID NO: 45436 - RNA, 22 nt, Staphylococcus aureus subsp. aureus MW2
acauaucgcuugugaugcuaau

SEQ ID NO: 45437 - RNA, 22 nt, Staphylococcus aureus subsp. aureus MW2
acauauugaaaaaugcaccuga

SEQ ID NO: 45438 - RNA, 22 nt, Staphylococcus aureus subsp. aureus MW2
accaauuuguuucuuuguauua

SEQ ID NO: 45439 - RNA, 23 nt, Staphylococcus aureus subsp. aureus MW2
accagcggugacuagggguuuuu

SEQ ID NO: 45440 - RNA, 22 nt, Staphylococcus aureus subsp. aureus MW2
acgaauugaugcauugauauga

SEQ ID NO: 45441 - RNA, 22 nt, Staphylococcus aureus subsp. aureus MW2
acgauuugaaaccguauauaaa

SEQ ID NO: 45442 - RNA, 22 nt, Staphylococcus aureus subsp. aureus MW2
acgucaaucuauauuagagaua

SEQ ID NO: 45443 - RNA, 22 nt, Staphylococcus aureus subsp. aureus MW2
acuauuuguuaauaaauccauu

SEQ ID NO: 45444 - RNA, 22 nt, Staphylococcus aureus subsp. aureus MW2
acugauacaguguuugacuggu

SEQ ID NO: 45445 - RNA, 22 nt, Staphylococcus aureus subsp. aureus MW2
acuggauuauuuugagauaaua

SEQ ID NO: 45446 - RNA, 22 nt, Staphylococcus aureus subsp. aureus MW2
acuuaauggauaauaguguagc

SEQ ID NO: 45447 - RNA, 22 nt, Staphylococcus aureus subsp. aureus MW2
agaaauuggacuuggugcuacg

SEQ ID NO: 45448 - RNA, 22 nt, Staphylococcus aureus subsp. aureus MW2
agacguguauccaauuaaccga

SEQ ID NO: 45449 - RNA, 22 nt, Staphylococcus aureus subsp. aureus MW2
agagguacuagcaagcgcuuug

SEQ ID NO: 45450 - RNA, 22 nt, Staphylococcus aureus subsp. aureus MW2
agauaucuuuaaauggcucuuc

SEQ ID NO: 45451 - RNA, 22 nt, Staphylococcus aureus subsp. aureus MW2
agauauuguugauauggcauuu

SEQ ID NO: 45452 - RNA, 22 nt, Staphylococcus aureus subsp. aureus MW2
agcaagcaguagugacauuuuu

SEQ ID NO: 45453 - RNA, 22 nt, Staphylococcus aureus subsp. aureus MW2
agcaugauacucaauaaaauug

SEQ ID NO: 45454 - RNA, 22 nt, Staphylococcus aureus subsp. aureus MW2
agcaugauuuuagaugggaacc

SEQ ID NO: 45455 - RNA, 22 nt, Staphylococcus aureus subsp. aureus MW2
agccaauguuauuuguuagugu

SEQ ID NO: 45456 - RNA, 21 nt, Staphylococcus aureus subsp. aureus MW2
agccaugauuauccuuuaaau

SEQ ID NO: 45457 - RNA, 22 nt, Staphylococcus aureus subsp. aureus MW2
agcguuguaugaggcaaugauu

SEQ ID NO: 45458 - RNA, 22 nt, Staphylococcus aureus subsp. aureus MW2
agcuagaaguugaugagccauu

SEQ ID NO: 45459 - RNA, 23 nt, Staphylococcus aureus subsp. aureus MW2
agcuuaaaauauuauugauuccu

SEQ ID NO: 45460 - RNA, 22 nt, Staphylococcus aureus subsp. aureus MW2
agcuuacuuauuauuauugcag

SEQ ID NO: 45461 - RNA, 18 nt, Staphylococcus aureus subsp. aureus MW2
agcuugcauuguauugcg

SEQ ID NO: 45462 - RNA, 22 nt, Staphylococcus aureus subsp. aureus MW2
aggcgaauggcuuucaauaaaa

SEQ ID NO: 45463 - RNA, 22 nt, Staphylococcus aureus subsp. aureus MW2
aggguuuaauacuaauauucuu

SEQ ID NO: 45464 - RNA, 22 nt, Staphylococcus aureus subsp. aureus MW2
aguagcauuauucuucuuaaac

SEQ ID NO: 45465 - RNA, 22 nt, Staphylococcus aureus subsp. aureus MW2
agucuucuuuccuauaaucgcu

SEQ ID NO: 45466 - RNA, 22 nt, Staphylococcus aureus subsp. aureus MW2
agugaacuuuccucuuuuuaau

SEQ ID NO: 45467 - RNA, 22 nt, Staphylococcus aureus subsp. aureus MW2
aguucuguaaacgauugcaugg

SEQ ID NO: 45468 - RNA, 22 nt, Staphylococcus aureus subsp. aureus MW2
aguuugaaugauaacucauugc

SEQ ID NO: 45469 - RNA, 22 nt, Staphylococcus aureus subsp. aureus MW2
auaaagugcucucuuagaagua

SEQ ID NO: 45470 - RNA, 22 nt, Staphylococcus aureus subsp. aureus MW2
auaaugcaacgugcauagcagu

SEQ ID NO: 45471 - RNA, 22 nt, Staphylococcus aureus subsp. aureus MW2
auaaugugauaaauuuugacgg

SEQ ID NO: 45472 - RNA, 22 nt, Staphylococcus aureus subsp. aureus MW2
auauacacaucuuucaaaggaa

SEQ ID NO: 45473 - RNA, 20 nt, Staphylococcus aureus subsp. aureus MW2
auaucauguuagaagcuuuu

SEQ ID NO: 45474 - RNA, 22 nt, Staphylococcus aureus subsp. aureus MW2
auaugcaacaaauugguuaccu

SEQ ID NO: 45475 - RNA, 22 nt, Staphylococcus aureus subsp. aureus MW2
auaugcauuuauugucugagua

SEQ ID NO: 45476 - RNA, 22 nt, Staphylococcus aureus subsp. aureus MW2
aucaagugcuacgaaugauuga

SEQ ID NO: 45477 - RNA, 22 nt, Staphylococcus aureus subsp. aureus MW2
auccaaguaaacaaggucuagu

SEQ ID NO: 45478 - RNA, 22 nt, Staphylococcus aureus subsp. aureus MW2
aucgaugaauggaaagauuggu

SEQ ID NO: 45479 - RNA, 22 nt, Staphylococcus aureus subsp. aureus MW2
aucugcaacauauugaucaauu

SEQ ID NO: 45480 - RNA, 22 nt, Staphylococcus aureus subsp. aureus MW2
augauauggcaagcuauauaga

SEQ ID NO: 45481 - RNA, 22 nt, Staphylococcus aureus subsp. aureus MW2
auggacaaauauuccauuggca

SEQ ID NO: 45482 - RNA, 22 nt, Staphylococcus aureus subsp. aureus MW2
auggcgaccauuaucaauggua

SEQ ID NO: 45483 - RNA, 22 nt, Staphylococcus aureus subsp. aureus MW2
auggcuaaaaagauuaacgcga

SEQ ID NO: 45484 - RNA, 22 nt, Staphylococcus aureus subsp. aureus MW2
auggcuuucaguagaguagugg

SEQ ID NO: 45485 - RNA, 22 nt, Staphylococcus aureus subsp. aureus MW2
augguacucguuggcauuguug

SEQ ID NO: 45486 - RNA, 22 nt, Staphylococcus aureus subsp. aureus MW2
augguuauaugagacaaauaaa

SEQ ID NO: 45487 - RNA, 22 nt, Staphylococcus aureus subsp. aureus MW2
augguucugcacguguuauuau

SEQ ID NO: 45488 - RNA, 22 nt, Staphylococcus aureus subsp. aureus MW2
augugcuaaaggagcucgaaac

SEQ ID NO: 45489 - RNA, 22 nt, Staphylococcus aureus subsp. aureus MW2
augugucaacaacaguuaaugg

SEQ ID NO: 45490 - RNA, 22 nt, Staphylococcus aureus subsp. aureus MW2
auguugauguauguaauuuguu

SEQ ID NO: 45491 - RNA, 22 nt, Staphylococcus aureus subsp. aureus MW2
auguugcaagaacguuuaggga

SEQ ID NO: 45492 - RNA, 22 nt, Staphylococcus aureus subsp. aureus MW2
auucaauggcucuguuguuucg

SEQ ID NO: 45493 - RNA, 22 nt, Staphylococcus aureus subsp. aureus MW2
auucguuaugguuaucauucua

SEQ ID NO: 45494 - RNA, 22 nt, Staphylococcus aureus subsp. aureus MW2
auugaagucgcguaauugugaa

SEQ ID NO: 45495 - RNA, 22 nt, Staphylococcus aureus subsp. aureus MW2
auugauacauuauuuguaugua

SEQ ID NO: 45496 - RNA, 22 nt, Staphylococcus aureus subsp. aureus MW2
auugaugugaagcggacaaucu

SEQ ID NO: 45497 - RNA, 22 nt, Staphylococcus aureus subsp. aureus MW2
auugccuuugguauugguguua

SEQ ID NO: 45498 - RNA, 22 nt, Staphylococcus aureus subsp. aureus MW2
auugcguauagugaugugucuu

SEQ ID NO: 45499 - RNA, 22 nt, Staphylococcus aureus subsp. aureus MW2
auuucgaguguauggaugaugu

SEQ ID NO: 45500 - RNA, 19 nt, Staphylococcus aureus subsp. aureus MW2
auuucugucccacucccac

SEQ ID NO: 45501 - RNA, 22 nt, Staphylococcus aureus subsp. aureus MW2
caaacuuucuaaacuuucauca

SEQ ID NO: 45502 - RNA, 22 nt, Staphylococcus aureus subsp. aureus MW2
caaccuauagauuauuuugucg

SEQ ID NO: 45503 - RNA, 16 nt, Staphylococcus aureus subsp. aureus MW2
caaguguuaaauguuu

SEQ ID NO: 45504 - RNA, 22 nt, Staphylococcus aureus subsp. aureus MW2
caauaccguuaguagcuaacuu

SEQ ID NO: 45505 - RNA, 22 nt, Staphylococcus aureus subsp. aureus MW2
caaucguugaaggugaucugag

SEQ ID NO: 45506 - RNA, 22 nt, Staphylococcus aureus subsp. aureus MW2
caaugggagugggacagaaaug

SEQ ID NO: 45507 - RNA, 22 nt, Staphylococcus aureus subsp. aureus MW2
caccuuuaaauaaaauaccauu

SEQ ID NO: 45508 - RNA, 22 nt, Staphylococcus aureus subsp. aureus MW2
ugaagguagauuguuauuagcg

SEQ ID NO: 45509 - RNA, 22 nt, Staphylococcus aureus subsp. aureus MW2
ugacuaugaaaaaucaauacgu

SEQ ID NO: 45510 - RNA, 22 nt, Staphylococcus aureus subsp. aureus MW2
ugauagcauugcuuuaguagcg

SEQ ID NO: 45511 - RNA, 22 nt, Staphylococcus aureus subsp. aureus MW2
ugaugccaagaauuuuaguaag

SEQ ID NO: 45512 - RNA, 22 nt, Staphylococcus aureus subsp. aureus MW2
ugauguuaucaaacauugaagu

SEQ ID NO: 45513 - RNA, 22 nt, Staphylococcus aureus subsp. aureus MW2
ugauuucgcccaccgcguguuu

SEQ ID NO: 45514 - RNA, 22 nt, Staphylococcus aureus subsp. aureus MW2
ugcaaugacacaauuagccuuu

SEQ ID NO: 45515 - RNA, 22 nt, Staphylococcus aureus subsp. aureus MW2
ugcacuuaguugaacaaauucu

SEQ ID NO: 45516 - RNA, 22 nt, Staphylococcus aureus subsp. aureus MW2
ugcaugucagucauagaaaaga

SEQ ID NO: 45517 - RNA, 22 nt, Staphylococcus aureus subsp. aureus MW2
ugcuacaaacgcuugugcauua

SEQ ID NO: 45518 - RNA, 21 nt, Staphylococcus aureus subsp. aureus MW2
ugcuagcaagcgcuuuucuau

SEQ ID NO: 45519 - RNA, 22 nt, Staphylococcus aureus subsp. aureus MW2
uggauuagcugaaaugauaaau

SEQ ID NO: 45520 - RNA, 23 nt, Staphylococcus aureus subsp. aureus MW2
uggcuccguuucauuacguaaua

SEQ ID NO: 45521 - RNA, 22 nt, Staphylococcus aureus subsp. aureus MW2
uggcuucaaugguauuuuuauu

SEQ ID NO: 45522 - RNA, 22 nt, Staphylococcus aureus subsp. aureus MW2
ugguaaaucaauuauuaaacuu

SEQ ID NO: 45523 - RNA, 22 nt, Staphylococcus aureus subsp. aureus MW2
uguaaugguagcugucuugaua

SEQ ID NO: 45524 - RNA, 22 nt, Staphylococcus aureus subsp. aureus MW2
ugucaguguuggugauaucguu

SEQ ID NO: 45525 - RNA, 22 nt, Staphylococcus aureus subsp. aureus MW2
ugugaauaagcucccuucaaag

SEQ ID NO: 45526 - RNA, 22 nt, Staphylococcus aureus subsp. aureus MW2
uguuugaaucgguaaaguugau

SEQ ID NO: 45527 - RNA, 22 nt, Staphylococcus aureus subsp. aureus MW2
uuaaagacauucguuuuagcag

SEQ ID NO: 45528 - RNA, 22 nt, Staphylococcus aureus subsp. aureus MW2
uuacaaacuuuaucagaugaug

SEQ ID NO: 45529 - RNA, 22 nt, Staphylococcus aureus subsp. aureus MW2
uuaccguuaguagcuaaauauc

SEQ ID NO: 45530 - RNA, 22 nt, Staphylococcus aureus subsp. aureus MW2
uuacuaguaauuaucagcauuu

SEQ ID NO: 45531 - RNA, 22 nt, Staphylococcus aureus subsp. aureus MW2
uuacugaaaaugguuaugguaa

SEQ ID NO: 45532 - RNA, 22 nt, Staphylococcus aureus subsp. aureus MW2
uuauguacguacuugggcuugu

SEQ ID NO: 45533 - RNA, 22 nt, Staphylococcus aureus subsp. aureus MW2
uucaauacacauuuagauuuaa

SEQ ID NO: 45534 - RNA, 23 nt, Staphylococcus aureus subsp. aureus MW2
uucauacauuacuuuggaguaau

SEQ ID NO: 45535 - RNA, 22 nt, Staphylococcus aureus subsp. aureus MW2
uucauagucuucugucauguga

SEQ ID NO: 45536 - RNA, 22 nt, Staphylococcus aureus subsp. aureus MW2
uucaucuguccgauuuuuugau

SEQ ID NO: 45537 - RNA, 22 nt, Staphylococcus aureus subsp. aureus MW2
uucauuacauguuacugaugaa

SEQ ID NO: 45538 - RNA, 22 nt, Staphylococcus aureus subsp. aureus MW2
uucggcuuuccuaauggucgug

SEQ ID NO: 45539 - RNA, 22 nt, Staphylococcus aureus subsp. aureus MW2
uucgguaacauuaugaaaccau

SEQ ID NO: 45540 - RNA, 23 nt, Staphylococcus aureus subsp. aureus MW2
uucuauggagggauuuuccguga

SEQ ID NO: 45541 - RNA, 22 nt, Staphylococcus aureus subsp. aureus MW2
uucuuuaggaugauucgcguga

SEQ ID NO: 45542 - RNA, 20 nt, Staphylococcus aureus subsp. aureus MW2
uugaagccuuauuugucguu

SEQ ID NO: 45543 - RNA, 22 nt, Staphylococcus aureus subsp. aureus MW2
uugacugaaugaaaauacgcuu

SEQ ID NO: 45544 - RNA, 22 nt, Staphylococcus aureus subsp. aureus MW2
uugauacagcugguacauuagu

SEQ ID NO: 45545 - RNA, 22 nt, Staphylococcus aureus subsp. aureus MW2
uugcagcaaugugaucugcauc

SEQ ID NO: 45546 - RNA, 22 nt, Staphylococcus aureus subsp. aureus MW2
uugcgauugguauaguaguuua

SEQ ID NO: 45547 - RNA, 22 nt, Staphylococcus aureus subsp. aureus MW2
uugguaaguauuuaagugaagu

SEQ ID NO: 45548 - RNA, 22 nt, Staphylococcus aureus subsp. aureus MW2
uuguagauaaauuagcguuguu

SEQ ID NO: 45549 - RNA, 22 nt, Staphylococcus aureus subsp. aureus MW2
uugugaaauauucggcgguacu

SEQ ID NO: 45550 - RNA, 22 nt, Staphylococcus aureus subsp. aureus MW2
uuuaccagguguaucgauugcu

SEQ ID NO: 45551 - RNA, 22 nt, Staphylococcus aureus subsp. aureus MW2
aaacauguauguaugaguauau

SEQ ID NO: 45552 - RNA, 22 nt, Staphylococcus aureus subsp. aureus MW2
aaagaugucuaaauuuaaaguu

SEQ ID NO: 45553 - RNA, 22 nt, Staphylococcus aureus subsp. aureus MW2
aaagcacucauuauuuaaggcg

SEQ ID NO: 45554 - RNA, 22 nt, Staphylococcus aureus subsp. aureus MW2
aaagcgaccaauuuugcagugu

SEQ ID NO: 45555 - RNA, 22 nt, Staphylococcus aureus subsp. aureus MW2
aaagcgcuugcuagcaucaucu

SEQ ID NO: 45556 - RNA, 22 nt, Staphylococcus aureus subsp. aureus MW2
aaagcuucuaacaugauaugga

SEQ ID NO: 45557 - RNA, 22 nt, Staphylococcus aureus subsp. aureus MW2
aaaggugcauguaauguugaac

SEQ ID NO: 45558 - RNA, 22 nt, Staphylococcus aureus subsp. aureus MW2
aaauacuguaaugaagaaugua

SEQ ID NO: 45559 - RNA, 22 nt, Staphylococcus aureus subsp. aureus MW2
aaaucacgcaggugaauugguu

SEQ ID NO: 45560 - RNA, 22 nt, Staphylococcus aureus subsp. aureus MW2
aaaucaucgaacaugaaugaua

SEQ ID NO: 45561 - RNA, 22 nt, Staphylococcus aureus subsp. aureus MW2
aaauccauuaugcuuauuuugu

SEQ ID NO: 45562 - RNA, 21 nt, Staphylococcus aureus subsp. aureus MW2
aaaugguuggagauaucauuu

SEQ ID NO: 45563 - RNA, 22 nt, Staphylococcus aureus subsp. aureus MW2
aacacgcgguaaaacgaaguca

SEQ ID NO: 45564 - RNA, 22 nt, Staphylococcus aureus subsp. aureus MW2
aacacuuaucaaucaagcuauu

SEQ ID NO: 45565 - RNA, 22 nt, Staphylococcus aureus subsp. aureus MW2
aacgaugcgaacaauuuuaacg

SEQ ID NO: 45566 - RNA, 22 nt, Staphylococcus aureus subsp. aureus MW2
aacugguacuuuaucgcagcga

SEQ ID NO: 45567 - RNA, 22 nt, Staphylococcus aureus subsp. aureus MW2
aagaagcugaaucagguaaagc

SEQ ID NO: 45568 - RNA, 20 nt, Staphylococcus aureus subsp. aureus MW2
aagaccucuguuuuuggugu

SEQ ID NO: 45569 - RNA, 22 nt, Staphylococcus aureus subsp. aureus MW2
aagaccuucaacauguaggaga

SEQ ID NO: 45570 - RNA, 22 nt, Staphylococcus aureus subsp. aureus MW2
aagcgcauuuucguucagucaa

SEQ ID NO: 45571 - RNA, 22 nt, Staphylococcus aureus subsp. aureus MW2
aagggcuauuggagguauuguu

SEQ ID NO: 45572 - RNA, 22 nt, Staphylococcus aureus subsp. aureus MW2
aagugguuaguagguucaucua

SEQ ID NO: 45573 - RNA, 22 nt, Staphylococcus aureus subsp. aureus MW2
aaguuagacguugcauuagguu

SEQ ID NO: 45574 - RNA, 21 nt, Staphylococcus aureus subsp. aureus MW2
aauaacaguuacaaaugcuga

SEQ ID NO: 45575 - RNA, 22 nt, Staphylococcus aureus subsp. aureus MW2
aauacacuaaucgcacguacuc

SEQ ID NO: 45576 - RNA, 22 nt, Staphylococcus aureus subsp. aureus MW2
aauaguuguaccgacagcgccu

SEQ ID NO: 45577 - RNA, 22 nt, Staphylococcus aureus subsp. aureus MW2
aaucaucuuacugcuguuuguu

SEQ ID NO: 45578 - RNA, 19 nt, Staphylococcus aureus subsp. aureus MW2
aaucauggcauuuaucgca

SEQ ID NO: 45579 - RNA, 23 nt, Staphylococcus aureus subsp. aureus MW2
aaucgcuuguacgaugaguaugg

SEQ ID NO: 45580 - RNA, 22 nt, Staphylococcus aureus subsp. aureus MW2
aaugauguaaaacuguauauag

SEQ ID NO: 45581 - RNA, 22 nt, Staphylococcus aureus subsp. aureus MW2
aaugcgauugcgccuaugauug

SEQ ID NO: 45582 - RNA, 22 nt, Staphylococcus aureus subsp. aureus MW2
aauggaauuuaagacgcugcau

SEQ ID NO: 45583 - RNA, 22 nt, Staphylococcus aureus subsp. aureus MW2
aauggcuaaagaacuuguugaa

SEQ ID NO: 45584 - RNA, 22 nt, Staphylococcus aureus subsp. aureus MW2
aaugugcuuacuugccuuuuuc

SEQ ID NO: 45585 - RNA, 22 nt, Staphylococcus aureus subsp. aureus MW2
aauuacagaggcaauugcgcuu

SEQ ID NO: 45586 - RNA, 22 nt, Staphylococcus aureus subsp. aureus MW2
aauucgauggguaauaaacaau

SEQ ID NO: 45587 - RNA, 22 nt, Staphylococcus aureus subsp. aureus MW2
aauucuacaucaauccuacagg

SEQ ID NO: 45588 - RNA, 22 nt, Staphylococcus aureus subsp. aureus MW2
acaaugcguuagucgaugccuu

SEQ ID NO: 45589 - RNA, 22 nt, Staphylococcus aureus subsp. aureus MW2
acaauuucuuaugcaccaggua

SEQ ID NO: 45590 - RNA, 22 nt, Staphylococcus aureus subsp. aureus MW2
acagcaguugcagguguaauug

SEQ ID NO: 45591 - RNA, 22 nt, Staphylococcus aureus subsp. aureus MW2
acagcuggugagauagguguca

SEQ ID NO: 45592 - RNA, 22 nt, Staphylococcus aureus subsp. aureus MW2
acagcuguuaaaauggcauaga

SEQ ID NO: 45593 - RNA, 22 nt, Staphylococcus aureus subsp. aureus MW2
acagguaaauacuacaucacug

SEQ ID NO: 45594 - RNA, 22 nt, Staphylococcus aureus subsp. aureus MW2
acaggugguaaaacuuguaugu

SEQ ID NO: 45595 - RNA, 22 nt, Staphylococcus aureus subsp. aureus MW2
acaugaaggaaaccacuuugau

SEQ ID NO: 45596 - RNA, 22 nt, Staphylococcus aureus subsp. aureus MW2
acaugauagaauuuuauaugua

SEQ ID NO: 45597 - RNA, 22 nt, Staphylococcus aureus subsp. aureus MW2
accacguaucauguuuuaguau

SEQ ID NO: 45598 - RNA, 22 nt, Staphylococcus aureus subsp. aureus MW2
accagcauuugcguuaggcugu

SEQ ID NO: 45599 - RNA, 22 nt, Staphylococcus aureus subsp. aureus MW2
acguagcaguuaccacuugaac

SEQ ID NO: 45600 - RNA, 22 nt, Staphylococcus aureus subsp. aureus MW2
acuauagaauguauggugucaa

SEQ ID NO: 45601 - RNA, 22 nt, Staphylococcus aureus subsp. aureus MW2
acucaagcagguauuaugaaag

SEQ ID NO: 45602 - RNA, 22 nt, Staphylococcus aureus subsp. aureus MW2
acugaaauaucaauauuggaga

SEQ ID NO: 45603 - RNA, 21 nt, Staphylococcus aureus subsp. aureus MW2
acuuucuguuucauuaguugu

SEQ ID NO: 45604 - RNA, 20 nt, Staphylococcus aureus subsp. aureus MW2
agacaccucauauugguauu

SEQ ID NO: 45605 - RNA, 22 nt, Staphylococcus aureus subsp. aureus MW2
agauauuguuaaacuaugugga

SEQ ID NO: 45606 - RNA, 22 nt, Staphylococcus aureus subsp. aureus MW2
agaugacuucauuuugagagcg

SEQ ID NO: 45607 - RNA, 23 nt, Staphylococcus aureus subsp. aureus MW2
agcauggugugcgguuugacgau

SEQ ID NO: 45608 - RNA, 19 nt, Staphylococcus aureus subsp. aureus MW2
agccugaagguuaauuaua

SEQ ID NO: 45609 - RNA, 22 nt, Staphylococcus aureus subsp. aureus MW2
agccuguauacguuugaguggu

SEQ ID NO: 45610 - RNA, 22 nt, Staphylococcus aureus subsp. aureus MW2
agcgacuaaagauaaugaagug

SEQ ID NO: 45611 - RNA, 20 nt, Staphylococcus aureus subsp. aureus MW2
agcuuugucauaauaugcgu

SEQ ID NO: 45612 - RNA, 22 nt, Staphylococcus aureus subsp. aureus MW2
agguaacuuauuaagcaaugaa

SEQ ID NO: 45613 - RNA, 22 nt, Staphylococcus aureus subsp. aureus MW2
agguaucguuucuguuccauaa

SEQ ID NO: 45614 - RNA, 22 nt, Staphylococcus aureus subsp. aureus MW2
agguuguccuuuuucauuuaau

SEQ ID NO: 45615 - RNA, 19 nt, Staphylococcus aureus subsp. aureus MW2
aguaagugacguuaaauau

SEQ ID NO: 45616 - RNA, 22 nt, Staphylococcus aureus subsp. aureus MW2
aguauaucaucuggugcugaug

SEQ ID NO: 45617 - RNA, 22 nt, Staphylococcus aureus subsp. aureus MW2
aguauguuaaacauuaaaaaug

SEQ ID NO: 45618 - RNA, 22 nt, Staphylococcus aureus subsp. aureus MW2
aguuagauuuaagcgcauuagu

SEQ ID NO: 45619 - RNA, 22 nt, Staphylococcus aureus subsp. aureus MW2
auaaagacuuggucgaaucgug

SEQ ID NO: 45620 - RNA, 22 nt, Staphylococcus aureus subsp. aureus MW2
auaaccuaauagaugugaaguc

SEQ ID NO: 45621 - RNA, 19 nt, Staphylococcus aureus subsp. aureus MW2
auacauugauuuacaccuu

SEQ ID NO: 45622 - RNA, 22 nt, Staphylococcus aureus subsp. aureus MW2
auacggucauacgauuagugug

SEQ ID NO: 45623 - RNA, 22 nt, Staphylococcus aureus subsp. aureus MW2
auaguaucugcagauuguucaa

SEQ ID NO: 45624 - RNA, 22 nt, Staphylococcus aureus subsp. aureus MW2
auagugaguuuguuacauauug

SEQ ID NO: 45625 - RNA, 22 nt, Staphylococcus aureus subsp. aureus MW2
auaucgcucauauguugcgaau

SEQ ID NO: 45626 - RNA, 22 nt, Staphylococcus aureus subsp. aureus MW2
aucaagcuguagaaaugguuuc

SEQ ID NO: 45627 - RNA, 22 nt, Staphylococcus aureus subsp. aureus MW2
aucaggugucgccauagguauu

SEQ ID NO: 45628 - RNA, 22 nt, Staphylococcus aureus subsp. aureus MW2
aucauucaaaccuaaguaagcu

SEQ ID NO: 45629 - RNA, 22 nt, Staphylococcus aureus subsp. aureus MW2
aucgaauuuuugaauaguuggu

SEQ ID NO: 45630 - RNA, 22 nt, Staphylococcus aureus subsp. aureus MW2
aucuuacaaucaauaauuuugu

SEQ ID NO: 45631 - RNA, 22 nt, Staphylococcus aureus subsp. aureus MW2
augacguuguugaauuaucuuc

SEQ ID NO: 45632 - RNA, 22 nt, Staphylococcus aureus subsp. aureus MW2
augagagucacccuauaaaguu

SEQ ID NO: 45633 - RNA, 22 nt, Staphylococcus aureus subsp. aureus MW2
augaguuaaauuaagcugugau

SEQ ID NO: 45634 - RNA, 22 nt, Staphylococcus aureus subsp. aureus MW2
augauggagugggaagauggaa

SEQ ID NO: 45635 - RNA, 22 nt, Staphylococcus aureus subsp. aureus MW2
augcauauucaacuagcucagg

SEQ ID NO: 45636 - RNA, 22 nt, Staphylococcus aureus subsp. aureus MW2
augcuaauaaaauaaguguugu

SEQ ID NO: 45637 - RNA, 22 nt, Staphylococcus aureus subsp. aureus MW2
auggcaaaaucaugcuugcaua

SEQ ID NO: 45638 - RNA, 22 nt, Staphylococcus aureus subsp. aureus MW2
auggcaguuauagcauuauuca

SEQ ID NO: 45639 - RNA, 22 nt, Staphylococcus aureus subsp. aureus MW2
auggcuauuuacgcauaaugca

SEQ ID NO: 45640 - RNA, 22 nt, Staphylococcus aureus subsp. aureus MW2
auguagcgauucuuuaucauua

SEQ ID NO: 45641 - RNA, 22 nt, Staphylococcus aureus subsp. aureus MW2
augugaauauagguucauugug

SEQ ID NO: 45642 - RNA, 22 nt, Staphylococcus aureus subsp. aureus MW2
auuagguuuaguaggagaaucg

SEQ ID NO: 45643 - RNA, 22 nt, Staphylococcus aureus subsp. aureus MW2
auucaucuaaauccauuuguug

SEQ ID NO: 45644 - RNA, 22 nt, Staphylococcus aureus subsp. aureus MW2
auugaaguacacguuuauggca

SEQ ID NO: 45645 - RNA, 22 nt, Staphylococcus aureus subsp. aureus MW2
auugaggcagaauuagcgcgua

SEQ ID NO: 45646 - RNA, 19 nt, Staphylococcus aureus subsp. aureus MW2
auugcauuagcugccuaua

SEQ ID NO: 45647 - RNA, 19 nt, Staphylococcus aureus subsp. aureus MW2
auuucugucccacucccaa

SEQ ID NO: 45648 - RNA, 22 nt, Staphylococcus aureus subsp. aureus MW2
auuuggaacuuuguuagguaua

SEQ ID NO: 45649 - RNA, 22 nt, Staphylococcus aureus subsp. aureus MW2
caaaguaauguaugaaguugug

SEQ ID NO: 45650 - RNA, 22 nt, Staphylococcus aureus subsp. aureus MW2
caacagauggaucuggaugcac

SEQ ID NO: 45651 - RNA, 22 nt, Staphylococcus aureus subsp. aureus MW2
caagguugacuagaauugaaaa

SEQ ID NO: 45652 - RNA, 23 nt, Staphylococcus aureus subsp. aureus MW2
caauaucugcuaauguuaacggc

SEQ ID NO: 45653 - RNA, 22 nt, Staphylococcus aureus subsp. aureus MW2
caaucguaagggaucuuagcua

SEQ ID NO: 45654 - RNA, 23 nt, Staphylococcus aureus subsp. aureus MW2
cacggcucgaacaagucuuuuuu

SEQ ID NO: 45655 - RNA, 22 nt, Staphylococcus aureus subsp. aureus MW2
cagcuaaauuacuaccuucagu

SEQ ID NO: 45656 - RNA, 22 nt, Staphylococcus aureus subsp. aureus MW2
caguuacagcaaucgcuuuagu

SEQ ID NO: 45657 - RNA, 22 nt, Staphylococcus aureus subsp. aureus MW2
cauaacuacggcuagcaguuuu

SEQ ID NO: 45658 - RNA, 21 nt, Staphylococcus aureus subsp. aureus MW2
caugacauuaaggcuuuagua

SEQ ID NO: 45659 - RNA, 22 nt, Staphylococcus aureus subsp. aureus MW2
cauuaagucgcacgauagaauc

SEQ ID NO: 45660 - RNA, 22 nt, Staphylococcus aureus subsp. aureus MW2
cauugccaucaaacuacuuuca

SEQ ID NO: 45661 - RNA, 22 nt, Staphylococcus aureus subsp. aureus MW2
cauuucguugacccacuuccug

SEQ ID NO: 45662 - RNA, 22 nt, Staphylococcus aureus subsp. aureus MW2
cauuuguguuagcauagacgcu

SEQ ID NO: 45663 - RNA, 20 nt, Staphylococcus aureus subsp. aureus MW2
ccagaugguuaugguuuuuu

SEQ ID NO: 45664 - RNA, 20 nt, Staphylococcus aureus subsp. aureus MW2
ccucaaggugaugcaggauu

SEQ ID NO: 45665 - RNA, 22 nt, Staphylococcus aureus subsp. aureus MW2
ccuuagcuagauugaaaauggg

SEQ ID NO: 45666 - RNA, 22 nt, Staphylococcus aureus subsp. aureus MW2
cgcaauauuaucaagcucuuuc

SEQ ID NO: 45667 - RNA, 22 nt, Staphylococcus aureus subsp. aureus MW2
cgccacuuuuuuugugcuguaa

SEQ ID NO: 45668 - RNA, 22 nt, Staphylococcus aureus subsp. aureus MW2
cggauauuguuaugguguugcu

SEQ ID NO: 45669 - RNA, 22 nt, Staphylococcus aureus subsp. aureus MW2
cuauugaugguuuuagcagcau

SEQ ID NO: 45670 - RNA, 22 nt, Staphylococcus aureus subsp. aureus MW2
cucaaguaguaacguaguacgu

SEQ ID NO: 45671 - RNA, 22 nt, Staphylococcus aureus subsp. aureus MW2
cucguuaaaggucauaauuaac

SEQ ID NO: 45672 - RNA, 22 nt, Staphylococcus aureus subsp. aureus MW2
cugcaggucaacguuuaaaaga

SEQ ID NO: 45673 - RNA, 22 nt, Staphylococcus aureus subsp. aureus MW2
cugcaguauuaccauugcuuaa

SEQ ID NO: 45674 - RNA, 22 nt, Staphylococcus aureus subsp. aureus MW2
cuuaguuaaagcgcgcacucaa

SEQ ID NO: 45675 - RNA, 22 nt, Staphylococcus aureus subsp. aureus MW2
cuugaauagugagcguauuauu

SEQ ID NO: 45676 - RNA, 22 nt, Staphylococcus aureus subsp. aureus MW2
cuuuccaaguuaaagauuuacc

SEQ ID NO: 45677 - RNA, 22 nt, Staphylococcus aureus subsp. aureus MW2
gaacgaugacaccacugauuac

SEQ ID NO: 45678 - RNA, 22 nt, Staphylococcus aureus subsp. aureus MW2
gacaaaguaucauuaacgauga

SEQ ID NO: 45679 - RNA, 22 nt, Staphylococcus aureus subsp. aureus MW2
gaguuuaaaaaagguuaaguac

SEQ ID NO: 45680 - RNA, 22 nt, Staphylococcus aureus subsp. aureus MW2
gauagcaucguuuuguuccuuu

SEQ ID NO: 45681 - RNA, 22 nt, Staphylococcus aureus subsp. aureus MW2
gaugauauuucaagauccguau

SEQ ID NO: 45682 - RNA, 22 nt, Staphylococcus aureus subsp. aureus MW2
gaugauuuugguuauggcucua

SEQ ID NO: 45683 - RNA, 22 nt, Staphylococcus aureus subsp. aureus MW2
gauguaacuugaacgauuaaaa

SEQ ID NO: 45684 - RNA, 22 nt, Staphylococcus aureus subsp. aureus MW2
gauuaaguucuuuaacuucauc

SEQ ID NO: 45685 - RNA, 22 nt, Staphylococcus aureus subsp. aureus MW2
gauuacuaugacuauuguauuu

SEQ ID NO: 45686 - RNA, 22 nt, Staphylococcus aureus subsp. aureus MW2
gauuaguuauuaucgguacuua

SEQ ID NO: 45687 - RNA, 22 nt, Staphylococcus aureus subsp. aureus MW2
gauugagauaccagaugcgaac

SEQ ID NO: 45688 - RNA, 22 nt, Staphylococcus aureus subsp. aureus MW2
gcaagguugacuagaauugaaa

SEQ ID NO: 45689 - RNA, 22 nt, Staphylococcus aureus subsp. aureus MW2
gcacagauauuuuuacaaugag

SEQ ID NO: 45690 - RNA, 22 nt, Staphylococcus aureus subsp. aureus MW2
gcaggcaugaacaaacaagacu

SEQ ID NO: 45691 - RNA, 22 nt, Staphylococcus aureus subsp. aureus MW2
gcaucagcaacugcuguauugu

SEQ ID NO: 45692 - RNA, 22 nt, Staphylococcus aureus subsp. aureus MW2
gccaauuuaucuauucaucuuc

SEQ ID NO: 45693 - RNA, 22 nt, Staphylococcus aureus subsp. aureus MW2
gccauacauaugaaguggauag

SEQ ID NO: 45694 - RNA, 22 nt, Staphylococcus aureus subsp. aureus MW2
gccuagagaguucuguuuaguu

SEQ ID NO: 45695 - RNA, 22 nt, Staphylococcus aureus subsp. aureus MW2
gcguuguauauggugcgauuuc

SEQ ID NO: 45696 - RNA, 22 nt, Staphylococcus aureus subsp. aureus MW2
gcuaugauaugaagguuuagca

SEQ ID NO: 45697 - RNA, 22 nt, Staphylococcus aureus subsp. aureus MW2
gcugaacuuuuuacuauaucaa

SEQ ID NO: 45698 - RNA, 22 nt, Staphylococcus aureus subsp. aureus MW2
gcuguaauuauuguagcuauaa

SEQ ID NO: 45699 - RNA, 22 nt, Staphylococcus aureus subsp. aureus MW2
guacuugagcagguuuguaugc

SEQ ID NO: 45700 - RNA, 22 nt, Staphylococcus aureus subsp. aureus MW2
guaguuauggugaaacucaaag

SEQ ID NO: 45701 - RNA, 21 nt, Staphylococcus aureus subsp. aureus MW2
guaucaguauuaauagugauc

SEQ ID NO: 45702 - RNA, 22 nt, Staphylococcus aureus subsp. aureus MW2
guaucauuuaagcugaaacgcg

SEQ ID NO: 45703 - RNA, 22 nt, Staphylococcus aureus subsp. aureus MW2
guaugaacaguaccaauggauu

SEQ ID NO: 45704 - RNA, 22 nt, Staphylococcus aureus subsp. aureus MW2
gucaacaaguagaugccaauug

SEQ ID NO: 45705 - RNA, 21 nt, Staphylococcus aureus subsp. aureus MW2
gucgauacgauuaugcaacgu

SEQ ID NO: 45706 - RNA, 22 nt, Staphylococcus aureus subsp. aureus MW2
gugauagaagagaaggccacac

SEQ ID NO: 45707 - RNA, 22 nt, Staphylococcus aureus subsp. aureus MW2
gugcuggcgaaaagaaaguuaa

SEQ ID NO: 45708 - RNA, 22 nt, Staphylococcus aureus subsp. aureus MW2
guggauuaggugauuucauuuu

SEQ ID NO: 45709 - RNA, 20 nt, Staphylococcus aureus subsp. aureus MW2
guguggcccuuuuuauuauu

SEQ ID NO: 45710 - RNA, 22 nt, Staphylococcus aureus subsp. aureus MW2
guuaacaacugagauaccggcu

SEQ ID NO: 45711 - RNA, 22 nt, Staphylococcus aureus subsp. aureus MW2
guucacucacacauuagucaug

SEQ ID NO: 45712 - RNA, 22 nt, Staphylococcus aureus subsp. aureus MW2
guucagauuacauuagcaucua

SEQ ID NO: 45713 - RNA, 22 nt, Staphylococcus aureus subsp. aureus MW2
guucgauugauuuagaagauaa

SEQ ID NO: 45714 - RNA, 22 nt, Staphylococcus aureus subsp. aureus MW2
uaacuguucaagauauugccaa

SEQ ID NO: 45715 - RNA, 22 nt, Staphylococcus aureus subsp. aureus MW2
uaagugaaauaauuauuaguau

SEQ ID NO: 45716 - RNA, 22 nt, Staphylococcus aureus subsp. aureus MW2
uaauaccagcgauuugagcagu

SEQ ID NO: 45717 - RNA, 22 nt, Staphylococcus aureus subsp. aureus MW2
uaaugcaggccaacuaaauauu

SEQ ID NO: 45718 - RNA, 22 nt, Staphylococcus aureus subsp. aureus MW2
uaauugugacauaaguugcuga

SEQ ID NO: 45719 - RNA, 22 nt, Staphylococcus aureus subsp. aureus MW2
uacaagcaaaaguagcggugau

SEQ ID NO: 45720 - RNA, 22 nt, Staphylococcus aureus subsp. aureus MW2
uaccugaugauguagguggaag

SEQ ID NO: 45721 - RNA, 22 nt, Staphylococcus aureus subsp. aureus MW2
uacgauacugaauguauuugaa

SEQ ID NO: 45722 - RNA, 22 nt, Staphylococcus aureus subsp. aureus MW2
uacuugaacagcgcuaacaaau

SEQ ID NO: 45723 - RNA, 22 nt, Staphylococcus aureus subsp. aureus MW2
uagacaccaaaaacagaggucu

SEQ ID NO: 45724 - RNA, 22 nt, Staphylococcus aureus subsp. aureus MW2
uagaugaacuuaauuugaugac

SEQ ID NO: 45725 - RNA, 22 nt, Staphylococcus aureus subsp. aureus MW2
uagaugaugaugguuauuucug

SEQ ID NO: 45726 - RNA, 22 nt, Staphylococcus aureus subsp. aureus MW2
uaggauauacauuuaaaacagc

SEQ ID NO: 45727 - RNA, 23 nt, Staphylococcus aureus subsp. aureus MW2
uaguaacgcucuuaaguguguca

SEQ ID NO: 45728 - RNA, 22 nt, Staphylococcus aureus subsp. aureus MW2
uaguguaguucccauaacaauu

SEQ ID NO: 45729 - RNA, 21 nt, Staphylococcus aureus subsp. aureus MW2
uaucaacuugaauguaugagu

SEQ ID NO: 45730 - RNA, 22 nt, Staphylococcus aureus subsp. aureus MW2
uaucaugcauguuauuaacaga

SEQ ID NO: 45731 - RNA, 22 nt, Staphylococcus aureus subsp. aureus MW2
uauccugaauacgaugauguug

SEQ ID NO: 45732 - RNA, 22 nt, Staphylococcus aureus subsp. aureus MW2
uaugcuaaggacauuauucugc

SEQ ID NO: 45733 - RNA, 22 nt, Staphylococcus aureus subsp. aureus MW2
uaugucaagguuuugacuuauu

SEQ ID NO: 45734 - RNA, 22 nt, Staphylococcus aureus subsp. aureus MW2
uauguuucuaaaaaacaguacg

SEQ ID NO: 45735 - RNA, 22 nt, Staphylococcus aureus subsp. aureus MW2
uauuucgucgucccaccccaac

SEQ ID NO: 45736 - RNA, 21 nt, Staphylococcus aureus subsp. aureus MW2
ucagauucugacccagguuca

SEQ ID NO: 45737 - RNA, 22 nt, Staphylococcus aureus subsp. aureus MW2
ucauaagacgguaaauaucaau

SEQ ID NO: 45738 - RNA, 19 nt, Staphylococcus aureus subsp. aureus MW2
ucauagugguuuaugcguc

SEQ ID NO: 45739 - RNA, 22 nt, Staphylococcus aureus subsp. aureus MW2
uccgauaucacauuagaagcuu

SEQ ID NO: 45740 - RNA, 22 nt, Staphylococcus aureus subsp. aureus MW2
ucggcauuuuaauuguaauauu

SEQ ID NO: 45741 - RNA, 22 nt, Staphylococcus aureus subsp. aureus MW2
ucggugauaagugaaucaauua

SEQ ID NO: 45742 - RNA, 22 nt, Staphylococcus aureus subsp. aureus MW2
ucguaauaacuguaaauagugc

SEQ ID NO: 45743 - RNA, 22 nt, Staphylococcus aureus subsp. aureus MW2
ucguauuaccaucuggggcauu

SEQ ID NO: 45744 - RNA, 22 nt, Staphylococcus aureus subsp. aureus MW2
ucuaagugaugauguuugugua

SEQ ID NO: 45745 - RNA, 22 nt, Staphylococcus aureus subsp. aureus MW2
ugaaaucuucgguagucgagau

SEQ ID NO: 45746 - RNA, 22 nt, Staphylococcus aureus subsp. aureus MW2
ugaacaaccgggcagaaugaaa

SEQ ID NO: 45747 - RNA, 22 nt, Staphylococcus aureus subsp. aureus MW2
ugaauaagaaaucggacuuaug

SEQ ID NO: 45748 - RNA, 22 nt, Staphylococcus aureus subsp. aureus MW2
ugaaucauauaagcacuacugc

SEQ ID NO: 45749 - RNA, 22 nt, Staphylococcus aureus subsp. aureus MW2
ugaauuacuuugaagggauugu

SEQ ID NO: 45750 - RNA, 22 nt, Staphylococcus aureus subsp. aureus MW2
ugaauucuucacccauuguuac

SEQ ID NO: 45751 - RNA, 22 nt, Staphylococcus aureus subsp. aureus MW2
ugaauuguacugucgacauaau

SEQ ID NO: 45752 - RNA, 22 nt, Staphylococcus aureus subsp. aureus MW2
ugacuagaauugaaaaaagcuu

SEQ ID NO: 45753 - RNA, 22 nt, Staphylococcus aureus subsp. aureus MW2
ugacuucguuuuaccgcguguu

SEQ ID NO: 45754 - RNA, 22 nt, Staphylococcus aureus subsp. aureus MW2
ugaguucacuguuguauuaaac

SEQ ID NO: 45755 - RNA, 22 nt, Staphylococcus aureus subsp. aureus MW2
ugauacauuuccugagcaacag

SEQ ID NO: 45756 - RNA, 23 nt, Staphylococcus aureus subsp. aureus MW2
ugauauaguucagaaauguuugg

SEQ ID NO: 45757 - RNA, 22 nt, Staphylococcus aureus subsp. aureus MW2
ugaugcauuaagaguauaggga

SEQ ID NO: 45758 - RNA, 22 nt, Staphylococcus aureus subsp. aureus MW2
ugcaacauucguauaucauggc

SEQ ID NO: 45759 - RNA, 22 nt, Staphylococcus aureus subsp. aureus MW2
ugcaguuagaaagaaagccacu

SEQ ID NO: 45760 - RNA, 22 nt, Staphylococcus aureus subsp. aureus MW2
ugcauuagcgauuuauaugcuu

SEQ ID NO: 45761 - RNA, 22 nt, Staphylococcus aureus subsp. aureus MW2
ugcgaugauugcacuuuggguu

SEQ ID NO: 45762 - RNA, 22 nt, Staphylococcus aureus subsp. aureus MW2
ugcguuaaaggauauuaagauu

SEQ ID NO: 45763 - RNA, 22 nt, Staphylococcus aureus subsp. aureus MW2
ugcuaaaccuucauaucauagc

SEQ ID NO: 45764 - RNA, 18 nt, Staphylococcus aureus subsp. aureus MW2
ugcugaaugaagcauuuu

SEQ ID NO: 45765 - RNA, 22 nt, Staphylococcus aureus subsp. aureus MW2
uguacucuaauagguauguggc

SEQ ID NO: 45766 - RNA, 22 nt, Staphylococcus aureus subsp. aureus MW2
ugucuuacugcuguuuuuaggu

SEQ ID NO: 45767 - RNA, 22 nt, Staphylococcus aureus subsp. aureus MW2
ugucuugaugaaguuaucuaug

SEQ ID NO: 45768 - RNA, 22 nt, Staphylococcus aureus subsp. aureus MW2
uguggagcaaguagaugcgguu

SEQ ID NO: 45769 - RNA, 22 nt, Staphylococcus aureus subsp. aureus MW2
uguuaauguaaaaccagauuca

SEQ ID NO: 45770 - RNA, 22 nt, Staphylococcus aureus subsp. aureus MW2
uguuugacuucaguacaauccu

SEQ ID NO: 45771 - RNA, 22 nt, Staphylococcus aureus subsp. aureus MW2
uuaaugcagguucuaauuuugu

SEQ ID NO: 45772 - RNA, 22 nt, Staphylococcus aureus subsp. aureus MW2
uuacaugagacaccaugguuau

SEQ ID NO: 45773 - RNA, 22 nt, Staphylococcus aureus subsp. aureus MW2
uuacgcaucuuauguggcguug

SEQ ID NO: 45774 - RNA, 22 nt, Staphylococcus aureus subsp. aureus MW2
uuacuucaaaucauuuucggac

SEQ ID NO: 45775 - RNA, 22 nt, Staphylococcus aureus subsp. aureus MW2
uuaggugagaaaauauuuaucu

SEQ ID NO: 45776 - RNA, 22 nt, Staphylococcus aureus subsp. aureus MW2
uuaugcaaaguaaugauaugaa

SEQ ID NO: 45777 - RNA, 17 nt, Staphylococcus aureus subsp. aureus MW2
uucauaucauuacuuug

SEQ ID NO: 45778 - RNA, 22 nt, Staphylococcus aureus subsp. aureus MW2
uuccuauggguacuguuaauga

SEQ ID NO: 45779 - RNA, 22 nt, Staphylococcus aureus subsp. aureus MW2
uucguuaucccacucacaugau

SEQ ID NO: 45780 - RNA, 22 nt, Staphylococcus aureus subsp. aureus MW2
uucuagaugaguuucuuagaug

SEQ ID NO: 45781 - RNA, 19 nt, Staphylococcus aureus subsp. aureus MW2
uugaagcuggcacauuaaa

SEQ ID NO: 45782 - RNA, 21 nt, Staphylococcus aureus subsp. aureus MW2
uugaagggagccuuauuuaug

SEQ ID NO: 45783 - RNA, 22 nt, Staphylococcus aureus subsp. aureus MW2
uugacugugauuuggaguguau

SEQ ID NO: 45784 - RNA, 19 nt, Staphylococcus aureus subsp. aureus MW2
uugcuaauaauguugcaaa

SEQ ID NO: 45785 - RNA, 22 nt, Staphylococcus aureus subsp. aureus MW2
uuggauaugcagauggcuauuu

SEQ ID NO: 45786 - RNA, 22 nt, Staphylococcus aureus subsp. aureus MW2
uuggcaagguaagccugcauua

SEQ ID NO: 45787 - RNA, 22 nt, Staphylococcus aureus subsp. aureus MW2
uuguaacgaugauacaagaugu

SEQ ID NO: 45788 - RNA, 22 nt, Staphylococcus aureus subsp. aureus MW2
uuuaugccuuauauucagaugu

SEQ ID NO: 45789 - RNA, 22 nt, Staphylococcus aureus subsp. aureus MW2
uuuccaugaaauugaauuucug

SEQ ID NO: 45790 - RNA, 22 nt, Staphylococcus aureus subsp. aureus MW2
uuugccauugaaagaaaagcgu

SEQ ID NO: 45791 - RNA, 22 nt, Staphylococcus aureus subsp. aureus MW2
uuugccguuuggauuuuaagua

SEQ ID NO: 45792 - RNA, 22 nt, Staphylococcus aureus subsp. aureus MW2
uuugcguaccauuguuaguaau

SEQ ID NO: 45793 - RNA, 22 nt, Staphylococcus aureus subsp. aureus MW2
aaacguugugcaauaucuuuag

SEQ ID NO: 45794 - RNA, 22 nt, Staphylococcus aureus subsp. aureus MW2
aaacguuuagcauaucuugauu

SEQ ID NO: 45795 - RNA, 22 nt, Staphylococcus aureus subsp. aureus MW2
aaacuagaaauauaguuauugg

SEQ ID NO: 45796 - RNA, 22 nt, Staphylococcus aureus subsp. aureus MW2
aaagacuaguguaccuuguuuc

SEQ ID NO: 45797 - RNA, 22 nt, Staphylococcus aureus subsp. aureus MW2
aaagucaugagaugaagugaac

SEQ ID NO: 45798 - RNA, 22 nt, Staphylococcus aureus subsp. aureus MW2
aaaugguggccaugcgguaggu

SEQ ID NO: 45799 - RNA, 22 nt, Staphylococcus aureus subsp. aureus MW2
aacauucagacauugaugacgu

SEQ ID NO: 45800 - RNA, 22 nt, Staphylococcus aureus subsp. aureus MW2
aacauuucccauugauuggcuu

SEQ ID NO: 45801 - RNA, 22 nt, Staphylococcus aureus subsp. aureus MW2
aaccauuugauguaacugaaac

SEQ ID NO: 45802 - RNA, 22 nt, Staphylococcus aureus subsp. aureus MW2
aacgaauugucuuuuguugcgu

SEQ ID NO: 45803 - RNA, 22 nt, Staphylococcus aureus subsp. aureus MW2
aacugcuagcugaaauguuaug

SEQ ID NO: 45804 - RNA, 23 nt, Staphylococcus aureus subsp. aureus MW2
aacuggauuuguaguuggaaaga

SEQ ID NO: 45805 - RNA, 22 nt, Staphylococcus aureus subsp. aureus MW2
aagaagcugaagcgacuuuguc

SEQ ID NO: 45806 - RNA, 22 nt, Staphylococcus aureus subsp. aureus MW2
aagaagucauuaaugauaguua

SEQ ID NO: 45807 - RNA, 22 nt, Staphylococcus aureus subsp. aureus MW2
aagccucaggauuaaguaauug

SEQ ID NO: 45808 - RNA, 22 nt, Staphylococcus aureus subsp. aureus MW2
aagcuagauguuacaaauauua

SEQ ID NO: 45809 - RNA, 22 nt, Staphylococcus aureus subsp. aureus MW2
aagguguggaacagacaugugu

SEQ ID NO: 45810 - RNA, 22 nt, Staphylococcus aureus subsp. aureus MW2
aagugcauugucuaacguauuu

SEQ ID NO: 45811 - RNA, 22 nt, Staphylococcus aureus subsp. aureus MW2
aaucagauggucuuacaacuuc

SEQ ID NO: 45812 - RNA, 18 nt, Staphylococcus aureus subsp. aureus MW2
aaucgugcuggguuugau

SEQ ID NO: 45813 - RNA, 22 nt, Staphylococcus aureus subsp. aureus MW2
aaugaucuuggugcuguuuuuc

SEQ ID NO: 45814 - RNA, 22 nt, Staphylococcus aureus subsp. aureus MW2
aaugauggaugaaauuaacgaa

SEQ ID NO: 45815 - RNA, 22 nt, Staphylococcus aureus subsp. aureus MW2
aaugcgauauuacuaccgcaua

SEQ ID NO: 45816 - RNA, 20 nt, Staphylococcus aureus subsp. aureus MW2
aauggauucgguaacaaugc

SEQ ID NO: 45817 - RNA, 22 nt, Staphylococcus aureus subsp. aureus MW2
aauguauguuagugaugguaua

SEQ ID NO: 45818 - RNA, 22 nt, Staphylococcus aureus subsp. aureus MW2
aaugucaugaaaguuuagcuuu

SEQ ID NO: 45819 - RNA, 19 nt, Staphylococcus aureus subsp. aureus MW2
aauguuagggguguuuguu

SEQ ID NO: 45820 - RNA, 22 nt, Staphylococcus aureus subsp. aureus MW2
aauguugcagcauuaauauuaa

SEQ ID NO: 45821 - RNA, 22 nt, Staphylococcus aureus subsp. aureus MW2
aauugguggcgaauaugguauu

SEQ ID NO: 45822 - RNA, 22 nt, Staphylococcus aureus subsp. aureus MW2
aauuguucugguguugcgaucg

SEQ ID NO: 45823 - RNA, 22 nt, Staphylococcus aureus subsp. aureus MW2
acacugcaaaauuggucgcuuu

SEQ ID NO: 45824 - RNA, 22 nt, Staphylococcus aureus subsp. aureus MW2
cagauucaucguacauauuaga

SEQ ID NO: 45825 - RNA, 22 nt, Staphylococcus aureus subsp. aureus MW2
caggcaugagcaaacaaccgca

SEQ ID NO: 45826 - RNA, 19 nt, Staphylococcus aureus subsp. aureus MW2
caucaauugugaguucuuu

SEQ ID NO: 45827 - RNA, 21 nt, Staphylococcus aureus subsp. aureus MW2
caucugaugguauguuaguaa

SEQ ID NO: 45828 - RNA, 22 nt, Staphylococcus aureus subsp. aureus MW2
ccagauauuugcaagaucauug

SEQ ID NO: 45829 - RNA, 22 nt, Staphylococcus aureus subsp. aureus MW2
ccguguuuuagcugaaacaagu

SEQ ID NO: 45830 - RNA, 19 nt, Staphylococcus aureus subsp. aureus MW2
ccguuuaaaguaguugaug

SEQ ID NO: 45831 - RNA, 22 nt, Staphylococcus aureus subsp. aureus MW2
ccuguaaucuaguuagggguuu

SEQ ID NO: 45832 - RNA, 18 nt, Staphylococcus aureus subsp. aureus MW2
cgugugauagaaguuuuu

SEQ ID NO: 45833 - RNA, 22 nt, Staphylococcus aureus subsp. aureus MW2
cuagauuuaucuaaauccaaug

SEQ ID NO: 45834 - RNA, 22 nt, Staphylococcus aureus subsp. aureus MW2
cuauacugcaauccaacaauaa

SEQ ID NO: 45835 - RNA, 22 nt, Staphylococcus aureus subsp. aureus MW2
cucgauuggaccuugagcuuga

SEQ ID NO: 45836 - RNA, 22 nt, Staphylococcus aureus subsp. aureus MW2
cuucuaauucacgaauauuaga

SEQ ID NO: 45837 - RNA, 22 nt, Staphylococcus aureus subsp. aureus MW2
cuugaaaggucauagcaauguu

SEQ ID NO: 45838 - RNA, 22 nt, Staphylococcus aureus subsp. aureus MW2
gaacauuccacaauuagaugaa

SEQ ID NO: 45839 - RNA, 17 nt, Staphylococcus aureus subsp. aureus MW2
gaagaugucaugauuaa

SEQ ID NO: 45840 - RNA, 22 nt, Staphylococcus aureus subsp. aureus MW2
gacaccauuacaguuuguacuu

SEQ ID NO: 45841 - RNA, 22 nt, Staphylococcus aureus subsp. aureus MW2
gacacgauuuggggcgauagug

SEQ ID NO: 45842 - RNA, 22 nt, Staphylococcus aureus subsp. aureus MW2
gauaucaaguuuaacguugccu

SEQ ID NO: 45843 - RNA, 22 nt, Staphylococcus aureus subsp. aureus MW2
gaucaacauuuuacaauguuug

SEQ ID NO: 45844 - RNA, 22 nt, Staphylococcus aureus subsp. aureus MW2
gaugaaguuauucaaugguuuu

SEQ ID NO: 45845 - RNA, 22 nt, Staphylococcus aureus subsp. aureus MW2
gaugaugugggaauaguuauuu

SEQ ID NO: 45846 - RNA, 22 nt, Staphylococcus aureus subsp. aureus MW2
gaugcgcuuaauugcgucauug

SEQ ID NO: 45847 - RNA, 22 nt, Staphylococcus aureus subsp. aureus MW2
gaugguaucaauuugaugugug

SEQ ID NO: 45848 - RNA, 22 nt, Staphylococcus aureus subsp. aureus MW2
gcaauacaucuuuaccaucaua

SEQ ID NO: 45849 - RNA, 22 nt, Staphylococcus aureus subsp. aureus MW2
gcaauauguaacaaacucacua

SEQ ID NO: 45850 - RNA, 22 nt, Staphylococcus aureus subsp. aureus MW2
gcauuguauugacgacauaagu

SEQ ID NO: 45851 - RNA, 22 nt, Staphylococcus aureus subsp. aureus MW2
gccagcauuugauauuuaugag

SEQ ID NO: 45852 - RNA, 22 nt, Staphylococcus aureus subsp. aureus MW2
gcugaaaugguaauaucuuuau

SEQ ID NO: 45853 - RNA, 22 nt, Staphylococcus aureus subsp. aureus MW2
ggaugccgacaguauuccgauu

SEQ ID NO: 45854 - RNA, 22 nt, Staphylococcus aureus subsp. aureus MW2
ggcuaauuuaucacaauuuucu

SEQ ID NO: 45855 - RNA, 22 nt, Staphylococcus aureus subsp. aureus MW2
ggugggacgacgaaauaaauuu

SEQ ID NO: 45856 - RNA, 17 nt, Staphylococcus aureus subsp. aureus MW2
guacgcuugccaugauu

SEQ ID NO: 45857 - RNA, 22 nt, Staphylococcus aureus subsp. aureus MW2
guaugaaaaggacaaccuugcg

SEQ ID NO: 45858 - RNA, 22 nt, Staphylococcus aureus subsp. aureus MW2
gucaucauuggaaucuuuauaa

SEQ ID NO: 45859 - RNA, 23 nt, Staphylococcus aureus subsp. aureus MW2
gucauugaaauaaugaguguuuu

SEQ ID NO: 45860 - RNA, 22 nt, Staphylococcus aureus subsp. aureus MW2
gugaaaugagagucugaaacau

SEQ ID NO: 45861 - RNA, 22 nt, Staphylococcus aureus subsp. aureus MW2
gugaaaugcuuggauugauggc

SEQ ID NO: 45862 - RNA, 22 nt, Staphylococcus aureus subsp. aureus MW2
gugaacgugcauaugauauaua

SEQ ID NO: 45863 - RNA, 22 nt, Staphylococcus aureus subsp. aureus MW2
gugaggcuguucaacuuguuaa

SEQ ID NO: 45864 - RNA, 22 nt, Staphylococcus aureus subsp. aureus MW2
gugauaauguugaacucguugu

SEQ ID NO: 45865 - RNA, 22 nt, Staphylococcus aureus subsp. aureus MW2
guuacuuuaugaucacuaaaaa

SEQ ID NO: 45866 - RNA, 22 nt, Staphylococcus aureus subsp. aureus MW2
guucaagugguaacugcuacgu

SEQ ID NO: 45867 - RNA, 22 nt, Staphylococcus aureus subsp. aureus MW2
guuccagcuccuuuaagcaccg

SEQ ID NO: 45868 - RNA, 22 nt, Staphylococcus aureus subsp. aureus MW2
guucuaugcucuacgaaguuau

SEQ ID NO: 45869 - RNA, 22 nt, Staphylococcus aureus subsp. aureus MW2
uaaagcaccacuaauguguaau

SEQ ID NO: 45870 - RNA, 22 nt, Staphylococcus aureus subsp. aureus MW2
uaaaggcacgcauacuuuguag

SEQ ID NO: 45871 - RNA, 22 nt, Staphylococcus aureus subsp. aureus MW2
uaacuacaauuuacaauguaaa

SEQ ID NO: 45872 - RNA, 22 nt, Staphylococcus aureus subsp. aureus MW2
uaagucauguugugccaacaau

SEQ ID NO: 45873 - RNA, 22 nt, Staphylococcus aureus subsp. aureus MW2
uaaguuugauuaauguguuuag

SEQ ID NO: 45874 - RNA, 22 nt, Staphylococcus aureus subsp. aureus MW2
uacaaagccuuaauaucaugcg

SEQ ID NO: 45875 - RNA, 22 nt, Staphylococcus aureus subsp. aureus MW2
uacauaucguuauaucauucgu

SEQ ID NO: 45876 - RNA, 22 nt, Staphylococcus aureus subsp. aureus MW2
uacguuuguaaaaacaggugcu

SEQ ID NO: 45877 - RNA, 18 nt, Staphylococcus aureus subsp. aureus MW2
uacugcuugcuuaggugc

SEQ ID NO: 45878 - RNA, 22 nt, Staphylococcus aureus subsp. aureus MW2
uacugucuuuuaguaauggaug

SEQ ID NO: 45879 - RNA, 22 nt, Staphylococcus aureus subsp. aureus MW2
uagaaacagcaguaagaugauu

SEQ ID NO: 45880 - RNA, 22 nt, Staphylococcus aureus subsp. aureus MW2
uagcguuaauuuaucacucaug

SEQ ID NO: 45881 - RNA, 22 nt, Staphylococcus aureus subsp. aureus MW2
uaguucauccacuaguucaauc

SEQ ID NO: 45882 - RNA, 22 nt, Staphylococcus aureus subsp. aureus MW2
uaguugauguugcuaacuucuu

SEQ ID NO: 45883 - RNA, 22 nt, Staphylococcus aureus subsp. aureus MW2
uauacagauauuguagaacacu

SEQ ID NO: 45884 - RNA, 22 nt, Staphylococcus aureus subsp. aureus MW2
uaucaaacauugaaugcacgcg

SEQ ID NO: 45885 - RNA, 20 nt, Staphylococcus aureus subsp. aureus MW2
uaugauagggaagggugaga

SEQ ID NO: 45886 - RNA, 22 nt, Staphylococcus aureus subsp. aureus MW2
uaugcgacaacgcguugccaag

SEQ ID NO: 45887 - RNA, 22 nt, Staphylococcus aureus subsp. aureus MW2
uauucguuggaugauauaaaug

SEQ ID NO: 45888 - RNA, 22 nt, Staphylococcus aureus subsp. aureus MW2
ucacuagagcuaugaaacuugg

SEQ ID NO: 45889 - RNA, 22 nt, Staphylococcus aureus subsp. aureus MW2
ucagccauaaaucaaaugaucg

SEQ ID NO: 45890 - RNA, 22 nt, Staphylococcus aureus subsp. aureus MW2
ucaugauuaaaauauguaccug

SEQ ID NO: 45891 - RNA, 22 nt, Staphylococcus aureus subsp. aureus MW2
ucauuugugcaauuggaaaugg

SEQ ID NO: 45892 - RNA, 22 nt, Staphylococcus aureus subsp. aureus MW2
uccacugcugauuucuuuuuga

SEQ ID NO: 45893 - RNA, 22 nt, Staphylococcus aureus subsp. aureus MW2
ucgaauacuguuaugaaguaau

SEQ ID NO: 45894 - RNA, 22 nt, Staphylococcus aureus subsp. aureus MW2
ucuaauacugcaacugcaacga

SEQ ID NO: 45895 - RNA, 22 nt, Staphylococcus aureus subsp. aureus MW2
ucucaaauaaaucggacaaaug

SEQ ID NO: 45896 - RNA, 22 nt, Staphylococcus aureus subsp. aureus MW2
ucucauaugaaaagcacgccug

SEQ ID NO: 45897 - RNA, 22 nt, Staphylococcus aureus subsp. aureus MW2
ugaaggaucgucuuuaaggcuu

SEQ ID NO: 45898 - RNA, 22 nt, Staphylococcus aureus subsp. aureus N315
acauugggcauaaucacagcua

SEQ ID NO: 45899 - RNA, 22 nt, Staphylococcus aureus subsp. aureus N315
accacguaucauguuuuaguau

SEQ ID NO: 45900 - RNA, 22 nt, Staphylococcus aureus subsp. aureus N315
accauugaugcgacgcgauuua

SEQ ID NO: 45901 - RNA, 22 nt, Staphylococcus aureus subsp. aureus N315
accuguaaaugcacugcuuauu

SEQ ID NO: 45902 - RNA, 22 nt, Staphylococcus aureus subsp. aureus N315
acgauugacugccaccaccgug

SEQ ID NO: 45903 - RNA, 22 nt, Staphylococcus aureus subsp. aureus N315
acgugucaugaguuuacaagac

SEQ ID NO: 45904 - RNA, 22 nt, Staphylococcus aureus subsp. aureus N315
acuauagaauguauggugucaa

SEQ ID NO: 45905 - RNA, 22 nt, Staphylococcus aureus subsp. aureus N315
acuauuuguuaauaaauccauu

SEQ ID NO: 45906 - RNA, 22 nt, Staphylococcus aureus subsp. aureus N315
acucaagcagguauuaugaaag

SEQ ID NO: 45907 - RNA, 22 nt, Staphylococcus aureus subsp. aureus N315
acugauacaguguuugacuggu

SEQ ID NO: 45908 - RNA, 22 nt, Staphylococcus aureus subsp. aureus N315
acugcugcgagagauaacgaua

SEQ ID NO: 45909 - RNA, 21 nt, Staphylococcus aureus subsp. aureus N315
acuuucuguuucauuaguugu

SEQ ID NO: 45910 - RNA, 22 nt, Staphylococcus aureus subsp. aureus N315
agaaauuggacuuggugcuacg

SEQ ID NO: 45911 - RNA, 22 nt, Staphylococcus aureus subsp. aureus N315
agagguacuagcaagcgcuuug

SEQ ID NO: 45912 - RNA, 22 nt, Staphylococcus aureus subsp. aureus N315
agauauuguugauauggcauuu

SEQ ID NO: 45913 - RNA, 23 nt, Staphylococcus aureus subsp. aureus N315
agaugacuucauuuugagagcgu

SEQ ID NO: 45914 - RNA, 22 nt, Staphylococcus aureus subsp. aureus N315
agcaugauuuuagaugggaacc

SEQ ID NO: 45915 - RNA, 22 nt, Staphylococcus aureus subsp. aureus N315
agcauugguauugauauuguuu

SEQ ID NO: 45916 - RNA, 22 nt, Staphylococcus aureus subsp. aureus N315
agcgguuuaugugaugauuuua

SEQ ID NO: 45917 - RNA, 22 nt, Staphylococcus aureus subsp. aureus N315
agcguaugccgcuuucgaaaua

SEQ ID NO: 45918 - RNA, 22 nt, Staphylococcus aureus subsp. aureus N315
agcuuaaaauauuauugauucc

SEQ ID NO: 45919 - RNA, 20 nt, Staphylococcus aureus subsp. aureus N315
agcuuugucauaauaugcgu

SEQ ID NO: 45920 - RNA, 22 nt, Staphylococcus aureus subsp. aureus N315
agguaucguuucuguuccauaa

SEQ ID NO: 45921 - RNA, 22 nt, Staphylococcus aureus subsp. aureus N315
agguguaauacaaggggcuauu

SEQ ID NO: 45922 - RNA, 22 nt, Staphylococcus aureus subsp. aureus N315
agugccucuuuuauuauuuaac

SEQ ID NO: 45923 - RNA, 22 nt, Staphylococcus aureus subsp. aureus N315
aguuagauuuaagcgcauuagu

SEQ ID NO: 45924 - RNA, 22 nt, Staphylococcus aureus subsp. aureus N315
auaaaccugguuucgcuucagg

SEQ ID NO: 45925 - RNA, 22 nt, Staphylococcus aureus subsp. aureus N315
auaaugugauaaauuuugacgg

SEQ ID NO: 45926 - RNA, 18 nt, Staphylococcus aureus subsp. aureus N315
auacauugauuuacaccu

SEQ ID NO: 45927 - RNA, 22 nt, Staphylococcus aureus subsp. aureus N315
auagugaguuuguuacauauug

SEQ ID NO: 45928 - RNA, 22 nt, Staphylococcus aureus subsp. aureus N315
auauacacaucuuucaaaggaa

SEQ ID NO: 45929 - RNA, 22 nt, Staphylococcus aureus subsp. aureus N315
auauacaccccaaaaguuggau

SEQ ID NO: 45930 - RNA, 22 nt, Staphylococcus aureus subsp. aureus N315
aucaagugcuacgaaugauuga

SEQ ID NO: 45931 - RNA, 22 nt, Staphylococcus aureus subsp. aureus N315
aucaaucguuuuguuaucaaau

SEQ ID NO: 45932 - RNA, 22 nt, Staphylococcus aureus subsp. aureus N315
aucauagcgucugaucuagagu

SEQ ID NO: 45933 - RNA, 22 nt, Staphylococcus aureus subsp. aureus N315
aucauagguuuauuuaguggcu

SEQ ID NO: 45934 - RNA, 22 nt, Staphylococcus aureus subsp. aureus N315
auccuaauuucacaugauauga

SEQ ID NO: 45935 - RNA, 22 nt, Staphylococcus aureus subsp. aureus N315
aucgacuucaucaauaaaaaua

SEQ ID NO: 45936 - RNA, 22 nt, Staphylococcus aureus subsp. aureus N315
aucgauggcuuuaaagauacgg

SEQ ID NO: 45937 - RNA, 21 nt, Staphylococcus aureus subsp. aureus N315
aucguuaguauuaccauuaga

SEQ ID NO: 45938 - RNA, 22 nt, Staphylococcus aureus subsp. aureus N315
aucuaguaaaacgauuuuagau

SEQ ID NO: 45939 - RNA, 22 nt, Staphylococcus aureus subsp. aureus N315
augacguacacuuuuagucgcc

SEQ ID NO: 45940 - RNA, 22 nt, Staphylococcus aureus subsp. aureus N315
augacguuguugaauuaucuuc

SEQ ID NO: 45941 - RNA, 22 nt, Staphylococcus aureus subsp. aureus N315
augauguuaaaaaucaucuuau

SEQ ID NO: 45942 - RNA, 22 nt, Staphylococcus aureus subsp. aureus N315
augcgucacaacguaaaucagc

SEQ ID NO: 45943 - RNA, 22 nt, Staphylococcus aureus subsp. aureus N315
auggcuaaaaagauuaacgcga

SEQ ID NO: 45944 - RNA, 22 nt, Staphylococcus aureus subsp. aureus N315
augguacucguuggcauuguug

SEQ ID NO: 45945 - RNA, 22 nt, Staphylococcus aureus subsp. aureus N315
auguagagcuuguuuuuggauu

SEQ ID NO: 45946 - RNA, 22 nt, Staphylococcus aureus subsp. aureus N315
auguagcgauucuuuaucauua

SEQ ID NO: 45947 - RNA, 22 nt, Staphylococcus aureus subsp. aureus N315
auguagugguucuuugucauua

SEQ ID NO: 45948 - RNA, 22 nt, Staphylococcus aureus subsp. aureus N315
auuaggcauucaucuaacgacc

SEQ ID NO: 45949 - RNA, 22 nt, Staphylococcus aureus subsp. aureus N315
auucauccuuaacaaucugucu

SEQ ID NO: 45950 - RNA, 22 nt, Staphylococcus aureus subsp. aureus N315
auucaucuaaauccauuuguug

SEQ ID NO: 45951 - RNA, 22 nt, Staphylococcus aureus subsp. aureus N315
auucuaagcauuuaaaacguug

SEQ ID NO: 45952 - RNA, 22 nt, Staphylococcus aureus subsp. aureus N315
auugauacauuauuuguaugua

SEQ ID NO: 45953 - RNA, 22 nt, Staphylococcus aureus subsp. aureus N315
auugaugugaagcggacaaucu

SEQ ID NO: 45954 - RNA, 22 nt, Staphylococcus aureus subsp. aureus N315
auugauuguguauuuagaagau

SEQ ID NO: 45955 - RNA, 19 nt, Staphylococcus aureus subsp. aureus N315
auugcauuagcugccuaua

SEQ ID NO: 45956 - RNA, 22 nt, Staphylococcus aureus subsp. aureus N315
auuucgaguguauggaugaugu

SEQ ID NO: 45957 - RNA, 22 nt, Staphylococcus aureus subsp. aureus N315
auuucguugacccacuuccugc

SEQ ID NO: 45958 - RNA, 22 nt, Staphylococcus aureus subsp. aureus N315
auuucugucccacucccauugg

SEQ ID NO: 45959 - RNA, 22 nt, Staphylococcus aureus subsp. aureus N315
auuuggaacuuuguuagguaua

SEQ ID NO: 45960 - RNA, 22 nt, Staphylococcus aureus subsp. aureus N315
caaacuuucuaaacuuucauca

SEQ ID NO: 45961 - RNA, 22 nt, Staphylococcus aureus subsp. aureus N315
caacagauggaucuggaugcac

SEQ ID NO: 45962 - RNA, 22 nt, Staphylococcus aureus subsp. aureus N315
caagguugacuagaauugaaaa

SEQ ID NO: 45963 - RNA, 22 nt, Staphylococcus aureus subsp. aureus N315
caauaucauuggcgguucuuug

SEQ ID NO: 45964 - RNA, 22 nt, Staphylococcus aureus subsp. aureus N315
caauaucgugaugaagugcagc

SEQ ID NO: 45965 - RNA, 23 nt, Staphylococcus aureus subsp. aureus N315
caauaucugcuaauguuaacggc

SEQ ID NO: 45966 - RNA, 22 nt, Staphylococcus aureus subsp. aureus N315
caaucguaagggaucuuagcua

SEQ ID NO: 45967 - RNA, 22 nt, Staphylococcus aureus subsp. aureus N315
cagauuaaucguacauauuaga

SEQ ID NO: 45968 - RNA, 22 nt, Staphylococcus aureus subsp. aureus N315
cagcuaaauuacuaccuucagu

SEQ ID NO: 45969 - RNA, 22 nt, Staphylococcus aureus subsp. aureus N315
caggaaaugcauuuaaagacgu

SEQ ID NO: 45970 - RNA, 22 nt, Staphylococcus aureus subsp. aureus N315
cagguauugcacauacguacau

SEQ ID NO: 45971 - RNA, 22 nt, Staphylococcus aureus subsp. aureus N315
ugaacaaccgggcagaaugaaa

SEQ ID NO: 45972 - RNA, 22 nt, Staphylococcus aureus subsp. aureus N315
ugaauaagaaaucggacuuaug

SEQ ID NO: 45973 - RNA, 22 nt, Staphylococcus aureus subsp. aureus N315
ugacagaucaaauuuuucuaaa

SEQ ID NO: 45974 - RNA, 22 nt, Staphylococcus aureus subsp. aureus N315
ugacaugaaaacguaauugggu

SEQ ID NO: 45975 - RNA, 22 nt, Staphylococcus aureus subsp. aureus N315
ugacuagaauugaaaaaagcuu

SEQ ID NO: 45976 - RNA, 23 nt, Staphylococcus aureus subsp. aureus N315
ugacuucguuuuaccgcguguuu

SEQ ID NO: 45977 - RNA, 22 nt, Staphylococcus aureus subsp. aureus N315
ugauacagauaaaguauaggga

SEQ ID NO: 45978 - RNA, 23 nt, Staphylococcus aureus subsp. aureus N315
ugauauaguucagaaauguuugg

SEQ ID NO: 45979 - RNA, 22 nt, Staphylococcus aureus subsp. aureus N315
ugauaugcauuuauugucugag

SEQ ID NO: 45980 - RNA, 22 nt, Staphylococcus aureus subsp. aureus N315
ugaugcuaagaauuuuaguaag

SEQ ID NO: 45981 - RNA, 22 nt, Staphylococcus aureus subsp. aureus N315
ugauguuaucaaacauugaagu

SEQ ID NO: 45982 - RNA, 22 nt, Staphylococcus aureus subsp. aureus N315
ugauuaacguuaguagcaguug

SEQ ID NO: 45983 - RNA, 23 nt, Staphylococcus aureus subsp. aureus N315
ugcaaauguugagcgcauauuug

SEQ ID NO: 45984 - RNA, 22 nt, Staphylococcus aureus subsp. aureus N315
ugcauuaauugucuuugaaaaa

SEQ ID NO: 45985 - RNA, 22 nt, Staphylococcus aureus subsp. aureus N315
ugcuacaaacgcuugugcauua

SEQ ID NO: 45986 - RNA, 21 nt, Staphylococcus aureus subsp. aureus N315
ugcuagcaagcgcuuuucuau

SEQ ID NO: 45987 - RNA, 22 nt, Staphylococcus aureus subsp. aureus N315
uggauaauuguguuacaagaau

SEQ ID NO: 45988 - RNA, 22 nt, Staphylococcus aureus subsp. aureus N315
uggauuagcugaaaugauaaau

SEQ ID NO: 45989 - RNA, 23 nt, Staphylococcus aureus subsp. aureus N315
uggcuccguuucauuacguaaua

SEQ ID NO: 45990 - RNA, 21 nt, Staphylococcus aureus subsp. aureus N315
uggguacuuugacagggcguc

SEQ ID NO: 45991 - RNA, 22 nt, Staphylococcus aureus subsp. aureus N315
ugguacauguggagguacuuga

SEQ ID NO: 45992 - RNA, 22 nt, Staphylococcus aureus subsp. aureus N315
ugucuugaugaaguuaucuaug

SEQ ID NO: 45993 - RNA, 22 nt, Staphylococcus aureus subsp. aureus N315
ugugaauaagcucccuucaaag

SEQ ID NO: 45994 - RNA, 22 nt, Staphylococcus aureus subsp. aureus N315
uguuugaaucgguaaaguugau

SEQ ID NO: 45995 - RNA, 22 nt, Staphylococcus aureus subsp. aureus N315
uuaaagacauucguuuuagcag

SEQ ID NO: 45996 - RNA, 22 nt, Staphylococcus aureus subsp. aureus N315
uuaagguuagagucauuuggau

SEQ ID NO: 45997 - RNA, 19 nt, Staphylococcus aureus subsp. aureus N315
uuaagugucuaucaagcau

SEQ ID NO: 45998 - RNA, 22 nt, Staphylococcus aureus subsp. aureus N315
uuaaugcgaaaguuaaauaucc

SEQ ID NO: 45999 - RNA, 22 nt, Staphylococcus aureus subsp. aureus N315
uuaccgcugaaaauggaauuaa

SEQ ID NO: 46000 - RNA, 22 nt, Staphylococcus aureus subsp. aureus N315
uuacuaguaauuaucagcauuu

SEQ ID NO: 46001 - RNA, 22 nt, Staphylococcus aureus subsp. aureus N315
uuacugauguugauuuugaagu

SEQ ID NO: 46002 - RNA, 22 nt, Staphylococcus aureus subsp. aureus N315
uuaugagcuaaucaaacaucau

SEQ ID NO: 46003 - RNA, 22 nt, Staphylococcus aureus subsp. aureus N315
uuaugcaaaguaaugauaugaa

SEQ ID NO: 46004 - RNA, 22 nt, Staphylococcus aureus subsp. aureus N315
uuauguacguacuugggcuugu

SEQ ID NO: 46005 - RNA, 22 nt, Staphylococcus aureus subsp. aureus N315
uucaauacacauuuagauuuaa

SEQ ID NO: 46006 - RNA, 21 nt, Staphylococcus aureus subsp. aureus N315
uucagcaaaagucuuuuuaac

SEQ ID NO: 46007 - RNA, 22 nt, Staphylococcus aureus subsp. aureus N315
uucaucuguccgauuuuuugau

SEQ ID NO: 46008 - RNA, 22 nt, Staphylococcus aureus subsp. aureus N315
uucgguaacauuaugaaaccau

SEQ ID NO: 46009 - RNA, 22 nt, Staphylococcus aureus subsp. aureus N315
uucuagaugaguuucuuagaug

SEQ ID NO: 46010 - RNA, 21 nt, Staphylococcus aureus subsp. aureus N315
uugaagggagccuuauuuaug

SEQ ID NO: 46011 - RNA, 22 nt, Staphylococcus aureus subsp. aureus N315
uugacguuuuagcaguaaaagu

SEQ ID NO: 46012 - RNA, 22 nt, Staphylococcus aureus subsp. aureus N315
uugacugaaugaaaaugcgcuu

SEQ ID NO: 46013 - RNA, 22 nt, Staphylococcus aureus subsp. aureus N315
uugcaguuauggaagcaaguuu

SEQ ID NO: 46014 - RNA, 22 nt, Staphylococcus aureus subsp. aureus N315
uuguaacgaugauacaagaugu

SEQ ID NO: 46015 - RNA, 19 nt, Staphylococcus aureus subsp. aureus N315
uuugaacuuguauuuguag

SEQ ID NO: 46016 - RNA, 22 nt, Staphylococcus aureus subsp. aureus N315
uuugccauugaaagaaaagcgu

SEQ ID NO: 46017 - RNA, 22 nt, Staphylococcus aureus subsp. aureus N315
uuuguacuucaucauauuguug

SEQ ID NO: 46018 - RNA, 20 nt, Staphylococcus aureus subsp. aureus N315
uuuguaucuaguacauuggc

SEQ ID NO: 46019 - RNA, 22 nt, Staphylococcus aureus subsp. aureus N315
aaacacgugaugccagugcggc

SEQ ID NO: 46020 - RNA, 22 nt, Staphylococcus aureus subsp. aureus N315
aaacguugugcaauaucuuuag

SEQ ID NO: 46021 - RNA, 22 nt, Staphylococcus aureus subsp. aureus N315
aaagacuuggucgaaucgugga

SEQ ID NO: 46022 - RNA, 22 nt, Staphylococcus aureus subsp. aureus N315
aaagcgaccaauuuugcagugu

SEQ ID NO: 46023 - RNA, 22 nt, Staphylococcus aureus subsp. aureus N315
aaaucacgcaggugaauuaguu

SEQ ID NO: 46024 - RNA, 22 nt, Staphylococcus aureus subsp. aureus N315
aaauguuguuauaucggagcgu

SEQ ID NO: 46025 - RNA, 22 nt, Staphylococcus aureus subsp. aureus N315
aacauuucccauugauuggcuu

SEQ ID NO: 46026 - RNA, 22 nt, Staphylococcus aureus subsp. aureus N315
aaccauuugauguaacugaaac

SEQ ID NO: 46027 - RNA, 22 nt, Staphylococcus aureus subsp. aureus N315
aacugcuagcugaaauguuaug

SEQ ID NO: 46028 - RNA, 22 nt, Staphylococcus aureus subsp. aureus N315
aacuggauuuguaguuggaaag

SEQ ID NO: 46029 - RNA, 22 nt, Staphylococcus aureus subsp. aureus N315
aagaccuucaacauguaggaga

SEQ ID NO: 46030 - RNA, 22 nt, Staphylococcus aureus subsp. aureus N315
aagaugcacaacgcgguaugga

SEQ ID NO: 46031 - RNA, 22 nt, Staphylococcus aureus subsp. aureus N315
aagcuagauguuacaaauauua

SEQ ID NO: 46032 - RNA, 22 nt, Staphylococcus aureus subsp. aureus N315
aagcuguagaaaugguuucacg

SEQ ID NO: 46033 - RNA, 22 nt, Staphylococcus aureus subsp. aureus N315
aagggcuauuggagguauuguu

SEQ ID NO: 46034 - RNA, 22 nt, Staphylococcus aureus subsp. aureus N315
aauacacuaaucgcacguacuc

SEQ ID NO: 46035 - RNA, 22 nt, Staphylococcus aureus subsp. aureus N315
aauaguuguaccgacagcgccu

SEQ ID NO: 46036 - RNA, 22 nt, Staphylococcus aureus subsp. aureus N315
aaucagauggucuuacaacuuc

SEQ ID NO: 46037 - RNA, 23 nt, Staphylococcus aureus subsp. aureus N315
aaucgcuuguacgaugaguaugg

SEQ ID NO: 46038 - RNA, 22 nt, Staphylococcus aureus subsp. aureus N315
aaugauggaugaaauuaacgaa

SEQ ID NO: 46039 - RNA, 22 nt, Staphylococcus aureus subsp. aureus N315
aaugcgauugcgccuaugauug

SEQ ID NO: 46040 - RNA, 22 nt, Staphylococcus aureus subsp. aureus N315
aauggcuaaagaacuuguugaa

SEQ ID NO: 46041 - RNA, 22 nt, Staphylococcus aureus subsp. aureus N315
aaugucaugaaaguuuagcuuu

SEQ ID NO: 46042 - RNA, 19 nt, Staphylococcus aureus subsp. aureus N315
aauguuagggguguuuguu

SEQ ID NO: 46043 - RNA, 22 nt, Staphylococcus aureus subsp. aureus N315
aauucuacaucaauccuacagg

SEQ ID NO: 46044 - RNA, 22 nt, Staphylococcus aureus subsp. aureus N315
acaaguuggaacauuucgucuu

SEQ ID NO: 46045 - RNA, 22 nt, Staphylococcus aureus subsp. aureus N315
acagaaauguagcuaacauuuu

SEQ ID NO: 46046 - RNA, 22 nt, Staphylococcus aureus subsp. aureus N315
acagcuggugagauagguguca

SEQ ID NO: 46047 - RNA, 23 nt, Staphylococcus aureus subsp. aureus N315
acaucgaaaccugcaauagauuu

SEQ ID NO: 46048 - RNA, 22 nt, Staphylococcus aureus subsp. aureus N315
acaugaaggaaaccacuuugau

SEQ ID NO: 46049 - RNA, 22 nt, Staphylococcus aureus subsp. aureus N315
accauuuauggcaauuauuuac

SEQ ID NO: 46050 - RNA, 22 nt, Staphylococcus aureus subsp. aureus N315
acgauaucaauuuaaguuugcc

SEQ ID NO: 46051 - RNA, 22 nt, Staphylococcus aureus subsp. aureus N315
acgauuugaaaccguauauaaa

SEQ ID NO: 46052 - RNA, 22 nt, Staphylococcus aureus subsp. aureus N315
acguuugacuuauaaaaauggu

SEQ ID NO: 46053 - RNA, 22 nt, Staphylococcus aureus subsp. aureus N315
acuaugauuuuauuaacggucu

SEQ ID NO: 46054 - RNA, 23 nt, Staphylococcus aureus subsp. aureus N315
agacauuuaaugauaaauacuga

SEQ ID NO: 46055 - RNA, 20 nt, Staphylococcus aureus subsp. aureus N315
agaccucuguuuuuuggugu

SEQ ID NO: 46056 - RNA, 22 nt, Staphylococcus aureus subsp. aureus N315
agacguguauccaauuaaccga

SEQ ID NO: 46057 - RNA, 22 nt, Staphylococcus aureus subsp. aureus N315
agauaucuuuaaauggcucuuc

SEQ ID NO: 46058 - RNA, 22 nt, Staphylococcus aureus subsp. aureus N315
agcaagcaguagugacauuuuu

SEQ ID NO: 46059 - RNA, 20 nt, Staphylococcus aureus subsp. aureus N315
agcaguuucagugauugcag

SEQ ID NO: 46060 - RNA, 22 nt, Staphylococcus aureus subsp. aureus N315
agcaugauacucaauaaaauug

SEQ ID NO: 46061 - RNA, 22 nt, Staphylococcus aureus subsp. aureus N315
agcauuaaaugauuuugaaaac

SEQ ID NO: 46062 - RNA, 22 nt, Staphylococcus aureus subsp. aureus N315
agcgauaucacuacuauucauu

SEQ ID NO: 46063 - RNA, 22 nt, Staphylococcus aureus subsp. aureus N315
agcguuguaugaggcaaugauu

SEQ ID NO: 46064 - RNA, 22 nt, Staphylococcus aureus subsp. aureus N315
agcuaacaaaagcauaugauuu

SEQ ID NO: 46065 - RNA, 22 nt, Staphylococcus aureus subsp. aureus N315
agcuagaaguugaugagccauu

SEQ ID NO: 46066 - RNA, 18 nt, Staphylococcus aureus subsp. aureus N315
agcuugcauuguauugcg

SEQ ID NO: 46067 - RNA, 22 nt, Staphylococcus aureus subsp. aureus N315
agcuuuaagugauucugaguca

SEQ ID NO: 46068 - RNA, 22 nt, Staphylococcus aureus subsp. aureus N315
aggcgaauggcuuucaauaaaa

SEQ ID NO: 46069 - RNA, 22 nt, Staphylococcus aureus subsp. aureus N315
aggcggcaguacaauaugguua

SEQ ID NO: 46070 - RNA, 22 nt, Staphylococcus aureus subsp. aureus N315
aggcuucacuaggacgagcauu

SEQ ID NO: 46071 - RNA, 22 nt, Staphylococcus aureus subsp. aureus N315
aggugcuaaaaucaacgauuga

SEQ ID NO: 46072 - RNA, 22 nt, Staphylococcus aureus subsp. aureus N315
agguuuaacauuauuacaaauc

SEQ ID NO: 46073 - RNA, 23 nt, Staphylococcus aureus subsp. aureus N315
aguauaucaucuggugcugaugc

SEQ ID NO: 46074 - RNA, 22 nt, Staphylococcus aureus subsp. aureus N315
agucaucgauuuauuaguuaaa

SEQ ID NO: 46075 - RNA, 22 nt, Staphylococcus aureus subsp. aureus N315
agugaacuuuccucuuuuuaau

SEQ ID NO: 46076 - RNA, 22 nt, Staphylococcus aureus subsp. aureus N315
agugauaaugggugccaauauc

SEQ ID NO: 46077 - RNA, 22 nt, Staphylococcus aureus subsp. aureus N315
aguuugaaugauaacucauugc

SEQ ID NO: 46078 - RNA, 22 nt, Staphylococcus aureus subsp. aureus N315
auaaccuaauagaugugaaguc

SEQ ID NO: 46079 - RNA, 22 nt, Staphylococcus aureus subsp. aureus N315
auaaugcaacgugcauagcagu

SEQ ID NO: 46080 - RNA, 22 nt, Staphylococcus aureus subsp. aureus N315
auacggucauacgauuagugug

SEQ ID NO: 46081 - RNA, 22 nt, Staphylococcus aureus subsp. aureus N315
auaguaucugcagauuguucaa

SEQ ID NO: 46082 - RNA, 22 nt, Staphylococcus aureus subsp. aureus N315
auauagcguucucgcauaagua

SEQ ID NO: 46083 - RNA, 22 nt, Staphylococcus aureus subsp. aureus N315
auaucgcucauauguugcgaau

SEQ ID NO: 46084 - RNA, 22 nt, Staphylococcus aureus subsp. aureus N315
auaucguugcauucuuauaccg

SEQ ID NO: 46085 - RNA, 22 nt, Staphylococcus aureus subsp. aureus N315
auaugcaacaaauugguuaccu

SEQ ID NO: 46086 - RNA, 22 nt, Staphylococcus aureus subsp. aureus N315
aucaggugucgccauagguauu

SEQ ID NO: 46087 - RNA, 22 nt, Staphylococcus aureus subsp. aureus N315
auccaaguaaacaaggucuagu

SEQ ID NO: 46088 - RNA, 22 nt, Staphylococcus aureus subsp. aureus N315
aucgaauuuuugaauaguuggu

SEQ ID NO: 46089 - RNA, 22 nt, Staphylococcus aureus subsp. aureus N315
aucugcaacauauugaucaauu

SEQ ID NO: 46090 - RNA, 22 nt, Staphylococcus aureus subsp. aureus N315
augagagucacccuauaaaguu

SEQ ID NO: 46091 - RNA, 22 nt, Staphylococcus aureus subsp. aureus N315
augagagugacacacauuuauc

SEQ ID NO: 46092 - RNA, 22 nt, Staphylococcus aureus subsp. aureus N315
augagccauuagcacguaauga

SEQ ID NO: 46093 - RNA, 22 nt, Staphylococcus aureus subsp. aureus N315
augaguuaaauuaagcugugau

SEQ ID NO: 46094 - RNA, 22 nt, Staphylococcus aureus subsp. aureus N315
augcacgauuaucuuuaucucu

SEQ ID NO: 46095 - RNA, 22 nt, Staphylococcus aureus subsp. aureus N315
augcauauucaacuagcucagg

SEQ ID NO: 46096 - RNA, 22 nt, Staphylococcus aureus subsp. aureus N315
augcuaauaaaauaaguguugu

SEQ ID NO: 46097 - RNA, 22 nt, Staphylococcus aureus subsp. aureus N315
auggacaaauauuccauuggca

SEQ ID NO: 46098 - RNA, 19 nt, Staphylococcus aureus subsp. aureus N315
auggcacauaucauucguc

SEQ ID NO: 46099 - RNA, 22 nt, Staphylococcus aureus subsp. aureus N315
auguaugguggucuuacauuua

SEQ ID NO: 46100 - RNA, 22 nt, Staphylococcus aureus subsp. aureus N315
auguugcaagaacguuuaggga

SEQ ID NO: 46101 - RNA, 22 nt, Staphylococcus aureus subsp. aureus N315
auuagguuuaguaggagaaucg

SEQ ID NO: 46102 - RNA, 22 nt, Staphylococcus aureus subsp. aureus N315
auucguuaugguuaucauucua

SEQ ID NO: 46103 - RNA, 22 nt, Staphylococcus aureus subsp. aureus N315
auugagggauuuuuauaguucu

SEQ ID NO: 46104 - RNA, 22 nt, Staphylococcus aureus subsp. aureus N315
auugcguauagugaugugucuu

SEQ ID NO: 46105 - RNA, 22 nt, Staphylococcus aureus subsp. aureus N315
auuggaaauuaacgauugauga

SEQ ID NO: 46106 - RNA, 22 nt, Staphylococcus aureus subsp. aureus N315
auuguacuuguggcacccauga

SEQ ID NO: 46107 - RNA, 22 nt, Staphylococcus aureus subsp. aureus N315
auuucguuaucccacucacaug

SEQ ID NO: 46108 - RNA, 19 nt, Staphylococcus aureus subsp. aureus N315
auuucugucccacucccac

SEQ ID NO: 46109 - RNA, 22 nt, Staphylococcus aureus subsp. aureus N315
caaaguggaucguaauggugaa

SEQ ID NO: 46110 - RNA, 22 nt, Staphylococcus aureus subsp. aureus N315
caaaguugacuagaauugaaaa

SEQ ID NO: 46111 - RNA, 22 nt, Staphylococcus aureus subsp. aureus N315
caacguuuuaaaugcuuagaau

SEQ ID NO: 46112 - RNA, 22 nt, Staphylococcus aureus subsp. aureus N315
caagguacauuuauuaaguauu

SEQ ID NO: 46113 - RNA, 22 nt, Staphylococcus aureus subsp. aureus N315
caaugcugacaauaaucacugu

SEQ ID NO: 46114 - RNA, 20 nt, Staphylococcus aureus subsp. aureus N315
cacggcucgaacaagucuuu

SEQ ID NO: 46115 - RNA, 19 nt, Staphylococcus aureus subsp. aureus N315
caucaauugugaguucuuu

SEQ ID NO: 46116 - RNA, 22 nt, Staphylococcus aureus subsp. aureus N315
caugcaaagucuucgauacuuu

SEQ ID NO: 46117 - RNA, 22 nt, Staphylococcus aureus subsp. aureus N315
cauuggugguaaaucuuuaaau

SEQ ID NO: 46118 - RNA, 22 nt, Staphylococcus aureus subsp. aureus N315
ccagauauuugcaagaucauug

SEQ ID NO: 46119 - RNA, 20 nt, Staphylococcus aureus subsp. aureus N315
ccagaugguuaugguuuuuu

SEQ ID NO: 46120 - RNA, 18 nt, Staphylococcus aureus subsp. aureus N315
ccguuuaaaguaguugau

SEQ ID NO: 46121 - RNA, 22 nt, Staphylococcus aureus subsp. aureus N315
ccuguaaucuaguuagggguuu

SEQ ID NO: 46122 - RNA, 22 nt, Staphylococcus aureus subsp. aureus N315
cgcaauauuaucaagcucuuuc

SEQ ID NO: 46123 - RNA, 17 nt, Staphylococcus aureus subsp. aureus N315
cgcagguagauuaaugc

SEQ ID NO: 46124 - RNA, 22 nt, Staphylococcus aureus subsp. aureus N315
cgucaacaagugugagcgauuc

SEQ ID NO: 46125 - RNA, 22 nt, Staphylococcus aureus subsp. aureus N315
cuauuuguaacucuuauauuga

SEQ ID NO: 46126 - RNA, 22 nt, Staphylococcus aureus subsp. aureus N315
cugauaaauuuggucgcgucaa

SEQ ID NO: 46127 - RNA, 22 nt, Staphylococcus aureus subsp. aureus N315
cuguaucacauuagaagcuuuu

SEQ ID NO: 46128 - RNA, 22 nt, Staphylococcus aureus subsp. aureus N315
cuuaguuaaagcgcgcacucaa

SEQ ID NO: 46129 - RNA, 22 nt, Staphylococcus aureus subsp. aureus N315
cuugaauagugagcguauuauu

SEQ ID NO: 46130 - RNA, 22 nt, Staphylococcus aureus subsp. aureus N315
gaaaugauauaguuacagcugu

SEQ ID NO: 46131 - RNA, 22 nt, Staphylococcus aureus subsp. aureus N315
gaacauuccacaauuagaugaa

SEQ ID NO: 46132 - RNA, 18 nt, Staphylococcus aureus subsp. aureus N315
gaaucaauagucgcuaga

SEQ ID NO: 46133 - RNA, 22 nt, Staphylococcus aureus subsp. aureus N315
gaaucagaauagauuugaugcu

SEQ ID NO: 46134 - RNA, 22 nt, Staphylococcus aureus subsp. aureus N315
gaauucuucacccauuguuaca

SEQ ID NO: 46135 - RNA, 22 nt, Staphylococcus aureus subsp. aureus N315
gacaccauuacaguuuguacuu

SEQ ID NO: 46136 - RNA, 22 nt, Staphylococcus aureus subsp. aureus N315
gagcugcauuuaauugaucuug

SEQ ID NO: 46137 - RNA, 22 nt, Staphylococcus aureus subsp. aureus N315
gaguuuaaaaaagguuaaguac

SEQ ID NO: 46138 - RNA, 22 nt, Staphylococcus aureus subsp. aureus N315
gaugaauggaaagauugguuga

SEQ ID NO: 46139 - RNA, 22 nt, Staphylococcus aureus subsp. aureus N315
gaugauauuucaagauccguau

SEQ ID NO: 46140 - RNA, 22 nt, Staphylococcus aureus subsp. aureus N315
gaugaugugggaauaguuauuu

SEQ ID NO: 46141 - RNA, 22 nt, Staphylococcus aureus subsp. aureus N315
gauuacaugacacgauagguaa

SEQ ID NO: 46142 - RNA, 22 nt, Staphylococcus aureus subsp. aureus N315
gauucgauuguaguuguugaaa

SEQ ID NO: 46143 - RNA, 22 nt, Staphylococcus aureus subsp. aureus N315
gcagcaauugcugaauuagaua

SEQ ID NO: 46144 - RNA, 22 nt, Staphylococcus aureus subsp. aureus N315
gcauuaacaguagcgauuggac

SEQ ID NO: 46145 - RNA, 22 nt, Staphylococcus aureus subsp. aureus N315
gcauuguauugacgacauaagu

SEQ ID NO: 46146 - RNA, 22 nt, Staphylococcus aureus subsp. aureus N315
gcuaugauaugaagguuuagca

SEQ ID NO: 46147 - RNA, 22 nt, Staphylococcus aureus subsp. aureus N315
ggaucuauugcaucaugugaca

SEQ ID NO: 46148 - RNA, 22 nt, Staphylococcus aureus subsp. aureus N315
ggaugccgacaguauuccgauu

SEQ ID NO: 46149 - RNA, 22 nt, Staphylococcus aureus subsp. aureus N315
gguaacugcauuuauuaucggu

SEQ ID NO: 46150 - RNA, 22 nt, Staphylococcus aureus subsp. aureus N315
ggugggacgacgaaauaaauuu

SEQ ID NO: 46151 - RNA, 22 nt, Staphylococcus aureus subsp. aureus N315
gguguauaagaugcaauaucuu

SEQ ID NO: 46152 - RNA, 22 nt, Staphylococcus aureus subsp. aureus N315
guaucauuuaagcugaaacgcg

SEQ ID NO: 46153 - RNA, 22 nt, Staphylococcus aureus subsp. aureus N315
guaugaaaaggacaaccuugcg

SEQ ID NO: 46154 - RNA, 22 nt, Staphylococcus aureus subsp. aureus N315
gucaacaaguagaugccaauug

SEQ ID NO: 46155 - RNA, 22 nt, Staphylococcus aureus subsp. aureus N315
gucauugaaaugaugaguguuu

SEQ ID NO: 46156 - RNA, 22 nt, Staphylococcus aureus subsp. aureus N315
gugauaauguugaacucguugu

SEQ ID NO: 46157 - RNA, 22 nt, Staphylococcus aureus subsp. aureus N315
gugauauuauuguuacaaaagg

SEQ ID NO: 46158 - RNA, 22 nt, Staphylococcus aureus subsp. aureus N315
guuaugcaaauuaugguuuacu

SEQ ID NO: 46159 - RNA, 22 nt, Staphylococcus aureus subsp. aureus N315
guucagauuacauuagcaucua

SEQ ID NO: 46160 - RNA, 22 nt, Staphylococcus aureus subsp. aureus N315
guucgauugauuuagaagauaa

SEQ ID NO: 46161 - RNA, 22 nt, Staphylococcus aureus subsp. aureus N315
guugauaauguuacgauacuuu

SEQ ID NO: 46162 - RNA, 22 nt, Staphylococcus aureus subsp. aureus N315
uaaagcacgugguguuauuguu

SEQ ID NO: 46163 - RNA, 22 nt, Staphylococcus aureus subsp. aureus N315
uaacuuuccuuaaauguuaaua

SEQ ID NO: 46164 - RNA, 22 nt, Staphylococcus aureus subsp. aureus N315
uaauaccagcgauuugagcagu

SEQ ID NO: 46165 - RNA, 22 nt, Staphylococcus aureus subsp. aureus N315
uaauggacgccuuggacaauga

SEQ ID NO: 46166 - RNA, 22 nt, Staphylococcus aureus subsp. aureus N315
uacaaagagcaguaaaguuauu

SEQ ID NO: 46167 - RNA, 22 nt, Staphylococcus aureus subsp. aureus N315
uacaagcaaaaguagcggugau

SEQ ID NO: 46168 - RNA, 22 nt, Staphylococcus aureus subsp. aureus N315
uagaaacagcaguaagaugauu

SEQ ID NO: 46169 - RNA, 22 nt, Staphylococcus aureus subsp. aureus N315
uagaccagcguuuuauugaaau

SEQ ID NO: 46170 - RNA, 22 nt, Staphylococcus aureus subsp. aureus N315
uagaugaugaugguuauuucug

SEQ ID NO: 46171 - RNA, 22 nt, Staphylococcus aureus subsp. aureus N315
uagcaauaauagguaguauguu

SEQ ID NO: 46172 - RNA, 22 nt, Staphylococcus aureus subsp. aureus N315
uagcuaugaccauaugccaugu

SEQ ID NO: 46173 - RNA, 23 nt, Staphylococcus aureus subsp. aureus N315
uaguaacgcucuuaaguguguca

SEQ ID NO: 46174 - RNA, 22 nt, Staphylococcus aureus subsp. aureus N315
uaguaacuaaauuacaagcugc

SEQ ID NO: 46175 - RNA, 22 nt, Staphylococcus aureus subsp. aureus N315
uaucaaacauugaaugcacgcg

SEQ ID NO: 46176 - RNA, 19 nt, Staphylococcus aureus subsp. aureus N315
uaucauguuagaagcuuuu

SEQ ID NO: 46177 - RNA, 22 nt, Staphylococcus aureus subsp. aureus N315
uaugucaagguuuugacuuauu

SEQ ID NO: 46178 - RNA, 22 nt, Staphylococcus aureus subsp. aureus N315
uauugugauuagugcacgaaca

SEQ ID NO: 46179 - RNA, 22 nt, Staphylococcus aureus subsp. aureus N315
ucagcauuguaaugaucugaaa

SEQ ID NO: 46180 - RNA, 19 nt, Staphylococcus aureus subsp. aureus N315
ucauagugguuuaugcguc

SEQ ID NO: 46181 - RNA, 22 nt, Staphylococcus aureus subsp. aureus N315
ucauguguaucuuguggucaau

SEQ ID NO: 46182 - RNA, 22 nt, Staphylococcus aureus subsp. aureus N315
ucauuugcgcaauuggaaaugg

SEQ ID NO: 46183 - RNA, 19 nt, Staphylococcus aureus subsp. aureus N315
ucguuggagcgaauggugc

SEQ ID NO: 46184 - RNA, 22 nt, Staphylococcus aureus subsp. aureus N315
ugaaaucuucgguagucgagau

SEQ ID NO: 46185 - RNA, 22 nt, Staphylococcus aureus subsp. aureus N315
ugaagcaaguuccagcaaaaug

SEQ ID NO: 46186 - RNA, 22 nt, Staphylococcus aureus subsp. aureus N315
ugaaggugguagcuuuuauauc

SEQ ID NO: 46187 - RNA, 22 nt, Staphylococcus aureus subsp. aureus N315
ugaaguagaugucaacgcuuua

SEQ ID NO: 46188 - RNA, 22 nt, Staphylococcus aureus subsp. aureus N315
ugaaucauauaagcacuacugc

SEQ ID NO: 46189 - RNA, 22 nt, Staphylococcus aureus subsp. aureus N315
ugacuagaguugaaaaaagcuu

SEQ ID NO: 46190 - RNA, 22 nt, Staphylococcus aureus subsp. aureus N315
ugauacguauaugacacuugcu

SEQ ID NO: 46191 - RNA, 22 nt, Staphylococcus aureus subsp. aureus N315
ugaugcauuaagaguauaggga

SEQ ID NO: 46192 - RNA, 22 nt, Staphylococcus aureus subsp. aureus N315
ugauuucgcccaccgcguguuu

SEQ ID NO: 46193 - RNA, 22 nt, Staphylococcus aureus subsp. aureus N315
ugcaacauucguauaucauggc

SEQ ID NO: 46194 - RNA, 22 nt, Staphylococcus aureus subsp. aureus N315
ugcaguuagaaagaaagccacu

SEQ ID NO: 46195 - RNA, 22 nt, Staphylococcus aureus subsp. aureus N315
ugcaguugaugaagugguagau

SEQ ID NO: 46196 - RNA, 22 nt, Staphylococcus aureus subsp. aureus N315
ugccuuauauucagauguaaac

SEQ ID NO: 46197 - RNA, 22 nt, Staphylococcus aureus subsp. aureus N315
ugcguuaaaggauauuaagauu

SEQ ID NO: 46198 - RNA, 22 nt, Staphylococcus aureus subsp. aureus N315
ugcuaaaccuucauaucauagc

SEQ ID NO: 46199 - RNA, 22 nt, Staphylococcus aureus subsp. aureus N315
uggcguuacgcacuaugcugcg

SEQ ID NO: 46200 - RNA, 22 nt, Staphylococcus aureus subsp. aureus N315
uggcuucaaugguauuuuuauu

SEQ ID NO: 46201 - RNA, 22 nt, Staphylococcus aureus subsp. aureus N315
ugggagauauugguaaagcuuu

SEQ ID NO: 46202 - RNA, 22 nt, Staphylococcus aureus subsp. aureus N315
ugguaaaucaauuauuaaacuu

SEQ ID NO: 46203 - RNA, 22 nt, Staphylococcus aureus subsp. aureus N315
ugguauuccagaauuagguaga

SEQ ID NO: 46204 - RNA, 22 nt, Staphylococcus aureus subsp. aureus N315
ugguucaagugguaacugcuac

SEQ ID NO: 46205 - RNA, 22 nt, Staphylococcus aureus subsp. aureus N315
ugguuuaacaauagguguggcu

SEQ ID NO: 46206 - RNA, 22 nt, Staphylococcus aureus subsp. aureus N315
uguaaaccaccuaugaaagaac

SEQ ID NO: 46207 - RNA, 20 nt, Staphylococcus aureus subsp. aureus N315
uguaacacaaaugaaaauug

SEQ ID NO: 46208 - RNA, 17 nt, Staphylococcus aureus subsp. aureus N315
uguacaucauugugaug

SEQ ID NO: 46209 - RNA, 22 nt, Staphylococcus aureus subsp. aureus N315
ugucuuacugcuguuuuuaggu

SEQ ID NO: 46210 - RNA, 22 nt, Staphylococcus aureus subsp. aureus N315
uguggagcaaguagaugcgguu

SEQ ID NO: 46211 - RNA, 22 nt, Staphylococcus aureus subsp. aureus N315
uguuaagauuuugaugaaagua

SEQ ID NO: 46212 - RNA, 18 nt, Staphylococcus aureus subsp. aureus N315
uguuaaugaugcauugua

SEQ ID NO: 46213 - RNA, 22 nt, Staphylococcus aureus subsp. aureus N315
uuaacagguauugcaaauucuu

SEQ ID NO: 46214 - RNA, 22 nt, Staphylococcus aureus subsp. aureus N315
uuaaugcagguucuaauuuugu

SEQ ID NO: 46215 - RNA, 18 nt, Staphylococcus aureus subsp. aureus N315
uuacagaauguaguggua

SEQ ID NO: 46216 - RNA, 22 nt, Staphylococcus aureus subsp. aureus N315
uuacaugagacaccaugguuau

SEQ ID NO: 46217 - RNA, 22 nt, Staphylococcus aureus subsp. aureus N315
uuacgcaucuuauguggcguug

SEQ ID NO: 46218 - RNA, 22 nt, Staphylococcus aureus subsp. aureus N315
uucaaggauaacggauaauacu

SEQ ID NO: 46219 - RNA, 23 nt, Staphylococcus aureus subsp. aureus N315
uucauacauuacuuuggaguaau

SEQ ID NO: 46220 - RNA, 22 nt, Staphylococcus aureus subsp. aureus N315
uucauagucuucugucauguga

SEQ ID NO: 46221 - RNA, 22 nt, Staphylococcus aureus subsp. aureus N315
uuccuauggguacuguuaauga

SEQ ID NO: 46222 - RNA, 20 nt, Staphylococcus aureus subsp. aureus N315
uugaagccuuauuugucguu

SEQ ID NO: 46223 - RNA, 19 nt, Staphylococcus aureus subsp. aureus N315
uugaagcuggcacauuaaa

SEQ ID NO: 46224 - RNA, 22 nt, Staphylococcus aureus subsp. aureus N315
uugaaguagaagauuuacuagg

SEQ ID NO: 46225 - RNA, 23 nt, Staphylococcus aureus subsp. aureus N315
uugagucgugauuugauuauguu

SEQ ID NO: 46226 - RNA, 22 nt, Staphylococcus aureus subsp. aureus N315
uugauacagcugguacauuagu

SEQ ID NO: 46227 - RNA, 22 nt, Staphylococcus aureus subsp. aureus N315
uugcuuaaagaccaacaguuua

SEQ ID NO: 46228 - RNA, 22 nt, Staphylococcus aureus subsp. aureus N315
uugguaaguauuuaagugaagu

SEQ ID NO: 46229 - RNA, 19 nt, Staphylococcus aureus subsp. aureus N315
uuguaacuauauaaucgau

SEQ ID NO: 46230 - RNA, 22 nt, Staphylococcus aureus subsp. aureus N315
uuguagauaaauuagcguuguu

SEQ ID NO: 46231 - RNA, 22 nt, Staphylococcus aureus subsp. aureus N315
uugugaaauauucggcgguacu

SEQ ID NO: 46232 - RNA, 22 nt, Staphylococcus aureus subsp. aureus N315
uuucacauaguuaacaauugcu

SEQ ID NO: 46233 - RNA, 22 nt, Staphylococcus aureus subsp. aureus N315
uuugucauuuauucuggauugu

SEQ ID NO: 46234 - RNA, 22 nt, Staphylococcus aureus subsp. aureus N315
aaacauguauguaugaguauau

SEQ ID NO: 46235 - RNA, 22 nt, Staphylococcus aureus subsp. aureus N315
aaagccuugauugucagcacuu

SEQ ID NO: 46236 - RNA, 22 nt, Staphylococcus aureus subsp. aureus N315
aaaggugcauguaauguugaac

SEQ ID NO: 46237 - RNA, 22 nt, Staphylococcus aureus subsp. aureus N315
aaaguaucuccaauaguaucug

SEQ ID NO: 46238 - RNA, 20 nt, Staphylococcus aureus subsp. aureus N315
aaagugguuuuaggaugccu

SEQ ID NO: 46239 - RNA, 22 nt, Staphylococcus aureus subsp. aureus N315
aaauccauuaugcuuauuuugu

SEQ ID NO: 46240 - RNA, 22 nt, Staphylococcus aureus subsp. aureus N315
aaaugguggcgccaauauggau

SEQ ID NO: 46241 - RNA, 21 nt, Staphylococcus aureus subsp. aureus N315
aaaugguuggagauaucauuu

SEQ ID NO: 46242 - RNA, 22 nt, Staphylococcus aureus subsp. aureus N315
aacaaaguugagugcauauuga

SEQ ID NO: 46243 - RNA, 22 nt, Staphylococcus aureus subsp. aureus N315
aacacuuaucaaucaagcuauu

SEQ ID NO: 46244 - RNA, 22 nt, Staphylococcus aureus subsp. aureus N315
aaccauuugcgguauuauuagg

SEQ ID NO: 46245 - RNA, 22 nt, Staphylococcus aureus subsp. aureus N315
aacgugaaaugcuuggauugau

SEQ ID NO: 46246 - RNA, 22 nt, Staphylococcus aureus subsp. aureus N315
aagaagcugaagcgacuuuguc

SEQ ID NO: 46247 - RNA, 22 nt, Staphylococcus aureus subsp. aureus N315
aagcacgcacgcuuuauauguc

SEQ ID NO: 46248 - RNA, 22 nt, Staphylococcus aureus subsp. aureus N315
aagcgcauuuucauucagucaa

SEQ ID NO: 46249 - RNA, 22 nt, Staphylococcus aureus subsp. aureus N315
aagcgcauuuucguucagucaa

SEQ ID NO: 46250 - RNA, 22 nt, Staphylococcus aureus subsp. aureus N315
aagugcauuuucguucagucaa

SEQ ID NO: 46251 - RNA, 22 nt, Staphylococcus aureus subsp. aureus N315
aauaucagcuucuagaauugcu

SEQ ID NO: 46252 - RNA, 22 nt, Staphylococcus aureus subsp. aureus N315
aaucaucuuacugcuguuuguu

SEQ ID NO: 46253 - RNA, 22 nt, Staphylococcus aureus subsp. aureus N315
aaucauggagugggauagaaau

SEQ ID NO: 46254 - RNA, 22 nt, Staphylococcus aureus subsp. aureus N315
aaucugauggaucuggaucugu

SEQ ID NO: 46255 - RNA, 22 nt, Staphylococcus aureus subsp. aureus N315
aauggaauuuaagacgcugcau

SEQ ID NO: 46256 - RNA, 20 nt, Staphylococcus aureus subsp. aureus N315
aauggauucgguaacaaugc

SEQ ID NO: 46257 - RNA, 23 nt, Staphylococcus aureus subsp. aureus N315
aaugucuuacugcuccuuuguau

SEQ ID NO: 46258 - RNA, 22 nt, Staphylococcus aureus subsp. aureus N315
aauuguucugguguugcgaucg

SEQ ID NO: 46259 - RNA, 22 nt, Staphylococcus aureus subsp. aureus N315
acaauugaugucacugcauuau

SEQ ID NO: 46260 - RNA, 22 nt, Staphylococcus aureus subsp. aureus N315
acacugcaaaauuggucgcuuu

SEQ ID NO: 46261 - RNA, 22 nt, Staphylococcus aureus subsp. aureus N315
acagcuguuaaaauggcauaga

SEQ ID NO: 46262 - RNA, 22 nt, Staphylococcus aureus subsp. aureus N315
acagguaaauacuacaucacug

SEQ ID NO: 46263 - RNA, 22 nt, Staphylococcus aureus subsp. aureus N315
acaggugguaaaacuuguaugu

SEQ ID NO: 46264 - RNA, 22 nt, Staphylococcus aureus subsp. aureus N315
acauauugaaaaaugcaccuga

SEQ ID NO: 46265 - RNA, 22 nt, Staphylococcus aureus subsp. aureus N315
cauaacuacggcuagcaguuuu

SEQ ID NO: 46266 - RNA, 21 nt, Staphylococcus aureus subsp. aureus N315
caugacauuaaggcuuuagua

SEQ ID NO: 46267 - RNA, 22 nt, Staphylococcus aureus subsp. aureus N315
cauugccaucaaacuacuuuca

SEQ ID NO: 46268 - RNA, 22 nt, Staphylococcus aureus subsp. aureus N315
ccaauuguugaaggcaguuuua

SEQ ID NO: 46269 - RNA, 22 nt, Staphylococcus aureus subsp. aureus N315
ccguguuuuagcugaaacaagu

SEQ ID NO: 46270 - RNA, 20 nt, Staphylococcus aureus subsp. aureus N315
ccucaaggugaugcaggauu

SEQ ID NO: 46271 - RNA, 22 nt, Staphylococcus aureus subsp. aureus N315
ccugcaauaauuacagccgggu

SEQ ID NO: 46272 - RNA, 18 nt, Staphylococcus aureus subsp. aureus N315
cgugugauagaaguuuuu

SEQ ID NO: 46273 - RNA, 22 nt, Staphylococcus aureus subsp. aureus N315
cuagauuuaucuaaauccaaug

SEQ ID NO: 46274 - RNA, 22 nt, Staphylococcus aureus subsp. aureus N315
cuauacugcaauccaacaauaa

SEQ ID NO: 46275 - RNA, 22 nt, Staphylococcus aureus subsp. aureus N315
cucguuaaaggucauaauuaac

SEQ ID NO: 46276 - RNA, 22 nt, Staphylococcus aureus subsp. aureus N315
cugacuagaauugaaaaaacuu

SEQ ID NO: 46277 - RNA, 22 nt, Staphylococcus aureus subsp. aureus N315
cugcaggucaacguuuaaaaga

SEQ ID NO: 46278 - RNA, 22 nt, Staphylococcus aureus subsp. aureus N315
cugcaguauuaccauugcuuaa

SEQ ID NO: 46279 - RNA, 22 nt, Staphylococcus aureus subsp. aureus N315
cugggucuggacuugguucugg

SEQ ID NO: 46280 - RNA, 22 nt, Staphylococcus aureus subsp. aureus N315
cuguuacuguugcguuauauga

SEQ ID NO: 46281 - RNA, 22 nt, Staphylococcus aureus subsp. aureus N315
cuucuaauucacgaauauuaga

SEQ ID NO: 46282 - RNA, 22 nt, Staphylococcus aureus subsp. aureus N315
cuuuccaaguuaaagauuuacc

SEQ ID NO: 46283 - RNA, 22 nt, Staphylococcus aureus subsp. aureus N315
gacguauuuuuuaucacauuga

SEQ ID NO: 46284 - RNA, 22 nt, Staphylococcus aureus subsp. aureus N315
gaugacaauucauaguaguaaa

SEQ ID NO: 46285 - RNA, 22 nt, Staphylococcus aureus subsp. aureus N315
gauggcgaaguaguuaaaguug

SEQ ID NO: 46286 - RNA, 22 nt, Staphylococcus aureus subsp. aureus N315
gauuaaguucuuuaacuucauc

SEQ ID NO: 46287 - RNA, 22 nt, Staphylococcus aureus subsp. aureus N315
gcaauacaucuuuaccaucaua

SEQ ID NO: 46288 - RNA, 22 nt, Staphylococcus aureus subsp. aureus N315
gcaggcaugaacaaacaagacu

SEQ ID NO: 46289 - RNA, 22 nt, Staphylococcus aureus subsp. aureus N315
gcauuguaguuuauuugcgagg

SEQ ID NO: 46290 - RNA, 22 nt, Staphylococcus aureus subsp. aureus N315
gcuaguuuaucuagauuagguu

SEQ ID NO: 46291 - RNA, 22 nt, Staphylococcus aureus subsp. aureus N315
gcugaaaugguaauaucuuuau

SEQ ID NO: 46292 - RNA, 22 nt, Staphylococcus aureus subsp. aureus N315
ggcgcaugccacuaaaaugauu

SEQ ID NO: 46293 - RNA, 21 nt, Staphylococcus aureus subsp. aureus N315
ggcuguucggauuuagugcaa

SEQ ID NO: 46294 - RNA, 22 nt, Staphylococcus aureus subsp. aureus N315
gguauagguugcuuuuucguug

SEQ ID NO: 46295 - RNA, 22 nt, Staphylococcus aureus subsp. aureus N315
ggugaucguucagaacguauuc

SEQ ID NO: 46296 - RNA, 22 nt, Staphylococcus aureus subsp. aureus N315
ggugccugaucuguaauuaccu

SEQ ID NO: 46297 - RNA, 22 nt, Staphylococcus aureus subsp. aureus N315
gguugucauuauuguguugaua

SEQ ID NO: 46298 - RNA, 22 nt, Staphylococcus aureus subsp. aureus N315
guaacuuuauuugucauaaaug

SEQ ID NO: 46299 - RNA, 22 nt, Staphylococcus aureus subsp. aureus N315
guagauugaucaaguaauguac

SEQ ID NO: 46300 - RNA, 22 nt, Staphylococcus aureus subsp. aureus N315
guaugaacaguaccaauggauu

SEQ ID NO: 46301 - RNA, 22 nt, Staphylococcus aureus subsp. aureus N315
gucaucauuggaaucuuuauaa

SEQ ID NO: 46302 - RNA, 22 nt, Staphylococcus aureus subsp. aureus N315
gucaugcaaaauauauacguau

SEQ ID NO: 46303 - RNA, 22 nt, Staphylococcus aureus subsp. aureus N315
gucauuauaauugaguauuuga

SEQ ID NO: 46304 - RNA, 22 nt, Staphylococcus aureus subsp. aureus N315
gugcauuagcuguugagguauu

SEQ ID NO: 46305 - RNA, 22 nt, Staphylococcus aureus subsp. aureus N315
gugcuggcgaaaagaaaguuaa

SEQ ID NO: 46306 - RNA, 22 nt, Staphylococcus aureus subsp. aureus N315
guuaacaacugagauaccggcu

SEQ ID NO: 46307 - RNA, 22 nt, Staphylococcus aureus subsp. aureus N315
guuacuuuaugauuacuaaaaa

SEQ ID NO: 46308 - RNA, 22 nt, Staphylococcus aureus subsp. aureus N315
guuagaagacauuguguugaau

SEQ ID NO: 46309 - RNA, 22 nt, Staphylococcus aureus subsp. aureus N315
guuaugauaauucauugaauau

SEQ ID NO: 46310 - RNA, 22 nt, Staphylococcus aureus subsp. aureus N315
guuauguaucgauuucagaaga

SEQ ID NO: 46311 - RNA, 22 nt, Staphylococcus aureus subsp. aureus N315
guucauugacaaggacugauuu

SEQ ID NO: 46312 - RNA, 22 nt, Staphylococcus aureus subsp. aureus N315
guugacugaacgaaaaugcacu

SEQ ID NO: 46313 - RNA, 22 nt, Staphylococcus aureus subsp. aureus N315
uaaagcacucauuauuuaaggc

SEQ ID NO: 46314 - RNA, 22 nt, Staphylococcus aureus subsp. aureus N315
uaaagcuacugauacuauguag

SEQ ID NO: 46315 - RNA, 22 nt, Staphylococcus aureus subsp. aureus N315
uaaaggcacgcauacuuuguag

SEQ ID NO: 46316 - RNA, 21 nt, Staphylococcus aureus subsp. aureus N315
uaagaaguuagcaacaucaac

SEQ ID NO: 46317 - RNA, 22 nt, Staphylococcus aureus subsp. aureus N315
uaagagugugacauuuucuaca

SEQ ID NO: 46318 - RNA, 22 nt, Staphylococcus aureus subsp. aureus N315
uaagucaacuaagugugcuuga

SEQ ID NO: 46319 - RNA, 22 nt, Staphylococcus aureus subsp. aureus N315
uaaguggauuguaauuauauua

SEQ ID NO: 46320 - RNA, 22 nt, Staphylococcus aureus subsp. aureus N315
uacaaagccuuaauaucaugca

SEQ ID NO: 46321 - RNA, 22 nt, Staphylococcus aureus subsp. aureus N315
uagacaccaaaaaacagagguc

SEQ ID NO: 46322 - RNA, 22 nt, Staphylococcus aureus subsp. aureus N315
uagggagugggacagaaaugau

SEQ ID NO: 46323 - RNA, 22 nt, Staphylococcus aureus subsp. aureus N315
uagggcgauauuaaaagaugca

SEQ ID NO: 46324 - RNA, 22 nt, Staphylococcus aureus subsp. aureus N315
uaguagggauugggacagaaau

SEQ ID NO: 46325 - RNA, 22 nt, Staphylococcus aureus subsp. aureus N315
uauggcgaaacuaauguauuau

SEQ ID NO: 46326 - RNA, 22 nt, Staphylococcus aureus subsp. aureus N315
ucaaauccauuuauugcggcau

SEQ ID NO: 46327 - RNA, 22 nt, Staphylococcus aureus subsp. aureus N315
ucacaauuuggguguuugugau

SEQ ID NO: 46328 - RNA, 22 nt, Staphylococcus aureus subsp. aureus N315
ucacuugagagagcuugcagau

SEQ ID NO: 46329 - RNA, 22 nt, Staphylococcus aureus subsp. aureus N315
ucaguuaccacuuuuuauugug

SEQ ID NO: 46330 - RNA, 22 nt, Staphylococcus aureus subsp. aureus N315
ucaugauuaaaauauguaccug

SEQ ID NO: 46331 - RNA, 22 nt, Staphylococcus aureus subsp. aureus N315
ucauuuguuccagguaaaauug

SEQ ID NO: 46332 - RNA, 22 nt, Staphylococcus aureus subsp. aureus N315
ucccuauacucuuaaugcauca

SEQ ID NO: 46333 - RNA, 22 nt, Staphylococcus aureus subsp. aureus N315
ucgaacaagauauugccaauuu

SEQ ID NO: 46334 - RNA, 22 nt, Staphylococcus aureus subsp. aureus N315
ucggugauaagugaaucaauua

SEQ ID NO: 46335 - RNA, 22 nt, Staphylococcus aureus subsp. aureus N315
ucgguucgccugcgcuuuugcg

SEQ ID NO: 46336 - RNA, 19 nt, Staphylococcus aureus subsp. aureus N315
ucucaucaguucgauuuuu

SEQ ID NO: 46337 - RNA, 22 nt, Staphylococcus aureus subsp. aureus N315
ugaaauacuaacauugacuucu

SEQ ID NO: 46338 - RNA, 22 nt, Streptococcus pneumoniae R6
agcuaagccuaaaauuggugcc

SEQ ID NO: 46339 - RNA, 22 nt, Streptococcus pneumoniae R6
aggaaucggugaauuugcuuca

SEQ ID NO: 46340 - RNA, 23 nt, Streptococcus pneumoniae R6
aggacaauagaaaaguguauagu

SEQ ID NO: 46341 - RNA, 22 nt, Streptococcus pneumoniae R6
aggguugauaaccaacugcaug

SEQ ID NO: 46342 - RNA, 22 nt, Streptococcus pneumoniae R6
aguaaguauauuaaguauggug

SEQ ID NO: 46343 - RNA, 20 nt, Streptococcus pneumoniae R6
agucaguucagaagcaaggu

SEQ ID NO: 46344 - RNA, 18 nt, Streptococcus pneumoniae R6
agucuugcaaguaaucca

SEQ ID NO: 46345 - RNA, 19 nt, Streptococcus pneumoniae R6
aucgcuuugaucacuggaa

SEQ ID NO: 46346 - RNA, 22 nt, Streptococcus pneumoniae R6
aucuacuuaacucuuuauauga

SEQ ID NO: 46347 - RNA, 22 nt, Streptococcus pneumoniae R6
aucuuuagucacaggaagguua

SEQ ID NO: 46348 - RNA, 22 nt, Streptococcus pneumoniae R6
augaacugcaccccaaaaguua

SEQ ID NO: 46349 - RNA, 22 nt, Streptococcus pneumoniae R6
augaauguugacaauccgaccu

SEQ ID NO: 46350 - RNA, 22 nt, Streptococcus pneumoniae R6
auuaguuggcuugucuuuguag

SEQ ID NO: 46351 - RNA, 22 nt, Streptococcus pneumoniae R6
auucaguauuacuugaauagag

SEQ ID NO: 46352 - RNA, 22 nt, Streptococcus pneumoniae R6
auuguaagcagcauaccaauga

SEQ ID NO: 46353 - RNA, 22 nt, Streptococcus pneumoniae R6
auugucagcaacuugaccgaca

SEQ ID NO: 46354 - RNA, 20 nt, Streptococcus pneumoniae R6
auuuaccuauuuuagcagag

SEQ ID NO: 46355 - RNA, 20 nt, Streptococcus pneumoniae R6
auuucucagucuuaucauau

SEQ ID NO: 46356 - RNA, 22 nt, Streptococcus pneumoniae R6
caagguguuugguggauuuguu

SEQ ID NO: 46357 - RNA, 22 nt, Streptococcus pneumoniae R6
cagacagauguggcuugugagg

SEQ ID NO: 46358 - RNA, 22 nt, Streptococcus pneumoniae R6
cagacuuugucuucuauauggg

SEQ ID NO: 46359 - RNA, 22 nt, Streptococcus pneumoniae R6
caggaacugggacuguuuccuu

SEQ ID NO: 46360 - RNA, 22 nt, Streptococcus pneumoniae R6
caguauccgucuauagaaacgg

SEQ ID NO: 46361 - RNA, 21 nt, Streptococcus pneumoniae R6
caguugacaaagaugaggccu

SEQ ID NO: 46362 - RNA, 22 nt, Streptococcus pneumoniae R6
caucagacaaaauagaacgauu

SEQ ID NO: 46363 - RNA, 22 nt, Streptococcus pneumoniae R6
ccaagcauacgacuucaugcgu

SEQ ID NO: 46364 - RNA, 22 nt, Streptococcus pneumoniae R6
ccaauuucuuuugacgagacau

SEQ ID NO: 46365 - RNA, 22 nt, Streptococcus pneumoniae R6
ccuaaucuggagauuucuuauu

SEQ ID NO: 46366 - RNA, 22 nt, Streptococcus pneumoniae R6
cuaucucagcucgaagucguag

SEQ ID NO: 46367 - RNA, 23 nt, Streptococcus pneumoniae R6
cuccaguuggguuauuuggauug

SEQ ID NO: 46368 - RNA, 22 nt, Streptococcus pneumoniae R6
cugaagugaugacuucuuuauu

SEQ ID NO: 46369 - RNA, 22 nt, Streptococcus pneumoniae R6
cugcaacagccaagucaaucgc

SEQ ID NO: 46370 - RNA, 22 nt, Streptococcus pneumoniae R6
cugcucuauaccaccguuuguc

SEQ ID NO: 46371 - RNA, 22 nt, Streptococcus pneumoniae R6
cuguaacuuuggaugaugcgga

SEQ ID NO: 46372 - RNA, 19 nt, Streptococcus pneumoniae R6
cugucuuggcucucuuguc

SEQ ID NO: 46373 - RNA, 22 nt, Streptococcus pneumoniae R6
cuuauguucucaauauuggauu

SEQ ID NO: 46374 - RNA, 21 nt, Streptococcus pneumoniae R6
gaggacuucuacauagauauu

SEQ ID NO: 46375 - RNA, 22 nt, Streptococcus pneumoniae R6
gauauggucugccgucuugaua

SEQ ID NO: 46376 - RNA, 22 nt, Streptococcus pneumoniae R6
gaugcagaugucuuuguuuacc

SEQ ID NO: 46377 - RNA, 22 nt, Streptococcus pneumoniae R6
gauugauauuuuugagaaccug

SEQ ID NO: 46378 - RNA, 22 nt, Streptococcus pneumoniae R6
gcacagcuaggacuugaaaguu

SEQ ID NO: 46379 - RNA, 22 nt, Streptococcus pneumoniae R6
gcaucucugugccuuucuugug

SEQ ID NO: 46380 - RNA, 22 nt, Streptococcus pneumoniae R6
gccaaaugaagguccugaugau

SEQ ID NO: 46381 - RNA, 22 nt, Streptococcus pneumoniae R6
gccagcaggugacugguaggua

SEQ ID NO: 46382 - RNA, 20 nt, Streptococcus pneumoniae R6
gccuucuauugauuucuuag

SEQ ID NO: 46383 - RNA, 22 nt, Streptococcus pneumoniae R6
gcgcuugaaagaauuggcgauu

SEQ ID NO: 46384 - RNA, 17 nt, Streptococcus pneumoniae R6
ggccaaagauacguguu

SEQ ID NO: 46385 - RNA, 22 nt, Streptococcus pneumoniae R6
ggguagcuauacaggcuugcga

SEQ ID NO: 46386 - RNA, 22 nt, Streptococcus pneumoniae R6
ggucaaggucaagaaaaacugg

SEQ ID NO: 46387 - RNA, 22 nt, Streptococcus pneumoniae R6
ggugauauuaccaacaguuucu

SEQ ID NO: 46388 - RNA, 22 nt, Streptococcus pneumoniae R6
gucauaaggaauggugaagaaa

SEQ ID NO: 46389 - RNA, 19 nt, Streptococcus pneumoniae R6
gucaucaugccaucgcagc

SEQ ID NO: 46390 - RNA, 22 nt, Streptococcus pneumoniae R6
gucuaaacauuccaguuuucuu

SEQ ID NO: 46391 - RNA, 22 nt, Streptococcus pneumoniae R6
gucugaauuaaguauccgucaa

SEQ ID NO: 46392 - RNA, 22 nt, Streptococcus pneumoniae R6
gugcaguucgcuacaucaacgu

SEQ ID NO: 46393 - RNA, 22 nt, Streptococcus pneumoniae R6
guguuaaauuuagcgauaguga

SEQ ID NO: 46394 - RNA, 22 nt, Streptococcus pneumoniae R6
guucccaaagcuuugucuugcu

SEQ ID NO: 46395 - RNA, 22 nt, Streptococcus pneumoniae R6
guucuaacuaccaagucccagu

SEQ ID NO: 46396 - RNA, 22 nt, Streptococcus pneumoniae R6
uaaaucaggccaggucuugguc

SEQ ID NO: 46397 - RNA, 22 nt, Streptococcus pneumoniae R6
uaacuucagaaggagaaauugu

SEQ ID NO: 46398 - RNA, 22 nt, Streptococcus pneumoniae R6
uaagcuuagaauugccauaaaa

SEQ ID NO: 46399 - RNA, 20 nt, Streptococcus pneumoniae R6
uacauugcauacuaugagug

SEQ ID NO: 46400 - RNA, 22 nt, Streptococcus pneumoniae R6
uacugggaaagucggaacgaug

SEQ ID NO: 46401 - RNA, 22 nt, Streptococcus pneumoniae R6
uagcagaauuaccauucuuccu

SEQ ID NO: 46402 - RNA, 22 nt, Streptococcus pneumoniae R6
uagcucuuucugguggauuaga

SEQ ID NO: 46403 - RNA, 22 nt, Streptococcus pneumoniae R6
uagcuucugaagauauuuuuua

SEQ ID NO: 46404 - RNA, 22 nt, Streptococcus pneumoniae R6
uaucuugagcaaguaguccaaa

SEQ ID NO: 46405 - RNA, 18 nt, Streptococcus pneumoniae R6
uaucuugauagaaaauau

SEQ ID NO: 46406 - RNA, 22 nt, Streptococcus pneumoniae R6
uaugcagaauaucuuggacuuu

SEQ ID NO: 46407 - RNA, 22 nt, Streptococcus pneumoniae R6
ucaauccagauuuugcuccauu

SEQ ID NO: 46408 - RNA, 22 nt, Streptococcus pneumoniae R6
ucaaucuagacacaaaauggaa

SEQ ID NO: 46409 - RNA, 22 nt, Streptococcus pneumoniae R6
ucacuguugguaaaaaagcggc

SEQ ID NO: 46410 - RNA, 22 nt, Streptococcus pneumoniae R6
ucagacuaugauaugauuguuc

SEQ ID NO: 46411 - RNA, 22 nt, Streptococcus pneumoniae R6
ucagucagauuaucuauuuucc

SEQ ID NO: 46412 - RNA, 22 nt, Streptococcus pneumoniae R6
ucaugggcuugaccuauccugc

SEQ ID NO: 46413 - RNA, 22 nt, Streptococcus pneumoniae R6
uccaaauagucuggaaauugcc

SEQ ID NO: 46414 - RNA, 22 nt, Streptococcus pneumoniae R6
uccaaauguaacucguacuuca

SEQ ID NO: 46415 - RNA, 22 nt, Streptococcus pneumoniae R6
uccaagcgguaauaaucugcca

SEQ ID NO: 46416 - RNA, 20 nt, Streptococcus pneumoniae R6
ucgaugacgaggacuguauu

SEQ ID NO: 46417 - RNA, 22 nt, Streptococcus pneumoniae R6
ucgcuagaccaacuaucuuuuu

SEQ ID NO: 46418 - RNA, 22 nt, Streptococcus pneumoniae R6
ucggauugaccacaccaagaac

SEQ ID NO: 46419 - RNA, 22 nt, Streptococcus pneumoniae R6
ucgggaagagaaaaagacugca

SEQ ID NO: 46420 - RNA, 22 nt, Streptococcus pneumoniae R6
ucguaaacaaagagguuuuaga

SEQ ID NO: 46421 - RNA, 21 nt, Streptococcus pneumoniae R6
ucgucgugaguuuaucgaaga

SEQ ID NO: 46422 - RNA, 22 nt, Streptococcus pneumoniae R6
aaacagguaucuggaaguuuga

SEQ ID NO: 46423 - RNA, 22 nt, Streptococcus pneumoniae R6
aaagagccucauaaaagguauu

SEQ ID NO: 46424 - RNA, 22 nt, Streptococcus pneumoniae R6
aaagucaucugaaucuuugaga

SEQ ID NO: 46425 - RNA, 22 nt, Streptococcus pneumoniae R6
aaaugcuguauuguagcuaguu

SEQ ID NO: 46426 - RNA, 22 nt, Streptococcus pneumoniae R6
aacgauagaacucugagucuca

SEQ ID NO: 46427 - RNA, 22 nt, Streptococcus pneumoniae R6
aacuggcuagcuuuacgagcuu

SEQ ID NO: 46428 - RNA, 22 nt, Streptococcus pneumoniae R6
aagauugucuugauuaucuuaa

SEQ ID NO: 46429 - RNA, 22 nt, Streptococcus pneumoniae R6
aagauuguuaucuugacagcga

SEQ ID NO: 46430 - RNA, 22 nt, Streptococcus pneumoniae R6
aagcgaugcagcuccccccugu

SEQ ID NO: 46431 - RNA, 22 nt, Streptococcus pneumoniae R6
aaggugauaugaauaaguucug

SEQ ID NO: 46432 - RNA, 22 nt, Streptococcus pneumoniae R6
aaguaagcuuuacuucuaaagu

SEQ ID NO: 46433 - RNA, 22 nt, Streptococcus pneumoniae R6
aaguuacuggggauauucuaau

SEQ ID NO: 46434 - RNA, 22 nt, Streptococcus pneumoniae R6
aauaccuuuuugaggugcuuuu

SEQ ID NO: 46435 - RNA, 22 nt, Streptococcus pneumoniae R6
aauccaucucaguaaagaagcu

SEQ ID NO: 46436 - RNA, 22 nt, Streptococcus pneumoniae R6
aaugcuuacuucacuucuguaa

SEQ ID NO: 46437 - RNA, 22 nt, Streptococcus pneumoniae R6
aauuggaauguaggcaugaccu

SEQ ID NO: 46438 - RNA, 22 nt, Streptococcus pneumoniae R6
aauuuggcuuaaaacaauuauc

SEQ ID NO: 46439 - RNA, 22 nt, Streptococcus pneumoniae R6
acacucguucuucucuuacaac

SEQ ID NO: 46440 - RNA, 22 nt, Streptococcus pneumoniae R6
acagaaaugauuaugggcccac

SEQ ID NO: 46441 - RNA, 22 nt, Streptococcus pneumoniae R6
acauuugacaaggcuuuauuga

SEQ ID NO: 46442 - RNA, 19 nt, Streptococcus pneumoniae R6
accaaauuuagguaugguu

SEQ ID NO: 46443 - RNA, 23 nt, Streptococcus pneumoniae R6
accgagaauaugggugucaaacu

SEQ ID NO: 46444 - RNA, 22 nt, Streptococcus pneumoniae R6
acgcucaagcucuucuuaauga

SEQ ID NO: 46445 - RNA, 22 nt, Streptococcus pneumoniae R6
acugggaaauuaagcuauauuu

SEQ ID NO: 46446 - RNA, 22 nt, Streptococcus pneumoniae R6
acuuaaucaucacuugcucauu

SEQ ID NO: 46447 - RNA, 22 nt, Streptococcus pneumoniae R6
acuuggacuucguugguuggua

SEQ ID NO: 46448 - RNA, 22 nt, Streptococcus pneumoniae R6
acuuggugggcuaauugaguga

SEQ ID NO: 46449 - RNA, 22 nt, Streptococcus pneumoniae R6
acuuuaccaauagcaaauggua

SEQ ID NO: 46450 - RNA, 22 nt, Streptococcus pneumoniae R6
agaaaccugcuccaagggaaag

SEQ ID NO: 46451 - RNA, 22 nt, Streptococcus pneumoniae R6
agaaguugaaauccgcaaccgu

SEQ ID NO: 46452 - RNA, 22 nt, Streptococcus pneumoniae R6
agauagcugcagcugaggaaau

SEQ ID NO: 46453 - RNA, 22 nt, Streptococcus pneumoniae R6
agauguacggcuuauuccguga

SEQ ID NO: 46454 - RNA, 22 nt, Streptococcus pneumoniae R6
agcaucuuuauuggaagaagcu

SEQ ID NO: 46455 - RNA, 22 nt, Streptococcus pneumoniae R6
agcaugacucguuuugugaccg

SEQ ID NO: 46456 - RNA, 22 nt, Streptococcus pneumoniae R6
aaacuucuuauagggugcuaga

SEQ ID NO: 46457 - RNA, 22 nt, Streptococcus pneumoniae R6
aaaugagcuucaggcauuaaac

SEQ ID NO: 46458 - RNA, 22 nt, Streptococcus pneumoniae R6
aaaugguugacaucgacuccua

SEQ ID NO: 46459 - RNA, 22 nt, Streptococcus pneumoniae R6
aaauugcgaugaaguugauacc

SEQ ID NO: 46460 - RNA, 22 nt, Streptococcus pneumoniae R6
aacaguaugagagggauagagg

SEQ ID NO: 46461 - RNA, 22 nt, Streptococcus pneumoniae R6
aaccaucugcacgacggaaguc

SEQ ID NO: 46462 - RNA, 22 nt, Streptococcus pneumoniae R6
aacuguugaaagcaguggaugg

SEQ ID NO: 46463 - RNA, 22 nt, Streptococcus pneumoniae R6
aacuugauacuaugcguuuuaa

SEQ ID NO: 46464 - RNA, 22 nt, Streptococcus pneumoniae R6
aacuugauauuguguguuuuau

SEQ ID NO: 46465 - RNA, 22 nt, Streptococcus pneumoniae R6
aacuuucagacacggaacaacu

SEQ ID NO: 46466 - RNA, 22 nt, Streptococcus pneumoniae R6
aaggacuacguaccuugaugga

SEQ ID NO: 46467 - RNA, 22 nt, Streptococcus pneumoniae R6
aaggaguuuuggucguuaugaa

SEQ ID NO: 46468 - RNA, 22 nt, Streptococcus pneumoniae R6
aagguuugaaaauugcaacccu

SEQ ID NO: 46469 - RNA, 22 nt, Streptococcus pneumoniae R6
aagucuauuggaaaguaagaaa

SEQ ID NO: 46470 - RNA, 22 nt, Streptococcus pneumoniae R6
aaguugaagagcuuguagaaac

SEQ ID NO: 46471 - RNA, 22 nt, Streptococcus pneumoniae R6
aaugucaguggaagaggugcuu

SEQ ID NO: 46472 - RNA, 22 nt, Streptococcus pneumoniae R6
acaaggauaugcugacuuuguu

SEQ ID NO: 46473 - RNA, 22 nt, Streptococcus pneumoniae R6
acgaugcaguuguauuguucgu

SEQ ID NO: 46474 - RNA, 22 nt, Streptococcus pneumoniae R6
acgguugcggauuucaacuucu

SEQ ID NO: 46475 - RNA, 22 nt, Streptococcus pneumoniae R6
acuauugacucagcccuuacuu

SEQ ID NO: 46476 - RNA, 21 nt, Streptococcus pneumoniae R6
acuuggucauuucgagaacga

SEQ ID NO: 46477 - RNA, 22 nt, Streptococcus pneumoniae R6
acuugugauucugauaagaauc

SEQ ID NO: 46478 - RNA, 22 nt, Streptococcus pneumoniae R6
acuuugacuacccaguagcaaa

SEQ ID NO: 46479 - RNA, 22 nt, Streptococcus pneumoniae R6
agaagacuuuguuaaagaaguc

SEQ ID NO: 46480 - RNA, 22 nt, Streptococcus pneumoniae R6
agaagcccuuauccguuucuac

SEQ ID NO: 46481 - RNA, 22 nt, Streptococcus pneumoniae R6
agaguacauaaacgauuacaaa

SEQ ID NO: 46482 - RNA, 22 nt, Streptococcus pneumoniae R6
agauucuucuucaauauagaua

SEQ ID NO: 46483 - RNA, 22 nt, Streptococcus pneumoniae R6
agcauuguccagauagaccaga

SEQ ID NO: 46484 - RNA, 22 nt, Streptococcus pneumoniae R6
agcgagucaaaaucuggcggau

SEQ ID NO: 46485 - RNA, 22 nt, Streptococcus pneumoniae R6
ucguuaucauaaacaguuuaaa

SEQ ID NO: 46486 - RNA, 22 nt, Streptococcus pneumoniae R6
ucuagccuaucucaucgcacaa

SEQ ID NO: 46487 - RNA, 22 nt, Streptococcus pneumoniae R6
ucuugacagaugagcgucuuaa

SEQ ID NO: 46488 - RNA, 22 nt, Streptococcus pneumoniae R6
ugaauaacuucacacgcgauuu

SEQ ID NO: 46489 - RNA, 22 nt, Streptococcus pneumoniae R6
ugaccguuuuuacuuugugcaa

SEQ ID NO: 46490 - RNA, 22 nt, Streptococcus pneumoniae R6
ugauacuaugcguuuuauguug

SEQ ID NO: 46491 - RNA, 22 nt, Streptococcus pneumoniae R6
ugauaggaugccuuuuuaugau

SEQ ID NO: 46492 - RNA, 22 nt, Streptococcus pneumoniae R6
ugcaaaugaucaugcucaugca

SEQ ID NO: 46493 - RNA, 22 nt, Streptococcus pneumoniae R6
ugcacuucuuuguaguuuugac

SEQ ID NO: 46494 - RNA, 22 nt, Streptococcus pneumoniae R6
ugcagauucauaaucagcugcg

SEQ ID NO: 46495 - RNA, 22 nt, Streptococcus pneumoniae R6
ugcuaucuacuauuuuaguggu

SEQ ID NO: 46496 - RNA, 22 nt, Streptococcus pneumoniae R6
uggauagaacuucgugggccgc

SEQ ID NO: 46497 - RNA, 22 nt, Streptococcus pneumoniae R6
uggcggauacgcuugaaguggc

SEQ ID NO: 46498 - RNA, 21 nt, Streptococcus pneumoniae R6
uggcgguaauuuugugaagca

SEQ ID NO: 46499 - RNA, 22 nt, Streptococcus pneumoniae R6
uggcuuucccuugauagagcuc

SEQ ID NO: 46500 - RNA, 22 nt, Streptococcus pneumoniae R6
ugguucuauaauauuuguagug

SEQ ID NO: 46501 - RNA, 22 nt, Streptococcus pneumoniae R6
uguaccaagaugauccagauuc

SEQ ID NO: 46502 - RNA, 22 nt, Streptococcus pneumoniae R6
ugucaaucuugguuugaucuau

SEQ ID NO: 46503 - RNA, 22 nt, Streptococcus pneumoniae R6
uguggcgacaaacugaugcgaa

SEQ ID NO: 46504 - RNA, 22 nt, Streptococcus pneumoniae R6
uuagcaagguaaaauuaggaau

SEQ ID NO: 46505 - RNA, 22 nt, Streptococcus pneumoniae R6
uuauggaagaguuaggcggugg

SEQ ID NO: 46506 - RNA, 22 nt, Streptococcus pneumoniae R6
uucagcuaucuaaggacuugga

SEQ ID NO: 46507 - RNA, 22 nt, Streptococcus pneumoniae R6
uucagcuguugccauaaccucu

SEQ ID NO: 46508 - RNA, 22 nt, Streptococcus pneumoniae R6
uuccaaguaucaauagagauga

SEQ ID NO: 46509 - RNA, 22 nt, Streptococcus pneumoniae R6
uugacgacuaaaccaguucuuu

SEQ ID NO: 46510 - RNA, 22 nt, Streptococcus pneumoniae R6
uugaggcaaauacugguaaaau

SEQ ID NO: 46511 - RNA, 22 nt, Streptococcus pneumoniae R6
uugauagauuccaauucuucuu

SEQ ID NO: 46512 - RNA, 22 nt, Streptococcus pneumoniae R6
uuggaaucaaugccuucgacuu

SEQ ID NO: 46513 - RNA, 22 nt, Streptococcus pneumoniae R6
uuggcaaaaaagaccaauuugc

SEQ ID NO: 46514 - RNA, 22 nt, Streptococcus pneumoniae R6
uuuggaaaucuggaagcucgcu

SEQ ID NO: 46515 - RNA, 23 nt, Streptococcus pneumoniae R6
agcguuaucuucuuuaauaacag

SEQ ID NO: 46516 - RNA, 22 nt, Streptococcus pneumoniae R6
agcuuucaaaaagauuuggugu

SEQ ID NO: 46517 - RNA, 22 nt, Streptococcus pneumoniae R6
agcuuucaauucuucguuagug

SEQ ID NO: 46518 - RNA, 22 nt, Streptococcus pneumoniae R6
agguauucucuuugccaacugg

SEQ ID NO: 46519 - RNA, 22 nt, Streptococcus pneumoniae R6
aguacuuguuggcaaaugguuu

SEQ ID NO: 46520 - RNA, 22 nt, Streptococcus pneumoniae R6
aguguauuguguggaagcauac

SEQ ID NO: 46521 - RNA, 22 nt, Streptococcus pneumoniae R6
aguuugacaccugaacgagugg

SEQ ID NO: 46522 - RNA, 22 nt, Streptococcus pneumoniae R6
aguuugaugacugguaauggug

SEQ ID NO: 46523 - RNA, 22 nt, Streptococcus pneumoniae R6
auaagacgaguaacuaguugug

SEQ ID NO: 46524 - RNA, 22 nt, Streptococcus pneumoniae R6
auaccuuuuaugaggcucuuuu

SEQ ID NO: 46525 - RNA, 22 nt, Streptococcus pneumoniae R6
auagacacauuuuuauccaacu

SEQ ID NO: 46526 - RNA, 22 nt, Streptococcus pneumoniae R6
auaguuaccaugaggagaucgu

SEQ ID NO: 46527 - RNA, 22 nt, Streptococcus pneumoniae R6
aucagaaaaacguaucauauca

SEQ ID NO: 46528 - RNA, 22 nt, Streptococcus pneumoniae R6
augacuuaucauuuaaggucau

SEQ ID NO: 46529 - RNA, 22 nt, Streptococcus pneumoniae R6
augagguauucaggcuugugau

SEQ ID NO: 46530 - RNA, 22 nt, Streptococcus pneumoniae R6
augcaguuggggaggcuuauga

SEQ ID NO: 46531 - RNA, 22 nt, Streptococcus pneumoniae R6
augccaagcuuggugagaagcg

SEQ ID NO: 46532 - RNA, 22 nt, Streptococcus pneumoniae R6
augcgauucaggccguucugac

SEQ ID NO: 46533 - RNA, 22 nt, Streptococcus pneumoniae R6
auuaucacuuucuagcuguucu

SEQ ID NO: 46534 - RNA, 22 nt, Streptococcus pneumoniae R6
auugcaacaucgguaauaguua

SEQ ID NO: 46535 - RNA, 22 nt, Streptococcus pneumoniae R6
auugucuagauugucuucaggc

SEQ ID NO: 46536 - RNA, 22 nt, Streptococcus pneumoniae R6
caaagauaagguucgauugaau

SEQ ID NO: 46537 - RNA, 22 nt, Streptococcus pneumoniae R6
caacaaguauaacacagaggug

SEQ ID NO: 46538 - RNA, 22 nt, Streptococcus pneumoniae R6
caacgagcgaaugaauaucgca

SEQ ID NO: 46539 - RNA, 19 nt, Streptococcus pneumoniae R6
caagaggugcuauauucuu

SEQ ID NO: 46540 - RNA, 22 nt, Streptococcus pneumoniae R6
caagucagcguaagcaccuuuu

SEQ ID NO: 46541 - RNA, 22 nt, Streptococcus pneumoniae R6
caaguuucucaguuuaguucaa

SEQ ID NO: 46542 - RNA, 22 nt, Streptococcus pneumoniae R6
caccuacuggauaucuagcugg

SEQ ID NO: 46543 - RNA, 20 nt, Streptococcus pneumoniae R6
cagaagcgaccauggcucac

SEQ ID NO: 46544 - RNA, 22 nt, Streptococcus pneumoniae R6
cauuugguauuuuaucugguca

SEQ ID NO: 46545 - RNA, 22 nt, Streptococcus pneumoniae R6
cuagucuuggucuagugguggc

SEQ ID NO: 46546 - RNA, 16 nt, Streptococcus pneumoniae R6
gaauagccuaucuucc

SEQ ID NO: 46547 - RNA, 22 nt, Streptococcus pneumoniae R6
gaauuuguauccugguacaccu

SEQ ID NO: 46548 - RNA, 22 nt, Streptococcus pneumoniae R6
gacaagugauuucuggauugcu

SEQ ID NO: 46549 - RNA, 22 nt, Streptococcus pneumoniae R6
gacacgaucuucaugaagccac

SEQ ID NO: 46550 - RNA, 22 nt, Streptococcus pneumoniae R6
gacuugcuucuaagucuucugg

SEQ ID NO: 46551 - RNA, 22 nt, Streptococcus pneumoniae R6
gagauaucagucagauugaccu

SEQ ID NO: 46552 - RNA, 22 nt, Streptococcus pneumoniae R6
gagaugaugcgaacagguuaug

SEQ ID NO: 46553 - RNA, 22 nt, Streptococcus pneumoniae R6
gagauuagagugaaucuugugc

SEQ ID NO: 46554 - RNA, 22 nt, Streptococcus pneumoniae R6
gauaugggugucaacaugguug

SEQ ID NO: 46555 - RNA, 22 nt, Streptococcus pneumoniae R6
gauguucagccaaugcgacgag

SEQ ID NO: 46556 - RNA, 22 nt, Streptococcus pneumoniae R6
gauugccuggccgacuucuucu

SEQ ID NO: 46557 - RNA, 20 nt, Streptococcus pneumoniae R6
gcugcauccuguggagaacc

SEQ ID NO: 46558 - RNA, 22 nt, Streptococcus pneumoniae R6
ggagcuuauaugcguuauacaa

SEQ ID NO: 46559 - RNA, 22 nt, Streptococcus pneumoniae R6
ggcauucuugucagguguugcc

SEQ ID NO: 46560 - RNA, 19 nt, Streptococcus pneumoniae R6
gggaauugaggauaucgcc

SEQ ID NO: 46561 - RNA, 22 nt, Streptococcus pneumoniae R6
gguaucaagauugucuggacca

SEQ ID NO: 46562 - RNA, 22 nt, Streptococcus pneumoniae R6
gucaaagcucauggauguugca

SEQ ID NO: 46563 - RNA, 22 nt, Streptococcus pneumoniae R6
gucaaggaauucuuagguacau

SEQ ID NO: 46564 - RNA, 22 nt, Streptococcus pneumoniae R6
gucaggaucuaugaucuuuggu

SEQ ID NO: 46565 - RNA, 22 nt, Streptococcus pneumoniae R6
gucauagaagucuuuucaauua

SEQ ID NO: 46566 - RNA, 22 nt, Streptococcus pneumoniae R6
gucugaagucuuuagaauaauc

SEQ ID NO: 46567 - RNA, 22 nt, Streptococcus pneumoniae R6
gucuuaucuacuaccucaaaac

SEQ ID NO: 46568 - RNA, 22 nt, Streptococcus pneumoniae R6
gugagccauggucgcuucugug

SEQ ID NO: 46569 - RNA, 22 nt, Streptococcus pneumoniae R6
gugcgauuuuagaagggaugga

SEQ ID NO: 46570 - RNA, 22 nt, Streptococcus pneumoniae R6
guugaaauagacaacugaugau

SEQ ID NO: 46571 - RNA, 21 nt, Streptococcus pneumoniae R6
guugccagaaucauagucugc

SEQ ID NO: 46572 - RNA, 22 nt, Streptococcus pneumoniae R6
uaagagcagaucaugucuuuga

SEQ ID NO: 46573 - RNA, 22 nt, Streptococcus pneumoniae R6
uaagucaauggauaggaggaag

SEQ ID NO: 46574 - RNA, 22 nt, Streptococcus pneumoniae R6
uacaagauuuuguuucuuaucu

SEQ ID NO: 46575 - RNA, 22 nt, Streptococcus pneumoniae R6
uaccauuugcuauugguaaagu

SEQ ID NO: 46576 - RNA, 22 nt, Streptococcus pneumoniae R6
uaccuauagaguagcagaagca

SEQ ID NO: 46577 - RNA, 22 nt, Streptococcus pneumoniae R6
uacugggaagaauucaacguug

SEQ ID NO: 46578 - RNA, 21 nt, Streptococcus pneumoniae R6
uagagauuacagaguuauuuu

SEQ ID NO: 46579 - RNA, 21 nt, Streptococcus pneumoniae R6
uagauuuggcugacuuuggcu

SEQ ID NO: 46580 - RNA, 23 nt, Streptococcus pneumoniae R6
uaguaaguacuguaaaaguuuug

SEQ ID NO: 46581 - RNA, 22 nt, Streptococcus pneumoniae R6
uauaucaguuuaaucaagccau

SEQ ID NO: 46582 - RNA, 19 nt, Streptococcus pneumoniae R6
uaucccaucagcaggaugg

SEQ ID NO: 46583 - RNA, 22 nt, Streptococcus pneumoniae R6
uaugaacugcaccccaaaaguu

SEQ ID NO: 46584 - RNA, 22 nt, Streptococcus pneumoniae R6
uaugagcggaaggauuugaugc

SEQ ID NO: 46585 - RNA, 22 nt, Streptococcus pneumoniae R6
uauggaaauagguuggcaauuu

SEQ ID NO: 46586 - RNA, 22 nt, Streptococcus pneumoniae R6
uauggugauacuuugagcacca

SEQ ID NO: 46587 - RNA, 22 nt, Streptococcus pneumoniae R6
ucagagaaucgcuuuggcgcgu

SEQ ID NO: 46588 - RNA, 22 nt, Streptococcus pneumoniae R6
ucagaugagaugccaaguucaa

SEQ ID NO: 46589 - RNA, 22 nt, Streptococcus pneumoniae R6
ucagucacauauauaauccaag

SEQ ID NO: 46590 - RNA, 22 nt, Streptococcus pneumoniae R6
ucauagaacuacuauaccauau

SEQ ID NO: 46591 - RNA, 22 nt, Streptococcus pneumoniae R6
uccauacccgugaugcgcugga

SEQ ID NO: 46592 - RNA, 22 nt, Streptococcus pneumoniae R6
ucgaauuggcccaggucuuuuu

SEQ ID NO: 46593 - RNA, 22 nt, Streptococcus pneumoniae R6
ucgcaugucuucuuacuuguug

SEQ ID NO: 46594 - RNA, 22 nt, Streptococcus pneumoniae R6
ucuacaucugguuuuuccauau

SEQ ID NO: 46595 - RNA, 22 nt, Streptococcus pneumoniae R6
ucuacuuaucaaaaagaguuag

SEQ ID NO: 46596 - RNA, 22 nt, Streptococcus pneumoniae R6
ucuagaugcccaucgagagggc

SEQ ID NO: 46597 - RNA, 22 nt, Streptococcus pneumoniae R6
ucucaauaaucuccagcaagag

SEQ ID NO: 46598 - RNA, 22 nt, Streptococcus pneumoniae R6
ucucgguucuggcuuuacugau

SEQ ID NO: 46599 - RNA, 23 nt, Streptococcus pneumoniae R6
ucugauaacgucuauaacuuggu

SEQ ID NO: 46600 - RNA, 22 nt, Streptococcus pneumoniae R6
ucugaucuaaaauuggaaaauc

SEQ ID NO: 46601 - RNA, 22 nt, Streptococcus pneumoniae R6
ucuuuacaacuggaucggacgu

SEQ ID NO: 46602 - RNA, 22 nt, Streptococcus pneumoniae R6
ucuuugauauguugauggggga

SEQ ID NO: 46603 - RNA, 18 nt, Streptococcus pneumoniae R6
ugaaaugagcaagaaaga

SEQ ID NO: 46604 - RNA, 22 nt, Streptococcus pneumoniae R6
ugaaucgucugccaaaagauca

SEQ ID NO: 46605 - RNA, 22 nt, Streptococcus pneumoniae R6
ugaccagauaaaauaccaaaug

SEQ ID NO: 46606 - RNA, 22 nt, Streptococcus pneumoniae R6
ugauaaugaugcuaaaaacgga

SEQ ID NO: 46607 - RNA, 22 nt, Streptococcus pneumoniae R6
ugauacuaugcguuuuauugug

SEQ ID NO: 46608 - RNA, 22 nt, Streptococcus pneumoniae R6
ugauucagauucauuugagcgu

SEQ ID NO: 46609 - RNA, 22 nt, Streptococcus pneumoniae R6
ugcaacauccaugagcuuugac

SEQ ID NO: 46610 - RNA, 23 nt, Streptococcus pneumoniae R6
ugcuaagaccuuagcucacaccc

SEQ ID NO: 46611 - RNA, 22 nt, Streptococcus pneumoniae R6
ugcucaaaauacguuuguaggu

SEQ ID NO: 46612 - RNA, 22 nt, Streptococcus pneumoniae R6
ugcuuguacgaguugaagcauc

SEQ ID NO: 46613 - RNA, 22 nt, Streptococcus pneumoniae R6
uggaacuggaauuccauuguua

SEQ ID NO: 46614 - RNA, 22 nt, Streptococcus pneumoniae R6
uggcagauagacguauucuugg

SEQ ID NO: 46615 - RNA, 19 nt, Streptococcus pneumoniae R6
ugggcaggaagucuggauc

SEQ ID NO: 46616 - RNA, 22 nt, Streptococcus pneumoniae R6
ugguaagauaccgucacagugu

SEQ ID NO: 46617 - RNA, 18 nt, Streptococcus pneumoniae R6
uguggacaaggaugucaa

SEQ ID NO: 46618 - RNA, 20 nt, Streptococcus pneumoniae R6
uguuaagcuaaaguuugccg

SEQ ID NO: 46619 - RNA, 22 nt, Streptococcus pneumoniae R6
uguuacuaagugagauacugcu

SEQ ID NO: 46620 - RNA, 22 nt, Streptococcus pneumoniae R6
uguugccaguauuaccgacuau

SEQ ID NO: 46621 - RNA, 22 nt, Streptococcus pneumoniae R6
uuacuacuaucucuuuuauaug

SEQ ID NO: 46622 - RNA, 19 nt, Streptococcus pneumoniae R6
uuacuaugcguuuuguuau

SEQ ID NO: 46623 - RNA, 21 nt, Streptococcus pneumoniae R6
uuagagaaaauggguuguuuu

SEQ ID NO: 46624 - RNA, 22 nt, Streptococcus pneumoniae R6
uucuagaaugucuuccaaacga

SEQ ID NO: 46625 - RNA, 22 nt, Streptococcus pneumoniae R6
uugaaacgggaauuuuggaaga

SEQ ID NO: 46626 - RNA, 22 nt, Streptococcus pneumoniae R6
uugacaaaagugaaagaaucag

SEQ ID NO: 46627 - RNA, 22 nt, Streptococcus pneumoniae R6
uugaccagcuuuucaucaauca

SEQ ID NO: 46628 - RNA, 22 nt, Streptococcus pneumoniae R6
uugauaacgaaauugaggaauu

SEQ ID NO: 46629 - RNA, 22 nt, Streptococcus pneumoniae R6
uugauacuaugcguuuucugau

SEQ ID NO: 46630 - RNA, 22 nt, Streptococcus pneumoniae R6
uugauaggcuggcgauaugauu

SEQ ID NO: 46631 - RNA, 23 nt, Streptococcus pneumoniae R6
uugcgaaguuuuggugaguauuu

SEQ ID NO: 46632 - RNA, 19 nt, Streptococcus pneumoniae R6
uugcuaaggaagaagguca

SEQ ID NO: 46633 - RNA, 22 nt, Streptococcus pneumoniae R6
uuugaucauagaugucagcauu

SEQ ID NO: 46634 - RNA, 21 nt, Streptococcus pneumoniae R6
uuugcuaggaagaaagacuag

SEQ ID NO: 46635 - RNA, 22 nt, Streptococcus pneumoniae R6
uuugcugaugauaggcuacaau

SEQ ID NO: 46636 - RNA, 22 nt, Streptococcus pneumoniae TIGR4
aaaagagacauauuuaugaaaa

SEQ ID NO: 46637 - RNA, 22 nt, Streptococcus pneumoniae TIGR4
aaaccauuucugacaagggagu

SEQ ID NO: 46638 - RNA, 22 nt, Streptococcus pneumoniae TIGR4
aaauguagccaugaauaacaaa

SEQ ID NO: 46639 - RNA, 22 nt, Streptococcus pneumoniae TIGR4
aagaggagagaagcaaucugcg

SEQ ID NO: 46640 - RNA, 22 nt, Streptococcus pneumoniae TIGR4
aagauaaaaacgaacaaguucu

SEQ ID NO: 46641 - RNA, 18 nt, Streptococcus pneumoniae TIGR4
aagauuuucaaccaguag

SEQ ID NO: 46642 - RNA, 22 nt, Streptococcus pneumoniae TIGR4
aagcgaugcagcuccccccugu

SEQ ID NO: 46643 - RNA, 22 nt, Streptococcus pneumoniae TIGR4
aaggauggaacggccuauacca

SEQ ID NO: 46644 - RNA, 22 nt, Streptococcus pneumoniae TIGR4
aauccuugucauaaggauccac

SEQ ID NO: 46645 - RNA, 22 nt, Streptococcus pneumoniae TIGR4
aaugcuuauuuaaccucuguaa

SEQ ID NO: 46646 - RNA, 22 nt, Streptococcus pneumoniae TIGR4
aauuacaugauuuuccgcaauu

SEQ ID NO: 46647 - RNA, 22 nt, Streptococcus pneumoniae TIGR4
acaauaacccacaaugaggcug

SEQ ID NO: 46648 - RNA, 22 nt, Streptococcus pneumoniae TIGR4
acagcugguuugaggccuugaa

SEQ ID NO: 46649 - RNA, 22 nt, Streptococcus pneumoniae TIGR4
acaggggcagucuugucuccau

SEQ ID NO: 46650 - RNA, 22 nt, Streptococcus pneumoniae TIGR4
acuaggaagcucguuuaagguu

SEQ ID NO: 46651 - RNA, 22 nt, Streptococcus pneumoniae TIGR4
acuuuugggggcaguucauaag

SEQ ID NO: 46652 - RNA, 19 nt, Streptococcus pneumoniae TIGR4
agagaaaauggguuguuuu

SEQ ID NO: 46653 - RNA, 22 nt, Streptococcus pneumoniae TIGR4
agauuuuguugauaaggauauc

SEQ ID NO: 46654 - RNA, 22 nt, Streptococcus pneumoniae TIGR4
agcuagaacaguaucgagaacu

SEQ ID NO: 46655 - RNA, 22 nt, Streptococcus pneumoniae TIGR4
agcuuucaauucuucguuagug

SEQ ID NO: 46656 - RNA, 22 nt, Streptococcus pneumoniae TIGR4
aggauuuugaauaaucuccuga

SEQ ID NO: 46657 - RNA, 22 nt, Streptococcus pneumoniae TIGR4
agugauuacuuaauagaugcac

SEQ ID NO: 46658 - RNA, 22 nt, Streptococcus pneumoniae TIGR4
auauuauuaaagguggaauuaa

SEQ ID NO: 46659 - RNA, 22 nt, Streptococcus pneumoniae TIGR4
aucuugaauuguaagugauuga

SEQ ID NO: 46660 - RNA, 22 nt, Streptococcus pneumoniae TIGR4
aucuuucaccauaacugcauca

SEQ ID NO: 46661 - RNA, 23 nt, Streptococcus pneumoniae TIGR4
auucauauggaagagaagcuguc

SEQ ID NO: 46662 - RNA, 22 nt, Streptococcus pneumoniae TIGR4
auucguauuggcaagcuugaag

SEQ ID NO: 46663 - RNA, 22 nt, Streptococcus pneumoniae TIGR4
auugaugaggaggagauuugca

SEQ ID NO: 46664 - RNA, 22 nt, Streptococcus pneumoniae TIGR4
cagaaaaacacuucugcucucu

SEQ ID NO: 46665 - RNA, 22 nt, Streptococcus pneumoniae TIGR4
cagaaaaaucaaaguuugauag

SEQ ID NO: 46666 - RNA, 20 nt, Streptococcus pneumoniae TIGR4
cagaagcgaccauggcucac

SEQ ID NO: 46667 - RNA, 22 nt, Streptococcus pneumoniae TIGR4
ccaauuucuuuugacgagacau

SEQ ID NO: 46668 - RNA, 22 nt, Streptococcus pneumoniae TIGR4
cccuacucagcguaagauuucu

SEQ ID NO: 46669 - RNA, 22 nt, Streptococcus pneumoniae TIGR4
ccguuuugcgauuugaggauaa

SEQ ID NO: 46670 - RNA, 22 nt, Streptococcus pneumoniae TIGR4
ccugucuucaaaucagauuucu

SEQ ID NO: 46671 - RNA, 22 nt, Streptococcus pneumoniae TIGR4
cguugaaauuacuugauuguau

SEQ ID NO: 46672 - RNA, 22 nt, Streptococcus pneumoniae TIGR4
cuaucucagcucgaagucguag

SEQ ID NO: 46673 - RNA, 22 nt, Streptococcus pneumoniae TIGR4
cuugccagauaucuuuuugaau

SEQ ID NO: 46674 - RNA, 22 nt, Streptococcus pneumoniae TIGR4
cuuuuuuuccugaauaaugagg

SEQ ID NO: 46675 - RNA, 22 nt, Streptococcus pneumoniae TIGR4
gaaauugauuauaucgacgaga

SEQ ID NO: 46676 - RNA, 20 nt, Streptococcus pneumoniae TIGR4
gaacuauuacguaagcaagg

SEQ ID NO: 46677 - RNA, 22 nt, Streptococcus pneumoniae TIGR4
gaacucuauuuucagacuugag

SEQ ID NO: 46678 - RNA, 22 nt, Streptococcus pneumoniae TIGR4
gagauuuuaggugauaccauug

SEQ ID NO: 46679 - RNA, 22 nt, Streptococcus pneumoniae TIGR4
gaggauggaauuuucaucgugg

SEQ ID NO: 46680 - RNA, 20 nt, Streptococcus pneumoniae TIGR4
gcucaaaacaccguuuugag

SEQ ID NO: 46681 - RNA, 20 nt, Streptococcus pneumoniae TIGR4
gcucaaaacacuguuuugag

SEQ ID NO: 46682 - RNA, 22 nt, Streptococcus pneumoniae TIGR4
gcucaaaacaguguuuugaggu

SEQ ID NO: 46683 - RNA, 20 nt, Streptococcus pneumoniae TIGR4
gcucaaagcacugcuuugag

SEQ ID NO: 46684 - RNA, 22 nt, Streptococcus pneumoniae TIGR4
ggaaaauagauaaucugacuga

SEQ ID NO: 46685 - RNA, 21 nt, Streptococcus pneumoniae TIGR4
ggccaaagauacguguuccgc

SEQ ID NO: 46686 - RNA, 22 nt, Streptococcus pneumoniae TIGR4
ggucggucagaguggauuuuga

SEQ ID NO: 46687 - RNA, 22 nt, Streptococcus pneumoniae TIGR4
guaccuguaucaucaaccaagu

SEQ ID NO: 46688 - RNA, 22 nt, Streptococcus pneumoniae TIGR4
gucauagaagucuuuuuaauua

SEQ ID NO: 46689 - RNA, 22 nt, Streptococcus pneumoniae TIGR4
gucucugcuggagcagauguag

SEQ ID NO: 46690 - RNA, 22 nt, Streptococcus pneumoniae TIGR4
guucuaucuacaaccucaaaac

SEQ ID NO: 46691 - RNA, 22 nt, Streptococcus pneumoniae TIGR4
uaauucauugcaguacagccaa

SEQ ID NO: 46692 - RNA, 22 nt, Streptococcus pneumoniae TIGR4
uagcaucugcuucccuacuugc

SEQ ID NO: 46693 - RNA, 22 nt, Streptococcus pneumoniae TIGR4
uaggucacggauuuccauuuca

SEQ ID NO: 46694 - RNA, 22 nt, Streptococcus pneumoniae TIGR4
uauaaguuuugcuacuguugau

SEQ ID NO: 46695 - RNA, 22 nt, Streptococcus pneumoniae TIGR4
uaucucacugcugacuuacuua

SEQ ID NO: 46696 - RNA, 22 nt, Streptococcus pneumoniae TIGR4
ucagaauugccacuugccuuug

SEQ ID NO: 46697 - RNA, 22 nt, Streptococcus pneumoniae TIGR4
ucagucacauauauaauccaag

SEQ ID NO: 46698 - RNA, 22 nt, Streptococcus pneumoniae TIGR4
uccagcuguuuugaugagcgcu

SEQ ID NO: 46699 - RNA, 17 nt, Streptococcus pneumoniae TIGR4
uccaugcauaagucugg

SEQ ID NO: 46700 - RNA, 22 nt, Streptococcus pneumoniae TIGR4
uccugcaguugcuugcggugca

SEQ ID NO: 46701 - RNA, 22 nt, Streptococcus pneumoniae TIGR4
ucgcucgaaaugaggugcaaaa

SEQ ID NO: 46702 - RNA, 22 nt, Streptococcus pneumoniae TIGR4
ucuuccaguaugacucauguaa

SEQ ID NO: 46703 - RNA, 22 nt, Streptococcus pneumoniae TIGR4
ugauugagugcuuucuugaggc

SEQ ID NO: 46704 - RNA, 22 nt, Streptococcus pneumoniae TIGR4
ugccuuuccaucuugguugaca

SEQ ID NO: 46705 - RNA, 22 nt, Streptococcus pneumoniae TIGR4
ugcucaaaauacguuuguaggu

SEQ ID NO: 46706 - RNA, 22 nt, Streptococcus pneumoniae TIGR4
uggagccuuaacagcuguuuuu

SEQ ID NO: 46707 - RNA, 20 nt, Streptococcus pneumoniae TIGR4
uggagcuuuguaugugugau

SEQ ID NO: 46708 - RNA, 20 nt, Streptococcus pneumoniae TIGR4
uggauugcucucaacugcac

SEQ ID NO: 46709 - RNA, 22 nt, Streptococcus pneumoniae TIGR4
uggcucuauaauauuuguagug

SEQ ID NO: 46710 - RNA, 22 nt, Streptococcus pneumoniae TIGR4
uguuguaggugaaauuguugag

SEQ ID NO: 46711 - RNA, 22 nt, Streptococcus pneumoniae TIGR4
uucauaaagacagguacuauaa

SEQ ID NO: 46712 - RNA, 22 nt, Streptococcus pneumoniae TIGR4
uuccaaguaucaauagagauga

SEQ ID NO: 46713 - RNA, 22 nt, Streptococcus pneumoniae TIGR4
uucuagaaugucuuccaaacga

SEQ ID NO: 46714 - RNA, 22 nt, Streptococcus pneumoniae TIGR4
uucugugauggucuugccaucc

SEQ ID NO: 46715 - RNA, 22 nt, Streptococcus pneumoniae TIGR4
uucuuguuaccgauuuuccagc

SEQ ID NO: 46716 - RNA, 22 nt, Streptococcus pneumoniae TIGR4
uugauuaaaguucaagacaagg

SEQ ID NO: 46717 - RNA, 22 nt, Streptococcus pneumoniae TIGR4
uuuaaaaagaauacuggugucg

SEQ ID NO: 46718 - RNA, 22 nt, Streptococcus pneumoniae TIGR4
uuuaaaaagccuauuguaucaa

SEQ ID NO: 46719 - RNA, 22 nt, Streptococcus pneumoniae TIGR4
uuuauugaguauaagaggucuu

SEQ ID NO: 46720 - RNA, 22 nt, Streptococcus pneumoniae TIGR4
uuucuauucguccuuuguaucu

SEQ ID NO: 46721 - RNA, 22 nt, Streptococcus pneumoniae TIGR4
uuuucuuaccaucuugguaggc

SEQ ID NO: 46722 - RNA, 22 nt, Streptococcus pneumoniae TIGR4
uuuuuucuaggagugaaguaug

SEQ ID NO: 46723 - RNA, 22 nt, Streptococcus pneumoniae TIGR4
aaaaaaacuccguagucucuag

SEQ ID NO: 46724 - RNA, 20 nt, Streptococcus pneumoniae TIGR4
aaauugacuccuuuaucaau

SEQ ID NO: 46725 - RNA, 22 nt, Streptococcus pneumoniae TIGR4
aacauucuuacaaucucucaaa

SEQ ID NO: 46726 - RNA, 22 nt, Streptococcus pneumoniae TIGR4
aacuagaaaagguuuuccuuau

SEQ ID NO: 46727 - RNA, 22 nt, Streptococcus pneumoniae TIGR4
aagauuuuucaauacaggucuu

SEQ ID NO: 46728 - RNA, 22 nt, Streptococcus pneumoniae TIGR4
aagcguccgaauccgaaagaga

SEQ ID NO: 46729 - RNA, 20 nt, Streptococcus pneumoniae TIGR4
aaggaaggucaucucaauca

SEQ ID NO: 46730 - RNA, 22 nt, Streptococcus pneumoniae TIGR4
accccccaccuuucuuaggauc

SEQ ID NO: 46731 - RNA, 22 nt, Streptococcus pneumoniae TIGR4
acuucuguuuggucucagcauc

SEQ ID NO: 46732 - RNA, 20 nt, Streptococcus pneumoniae TIGR4
acuuuuggggugcaguucau

SEQ ID NO: 46733 - RNA, 22 nt, Streptococcus pneumoniae TIGR4
agcaucuuuauuggaagaagcu

SEQ ID NO: 46734 - RNA, 22 nt, Streptococcus pneumoniae TIGR4
agccguccauugaaaucauuga

SEQ ID NO: 46735 - RNA, 22 nt, Streptococcus pneumoniae TIGR4
agcuuuagcccguuauagugaa

SEQ ID NO: 46736 - RNA, 22 nt, Streptococcus pneumoniae TIGR4
agggcagcuucaccugucaaaa

SEQ ID NO: 46737 - RNA, 22 nt, Streptococcus pneumoniae TIGR4
aggucacuugauagcuauauuu

SEQ ID NO: 46738 - RNA, 22 nt, Streptococcus pneumoniae TIGR4
agguugguccaacgauuuucau

SEQ ID NO: 46739 - RNA, 22 nt, Streptococcus pneumoniae TIGR4
aucuuucaccaugacugcauca

SEQ ID NO: 46740 - RNA, 22 nt, Streptococcus pneumoniae TIGR4
augcuucuagcguugagaaaau

SEQ ID NO: 46741 - RNA, 22 nt, Streptococcus pneumoniae TIGR4
auucccuugggcaaaggcuucu

SEQ ID NO: 46742 - RNA, 22 nt, Streptococcus pneumoniae TIGR4
auuugcuuuuuuaucugacaga

SEQ ID NO: 46743 - RNA, 22 nt, Streptococcus pneumoniae TIGR4
auuuuuaagaagauguuauaag

SEQ ID NO: 46744 - RNA, 22 nt, Streptococcus pneumoniae TIGR4
caacgagcgaaugaauaucgca

SEQ ID NO: 46745 - RNA, 20 nt, Streptococcus pneumoniae TIGR4
caugcggaaauuauggcuau

SEQ ID NO: 46746 - RNA, 22 nt, Streptococcus pneumoniae TIGR4
cauuauaggucauaugggacuu

SEQ ID NO: 46747 - RNA, 22 nt, Streptococcus pneumoniae TIGR4
cauuuuacuugaaagugauuug

SEQ ID NO: 46748 - RNA, 22 nt, Streptococcus pneumoniae TIGR4
ccacacuugcuucagcuggagc

SEQ ID NO: 46749 - RNA, 22 nt, Streptococcus pneumoniae TIGR4
cuagccuuugagggggaugcgg

SEQ ID NO: 46750 - RNA, 22 nt, Streptococcus pneumoniae TIGR4
cuuauagauauuauggagccua

SEQ ID NO: 46751 - RNA, 22 nt, Streptococcus pneumoniae TIGR4
cuuccuucuuuuucagcaacca

SEQ ID NO: 46752 - RNA, 22 nt, Streptococcus pneumoniae TIGR4
gauaaaaucaucuggucuucag

SEQ ID NO: 46753 - RNA, 22 nt, Streptococcus pneumoniae TIGR4
gcauugaugaugugaccaaccu

SEQ ID NO: 46754 - RNA, 22 nt, Streptococcus pneumoniae TIGR4
gcguuauuaucgguacuccuga

SEQ ID NO: 46755 - RNA, 22 nt, Streptococcus pneumoniae TIGR4
gcucaaaacacuguuuugaggu

SEQ ID NO: 46756 - RNA, 20 nt, Streptococcus pneumoniae TIGR4
gcugcauccuguggagaacc

SEQ ID NO: 46757 - RNA, 21 nt, Streptococcus pneumoniae TIGR4
ggcugcuuugacacggcauuu

SEQ ID NO: 46758 - RNA, 23 nt, Streptococcus pneumoniae TIGR4
gggagcgcacuucgucauacuca

SEQ ID NO: 46759 - RNA, 22 nt, Streptococcus pneumoniae TIGR4
gggcaggcuuuggaggagcugu

SEQ ID NO: 46760 - RNA, 22 nt, Streptococcus pneumoniae TIGR4
ggguagcuauacaggcuugcga

SEQ ID NO: 46761 - RNA, 22 nt, Streptococcus pneumoniae TIGR4
gugauuuucucaaagcugaugc

SEQ ID NO: 46762 - RNA, 22 nt, Streptococcus pneumoniae TIGR4
guucuaucugcaaccucaaaac

SEQ ID NO: 46763 - RNA, 22 nt, Streptococcus pneumoniae TIGR4
guugagauucagguauuuucua

SEQ ID NO: 46764 - RNA, 22 nt, Streptococcus pneumoniae TIGR4
uaagacuuguaagaucuauuuu

SEQ ID NO: 46765 - RNA, 22 nt, Streptococcus pneumoniae TIGR4
uacaaaagcgcauaguaucaag

SEQ ID NO: 46766 - RNA, 22 nt, Streptococcus pneumoniae TIGR4
uaggaugguaauuugucauagg

SEQ ID NO: 46767 - RNA, 22 nt, Streptococcus pneumoniae TIGR4
uauagaaaaacgcauaguauca

SEQ ID NO: 46768 - RNA, 22 nt, Streptococcus pneumoniae TIGR4
uauuuuccaaaugagcaaauug

SEQ ID NO: 46769 - RNA, 22 nt, Streptococcus pneumoniae TIGR4
ucauauaaucguaccaauccau

SEQ ID NO: 46770 - RNA, 22 nt, Streptococcus pneumoniae TIGR4
ucauugaggacaaucugaagca

SEQ ID NO: 46771 - RNA, 22 nt, Streptococcus pneumoniae TIGR4
ucccuaucauucugcccaacag

SEQ ID NO: 46772 - RNA, 22 nt, Streptococcus pneumoniae TIGR4
ucucaguuuacccucuuugcgg

SEQ ID NO: 46773 - RNA, 22 nt, Streptococcus pneumoniae TIGR4
ucuuguggcuucaguaggaaug

SEQ ID NO: 46774 - RNA, 22 nt, Streptococcus pneumoniae TIGR4
ucuuuuucagacugucuuuaaa

SEQ ID NO: 46775 - RNA, 22 nt, Streptococcus pneumoniae TIGR4
ugacaccauagauuggugguug

SEQ ID NO: 46776 - RNA, 22 nt, Streptococcus pneumoniae TIGR4
ugauguuggaaauguuguucuu

SEQ ID NO: 46777 - RNA, 22 nt, Streptococcus pneumoniae TIGR4
uggaagaagcagauguuaucgu

SEQ ID NO: 46778 - RNA, 22 nt, Streptococcus pneumoniae TIGR4
uguggcgacaaacugaugcgaa

SEQ ID NO: 46779 - RNA, 22 nt, Streptococcus pneumoniae TIGR4
ugugggauuauuucauugauua

SEQ ID NO: 46780 - RNA, 22 nt, Streptococcus pneumoniae TIGR4
uuccauaagauacuuucuaaug

SEQ ID NO: 46781 - RNA, 22 nt, Streptococcus pneumoniae TIGR4
uucgucaggcaauucaauauca

SEQ ID NO: 46782 - RNA, 22 nt, Streptococcus pneumoniae TIGR4
uugagcuuuuugaagcaagcua

SEQ ID NO: 46783 - RNA, 22 nt, Streptococcus pneumoniae TIGR4
uugagguuguagauagaacuga

SEQ ID NO: 46784 - RNA, 22 nt, Streptococcus pneumoniae TIGR4
uugcagaaaagcaugauguuuu

SEQ ID NO: 46785 - RNA, 22 nt, Streptococcus pneumoniae TIGR4
uuguuauugaugcggcaauuau

SEQ ID NO: 46786 - RNA, 22 nt, Streptococcus pneumoniae TIGR4
uuucacuagugcuccauggacc

SEQ ID NO: 46787 - RNA, 22 nt, Streptococcus pyogenes M1 GAS
aaaagaaauaggauguaaguga

SEQ ID NO: 46788 - RNA, 22 nt, Streptococcus pyogenes M1 GAS
aaaagucucgccuugauuuguu

SEQ ID NO: 46789 - RNA, 22 nt, Streptococcus pyogenes M1 GAS
aaaauaucgcagaaguccuuga

SEQ ID NO: 46790 - RNA, 22 nt, Streptococcus pyogenes M1 GAS
aaaaugguccagcagauuuggu

SEQ ID NO: 46791 - RNA, 22 nt, Streptococcus pyogenes M1 GAS
aaagcaaaaaagcaucuggaua

SEQ ID NO: 46792 - RNA, 22 nt, Streptococcus pyogenes M1 GAS
aaagcucuguaagggaacaucu

SEQ ID NO: 46793 - RNA, 21 nt, Streptococcus pyogenes M1 GAS
aaaggcaauauucauguuuga

SEQ ID NO: 46794 - RNA, 19 nt, Streptococcus pyogenes M1 GAS
aaaucaaggcgagacuuuu

SEQ ID NO: 46795 - RNA, 22 nt, Streptococcus pyogenes M1 GAS
aaauuaauggaagaaauucgca

SEQ ID NO: 46796 - RNA, 22 nt, Streptococcus pyogenes M1 GAS
aacaaaagacaguauuuuagug

SEQ ID NO: 46797 - RNA, 22 nt, Streptococcus pyogenes M1 GAS
aaccuugcuacuggcacucuuu

SEQ ID NO: 46798 - RNA, 22 nt, Streptococcus pyogenes M1 GAS
aacugcaguaagucuugguggc

SEQ ID NO: 46799 - RNA, 22 nt, Streptococcus pyogenes M1 GAS
aagaauguauccgauauacuua

SEQ ID NO: 46800 - RNA, 22 nt, Streptococcus pyogenes M1 GAS
aagauguaccaauugauaugaa

SEQ ID NO: 46801 - RNA, 22 nt, Streptococcus pyogenes M1 GAS
aagcaucaauugaacaccuuug

SEQ ID NO: 46802 - RNA, 22 nt, Streptococcus pyogenes M1 GAS
aagcucuucuuuugucaugcag

SEQ ID NO: 46803 - RNA, 22 nt, Streptococcus pyogenes M1 GAS
aaggaacucgaucagcgcaaua

SEQ ID NO: 46804 - RNA, 22 nt, Streptococcus pyogenes M1 GAS
aagggauacaacgcuauugugg

SEQ ID NO: 46805 - RNA, 22 nt, Streptococcus pyogenes M1 GAS
aaucaucguuucaaacccagac

SEQ ID NO: 46806 - RNA, 22 nt, Streptococcus pyogenes M1 GAS
aaugauauggucaaaauggcua

SEQ ID NO: 46807 - RNA, 22 nt, Streptococcus pyogenes M1 GAS
aaugauguuuaaaaauuugcca

SEQ ID NO: 46808 - RNA, 22 nt, Streptococcus pyogenes M1 GAS
aauuuuacgguacggaguuuaa

SEQ ID NO: 46809 - RNA, 22 nt, Streptococcus pyogenes M1 GAS
accaagaaaaauacaguagccg

SEQ ID NO: 46810 - RNA, 22 nt, Streptococcus pyogenes M1 GAS
accagcuugggacguuugaggu

SEQ ID NO: 46811 - RNA, 22 nt, Streptococcus pyogenes M1 GAS
accuaucacgccaguaaaguca

SEQ ID NO: 46812 - RNA, 22 nt, Streptococcus pyogenes M1 GAS
acuauuuaauaaguuuucuagu

SEQ ID NO: 46813 - RNA, 22 nt, Streptococcus pyogenes M1 GAS
acugcagaaauaggcacuucug

SEQ ID NO: 46814 - RNA, 16 nt, Streptococcus pyogenes M1 GAS
agaaaaagauaacagc

SEQ ID NO: 46815 - RNA, 22 nt, Streptococcus pyogenes M1 GAS
agagaagcuguucucuuuggag

SEQ ID NO: 46816 - RNA, 18 nt, Streptococcus pyogenes M1 GAS
agagauuauagagcuuuu

SEQ ID NO: 46817 - RNA, 22 nt, Streptococcus pyogenes M1 GAS
agcaaaaagacaaauuucugaa

SEQ ID NO: 46818 - RNA, 22 nt, Streptococcus pyogenes M1 GAS
agcugaaauagcagugcaaaac

SEQ ID NO: 46819 - RNA, 22 nt, Streptococcus pyogenes M1 GAS
agcuggguaggcuggcgucaga

SEQ ID NO: 46820 - RNA, 20 nt, Streptococcus pyogenes M1 GAS
aggauaaagcucccaaaauc

SEQ ID NO: 46821 - RNA, 20 nt, Streptococcus pyogenes M1 GAS
aggcauuuuuaggagaaggc

SEQ ID NO: 46822 - RNA, 22 nt, Streptococcus pyogenes M1 GAS
aguauggaaagcagaugaacau

SEQ ID NO: 46823 - RNA, 22 nt, Streptococcus pyogenes M1 GAS
agucuuuuuuaucguuaucuga

SEQ ID NO: 46824 - RNA, 17 nt, Streptococcus pyogenes M1 GAS
auagucaacuccgcaca

SEQ ID NO: 46825 - RNA, 22 nt, Streptococcus pyogenes M1 GAS
auaugggauuuggagugggugc

SEQ ID NO: 46826 - RNA, 22 nt, Streptococcus pyogenes M1 GAS
auauuagcaauaccuuacgucu

SEQ ID NO: 46827 - RNA, 22 nt, Streptococcus pyogenes M1 GAS
aucaaaaagugaggcgacccuu

SEQ ID NO: 46828 - RNA, 22 nt, Streptococcus pyogenes M1 GAS
aucagcuuuuaaaauaucuuga

SEQ ID NO: 46829 - RNA, 19 nt, Streptococcus pyogenes M1 GAS
auccugauagugcuuuuaa

SEQ ID NO: 46830 - RNA, 22 nt, Streptococcus pyogenes M1 GAS
auccuuaaagguuggugaucgu

SEQ ID NO: 46831 - RNA, 22 nt, Streptococcus pyogenes M1 GAS
augaauuuacaauugaucagaa

SEQ ID NO: 46832 - RNA, 22 nt, Streptococcus pyogenes M1 GAS
augauuuguucuucguuuaagg

SEQ ID NO: 46833 - RNA, 19 nt, Streptococcus pyogenes M1 GAS
auguuuuuuguguaucuau

SEQ ID NO: 46834 - RNA, 22 nt, Streptococcus pyogenes M1 GAS
auuaacaauauaguacauagga

SEQ ID NO: 46835 - RNA, 18 nt, Streptococcus pyogenes M1 GAS
caacaguuguuucgucag

SEQ ID NO: 46836 - RNA, 22 nt, Streptococcus pyogenes M1 GAS
caauuacaccucuaucuauccu

SEQ ID NO: 46837 - RNA, 22 nt, Streptococcus pyogenes M1 GAS
cagcuugggacguuugagguag

SEQ ID NO: 46838 - RNA, 22 nt, Streptococcus pyogenes M1 GAS
cagcuuuugcaaccaagcgggc

SEQ ID NO: 46839 - RNA, 22 nt, Streptococcus pyogenes M1 GAS
caggacuaaauccuuuuaguuu

SEQ ID NO: 46840 - RNA, 22 nt, Streptococcus pyogenes M1 GAS
cauuaucaaagauaagcgauuu

SEQ ID NO: 46841 - RNA, 22 nt, Streptococcus pyogenes M1 GAS
cauuaucaugaauugacagacu

SEQ ID NO: 46842 - RNA, 22 nt, Streptococcus pyogenes M1 GAS
ccaauauauuuuagagccgguu

SEQ ID NO: 46843 - RNA, 22 nt, Streptococcus pyogenes M1 GAS
ccaauuaacaaaaaagugcuua

SEQ ID NO: 46844 - RNA, 22 nt, Streptococcus pyogenes M1 GAS
ccuagucugucauuauggguuu

SEQ ID NO: 46845 - RNA, 22 nt, Streptococcus pyogenes M1 GAS
ccuuuuuugauauuauguggcg

SEQ ID NO: 46846 - RNA, 22 nt, Streptococcus pyogenes M1 GAS
cguaaaaaugcauuugacaguc

SEQ ID NO: 46847 - RNA, 22 nt, Streptococcus pyogenes M1 GAS
cguugaagcuaauggauugggc

SEQ ID NO: 46848 - RNA, 22 nt, Streptococcus pyogenes M1 GAS
cuaucgucaaaccguugcaacc

SEQ ID NO: 46849 - RNA, 22 nt, Streptococcus pyogenes M1 GAS
cucaaaaaaagaggccacacuc

SEQ ID NO: 46850 - RNA, 22 nt, Streptococcus pyogenes M1 GAS
cuccgcaaguuuguaccuuuga

SEQ ID NO: 46851 - RNA, 22 nt, Streptococcus pyogenes M1 GAS
cugaugucauguguaauaagga

SEQ ID NO: 46852 - RNA, 22 nt, Streptococcus pyogenes M1 GAS
cugcuuuuauuauucacuacua

SEQ ID NO: 46853 - RNA, 22 nt, Streptococcus pyogenes M1 GAS
cuuaucugcuuugaaauuaggg

SEQ ID NO: 46854 - RNA, 22 nt, Streptococcus pyogenes M1 GAS
cuuauuauugcuauaaauugau

SEQ ID NO: 46855 - RNA, 22 nt, Streptococcus pyogenes M1 GAS
cuuauugucgugugaaacaacu

SEQ ID NO: 46856 - RNA, 22 nt, Streptococcus pyogenes M1 GAS
gaaaaacacaccuaucuugcga

SEQ ID NO: 46857 - RNA, 22 nt, Streptococcus pyogenes M1 GAS
uuucauuuauccaaccauggga

SEQ ID NO: 46858 - RNA, 22 nt, Streptococcus pyogenes M1 GAS
uuucuaauuugggugcuugaag

SEQ ID NO: 46859 - RNA, 22 nt, Streptococcus pyogenes M1 GAS
uuugaagaaacugauaaauuga

SEQ ID NO: 46860 - RNA, 22 nt, Streptococcus pyogenes M1 GAS
uuugaaggaguuugcuuaacua

SEQ ID NO: 46861 - RNA, 22 nt, Streptococcus pyogenes M1 GAS
uuugaauagcauguaaaaagua

SEQ ID NO: 46862 - RNA, 22 nt, Streptococcus pyogenes M1 GAS
uuugauugguaugaucuagcau

SEQ ID NO: 46863 - RNA, 22 nt, Streptococcus pyogenes M1 GAS
uuugcaagcaagguuaucugau

SEQ ID NO: 46864 - RNA, 22 nt, Streptococcus pyogenes M1 GAS
uuuggucaguugguagugguaa

SEQ ID NO: 46865 - RNA, 22 nt, Streptococcus pyogenes M1 GAS
gacuucuauauugauauuauga

SEQ ID NO: 46866 - RNA, 22 nt, Streptococcus pyogenes M1 GAS
gacuuuauggauguugauguua

SEQ ID NO: 46867 - RNA, 22 nt, Streptococcus pyogenes M1 GAS
gaugauuuugagauaauugugu

SEQ ID NO: 46868 - RNA, 22 nt, Streptococcus pyogenes M1 GAS
gauuaugaggauuugccugaaa

SEQ ID NO: 46869 - RNA, 22 nt, Streptococcus pyogenes M1 GAS
gauugcuuguuuuugagcacga

SEQ ID NO: 46870 - RNA, 22 nt, Streptococcus pyogenes M1 GAS
gauuguacggacuauaucaguu

SEQ ID NO: 46871 - RNA, 22 nt, Streptococcus pyogenes M1 GAS
gccugugugauuuugcaagcua

SEQ ID NO: 46872 - RNA, 22 nt, Streptococcus pyogenes M1 GAS
gcguuuuucaggggaauuguuc

SEQ ID NO: 46873 - RNA, 22 nt, Streptococcus pyogenes M1 GAS
gcuaaugcuuaaucacuuuuuu

SEQ ID NO: 46874 - RNA, 22 nt, Streptococcus pyogenes M1 GAS
gcuaucuuuuggaaagccugcc

SEQ ID NO: 46875 - RNA, 22 nt, Streptococcus pyogenes M1 GAS
gcuuuuugaucaucaauccuua

SEQ ID NO: 46876 - RNA, 22 nt, Streptococcus pyogenes M1 GAS
guaccguuccuccuaauccuau

SEQ ID NO: 46877 - RNA, 22 nt, Streptococcus pyogenes M1 GAS
guauucaaagcagucuaauuga

SEQ ID NO: 46878 - RNA, 22 nt, Streptococcus pyogenes M1 GAS
guguuagucccucauccauucu

SEQ ID NO: 46879 - RNA, 22 nt, Streptococcus pyogenes M1 GAS
guucuauuauuaguggccugug

SEQ ID NO: 46880 - RNA, 22 nt, Streptococcus pyogenes M1 GAS
guugaagauaucaagguuuuuu

SEQ ID NO: 46881 - RNA, 22 nt, Streptococcus pyogenes M1 GAS
guugguuugguaguaugcaaaa

SEQ ID NO: 46882 - RNA, 22 nt, Streptococcus pyogenes M1 GAS
guuuacuuaauugggcuguuga

SEQ ID NO: 46883 - RNA, 22 nt, Streptococcus pyogenes M1 GAS
guuugguaauccagcauuccuu

SEQ ID NO: 46884 - RNA, 22 nt, Streptococcus pyogenes M1 GAS
uaaaaaacgguugaaccagaua

SEQ ID NO: 46885 - RNA, 22 nt, Streptococcus pyogenes M1 GAS
uaaaagacaaacaagcuuacuc

SEQ ID NO: 46886 - RNA, 22 nt, Streptococcus pyogenes M1 GAS
uaaauuuaucugacuuaaaaca

SEQ ID NO: 46887 - RNA, 22 nt, Streptococcus pyogenes M1 GAS
uaagauuacugguuaacaagag

SEQ ID NO: 46888 - RNA, 22 nt, Streptococcus pyogenes M1 GAS
uaagucaaaguuagacaaagca

SEQ ID NO: 46889 - RNA, 22 nt, Streptococcus pyogenes M1 GAS
uagugauaugacgaggaccauu

SEQ ID NO: 46890 - RNA, 22 nt, Streptococcus pyogenes M1 GAS
uaucaagguaauacuuuuucug

SEQ ID NO: 46891 - RNA, 19 nt, Streptococcus pyogenes M1 GAS
uaucauccuuuaaaacuuu

SEQ ID NO: 46892 - RNA, 22 nt, Streptococcus pyogenes M1 GAS
uauuuugcucaaggagcuauug

SEQ ID NO: 46893 - RNA, 22 nt, Streptococcus pyogenes M1 GAS
ucaaaggaaugcuccccuccgc

SEQ ID NO: 46894 - RNA, 22 nt, Streptococcus pyogenes M1 GAS
ucaagacagaaacaauagcauu

SEQ ID NO: 46895 - RNA, 22 nt, Streptococcus pyogenes M1 GAS
ucagauggacuuaacaccaaag

SEQ ID NO: 46896 - RNA, 22 nt, Streptococcus pyogenes M1 GAS
ucaucaaaggagcucccugaua

SEQ ID NO: 46897 - RNA, 22 nt, Streptococcus pyogenes M1 GAS
ucaucauuauuagucaugaguu

SEQ ID NO: 46898 - RNA, 21 nt, Streptococcus pyogenes M1 GAS
ucguaaucgcuguuacaauga

SEQ ID NO: 46899 - RNA, 22 nt, Streptococcus pyogenes M1 GAS
ucucgcuuugcucugcuauuug

SEQ ID NO: 46900 - RNA, 22 nt, Streptococcus pyogenes M1 GAS
ucugggaaagguuuucagggcu

SEQ ID NO: 46901 - RNA, 22 nt, Streptococcus pyogenes M1 GAS
ucuugcaacgaaaugugauuua

SEQ ID NO: 46902 - RNA, 22 nt, Streptococcus pyogenes M1 GAS
ucuuuaaauacggagaaaaguu

SEQ ID NO: 46903 - RNA, 23 nt, Streptococcus pyogenes M1 GAS
ucuuuuucaggaggagcuaauag

SEQ ID NO: 46904 - RNA, 22 nt, Streptococcus pyogenes M1 GAS
ugacaaaagaagagcuuaugga

SEQ ID NO: 46905 - RNA, 22 nt, Streptococcus pyogenes M1 GAS
ugacaaguuccuuuugagauau

SEQ ID NO: 46906 - RNA, 22 nt, Streptococcus pyogenes M1 GAS
ugagaaaaaauuggcuuauuua

SEQ ID NO: 46907 - RNA, 21 nt, Streptococcus pyogenes M1 GAS
ugagacagaucuggcuugacu

SEQ ID NO: 46908 - RNA, 22 nt, Streptococcus pyogenes M1 GAS
ugauguuuuagaugacaaaaag

SEQ ID NO: 46909 - RNA, 22 nt, Streptococcus pyogenes M1 GAS
ugccaaaagacuuugcgacuua

SEQ ID NO: 46910 - RNA, 19 nt, Streptococcus pyogenes M1 GAS
ugccuuugaaaagaugauu

SEQ ID NO: 46911 - RNA, 22 nt, Streptococcus pyogenes M1 GAS
ugcuaugguaugguggcgguuc

SEQ ID NO: 46912 - RNA, 22 nt, Streptococcus pyogenes M1 GAS
ugcugauaguacauugucaaua

SEQ ID NO: 46913 - RNA, 22 nt, Streptococcus pyogenes M1 GAS
ugcuugcuaacuccugauuuuu

SEQ ID NO: 46914 - RNA, 22 nt, Streptococcus pyogenes M1 GAS
ugcuuguugauaagcugauaca

SEQ ID NO: 46915 - RNA, 19 nt, Streptococcus pyogenes M1 GAS
ugcuuuuuuuaagaguauu

SEQ ID NO: 46916 - RNA, 21 nt, Streptococcus pyogenes M1 GAS
uggcagaaaccuucucggcuc

SEQ ID NO: 46917 - RNA, 22 nt, Streptococcus pyogenes M1 GAS
uggugcaguguuguagcgagau

SEQ ID NO: 46918 - RNA, 22 nt, Streptococcus pyogenes M1 GAS
ugguuugucaucaucuaaaaua

SEQ ID NO: 46919 - RNA, 21 nt, Streptococcus pyogenes M1 GAS
ugucaaaguucugaaaucuaa

SEQ ID NO: 46920 - RNA, 22 nt, Streptococcus pyogenes M1 GAS
ugucuauagaucuuccaacucg

SEQ ID NO: 46921 - RNA, 23 nt, Streptococcus pyogenes M1 GAS
ugugauaauggcuuuagcauuug

SEQ ID NO: 46922 - RNA, 22 nt, Streptococcus pyogenes M1 GAS
uguuaccaaguugucaacuugu

SEQ ID NO: 46923 - RNA, 22 nt, Streptococcus pyogenes M1 GAS
uguuagaauuccguagcuuacu

SEQ ID NO: 46924 - RNA, 22 nt, Streptococcus pyogenes M1 GAS
uguugucuguuccuugguuuaa

SEQ ID NO: 46925 - RNA, 22 nt, Streptococcus pyogenes M1 GAS
uguuuugacacuugguaaaaug

SEQ ID NO: 46926 - RNA, 19 nt, Streptococcus pyogenes M1 GAS
uuaauccugcuuacucuuc

SEQ ID NO: 46927 - RNA, 22 nt, Streptococcus pyogenes M1 GAS
uuauugcugagaauaucaaaag

SEQ ID NO: 46928 - RNA, 22 nt, Streptococcus pyogenes M1 GAS
uucaaaaacaagacgugacuau

SEQ ID NO: 46929 - RNA, 22 nt, Streptococcus pyogenes M1 GAS
uucuagacaacuuaucuuuuug

SEQ ID NO: 46930 - RNA, 22 nt, Streptococcus pyogenes M1 GAS
uucuagaugauagaugguuggu

SEQ ID NO: 46931 - RNA, 22 nt, Streptococcus pyogenes M1 GAS
uucucaucugcuuuauggccgu

SEQ ID NO: 46932 - RNA, 22 nt, Streptococcus pyogenes M1 GAS
uucuuguaccagauaaucuuga

SEQ ID NO: 46933 - RNA, 22 nt, Streptococcus pyogenes M1 GAS
uucuuuuguuuaaaaugguagu

SEQ ID NO: 46934 - RNA, 22 nt, Streptococcus pyogenes M1 GAS
uugauagccaguauuauuuggg

SEQ ID NO: 46935 - RNA, 22 nt, Streptococcus pyogenes M1 GAS
uugauggcaggcaguuagcaga

SEQ ID NO: 46936 - RNA, 21 nt, Streptococcus pyogenes M1 GAS
uugauugaugaugcaaguaca

SEQ ID NO: 46937 - RNA, 22 nt, Streptococcus pyogenes M1 GAS
uugccguuauggauuggcuuau

SEQ ID NO: 46938 - RNA, 22 nt, Streptococcus pyogenes M1 GAS
uugcucaaguugacgagcaaug

SEQ ID NO: 46939 - RNA, 22 nt, Streptococcus pyogenes M1 GAS
uugcugacaggagcugauauua

SEQ ID NO: 46940 - RNA, 22 nt, Streptococcus pyogenes M1 GAS
uugcuggcagacugauaguucu

SEQ ID NO: 46941 - RNA, 22 nt, Streptococcus pyogenes M1 GAS
uugcuucaucaucaaucggacu

SEQ ID NO: 46942 - RNA, 22 nt, Streptococcus pyogenes M1 GAS
uugcuuuugauauucucagcaa

SEQ ID NO: 46943 - RNA, 22 nt, Streptococcus pyogenes M1 GAS
uuggagugauugcacugcuguu

SEQ ID NO: 46944 - RNA, 22 nt, Streptococcus pyogenes M1 GAS
uuggauuucugauucuguaaag

SEQ ID NO: 46945 - RNA, 22 nt, Streptococcus pyogenes M1 GAS
uugguaauuuaauaguugcagg

SEQ ID NO: 46946 - RNA, 22 nt, Streptococcus pyogenes M1 GAS
uuuagcuugcccuuagaaacuu

SEQ ID NO: 46947 - RNA, 22 nt, Streptococcus pyogenes M1 GAS
aaaacaguuguuuggaaugguc

SEQ ID NO: 46948 - RNA, 23 nt, Streptococcus pyogenes M1 GAS
aaaaccugcuguauaagcugcau

SEQ ID NO: 46949 - RNA, 22 nt, Streptococcus pyogenes M1 GAS
aaaagcaacgugccauuaagag

SEQ ID NO: 46950 - RNA, 22 nt, Streptococcus pyogenes M1 GAS
aaaagcagccacuucaucaauc

SEQ ID NO: 46951 - RNA, 22 nt, Streptococcus pyogenes M1 GAS
aaacaauugcaagaguuaaugu

SEQ ID NO: 46952 - RNA, 22 nt, Streptococcus pyogenes M1 GAS
aaacugcuagcaucguuuuuug

SEQ ID NO: 46953 - RNA, 22 nt, Streptococcus pyogenes M1 GAS
aaagagaaauaccuccuagaua

SEQ ID NO: 46954 - RNA, 22 nt, Streptococcus pyogenes M1 GAS
aaaucauuucacaauccguuga

SEQ ID NO: 46955 - RNA, 22 nt, Streptococcus pyogenes M1 GAS
aaauggccaugauuaugcuggu

SEQ ID NO: 46956 - RNA, 22 nt, Streptococcus pyogenes M1 GAS
aaauugucuuaccauuagcugu

SEQ ID NO: 46957 - RNA, 22 nt, Streptococcus pyogenes M1 GAS
aacaucguaacgauugccuuua

SEQ ID NO: 46958 - RNA, 22 nt, Streptococcus pyogenes M1 GAS
aacaugaagcugcuagcguuac

SEQ ID NO: 46959 - RNA, 22 nt, Streptococcus pyogenes M1 GAS
aacuugcuuuuugauauuggua

SEQ ID NO: 46960 - RNA, 22 nt, Streptococcus pyogenes M1 GAS
aaggaguuuucucacuugauga

SEQ ID NO: 46961 - RNA, 22 nt, Streptococcus pyogenes M1 GAS
aauaaaccgaggugggacuuuc

SEQ ID NO: 46962 - RNA, 22 nt, Streptococcus pyogenes M1 GAS
aauauuuucagaaaaagcagca

SEQ ID NO: 46963 - RNA, 22 nt, Streptococcus pyogenes M1 GAS
aaucaaaggcaggauaugaugc

SEQ ID NO: 46964 - RNA, 22 nt, Streptococcus pyogenes M1 GAS
aaucaagguuuggcucuugccu

SEQ ID NO: 46965 - RNA, 22 nt, Streptococcus pyogenes M1 GAS
aaugauuauuuuuccuguaacg

SEQ ID NO: 46966 - RNA, 22 nt, Streptococcus pyogenes M1 GAS
aauggaaauggguguuucugua

SEQ ID NO: 46967 - RNA, 22 nt, Streptococcus pyogenes M1 GAS
aauucucuugagguguuagcag

SEQ ID NO: 46968 - RNA, 22 nt, Streptococcus pyogenes M1 GAS
acaaguaccaauuaucuccaga

SEQ ID NO: 46969 - RNA, 22 nt, Streptococcus pyogenes M1 GAS
acauaccucuuaaguagauuuu

SEQ ID NO: 46970 - RNA, 22 nt, Streptococcus pyogenes M1 GAS
accaaaaucuacuuaagaggua

SEQ ID NO: 46971 - RNA, 22 nt, Streptococcus pyogenes M1 GAS
accuucuuuguugacaagguua

SEQ ID NO: 46972 - RNA, 22 nt, Streptococcus pyogenes M1 GAS
acuuuuuauaagcaggcguuuu

SEQ ID NO: 46973 - RNA, 22 nt, Streptococcus pyogenes M1 GAS
agauagucgugaggauauauuu

SEQ ID NO: 46974 - RNA, 22 nt, Streptococcus pyogenes M1 GAS
agaugacaaaccuuaauccacu

SEQ ID NO: 46975 - RNA, 22 nt, Streptococcus pyogenes M1 GAS
agauguaucuuacgacugguuu

SEQ ID NO: 46976 - RNA, 22 nt, Streptococcus pyogenes M1 GAS
agauuuuuuaucgaauauagaa

SEQ ID NO: 46977 - RNA, 22 nt, Streptococcus pyogenes M1 GAS
agcuuuuuaccaacuuaaucca

SEQ ID NO: 46978 - RNA, 22 nt, Streptococcus pyogenes M1 GAS
aguuuagcuaguuuuucucaau

SEQ ID NO: 46979 - RNA, 22 nt, Streptococcus pyogenes M1 GAS
auaaaauagauucgaacacauu

SEQ ID NO: 46980 - RNA, 22 nt, Streptococcus pyogenes M1 GAS
auaagaagugauugagauuagu

SEQ ID NO: 46981 - RNA, 22 nt, Streptococcus pyogenes M1 GAS
auaagggagaugcuguccagac

SEQ ID NO: 46982 - RNA, 22 nt, Streptococcus pyogenes M1 GAS
auaaugaaauuguccaagcuuu

SEQ ID NO: 46983 - RNA, 22 nt, Streptococcus pyogenes M1 GAS
auagaacauuuuuaucguauga

SEQ ID NO: 46984 - RNA, 22 nt, Streptococcus pyogenes M1 GAS
auagucagaauuuugauuuuga

SEQ ID NO: 46985 - RNA, 22 nt, Streptococcus pyogenes M1 GAS
auagucugaggagaugauaagc

SEQ ID NO: 46986 - RNA, 22 nt, Streptococcus pyogenes M1 GAS
auaguugauauuggggauaaga

SEQ ID NO: 46987 - RNA, 22 nt, Streptococcus pyogenes M1 GAS
auaucaaucuuagucaagauaa

SEQ ID NO: 46988 - RNA, 22 nt, Streptococcus pyogenes M1 GAS
aucaaggaggccuuucauuaug

SEQ ID NO: 46989 - RNA, 23 nt, Streptococcus pyogenes M1 GAS
aucauauugacaaucaaaugauu

SEQ ID NO: 46990 - RNA, 22 nt, Streptococcus pyogenes M1 GAS
auuuaaugaauuaucuugaaug

SEQ ID NO: 46991 - RNA, 22 nt, Streptococcus pyogenes M1 GAS
auuuuugacacucagauggaca

SEQ ID NO: 46992 - RNA, 22 nt, Streptococcus pyogenes M1 GAS
caaaagcacagcaaucuuacua

SEQ ID NO: 46993 - RNA, 22 nt, Streptococcus pyogenes M1 GAS
caaaauaaguggcugcuucuuu

SEQ ID NO: 46994 - RNA, 22 nt, Streptococcus pyogenes M1 GAS
caaaggaucaagugaaugaugu

SEQ ID NO: 46995 - RNA, 22 nt, Streptococcus pyogenes M1 GAS
caagaaagguugguaaaguuau

SEQ ID NO: 46996 - RNA, 22 nt, Streptococcus pyogenes M1 GAS
caagacuuugggaacuauagac

SEQ ID NO: 46997 - RNA, 22 nt, Streptococcus pyogenes M1 GAS
caauagaaaaagauagauuugg

SEQ ID NO: 46998 - RNA, 22 nt, Streptococcus pyogenes M1 GAS
caauggauguuccuaugauuuu

SEQ ID NO: 46999 - RNA, 21 nt, Streptococcus pyogenes M1 GAS
cacuuuuuuguuaauuggucu

SEQ ID NO: 47000 - RNA, 22 nt, Streptococcus pyogenes M1 GAS
cagaugcuguuuuugccggaaa

SEQ ID NO: 47001 - RNA, 22 nt, Streptococcus pyogenes M1 GAS
caggacuaaguccuuuuaguuu

SEQ ID NO: 47002 - RNA, 22 nt, Streptococcus pyogenes M1 GAS
caggugucaagguuuccuuauc

SEQ ID NO: 47003 - RNA, 22 nt, Streptococcus pyogenes M1 GAS
cagucaaugguacaguuuauaa

SEQ ID NO: 47004 - RNA, 22 nt, Streptococcus pyogenes M1 GAS
cauugcuuugcuagggauuuau

SEQ ID NO: 47005 - RNA, 22 nt, Streptococcus pyogenes M1 GAS
ccaaaaagcugguguuuuagaa

SEQ ID NO: 47006 - RNA, 22 nt, Streptococcus pyogenes M1 GAS
ccaaccaauugaacacguuugc

SEQ ID NO: 47007 - RNA, 22 nt, Streptococcus pyogenes M1 GAS
ccuuugauggcaccaguaagcg

SEQ ID NO: 47008 - RNA, 22 nt, Streptococcus pyogenes M1 GAS
cgaguuggaagaucuauagaca

SEQ ID NO: 47009 - RNA, 20 nt, Streptococcus pyogenes M1 GAS
cuaauggcgcaaucagauau

SEQ ID NO: 47010 - RNA, 23 nt, Streptococcus pyogenes M1 GAS
cuagaauaacucucaaaaaucgu

SEQ ID NO: 47011 - RNA, 20 nt, Streptococcus pyogenes M1 GAS
cugacaaacaauuuagaggc

SEQ ID NO: 47012 - RNA, 22 nt, Streptococcus pyogenes M1 GAS
cugcgacagcaacuguugguca

SEQ ID NO: 47013 - RNA, 22 nt, Streptococcus pyogenes M1 GAS
cuucaggugcuacuuucuggga

SEQ ID NO: 47014 - RNA, 22 nt, Streptococcus pyogenes M1 GAS
cuuuaauuccgauguguuguaa

SEQ ID NO: 47015 - RNA, 22 nt, Streptococcus pyogenes M1 GAS
cuuuggcaaaauuaaaguauga

SEQ ID NO: 47016 - RNA, 22 nt, Streptococcus pyogenes M1 GAS
cuuuuccacagguuguggagaa

SEQ ID NO: 47017 - RNA, 22 nt, Streptococcus pyogenes M1 GAS
gaaaacuugaugucuaucacag

SEQ ID NO: 47018 - RNA, 22 nt, Streptococcus pyogenes M1 GAS
gaauaucuucuucaagaauauc

SEQ ID NO: 47019 - RNA, 22 nt, Streptococcus pyogenes M1 GAS
gacaaagauaguggugcuauuu

SEQ ID NO: 47020 - RNA, 22 nt, Streptococcus pyogenes M1 GAS
gagccagauucugugaucgcug

SEQ ID NO: 47021 - RNA, 22 nt, Streptococcus pyogenes M1 GAS
gagucagaagcauuuguucaau

SEQ ID NO: 47022 - RNA, 22 nt, Streptococcus pyogenes M1 GAS
gauaauuugaucguaucacgca

SEQ ID NO: 47023 - RNA, 22 nt, Streptococcus pyogenes M1 GAS
gcaaaauaggaaguuggcagaa

SEQ ID NO: 47024 - RNA, 18 nt, Streptococcus pyogenes M1 GAS
gcagauuuagaaaguuuu

SEQ ID NO: 47025 - RNA, 22 nt, Streptococcus pyogenes M1 GAS
gcuuuaauucagccauggcucu

SEQ ID NO: 47026 - RNA, 22 nt, Streptococcus pyogenes M1 GAS
gcuuuuuugacucgugaguaaa

SEQ ID NO: 47027 - RNA, 22 nt, Streptococcus pyogenes M1 GAS
ggcaaugguuacuauaauaugu

SEQ ID NO: 47028 - RNA, 22 nt, Streptococcus pyogenes M1 GAS
ggugauuuagcagguuuagcua

SEQ ID NO: 47029 - RNA, 19 nt, Streptococcus pyogenes M1 GAS
guaaagaaugauuuuacuu

SEQ ID NO: 47030 - RNA, 22 nt, Streptococcus pyogenes M1 GAS
gugaacacuggcggcaucauca

SEQ ID NO: 47031 - RNA, 22 nt, Streptococcus pyogenes M1 GAS
gugcaagauagcgauaagugga

SEQ ID NO: 47032 - RNA, 22 nt, Streptococcus pyogenes M1 GAS
gugguuuuagugaugguaagcc

SEQ ID NO: 47033 - RNA, 16 nt, Streptococcus pyogenes M1 GAS
guucaaucauuuuuua

SEQ ID NO: 47034 - RNA, 22 nt, Streptococcus pyogenes M1 GAS
guuuuuggaccugauauaacca

SEQ ID NO: 47035 - RNA, 22 nt, Streptococcus pyogenes M1 GAS
uaaaaaaugauguuaacaguuu

SEQ ID NO: 47036 - RNA, 22 nt, Streptococcus pyogenes M1 GAS
uaaagaaccuugucauaucaac

SEQ ID NO: 47037 - RNA, 22 nt, Streptococcus pyogenes M1 GAS
uaaggagcucugcaaaagcaaa

SEQ ID NO: 47038 - RNA, 22 nt, Streptococcus pyogenes M1 GAS
uaaugguagcauuaagguuaaa

SEQ ID NO: 47039 - RNA, 22 nt, Streptococcus pyogenes M1 GAS
uaccuuaguauccuuguucuua

SEQ ID NO: 47040 - RNA, 22 nt, Streptococcus pyogenes M1 GAS
uacuauuauggcagguguuaau

SEQ ID NO: 47041 - RNA, 22 nt, Streptococcus pyogenes M1 GAS
uaggugcugaugauuaucugac

SEQ ID NO: 47042 - RNA, 22 nt, Streptococcus pyogenes M1 GAS
uaguuuuuugacggugaucaau

SEQ ID NO: 47043 - RNA, 22 nt, Streptococcus pyogenes M1 GAS
uauaaagacaggagcagcugcu

SEQ ID NO: 47044 - RNA, 22 nt, Streptococcus pyogenes M1 GAS
uaucuuugucggauuuccuauu

SEQ ID NO: 47045 - RNA, 22 nt, Streptococcus pyogenes M1 GAS
uaugaaaagaguucauuaggca

SEQ ID NO: 47046 - RNA, 22 nt, Streptococcus pyogenes M1 GAS
uauuuuagcgaucaaugcgaca

SEQ ID NO: 47047 - RNA, 22 nt, Streptococcus pyogenes M1 GAS
ucaaaguuaauaucugauaagu

SEQ ID NO: 47048 - RNA, 22 nt, Streptococcus pyogenes M1 GAS
ucauuaggaauaaauaauggaa

SEQ ID NO: 47049 - RNA, 22 nt, Streptococcus pyogenes M1 GAS
uccacuaaaauacugucuuuug

SEQ ID NO: 47050 - RNA, 22 nt, Streptococcus pyogenes M1 GAS
uccuaucuagugguauugaagu

SEQ ID NO: 47051 - RNA, 23 nt, Streptococcus pyogenes M1 GAS
uccuuuguacgguauuuaaucgc

SEQ ID NO: 47052 - RNA, 19 nt, Streptococcus pyogenes M1 GAS
ucugaugucucaucuagau

SEQ ID NO: 47053 - RNA, 22 nt, Streptococcus pyogenes M1 GAS
ucuuaugguauacucaagaauu

SEQ ID NO: 47054 - RNA, 22 nt, Streptococcus pyogenes M1 GAS
ucuuuggaaaagacaucgucaa

SEQ ID NO: 47055 - RNA, 22 nt, Streptococcus pyogenes M1 GAS
ucuuuuguuacuggauaaagac

SEQ ID NO: 47056 - RNA, 22 nt, Streptococcus pyogenes M1 GAS
ugaaaaauuggaaucucgacua

SEQ ID NO: 47057 - RNA, 22 nt, Streptococcus pyogenes M1 GAS
ugaacaaaccaaugaaaaucgu

SEQ ID NO: 47058 - RNA, 22 nt, Streptococcus pyogenes M1 GAS
ugaacgauaccauugauauugc

SEQ ID NO: 47059 - RNA, 22 nt, Streptococcus pyogenes M1 GAS
ugacuggcgugcuauugaagca

SEQ ID NO: 47060 - RNA, 22 nt, Streptococcus pyogenes M1 GAS
ugauaaagacugagcauaagga

SEQ ID NO: 47061 - RNA, 20 nt, Streptococcus pyogenes M1 GAS
ugaugauccgggaguuaugg

SEQ ID NO: 47062 - RNA, 22 nt, Streptococcus pyogenes M1 GAS
ugaugaugccgccaguguucac

SEQ ID NO: 47063 - RNA, 22 nt, Streptococcus pyogenes M1 GAS
ugauuuugaaacacgaguggcu

SEQ ID NO: 47064 - RNA, 23 nt, Streptococcus pyogenes M1 GAS
ugcaaucuucuaggguuuuggcc

SEQ ID NO: 47065 - RNA, 22 nt, Streptococcus pyogenes M1 GAS
ugguuuuacaggacguuuuauc

SEQ ID NO: 47066 - RNA, 22 nt, Streptococcus pyogenes M1 GAS
ugucacaccaagugucaacaau

SEQ ID NO: 47067 - RNA, 22 nt, Streptococcus pyogenes M1 GAS
ugucuugagcuaguaaaaagug

SEQ ID NO: 47068 - RNA, 22 nt, Streptococcus pyogenes M1 GAS
uguugcaggaguacuaugacgg

SEQ ID NO: 47069 - RNA, 22 nt, Streptococcus pyogenes M1 GAS
uguuuuuuacgcuuauuggagg

SEQ ID NO: 47070 - RNA, 22 nt, Streptococcus pyogenes M1 GAS
uuaaaagacaaacaagcauacu

SEQ ID NO: 47071 - RNA, 22 nt, Streptococcus pyogenes M1 GAS
uuaccaauagugacuccauuuu

SEQ ID NO: 47072 - RNA, 22 nt, Streptococcus pyogenes M1 GAS
uuacuuaauaaaguaaugcuug

SEQ ID NO: 47073 - RNA, 22 nt, Streptococcus pyogenes M1 GAS
uuagaugaagcuuugccguugu

SEQ ID NO: 47074 - RNA, 22 nt, Streptococcus pyogenes M1 GAS
uuauauuuuaaaagacggcauu

SEQ ID NO: 47075 - RNA, 22 nt, Streptococcus pyogenes M1 GAS
uuauugaaaggauuuaguucug

SEQ ID NO: 47076 - RNA, 22 nt, Streptococcus pyogenes M1 GAS
uuauuuuuccuaauggccuuag

SEQ ID NO: 47077 - RNA, 22 nt, Streptococcus pyogenes M1 GAS
uucuaauuguucguuagcgaag

SEQ ID NO: 47078 - RNA, 22 nt, Streptococcus pyogenes M1 GAS
uugaagaauauuuucagcauua

SEQ ID NO: 47079 - RNA, 22 nt, Streptococcus pyogenes M1 GAS
uugagccacucgaacagccacg

SEQ ID NO: 47080 - RNA, 22 nt, Streptococcus pyogenes M1 GAS
uugaugucaauggcuucaaagu

SEQ ID NO: 47081 - RNA, 22 nt, Streptococcus pyogenes M1 GAS
uugcuaauaaucguccaaaaag

SEQ ID NO: 47082 - RNA, 22 nt, Streptococcus pyogenes M1 GAS
uugcuuugccuguuaaugauga

SEQ ID NO: 47083 - RNA, 22 nt, Streptococcus pyogenes M1 GAS
uuggauguucaaagcgaugagg

SEQ ID NO: 47084 - RNA, 22 nt, Streptococcus pyogenes M1 GAS
uuguacaucugguguuugcuca

SEQ ID NO: 47085 - RNA, 22 nt, Streptococcus pyogenes M1 GAS
uuguuagcugguuugccuucag

SEQ ID NO: 47086 - RNA, 22 nt, Streptococcus pyogenes M1 GAS
uuguuaguguuugaguaucuac

SEQ ID NO: 47087 - RNA, 22 nt, Streptococcus pyogenes M1 GAS
uuguuguagcugcaacuuacga

SEQ ID NO: 47088 - RNA, 22 nt, Streptococcus pyogenes M1 GAS
uuuagauugucaauguauuuua

SEQ ID NO: 47089 - RNA, 22 nt, Streptococcus pyogenes M1 GAS
uuuaucaguggguauucuuaug

SEQ ID NO: 47090 - RNA, 22 nt, Streptococcus pyogenes M1 GAS
uuucaaguauuaauguauuugg

SEQ ID NO: 47091 - RNA, 22 nt, Streptococcus pyogenes M1 GAS
uuucuauuaaaauuguuagcac

SEQ ID NO: 47092 - RNA, 22 nt, Streptococcus pyogenes M1 GAS
uuucuuuacaacgaguucacaa

SEQ ID NO: 47093 - RNA, 22 nt, Streptococcus pyogenes M1 GAS
uuuggcaagcaugagcucauuu

SEQ ID NO: 47094 - RNA, 22 nt, Streptococcus pyogenes M1 GAS
uuuugauauguccccuuucacu

SEQ ID NO: 47095 - RNA, 22 nt, Streptococcus pyogenes M1 GAS
uuuuuguaaagccucaagcuua

SEQ ID NO: 47096 - RNA, 22 nt, Streptococcus pyogenes MGAS315
aaaugcacaguauuaucagacu

SEQ ID NO: 47097 - RNA, 22 nt, Streptococcus pyogenes MGAS315
aacccuuauguccuugacauaa

SEQ ID NO: 47098 - RNA, 22 nt, Streptococcus pyogenes MGAS315
aagaauguauccgauauacuua

SEQ ID NO: 47099 - RNA, 22 nt, Streptococcus pyogenes MGAS315
aagauguaccaauugauaugaa

SEQ ID NO: 47100 - RNA, 22 nt, Streptococcus pyogenes MGAS315
aagguagcauugucuuugauaa

SEQ ID NO: 47101 - RNA, 20 nt, Streptococcus pyogenes MGAS315
aaguuccugaagguauuccg

SEQ ID NO: 47102 - RNA, 22 nt, Streptococcus pyogenes MGAS315
aauagugaucucauaauccguu

SEQ ID NO: 47103 - RNA, 22 nt, Streptococcus pyogenes MGAS315
aauuaggaaucugaccaugugu

SEQ ID NO: 47104 - RNA, 22 nt, Streptococcus pyogenes MGAS315
acaguuucucucucauuuaaga

SEQ ID NO: 47105 - RNA, 22 nt, Streptococcus pyogenes MGAS315
accuaucacgccaguaaaguca

SEQ ID NO: 47106 - RNA, 22 nt, Streptococcus pyogenes MGAS315
acugccauuaaccuucauuuua

SEQ ID NO: 47107 - RNA, 18 nt, Streptococcus pyogenes MGAS315
agagauuauagagcuuuu

SEQ ID NO: 47108 - RNA, 22 nt, Streptococcus pyogenes MGAS315
agauuucauagacaaaguaggg

SEQ ID NO: 47109 - RNA, 19 nt, Streptococcus pyogenes MGAS315
agguucaacagacgaugac

SEQ ID NO: 47110 - RNA, 22 nt, Streptococcus pyogenes MGAS315
aguauggaaagcagaugaacau

SEQ ID NO: 47111 - RNA, 22 nt, Streptococcus pyogenes MGAS315
agugaccagcaagucuguuguu

SEQ ID NO: 47112 - RNA, 22 nt, Streptococcus pyogenes MGAS315
auagccauucuaaggccauuuc

SEQ ID NO: 47113 - RNA, 22 nt, Streptococcus pyogenes MGAS315
auccuuauccaguuucuucugu

SEQ ID NO: 47114 - RNA, 22 nt, Streptococcus pyogenes MGAS315
auuucccauuacuacuaggacu

SEQ ID NO: 47115 - RNA, 22 nt, Streptococcus pyogenes MGAS315
caaguggagccucuugaauuug

SEQ ID NO: 47116 - RNA, 22 nt, Streptococcus pyogenes MGAS315
cagaugcuguuuuugcaggaaa

SEQ ID NO: 47117 - RNA, 22 nt, Streptococcus pyogenes MGAS315
cauugacaggaaaacuagugga

SEQ ID NO: 47118 - RNA, 22 nt, Streptococcus pyogenes MGAS315
gacuucuauauugauauuauga

SEQ ID NO: 47119 - RNA, 22 nt, Streptococcus pyogenes MGAS315
gauugcuuguuuuugagcacga

SEQ ID NO: 47120 - RNA, 22 nt, Streptococcus pyogenes MGAS315
uaacagcuguuucaauugcuga

SEQ ID NO: 47121 - RNA, 22 nt, Streptococcus pyogenes MGAS315
uaaggcauagucgauagauguu

SEQ ID NO: 47122 - RNA, 22 nt, Streptococcus pyogenes MGAS315
uagaugguccugcugauuaugc

SEQ ID NO: 47123 - RNA, 22 nt, Streptococcus pyogenes MGAS315
uaggcuaaaaaaggucugaugg

SEQ ID NO: 47124 - RNA, 22 nt, Streptococcus pyogenes MGAS315
uagguuaggagguucucuaugg

SEQ ID NO: 47125 - RNA, 22 nt, Streptococcus pyogenes MGAS315
uaucacuuuaaccagcccuuua

SEQ ID NO: 47126 - RNA, 22 nt, Streptococcus pyogenes MGAS315
ucaccuaagaugauagugccug

SEQ ID NO: 47127 - RNA, 22 nt, Streptococcus pyogenes MGAS315
ucauaucagcacguaggacuug

SEQ ID NO: 47128 - RNA, 23 nt, Streptococcus pyogenes MGAS315
ucauuugguacugcaauuugagc

SEQ ID NO: 47129 - RNA, 22 nt, Streptococcus pyogenes MGAS315
uccuucaaaacauuguuuagag

SEQ ID NO: 47130 - RNA, 21 nt, Streptococcus pyogenes MGAS315
ucucaauccgccuuaugaaac

SEQ ID NO: 47131 - RNA, 22 nt, Streptococcus pyogenes MGAS315
ugaaauugauggugauauuggc

SEQ ID NO: 47132 - RNA, 22 nt, Streptococcus pyogenes MGAS315
ugcagccacaccaagagacaaa

SEQ ID NO: 47133 - RNA, 22 nt, Streptococcus pyogenes MGAS315
ugccaagaacguuuaucaagac

SEQ ID NO: 47134 - RNA, 22 nt, Streptococcus pyogenes MGAS315
ugucaagugcuucaagcauagc

SEQ ID NO: 47135 - RNA, 22 nt, Streptococcus pyogenes MGAS315
ugucgauucaguagcagcuuua

SEQ ID NO: 47136 - RNA, 22 nt, Streptococcus pyogenes MGAS315
uuaucaacuuuagagggaagaa

SEQ ID NO: 47137 - RNA, 22 nt, Streptococcus pyogenes MGAS315
uuuacggcuugcacaugguauc

SEQ ID NO: 47138 - RNA, 19 nt, Streptococcus pyogenes MGAS315
uuuagcaagauagucuuuu

SEQ ID NO: 47139 - RNA, 22 nt, Streptococcus pyogenes MGAS315
uuucaaguauuaauguauuugg

SEQ ID NO: 47140 - RNA, 22 nt, Streptococcus pyogenes MGAS315
aaagacugguucaugaccuuga

SEQ ID NO: 47141 - RNA, 22 nt, Streptococcus pyogenes MGAS315
aagcacuugacauuccuuaugu

SEQ ID NO: 47142 - RNA, 22 nt, Streptococcus pyogenes MGAS315
aaucaagguuuggcucuugccu

SEQ ID NO: 47143 - RNA, 22 nt, Streptococcus pyogenes MGAS315
aaucgacuaaaagauuauuguu

SEQ ID NO: 47144 - RNA, 22 nt, Streptococcus pyogenes MGAS315
aaugacuuaugugguaucuggu

SEQ ID NO: 47145 - RNA, 22 nt, Streptococcus pyogenes MGAS315
acaaguaccaauuaucuccaga

SEQ ID NO: 47146 - RNA, 22 nt, Streptococcus pyogenes MGAS315
accauugauaauggcuuugcaa

SEQ ID NO: 47147 - RNA, 22 nt, Streptococcus pyogenes MGAS315
acgauguggcuacuggaaagau

SEQ ID NO: 47148 - RNA, 22 nt, Streptococcus pyogenes MGAS315
aucuaucaucguagucaacugu

SEQ ID NO: 47149 - RNA, 22 nt, Streptococcus pyogenes MGAS315
augaagguuuauacgaagcaga

SEQ ID NO: 47150 - RNA, 22 nt, Streptococcus pyogenes MGAS315
augugcuucauuugaagcaauc

SEQ ID NO: 47151 - RNA, 22 nt, Streptococcus pyogenes MGAS315
caauggauguuccuaugauuuu

SEQ ID NO: 47152 - RNA, 22 nt, Streptococcus pyogenes MGAS315
cuuugaaaguuggucgaauugc

SEQ ID NO: 47153 - RNA, 22 nt, Streptococcus pyogenes MGAS315
gaaguauaagauaacacacgaa

SEQ ID NO: 47154 - RNA, 22 nt, Streptococcus pyogenes MGAS315
gaccauuuugauaauggguaaa

SEQ ID NO: 47155 - RNA, 22 nt, Streptococcus pyogenes MGAS315
gacuccuauaugggagauauuu

SEQ ID NO: 47156 - RNA, 22 nt, Streptococcus pyogenes MGAS315
gauuaugaggauuugccugaaa

SEQ ID NO: 47157 - RNA, 22 nt, Streptococcus pyogenes MGAS315
gauuguacggacuauaucaguu

SEQ ID NO: 47158 - RNA, 22 nt, Streptococcus pyogenes MGAS315
gauuuguaugaguuaaguccua

SEQ ID NO: 47159 - RNA, 23 nt, Streptococcus pyogenes MGAS315
uaaauggucgccaugcuauuagg

SEQ ID NO: 47160 - RNA, 22 nt, Streptococcus pyogenes MGAS315
uaauggcuuugaacauuaugaa

SEQ ID NO: 47161 - RNA, 22 nt, Streptococcus pyogenes MGAS315
uacuggaauggauuauucuuua

SEQ ID NO: 47162 - RNA, 22 nt, Streptococcus pyogenes MGAS315
uaggcuuguguuucuugccuca

SEQ ID NO: 47163 - RNA, 22 nt, Streptococcus pyogenes MGAS315
uagguuaauaagguuaaguuaa

SEQ ID NO: 47164 - RNA, 18 nt, Streptococcus pyogenes MGAS315
uagucaaaaucccaugcu

SEQ ID NO: 47165 - RNA, 22 nt, Streptococcus pyogenes MGAS315
ucaaaguuaauaucugauaagu

SEQ ID NO: 47166 - RNA, 17 nt, Streptococcus pyogenes MGAS315
ucagcuaauugauuggc

SEQ ID NO: 47167 - RNA, 22 nt, Streptococcus pyogenes MGAS315
uccaugaguuguuuggugagag

SEQ ID NO: 47168 - RNA, 22 nt, Streptococcus pyogenes MGAS315
ucuauugcgucaacgacaagac

SEQ ID NO: 47169 - RNA, 22 nt, Streptococcus pyogenes MGAS315
ugaugauaacuuugcgguugug

SEQ ID NO: 47170 - RNA, 22 nt, Streptococcus pyogenes MGAS315
ugcuaugguaugguggcgguuc

SEQ ID NO: 47171 - RNA, 22 nt, Streptococcus pyogenes MGAS315
uggcuuaucagaugcuuuuuga

SEQ ID NO: 47172 - RNA, 22 nt, Streptococcus pyogenes MGAS315
ugucuugagcuaguaaaaagug

SEQ ID NO: 47173 - RNA, 22 nt, Streptococcus pyogenes MGAS315
uuagaucaccaagcuauuuugg

SEQ ID NO: 47174 - RNA, 22 nt, Streptococcus pyogenes MGAS315
uugaugauccaucccauaaggg

SEQ ID NO: 47175 - RNA, 22 nt, Streptococcus pyogenes MGAS315
uugucagaagaugguauuuuca

SEQ ID NO: 47176 - RNA, 22 nt, Streptococcus pyogenes MGAS315
uuuaucaguggguauucuuaug

SEQ ID NO: 47177 - RNA, 22 nt, Streptococcus pyogenes MGAS8232
aaauggccaugauuaugcuggu

SEQ ID NO: 47178 - RNA, 22 nt, Streptococcus pyogenes MGAS8232
aaggaacucgaucagcgcaaua

SEQ ID NO: 47179 - RNA, 20 nt, Streptococcus pyogenes MGAS8232
aaguuccugaagguauuccg

SEQ ID NO: 47180 - RNA, 22 nt, Streptococcus pyogenes MGAS8232
aauucucuugagguguuagcag

SEQ ID NO: 47181 - RNA, 22 nt, Streptococcus pyogenes MGAS8232
agaagccuugaaggcauuuuac

SEQ ID NO: 47182 - RNA, 22 nt, Streptococcus pyogenes MGAS8232
agcugguggcacagcuaugacu

SEQ ID NO: 47183 - RNA, 19 nt, Streptococcus pyogenes MGAS8232
aggugccuuuucuuugaag

SEQ ID NO: 47184 - RNA, 22 nt, Streptococcus pyogenes MGAS8232
augaagguuuauacgaagcaga

SEQ ID NO: 47185 - RNA, 17 nt, Streptococcus pyogenes MGAS8232
auugaguaggugacgau

SEQ ID NO: 47186 - RNA, 22 nt, Streptococcus pyogenes MGAS8232
auuuccaugacuagcaaacuuc

SEQ ID NO: 47187 - RNA, 22 nt, Streptococcus pyogenes MGAS8232
auuucccauuacuacuaggacu

SEQ ID NO: 47188 - RNA, 22 nt, Streptococcus pyogenes MGAS8232
cgauuugucauuugcuaguaau

SEQ ID NO: 47189 - RNA, 22 nt, Streptococcus pyogenes MGAS8232
gaccauuuugauaauggguaaa

SEQ ID NO: 47190 - RNA, 22 nt, Streptococcus pyogenes MGAS8232
gagcugaagaaguucucuuuau

SEQ ID NO: 47191 - RNA, 22 nt, Streptococcus pyogenes MGAS8232
gagcugugaaagcugcugcauc

SEQ ID NO: 47192 - RNA, 22 nt, Streptococcus pyogenes MGAS8232
gauugcuuguuuuugagcacga

SEQ ID NO: 47193 - RNA, 20 nt, Streptococcus pyogenes MGAS8232
guuccagauuguuuaaagag

SEQ ID NO: 47194 - RNA, 22 nt, Streptococcus pyogenes MGAS8232
uaagacuuguucuucagccauu

SEQ ID NO: 47195 - RNA, 22 nt, Streptococcus pyogenes MGAS8232
uaaucucaccaguuucuuuauu

SEQ ID NO: 47196 - RNA, 22 nt, Streptococcus pyogenes MGAS8232
uacugucucauaaucuugcucu

SEQ ID NO: 47197 - RNA, 22 nt, Streptococcus pyogenes MGAS8232
uagguuaauaagguuaaguuaa

SEQ ID NO: 47198 - RNA, 18 nt, Streptococcus pyogenes MGAS8232
uaucaaacgcaugcauga

SEQ ID NO: 47199 - RNA, 20 nt, Streptococcus pyogenes MGAS8232
uaucaaagauuuagaggcgg

SEQ ID NO: 47200 - RNA, 22 nt, Streptococcus pyogenes MGAS8232
uauuggcguaugaacgguuuga

SEQ ID NO: 47201 - RNA, 22 nt, Streptococcus pyogenes MGAS8232
ucaaaguuaauaucugauaagu

SEQ ID NO: 47202 - RNA, 22 nt, Streptococcus pyogenes MGAS8232
ucauaucagcacguaggacuug

SEQ ID NO: 47203 - RNA, 22 nt, Streptococcus pyogenes MGAS8232
ugaaggcauaacaagugcaagu

SEQ ID NO: 47204 - RNA, 22 nt, Streptococcus pyogenes MGAS8232
ugaccauuauaaaaaaagcagu

SEQ ID NO: 47205 - RNA, 22 nt, Streptococcus pyogenes MGAS8232
ugcuaugguaugguggcgguuc

SEQ ID NO: 47206 - RNA, 20 nt, Streptococcus pyogenes MGAS8232
ugcuccaagcucuugaaaaa

SEQ ID NO: 47207 - RNA, 19 nt, Streptococcus pyogenes MGAS8232
uggcaacagugaccuugga

SEQ ID NO: 47208 - RNA, 22 nt, Streptococcus pyogenes MGAS8232
uuggaccaugacaauuuagucg

SEQ ID NO: 47209 - RNA, 22 nt, Streptococcus pyogenes MGAS8232
aaacggauuuagcaaagucgua

SEQ ID NO: 47210 - RNA, 22 nt, Streptococcus pyogenes MGAS8232
aaacugcuagcaucguuuuuug

SEQ ID NO: 47211 - RNA, 22 nt, Streptococcus pyogenes MGAS8232
aagcacuaauacaaagaugaaa

SEQ ID NO: 47212 - RNA, 22 nt, Streptococcus pyogenes MGAS8232
aagguagcauugucuuugauaa

SEQ ID NO: 47213 - RNA, 22 nt, Streptococcus pyogenes MGAS8232
aauaguugcugcaugggcuccu

SEQ ID NO: 47214 - RNA, 22 nt, Streptococcus pyogenes MGAS8232
acgaagcuaugcuagauaagau

SEQ ID NO: 47215 - RNA, 22 nt, Streptococcus pyogenes MGAS8232
acugucuuuucuugagauggua

SEQ ID NO: 47216 - RNA, 22 nt, Streptococcus pyogenes MGAS8232
aggcuggacuugaucgugacgu

SEQ ID NO: 47217 - RNA, 22 nt, Streptococcus pyogenes MGAS8232
aguauggaaagcagaugaacau

SEQ ID NO: 47218 - RNA, 22 nt, Streptococcus pyogenes MGAS8232
agucacuuuuccagucaagucu

SEQ ID NO: 47219 - RNA, 22 nt, Streptococcus pyogenes MGAS8232
auagccauucuaaggccauuuc

SEQ ID NO: 47220 - RNA, 19 nt, Streptococcus pyogenes MGAS8232
augguauuuugauguuugc

SEQ ID NO: 47221 - RNA, 22 nt, Streptococcus pyogenes MGAS8232
caggcguagcgucaucaugauu

SEQ ID NO: 47222 - RNA, 22 nt, Streptococcus pyogenes MGAS8232
cguugaagcuaauggauugggc

SEQ ID NO: 47223 - RNA, 22 nt, Streptococcus pyogenes MGAS8232
gacguugaaguaagugacgaca

SEQ ID NO: 47224 - RNA, 22 nt, Streptococcus pyogenes MGAS8232
gauugcaauuuaguaaucuggc

SEQ ID NO: 47225 - RNA, 22 nt, Streptococcus pyogenes MGAS8232
gcauuagcuacugccaugagcu

SEQ ID NO: 47226 - RNA, 18 nt, Streptococcus pyogenes MGAS8232
gguuaaacgauucucuua

SEQ ID NO: 47227 - RNA, 22 nt, Streptococcus pyogenes MGAS8232
gucuuguacuucgcuuguaaaa

SEQ ID NO: 47228 - RNA, 22 nt, Streptococcus pyogenes MGAS8232
guucuaacuaccaagucccagu

SEQ ID NO: 47229 - RNA, 22 nt, Streptococcus pyogenes MGAS8232
guuuccagagucuaacauugcu

SEQ ID NO: 47230 - RNA, 22 nt, Streptococcus pyogenes MGAS8232
uaacagcuguuucaauugcuga

SEQ ID NO: 47231 - RNA, 22 nt, Streptococcus pyogenes MGAS8232
uaaggcauagucgauagauguu

SEQ ID NO: 47232 - RNA, 22 nt, Streptococcus pyogenes MGAS8232
uagcaacuucccagagugccgu

SEQ ID NO: 47233 - RNA, 22 nt, Streptococcus pyogenes MGAS8232
ucaaggguauccuaagauuccu

SEQ ID NO: 47234 - RNA, 20 nt, Streptococcus pyogenes MGAS8232
ucacagacauuacugaccca

SEQ ID NO: 47235 - RNA, 22 nt, Streptococcus pyogenes MGAS8232
ucuaagagagauaguuauugcu

SEQ ID NO: 47236 - RNA, 22 nt, Streptococcus pyogenes MGAS8232
ucuugucagaagaugguauuuu

SEQ ID NO: 47237 - RNA, 22 nt, Streptococcus pyogenes MGAS8232
ugaaauugauggugauauuggc

SEQ ID NO: 47238 - RNA, 22 nt, Streptococcus pyogenes MGAS8232
ugcggcagcuaggucacgggua

SEQ ID NO: 47239 - RNA, 22 nt, Streptococcus pyogenes MGAS8232
ugucgauucaguagcagcuuua

SEQ ID NO: 47240 - RNA, 22 nt, Streptococcus pyogenes MGAS8232
ugucuugagcuaguaaaaagug

SEQ ID NO: 47241 - RNA, 22 nt, Streptococcus pyogenes MGAS8232
uuacacauaugggauauauuuc

SEQ ID NO: 47242 - RNA, 22 nt, Streptococcus pyogenes MGAS8232
uugcucaaguugacgagcaaua

SEQ ID NO: 47243 - RNA, 22 nt, Streptococcus pyogenes MGAS8232
uuuaucaguggguauucuuaug

SEQ ID NO: 47244 - RNA, 23 nt, Streptococcus pyogenes MGAS8232
uuugaaagagguuuuauucgugc

SEQ ID NO: 47245 - RNA, 22 nt, Streptococcus pyogenes MGAS8232
uuugcaagcaagguuaucugau

SEQ ID NO: 47246 - RNA, 22 nt, Streptococcus pyogenes SSI-1
aagcacuugacauuccuuaugu

SEQ ID NO: 47247 - RNA, 22 nt, Streptococcus pyogenes SSI-1
aauuaggaaucugaccaugugu

SEQ ID NO: 47248 - RNA, 22 nt, Streptococcus pyogenes SSI-1
acugcagaaauaggcacuucug

SEQ ID NO: 47249 - RNA, 22 nt, Streptococcus pyogenes SSI-1
agauuucauagacaaaguaggg

SEQ ID NO: 47250 - RNA, 21 nt, Streptococcus pyogenes SSI-1
auaguuuggagcaauauuacu

SEQ ID NO: 47251 - RNA, 22 nt, Streptococcus pyogenes SSI-1
uaagccugguguggauaugugg

SEQ ID NO: 47252 - RNA, 22 nt, Streptococcus pyogenes SSI-1
uacugucucauaaucuugcucu

SEQ ID NO: 47253 - RNA, 22 nt, Streptococcus pyogenes SSI-1
uaucauguaugugaccuugaac

SEQ ID NO: 47254 - RNA, 22 nt, Streptococcus pyogenes SSI-1
uccaugaguuguuuggugagag

SEQ ID NO: 47255 - RNA, 22 nt, Streptococcus pyogenes SSI-1
uccuucaaaacauuguuuagag

SEQ ID NO: 47256 - RNA, 22 nt, Streptococcus pyogenes SSI-1
ugaaauugauggugauauuggc

SEQ ID NO: 47257 - RNA, 22 nt, Streptococcus pyogenes SSI-1
ugccaagaacguuuaucaagac

SEQ ID NO: 47258 - RNA, 20 nt, Streptococcus pyogenes SSI-1
ugcuccaagcucuugaaaaa

SEQ ID NO: 47259 - RNA, 19 nt, Streptococcus pyogenes SSI-1
uuaguagccaaguuguaga

SEQ ID NO: 47260 - RNA, 22 nt, Streptococcus pyogenes SSI-1
aguagcugauuuuuuaucagaa

SEQ ID NO: 47261 - RNA, 22 nt, Streptococcus pyogenes SSI-1
aguauggaaagcagaugaacau

SEQ ID NO: 47262 - RNA, 22 nt, Streptococcus pyogenes SSI-1
auuucccauuacuacuaggacu

SEQ ID NO: 47263 - RNA, 22 nt, Streptococcus pyogenes SSI-1
ccugaaggcauaacaagugcaa

SEQ ID NO: 47264 - RNA, 23 nt, Streptococcus pyogenes SSI-1
ucaaggguauccuaagauuccua

SEQ ID NO: 47265 - RNA, 22 nt, Streptococcus pyogenes SSI-1
ucagcucuuuggcauuaacugu

SEQ ID NO: 47266 - RNA, 22 nt, Streptococcus pyogenes SSI-1
ucauaucagcacguaggacuug

SEQ ID NO: 47267 - RNA, 23 nt, Streptococcus pyogenes SSI-1
ugaaugcuuugauucaaugugcg

SEQ ID NO: 47268 - RNA, 22 nt, Streptococcus pyogenes SSI-1
ugcaaaggaagguauucuaaaa

SEQ ID NO: 47269 - RNA, 22 nt, Streptococcus pyogenes SSI-1
ugucgauucaguagcagcuuua

SEQ ID NO: 47270 - RNA, 22 nt, Streptococcus pyogenes SSI-1
ugugauucucuuuauugaugaa

SEQ ID NO: 47271 - RNA, 22 nt, Streptococcus pyogenes SSI-1
aaaugcuuaaaggaauugcagc

SEQ ID NO: 47272 - RNA, 22 nt, Streptococcus pyogenes SSI-1
agcucgaagauugcuugacgaa

SEQ ID NO: 47273 - RNA, 22 nt, Streptococcus pyogenes SSI-1
aggcuggacuugaucgugacgu

SEQ ID NO: 47274 - RNA, 23 nt, Streptococcus pyogenes SSI-1
agggcugaaacagguguuugaua

SEQ ID NO: 47275 - RNA, 22 nt, Treponema pallidum subsp. pallidum str. Nichols
aaaaacaugcugacuucgucgg

SEQ ID NO: 47276 - RNA, 22 nt, Treponema pallidum subsp. pallidum str. Nichols
aaauaacacgaaaaaugucgca

SEQ ID NO: 47277 - RNA, 22 nt, Treponema pallidum subsp. pallidum str. Nichols
aagaguuuuacacaaaauacgc

SEQ ID NO: 47278 - RNA, 22 nt, Treponema pallidum subsp. pallidum str. Nichols
aagauauugucaaauguauccu

SEQ ID NO: 47279 - RNA, 22 nt, Treponema pallidum subsp. pallidum str. Nichols
acgaagacgccucacggaagcu

SEQ ID NO: 47280 - RNA, 22 nt, Treponema pallidum subsp. pallidum str. Nichols
agggaaaacgacgauggacucu

SEQ ID NO: 47281 - RNA, 22 nt, Treponema pallidum subsp. pallidum str. Nichols
aucaaugucgcggcagagaacu

SEQ ID NO: 47282 - RNA, 22 nt, Treponema pallidum subsp. pallidum str. Nichols
cgacgcucguccguaacuucuu

SEQ ID NO: 47283 - RNA, 22 nt, Treponema pallidum subsp. pallidum str. Nichols
gagaagggacuugccccugagu

SEQ ID NO: 47284 - RNA, 22 nt, Treponema pallidum subsp. pallidum str. Nichols
gcuguauccgaaauaccauuuu

SEQ ID NO: 47285 - RNA, 20 nt, Treponema pallidum subsp. pallidum str. Nichols
gguguccuguuuguacuauc

SEQ ID NO: 47286 - RNA, 18 nt, Treponema pallidum subsp. pallidum str. Nichols
guccuuuccggugaacuc

SEQ ID NO: 47287 - RNA, 22 nt, Treponema pallidum subsp. pallidum str. Nichols
guggauuuucaagaugugggga

SEQ ID NO: 47288 - RNA, 22 nt, Treponema pallidum subsp. pallidum str. Nichols
guggcaguuuggauuugaacca

SEQ ID NO: 47289 - RNA, 22 nt, Treponema pallidum subsp. pallidum str. Nichols
ugaagauaaaauucuugcagua

SEQ ID NO: 47290 - RNA, 22 nt, Treponema pallidum subsp. pallidum str. Nichols
uguacccuguuagucggcgcgu

SEQ ID NO: 47291 - RNA, 22 nt, Treponema pallidum subsp. pallidum str. Nichols
uuaucaauacaggaauugcagg

SEQ ID NO: 47292 - RNA, 22 nt, Treponema pallidum subsp. pallidum str. Nichols
uugauucgguuuuguacguucc

SEQ ID NO: 47293 - RNA, 22 nt, Treponema pallidum subsp. pallidum str. Nichols
uuuucccagcuuggcgcgcuug

SEQ ID NO: 47294 - RNA, 22 nt, Treponema pallidum subsp. pallidum str. Nichols
aacaagcaaucguuacucuuuu

SEQ ID NO: 47295 - RNA, 22 nt, Treponema pallidum subsp. pallidum str. Nichols
aagaacuaggagucugugucgc

SEQ ID NO: 47296 - RNA, 22 nt, Treponema pallidum subsp. pallidum str. Nichols
aagacgugcucgggccgcugca

SEQ ID NO: 47297 - RNA, 22 nt, Treponema pallidum subsp. pallidum str. Nichols
acagaagacaagagcgcacugg

SEQ ID NO: 47298 - RNA, 22 nt, Treponema pallidum subsp. pallidum str. Nichols
agcuuucuggcgugcuuggacu

SEQ ID NO: 47299 - RNA, 22 nt, Treponema pallidum subsp. pallidum str. Nichols
aguguauucaaccauuugcuuu

SEQ ID NO: 47300 - RNA, 22 nt, Treponema pallidum subsp. pallidum str. Nichols
auuuuaaugcagcgucuugcgc

SEQ ID NO: 47301 - RNA, 22 nt, Treponema pallidum subsp. pallidum str. Nichols
cuuuccagguaagugugugucg

SEQ ID NO: 47302 - RNA, 22 nt, Treponema pallidum subsp. pallidum str. Nichols
gcagaaguuuuuugugcagaug

SEQ ID NO: 47303 - RNA, 22 nt, Treponema pallidum subsp. pallidum str. Nichols
gcugucugugugcugcacgaaa

SEQ ID NO: 47304 - RNA, 22 nt, Treponema pallidum subsp. pallidum str. Nichols
gugaugcacgugauuuugugcu

SEQ ID NO: 47305 - RNA, 20 nt, Treponema pallidum subsp. pallidum str. Nichols
uccugcuccaacugacggug

SEQ ID NO: 47306 - RNA, 22 nt, Treponema pallidum subsp. pallidum str. Nichols
ugagcgcugcgcgcaguugggu

SEQ ID NO: 47307 - RNA, 22 nt, Treponema pallidum subsp. pallidum str. Nichols
ugagguagccgacgacgaccgu

SEQ ID NO: 47308 - RNA, 22 nt, Treponema pallidum subsp. pallidum str. Nichols
ugcuggugagaguuuucaagcg

SEQ ID NO: 47309 - RNA, 22 nt, Treponema pallidum subsp. pallidum str. Nichols
uggcagaaguagaugugcugcu

SEQ ID NO: 47310 - RNA, 22 nt, Treponema pallidum subsp. pallidum str. Nichols
uuauuuauccacguauucauga

SEQ ID NO: 47311 - RNA, 22 nt, Treponema pallidum subsp. pallidum str. Nichols
uugagggucguuugacgcaacu

SEQ ID NO: 47312 - RNA, 22 nt, Yersinia pestis
aaacccuguccgguggcgaagc

SEQ ID NO: 47313 - RNA, 22 nt, Yersinia pestis
aaaccgcucaauccguugcagg

SEQ ID NO: 47314 - RNA, 22 nt, Yersinia pestis
aaacgcauauugcuggucggcu

SEQ ID NO: 47315 - RNA, 22 nt, Yersinia pestis
aaacgcauuuauaaguucccga

SEQ ID NO: 47316 - RNA, 22 nt, Yersinia pestis
aaacucggccuuucagucaugc

SEQ ID NO: 47317 - RNA, 22 nt, Yersinia pestis
aaagcugauccggcgcaggcgg

SEQ ID NO: 47318 - RNA, 22 nt, Yersinia pestis
aaaggccgcccguucuuugaug

SEQ ID NO: 47319 - RNA, 22 nt, Yersinia pestis
aaaggcucacaccaccgaguuc

SEQ ID NO: 47320 - RNA, 22 nt, Yersinia pestis
aaagguauuuacugauccaaaa

SEQ ID NO: 47321 - RNA, 22 nt, Yersinia pestis
aaaguggccagagaucuguuua

SEQ ID NO: 47322 - RNA, 22 nt, Yersinia pestis
aaaucgacugauauucagcgau

SEQ ID NO: 47323 - RNA, 22 nt, Yersinia pestis
aaccgcagauggcggcggaucu

SEQ ID NO: 47324 - RNA, 22 nt, Yersinia pestis
aacgacuggcgucacuggauaa

SEQ ID NO: 47325 - RNA, 22 nt, Yersinia pestis
aacgcaguggagguuacguucg

SEQ ID NO: 47326 - RNA, 22 nt, Yersinia pestis
aacggcagagcaauuuacugau

SEQ ID NO: 47327 - RNA, 22 nt, Yersinia pestis
aacgucagaagacaguugaucg

SEQ ID NO: 47328 - RNA, 22 nt, Yersinia pestis
aacgucgagcaacaagagcgug

SEQ ID NO: 47329 - RNA, 22 nt, Yersinia pestis
aacugcacuggcggucgagagg

SEQ ID NO: 47330 - RNA, 22 nt, Yersinia pestis
aacuggcagcagauaccgcuaa

SEQ ID NO: 47331 - RNA, 22 nt, Yersinia pestis
aacuuucaugcuauuacccuua

SEQ ID NO: 47332 - RNA, 22 nt, Yersinia pestis
aagcagcgacaggagaaggguu

SEQ ID NO: 47333 - RNA, 22 nt, Yersinia pestis
aagccguauuaacugaauacca

SEQ ID NO: 47334 - RNA, 21 nt, Yersinia pestis
aagccguuggugaguuuggua

SEQ ID NO: 47335 - RNA, 22 nt, Yersinia pestis
aagcggaucgucgauagguugg

SEQ ID NO: 47336 - RNA, 22 nt, Yersinia pestis
aagcgguaaucaguagucauug

SEQ ID NO: 47337 - RNA, 22 nt, Yersinia pestis
aaggacuugggaucauugucuc

SEQ ID NO: 47338 - RNA, 21 nt, Yersinia pestis
aagugauucggguuauugagc

SEQ ID NO: 47339 - RNA, 22 nt, Yersinia pestis
aaguggcuaucggcggcaagcg

SEQ ID NO: 47340 - RNA, 22 nt, Yersinia pestis
aagugugguguugaugcagaua

SEQ ID NO: 47341 - RNA, 22 nt, Yersinia pestis
aauaacgaacguguggaugcgc

SEQ ID NO: 47342 - RNA, 22 nt, Yersinia pestis
aaucaaugaccaauaccaaaac

SEQ ID NO: 47343 - RNA, 22 nt, Yersinia pestis
aaucauguuguagagaaacgaa

SEQ ID NO: 47344 - RNA, 22 nt, Yersinia pestis
aaucggugcgccaucaccaaua

SEQ ID NO: 47345 - RNA, 22 nt, Yersinia pestis
aaucuuguggcuaauaugaugg

SEQ ID NO: 47346 - RNA, 22 nt, Yersinia pestis
aaugacaguguuacccgagaga

SEQ ID NO: 47347 - RNA, 22 nt, Yersinia pestis
aaugaccaucaaagaguuacug

SEQ ID NO: 47348 - RNA, 22 nt, Yersinia pestis
aaugagucaauagcauucaagc

SEQ ID NO: 47349 - RNA, 22 nt, Yersinia pestis
aaugccauggucacaucguuau

SEQ ID NO: 47350 - RNA, 22 nt, Yersinia pestis
aauggccgauaauaauggcuug

SEQ ID NO: 47351 - RNA, 22 nt, Yersinia pestis
aauggcgauggaaagacccacu

SEQ ID NO: 47352 - RNA, 22 nt, Yersinia pestis
aauggugcggcgaugaagucgc

SEQ ID NO: 47353 - RNA, 22 nt, Yersinia pestis
aaugucaccgaauugaaugggc

SEQ ID NO: 47354 - RNA, 22 nt, Yersinia pestis
aaugugugcugaaauggucgcu

SEQ ID NO: 47355 - RNA, 22 nt, Yersinia pestis
acacauauuucaggcuguugcg

SEQ ID NO: 47356 - RNA, 21 nt, Yersinia pestis
acaccgcuaagguaucaaacc

SEQ ID NO: 47357 - RNA, 22 nt, Yersinia pestis
acagaguauuaccgcaaaauga

SEQ ID NO: 47358 - RNA, 22 nt, Yersinia pestis
acaguauugggacaguauuugu

SEQ ID NO: 47359 - RNA, 22 nt, Yersinia pestis
acaucagagcucaauuuaacgg

SEQ ID NO: 47360 - RNA, 22 nt, Yersinia pestis
accaagguuuaugguuuucaau

SEQ ID NO: 47361 - RNA, 19 nt, Yersinia pestis
accaauaugaaguuacugg

SEQ ID NO: 47362 - RNA, 22 nt, Yersinia pestis
accaaugggcagcgcuguuacu

SEQ ID NO: 47363 - RNA, 22 nt, Yersinia pestis
accacguggaugaaaaaacgcc

SEQ ID NO: 47364 - RNA, 22 nt, Yersinia pestis
accaguagcaacacaaccagua

SEQ ID NO: 47365 - RNA, 22 nt, Yersinia pestis
acccgucguacuuuaagcugca

SEQ ID NO: 47366 - RNA, 22 nt, Yersinia pestis
accgcgcacgauaaagguaaua

SEQ ID NO: 47367 - RNA, 22 nt, Yersinia pestis
accggcaaugcugaagaaaugg

SEQ ID NO: 47368 - RNA, 22 nt, Yersinia pestis
accggugcugcguuugacagcu

SEQ ID NO: 47369 - RNA, 22 nt, Yersinia pestis
accggugugguguuagccacgg

SEQ ID NO: 47370 - RNA, 22 nt, Yersinia pestis
accugaaggcugggcaagaggu

SEQ ID NO: 47371 - RNA, 22 nt, Yersinia pestis
acgaaggugauaguaacgaagg

SEQ ID NO: 47372 - RNA, 22 nt, Yersinia pestis
acgaaguuguagaacuuaauug

SEQ ID NO: 47373 - RNA, 22 nt, Yersinia pestis
acgauauuguccaugcguuaca

SEQ ID NO: 47374 - RNA, 22 nt, Yersinia pestis
acgccgcuucaaagaugacguu

SEQ ID NO: 47375 - RNA, 22 nt, Yersinia pestis
acgccugacaaauguacucaaa

SEQ ID NO: 47376 - RNA, 22 nt, Yersinia pestis
acgcgcugcuucaacauuguag

SEQ ID NO: 47377 - RNA, 22 nt, Yersinia pestis
acgcuguuggagaagauguuga

SEQ ID NO: 47378 - RNA, 22 nt, Yersinia pestis
acggaaaccaacuaaaugggua

SEQ ID NO: 47379 - RNA, 22 nt, Yersinia pestis
acggcucugccaacgugaucgc

SEQ ID NO: 47380 - RNA, 22 nt, Yersinia pestis
acgguguacgggauuaccgugg

SEQ ID NO: 47381 - RNA, 22 nt, Yersinia pestis
acguucagacagugugccguug

SEQ ID NO: 47382 - RNA, 22 nt, Yersinia pestis
acguuggcaauagugccgucca

SEQ ID NO: 47383 - RNA, 22 nt, Yersinia pestis
acguuguaugaacauggugugc

SEQ ID NO: 47384 - RNA, 22 nt, Yersinia pestis
acguuucuuuacguaaaguacg

SEQ ID NO: 47385 - RNA, 22 nt, Yersinia pestis
acucgcccuuguuuuggcauuc

SEQ ID NO: 47386 - RNA, 22 nt, Yersinia pestis
acucugcuuguaccacaggaac

SEQ ID NO: 47387 - RNA, 22 nt, Yersinia pestis
acugacgauauugcguagcaua

SEQ ID NO: 47388 - RNA, 19 nt, Yersinia pestis
acugccacaggaagagggc

SEQ ID NO: 47389 - RNA, 22 nt, Yersinia pestis
acuggauguugauauuccucau

SEQ ID NO: 47390 - RNA, 22 nt, Yersinia pestis
acugguugcgcaauaugggaua

SEQ ID NO: 47391 - RNA, 22 nt, Yersinia pestis
acuguugauggcgacuucguua

SEQ ID NO: 47392 - RNA, 18 nt, Yersinia pestis
acuucuuagugcgcuagc

SEQ ID NO: 47393 - RNA, 20 nt, Yersinia pestis
agaaaucgacuuuacuggcg

SEQ ID NO: 47394 - RNA, 16 nt, Yersinia pestis
agaacugcgccaacug

SEQ ID NO: 47395 - RNA, 22 nt, Yersinia pestis
agaggcucuguuagcgguaaag

SEQ ID NO: 47396 - RNA, 22 nt, Yersinia pestis
agaucagcuauccggguugaaa

SEQ ID NO: 47397 - RNA, 21 nt, Yersinia pestis
agaugguaucccugcuguggu

SEQ ID NO: 47398 - RNA, 22 nt, Yersinia pestis
agauguuuuccaguugaucaug

SEQ ID NO: 47399 - RNA, 22 nt, Yersinia pestis
agauuaagcgccucaaacaggc

SEQ ID NO: 47400 - RNA, 22 nt, Yersinia pestis
agauuucagacugcugacaacc

SEQ ID NO: 47401 - RNA, 22 nt, Yersinia pestis
agcaggcuaaacagcaugcauu

SEQ ID NO: 47402 - RNA, 21 nt, Yersinia pestis
agcaucgcuaugaaauucuug

SEQ ID NO: 47403 - RNA, 22 nt, Yersinia pestis
agcaucgucuccaguuugauga

SEQ ID NO: 47404 - RNA, 22 nt, Yersinia pestis
agccaguacuuuuguucaaacg

SEQ ID NO: 47405 - RNA, 18 nt, Yersinia pestis
agcccgcuuauuggucag

SEQ ID NO: 47406 - RNA, 18 nt, Yersinia pestis
agccgcuauuuacggaug

SEQ ID NO: 47407 - RNA, 22 nt, Yersinia pestis
agccugacagaaaaugucaaug

SEQ ID NO: 47408 - RNA, 22 nt, Yersinia pestis
agccuuuguuuuccgucuucag

SEQ ID NO: 47409 - RNA, 22 nt, Yersinia pestis
agcgcauuuaaaaauaaugauc

SEQ ID NO: 47410 - RNA, 22 nt, Yersinia pestis
agcgcguuguucaccguauuac

SEQ ID NO: 47411 - RNA, 22 nt, Yersinia pestis
agcgcuguuaucgccagccacu

SEQ ID NO: 47412 - RNA, 22 nt, Yersinia pestis
agcgcuuucuggguaucugccu

SEQ ID NO: 47413 - RNA, 22 nt, Yersinia pestis
agcggcacaagauaccuuaccg

SEQ ID NO: 47414 - RNA, 22 nt, Yersinia pestis
agcuaaauacgaucuaaugaau

SEQ ID NO: 47415 - RNA, 22 nt, Yersinia pestis
agcuaucgucgucgauuucaau

SEQ ID NO: 47416 - RNA, 22 nt, Yersinia pestis
agcuggcacuuaguacguagcg

SEQ ID NO: 47417 - RNA, 23 nt, Yersinia pestis
agcugucagggauguaguuuugc

SEQ ID NO: 47418 - RNA, 22 nt, Yersinia pestis
agcuugaacagcagguuaucca

SEQ ID NO: 47419 - RNA, 22 nt, Yersinia pestis
agcuugaauaccugggauaauu

SEQ ID NO: 47420 - RNA, 22 nt, Yersinia pestis
agcuuugugggauaccguauca

SEQ ID NO: 47421 - RNA, 22 nt, Yersinia pestis
aggaguuugaaggccauugucu

SEQ ID NO: 47422 - RNA, 22 nt, Yersinia pestis
aggauaccauuugucagggucu

SEQ ID NO: 47423 - RNA, 22 nt, Yersinia pestis
aggauuauucauggugaauggu

SEQ ID NO: 47424 - RNA, 22 nt, Yersinia pestis
aggcaucucugucauccaguaa

SEQ ID NO: 47425 - RNA, 22 nt, Yersinia pestis
agguaacgguuccuucaaaguc

SEQ ID NO: 47426 - RNA, 22 nt, Yersinia pestis
agguacccaauaauauuccggc

SEQ ID NO: 47427 - RNA, 22 nt, Yersinia pestis
aggugagcagcaccaaacgguu

SEQ ID NO: 47428 - RNA, 22 nt, Yersinia pestis
aggugcaauuacagaagcuuga

SEQ ID NO: 47429 - RNA, 22 nt, Yersinia pestis
aggugcagccacuaucagcuac

SEQ ID NO: 47430 - RNA, 22 nt, Yersinia pestis
aguaacagcgcugcccauuggu

SEQ ID NO: 47431 - RNA, 22 nt, Yersinia pestis
aguaacgaauuacgcugaauug

SEQ ID NO: 47432 - RNA, 22 nt, Yersinia pestis
aguaacguuagucauuaaucag

SEQ ID NO: 47433 - RNA, 17 nt, Yersinia pestis
aguaggguuauguguga

SEQ ID NO: 47434 - RNA, 22 nt, Yersinia pestis
aguaugcuggcgcuguugcugg

SEQ ID NO: 47435 - RNA, 22 nt, Yersinia pestis
agucaaagaauccaugucuggc

SEQ ID NO: 47436 - RNA, 22 nt, Yersinia pestis
agucaccgggcguaccuuaguc

SEQ ID NO: 47437 - RNA, 19 nt, Yersinia pestis
aguccugaccgguaucgcc

SEQ ID NO: 47438 - RNA, 22 nt, Yersinia pestis
agucgccgcaaccggugauggc

SEQ ID NO: 47439 - RNA, 22 nt, Yersinia pestis
agucucaguucaucaacguauc

SEQ ID NO: 47440 - RNA, 22 nt, Yersinia pestis
agucuuaucaaucugucauggu

SEQ ID NO: 47441 - RNA, 22 nt, Yersinia pestis
agucuucgcuggcagugccuau

SEQ ID NO: 47442 - RNA, 22 nt, Yersinia pestis
agugacuauugaauggaaacau

SEQ ID NO: 47443 - RNA, 22 nt, Yersinia pestis
agugaguuugugcagacauucc

SEQ ID NO: 47444 - RNA, 22 nt, Yersinia pestis
agugccugcaucuguuuaccgg

SEQ ID NO: 47445 - RNA, 22 nt, Yersinia pestis
agugcguucagugccguugacc

SEQ ID NO: 47446 - RNA, 22 nt, Yersinia pestis
agugcugcuugagaacuuacua

SEQ ID NO: 47447 - RNA, 20 nt, Yersinia pestis
agugggucuuuccaucgcca

SEQ ID NO: 47448 - RNA, 22 nt, Yersinia pestis
aguucuauguucgugaacgccg

SEQ ID NO: 47449 - RNA, 22 nt, Yersinia pestis
auaaacgcgguauuagugguga

SEQ ID NO: 47450 - RNA, 22 nt, Yersinia pestis
auaaccugcgucacuguauucu

SEQ ID NO: 47451 - RNA, 22 nt, Yersinia pestis
auaaugccuugauugaaggaga

SEQ ID NO: 47452 - RNA, 22 nt, Yersinia pestis
auacugaagucaguuuuucgcc

SEQ ID NO: 47453 - RNA, 22 nt, Yersinia pestis
auauugucguugauauugucgc

SEQ ID NO: 47454 - RNA, 23 nt, Yersinia pestis
aucacccgcuuccagaaaaucaa

SEQ ID NO: 47455 - RNA, 22 nt, Yersinia pestis
aucagcaaugaaacccugcaaa

SEQ ID NO: 47456 - RNA, 22 nt, Yersinia pestis
aucaggucagcagugaugaagu

SEQ ID NO: 47457 - RNA, 22 nt, Yersinia pestis
aucaguuucucuuuaaccucga

SEQ ID NO: 47458 - RNA, 22 nt, Yersinia pestis
aucgaaaugguagucaaacaau

SEQ ID NO: 47459 - RNA, 22 nt, Yersinia pestis
aucgccauccugguguugauga

SEQ ID NO: 47460 - RNA, 22 nt, Yersinia pestis
aucgccauuccguugauggaca

SEQ ID NO: 47461 - RNA, 22 nt, Yersinia pestis
aucgcgauccagaccugacucu

SEQ ID NO: 47462 - RNA, 20 nt, Yersinia pestis
aucggcgcgguggucgccgc

SEQ ID NO: 47463 - RNA, 22 nt, Yersinia pestis
aucuaaugguuguuaauuaaga

SEQ ID NO: 47464 - RNA, 22 nt, Yersinia pestis
aucuacaccacgccauggauaa

SEQ ID NO: 47465 - RNA, 22 nt, Yersinia pestis
aucugauucaaaccauuaaccu

SEQ ID NO: 47466 - RNA, 22 nt, Yersinia pestis
augaccugauauggugcgacgg

SEQ ID NO: 47467 - RNA, 22 nt, Yersinia pestis
augagccuauugcugcccgaga

SEQ ID NO: 47468 - RNA, 22 nt, Yersinia pestis
augaggcacguguacaugacua

SEQ ID NO: 47469 - RNA, 22 nt, Yersinia pestis
augaguugcucacauugcugcc

SEQ ID NO: 47470 - RNA, 22 nt, Yersinia pestis
augaucuggagguucgguucaa

SEQ ID NO: 47471 - RNA, 22 nt, Yersinia pestis
augcaauugcugaggugcgcug

SEQ ID NO: 47472 - RNA, 22 nt, Yersinia pestis
augcaguuaagguuagcuaugc

SEQ ID NO: 47473 - RNA, 22 nt, Yersinia pestis
augccauauuuacauucgcgau

SEQ ID NO: 47474 - RNA, 22 nt, Yersinia pestis
augccguugaauugaucagacc

SEQ ID NO: 47475 - RNA, 22 nt, Yersinia pestis
augcggugggugugauugguuu

SEQ ID NO: 47476 - RNA, 22 nt, Yersinia pestis
augcugaugcugauguuaauac

SEQ ID NO: 47477 - RNA, 22 nt, Yersinia pestis
auggaucuuguccugagugcgg

SEQ ID NO: 47478 - RNA, 22 nt, Yersinia pestis
auggccuucgcggucccuacgu

SEQ ID NO: 47479 - RNA, 22 nt, Yersinia pestis
augggcauuagccaaacagaac

SEQ ID NO: 47480 - RNA, 22 nt, Yersinia pestis
augggcugguuagcauuaucuu

SEQ ID NO: 47481 - RNA, 22 nt, Yersinia pestis
auggucgguucuauguuggcug

SEQ ID NO: 47482 - RNA, 22 nt, Yersinia pestis
auguuaucaaggcgcuauuuga

SEQ ID NO: 47483 - RNA, 22 nt, Yersinia pestis
auguuucuccauuuugccauug

SEQ ID NO: 47484 - RNA, 22 nt, Yersinia pestis
auuacccugggacucaagguua

SEQ ID NO: 47485 - RNA, 22 nt, Yersinia pestis
auuacgacagucucauuuuagc

SEQ ID NO: 47486 - RNA, 22 nt, Yersinia pestis
auucagaugccaaucuucuugg

SEQ ID NO: 47487 - RNA, 22 nt, Yersinia pestis
auucgauuuaucuggcuuuaau

SEQ ID NO: 47488 - RNA, 22 nt, Yersinia pestis
auucgcguugcaguaaggcagu

SEQ ID NO: 47489 - RNA, 22 nt, Yersinia pestis
auugaucugauuuuacugaaag

SEQ ID NO: 47490 - RNA, 22 nt, Yersinia pestis
auugccguaaaugagugagucg

SEQ ID NO: 47491 - RNA, 22 nt, Yersinia pestis
auuggccgaggugauuuuagcc

SEQ ID NO: 47492 - RNA, 22 nt, Yersinia pestis
auuggcuagccaugcuguccuu

SEQ ID NO: 47493 - RNA, 22 nt, Yersinia pestis
auugucaugcagaaucgaaacu

SEQ ID NO: 47494 - RNA, 22 nt, Yersinia pestis
auugugcuuucugaugccugau

SEQ ID NO: 47495 - RNA, 22 nt, Yersinia pestis
auuucaucacugagcugguggg

SEQ ID NO: 47496 - RNA, 22 nt, Yersinia pestis
auuucccgaguaaccaaugaca

SEQ ID NO: 47497 - RNA, 22 nt, Yersinia pestis
auuugucauuauuuaugagcgu

SEQ ID NO: 47498 - RNA, 22 nt, Yersinia pestis
caaagauuauugguuaguugcg

SEQ ID NO: 47499 - RNA, 22 nt, Yersinia pestis
caacccgucaacuauguugcaa

SEQ ID NO: 47500 - RNA, 22 nt, Yersinia pestis
caaguugugccaacguaccgau

SEQ ID NO: 47501 - RNA, 22 nt, Yersinia pestis
caaucaugauauggcgagcccc

SEQ ID NO: 47502 - RNA, 22 nt, Yersinia pestis
caaucguuguuucugauagcga

SEQ ID NO: 47503 - RNA, 22 nt, Yersinia pestis
caaugucacuggaguugauggu

SEQ ID NO: 47504 - RNA, 22 nt, Yersinia pestis
cacagaugcuggagaaggucgg

SEQ ID NO: 47505 - RNA, 22 nt, Yersinia pestis
caccgcuaauaucuuggcuuca

SEQ ID NO: 47506 - RNA, 22 nt, Yersinia pestis
caccgucggcguggauaucggc

SEQ ID NO: 47507 - RNA, 22 nt, Yersinia pestis
cacgcgcuaacguuucucaggu

SEQ ID NO: 47508 - RNA, 22 nt, Yersinia pestis
cacuggcggugucucauuaaua

SEQ ID NO: 47509 - RNA, 20 nt, Yersinia pestis
cacuggguggacaucgcucu

SEQ ID NO: 47510 - RNA, 22 nt, Yersinia pestis
cacuuugucaguaaccgcagua

SEQ ID NO: 47511 - RNA, 22 nt, Yersinia pestis
cagagcagucauuaaauuuuau

SEQ ID NO: 47512 - RNA, 22 nt, Yersinia pestis
cagccguaguccaacccaguag

SEQ ID NO: 47513 - RNA, 22 nt, Yersinia pestis
caggaguucgugaaugcucugu

SEQ ID NO: 47514 - RNA, 22 nt, Yersinia pestis
caggcucauugcguaugcagag

SEQ ID NO: 47515 - RNA, 22 nt, Yersinia pestis
caggcuguguauuccgcacccg

SEQ ID NO: 47516 - RNA, 22 nt, Yersinia pestis
cagggauaacagcgacaguaug

SEQ ID NO: 47517 - RNA, 22 nt, Yersinia pestis
cagggcuguuuacacgcaagau

SEQ ID NO: 47518 - RNA, 22 nt, Yersinia pestis
caguagacggucauagaguugu

SEQ ID NO: 47519 - RNA, 22 nt, Yersinia pestis
cagucuggcuuuucgcaaaauu

SEQ ID NO: 47520 - RNA, 18 nt, Yersinia pestis
cagugaucaaugccucga

SEQ ID NO: 47521 - RNA, 22 nt, Yersinia pestis
cagugcauuuuucggcucuuua

SEQ ID NO: 47522 - RNA, 18 nt, Yersinia pestis
cagugccacaauaaacag

SEQ ID NO: 47523 - RNA, 19 nt, Yersinia pestis
caguggcaaaaucagcgcc

SEQ ID NO: 47524 - RNA, 22 nt, Yersinia pestis
caguggcgaucuauucauagag

SEQ ID NO: 47525 - RNA, 20 nt, Yersinia pestis
caguuaauggaaaaagcguu

SEQ ID NO: 47526 - RNA, 22 nt, Yersinia pestis
caucaacuccagugacauugac

SEQ ID NO: 47527 - RNA, 22 nt, Yersinia pestis
caucaagaugcacgucauacuc

SEQ ID NO: 47528 - RNA, 22 nt, Yersinia pestis
caucaauauagcguauugaauc

SEQ ID NO: 47529 - RNA, 21 nt, Yersinia pestis
caugaugauguccacucucgc

SEQ ID NO: 47530 - RNA, 22 nt, Yersinia pestis
cauggcguuuaaucugaagcug

SEQ ID NO: 47531 - RNA, 22 nt, Yersinia pestis
cauggcuuucgugguuugauca

SEQ ID NO: 47532 - RNA, 22 nt, Yersinia pestis
cauggguacugaaagaaccuga

SEQ ID NO: 47533 - RNA, 22 nt, Yersinia pestis
cauuacugucaacguuguggca

SEQ ID NO: 47534 - RNA, 22 nt, Yersinia pestis
cauugaaauagaauaaugucuc

SEQ ID NO: 47535 - RNA, 22 nt, Yersinia pestis
cauugguuugguacgcaagcca

SEQ ID NO: 47536 - RNA, 19 nt, Yersinia pestis
cauuuggcgcaagggccgg

SEQ ID NO: 47537 - RNA, 22 nt, Yersinia pestis
ccaauugagcaccguagcuuug

SEQ ID NO: 47538 - RNA, 20 nt, Yersinia pestis
ccacguuggacucuuggauc

SEQ ID NO: 47539 - RNA, 22 nt, Yersinia pestis
ccagauaaguuuaaaugguuuc

SEQ ID NO: 47540 - RNA, 23 nt, Yersinia pestis
ccagcgugaacuguucuucaccc

SEQ ID NO: 47541 - RNA, 22 nt, Yersinia pestis
ccagcugauuuauuccaacuga

SEQ ID NO: 47542 - RNA, 20 nt, Yersinia pestis
ccagcuugcaauucggcgau

SEQ ID NO: 47543 - RNA, 22 nt, Yersinia pestis
ccaguuggaugaucgccuggca

SEQ ID NO: 47544 - RNA, 23 nt, Yersinia pestis
cccacagguuuuuacccauccuc

SEQ ID NO: 47545 - RNA, 22 nt, Yersinia pestis
cccgauguuggguggugguaca

SEQ ID NO: 47546 - RNA, 22 nt, Yersinia pestis
cccgugucgucaacggcgcuuu

SEQ ID NO: 47547 - RNA, 22 nt, Yersinia pestis
ccgcauagcuugcaacccaucg

SEQ ID NO: 47548 - RNA, 22 nt, Yersinia pestis
ccgcauuaugggcaggggccgc

SEQ ID NO: 47549 - RNA, 22 nt, Yersinia pestis
ccgcuacuugauguacagcauu

SEQ ID NO: 47550 - RNA, 22 nt, Yersinia pestis
ccgcuugguuaacugcgucauu

SEQ ID NO: 47551 - RNA, 22 nt, Yersinia pestis
ccggcaucaagcauuuggucaa

SEQ ID NO: 47552 - RNA, 22 nt, Yersinia pestis
ccgguaucugauauugcugcuu

SEQ ID NO: 47553 - RNA, 22 nt, Yersinia pestis
ccgugcuggcgagaguggucac

SEQ ID NO: 47554 - RNA, 22 nt, Yersinia pestis
ccguuaaguuuagucuagucua

SEQ ID NO: 47555 - RNA, 22 nt, Yersinia pestis
ccuagccgaaacagugcucuac

SEQ ID NO: 47556 - RNA, 22 nt, Yersinia pestis
ccugacauaggcuagcugauaa

SEQ ID NO: 47557 - RNA, 22 nt, Yersinia pestis
ccugacuuucuguuguguuggu

SEQ ID NO: 47558 - RNA, 22 nt, Yersinia pestis
ccuguucacgauaggcgguguu

SEQ ID NO: 47559 - RNA, 22 nt, Yersinia pestis
ccuuacauccgauagccgguca

SEQ ID NO: 47560 - RNA, 22 nt, Yersinia pestis
ccuugucacgguuagcuguuau

SEQ ID NO: 47561 - RNA, 22 nt, Yersinia pestis
cgaagcgguaacccgcauucac

SEQ ID NO: 47562 - RNA, 22 nt, Yersinia pestis
cgacaucaguaggauaugcaag

SEQ ID NO: 47563 - RNA, 22 nt, Yersinia pestis
cgacgauaaacugguaagcgcc

SEQ ID NO: 47564 - RNA, 22 nt, Yersinia pestis
cgagagacgcugaauucauuga

SEQ ID NO: 47565 - RNA, 22 nt, Yersinia pestis
cgaucauuuuggacuuaauucg

SEQ ID NO: 47566 - RNA, 22 nt, Yersinia pestis
cgauugguugguaccgccaggg

SEQ ID NO: 47567 - RNA, 22 nt, Yersinia pestis
cgccauauuuugccuuccaguu

SEQ ID NO: 47568 - RNA, 22 nt, Yersinia pestis
cgcccugaacacccugccgacg

SEQ ID NO: 47569 - RNA, 22 nt, Yersinia pestis
cgccgcauuggugggugcagac

SEQ ID NO: 47570 - RNA, 22 nt, Yersinia pestis
cgccgguuucaagcgucaggua

SEQ ID NO: 47571 - RNA, 22 nt, Yersinia pestis
cgccguauucaaaauagaaaag

SEQ ID NO: 47572 - RNA, 22 nt, Yersinia pestis
cgcgauggcgguaaucuauucu

SEQ ID NO: 47573 - RNA, 22 nt, Yersinia pestis
cgcggcuaaugagagacuuuaa

SEQ ID NO: 47574 - RNA, 22 nt, Yersinia pestis
cgcuguacgccgauccgcauuu

SEQ ID NO: 47575 - RNA, 22 nt, Yersinia pestis
cggcacucuugacgaggcguuu

SEQ ID NO: 47576 - RNA, 22 nt, Yersinia pestis
cggcgagauccuuauugagggu

SEQ ID NO: 47577 - RNA, 18 nt, Yersinia pestis
cggcguaacuggccguua

SEQ ID NO: 47578 - RNA, 21 nt, Yersinia pestis
cggcuuagcccuggaauaucc

SEQ ID NO: 47579 - RNA, 22 nt, Yersinia pestis
cgggagguuccccaacaacaaa

SEQ ID NO: 47580 - RNA, 22 nt, Yersinia pestis
cggugcuguucuucgucucugu

SEQ ID NO: 47581 - RNA, 22 nt, Yersinia pestis
cgguggucucccuugaugguuu

SEQ ID NO: 47582 - RNA, 22 nt, Yersinia pestis
cguaauggcagaagccgguggu

SEQ ID NO: 47583 - RNA, 22 nt, Yersinia pestis
cgucagccguacccgcucucuc

SEQ ID NO: 47584 - RNA, 22 nt, Yersinia pestis
cguccugaaggguauggcagca

SEQ ID NO: 47585 - RNA, 22 nt, Yersinia pestis
cgucugauuuacgguacccggc

SEQ ID NO: 47586 - RNA, 22 nt, Yersinia pestis
cgugaucuucacugcgcacgau

SEQ ID NO: 47587 - RNA, 22 nt, Yersinia pestis
cguucauuaacggucgccaucc

SEQ ID NO: 47588 - RNA, 18 nt, Yersinia pestis
cguugaugcagaugaagu

SEQ ID NO: 47589 - RNA, 22 nt, Yersinia pestis
cguuucaguacuguugcgccuu

SEQ ID NO: 47590 - RNA, 22 nt, Yersinia pestis
cuacagggcuauagcaugcguc

SEQ ID NO: 47591 - RNA, 22 nt, Yersinia pestis
cucaaucauugauggcguacgg

SEQ ID NO: 47592 - RNA, 21 nt, Yersinia pestis
cucaccauuaacguuuauucu

SEQ ID NO: 47593 - RNA, 22 nt, Yersinia pestis
cucugcgacgggaagcggugcu

SEQ ID NO: 47594 - RNA, 22 nt, Yersinia pestis
cucuugaaggugaagccauccg

SEQ ID NO: 47595 - RNA, 22 nt, Yersinia pestis
cugacacgacguuugaauucag

SEQ ID NO: 47596 - RNA, 22 nt, Yersinia pestis
cugauaccgauuaucuucggua

SEQ ID NO: 47597 - RNA, 22 nt, Yersinia pestis
cugaugaauuacgugaugcggu

SEQ ID NO: 47598 - RNA, 21 nt, Yersinia pestis
cugcagugaaugaccgccuac

SEQ ID NO: 47599 - RNA, 22 nt, Yersinia pestis
cuggacaucucuuacuccguug

SEQ ID NO: 47600 - RNA, 22 nt, Yersinia pestis
cuggaugcauucaauaaaggcu

SEQ ID NO: 47601 - RNA, 22 nt, Yersinia pestis
cuggaugggagcgagagugcau

SEQ ID NO: 47602 - RNA, 22 nt, Yersinia pestis
cuggauuguuacgcggaucagc

SEQ ID NO: 47603 - RNA, 22 nt, Yersinia pestis
cuggguuaagcucgguagcgca

SEQ ID NO: 47604 - RNA, 22 nt, Yersinia pestis
cuguauugcgccaaugacugug

SEQ ID NO: 47605 - RNA, 22 nt, Yersinia pestis
cugugccgcagcuagccuauua

SEQ ID NO: 47606 - RNA, 21 nt, Yersinia pestis
cugugucagggugauauuggc

SEQ ID NO: 47607 - RNA, 21 nt, Yersinia pestis
cuguucagugcguucgauacu

SEQ ID NO: 47608 - RNA, 22 nt, Yersinia pestis
cuguuccaccgacuuuacugcg

SEQ ID NO: 47609 - RNA, 22 nt, Yersinia pestis
cuuaaucugucugguuaucagg

SEQ ID NO: 47610 - RNA, 22 nt, Yersinia pestis
cuugauaccgaugguggauuuc

SEQ ID NO: 47611 - RNA, 22 nt, Yersinia pestis
cuugccgcuucaauuugauuag

SEQ ID NO: 47612 - RNA, 22 nt, Yersinia pestis
cuuuaagacuuaugguugcggu

SEQ ID NO: 47613 - RNA, 22 nt, Yersinia pestis
cuuuggauagcaaugaguuauc

SEQ ID NO: 47614 - RNA, 22 nt, Yersinia pestis
cuuugucaauacccugaaggcc

SEQ ID NO: 47615 - RNA, 22 nt, Yersinia pestis
gaaauacuccuguucuaucgaa

SEQ ID NO: 47616 - RNA, 22 nt, Yersinia pestis
gaagauacuuauguuguuaauu

SEQ ID NO: 47617 - RNA, 22 nt, Yersinia pestis
gaagcaguuuccaaugagaaau

SEQ ID NO: 47618 - RNA, 22 nt, Yersinia pestis
gaauucauaagguagacuugga

SEQ ID NO: 47619 - RNA, 22 nt, Yersinia pestis
gaauugaacucaucaaucauug

SEQ ID NO: 47620 - RNA, 22 nt, Yersinia pestis
gaauugagaagacucaaagggg

SEQ ID NO: 47621 - RNA, 22 nt, Yersinia pestis
gacagauggucagggagucggu

SEQ ID NO: 47622 - RNA, 22 nt, Yersinia pestis
gacgcuuuugauccggcgcugg

SEQ ID NO: 47623 - RNA, 22 nt, Yersinia pestis
gacggugagucagcccgugagu

SEQ ID NO: 47624 - RNA, 22 nt, Yersinia pestis
gacgucugacaugguacguguu

SEQ ID NO: 47625 - RNA, 22 nt, Yersinia pestis
gacgugacauuaauuuaugacg

SEQ ID NO: 47626 - RNA, 22 nt, Yersinia pestis
gagagccaacagcaacggcgca

SEQ ID NO: 47627 - RNA, 22 nt, Yersinia pestis
gagcguuagcgggcggcuuagu

SEQ ID NO: 47628 - RNA, 22 nt, Yersinia pestis
gagggauuuuugcaguaguccu

SEQ ID NO: 47629 - RNA, 22 nt, Yersinia pestis
gauaagccaccagaugaaauga

SEQ ID NO: 47630 - RNA, 21 nt, Yersinia pestis
gauaucugccggauauuuuuc

SEQ ID NO: 47631 - RNA, 22 nt, Yersinia pestis
gauauucgcgcagcacagauug

SEQ ID NO: 47632 - RNA, 22 nt, Yersinia pestis
gaucaugaaaaaacuguccggu

SEQ ID NO: 47633 - RNA, 22 nt, Yersinia pestis
gaucccucguggagaggcucaa

SEQ ID NO: 47634 - RNA, 22 nt, Yersinia pestis
gaucgcugaauuacuuuccggu

SEQ ID NO: 47635 - RNA, 22 nt, Yersinia pestis
gaucucccgcaauaccguuaaa

SEQ ID NO: 47636 - RNA, 22 nt, Yersinia pestis
gaugaguuuugcguuuaaugaa

SEQ ID NO: 47637 - RNA, 21 nt, Yersinia pestis
gaugaugacgggcuuggcgcu

SEQ ID NO: 47638 - RNA, 22 nt, Yersinia pestis
gauggugcucuuuagcguuuug

SEQ ID NO: 47639 - RNA, 22 nt, Yersinia pestis
gauucagccugugacaccauca

SEQ ID NO: 47640 - RNA, 22 nt, Yersinia pestis
gauucaucgacaacaucaucgu

SEQ ID NO: 47641 - RNA, 22 nt, Yersinia pestis
gauugcagccaguguuuccccg

SEQ ID NO: 47642 - RNA, 22 nt, Yersinia pestis
gauugccauucuggggcuggua

SEQ ID NO: 47643 - RNA, 22 nt, Yersinia pestis
gcaauguccgaucgagugcagg

SEQ ID NO: 47644 - RNA, 22 nt, Yersinia pestis
gcaccugguaguuggcaccacu

SEQ ID NO: 47645 - RNA, 22 nt, Yersinia pestis
gcaggucagaccuaaguugugu

SEQ ID NO: 47646 - RNA, 22 nt, Yersinia pestis
gcaguaagaauaggcugcucau

SEQ ID NO: 47647 - RNA, 22 nt, Yersinia pestis
gcaguagaacuacagccuggac

SEQ ID NO: 47648 - RNA, 19 nt, Yersinia pestis
gcaguagguuaaauuagcc

SEQ ID NO: 47649 - RNA, 22 nt, Yersinia pestis
gcauauccugcuucuuuauaua

SEQ ID NO: 47650 - RNA, 22 nt, Yersinia pestis
gcauccggcuggccugucgcca

SEQ ID NO: 47651 - RNA, 22 nt, Yersinia pestis
gccacaagcaacauuaucgucu

SEQ ID NO: 47652 - RNA, 22 nt, Yersinia pestis
gccagguaaaacgaauggauuc

SEQ ID NO: 47653 - RNA, 22 nt, Yersinia pestis
gccagucaaggggucuaugauu

SEQ ID NO: 47654 - RNA, 22 nt, Yersinia pestis
gccauuggauaaagcacuggaa

SEQ ID NO: 47655 - RNA, 22 nt, Yersinia pestis
gcccaugaccguuuugguggcu

SEQ ID NO: 47656 - RNA, 22 nt, Yersinia pestis
gccgauguggguauguugggcc

SEQ ID NO: 47657 - RNA, 22 nt, Yersinia pestis
gccucaggcgcugauccgugag

SEQ ID NO: 47658 - RNA, 22 nt, Yersinia pestis
gccugaucggucaacaacagua

SEQ ID NO: 47659 - RNA, 23 nt, Yersinia pestis
gccuuaauuuauaucguuaaugu

SEQ ID NO: 47660 - RNA, 22 nt, Yersinia pestis
gccuuucagacugcugacaaac

SEQ ID NO: 47661 - RNA, 22 nt, Yersinia pestis
gcgaauaaguucaucgggauuc

SEQ ID NO: 47662 - RNA, 22 nt, Yersinia pestis
gcgagugaucaccgcguugugu

SEQ ID NO: 47663 - RNA, 22 nt, Yersinia pestis
gcgauaccauaugggcgggcac

SEQ ID NO: 47664 - RNA, 21 nt, Yersinia pestis
gcgauugaaagucacaccgag

SEQ ID NO: 47665 - RNA, 22 nt, Yersinia pestis
gcgauugagcggggugagucua

SEQ ID NO: 47666 - RNA, 22 nt, Yersinia pestis
gcgcguuaguacuggguagcua

SEQ ID NO: 47667 - RNA, 22 nt, Yersinia pestis
gcggcgaauucuaccuauaaga

SEQ ID NO: 47668 - RNA, 22 nt, Yersinia pestis
gcggcguuucuucaugauugca

SEQ ID NO: 47669 - RNA, 22 nt, Yersinia pestis
gcgguuaucugcacuguggcca

SEQ ID NO: 47670 - RNA, 21 nt, Yersinia pestis
gcuaaaggugcaauccucacu

SEQ ID NO: 47671 - RNA, 21 nt, Yersinia pestis
gcuaagaagucuugauacuac

SEQ ID NO: 47672 - RNA, 22 nt, Yersinia pestis
gcuauguaaacgacuuuaucga

SEQ ID NO: 47673 - RNA, 18 nt, Yersinia pestis
gcucacugauuaacgcac

SEQ ID NO: 47674 - RNA, 20 nt, Yersinia pestis
gcucuucggcaauaacagcu

SEQ ID NO: 47675 - RNA, 22 nt, Yersinia pestis
gcugauccaaacgcuggcgcag

SEQ ID NO: 47676 - RNA, 22 nt, Yersinia pestis
gcugcuuaaacccgguaugauu

SEQ ID NO: 47677 - RNA, 22 nt, Yersinia pestis
gcuggcgaguugagggagucug

SEQ ID NO: 47678 - RNA, 22 nt, Yersinia pestis
gcuggcugagaucggcaaucug

SEQ ID NO: 47679 - RNA, 22 nt, Yersinia pestis
gcuguagcugaggguuuguuga

SEQ ID NO: 47680 - RNA, 22 nt, Yersinia pestis
gcuuaugcauuaggugcgucuu

SEQ ID NO: 47681 - RNA, 23 nt, Yersinia pestis
ggagauauuuugcguguagccgg

SEQ ID NO: 47682 - RNA, 18 nt, Yersinia pestis
ggagaugcaugaauuggc

SEQ ID NO: 47683 - RNA, 22 nt, Yersinia pestis
ggagugcuuccgccaaccagac

SEQ ID NO: 47684 - RNA, 22 nt, Yersinia pestis
ggauaagugcuguagucuuugu

SEQ ID NO: 47685 - RNA, 22 nt, Yersinia pestis
ggaugccguagauuuuuuugcc

SEQ ID NO: 47686 - RNA, 22 nt, Yersinia pestis
ggcaaauaucauuuauucgucg

SEQ ID NO: 47687 - RNA, 22 nt, Yersinia pestis
ggcaacauucagcggaacggau

SEQ ID NO: 47688 - RNA, 22 nt, Yersinia pestis
ggcaagacgguauuuaggcgcu

SEQ ID NO: 47689 - RNA, 20 nt, Yersinia pestis
ggcaugacucauugcuucaa

SEQ ID NO: 47690 - RNA, 22 nt, Yersinia pestis
ggccauuggcagcuuuauauau

SEQ ID NO: 47691 - RNA, 22 nt, Yersinia pestis
ggccgaugcugauauuuuugua

SEQ ID NO: 47692 - RNA, 17 nt, Yersinia pestis
ggccgguaagcuaccaa

SEQ ID NO: 47693 - RNA, 22 nt, Yersinia pestis
ggccgucagggucaggauauca

SEQ ID NO: 47694 - RNA, 19 nt, Yersinia pestis
ggccuguacggauuggcga

SEQ ID NO: 47695 - RNA, 22 nt, Yersinia pestis
ggccuucaggguauugacaaag

SEQ ID NO: 47696 - RNA, 22 nt, Yersinia pestis
ggcgauugauuuauuauucuga

SEQ ID NO: 47697 - RNA, 22 nt, Yersinia pestis
ggcgcaauuggguugagcuaua

SEQ ID NO: 47698 - RNA, 22 nt, Yersinia pestis
ggcgcagaaauugauugaugau

SEQ ID NO: 47699 - RNA, 22 nt, Yersinia pestis
ggcguaauacaccauugauaag

SEQ ID NO: 47700 - RNA, 22 nt, Yersinia pestis
ggcguauuaacauuggcuggug

SEQ ID NO: 47701 - RNA, 22 nt, Yersinia pestis
ggcuaauagcgucaaaaguaca

SEQ ID NO: 47702 - RNA, 22 nt, Yersinia pestis
ggcucaaugauugaauuuggcg

SEQ ID NO: 47703 - RNA, 22 nt, Yersinia pestis
ggcucacuggaagccgguuauc

SEQ ID NO: 47704 - RNA, 22 nt, Yersinia pestis
ggcugcuaauaccaauaauaga

SEQ ID NO: 47705 - RNA, 19 nt, Yersinia pestis
gggauuuauuuagccugcu

SEQ ID NO: 47706 - RNA, 22 nt, Yersinia pestis
ggguuuacuuugcuuaaaguca

SEQ ID NO: 47707 - RNA, 22 nt, Yersinia pestis
gguaauggcgaaagcuccgcag

SEQ ID NO: 47708 - RNA, 22 nt, Yersinia pestis
gguaucgguauugaugaauugu

SEQ ID NO: 47709 - RNA, 22 nt, Yersinia pestis
gguauuccaugugguugcggcu

SEQ ID NO: 47710 - RNA, 22 nt, Yersinia pestis
gguauugauguugguuggaagg

SEQ ID NO: 47711 - RNA, 22 nt, Yersinia pestis
ggucauugccaucgccacuuuu

SEQ ID NO: 47712 - RNA, 22 nt, Yersinia pestis
ggucgcaagaugcuaccgaugg

SEQ ID NO: 47713 - RNA, 22 nt, Yersinia pestis
ggugcaacuaaacgcccggacu

SEQ ID NO: 47714 - RNA, 22 nt, Yersinia pestis
ggugccuuaucuggucgcgcca

SEQ ID NO: 47715 - RNA, 22 nt, Yersinia pestis
gguguagacauuuuugcgcuua

SEQ ID NO: 47716 - RNA, 22 nt, Yersinia pestis
gguguccggccaugaagcgauu

SEQ ID NO: 47717 - RNA, 22 nt, Yersinia pestis
gguuaucgguggucuaaaaaaa

SEQ ID NO: 47718 - RNA, 22 nt, Yersinia pestis
gguucacuuauuauggaauugg

SEQ ID NO: 47719 - RNA, 22 nt, Yersinia pestis
gguugcucaauugguaccucag

SEQ ID NO: 47720 - RNA, 22 nt, Yersinia pestis
gguuuaccagaaugacacauua

SEQ ID NO: 47721 - RNA, 23 nt, Yersinia pestis
guacacgaacgcgcaggcuuggc

SEQ ID NO: 47722 - RNA, 22 nt, Yersinia pestis
guauugauguauuacggcaagu

SEQ ID NO: 47723 - RNA, 23 nt, Yersinia pestis
gucagcagauuaccuauuucggg

SEQ ID NO: 47724 - RNA, 22 nt, Yersinia pestis
gucagugcaucagaggaacagu

SEQ ID NO: 47725 - RNA, 22 nt, Yersinia pestis
guccagcuaagggguauuccca

SEQ ID NO: 47726 - RNA, 22 nt, Yersinia pestis
guccauaaaaauagcccugucu

SEQ ID NO: 47727 - RNA, 22 nt, Yersinia pestis
gucgggcugauuuguagcgguu

SEQ ID NO: 47728 - RNA, 22 nt, Yersinia pestis
gucuucaccuccggugcgaccg

SEQ ID NO: 47729 - RNA, 22 nt, Yersinia pestis
gugaacaguacuuugcccguag

SEQ ID NO: 47730 - RNA, 22 nt, Yersinia pestis
gugacugaggaugauuguggua

SEQ ID NO: 47731 - RNA, 22 nt, Yersinia pestis
gugcaguaucgaucugagcuug

SEQ ID NO: 47732 - RNA, 21 nt, Yersinia pestis
gugcaguuuuuuauugaugua

SEQ ID NO: 47733 - RNA, 18 nt, Yersinia pestis
gugccgaucaccgggugc

SEQ ID NO: 47734 - RNA, 22 nt, Yersinia pestis
guggaaauuaucgaguuaccag

SEQ ID NO: 47735 - RNA, 22 nt, Yersinia pestis
guggaucacuuuucauccgucg

SEQ ID NO: 47736 - RNA, 22 nt, Yersinia pestis
guggcaggaucugucuccucau

SEQ ID NO: 47737 - RNA, 22 nt, Yersinia pestis
guggcggaaugcgcggcaucac

SEQ ID NO: 47738 - RNA, 22 nt, Yersinia pestis
guggugcaguuaugguugaucu

SEQ ID NO: 47739 - RNA, 22 nt, Yersinia pestis
guguucauauucaugguuucaa

SEQ ID NO: 47740 - RNA, 22 nt, Yersinia pestis
guuagguauugagagaguuuaa

SEQ ID NO: 47741 - RNA, 22 nt, Yersinia pestis
guugcugcucaauuuuuugcac

SEQ ID NO: 47742 - RNA, 22 nt, Yersinia pestis
guuguagcuguuaucucgauuu

SEQ ID NO: 47743 - RNA, 22 nt, Yersinia pestis
guuugccgaucauuauguuaac

SEQ ID NO: 47744 - RNA, 22 nt, Yersinia pestis
uaaacguguggccgugaucggg

SEQ ID NO: 47745 - RNA, 22 nt, Yersinia pestis
uaaacuggcuaauacauucgcu

SEQ ID NO: 47746 - RNA, 22 nt, Yersinia pestis
uaaagcaacggugguagcgaug

SEQ ID NO: 47747 - RNA, 22 nt, Yersinia pestis
uaacagcugcuggccacugcgu

SEQ ID NO: 47748 - RNA, 21 nt, Yersinia pestis
uaacagggcuaguucagcucg

SEQ ID NO: 47749 - RNA, 22 nt, Yersinia pestis
uaaccucagauaggagacaggg

SEQ ID NO: 47750 - RNA, 22 nt, Yersinia pestis
uaacggcucuguuucagugggu

SEQ ID NO: 47751 - RNA, 22 nt, Yersinia pestis
uaacugauauauaaauuaaggc

SEQ ID NO: 47752 - RNA, 22 nt, Yersinia pestis
uaaguugucuguuugcuguaua

SEQ ID NO: 47753 - RNA, 22 nt, Yersinia pestis
uaaugguaaauucauaauccac

SEQ ID NO: 47754 - RNA, 22 nt, Yersinia pestis
uacaccauuccugaaaucaguu

SEQ ID NO: 47755 - RNA, 22 nt, Yersinia pestis
uacaggcucuaaucguauugug

SEQ ID NO: 47756 - RNA, 22 nt, Yersinia pestis
uaccgcauuacuaauacucauu

SEQ ID NO: 47757 - RNA, 22 nt, Yersinia pestis
uaccgccgucagguucaggugu

SEQ ID NO: 47758 - RNA, 22 nt, Yersinia pestis
uaccgcucucugucacucgccg

SEQ ID NO: 47759 - RNA, 22 nt, Yersinia pestis
uaccgguuuaaauggcuugcca

SEQ ID NO: 47760 - RNA, 22 nt, Yersinia pestis
uacgcugaguugcaaaucuuga

SEQ ID NO: 47761 - RNA, 22 nt, Yersinia pestis
uacggcagcgaucaucagcggu

SEQ ID NO: 47762 - RNA, 22 nt, Yersinia pestis
uacguucgcggaucaccgguuc

SEQ ID NO: 47763 - RNA, 22 nt, Yersinia pestis
uacguugauuagacggagggau

SEQ ID NO: 47764 - RNA, 22 nt, Yersinia pestis
uacuggauguagauuauaauga

SEQ ID NO: 47765 - RNA, 22 nt, Yersinia pestis
uacuggugagauaggcucugga

SEQ ID NO: 47766 - RNA, 22 nt, Yersinia pestis
uacuugaaucuauuaugauagu

SEQ ID NO: 47767 - RNA, 22 nt, Yersinia pestis
uagcacaucaccggguugcagu

SEQ ID NO: 47768 - RNA, 22 nt, Yersinia pestis
uagcaguuuuuggucacugcgg

SEQ ID NO: 47769 - RNA, 16 nt, Yersinia pestis
uaggcaaaaacucauu

SEQ ID NO: 47770 - RNA, 22 nt, Yersinia pestis
uaggcgaugaucaggucacggu

SEQ ID NO: 47771 - RNA, 22 nt, Yersinia pestis
uaggugcuuauggugaagguaa

SEQ ID NO: 47772 - RNA, 22 nt, Yersinia pestis
uauaccaaccugcaaggaugcc

SEQ ID NO: 47773 - RNA, 22 nt, Yersinia pestis
uaucagcgaagcuacgcauauu

SEQ ID NO: 47774 - RNA, 22 nt, Yersinia pestis
uauccgauauucaucuuggauu

SEQ ID NO: 47775 - RNA, 22 nt, Yersinia pestis
uaucgcguuacuggcgggcgug

SEQ ID NO: 47776 - RNA, 22 nt, Yersinia pestis
uaucgugaugaccccgguuauc

SEQ ID NO: 47777 - RNA, 22 nt, Yersinia pestis
uaucugugguugacagacaaag

SEQ ID NO: 47778 - RNA, 22 nt, Yersinia pestis
uaugucacacaguggguuauug

SEQ ID NO: 47779 - RNA, 22 nt, Yersinia pestis
uauuacacaaucuggauaucaa

SEQ ID NO: 47780 - RNA, 22 nt, Yersinia pestis
uauucugaacuggaagaagagu

SEQ ID NO: 47781 - RNA, 22 nt, Yersinia pestis
uauugcgcuuuuguuagcgggu

SEQ ID NO: 47782 - RNA, 22 nt, Yersinia pestis
ucaacaucguaccugaacgauc

SEQ ID NO: 47783 - RNA, 22 nt, Yersinia pestis
ucaagucguuggcucagugacu

SEQ ID NO: 47784 - RNA, 22 nt, Yersinia pestis
ucacaaaguucgucuguuguug

SEQ ID NO: 47785 - RNA, 22 nt, Yersinia pestis
ucacaucacgcagguggcuuau

SEQ ID NO: 47786 - RNA, 22 nt, Yersinia pestis
ucacauugccgguaacgcguua

SEQ ID NO: 47787 - RNA, 22 nt, Yersinia pestis
ucacccugaauuugguguguug

SEQ ID NO: 47788 - RNA, 22 nt, Yersinia pestis
ucacgguuucccguacuuuuaa

SEQ ID NO: 47789 - RNA, 20 nt, Yersinia pestis
ucacucacuuauucgccugu

SEQ ID NO: 47790 - RNA, 22 nt, Yersinia pestis
ucagauccugucaccuucuuca

SEQ ID NO: 47791 - RNA, 22 nt, Yersinia pestis
ucaguacggaucgcauccguga

SEQ ID NO: 47792 - RNA, 22 nt, Yersinia pestis
ucagugaacucgaugauaauca

SEQ ID NO: 47793 - RNA, 23 nt, Yersinia pestis
ucaguguuggaucuuguguuggc

SEQ ID NO: 47794 - RNA, 22 nt, Yersinia pestis
ucaguuaaucugagugcgcuau

SEQ ID NO: 47795 - RNA, 22 nt, Yersinia pestis
ucaguugaucaacuuuagcguu

SEQ ID NO: 47796 - RNA, 22 nt, Yersinia pestis
ucaguuuaucgggcagguguua

SEQ ID NO: 47797 - RNA, 22 nt, Yersinia pestis
ucaucaacugcuuggcauacgg

SEQ ID NO: 47798 - RNA, 22 nt, Yersinia pestis
ucauccaucugucgcccgguca

SEQ ID NO: 47799 - RNA, 22 nt, Yersinia pestis
ucaucggaaggaugagacgaau

SEQ ID NO: 47800 - RNA, 21 nt, Yersinia pestis
ucauuucaucugguggcuuau

SEQ ID NO: 47801 - RNA, 17 nt, Yersinia pestis
uccagugcacucaauac

SEQ ID NO: 47802 - RNA, 22 nt, Yersinia pestis
uccauugaacccgugucauuaa

SEQ ID NO: 47803 - RNA, 22 nt, Yersinia pestis
uccgccaaccaaugucgcuaaa

SEQ ID NO: 47804 - RNA, 22 nt, Yersinia pestis
uccuuggguggaauggguuuau

SEQ ID NO: 47805 - RNA, 22 nt, Yersinia pestis
ucgauuauuacccggcgaaucu

SEQ ID NO: 47806 - RNA, 22 nt, Yersinia pestis
ucgcagaugaugcaagggcaca

SEQ ID NO: 47807 - RNA, 22 nt, Yersinia pestis
ucgcuacagcuuuaagcccgaa

SEQ ID NO: 47808 - RNA, 22 nt, Yersinia pestis
ucgcuauacgcaaauccgggcu

SEQ ID NO: 47809 - RNA, 19 nt, Yersinia pestis
ucgcugcgccguauugauc

SEQ ID NO: 47810 - RNA, 22 nt, Yersinia pestis
ucgcuuguggugcuaucucugg

SEQ ID NO: 47811 - RNA, 22 nt, Yersinia pestis
ucggcaccuuugaucgguaacu

SEQ ID NO: 47812 - RNA, 22 nt, Yersinia pestis
ucggcgauaaccgucaggggca

SEQ ID NO: 47813 - RNA, 22 nt, Yersinia pestis
ucguauuagagcguggcuccag

SEQ ID NO: 47814 - RNA, 22 nt, Yersinia pestis
ucgugugaagaaaguuuaugua

SEQ ID NO: 47815 - RNA, 22 nt, Yersinia pestis
ucguuaugccaacaaugauaug

SEQ ID NO: 47816 - RNA, 22 nt, Yersinia pestis
ucguucagugaucaccuaauca

SEQ ID NO: 47817 - RNA, 18 nt, Yersinia pestis
ucucauugccauuuaaau

SEQ ID NO: 47818 - RNA, 22 nt, Yersinia pestis
ucucuggaagagaacauugaaa

SEQ ID NO: 47819 - RNA, 22 nt, Yersinia pestis
ucugguuaguggcagugauauc

SEQ ID NO: 47820 - RNA, 22 nt, Yersinia pestis
ugaaacagcgcuggcagcagca

SEQ ID NO: 47821 - RNA, 20 nt, Yersinia pestis
ugaaauccuauuuuugcgca

SEQ ID NO: 47822 - RNA, 22 nt, Yersinia pestis
ugaacaguucucugugcuggcc

SEQ ID NO: 47823 - RNA, 22 nt, Yersinia pestis
ugaagagcguaucgacgcgcug

SEQ ID NO: 47824 - RNA, 20 nt, Yersinia pestis
ugaagccuugcucaauggcc

SEQ ID NO: 47825 - RNA, 22 nt, Yersinia pestis
ugaagcugcccauaaauuggau

SEQ ID NO: 47826 - RNA, 23 nt, Yersinia pestis
ugaaggcgucgaucauccgcagg

SEQ ID NO: 47827 - RNA, 22 nt, Yersinia pestis
ugaauuucacaucacgacauuu

SEQ ID NO: 47828 - RNA, 22 nt, Yersinia pestis
ugacgcguguugcuauuccaau

SEQ ID NO: 47829 - RNA, 22 nt, Yersinia pestis
ugacggcuuaaugagcacgcuu

SEQ ID NO: 47830 - RNA, 22 nt, Yersinia pestis
ugacuaaucgacggcugccuca

SEQ ID NO: 47831 - RNA, 22 nt, Yersinia pestis
ugacuaucaugagugcggcaac

SEQ ID NO: 47832 - RNA, 22 nt, Yersinia pestis
ugagaaugccguuguguuuucu

SEQ ID NO: 47833 - RNA, 22 nt, Yersinia pestis
ugaggcaggaaaucggcucuuu

SEQ ID NO: 47834 - RNA, 22 nt, Yersinia pestis
ugaucaaauuuuuguuacgacg

SEQ ID NO: 47835 - RNA, 22 nt, Yersinia pestis
ugaucacuauuuuucaccgauu

SEQ ID NO: 47836 - RNA, 22 nt, Yersinia pestis
ugauccgcucuuuaugacgcac

SEQ ID NO: 47837 - RNA, 21 nt, Yersinia pestis
ugaucggccagugccagcgcu

SEQ ID NO: 47838 - RNA, 23 nt, Yersinia pestis
ugaugcagagcuggauaugcguc

SEQ ID NO: 47839 - RNA, 23 nt, Yersinia pestis
ugauggcgagugagcugugucga

SEQ ID NO: 47840 - RNA, 22 nt, Yersinia pestis
ugaugugaucaccauggcgaaa

SEQ ID NO: 47841 - RNA, 22 nt, Yersinia pestis
ugauucgggcuguuuguuuacu

SEQ ID NO: 47842 - RNA, 22 nt, Yersinia pestis
ugcaaugguuccgauuuucauu

SEQ ID NO: 47843 - RNA, 22 nt, Yersinia pestis
ugcacugaaccccagaucuugg

SEQ ID NO: 47844 - RNA, 22 nt, Yersinia pestis
ugcagcuuggcgucugacgggu

SEQ ID NO: 47845 - RNA, 22 nt, Yersinia pestis
ugccaagcacuuugcggcuuua

SEQ ID NO: 47846 - RNA, 18 nt, Yersinia pestis
ugccacggguguuauugg

SEQ ID NO: 47847 - RNA, 22 nt, Yersinia pestis
ugccagauccccagccuucacu

SEQ ID NO: 47848 - RNA, 22 nt, Yersinia pestis
ugccauguuuaucgccauguug

SEQ ID NO: 47849 - RNA, 21 nt, Yersinia pestis
ugccauugagaacggcgugga

SEQ ID NO: 47850 - RNA, 23 nt, Yersinia pestis
ugcccguggcacaacuguguggc

SEQ ID NO: 47851 - RNA, 22 nt, Yersinia pestis
ugccugaacaauuuuuguggcg

SEQ ID NO: 47852 - RNA, 22 nt, Yersinia pestis
ugccugucguuccgguacauga

SEQ ID NO: 47853 - RNA, 22 nt, Yersinia pestis
ugcggccuaaauaccgcuugcc

SEQ ID NO: 47854 - RNA, 22 nt, Yersinia pestis
ugcggcgauuuucuggugaacc

SEQ ID NO: 47855 - RNA, 22 nt, Yersinia pestis
ugcgugaauuaaucccaggugc

SEQ ID NO: 47856 - RNA, 22 nt, Yersinia pestis
ugcugccaucuauuuagccagc

SEQ ID NO: 47857 - RNA, 22 nt, Yersinia pestis
ugcugcgaguuucgauaucacu

SEQ ID NO: 47858 - RNA, 20 nt, Yersinia pestis
ugcuggcacugaugggggca

SEQ ID NO: 47859 - RNA, 22 nt, Yersinia pestis
ugcuggcgucuucagugacuuu

SEQ ID NO: 47860 - RNA, 22 nt, Yersinia pestis
uggaaguuauggggaauguuuu

SEQ ID NO: 47861 - RNA, 18 nt, Yersinia pestis
uggaaugccaugauaguu

SEQ ID NO: 47862 - RNA, 22 nt, Yersinia pestis
uggacugaugagccgcuuauuu

SEQ ID NO: 47863 - RNA, 22 nt, Yersinia pestis
uggagcaauaucuuggaacuuc

SEQ ID NO: 47864 - RNA, 22 nt, Yersinia pestis
uggauccuuuagggagcgguau

SEQ ID NO: 47865 - RNA, 22 nt, Yersinia pestis
uggcagcaugucguuccucggu

SEQ ID NO: 47866 - RNA, 22 nt, Yersinia pestis
uggcaucaagcacguuauugcu

SEQ ID NO: 47867 - RNA, 22 nt, Yersinia pestis
uggcauugcuauugguggucgu

SEQ ID NO: 47868 - RNA, 22 nt, Yersinia pestis
uggccuggguguggaugccuuu

SEQ ID NO: 47869 - RNA, 22 nt, Yersinia pestis
uggccuuuuaauauauugaagc

SEQ ID NO: 47870 - RNA, 22 nt, Yersinia pestis
uggcgaugguuggccgacuaga

SEQ ID NO: 47871 - RNA, 22 nt, Yersinia pestis
uggcggaguguuucauccgugg

SEQ ID NO: 47872 - RNA, 16 nt, Yersinia pestis
uggcuaugguaauccu

SEQ ID NO: 47873 - RNA, 22 nt, Yersinia pestis
uggcucuuuacgaucaagugga

SEQ ID NO: 47874 - RNA, 22 nt, Yersinia pestis
uggcugccagcacuguuuaucc

SEQ ID NO: 47875 - RNA, 19 nt, Yersinia pestis
ugggcaauaaagagguugu

SEQ ID NO: 47876 - RNA, 22 nt, Yersinia pestis
ugguagccuuccauuugauccc

SEQ ID NO: 47877 - RNA, 22 nt, Yersinia pestis
ugguauaggccugaaaauaagc

SEQ ID NO: 47878 - RNA, 22 nt, Yersinia pestis
ugguugcaccgggcgcugaaag

SEQ ID NO: 47879 - RNA, 20 nt, Yersinia pestis
ugguuuaaccaguuccgucu

SEQ ID NO: 47880 - RNA, 22 nt, Yersinia pestis
uguaaaguggcucaugucagua

SEQ ID NO: 47881 - RNA, 22 nt, Yersinia pestis
uguaaggaugcaaucaggggca

SEQ ID NO: 47882 - RNA, 22 nt, Yersinia pestis
uguaucgucguuuacgcaaagg

SEQ ID NO: 47883 - RNA, 22 nt, Yersinia pestis
ugucacugauuuuuaucguugc

SEQ ID NO: 47884 - RNA, 22 nt, Yersinia pestis
ugucagugagaugguucugcgu

SEQ ID NO: 47885 - RNA, 22 nt, Yersinia pestis
ugucgaugaacugcguuuauau

SEQ ID NO: 47886 - RNA, 22 nt, Yersinia pestis
ugucgguaaccguuacggggca

SEQ ID NO: 47887 - RNA, 22 nt, Yersinia pestis
ugucguuaauucaaaguaaugc

SEQ ID NO: 47888 - RNA, 22 nt, Yersinia pestis
ugucugaacuugcuuuagugga

SEQ ID NO: 47889 - RNA, 22 nt, Yersinia pestis
ugugacuucaacaugccgcugc

SEQ ID NO: 47890 - RNA, 22 nt, Yersinia pestis
ugugagucacaguauuaaaaug

SEQ ID NO: 47891 - RNA, 22 nt, Yersinia pestis
ugugauccgcaugagugaugcg

SEQ ID NO: 47892 - RNA, 22 nt, Yersinia pestis
ugugccacuacauggcaauuga

SEQ ID NO: 47893 - RNA, 22 nt, Yersinia pestis
ugugcugauaauaggugugaug

SEQ ID NO: 47894 - RNA, 22 nt, Yersinia pestis
uguugaccacuccacggcuuau

SEQ ID NO: 47895 - RNA, 18 nt, Yersinia pestis
uguugcagcguaagccac

SEQ ID NO: 47896 - RNA, 22 nt, Yersinia pestis
uguugcauugccugaaguaauu

SEQ ID NO: 47897 - RNA, 22 nt, Yersinia pestis
uguugccaaaggagcucagcau

SEQ ID NO: 47898 - RNA, 22 nt, Yersinia pestis
uuaacgguaauuuugguguuuc

SEQ ID NO: 47899 - RNA, 19 nt, Yersinia pestis
uuaccggcaaauuaucuga

SEQ ID NO: 47900 - RNA, 22 nt, Yersinia pestis
uuaccgguguucgcgguugaug

SEQ ID NO: 47901 - RNA, 22 nt, Yersinia pestis
uuaccguucugagcaaagggcc

SEQ ID NO: 47902 - RNA, 22 nt, Yersinia pestis
uuacggugaucggaauuuguuc

SEQ ID NO: 47903 - RNA, 22 nt, Yersinia pestis
uuacugacgcguccagccguug

SEQ ID NO: 47904 - RNA, 22 nt, Yersinia pestis
uuacuggcggguaguguucuuc

SEQ ID NO: 47905 - RNA, 22 nt, Yersinia pestis
uuagcucgacguuaucugccgu

SEQ ID NO: 47906 - RNA, 22 nt, Yersinia pestis
uuaggccggccaauuggcgcuu

SEQ ID NO: 47907 - RNA, 22 nt, Yersinia pestis
uuauagguagaauucgccgcgu

SEQ ID NO: 47908 - RNA, 22 nt, Yersinia pestis
uuauuggcagucuugagcuaac

SEQ ID NO: 47909 - RNA, 22 nt, Yersinia pestis
uucacuugauucaagauacccg

SEQ ID NO: 47910 - RNA, 22 nt, Yersinia pestis
uucgaugaaagaggcauuagaa

SEQ ID NO: 47911 - RNA, 22 nt, Yersinia pestis
uucgccagaucguucaggaagc

SEQ ID NO: 47912 - RNA, 22 nt, Yersinia pestis
uucgcuaaacgcuugcuggcag

SEQ ID NO: 47913 - RNA, 22 nt, Yersinia pestis
uucgggauagggaaaaguuaac

SEQ ID NO: 47914 - RNA, 22 nt, Yersinia pestis
uugacaugcaguucagucagga

SEQ ID NO: 47915 - RNA, 20 nt, Yersinia pestis
uugaguaaccgggcuuuuuu

SEQ ID NO: 47916 - RNA, 20 nt, Yersinia pestis
uugagugaccgggcuuuuuu

SEQ ID NO: 47917 - RNA, 22 nt, Yersinia pestis
uugauagcguugaagcgcaagc

SEQ ID NO: 47918 - RNA, 22 nt, Yersinia pestis
uugauaguagauaacugauagu

SEQ ID NO: 47919 - RNA, 22 nt, Yersinia pestis
uugaucauggcugagguguguc

SEQ ID NO: 47920 - RNA, 22 nt, Yersinia pestis
uugcaaugaauguuaauggugu

SEQ ID NO: 47921 - RNA, 22 nt, Yersinia pestis
uugcaguuuagccagcaacuga

SEQ ID NO: 47922 - RNA, 22 nt, Yersinia pestis
uugccaacuuugucucgggcuu

SEQ ID NO: 47923 - RNA, 22 nt, Yersinia pestis
uugccagcauucaacagcacau

SEQ ID NO: 47924 - RNA, 22 nt, Yersinia pestis
uugcgaccaucacccugacugc

SEQ ID NO: 47925 - RNA, 22 nt, Yersinia pestis
uugcggauauugccaagcggga

SEQ ID NO: 47926 - RNA, 22 nt, Yersinia pestis
uugcugaaauuaggcuucaccg

SEQ ID NO: 47927 - RNA, 20 nt, Yersinia pestis
uugcugaucaauuagccggu

SEQ ID NO: 47928 - RNA, 22 nt, Yersinia pestis
uugcuucagccacguuugcuga

SEQ ID NO: 47929 - RNA, 23 nt, Yersinia pestis
uuggccaugcucguuuuacauag

SEQ ID NO: 47930 - RNA, 22 nt, Yersinia pestis
uuggccgccuaacaugccugcc

SEQ ID NO: 47931 - RNA, 20 nt, Yersinia pestis
uuggcgagcuggaacgcgcu

SEQ ID NO: 47932 - RNA, 22 nt, Yersinia pestis
uuggcgcagguaauaugcgguu

SEQ ID NO: 47933 - RNA, 22 nt, Yersinia pestis
uuggcgcugaggcagugaagca

SEQ ID NO: 47934 - RNA, 18 nt, Yersinia pestis
uuggcggcauccauccac

SEQ ID NO: 47935 - RNA, 22 nt, Yersinia pestis
uuggcugaaguuaaucucaaug

SEQ ID NO: 47936 - RNA, 22 nt, Yersinia pestis
uuuaaggucauggaaggugaaa

SEQ ID NO: 47937 - RNA, 22 nt, Yersinia pestis
uuucagacaaguuagugccuaa

SEQ ID NO: 47938 - RNA, 22 nt, Yersinia pestis
uuuccagcggaauuucaagcug

SEQ ID NO: 47939 - RNA, 22 nt, Yersinia pestis
uuugaaucaggcauuaaucaaa

SEQ ID NO: 47940 - RNA, 19 nt, Yersinia pestis
uuugaucaccaguuucggu

SEQ ID NO: 47941 - RNA, 22 nt, Yersinia pestis
uuugccgauaauuaacauaagc

SEQ ID NO: 47942 - RNA, 20 nt, Yersinia pestis
uuuggcauggugacugcggu

SEQ ID NO: 47943 - RNA, 22 nt, Yersinia pestis
uuuggcaugugggcuaucagga

SEQ ID NO: 47944 - RNA, 22 nt, Yersinia pestis
uuugugcaggaguaaaaccggg

SEQ ID NO: 47945 - RNA, 22 nt, Yersinia pestis
aaacgucuugauagcgaccaga

SEQ ID NO: 47946 - RNA, 22 nt, Yersinia pestis
aaacucguaauaucuuuaaagc

SEQ ID NO: 47947 - RNA, 22 nt, Yersinia pestis
aaacuuugaacaaacgcuuguu

SEQ ID NO: 47948 - RNA, 19 nt, Yersinia pestis
aaaguaccggucgugaaua

SEQ ID NO: 47949 - RNA, 22 nt, Yersinia pestis
aaaguuggcacuacucuuaauu

SEQ ID NO: 47950 - RNA, 19 nt, Yersinia pestis
aaaugagucuugcagagau

SEQ ID NO: 47951 - RNA, 20 nt, Yersinia pestis
aacauaucuugcacggguga

SEQ ID NO: 47952 - RNA, 22 nt, Yersinia pestis
aaccaucugaucacgggugacc

SEQ ID NO: 47953 - RNA, 22 nt, Yersinia pestis
aaccauugacgggggcuuccag

SEQ ID NO: 47954 - RNA, 22 nt, Yersinia pestis
aaccggauaugucacauguuca

SEQ ID NO: 47955 - RNA, 22 nt, Yersinia pestis
aaccguuuggugcugcucaccu

SEQ ID NO: 47956 - RNA, 22 nt, Yersinia pestis
aacugcuccuuuagccgugauu

SEQ ID NO: 47957 - RNA, 22 nt, Yersinia pestis
aacuugaaguaugggggguaua

SEQ ID NO: 47958 - RNA, 22 nt, Yersinia pestis
aagaugacgauuuugguuucug

SEQ ID NO: 47959 - RNA, 22 nt, Yersinia pestis
aagauuacguucaccgcauugg

SEQ ID NO: 47960 - RNA, 22 nt, Yersinia pestis
aagccuuuauugaaugcaucca

SEQ ID NO: 47961 - RNA, 20 nt, Yersinia pestis
aagcguuuguaguaacguuu

SEQ ID NO: 47962 - RNA, 22 nt, Yersinia pestis
aaggauguaugcuugaaggcuu

SEQ ID NO: 47963 - RNA, 22 nt, Yersinia pestis
aaggcuaugucauuaaagaaua

SEQ ID NO: 47964 - RNA, 22 nt, Yersinia pestis
aagggugccuggcuaacgcucc

SEQ ID NO: 47965 - RNA, 22 nt, Yersinia pestis
aauaacguuagaaaucaacaua

SEQ ID NO: 47966 - RNA, 22 nt, Yersinia pestis
aauaagcgaauuugguugucau

SEQ ID NO: 47967 - RNA, 22 nt, Yersinia pestis
aaucggugcugacaccacagga

SEQ ID NO: 47968 - RNA, 22 nt, Yersinia pestis
aaugaagccaggguugcagcaa

SEQ ID NO: 47969 - RNA, 22 nt, Yersinia pestis
aaugacugagauuauuaacagu

SEQ ID NO: 47970 - RNA, 22 nt, Yersinia pestis
aaugaguauaggcuggccuggg

SEQ ID NO: 47971 - RNA, 23 nt, Yersinia pestis
aaugccaggcaguguauucauac

SEQ ID NO: 47972 - RNA, 22 nt, Yersinia pestis
aaugcggggguagucauacaaa

SEQ ID NO: 47973 - RNA, 22 nt, Yersinia pestis
aauggauugauacugaucugau

SEQ ID NO: 47974 - RNA, 17 nt, Yersinia pestis
aaugguugguuucugac

SEQ ID NO: 47975 - RNA, 22 nt, Yersinia pestis
aauguaguguuguuaauguucu

SEQ ID NO: 47976 - RNA, 22 nt, Yersinia pestis
aauguauggcggugaagucggu

SEQ ID NO: 47977 - RNA, 22 nt, Yersinia pestis
aaugucuuuauugaucgauuca

SEQ ID NO: 47978 - RNA, 22 nt, Yersinia pestis
acaacgguaagaaagccgggcg

SEQ ID NO: 47979 - RNA, 22 nt, Yersinia pestis
acaaggucugaaugccgauaug

SEQ ID NO: 47980 - RNA, 19 nt, Yersinia pestis
acagcguuucggugucuuc

SEQ ID NO: 47981 - RNA, 22 nt, Yersinia pestis
acaggcugacgaauugaugauu

SEQ ID NO: 47982 - RNA, 22 nt, Yersinia pestis
acaggugaaacgcuggggcuga

SEQ ID NO: 47983 - RNA, 22 nt, Yersinia pestis
accaauuguaaauaauaacuag

SEQ ID NO: 47984 - RNA, 22 nt, Yersinia pestis
accacgaguacggcugcggcga

SEQ ID NO: 47985 - RNA, 22 nt, Yersinia pestis
accacgcucauguugcugaaau

SEQ ID NO: 47986 - RNA, 22 nt, Yersinia pestis
acccugacgggcaauuugccgc

SEQ ID NO: 47987 - RNA, 19 nt, Yersinia pestis
accgcgacuugccagccaa

SEQ ID NO: 47988 - RNA, 22 nt, Yersinia pestis
accucaguaaagggaggagauc

SEQ ID NO: 47989 - RNA, 22 nt, Yersinia pestis
accucugauuaucucugaacaa

SEQ ID NO: 47990 - RNA, 22 nt, Yersinia pestis
accuguuugaaagccugaaucu

SEQ ID NO: 47991 - RNA, 22 nt, Yersinia pestis
acgaagugaaaaccuggcgcga

SEQ ID NO: 47992 - RNA, 22 nt, Yersinia pestis
acgagcaucaauuucuggcaac

SEQ ID NO: 47993 - RNA, 22 nt, Yersinia pestis
acgauuaacaugaucguguugc

SEQ ID NO: 47994 - RNA, 22 nt, Yersinia pestis
acgcaggaaagaacugcauugg

SEQ ID NO: 47995 - RNA, 22 nt, Yersinia pestis
acgcaguggccagcagcuguua

SEQ ID NO: 47996 - RNA, 22 nt, Yersinia pestis
acgccuuguucgcaaccgaaga

SEQ ID NO: 47997 - RNA, 22 nt, Yersinia pestis
acggcaaauauguucuggcugg

SEQ ID NO: 47998 - RNA, 22 nt, Yersinia pestis
acggcauuagggcauggcugga

SEQ ID NO: 47999 - RNA, 22 nt, Yersinia pestis
acgggcgauuaucucuagaucg

SEQ ID NO: 48000 - RNA, 22 nt, Yersinia pestis
acggguaacgguggcguaaugc

SEQ ID NO: 48001 - RNA, 22 nt, Yersinia pestis
acgguguuccgcgaauaucugg

SEQ ID NO: 48002 - RNA, 22 nt, Yersinia pestis
acgucuaaauagaaaaugacgg

SEQ ID NO: 48003 - RNA, 22 nt, Yersinia pestis
acgugguuaaguccagcgucgg

SEQ ID NO: 48004 - RNA, 22 nt, Yersinia pestis
acguuagcaugaugauuguugu

SEQ ID NO: 48005 - RNA, 22 nt, Yersinia pestis
acguuucuuucaagaaagcacg

SEQ ID NO: 48006 - RNA, 22 nt, Yersinia pestis
acuaaugguuuuaugugcacua

SEQ ID NO: 48007 - RNA, 22 nt, Yersinia pestis
acucaauggggugauugguuuu

SEQ ID NO: 48008 - RNA, 21 nt, Yersinia pestis
acucaccgggacucagaauau

SEQ ID NO: 48009 - RNA, 23 nt, Yersinia pestis
acucagcgucuggguuagccaau

SEQ ID NO: 48010 - RNA, 20 nt, Yersinia pestis
acuguaugugcguuggcuac

SEQ ID NO: 48011 - RNA, 22 nt, Yersinia pestis
acuguggguuaaugauauucaa

SEQ ID NO: 48012 - RNA, 22 nt, Yersinia pestis
acuucaucgcacuuaaucaacg

SEQ ID NO: 48013 - RNA, 22 nt, Yersinia pestis
acuucaucugaucauuggcuga

SEQ ID NO: 48014 - RNA, 22 nt, Yersinia pestis
agaaauugguauccgucgucuu

SEQ ID NO: 48015 - RNA, 22 nt, Yersinia pestis
agacauauagagcagguuaucg

SEQ ID NO: 48016 - RNA, 22 nt, Yersinia pestis
agacugaugcaagauggcggua

SEQ ID NO: 48017 - RNA, 22 nt, Yersinia pestis
agagauucuagucgcccacgau

SEQ ID NO: 48018 - RNA, 22 nt, Yersinia pestis
agauuaucgccaccauucuggu

SEQ ID NO: 48019 - RNA, 22 nt, Yersinia pestis
agcaaguacuacucagccgaug

SEQ ID NO: 48020 - RNA, 22 nt, Yersinia pestis
agcacauuuuauucaggcgaca

SEQ ID NO: 48021 - RNA, 22 nt, Yersinia pestis
agcaggccaucacgaccuugcu

SEQ ID NO: 48022 - RNA, 22 nt, Yersinia pestis
agcauaacagcuugcugccgag

SEQ ID NO: 48023 - RNA, 22 nt, Yersinia pestis
agccaguucuucaucugaugga

SEQ ID NO: 48024 - RNA, 22 nt, Yersinia pestis
agcccgauaccauaaaaccgga

SEQ ID NO: 48025 - RNA, 22 nt, Yersinia pestis
agccgccaauauugucaaaauu

SEQ ID NO: 48026 - RNA, 22 nt, Yersinia pestis
agccgcguuggcaucacucacc

SEQ ID NO: 48027 - RNA, 22 nt, Yersinia pestis
agccguuaugguuuuguccaga

SEQ ID NO: 48028 - RNA, 22 nt, Yersinia pestis
agcgacuguaccaugccgauca

SEQ ID NO: 48029 - RNA, 22 nt, Yersinia pestis
agcgauaaaccgguaugcagga

SEQ ID NO: 48030 - RNA, 22 nt, Yersinia pestis
agcgcugguuuucucgacaaau

SEQ ID NO: 48031 - RNA, 22 nt, Yersinia pestis
agcggcguugaacugccaaaag

SEQ ID NO: 48032 - RNA, 22 nt, Yersinia pestis
agcuaauuguguuuuuaggcug

SEQ ID NO: 48033 - RNA, 22 nt, Yersinia pestis
agcugacagggugaguaagaac

SEQ ID NO: 48034 - RNA, 22 nt, Yersinia pestis
agcuggcuucagagauggcgug

SEQ ID NO: 48035 - RNA, 22 nt, Yersinia pestis
agcugggugccuugcagaucag

SEQ ID NO: 48036 - RNA, 19 nt, Yersinia pestis
aggauauuccgaugaugac

SEQ ID NO: 48037 - RNA, 21 nt, Yersinia pestis
aggcaacuucaauuaugcggc

SEQ ID NO: 48038 - RNA, 22 nt, Yersinia pestis
aggccacugucagcugaacuga

SEQ ID NO: 48039 - RNA, 22 nt, Yersinia pestis
aguagugccuuacguagcauga

SEQ ID NO: 48040 - RNA, 21 nt, Yersinia pestis
agucggccaaccaucgccauu

SEQ ID NO: 48041 - RNA, 22 nt, Yersinia pestis
agucuaucguuaucugauggca

SEQ ID NO: 48042 - RNA, 21 nt, Yersinia pestis
agugcuggugcgugagcauug

SEQ ID NO: 48043 - RNA, 22 nt, Yersinia pestis
aguggcgauaccggcaguaggc

SEQ ID NO: 48044 - RNA, 22 nt, Yersinia pestis
aguguaauacuggaaugugcgu

SEQ ID NO: 48045 - RNA, 22 nt, Yersinia pestis
aguugacgggguuagaucggau

SEQ ID NO: 48046 - RNA, 22 nt, Yersinia pestis
aguugagcuucaugcacuguug

SEQ ID NO: 48047 - RNA, 22 nt, Yersinia pestis
aguuugagaaaugaagacuuua

SEQ ID NO: 48048 - RNA, 22 nt, Yersinia pestis
aguuugauguuucuggguuaua

SEQ ID NO: 48049 - RNA, 22 nt, Yersinia pestis
auaaccugauuuaucagccuac

SEQ ID NO: 48050 - RNA, 22 nt, Yersinia pestis
auaagccaccugcgugauguga

SEQ ID NO: 48051 - RNA, 22 nt, Yersinia pestis
auacuccugccggcugacaggu

SEQ ID NO: 48052 - RNA, 22 nt, Yersinia pestis
aucaaucagcuauuaagcguuu

SEQ ID NO: 48053 - RNA, 22 nt, Yersinia pestis
aucaaugucuuuuauguuaaac

SEQ ID NO: 48054 - RNA, 22 nt, Yersinia pestis
aucagauaggcagucagccuua

SEQ ID NO: 48055 - RNA, 22 nt, Yersinia pestis
auccgguaguaaaaaccggucu

SEQ ID NO: 48056 - RNA, 22 nt, Yersinia pestis
auccugaucgccuccggcguuc

SEQ ID NO: 48057 - RNA, 22 nt, Yersinia pestis
auccuucgcguugcaggggggg

SEQ ID NO: 48058 - RNA, 23 nt, Yersinia pestis
aucgacgguuaaaccgcuacugg

SEQ ID NO: 48059 - RNA, 22 nt, Yersinia pestis
aucgccuugucgguugguuuug

SEQ ID NO: 48060 - RNA, 19 nt, Yersinia pestis
aucgggauuugugcgcugc

SEQ ID NO: 48061 - RNA, 22 nt, Yersinia pestis
aucuuuggaucuaaacgggccu

SEQ ID NO: 48062 - RNA, 22 nt, Yersinia pestis
augaaagcaaaaguucugucau

SEQ ID NO: 48063 - RNA, 22 nt, Yersinia pestis
augaccgccuuguuugcuggug

SEQ ID NO: 48064 - RNA, 22 nt, Yersinia pestis
augacuacgccguugcugaugc

SEQ ID NO: 48065 - RNA, 22 nt, Yersinia pestis
augagcuuauuccugucaguga

SEQ ID NO: 48066 - RNA, 22 nt, Yersinia pestis
augcuggcggcuaucgauguaa

SEQ ID NO: 48067 - RNA, 22 nt, Yersinia pestis
augcuguuaugagcaugcauua

SEQ ID NO: 48068 - RNA, 22 nt, Yersinia pestis
augcuguugccaagggaacuaa

SEQ ID NO: 48069 - RNA, 22 nt, Yersinia pestis
auggaaauaacaagcgagacaa

SEQ ID NO: 48070 - RNA, 21 nt, Yersinia pestis
auggaccgguaucagucaugc

SEQ ID NO: 48071 - RNA, 22 nt, Yersinia pestis
auggagaccuccucaggggaua

SEQ ID NO: 48072 - RNA, 23 nt, Yersinia pestis
auggauaaacucgaugagugccg

SEQ ID NO: 48073 - RNA, 22 nt, Yersinia pestis
auggauggcaaguuaacgugcu

SEQ ID NO: 48074 - RNA, 22 nt, Yersinia pestis
auggucagcaaagugccgaguu

SEQ ID NO: 48075 - RNA, 22 nt, Yersinia pestis
auguaggagcgauguuuucugu

SEQ ID NO: 48076 - RNA, 22 nt, Yersinia pestis
augugcuguugaaugcuggcaa

SEQ ID NO: 48077 - RNA, 22 nt, Yersinia pestis
auuagcagugaugguuauuuau

SEQ ID NO: 48078 - RNA, 22 nt, Yersinia pestis
auuagcgaacugaaucuacugc

SEQ ID NO: 48079 - RNA, 22 nt, Yersinia pestis
auuauccccagcgguaucagcc

SEQ ID NO: 48080 - RNA, 22 nt, Yersinia pestis
auuauggccgauaagacauuag

SEQ ID NO: 48081 - RNA, 22 nt, Yersinia pestis
auucaacggaauagccacgagu

SEQ ID NO: 48082 - RNA, 22 nt, Yersinia pestis
auucaguuccugauauggggug

SEQ ID NO: 48083 - RNA, 22 nt, Yersinia pestis
auucaugucagugcuaucacuc

SEQ ID NO: 48084 - RNA, 22 nt, Yersinia pestis
auucgcuguucgggaguaagag

SEQ ID NO: 48085 - RNA, 22 nt, Yersinia pestis
auucgggugauugcugccggua

SEQ ID NO: 48086 - RNA, 22 nt, Yersinia pestis
auucucaaacggauugcucgcc

SEQ ID NO: 48087 - RNA, 22 nt, Yersinia pestis
auucuggcuggggaucauaucu

SEQ ID NO: 48088 - RNA, 22 nt, Yersinia pestis
auucuuugaaaacggcgaggca

SEQ ID NO: 48089 - RNA, 22 nt, Yersinia pestis
auugaauccaugcuaaaccggu

SEQ ID NO: 48090 - RNA, 22 nt, Yersinia pestis
auugaugugccaggggauaaua

SEQ ID NO: 48091 - RNA, 22 nt, Yersinia pestis
auugcguagaaauggauguuaa

SEQ ID NO: 48092 - RNA, 22 nt, Yersinia pestis
auugcuugcaggugcugcgggu

SEQ ID NO: 48093 - RNA, 22 nt, Yersinia pestis
auuggaaaacccuggaucuggg

SEQ ID NO: 48094 - RNA, 22 nt, Yersinia pestis
auugucagcaacgaaaaaaggc

SEQ ID NO: 48095 - RNA, 22 nt, Yersinia pestis
auuguugcaggaagagggcuga

SEQ ID NO: 48096 - RNA, 21 nt, Yersinia pestis
auuguugcucguaaggcagcc

SEQ ID NO: 48097 - RNA, 22 nt, Yersinia pestis
cuguucuauugucuuauugucu

SEQ ID NO: 48098 - RNA, 22 nt, Yersinia pestis
cuuggauauuauccgccgcuau

SEQ ID NO: 48099 - RNA, 22 nt, Yersinia pestis
cuuugucaauaaccucuaaucu

SEQ ID NO: 48100 - RNA, 22 nt, Yersinia pestis
gaacagguuaaugacaugggcc

SEQ ID NO: 48101 - RNA, 22 nt, Yersinia pestis
gaacauaggguggcggcuaaaa

SEQ ID NO: 48102 - RNA, 22 nt, Yersinia pestis
gaacuugggaucagacagauau

SEQ ID NO: 48103 - RNA, 22 nt, Yersinia pestis
gaagauccgcuggggauggaag

SEQ ID NO: 48104 - RNA, 22 nt, Yersinia pestis
gaaguuaugggcgcgcauauug

SEQ ID NO: 48105 - RNA, 22 nt, Yersinia pestis
gaaugccauuaauacuguggca

SEQ ID NO: 48106 - RNA, 22 nt, Yersinia pestis
gaauuucauagcgaugcugaug

SEQ ID NO: 48107 - RNA, 22 nt, Yersinia pestis
gaccacaugggacauaugccug

SEQ ID NO: 48108 - RNA, 22 nt, Yersinia pestis
gacgcuaucuugaugaugccug

SEQ ID NO: 48109 - RNA, 22 nt, Yersinia pestis
gacugaaaucaugcacgguuug

SEQ ID NO: 48110 - RNA, 22 nt, Yersinia pestis
gagcagcaugaucaacaguuga

SEQ ID NO: 48111 - RNA, 22 nt, Yersinia pestis
gagcccgugauuugaaagggau

SEQ ID NO: 48112 - RNA, 22 nt, Yersinia pestis
gagguuuccugauuauaguauu

SEQ ID NO: 48113 - RNA, 22 nt, Yersinia pestis
gaguaguggccagacgguugag

SEQ ID NO: 48114 - RNA, 22 nt, Yersinia pestis
gaguaucggugaguugaugauc

SEQ ID NO: 48115 - RNA, 22 nt, Yersinia pestis
gagucuaaaaauaacauaagcu

SEQ ID NO: 48116 - RNA, 22 nt, Yersinia pestis
gagugaugauugaaacacaggu

SEQ ID NO: 48117 - RNA, 22 nt, Yersinia pestis
gauaccaauuuagcguucagaa

SEQ ID NO: 48118 - RNA, 22 nt, Yersinia pestis
gauacguugcgauuggaaaccg

SEQ ID NO: 48119 - RNA, 18 nt, Yersinia pestis
gauaucauugaaauggau

SEQ ID NO: 48120 - RNA, 23 nt, Yersinia pestis
gaucaacacagcaggaagccgga

SEQ ID NO: 48121 - RNA, 22 nt, Yersinia pestis
gaucaucaagcacggcuguauu

SEQ ID NO: 48122 - RNA, 22 nt, Yersinia pestis
gauccgccgguggucagcggaa

SEQ ID NO: 48123 - RNA, 22 nt, Yersinia pestis
gaugauguucuucaaaacaaag

SEQ ID NO: 48124 - RNA, 22 nt, Yersinia pestis
gaugucaaagcaauggaauggc

SEQ ID NO: 48125 - RNA, 22 nt, Yersinia pestis
gaugugaucaucaaaagcguca

SEQ ID NO: 48126 - RNA, 22 nt, Yersinia pestis
gcaaagcgaaaugaauaauguc

SEQ ID NO: 48127 - RNA, 22 nt, Yersinia pestis
gcaagucaaaaaauaucacuga

SEQ ID NO: 48128 - RNA, 22 nt, Yersinia pestis
gcagcauacaacuuccgcauca

SEQ ID NO: 48129 - RNA, 22 nt, Yersinia pestis
gcaggcguguugguggcuaccu

SEQ ID NO: 48130 - RNA, 19 nt, Yersinia pestis
gcaucauauaauuauuggu

SEQ ID NO: 48131 - RNA, 22 nt, Yersinia pestis
gcaugacugaaaggccgaguuu

SEQ ID NO: 48132 - RNA, 22 nt, Yersinia pestis
gcauucagcaacaagaggguau

SEQ ID NO: 48133 - RNA, 19 nt, Yersinia pestis
gcauugguaggcccuaucc

SEQ ID NO: 48134 - RNA, 22 nt, Yersinia pestis
gccaagcuugccagaucaugaa

SEQ ID NO: 48135 - RNA, 22 nt, Yersinia pestis
gccaagguaucgccuugcuaaa

SEQ ID NO: 48136 - RNA, 20 nt, Yersinia pestis
gccaaggugcuuuuacgcga

SEQ ID NO: 48137 - RNA, 19 nt, Yersinia pestis
gccaaugccgcucggcucc

SEQ ID NO: 48138 - RNA, 22 nt, Yersinia pestis
gccacugagggugaucgccagc

SEQ ID NO: 48139 - RNA, 22 nt, Yersinia pestis
gccagagacaaugucgacgacg

SEQ ID NO: 48140 - RNA, 22 nt, Yersinia pestis
gccagcuugucggucaguguuu

SEQ ID NO: 48141 - RNA, 22 nt, Yersinia pestis
gccaguuugagucuuuugucag

SEQ ID NO: 48142 - RNA, 22 nt, Yersinia pestis
gccauuuaugccgaucauccgu

SEQ ID NO: 48143 - RNA, 22 nt, Yersinia pestis
gcccauuggcaguugaaguaau

SEQ ID NO: 48144 - RNA, 22 nt, Yersinia pestis
gccgguauuggcguuugauaug

SEQ ID NO: 48145 - RNA, 22 nt, Yersinia pestis
gccguggugagcggguauggcu

SEQ ID NO: 48146 - RNA, 23 nt, Yersinia pestis
gccuggugauagcuuagcugugc

SEQ ID NO: 48147 - RNA, 22 nt, Yersinia pestis
gccuugagugcuuacuggggau

SEQ ID NO: 48148 - RNA, 22 nt, Yersinia pestis
gcgacucauugacacugagcaa

SEQ ID NO: 48149 - RNA, 22 nt, Yersinia pestis
gcgcuaucaccaagcauuauuu

SEQ ID NO: 48150 - RNA, 22 nt, Yersinia pestis
gcgcugaaaucuaugguggucg

SEQ ID NO: 48151 - RNA, 22 nt, Yersinia pestis
gcgcugaauuacuccguugguu

SEQ ID NO: 48152 - RNA, 22 nt, Yersinia pestis
gcgcuguuuuuauaaauaaccc

SEQ ID NO: 48153 - RNA, 22 nt, Yersinia pestis
gcggauauacccaaguugcuga

SEQ ID NO: 48154 - RNA, 22 nt, Yersinia pestis
gcggcacuuagguugagguuag

SEQ ID NO: 48155 - RNA, 22 nt, Yersinia pestis
gcggcugaauaugaaagacgau

SEQ ID NO: 48156 - RNA, 20 nt, Yersinia pestis
gcggugauggaugaucacac

SEQ ID NO: 48157 - RNA, 22 nt, Yersinia pestis
gcggugcugcucgguuuuggug

SEQ ID NO: 48158 - RNA, 22 nt, Yersinia pestis
gcgucguuuauaucucguugua

SEQ ID NO: 48159 - RNA, 19 nt, Yersinia pestis
gcuaaagcaaacgccguua

SEQ ID NO: 48160 - RNA, 22 nt, Yersinia pestis
gcuagcaagaagaauugaucau

SEQ ID NO: 48161 - RNA, 22 nt, Yersinia pestis
gcuaucagcccuggaugaagau

SEQ ID NO: 48162 - RNA, 22 nt, Yersinia pestis
gcuaugacgaucaguggcacac

SEQ ID NO: 48163 - RNA, 22 nt, Yersinia pestis
gcucauaauuguucauugccug

SEQ ID NO: 48164 - RNA, 22 nt, Yersinia pestis
gcucauuaauuccgaugagcuu

SEQ ID NO: 48165 - RNA, 22 nt, Yersinia pestis
gcucguuuaucucggcaauuac

SEQ ID NO: 48166 - RNA, 22 nt, Yersinia pestis
gcucuggcacaguaucgugagc

SEQ ID NO: 48167 - RNA, 20 nt, Yersinia pestis
gcucugucauaucauuguug

SEQ ID NO: 48168 - RNA, 22 nt, Yersinia pestis
gcugaauaucguugaacaggau

SEQ ID NO: 48169 - RNA, 22 nt, Yersinia pestis
gcugacaguaccuugcggacgg

SEQ ID NO: 48170 - RNA, 22 nt, Yersinia pestis
gcugacguugcccgucauacgg

SEQ ID NO: 48171 - RNA, 22 nt, Yersinia pestis
gcugcacugaaccccagaucuu

SEQ ID NO: 48172 - RNA, 22 nt, Yersinia pestis
gcuggauaucuugcugugcaac

SEQ ID NO: 48173 - RNA, 22 nt, Yersinia pestis
gcuggcugauacgcccacgauu

SEQ ID NO: 48174 - RNA, 22 nt, Yersinia pestis
gcuggcuuaaugaucaagcggc

SEQ ID NO: 48175 - RNA, 22 nt, Yersinia pestis
gcuuaaguaaagaugacaucug

SEQ ID NO: 48176 - RNA, 22 nt, Yersinia pestis
gcuuuccgcuucuuugucacca

SEQ ID NO: 48177 - RNA, 22 nt, Yersinia pestis
ggaacgccaaguaugcaggccc

SEQ ID NO: 48178 - RNA, 22 nt, Yersinia pestis
ggacgaucagguuuugcucauu

SEQ ID NO: 48179 - RNA, 19 nt, Yersinia pestis
ggagucuuuucuuuaguca

SEQ ID NO: 48180 - RNA, 22 nt, Yersinia pestis
ggaugcgguugcugcccugaaa

SEQ ID NO: 48181 - RNA, 22 nt, Yersinia pestis
ggauuauguuauagucguuaaa

SEQ ID NO: 48182 - RNA, 23 nt, Yersinia pestis
ggcaaugggcacacgagcugugu

SEQ ID NO: 48183 - RNA, 22 nt, Yersinia pestis
ggccgucagaguauucauuagc

SEQ ID NO: 48184 - RNA, 22 nt, Yersinia pestis
ggccuucagaaugcugacaaac

SEQ ID NO: 48185 - RNA, 22 nt, Yersinia pestis
ggcgauauugcgucaggcacug

SEQ ID NO: 48186 - RNA, 22 nt, Yersinia pestis
ggcuggcaaacguuucacacuc

SEQ ID NO: 48187 - RNA, 23 nt, Yersinia pestis
ggcuggucacagugagaucgcac

SEQ ID NO: 48188 - RNA, 22 nt, Yersinia pestis
ggcuuccugcauucguucagcc

SEQ ID NO: 48189 - RNA, 22 nt, Yersinia pestis
ggguauucgccuuuggucagug

SEQ ID NO: 48190 - RNA, 22 nt, Yersinia pestis
gguaccagaagcagaggugccc

SEQ ID NO: 48191 - RNA, 22 nt, Yersinia pestis
gguagcgaccuauggcgauaua

SEQ ID NO: 48192 - RNA, 22 nt, Yersinia pestis
ggucggauguuuugaccggugu

SEQ ID NO: 48193 - RNA, 22 nt, Yersinia pestis
ucaucuuguaagaguucugccc

SEQ ID NO: 48194 - RNA, 22 nt, Yersinia pestis
ucauguaugccuugguggcggg

SEQ ID NO: 48195 - RNA, 21 nt, Yersinia pestis
uccaguugguuaaugucaguu

SEQ ID NO: 48196 - RNA, 22 nt, Yersinia pestis
uccauuggucuauaucugcuuc

SEQ ID NO: 48197 - RNA, 22 nt, Yersinia pestis
uccguaaucuguucgggcugau

SEQ ID NO: 48198 - RNA, 20 nt, Yersinia pestis
uccucugggguuacggcggc

SEQ ID NO: 48199 - RNA, 22 nt, Yersinia pestis
uccugagagguuuuguaggcgu

SEQ ID NO: 48200 - RNA, 22 nt, Yersinia pestis
uccuggcuaaugcugccgccgg

SEQ ID NO: 48201 - RNA, 22 nt, Yersinia pestis
ucgaaaguaucgaagaauuagc

SEQ ID NO: 48202 - RNA, 22 nt, Yersinia pestis
ucgaagaacuggcauugcguuu

SEQ ID NO: 48203 - RNA, 22 nt, Yersinia pestis
ucgauuaaucuaucauaguaag

SEQ ID NO: 48204 - RNA, 22 nt, Yersinia pestis
ucgauucuuguucugcaacggu

SEQ ID NO: 48205 - RNA, 22 nt, Yersinia pestis
ucgcaaagcgaugaucacggca

SEQ ID NO: 48206 - RNA, 23 nt, Yersinia pestis
ucgccgaugugauguuugcaaug

SEQ ID NO: 48207 - RNA, 22 nt, Yersinia pestis
ucgguauuaaucaguacuggug

SEQ ID NO: 48208 - RNA, 22 nt, Yersinia pestis
ucuaugauuugaaaggugauuu

SEQ ID NO: 48209 - RNA, 20 nt, Yersinia pestis
ucuauuguuacuuuuaauac

SEQ ID NO: 48210 - RNA, 22 nt, Yersinia pestis
ucucauauucccauggguugau

SEQ ID NO: 48211 - RNA, 22 nt, Yersinia pestis
ucucggguaauuaacucuuuua

SEQ ID NO: 48212 - RNA, 21 nt, Yersinia pestis
ucuggcugagcguaucagcga

SEQ ID NO: 48213 - RNA, 22 nt, Yersinia pestis
ucuucaguggccgugaugaaau

SEQ ID NO: 48214 - RNA, 22 nt, Yersinia pestis
ugaacccaacccagcagaaagu

SEQ ID NO: 48215 - RNA, 22 nt, Yersinia pestis
ugaagugaugaucaacgcagcc

SEQ ID NO: 48216 - RNA, 22 nt, Yersinia pestis
ugacaaaucucugggcgcaggg

SEQ ID NO: 48217 - RNA, 22 nt, Yersinia pestis
ugacccuuuucgguauuggauu

SEQ ID NO: 48218 - RNA, 22 nt, Yersinia pestis
ugacuaggacguugacggauga

SEQ ID NO: 48219 - RNA, 22 nt, Yersinia pestis
ugacugaugggcgguuauccaa

SEQ ID NO: 48220 - RNA, 22 nt, Yersinia pestis
ugagacuuuccgcgccaaagcc

SEQ ID NO: 48221 - RNA, 22 nt, Yersinia pestis
ugagugacuuccauuugaaucg

SEQ ID NO: 48222 - RNA, 22 nt, Yersinia pestis
ugaguuuauaauuucagaggcu

SEQ ID NO: 48223 - RNA, 22 nt, Yersinia pestis
ugauacaucaguaacaggugua

SEQ ID NO: 48224 - RNA, 22 nt, Yersinia pestis
ugaugcagggcaccguaucgug

SEQ ID NO: 48225 - RNA, 22 nt, Yersinia pestis
ugaugcuaaaacugugaacuag

SEQ ID NO: 48226 - RNA, 22 nt, Yersinia pestis
ugaugcuaaauuuaucagcaaa

SEQ ID NO: 48227 - RNA, 22 nt, Yersinia pestis
ugauggcggacagugguauaac

SEQ ID NO: 48228 - RNA, 20 nt, Yersinia pestis
ugcacagcuggaugugaguc

SEQ ID NO: 48229 - RNA, 22 nt, Yersinia pestis
ugcacagcuggaugugagucug

SEQ ID NO: 48230 - RNA, 20 nt, Yersinia pestis
ugcauuggcaaucaggcugg

SEQ ID NO: 48231 - RNA, 20 nt, Yersinia pestis
ugccaaaggcccauuaagcc

SEQ ID NO: 48232 - RNA, 22 nt, Yersinia pestis
ugccaagcgcuuuggcaauuuc

SEQ ID NO: 48233 - RNA, 22 nt, Yersinia pestis
ugccaaguuuuaguuuaucucu

SEQ ID NO: 48234 - RNA, 22 nt, Yersinia pestis
ugccaccgguauuuggacauuc

SEQ ID NO: 48235 - RNA, 22 nt, Yersinia pestis
ugccauuggcucacauuguuua

SEQ ID NO: 48236 - RNA, 22 nt, Yersinia pestis
ugcgaacaugagcaauggcaga

SEQ ID NO: 48237 - RNA, 22 nt, Yersinia pestis
ugcgagaugauuacagugccuc

SEQ ID NO: 48238 - RNA, 22 nt, Yersinia pestis
ugcgguagcaagucuguuauaa

SEQ ID NO: 48239 - RNA, 22 nt, Yersinia pestis
ugcuacaccugcacagcgugaa

SEQ ID NO: 48240 - RNA, 22 nt, Yersinia pestis
ugcucaaguaucagugcucgca

SEQ ID NO: 48241 - RNA, 22 nt, Yersinia pestis
ugcucgcacagggucuggcgua

SEQ ID NO: 48242 - RNA, 22 nt, Yersinia pestis
ugcucgccguaauaaucugagu

SEQ ID NO: 48243 - RNA, 22 nt, Yersinia pestis
ugcugccaucaccgcauagaua

SEQ ID NO: 48244 - RNA, 22 nt, Yersinia pestis
ugcugcgugaguuuugcauuca

SEQ ID NO: 48245 - RNA, 20 nt, Yersinia pestis
ugcuguaacaugacuuauag

SEQ ID NO: 48246 - RNA, 23 nt, Yersinia pestis
ugcugucaccgaccuucauccgg

SEQ ID NO: 48247 - RNA, 21 nt, Yersinia pestis
uggaaugccauuggugauccu

SEQ ID NO: 48248 - RNA, 22 nt, Yersinia pestis
uggacgacguguugauucaacu

SEQ ID NO: 48249 - RNA, 22 nt, Yersinia pestis
uggcaagaacuggcagcagaua

SEQ ID NO: 48250 - RNA, 22 nt, Yersinia pestis
uggcacaguauuugauuuuggg

SEQ ID NO: 48251 - RNA, 22 nt, Yersinia pestis
uggcaggagguucucguucagg

SEQ ID NO: 48252 - RNA, 22 nt, Yersinia pestis
uggccaauaugucccaugagcu

SEQ ID NO: 48253 - RNA, 22 nt, Yersinia pestis
uggccugcgggaugugauguca

SEQ ID NO: 48254 - RNA, 22 nt, Yersinia pestis
uggcgauguacauucagggcgu

SEQ ID NO: 48255 - RNA, 22 nt, Yersinia pestis
uggcgauugccaguggugugcc

SEQ ID NO: 48256 - RNA, 20 nt, Yersinia pestis
uggcgcagcgcagaugccgc

SEQ ID NO: 48257 - RNA, 22 nt, Yersinia pestis
uggcguuagcccaacgggcaca

SEQ ID NO: 48258 - RNA, 22 nt, Yersinia pestis
uggcuagcguauuaaugccagu

SEQ ID NO: 48259 - RNA, 22 nt, Yersinia pestis
uggcuauauuaugaucaaaccc

SEQ ID NO: 48260 - RNA, 22 nt, Yersinia pestis
uggcugcagguaacagccugga

SEQ ID NO: 48261 - RNA, 22 nt, Yersinia pestis
uggcugccagccgcgauguguu

SEQ ID NO: 48262 - RNA, 22 nt, Yersinia pestis
uggcuuauuucaguuaccugaa

SEQ ID NO: 48263 - RNA, 22 nt, Yersinia pestis
ugggcauuguucucaauugaga

SEQ ID NO: 48264 - RNA, 22 nt, Yersinia pestis
ugggucagcaacuuuucccaga

SEQ ID NO: 48265 - RNA, 18 nt, Yersinia pestis
uggucaguaaagcggcuu

SEQ ID NO: 48266 - RNA, 22 nt, Yersinia pestis
uggucgccauggcuugcuuugu

SEQ ID NO: 48267 - RNA, 22 nt, Yersinia pestis
uggugaucagguccggugacuc

SEQ ID NO: 48268 - RNA, 22 nt, Yersinia pestis
uggugcgacaggcucggcguua

SEQ ID NO: 48269 - RNA, 22 nt, Yersinia pestis
ugguuaaacaauacggugcccu

SEQ ID NO: 48270 - RNA, 22 nt, Yersinia pestis
ugguuaucuaugaaggcgagcu

SEQ ID NO: 48271 - RNA, 22 nt, Yersinia pestis
uguaacaauuuaaaugugguag

SEQ ID NO: 48272 - RNA, 19 nt, Yersinia pestis
uguagugaugcugaauuua

SEQ ID NO: 48273 - RNA, 22 nt, Yersinia pestis
uguaucuugcaagguuggugua

SEQ ID NO: 48274 - RNA, 22 nt, Yersinia pestis
ugucagaaggucucuauguaau

SEQ ID NO: 48275 - RNA, 22 nt, Yersinia pestis
ugucaguaaauaagacccuugu

SEQ ID NO: 48276 - RNA, 22 nt, Yersinia pestis
ugucauugcaauggugccgguu

SEQ ID NO: 48277 - RNA, 22 nt, Yersinia pestis
ugucgcauuacugaaugccacg

SEQ ID NO: 48278 - RNA, 19 nt, Yersinia pestis
ugucgcgcucgcaggccgu

SEQ ID NO: 48279 - RNA, 22 nt, Yersinia pestis
ugugaaguugcaggauacgucc

SEQ ID NO: 48280 - RNA, 22 nt, Yersinia pestis
uguucccgcagaugccaguacc

SEQ ID NO: 48281 - RNA, 18 nt, Yersinia pestis
uguuuaaccacacgggug

SEQ ID NO: 48282 - RNA, 22 nt, Yersinia pestis
uuaaggauugucauuagucgcg

SEQ ID NO: 48283 - RNA, 22 nt, Yersinia pestis
uuaagguuagcuaugcaguuaa

SEQ ID NO: 48284 - RNA, 21 nt, Yersinia pestis
uuacacccauuuucgggaacu

SEQ ID NO: 48285 - RNA, 22 nt, Yersinia pestis
uuaccaccauauuuaacaucga

SEQ ID NO: 48286 - RNA, 22 nt, Yersinia pestis
uuaccacguuuaccguaaccca

SEQ ID NO: 48287 - RNA, 21 nt, Yersinia pestis
uuaccgucaccggaauagcua

SEQ ID NO: 48288 - RNA, 22 nt, Yersinia pestis
uuacucaucuggaaggcuaccg

SEQ ID NO: 48289 - RNA, 22 nt, Yersinia pestis
auuuccacaauuuguacugcca

SEQ ID NO: 48290 - RNA, 22 nt, Yersinia pestis
auuugcugcuugguuacggguu

SEQ ID NO: 48291 - RNA, 22 nt, Yersinia pestis
auuuggcaaugaaugccgauau

SEQ ID NO: 48292 - RNA, 22 nt, Yersinia pestis
caacggcggcaccggcgacuac

SEQ ID NO: 48293 - RNA, 22 nt, Yersinia pestis
caagauggcguguauaacgaug

SEQ ID NO: 48294 - RNA, 22 nt, Yersinia pestis
caagauuugcaacucagcguaa

SEQ ID NO: 48295 - RNA, 20 nt, Yersinia pestis
caaugcagaagaguucagcc

SEQ ID NO: 48296 - RNA, 19 nt, Yersinia pestis
cacgggcaagcauuuucca

SEQ ID NO: 48297 - RNA, 22 nt, Yersinia pestis
cacugcaauaugucuggaucgg

SEQ ID NO: 48298 - RNA, 22 nt, Yersinia pestis
cacuggauuauaauuucaaacg

SEQ ID NO: 48299 - RNA, 22 nt, Yersinia pestis
cagacauuguugcauaugguca

SEQ ID NO: 48300 - RNA, 19 nt, Yersinia pestis
cagcaaagccagcaguuuu

SEQ ID NO: 48301 - RNA, 22 nt, Yersinia pestis
cagcaaauugcauugauggggu

SEQ ID NO: 48302 - RNA, 22 nt, Yersinia pestis
cagcaacuggcguuucggaucc

SEQ ID NO: 48303 - RNA, 20 nt, Yersinia pestis
cagcauggaucccagcggcu

SEQ ID NO: 48304 - RNA, 22 nt, Yersinia pestis
cagcgcagcguccugacgcuga

SEQ ID NO: 48305 - RNA, 22 nt, Yersinia pestis
cagcgcgaugguguauguuauc

SEQ ID NO: 48306 - RNA, 23 nt, Yersinia pestis
cagcggauaauggauccgauggu

SEQ ID NO: 48307 - RNA, 22 nt, Yersinia pestis
cagcggcuaacguugaauauuu

SEQ ID NO: 48308 - RNA, 21 nt, Yersinia pestis
cagcgucaagaagugcaaaug

SEQ ID NO: 48309 - RNA, 22 nt, Yersinia pestis
caggcuaugugcugguccagau

SEQ ID NO: 48310 - RNA, 22 nt, Yersinia pestis
cagguagucagaugaaaagguc

SEQ ID NO: 48311 - RNA, 22 nt, Yersinia pestis
cagugaacuucauggcaaugcu

SEQ ID NO: 48312 - RNA, 22 nt, Yersinia pestis
cagugccuggauauaucuguau

SEQ ID NO: 48313 - RNA, 22 nt, Yersinia pestis
caguguuguuugguuuagggcu

SEQ ID NO: 48314 - RNA, 20 nt, Yersinia pestis
caguucaauuucgagggcuu

SEQ ID NO: 48315 - RNA, 22 nt, Yersinia pestis
cauaucgugaaagcauucgaca

SEQ ID NO: 48316 - RNA, 22 nt, Yersinia pestis
caucaaagaaauggauaaaggg

SEQ ID NO: 48317 - RNA, 22 nt, Yersinia pestis
caucacuggcguuaugaccacc

SEQ ID NO: 48318 - RNA, 19 nt, Yersinia pestis
caucauuugcaacucccau

SEQ ID NO: 48319 - RNA, 22 nt, Yersinia pestis
caucgguaaucaguuugcucca

SEQ ID NO: 48320 - RNA, 21 nt, Yersinia pestis
caugaucguccaugaagcggc

SEQ ID NO: 48321 - RNA, 22 nt, Yersinia pestis
cauguugacgaauaauuucauu

SEQ ID NO: 48322 - RNA, 22 nt, Yersinia pestis
cauuccgugccggugcugaaga

SEQ ID NO: 48323 - RNA, 22 nt, Yersinia pestis
cauuugauuuuggugacgucug

SEQ ID NO: 48324 - RNA, 22 nt, Yersinia pestis
cauuugugcugaagcuggguuc

SEQ ID NO: 48325 - RNA, 22 nt, Yersinia pestis
ccaacagugcugaauccgggau

SEQ ID NO: 48326 - RNA, 22 nt, Yersinia pestis
ccaaugaugccauguggcacau

SEQ ID NO: 48327 - RNA, 22 nt, Yersinia pestis
ccaccgaugugcuucaccaguu

SEQ ID NO: 48328 - RNA, 22 nt, Yersinia pestis
ccagagguuaaauauauguuaa

SEQ ID NO: 48329 - RNA, 22 nt, Yersinia pestis
ccagcgagacgucacccgcgcu

SEQ ID NO: 48330 - RNA, 18 nt, Yersinia pestis
ccaucaugaaacaacuga

SEQ ID NO: 48331 - RNA, 22 nt, Yersinia pestis
ccauggaauuacuauuuacugg

SEQ ID NO: 48332 - RNA, 22 nt, Yersinia pestis
ccauggugcuuucgguucuggu

SEQ ID NO: 48333 - RNA, 22 nt, Yersinia pestis
cccgguuuaucagugaaucugg

SEQ ID NO: 48334 - RNA, 23 nt, Yersinia pestis
ccgaccaguggcucagccaguaa

SEQ ID NO: 48335 - RNA, 22 nt, Yersinia pestis
ccgagccaacgguugauggcua

SEQ ID NO: 48336 - RNA, 22 nt, Yersinia pestis
ccgaugaugcagcaguaucuuc

SEQ ID NO: 48337 - RNA, 22 nt, Yersinia pestis
ccgcagucaaauaacaagaaua

SEQ ID NO: 48338 - RNA, 22 nt, Yersinia pestis
ccgccuaugccacccguauugc

SEQ ID NO: 48339 - RNA, 22 nt, Yersinia pestis
ccgcucaucgcuuccccccugu

SEQ ID NO: 48340 - RNA, 22 nt, Yersinia pestis
ccgguauuaaagcggcaucacc

SEQ ID NO: 48341 - RNA, 22 nt, Yersinia pestis
ccguagaaucagguggaaauca

SEQ ID NO: 48342 - RNA, 22 nt, Yersinia pestis
ccgugauaaauaacccgaauca

SEQ ID NO: 48343 - RNA, 22 nt, Yersinia pestis
ccuguuauuccuguaucucggc

SEQ ID NO: 48344 - RNA, 22 nt, Yersinia pestis
ccuuucagcagcgcaggaaggu

SEQ ID NO: 48345 - RNA, 22 nt, Yersinia pestis
cgauagcugccauguggacggc

SEQ ID NO: 48346 - RNA, 22 nt, Yersinia pestis
cgaucguggucagcauguguug

SEQ ID NO: 48347 - RNA, 22 nt, Yersinia pestis
cgcagaaauauucagagaggcg

SEQ ID NO: 48348 - RNA, 19 nt, Yersinia pestis
cgccaagggccaaugccag

SEQ ID NO: 48349 - RNA, 18 nt, Yersinia pestis
cgccacugugaugccccc

SEQ ID NO: 48350 - RNA, 22 nt, Yersinia pestis
cgcugauacgccaaauauuuuu

SEQ ID NO: 48351 - RNA, 22 nt, Yersinia pestis
cggaaugugcgaaaacacgucc

SEQ ID NO: 48352 - RNA, 22 nt, Yersinia pestis
cggcaacaauacacuggguuac

SEQ ID NO: 48353 - RNA, 22 nt, Yersinia pestis
cggcaacuuuauaucgaaaugc

SEQ ID NO: 48354 - RNA, 22 nt, Yersinia pestis
cggcagcaagcuguuaugcuuu

SEQ ID NO: 48355 - RNA, 22 nt, Yersinia pestis
cggcggauaaugauaucaaucc

SEQ ID NO: 48356 - RNA, 22 nt, Yersinia pestis
cggcguagugggcgaccugacc

SEQ ID NO: 48357 - RNA, 22 nt, Yersinia pestis
cggcgugaugggucuccgcaga

SEQ ID NO: 48358 - RNA, 23 nt, Yersinia pestis
cggcugagauagagcgccguguu

SEQ ID NO: 48359 - RNA, 22 nt, Yersinia pestis
cgggaugagaaaccgaugcuca

SEQ ID NO: 48360 - RNA, 22 nt, Yersinia pestis
cgggcgaaaucgaacuguauca

SEQ ID NO: 48361 - RNA, 22 nt, Yersinia pestis
cggucgucgccgaugcguguua

SEQ ID NO: 48362 - RNA, 22 nt, Yersinia pestis
cggugagcgaugauaaucaccg

SEQ ID NO: 48363 - RNA, 19 nt, Yersinia pestis
cgguggcauugauggucag

SEQ ID NO: 48364 - RNA, 19 nt, Yersinia pestis
cgguuaugacccucuggcc

SEQ ID NO: 48365 - RNA, 22 nt, Yersinia pestis
cgguugaugagaaagaugcgcu

SEQ ID NO: 48366 - RNA, 22 nt, Yersinia pestis
cguacuuuacguaaagaaacgu

SEQ ID NO: 48367 - RNA, 22 nt, Yersinia pestis
cguaucaugagaaucuaaccag

SEQ ID NO: 48368 - RNA, 22 nt, Yersinia pestis
cguauugacccuaaaaccggua

SEQ ID NO: 48369 - RNA, 21 nt, Yersinia pestis
cgucagugcgcaguaagaccu

SEQ ID NO: 48370 - RNA, 22 nt, Yersinia pestis
cgugcggaacaggugaugcagg

SEQ ID NO: 48371 - RNA, 22 nt, Yersinia pestis
cgugcuuucuugaaagaaacgu

SEQ ID NO: 48372 - RNA, 22 nt, Yersinia pestis
cguuugaaaucaacgucacggg

SEQ ID NO: 48373 - RNA, 22 nt, Yersinia pestis
cuacaugaaacguaaaucaguc

SEQ ID NO: 48374 - RNA, 22 nt, Yersinia pestis
cucagccgccccggagauagcg

SEQ ID NO: 48375 - RNA, 22 nt, Yersinia pestis
cucguuauguugaaaaggccgc

SEQ ID NO: 48376 - RNA, 22 nt, Yersinia pestis
cugaggucagugcugcaucacc

SEQ ID NO: 48377 - RNA, 21 nt, Yersinia pestis
cugauucaauucaucggucuc

SEQ ID NO: 48378 - RNA, 22 nt, Yersinia pestis
cugauucugguaauccauaauu

SEQ ID NO: 48379 - RNA, 22 nt, Yersinia pestis
cuggaagguuaauugauggggu

SEQ ID NO: 48380 - RNA, 22 nt, Yersinia pestis
cuggccagacuguacgcuuugg

SEQ ID NO: 48381 - RNA, 22 nt, Yersinia pestis
cuggcuauggacugugcggcuu

SEQ ID NO: 48382 - RNA, 22 nt, Yersinia pestis
cugguauuccgcauugucaauu

SEQ ID NO: 48383 - RNA, 22 nt, Yersinia pestis
cuguagcgugaguggugcuaug

SEQ ID NO: 48384 - RNA, 22 nt, Yersinia pestis
cuguuagccgugaaugaacucg

SEQ ID NO: 48385 - RNA, 22 nt, Yersinia pestis
ggugaacgcuuugguuuggcug

SEQ ID NO: 48386 - RNA, 20 nt, Yersinia pestis
ggugacgguagcgacggugg

SEQ ID NO: 48387 - RNA, 22 nt, Yersinia pestis
gguguucagaaugauaguugaa

SEQ ID NO: 48388 - RNA, 22 nt, Yersinia pestis
gguuaagcgguugacugagaug

SEQ ID NO: 48389 - RNA, 22 nt, Yersinia pestis
gguuccuuauagugaaguugcu

SEQ ID NO: 48390 - RNA, 22 nt, Yersinia pestis
guaaggauugccgcguaauuua

SEQ ID NO: 48391 - RNA, 22 nt, Yersinia pestis
guaagucgauguugcucacgua

SEQ ID NO: 48392 - RNA, 22 nt, Yersinia pestis
guaauggucgauguugaucgcg

SEQ ID NO: 48393 - RNA, 22 nt, Yersinia pestis
guacgguggacaguuauuucaa

SEQ ID NO: 48394 - RNA, 22 nt, Yersinia pestis
guagugaucgagcuacuagcga

SEQ ID NO: 48395 - RNA, 22 nt, Yersinia pestis
guauggcgguguccaccagcag

SEQ ID NO: 48396 - RNA, 22 nt, Yersinia pestis
guauugaagucgcauucgcggg

SEQ ID NO: 48397 - RNA, 22 nt, Yersinia pestis
guauugacacauuuauugccaa

SEQ ID NO: 48398 - RNA, 22 nt, Yersinia pestis
gucagggagagauaacggcacc

SEQ ID NO: 48399 - RNA, 22 nt, Yersinia pestis
gucaguuuccugcucuguucca

SEQ ID NO: 48400 - RNA, 22 nt, Yersinia pestis
gucauugcuuugauacggcugg

SEQ ID NO: 48401 - RNA, 22 nt, Yersinia pestis
gucccagcuacugcuacucagc

SEQ ID NO: 48402 - RNA, 22 nt, Yersinia pestis
gucgucauucacacccaaugua

SEQ ID NO: 48403 - RNA, 22 nt, Yersinia pestis
gucuaucuguuacaaacacgca

SEQ ID NO: 48404 - RNA, 22 nt, Yersinia pestis
gucuuagugugaguacaucuau

SEQ ID NO: 48405 - RNA, 22 nt, Yersinia pestis
gugaaccaauuguuagcuaagg

SEQ ID NO: 48406 - RNA, 21 nt, Yersinia pestis
gugaacggcgaauuaccgcuu

SEQ ID NO: 48407 - RNA, 22 nt, Yersinia pestis
gugacagcggcucaccucugcu

SEQ ID NO: 48408 - RNA, 22 nt, Yersinia pestis
gugcucuugccgcagguuuacu

SEQ ID NO: 48409 - RNA, 22 nt, Yersinia pestis
guggcgaugcuggcaaugcugg

SEQ ID NO: 48410 - RNA, 22 nt, Yersinia pestis
guggugcaucuacugcgcaccc

SEQ ID NO: 48411 - RNA, 22 nt, Yersinia pestis
guuaaugucacuuuaccagguu

SEQ ID NO: 48412 - RNA, 22 nt, Yersinia pestis
guuacaugguuuguugggcagc

SEQ ID NO: 48413 - RNA, 22 nt, Yersinia pestis
guuagcuguucucgugcuauuc

SEQ ID NO: 48414 - RNA, 22 nt, Yersinia pestis
guuaggcuggagucacgguagc

SEQ ID NO: 48415 - RNA, 22 nt, Yersinia pestis
guuaugaacauccaguuuagcu

SEQ ID NO: 48416 - RNA, 22 nt, Yersinia pestis
guucacugucgguaaagucuuc

SEQ ID NO: 48417 - RNA, 22 nt, Yersinia pestis
guugacguguuguaugccguua

SEQ ID NO: 48418 - RNA, 22 nt, Yersinia pestis
guugaugagugccugccgguag

SEQ ID NO: 48419 - RNA, 22 nt, Yersinia pestis
guugaugcuggcauuguccaug

SEQ ID NO: 48420 - RNA, 22 nt, Yersinia pestis
guugcacugaaccccagaucuu

SEQ ID NO: 48421 - RNA, 22 nt, Yersinia pestis
guugcugauucgucgcaauuua

SEQ ID NO: 48422 - RNA, 22 nt, Yersinia pestis
guugucauccaauuggucgcca

SEQ ID NO: 48423 - RNA, 22 nt, Yersinia pestis
guuugucagcauucugaaggcc

SEQ ID NO: 48424 - RNA, 21 nt, Yersinia pestis
uaaagcuuuauucaauggcgu

SEQ ID NO: 48425 - RNA, 22 nt, Yersinia pestis
uaaaugagguuuuuacuugagg

SEQ ID NO: 48426 - RNA, 22 nt, Yersinia pestis
uaaccagugguuuauugcuggu

SEQ ID NO: 48427 - RNA, 22 nt, Yersinia pestis
uaaccggaucaaaaugauggaa

SEQ ID NO: 48428 - RNA, 22 nt, Yersinia pestis
uaaccggccaaucuugucguag

SEQ ID NO: 48429 - RNA, 22 nt, Yersinia pestis
uaacggguaauuaugccgcaug

SEQ ID NO: 48430 - RNA, 20 nt, Yersinia pestis
uaagcugagucagucauaca

SEQ ID NO: 48431 - RNA, 22 nt, Yersinia pestis
uaagucucaauuuauuuugucg

SEQ ID NO: 48432 - RNA, 22 nt, Yersinia pestis
uaauacguugaucccggaugug

SEQ ID NO: 48433 - RNA, 22 nt, Yersinia pestis
uaauggcaucuucuuuagucuu

SEQ ID NO: 48434 - RNA, 22 nt, Yersinia pestis
uaaugguauuaucgccgacucu

SEQ ID NO: 48435 - RNA, 22 nt, Yersinia pestis
uacagcaaucucuguuggugca

SEQ ID NO: 48436 - RNA, 22 nt, Yersinia pestis
uaccgcuuuaccccgcugcaaa

SEQ ID NO: 48437 - RNA, 22 nt, Yersinia pestis
uaccuauuuugacaucauugau

SEQ ID NO: 48438 - RNA, 22 nt, Yersinia pestis
uaccucaaucacugggcugcac

SEQ ID NO: 48439 - RNA, 21 nt, Yersinia pestis
uacuaucuaaaaguuuaaggu

SEQ ID NO: 48440 - RNA, 22 nt, Yersinia pestis
uacugauaucauguggcggugu

SEQ ID NO: 48441 - RNA, 22 nt, Yersinia pestis
uacugcaucauguuugcugauu

SEQ ID NO: 48442 - RNA, 19 nt, Yersinia pestis
uacugcugcuagacaaaug

SEQ ID NO: 48443 - RNA, 22 nt, Yersinia pestis
uacuggaagccagagcagggau

SEQ ID NO: 48444 - RNA, 22 nt, Yersinia pestis
uacuguaucuuaauuuuaugcu

SEQ ID NO: 48445 - RNA, 22 nt, Yersinia pestis
uagaacaagguuuagcgggcaa

SEQ ID NO: 48446 - RNA, 19 nt, Yersinia pestis
uagauaacauaggguucgc

SEQ ID NO: 48447 - RNA, 22 nt, Yersinia pestis
uagaucguuaccuuggcaccca

SEQ ID NO: 48448 - RNA, 22 nt, Yersinia pestis
uagccauuauauucagcgccau

SEQ ID NO: 48449 - RNA, 22 nt, Yersinia pestis
uagcgucauaaauuaaugucac

SEQ ID NO: 48450 - RNA, 22 nt, Yersinia pestis
uagcuauccaguuggucaaucc

SEQ ID NO: 48451 - RNA, 22 nt, Yersinia pestis
uagcuaucggugaugagccgac

SEQ ID NO: 48452 - RNA, 22 nt, Yersinia pestis
uagcugauagucuuuaguagcu

SEQ ID NO: 48453 - RNA, 21 nt, Yersinia pestis
uaucaagguacaagacccuga

SEQ ID NO: 48454 - RNA, 22 nt, Yersinia pestis
uaucaauguuggcuuguaaaua

SEQ ID NO: 48455 - RNA, 22 nt, Yersinia pestis
uaucacuuugaucaauaccaug

SEQ ID NO: 48456 - RNA, 22 nt, Yersinia pestis
uaucagagugcgcugauuuaac

SEQ ID NO: 48457 - RNA, 22 nt, Yersinia pestis
uauccauauagcuguucagggu

SEQ ID NO: 48458 - RNA, 22 nt, Yersinia pestis
uaucgauaauaugugcuguuuu

SEQ ID NO: 48459 - RNA, 21 nt, Yersinia pestis
uaucgcuuucgcuacgccacc

SEQ ID NO: 48460 - RNA, 22 nt, Yersinia pestis
uaucgcuuugggcuugcucccu

SEQ ID NO: 48461 - RNA, 22 nt, Yersinia pestis
uaucgguauuuaguuguauaag

SEQ ID NO: 48462 - RNA, 22 nt, Yersinia pestis
uaucucgcagcaaauugguuau

SEQ ID NO: 48463 - RNA, 22 nt, Yersinia pestis
uaugcccucacaucugcaacuu

SEQ ID NO: 48464 - RNA, 22 nt, Yersinia pestis
uauggcaccaagugaugagaau

SEQ ID NO: 48465 - RNA, 22 nt, Yersinia pestis
uauggcugcauuauuaucugau

SEQ ID NO: 48466 - RNA, 22 nt, Yersinia pestis
uauggcuuuacggcucaccugg

SEQ ID NO: 48467 - RNA, 22 nt, Yersinia pestis
uauuaggaugguuagaguggga

SEQ ID NO: 48468 - RNA, 21 nt, Yersinia pestis
uauucgcucccaguuugaugc

SEQ ID NO: 48469 - RNA, 22 nt, Yersinia pestis
uauucugcuggaagaguugcug

SEQ ID NO: 48470 - RNA, 19 nt, Yersinia pestis
ucaaacaucugaugagacg

SEQ ID NO: 48471 - RNA, 22 nt, Yersinia pestis
ucaaccagauuauguuguucug

SEQ ID NO: 48472 - RNA, 22 nt, Yersinia pestis
ucaacguaucuuuaauuuuaua

SEQ ID NO: 48473 - RNA, 22 nt, Yersinia pestis
ucaagcuggcgaauaugacgag

SEQ ID NO: 48474 - RNA, 20 nt, Yersinia pestis
ucaaggcagaagccacauuc

SEQ ID NO: 48475 - RNA, 20 nt, Yersinia pestis
ucaauuaggagccgugccca

SEQ ID NO: 48476 - RNA, 22 nt, Yersinia pestis
ucacuugggugcauuggaugaa

SEQ ID NO: 48477 - RNA, 22 nt, Yersinia pestis
ucagcuuuaugauugugugcga

SEQ ID NO: 48478 - RNA, 22 nt, Yersinia pestis
ucaguaagaggggacaggguau

SEQ ID NO: 48479 - RNA, 22 nt, Yersinia pestis
ucagucguauacugauauuauc

SEQ ID NO: 48480 - RNA, 22 nt, Yersinia pestis
ucaguguggugucauucgcugu

SEQ ID NO: 48481 - RNA, 22 nt, Yersinia pestis
uuacuugguugaaugaaucggg

SEQ ID NO: 48482 - RNA, 22 nt, Yersinia pestis
uuagcgcugaucggaucaaaag

SEQ ID NO: 48483 - RNA, 22 nt, Yersinia pestis
uuagcgguguaguuaagguuag

SEQ ID NO: 48484 - RNA, 22 nt, Yersinia pestis
uuaucugauaugaaugaacugc

SEQ ID NO: 48485 - RNA, 22 nt, Yersinia pestis
uucaaugauggucgaagggcgu

SEQ ID NO: 48486 - RNA, 22 nt, Yersinia pestis
uucacgcuacguuauauccugc

SEQ ID NO: 48487 - RNA, 22 nt, Yersinia pestis
uucaucacgauaaagucagguu

SEQ ID NO: 48488 - RNA, 22 nt, Yersinia pestis
uucaugaguggcuuuccgcugu

SEQ ID NO: 48489 - RNA, 22 nt, Yersinia pestis
uucauuggaaaaauagauguca

SEQ ID NO: 48490 - RNA, 22 nt, Yersinia pestis
uucgcgggcauauuuuuagucu

SEQ ID NO: 48491 - RNA, 22 nt, Yersinia pestis
uucgguaugaguuuauugcuuu

SEQ ID NO: 48492 - RNA, 20 nt, Yersinia pestis
uugaacagaacgcggaagcc

SEQ ID NO: 48493 - RNA, 22 nt, Yersinia pestis
uugacgcauugaaaaguaauaa

SEQ ID NO: 48494 - RNA, 22 nt, Yersinia pestis
uugacguuuugacgaucaaucg

SEQ ID NO: 48495 - RNA, 22 nt, Yersinia pestis
uugagaaaacucuuauagugcu

SEQ ID NO: 48496 - RNA, 22 nt, Yersinia pestis
uugagcguuauccggggguguu

SEQ ID NO: 48497 - RNA, 22 nt, Yersinia pestis
uugaggauaaccagcaugucug

SEQ ID NO: 48498 - RNA, 22 nt, Yersinia pestis
uugaucaacugcugacgcugua

SEQ ID NO: 48499 - RNA, 22 nt, Yersinia pestis
uugaugcgcuggagcgccagaa

SEQ ID NO: 48500 - RNA, 22 nt, Yersinia pestis
uugcagaucaaagugaaugaag

SEQ ID NO: 48501 - RNA, 22 nt, Yersinia pestis
uugcaggcgguuagccgugaga

SEQ ID NO: 48502 - RNA, 20 nt, Yersinia pestis
uugccagagauugcgcacgu

SEQ ID NO: 48503 - RNA, 22 nt, Yersinia pestis
uugccagugucaauugguuacc

SEQ ID NO: 48504 - RNA, 22 nt, Yersinia pestis
uugcgcaggguccggugucgcu

SEQ ID NO: 48505 - RNA, 22 nt, Yersinia pestis
uugcguaauaaugcggcuuggu

SEQ ID NO: 48506 - RNA, 22 nt, Yersinia pestis
uugcuacggucaucuuuauaau

SEQ ID NO: 48507 - RNA, 22 nt, Yersinia pestis
uugcuaucuuugccguagugau

SEQ ID NO: 48508 - RNA, 22 nt, Yersinia pestis
uugcucgauagagauagccgga

SEQ ID NO: 48509 - RNA, 22 nt, Yersinia pestis
uugcuggcccacguguuauuga

SEQ ID NO: 48510 - RNA, 22 nt, Yersinia pestis
uugcuuuaucuguucacgcgaa

SEQ ID NO: 48511 - RNA, 22 nt, Yersinia pestis
uuggagaguaaagucgacacgu

SEQ ID NO: 48512 - RNA, 22 nt, Yersinia pestis
uuggauauuggcccgugggugu

SEQ ID NO: 48513 - RNA, 22 nt, Yersinia pestis
uuggauucaacggcccaguuag

SEQ ID NO: 48514 - RNA, 22 nt, Yersinia pestis
uuggcagucaggccaggaugcu

SEQ ID NO: 48515 - RNA, 22 nt, Yersinia pestis
uuggugaacgaucacauggcaa

SEQ ID NO: 48516 - RNA, 22 nt, Yersinia pestis
uuguucaauggcgauuuguuca

SEQ ID NO: 48517 - RNA, 22 nt, Yersinia pestis
uuuaaccgaugaaguguuugcc

SEQ ID NO: 48518 - RNA, 22 nt, Yersinia pestis
uuuaucagcaacaguggcuuuu

SEQ ID NO: 48519 - RNA, 22 nt, Yersinia pestis
uuucaggagaucgaugugcugg

SEQ ID NO: 48520 - RNA, 22 nt, Yersinia pestis
uuucagguuaccgcguaauuuc

SEQ ID NO: 48521 - RNA, 22 nt, Yersinia pestis
uuuccagugccgccuuugccau

SEQ ID NO: 48522 - RNA, 22 nt, Yersinia pestis
uuuccugauacauaccaucucc

SEQ ID NO: 48523 - RNA, 22 nt, Yersinia pestis
uuucgauacgaugcauauuaug

SEQ ID NO: 48524 - RNA, 22 nt, Yersinia pestis
uuucuugagccagucagccaga

SEQ ID NO: 48525 - RNA, 22 nt, Yersinia pestis
uuugacuucugauucagcgagu

SEQ ID NO: 48526 - RNA, 22 nt, Yersinia pestis
uuugccauggaauauuaucccg

SEQ ID NO: 48527 - RNA, 22 nt, Yersinia pestis
uuuggcaaaacuaucagguaaa

SEQ ID NO: 48528 - RNA, 22 nt, Yersinia pestis
uuuguagacauuguuauuggua

SEQ ID NO: 48529 - RNA, 22 nt, Yersinia pestis
uuugucagcagucugaaaggcc

SEQ ID NO: 48530 - RNA, 22 nt, Yersinia pestis KIM
aaacacugaaucuccaacagcg

SEQ ID NO: 48531 - RNA, 17 nt, Yersinia pestis KIM
aaacggcuucagugauu

SEQ ID NO: 48532 - RNA, 23 nt, Yersinia pestis KIM
aaacgguguucuguuuuuuaugg

SEQ ID NO: 48533 - RNA, 22 nt, Yersinia pestis KIM
aaacgucauuauuauuuaauau

SEQ ID NO: 48534 - RNA, 22 nt, Yersinia pestis KIM
aaacucggccuuucagucaugc

SEQ ID NO: 48535 - RNA, 22 nt, Yersinia pestis KIM
aaacuuugaacaaacgcuuguu

SEQ ID NO: 48536 - RNA, 19 nt, Yersinia pestis KIM
aaaguaccggucgugaaua

SEQ ID NO: 48537 - RNA, 22 nt, Yersinia pestis KIM
aaaugcuacagaaguucuacuu

SEQ ID NO: 48538 - RNA, 22 nt, Yersinia pestis KIM
aaauugcuuucuuuauguugau

SEQ ID NO: 48539 - RNA, 19 nt, Yersinia pestis KIM
aacagcagggcauuauccc

SEQ ID NO: 48540 - RNA, 22 nt, Yersinia pestis KIM
aacaucagcacuggugagauua

SEQ ID NO: 48541 - RNA, 22 nt, Yersinia pestis KIM
aaccauugacgggggcuuccag

SEQ ID NO: 48542 - RNA, 22 nt, Yersinia pestis KIM
aacccguugaaguugggcaaau

SEQ ID NO: 48543 - RNA, 22 nt, Yersinia pestis KIM
aaccgcagauggcggcggaucu

SEQ ID NO: 48544 - RNA, 22 nt, Yersinia pestis KIM
aaccggauaugucacauguuca

SEQ ID NO: 48545 - RNA, 22 nt, Yersinia pestis KIM
aaccggcaauuuauccaauaug

SEQ ID NO: 48546 - RNA, 22 nt, Yersinia pestis KIM
aacgacuggcgucacuggauaa

SEQ ID NO: 48547 - RNA, 22 nt, Yersinia pestis KIM
aacggcguugaguuacagacug

SEQ ID NO: 48548 - RNA, 22 nt, Yersinia pestis KIM
aacgguucaucagugcgauuga

SEQ ID NO: 48549 - RNA, 22 nt, Yersinia pestis KIM
aacgucgagcaacaagagcgug

SEQ ID NO: 48550 - RNA, 22 nt, Yersinia pestis KIM
aacucgaauuauuuaggguaua

SEQ ID NO: 48551 - RNA, 22 nt, Yersinia pestis KIM
aacuuucaugcuauuacccuua

SEQ ID NO: 48552 - RNA, 22 nt, Yersinia pestis KIM
aagaugacgauuuugguuucug

SEQ ID NO: 48553 - RNA, 22 nt, Yersinia pestis KIM
aagcauuacugcgugagaucca

SEQ ID NO: 48554 - RNA, 22 nt, Yersinia pestis KIM
aagccgauuaauuuccgaauau

SEQ ID NO: 48555 - RNA, 22 nt, Yersinia pestis KIM
aagccuuuauugaaugcaucca

SEQ ID NO: 48556 - RNA, 22 nt, Yersinia pestis KIM
aagcgcuggauccggauucauu

SEQ ID NO: 48557 - RNA, 22 nt, Yersinia pestis KIM
aagcgguaaucaguagucauug

SEQ ID NO: 48558 - RNA, 20 nt, Yersinia pestis KIM
aagcguuuguaguaacguuu

SEQ ID NO: 48559 - RNA, 22 nt, Yersinia pestis KIM
aaggccucugcuucauacagca

SEQ ID NO: 48560 - RNA, 22 nt, Yersinia pestis KIM
aagucgggagaauagcgcgcug

SEQ ID NO: 48561 - RNA, 21 nt, Yersinia pestis KIM
aagugauucggguuauugagc

SEQ ID NO: 48562 - RNA, 22 nt, Yersinia pestis KIM
aaguuaugguucuggacaucga

SEQ ID NO: 48563 - RNA, 22 nt, Yersinia pestis KIM
aauaacagaaacucagcauuua

SEQ ID NO: 48564 - RNA, 22 nt, Yersinia pestis KIM
aauagcaucguauucacuggcg

SEQ ID NO: 48565 - RNA, 22 nt, Yersinia pestis KIM
aauagcgcuaguuuaucaauuu

SEQ ID NO: 48566 - RNA, 22 nt, Yersinia pestis KIM
aaucauguuguagagaaacgaa

SEQ ID NO: 48567 - RNA, 22 nt, Yersinia pestis KIM
aaucggugcugacaccacagga

SEQ ID NO: 48568 - RNA, 22 nt, Yersinia pestis KIM
aaugacaguguuacccgagaga

SEQ ID NO: 48569 - RNA, 22 nt, Yersinia pestis KIM
aaugaccaucaaagaguuacug

SEQ ID NO: 48570 - RNA, 22 nt, Yersinia pestis KIM
aaugagucaauagcauucaagc

SEQ ID NO: 48571 - RNA, 22 nt, Yersinia pestis KIM
aaugccauggucacaucguuau

SEQ ID NO: 48572 - RNA, 22 nt, Yersinia pestis KIM
aauggauugauacugaucugau

SEQ ID NO: 48573 - RNA, 22 nt, Yersinia pestis KIM
aaugugguuggccugcgcaucg

SEQ ID NO: 48574 - RNA, 22 nt, Yersinia pestis KIM
aauucaguaauucgcucugugu

SEQ ID NO: 48575 - RNA, 22 nt, Yersinia pestis KIM
auccugaucgccuccggcguuc

SEQ ID NO: 48576 - RNA, 22 nt, Yersinia pestis KIM
auccugcguacugagcgacggu

SEQ ID NO: 48577 - RNA, 22 nt, Yersinia pestis KIM
auccuugaauucagucacugua

SEQ ID NO: 48578 - RNA, 22 nt, Yersinia pestis KIM
aucgccgaacugauuguggaca

SEQ ID NO: 48579 - RNA, 22 nt, Yersinia pestis KIM
aucgccuugucgguugguuuug

SEQ ID NO: 48580 - RNA, 19 nt, Yersinia pestis KIM
aucgggauuugugcgcugc

SEQ ID NO: 48581 - RNA, 22 nt, Yersinia pestis KIM
aucugcccgcguuggcggcugc

SEQ ID NO: 48582 - RNA, 22 nt, Yersinia pestis KIM
augaaacuguaaauaagucugu

SEQ ID NO: 48583 - RNA, 22 nt, Yersinia pestis KIM
augaccguuugugccguuuccc

SEQ ID NO: 48584 - RNA, 22 nt, Yersinia pestis KIM
augacuacgccguugcugaugc

SEQ ID NO: 48585 - RNA, 22 nt, Yersinia pestis KIM
augagccuauugcugcccgaga

SEQ ID NO: 48586 - RNA, 22 nt, Yersinia pestis KIM
augauagauucuaauggcuggu

SEQ ID NO: 48587 - RNA, 22 nt, Yersinia pestis KIM
augaucuggagguucgguucaa

SEQ ID NO: 48588 - RNA, 22 nt, Yersinia pestis KIM
augcaugggcugguaucacuug

SEQ ID NO: 48589 - RNA, 22 nt, Yersinia pestis KIM
augccguugaauugaucagacc

SEQ ID NO: 48590 - RNA, 22 nt, Yersinia pestis KIM
augcggugggugugauugguuu

SEQ ID NO: 48591 - RNA, 22 nt, Yersinia pestis KIM
augcuggcggcuaucgauguaa

SEQ ID NO: 48592 - RNA, 22 nt, Yersinia pestis KIM
auggaccgguaucagucaugcu

SEQ ID NO: 48593 - RNA, 22 nt, Yersinia pestis KIM
auggauggcaaguuaacgugcu

SEQ ID NO: 48594 - RNA, 22 nt, Yersinia pestis KIM
auggcccaccguggccguuuga

SEQ ID NO: 48595 - RNA, 20 nt, Yersinia pestis KIM
auggucaaucaguuccugcg

SEQ ID NO: 48596 - RNA, 22 nt, Yersinia pestis KIM
auggugacaaagagauagcugu

SEQ ID NO: 48597 - RNA, 18 nt, Yersinia pestis KIM
augguucguuuccugcgu

SEQ ID NO: 48598 - RNA, 21 nt, Yersinia pestis KIM
augucgcugaacauacgcugc

SEQ ID NO: 48599 - RNA, 22 nt, Yersinia pestis KIM
augugcugagcaggagcaguua

SEQ ID NO: 48600 - RNA, 22 nt, Yersinia pestis KIM
auguugaugaguucuguugagu

SEQ ID NO: 48601 - RNA, 22 nt, Yersinia pestis KIM
auuacagcuauuauucugcgcc

SEQ ID NO: 48602 - RNA, 22 nt, Yersinia pestis KIM
auuaucgcuuguuaauaaaugu

SEQ ID NO: 48603 - RNA, 21 nt, Yersinia pestis KIM
auucccguuuaucauuauagg

SEQ ID NO: 48604 - RNA, 22 nt, Yersinia pestis KIM
auucgcaagcugguuauccaag

SEQ ID NO: 48605 - RNA, 22 nt, Yersinia pestis KIM
auucgguuaguggugaucagcg

SEQ ID NO: 48606 - RNA, 22 nt, Yersinia pestis KIM
auucguuuagagcgcacggggu

SEQ ID NO: 48607 - RNA, 22 nt, Yersinia pestis KIM
auucugaaaucuaugaggugua

SEQ ID NO: 48608 - RNA, 22 nt, Yersinia pestis KIM
auucuuugaaaacggcgaggca

SEQ ID NO: 48609 - RNA, 22 nt, Yersinia pestis KIM
auugaucugauuuuacugaaag

SEQ ID NO: 48610 - RNA, 22 nt, Yersinia pestis KIM
auugaugugccaggggauaaua

SEQ ID NO: 48611 - RNA, 22 nt, Yersinia pestis KIM
auugccguaaaugagugagucg

SEQ ID NO: 48612 - RNA, 22 nt, Yersinia pestis KIM
auuggcacguaccgugacgguu

SEQ ID NO: 48613 - RNA, 22 nt, Yersinia pestis KIM
auuggccgaggugauuuuagcc

SEQ ID NO: 48614 - RNA, 22 nt, Yersinia pestis KIM
auuggcuuuaucgguacucaau

SEQ ID NO: 48615 - RNA, 22 nt, Yersinia pestis KIM
auugucagcaacgaaaaaaggc

SEQ ID NO: 48616 - RNA, 22 nt, Yersinia pestis KIM
auugucaugcagaaucgaaacu

SEQ ID NO: 48617 - RNA, 20 nt, Yersinia pestis KIM
auugucuugaugagauucaa

SEQ ID NO: 48618 - RNA, 22 nt, Yersinia pestis KIM
auuuagguaacgauaaauuugu

SEQ ID NO: 48619 - RNA, 22 nt, Yersinia pestis KIM
auuuggacaucccggcguuuuu

SEQ ID NO: 48620 - RNA, 22 nt, Yersinia pestis KIM
auuuggcggugcaaugguguuc

SEQ ID NO: 48621 - RNA, 22 nt, Yersinia pestis KIM
auuugucauuauuuaugagcgu

SEQ ID NO: 48622 - RNA, 22 nt, Yersinia pestis KIM
caaagauuauugguuaguugcg

SEQ ID NO: 48623 - RNA, 20 nt, Yersinia pestis KIM
caacgcgccgcugcugucgc

SEQ ID NO: 48624 - RNA, 22 nt, Yersinia pestis KIM
caagauggcguguauaacgaug

SEQ ID NO: 48625 - RNA, 22 nt, Yersinia pestis KIM
caagauguucgugguguagguu

SEQ ID NO: 48626 - RNA, 22 nt, Yersinia pestis KIM
caagucgccuuagguauccguc

SEQ ID NO: 48627 - RNA, 22 nt, Yersinia pestis KIM
caccgcuaauaucuuggcuuca

SEQ ID NO: 48628 - RNA, 22 nt, Yersinia pestis KIM
caccuucagucuccaaugugaa

SEQ ID NO: 48629 - RNA, 22 nt, Yersinia pestis KIM
cacgcgcuaacguuucucaggu

SEQ ID NO: 48630 - RNA, 22 nt, Yersinia pestis KIM
cacugcccaucgucagucauca

SEQ ID NO: 48631 - RNA, 22 nt, Yersinia pestis KIM
cacugcuccagcgccauuaaug

SEQ ID NO: 48632 - RNA, 22 nt, Yersinia pestis KIM
cagacggaacugguuaaaccau

SEQ ID NO: 48633 - RNA, 20 nt, Yersinia pestis KIM
cagcauggaucccagcggcu

SEQ ID NO: 48634 - RNA, 22 nt, Yersinia pestis KIM
cagcgcgaaucguuacacggua

SEQ ID NO: 48635 - RNA, 22 nt, Yersinia pestis KIM
caggcauuugauuuaugaaugg

SEQ ID NO: 48636 - RNA, 22 nt, Yersinia pestis KIM
caggcuguguauuccgcacccg

SEQ ID NO: 48637 - RNA, 22 nt, Yersinia pestis KIM
cagggcuguuuacacgcaagau

SEQ ID NO: 48638 - RNA, 22 nt, Yersinia pestis KIM
cagggucaguuggugguacauc

SEQ ID NO: 48639 - RNA, 22 nt, Yersinia pestis KIM
cagguuggcuguuguaugguag

SEQ ID NO: 48640 - RNA, 18 nt, Yersinia pestis KIM
cagugccacaauaaacag

SEQ ID NO: 48641 - RNA, 22 nt, Yersinia pestis KIM
cagugccuggauauaucuguau

SEQ ID NO: 48642 - RNA, 20 nt, Yersinia pestis KIM
caguuaauggaaaaagcguu

SEQ ID NO: 48643 - RNA, 20 nt, Yersinia pestis KIM
caguucaauuucgagggcuu

SEQ ID NO: 48644 - RNA, 22 nt, Yersinia pestis KIM
caguugauuaagcagccuuuca

SEQ ID NO: 48645 - RNA, 21 nt, Yersinia pestis KIM
caguuuacauuacgagggcuu

SEQ ID NO: 48646 - RNA, 22 nt, Yersinia pestis KIM
caucaauauagcguauugaauc

SEQ ID NO: 48647 - RNA, 22 nt, Yersinia pestis KIM
caucaucacgccacuccucugc

SEQ ID NO: 48648 - RNA, 21 nt, Yersinia pestis KIM
caugaucguccaugaagcggc

SEQ ID NO: 48649 - RNA, 22 nt, Yersinia pestis KIM
cauggcguuuaaucugaagcug

SEQ ID NO: 48650 - RNA, 22 nt, Yersinia pestis KIM
cauggguacugaaagaaccuga

SEQ ID NO: 48651 - RNA, 22 nt, Yersinia pestis KIM
caugugagaaauaugaaguuaa

SEQ ID NO: 48652 - RNA, 22 nt, Yersinia pestis KIM
cauugaaauagaauaaugucuc

SEQ ID NO: 48653 - RNA, 22 nt, Yersinia pestis KIM
cauugaaucggaucggugaauc

SEQ ID NO: 48654 - RNA, 22 nt, Yersinia pestis KIM
cauugguguacgccacucagcc

SEQ ID NO: 48655 - RNA, 19 nt, Yersinia pestis KIM
cauuuagucuacgcucuac

SEQ ID NO: 48656 - RNA, 22 nt, Yersinia pestis KIM
ccaauugagcaccguagcuuug

SEQ ID NO: 48657 - RNA, 21 nt, Yersinia pestis KIM
ccagaagcguuagcgcugguu

SEQ ID NO: 48658 - RNA, 22 nt, Yersinia pestis KIM
ccaguuggaugaucgccuggca

SEQ ID NO: 48659 - RNA, 23 nt, Yersinia pestis KIM
ccaugaucuggagguucgguuca

SEQ ID NO: 48660 - RNA, 22 nt, Yersinia pestis KIM
ccauggaauuacuauuuacugg

SEQ ID NO: 48661 - RNA, 22 nt, Yersinia pestis KIM
cccgacaugaccuccagcauau

SEQ ID NO: 48662 - RNA, 23 nt, Yersinia pestis KIM
ccgaccaguggcucagccaguaa

SEQ ID NO: 48663 - RNA, 22 nt, Yersinia pestis KIM
ccgacgcuggacuuaaccacgu

SEQ ID NO: 48664 - RNA, 22 nt, Yersinia pestis KIM
ccgauaagagucugcgagccuu

SEQ ID NO: 48665 - RNA, 22 nt, Yersinia pestis KIM
ccgaugaugcagcaguaucuuc

SEQ ID NO: 48666 - RNA, 22 nt, Yersinia pestis KIM
gaccuucaccguauugccuacc

SEQ ID NO: 48667 - RNA, 22 nt, Yersinia pestis KIM
gacgcuuuugauccggcgcugg

SEQ ID NO: 48668 - RNA, 22 nt, Yersinia pestis KIM
gagaggcuuuagacuccguaau

SEQ ID NO: 48669 - RNA, 22 nt, Yersinia pestis KIM
gagcaacgucucggccauuauu

SEQ ID NO: 48670 - RNA, 22 nt, Yersinia pestis KIM
gagcagcaugaucaacaguuga

SEQ ID NO: 48671 - RNA, 22 nt, Yersinia pestis KIM
gagcagcguuaugguauucggu

SEQ ID NO: 48672 - RNA, 22 nt, Yersinia pestis KIM
gagcguugcgcuguccguuauu

SEQ ID NO: 48673 - RNA, 22 nt, Yersinia pestis KIM
gaguaucucaagcggcacaaua

SEQ ID NO: 48674 - RNA, 22 nt, Yersinia pestis KIM
gagucuaaaaauaacauaagcu

SEQ ID NO: 48675 - RNA, 22 nt, Yersinia pestis KIM
gauacuguaucgguacucaccg

SEQ ID NO: 48676 - RNA, 22 nt, Yersinia pestis KIM
gaucaugaaaaaacuguccggu

SEQ ID NO: 48677 - RNA, 22 nt, Yersinia pestis KIM
gaucccucguggagaggcucaa

SEQ ID NO: 48678 - RNA, 22 nt, Yersinia pestis KIM
gauccugucaauauugggauau

SEQ ID NO: 48679 - RNA, 22 nt, Yersinia pestis KIM
gaugaggcguucaagaauuugg

SEQ ID NO: 48680 - RNA, 22 nt, Yersinia pestis KIM
gaugaguuuugcguuuaaugaa

SEQ ID NO: 48681 - RNA, 20 nt, Yersinia pestis KIM
gaugauauuaagaauagcua

SEQ ID NO: 48682 - RNA, 22 nt, Yersinia pestis KIM
gaugaucuucaugugcugcucg

SEQ ID NO: 48683 - RNA, 22 nt, Yersinia pestis KIM
gaugcgcugggaccaacuauuu

SEQ ID NO: 48684 - RNA, 22 nt, Yersinia pestis KIM
gauugcagccaguguuuccccg

SEQ ID NO: 48685 - RNA, 22 nt, Yersinia pestis KIM
gauugccauucuggggcuggua

SEQ ID NO: 48686 - RNA, 19 nt, Yersinia pestis KIM
gauugccgccgguucguug

SEQ ID NO: 48687 - RNA, 22 nt, Yersinia pestis KIM
gauuuagaugcaaucaauagag

SEQ ID NO: 48688 - RNA, 22 nt, Yersinia pestis KIM
gauuugccauucgcuugcugcc

SEQ ID NO: 48689 - RNA, 22 nt, Yersinia pestis KIM
gcaaagcgaaaugaauaauguc

SEQ ID NO: 48690 - RNA, 22 nt, Yersinia pestis KIM
gcaaagugucuggcaugaccgu

SEQ ID NO: 48691 - RNA, 22 nt, Yersinia pestis KIM
gcaaugaucacacgggguauag

SEQ ID NO: 48692 - RNA, 22 nt, Yersinia pestis KIM
gcaauggcauuacguguuaagu

SEQ ID NO: 48693 - RNA, 22 nt, Yersinia pestis KIM
gcaauguccgaucgagugcagg

SEQ ID NO: 48694 - RNA, 22 nt, Yersinia pestis KIM
gcacuauauuccgaugaauaug

SEQ ID NO: 48695 - RNA, 21 nt, Yersinia pestis KIM
gcagauugcggauaacaggag

SEQ ID NO: 48696 - RNA, 22 nt, Yersinia pestis KIM
gcagcauacaacuuccgcauca

SEQ ID NO: 48697 - RNA, 22 nt, Yersinia pestis KIM
gcaggucagaccuaaguugugu

SEQ ID NO: 48698 - RNA, 19 nt, Yersinia pestis KIM
gcaucauauaauuauuggu

SEQ ID NO: 48699 - RNA, 22 nt, Yersinia pestis KIM
gcauccggcuggccugucgcca

SEQ ID NO: 48700 - RNA, 22 nt, Yersinia pestis KIM
gcaugacugaaaggccgaguuu

SEQ ID NO: 48701 - RNA, 22 nt, Yersinia pestis KIM
gcaugugaauaagcuugaacaa

SEQ ID NO: 48702 - RNA, 19 nt, Yersinia pestis KIM
gcauugguaggcccuaucc

SEQ ID NO: 48703 - RNA, 22 nt, Yersinia pestis KIM
gcauuuaguugccgaacgaucc

SEQ ID NO: 48704 - RNA, 20 nt, Yersinia pestis KIM
gccaaggugcuuuuacgcga

SEQ ID NO: 48705 - RNA, 22 nt, Yersinia pestis KIM
gccaauaaaguccgugaaaucg

SEQ ID NO: 48706 - RNA, 22 nt, Yersinia pestis KIM
gccacaagcaacauuaucgucu

SEQ ID NO: 48707 - RNA, 22 nt, Yersinia pestis KIM
gccacgcugcgcugugagggug

SEQ ID NO: 48708 - RNA, 22 nt, Yersinia pestis KIM
gccagcuugucggucaguguuu

SEQ ID NO: 48709 - RNA, 22 nt, Yersinia pestis KIM
gccagcuuuguaaucuggcaga

SEQ ID NO: 48710 - RNA, 22 nt, Yersinia pestis KIM
gccagucaaggggucuaugauu

SEQ ID NO: 48711 - RNA, 22 nt, Yersinia pestis KIM
gccaguguuacccaccaaggaa

SEQ ID NO: 48712 - RNA, 22 nt, Yersinia pestis KIM
gccauuggauaaagcacuggaa

SEQ ID NO: 48713 - RNA, 22 nt, Yersinia pestis KIM
gcccaugaccguuuugguggcu

SEQ ID NO: 48714 - RNA, 22 nt, Yersinia pestis KIM
gcccauuggcaguugaaguaau

SEQ ID NO: 48715 - RNA, 22 nt, Yersinia pestis KIM
gccgcauugcguuuggucggug

SEQ ID NO: 48716 - RNA, 22 nt, Yersinia pestis KIM
gccguguaaaugcacaacaagc

SEQ ID NO: 48717 - RNA, 22 nt, Yersinia pestis KIM
gcgauaacgugacguugcuacg

SEQ ID NO: 48718 - RNA, 21 nt, Yersinia pestis KIM
gcgauugaaagucacaccgag

SEQ ID NO: 48719 - RNA, 22 nt, Yersinia pestis KIM
gcgcguuaguacuggguagcua

SEQ ID NO: 48720 - RNA, 22 nt, Yersinia pestis KIM
gcgcuguuuuuauaaauaaccc

SEQ ID NO: 48721 - RNA, 22 nt, Yersinia pestis KIM
gcgcuugauuauuggccucugc

SEQ ID NO: 48722 - RNA, 22 nt, Yersinia pestis KIM
gcggauauacccaaguugcuga

SEQ ID NO: 48723 - RNA, 22 nt, Yersinia pestis KIM
gcggcaaugugcuguauaccgc

SEQ ID NO: 48724 - RNA, 22 nt, Yersinia pestis KIM
gcggugcugcucgguuuuggug

SEQ ID NO: 48725 - RNA, 22 nt, Yersinia pestis KIM
gcguaaugguaagguugucggu

SEQ ID NO: 48726 - RNA, 22 nt, Yersinia pestis KIM
gcgucguuuuuagugucgcaau

SEQ ID NO: 48727 - RNA, 22 nt, Yersinia pestis KIM
gcuagcaagaagaauugaucau

SEQ ID NO: 48728 - RNA, 22 nt, Yersinia pestis KIM
gcuaucaaugaugccgcuacug

SEQ ID NO: 48729 - RNA, 22 nt, Yersinia pestis KIM
gcuaucaguggauuaggguucu

SEQ ID NO: 48730 - RNA, 18 nt, Yersinia pestis KIM
gcucacugauuaacgcac

SEQ ID NO: 48731 - RNA, 22 nt, Yersinia pestis KIM
gcucaugaguuaaugcgucucg

SEQ ID NO: 48732 - RNA, 22 nt, Yersinia pestis KIM
gcucauuaauuccgaugagcuu

SEQ ID NO: 48733 - RNA, 22 nt, Yersinia pestis KIM
gcucauuggucucguuuuuggu

SEQ ID NO: 48734 - RNA, 22 nt, Yersinia pestis KIM
gcucuggcccaaaguauguuua

SEQ ID NO: 48735 - RNA, 20 nt, Yersinia pestis KIM
gcucugucauaucauuguug

SEQ ID NO: 48736 - RNA, 22 nt, Yersinia pestis KIM
gcugaaaguaucgguaugaaag

SEQ ID NO: 48737 - RNA, 22 nt, Yersinia pestis KIM
gcuggauuugaguggcgguacg

SEQ ID NO: 48738 - RNA, 22 nt, Yersinia pestis KIM
gcuggcuuaaugaucaagcggc

SEQ ID NO: 48739 - RNA, 17 nt, Yersinia pestis KIM
gcugucagucguuugac

SEQ ID NO: 48740 - RNA, 22 nt, Yersinia pestis KIM
gcugucuguugccugacgcaga

SEQ ID NO: 48741 - RNA, 22 nt, Yersinia pestis KIM
gcuucgauguggcaauaaauuu

SEQ ID NO: 48742 - RNA, 22 nt, Yersinia pestis KIM
gcuuuccgcuucuuugucacca

SEQ ID NO: 48743 - RNA, 22 nt, Yersinia pestis KIM
ggaacucgaugaaaauuaguuu

SEQ ID NO: 48744 - RNA, 18 nt, Yersinia pestis KIM
ggaugcagugauuacggc

SEQ ID NO: 48745 - RNA, 22 nt, Yersinia pestis KIM
ggaugcauucuucaaugauauc

SEQ ID NO: 48746 - RNA, 22 nt, Yersinia pestis KIM
ggauuggauagaugccggaucg

SEQ ID NO: 48747 - RNA, 22 nt, Yersinia pestis KIM
ggcaaauaucagguuuggggug

SEQ ID NO: 48748 - RNA, 22 nt, Yersinia pestis KIM
ggcaacauucagcggaacggau

SEQ ID NO: 48749 - RNA, 22 nt, Yersinia pestis KIM
ggcaauccgacagaugacccaa

SEQ ID NO: 48750 - RNA, 22 nt, Yersinia pestis KIM
ggccauuggcagcuuuauauau

SEQ ID NO: 48751 - RNA, 20 nt, Yersinia pestis KIM
ggccauuugggugcacucua

SEQ ID NO: 48752 - RNA, 22 nt, Yersinia pestis KIM
ggcccucacguucaccacggua

SEQ ID NO: 48753 - RNA, 22 nt, Yersinia pestis KIM
ggccuucagaaugcugacaaac

SEQ ID NO: 48754 - RNA, 22 nt, Yersinia pestis KIM
ggcuggcaaacguuucacacuc

SEQ ID NO: 48755 - RNA, 22 nt, Yersinia pestis KIM
ggcuuccugcauucguucagcc

SEQ ID NO: 48756 - RNA, 22 nt, Yersinia pestis KIM
gggauaacaccgauccgcuggc

SEQ ID NO: 48757 - RNA, 20 nt, Yersinia pestis KIM
ucaauuaggagccgugccca

SEQ ID NO: 48758 - RNA, 22 nt, Yersinia pestis KIM
ucacaaaguucgucuguuguug

SEQ ID NO: 48759 - RNA, 22 nt, Yersinia pestis KIM
ucacagccauggcugugcgcaa

SEQ ID NO: 48760 - RNA, 22 nt, Yersinia pestis KIM
ucacggcuuguaugaggcugaa

SEQ ID NO: 48761 - RNA, 22 nt, Yersinia pestis KIM
ucagacagagaggaauaugaac

SEQ ID NO: 48762 - RNA, 22 nt, Yersinia pestis KIM
ucagaguuuaucuucguagguu

SEQ ID NO: 48763 - RNA, 22 nt, Yersinia pestis KIM
ucagauccugucaccuucuuca

SEQ ID NO: 48764 - RNA, 19 nt, Yersinia pestis KIM
ucaggcgcuuggauuuuac

SEQ ID NO: 48765 - RNA, 22 nt, Yersinia pestis KIM
ucagugaaguaaaugauuacga

SEQ ID NO: 48766 - RNA, 22 nt, Yersinia pestis KIM
ucaguugaucaacuuuagcguu

SEQ ID NO: 48767 - RNA, 22 nt, Yersinia pestis KIM
ucaguuguuccugacgccuguu

SEQ ID NO: 48768 - RNA, 22 nt, Yersinia pestis KIM
ucauccaucugucgcccgguca

SEQ ID NO: 48769 - RNA, 22 nt, Yersinia pestis KIM
ucauggcggugaggaauaucuu

SEQ ID NO: 48770 - RNA, 22 nt, Yersinia pestis KIM
ucaugggcuugagucccgacgg

SEQ ID NO: 48771 - RNA, 22 nt, Yersinia pestis KIM
uccauugaacccgugucauuaa

SEQ ID NO: 48772 - RNA, 22 nt, Yersinia pestis KIM
uccgguauuucucuggaugaga

SEQ ID NO: 48773 - RNA, 22 nt, Yersinia pestis KIM
uccuggcuaaugcugccgccgg

SEQ ID NO: 48774 - RNA, 22 nt, Yersinia pestis KIM
uccuuaacugaucggcauugcu

SEQ ID NO: 48775 - RNA, 22 nt, Yersinia pestis KIM
uccuuaacugaucggcauuggg

SEQ ID NO: 48776 - RNA, 22 nt, Yersinia pestis KIM
ucgauucuuguucugcaacggu

SEQ ID NO: 48777 - RNA, 22 nt, Yersinia pestis KIM
ucgcaaagcgaugaucacggca

SEQ ID NO: 48778 - RNA, 22 nt, Yersinia pestis KIM
ucgcaguggggggcacggucca

SEQ ID NO: 48779 - RNA, 22 nt, Yersinia pestis KIM
ucgccagcuaucagagcgguca

SEQ ID NO: 48780 - RNA, 22 nt, Yersinia pestis KIM
ucgucacgcuaaacagauaagc

SEQ ID NO: 48781 - RNA, 22 nt, Yersinia pestis KIM
ucucaaauuagaaaaugccgcu

SEQ ID NO: 48782 - RNA, 22 nt, Yersinia pestis KIM
ucucauuaaucggcucuggugc

SEQ ID NO: 48783 - RNA, 22 nt, Yersinia pestis KIM
ucucuggaagagaacauugaaa

SEQ ID NO: 48784 - RNA, 22 nt, Yersinia pestis KIM
ucugggcuguuggucgauugca

SEQ ID NO: 48785 - RNA, 22 nt, Yersinia pestis KIM
ucugguuaguggcagugauauc

SEQ ID NO: 48786 - RNA, 23 nt, Yersinia pestis KIM
ucugucacaccggaguuggcagc

SEQ ID NO: 48787 - RNA, 22 nt, Yersinia pestis KIM
ucugugcgcccauguucucgaa

SEQ ID NO: 48788 - RNA, 22 nt, Yersinia pestis KIM
ucuuccggugcaaauacuggca

SEQ ID NO: 48789 - RNA, 23 nt, Yersinia pestis KIM
ucuugcguaaucuuuaucgcgcg

SEQ ID NO: 48790 - RNA, 22 nt, Yersinia pestis KIM
ugaacguguucccaauauugau

SEQ ID NO: 48791 - RNA, 22 nt, Yersinia pestis KIM
ugacuaaucgacggcugccuca

SEQ ID NO: 48792 - RNA, 22 nt, Yersinia pestis KIM
ugacuaucaugagugcggcaac

SEQ ID NO: 48793 - RNA, 22 nt, Yersinia pestis KIM
ugagcuggcgccgaaagcgguc

SEQ ID NO: 48794 - RNA, 22 nt, Yersinia pestis KIM
ugauacaucaguaacaggugua

SEQ ID NO: 48795 - RNA, 22 nt, Yersinia pestis KIM
ugaucagcuuaauauuuugcac

SEQ ID NO: 48796 - RNA, 22 nt, Yersinia pestis KIM
ugaugcaagugaucccuggcgg

SEQ ID NO: 48797 - RNA, 22 nt, Yersinia pestis KIM
ugaugccgguaccgcuugcucc

SEQ ID NO: 48798 - RNA, 22 nt, Yersinia pestis KIM
ugauggcauaaaggaaacggua

SEQ ID NO: 48799 - RNA, 22 nt, Yersinia pestis KIM
ugcaaguucaggaagcggauuu

SEQ ID NO: 48800 - RNA, 20 nt, Yersinia pestis KIM
ugcacagcuggaugugaguc

SEQ ID NO: 48801 - RNA, 22 nt, Yersinia pestis KIM
ugcacugaaccccagaucuugg

SEQ ID NO: 48802 - RNA, 22 nt, Yersinia pestis KIM
ugccaagcgcuuuggcaauuuc

SEQ ID NO: 48803 - RNA, 22 nt, Yersinia pestis KIM
ugccaccgguauuuggacauuc

SEQ ID NO: 48804 - RNA, 21 nt, Yersinia pestis KIM
ugccacucuagcgaccgaaga

SEQ ID NO: 48805 - RNA, 22 nt, Yersinia pestis KIM
ugccagauccccagccuucacu

SEQ ID NO: 48806 - RNA, 22 nt, Yersinia pestis KIM
ugccaucuuaaucgcagccaga

SEQ ID NO: 48807 - RNA, 22 nt, Yersinia pestis KIM
ugcccguugggcuaacgccaug

SEQ ID NO: 48808 - RNA, 22 nt, Yersinia pestis KIM
ugcggaccggaaaauguggaac

SEQ ID NO: 48809 - RNA, 22 nt, Yersinia pestis KIM
ugcggaguuggucacauugaug

SEQ ID NO: 48810 - RNA, 22 nt, Yersinia pestis KIM
ugcggcaggcauuguggcucgu

SEQ ID NO: 48811 - RNA, 22 nt, Yersinia pestis KIM
ugcuacaccugcacagcgugaa

SEQ ID NO: 48812 - RNA, 22 nt, Yersinia pestis KIM
ugcuagguuuuaaucugaucag

SEQ ID NO: 48813 - RNA, 22 nt, Yersinia pestis KIM
ugcuauugaugucuuugaacuc

SEQ ID NO: 48814 - RNA, 22 nt, Yersinia pestis KIM
ugcucaaguaucagugcucgca

SEQ ID NO: 48815 - RNA, 22 nt, Yersinia pestis KIM
ugcucagauuaucaggccagua

SEQ ID NO: 48816 - RNA, 22 nt, Yersinia pestis KIM
ugcucagcauguugauguccuu

SEQ ID NO: 48817 - RNA, 22 nt, Yersinia pestis KIM
ugcugaaccggucaccgcaggc

SEQ ID NO: 48818 - RNA, 19 nt, Yersinia pestis KIM
ugcugagauugugcuuguu

SEQ ID NO: 48819 - RNA, 22 nt, Yersinia pestis KIM
uggauaccuggcaaauggcgga

SEQ ID NO: 48820 - RNA, 22 nt, Yersinia pestis KIM
uggccaauaugucccaugagcu

SEQ ID NO: 48821 - RNA, 18 nt, Yersinia pestis KIM
uggcccaacucucuuaau

SEQ ID NO: 48822 - RNA, 22 nt, Yersinia pestis KIM
uggccgaagaacauggguucga

SEQ ID NO: 48823 - RNA, 22 nt, Yersinia pestis KIM
uggccugcgggaugugauguca

SEQ ID NO: 48824 - RNA, 22 nt, Yersinia pestis KIM
uggccuggguguggaugccuuu

SEQ ID NO: 48825 - RNA, 22 nt, Yersinia pestis KIM
uggcuagagacgcuggccgauu

SEQ ID NO: 48826 - RNA, 22 nt, Yersinia pestis KIM
uggcucuuuacgaucaagugga

SEQ ID NO: 48827 - RNA, 22 nt, Yersinia pestis KIM
uggcuuaauuuggguaagaccu

SEQ ID NO: 48828 - RNA, 22 nt, Yersinia pestis KIM
uggcuuauuucaguuaccugaa

SEQ ID NO: 48829 - RNA, 22 nt, Yersinia pestis KIM
ugguagcgguuauuuucaggaa

SEQ ID NO: 48830 - RNA, 22 nt, Yersinia pestis KIM
ugguuaaacaauacggugcccu

SEQ ID NO: 48831 - RNA, 23 nt, Yersinia pestis KIM
uguacgcgauauuugucaccuac

SEQ ID NO: 48832 - RNA, 19 nt, Yersinia pestis KIM
uguagugaugcugaauuua

SEQ ID NO: 48833 - RNA, 22 nt, Yersinia pestis KIM
uguaucuugcaagguuggugua

SEQ ID NO: 48834 - RNA, 22 nt, Yersinia pestis KIM
ugucaucgccgaacugauuuug

SEQ ID NO: 48835 - RNA, 22 nt, Yersinia pestis KIM
uguccguugcgcaggauccacg

SEQ ID NO: 48836 - RNA, 22 nt, Yersinia pestis KIM
ugucguuaauucaaaguaaugc

SEQ ID NO: 48837 - RNA, 22 nt, Yersinia pestis KIM
ugucugaacuugcuuuagugga

SEQ ID NO: 48838 - RNA, 22 nt, Yersinia pestis KIM
ugucuuuaaccuugauaccaga

SEQ ID NO: 48839 - RNA, 22 nt, Yersinia pestis KIM
ugugacaauaaugcauauucgu

SEQ ID NO: 48840 - RNA, 22 nt, Yersinia pestis KIM
ugugagucacaguauuaaaaug

SEQ ID NO: 48841 - RNA, 22 nt, Yersinia pestis KIM
uguugccaaaggagcucagcau

SEQ ID NO: 48842 - RNA, 22 nt, Yersinia pestis KIM
uuaagccauugaauauuguuau

SEQ ID NO: 48843 - RNA, 22 nt, Yersinia pestis KIM
uuaccgauuuucaacgucagcu

SEQ ID NO: 48844 - RNA, 22 nt, Yersinia pestis KIM
uuaccgucuacccguggaagcg

SEQ ID NO: 48845 - RNA, 22 nt, Yersinia pestis KIM
uuacucaucuggaaggcuaccg

SEQ ID NO: 48846 - RNA, 22 nt, Yersinia pestis KIM
uuaggccggccaauuggcgcuu

SEQ ID NO: 48847 - RNA, 20 nt, Yersinia pestis KIM
uuauagguagaauucgccgc

SEQ ID NO: 48848 - RNA, 22 nt, Yersinia pestis KIM
uucacugaguguuugcaguaau

SEQ ID NO: 48849 - RNA, 22 nt, Yersinia pestis KIM
uucaggcugcgguucaugguca

SEQ ID NO: 48850 - RNA, 22 nt, Yersinia pestis KIM
uucaucacgauaaagucagguu

SEQ ID NO: 48851 - RNA, 22 nt, Yersinia pestis KIM
uucaugcugcaacacugacagg

SEQ ID NO: 48852 - RNA, 18 nt, Yersinia pestis KIM
uucauggaugggcgguga

SEQ ID NO: 48853 - RNA, 22 nt, Yersinia pestis KIM
uuccgugcuaccuauuuuggcu

SEQ ID NO: 48854 - RNA, 23 nt, Yersinia pestis KIM
uucgaaccacaaucuggcuauuu

SEQ ID NO: 48855 - RNA, 22 nt, Yersinia pestis KIM
uugacaugcaguucagucagga

SEQ ID NO: 48856 - RNA, 22 nt, Yersinia pestis KIM
uugacgcauugaaaaguaauaa

SEQ ID NO: 48857 - RNA, 22 nt, Yersinia pestis KIM
uugacguuuugacgaucaaucg

SEQ ID NO: 48858 - RNA, 22 nt, Yersinia pestis KIM
uugagcguuauccggggguguu

SEQ ID NO: 48859 - RNA, 22 nt, Yersinia pestis KIM
uugagcugcgccugaccggugg

SEQ ID NO: 48860 - RNA, 22 nt, Yersinia pestis KIM
uugauagcguugaagcgcaagc

SEQ ID NO: 48861 - RNA, 22 nt, Yersinia pestis KIM
uugauagcucuguugagcgugg

SEQ ID NO: 48862 - RNA, 22 nt, Yersinia pestis KIM
uugcagagaguauggugauagc

SEQ ID NO: 48863 - RNA, 22 nt, Yersinia pestis KIM
uugcagcggccucgucgagacg

SEQ ID NO: 48864 - RNA, 22 nt, Yersinia pestis KIM
uugcaguuuagccagcaacuga

SEQ ID NO: 48865 - RNA, 22 nt, Yersinia pestis KIM
uugcguaauaaugcggcuuggu

SEQ ID NO: 48866 - RNA, 19 nt, Yersinia pestis KIM
uugcugcaaaauauuuuca

SEQ ID NO: 48867 - RNA, 22 nt, Yersinia pestis KIM
uugcuugauuucacauuacguc

SEQ ID NO: 48868 - RNA, 22 nt, Yersinia pestis KIM
uuggauucaacggcccaguuag

SEQ ID NO: 48869 - RNA, 22 nt, Yersinia pestis KIM
uuggcgcugauaacuaaacuuu

SEQ ID NO: 48870 - RNA, 22 nt, Yersinia pestis KIM
uuggcuaacguugccguguuac

SEQ ID NO: 48871 - RNA, 22 nt, Yersinia pestis KIM
uugggcgauuaccaaugggaac

SEQ ID NO: 48872 - RNA, 22 nt, Yersinia pestis KIM
uuguaauguagacaaggagaau

SEQ ID NO: 48873 - RNA, 19 nt, Yersinia pestis KIM
uugugcacugccaucggcc

SEQ ID NO: 48874 - RNA, 22 nt, Yersinia pestis KIM
uuuaaggucauggaaggugaaa

SEQ ID NO: 48875 - RNA, 22 nt, Yersinia pestis KIM
uuuaucagcaacaguggcuuuu

SEQ ID NO: 48876 - RNA, 22 nt, Yersinia pestis KIM
uuuccagcggaauuucaagcug

SEQ ID NO: 48877 - RNA, 22 nt, Yersinia pestis KIM
uuugacuucugauucagcgagu

SEQ ID NO: 48878 - RNA, 19 nt, Yersinia pestis KIM
uuugcccguaauaugcaag

SEQ ID NO: 48879 - RNA, 22 nt, Yersinia pestis KIM
uuugccguguuggguaacgugg

SEQ ID NO: 48880 - RNA, 22 nt, Yersinia pestis KIM
auuaagcaggcuuugcuguagu

SEQ ID NO: 48881 - RNA, 22 nt, Yersinia pestis KIM
auuagcagugaugguuauuuau

SEQ ID NO: 48882 - RNA, 22 nt, Yersinia pestis KIM
auuauggccgauaagacauuag

SEQ ID NO: 48883 - RNA, 22 nt, Yersinia pestis KIM
auucagaugccaaucuucuugg

SEQ ID NO: 48884 - RNA, 21 nt, Yersinia pestis KIM
auucaugacaccacaacggau

SEQ ID NO: 48885 - RNA, 22 nt, Yersinia pestis KIM
auucaugucagugcuaucacuc

SEQ ID NO: 48886 - RNA, 22 nt, Yersinia pestis KIM
auucauucuguggauucaugac

SEQ ID NO: 48887 - RNA, 18 nt, Yersinia pestis KIM
auucgccaacugaugcag

SEQ ID NO: 48888 - RNA, 22 nt, Yersinia pestis KIM
auucgcuguucgggaguaagag

SEQ ID NO: 48889 - RNA, 22 nt, Yersinia pestis KIM
auucuggcuggggaucauaucu

SEQ ID NO: 48890 - RNA, 22 nt, Yersinia pestis KIM
auugaauccaugcuaaaccggu

SEQ ID NO: 48891 - RNA, 22 nt, Yersinia pestis KIM
auuggaaaacccuggaucuggg

SEQ ID NO: 48892 - RNA, 22 nt, Yersinia pestis KIM
auuggcacggguugcugucgau

SEQ ID NO: 48893 - RNA, 22 nt, Yersinia pestis KIM
auugugcuuucugaugccugau

SEQ ID NO: 48894 - RNA, 22 nt, Yersinia pestis KIM
auuucgaaguguacugggcggc

SEQ ID NO: 48895 - RNA, 22 nt, Yersinia pestis KIM
auuugcuggccuguuuaaucug

SEQ ID NO: 48896 - RNA, 22 nt, Yersinia pestis KIM
caaaucaugauaaaugauggug

SEQ ID NO: 48897 - RNA, 22 nt, Yersinia pestis KIM
caacccgucaacuauguugcaa

SEQ ID NO: 48898 - RNA, 22 nt, Yersinia pestis KIM
caauagacauaauuagggaacu

SEQ ID NO: 48899 - RNA, 22 nt, Yersinia pestis KIM
caaucaugauauggcgagcccc

SEQ ID NO: 48900 - RNA, 22 nt, Yersinia pestis KIM
caaucguuguuucugauagcga

SEQ ID NO: 48901 - RNA, 22 nt, Yersinia pestis KIM
cacccuuguuaaacgucaguaa

SEQ ID NO: 48902 - RNA, 22 nt, Yersinia pestis KIM
caccgcaguaaagaauuuaugc

SEQ ID NO: 48903 - RNA, 22 nt, Yersinia pestis KIM
caccgccuggcuauagcccuga

SEQ ID NO: 48904 - RNA, 22 nt, Yersinia pestis KIM
cacucgucauauuucacguggg

SEQ ID NO: 48905 - RNA, 22 nt, Yersinia pestis KIM
cagaacgccaugaauaauaaaa

SEQ ID NO: 48906 - RNA, 22 nt, Yersinia pestis KIM
cagacauuguugcauaugguca

SEQ ID NO: 48907 - RNA, 22 nt, Yersinia pestis KIM
cagagcagucauuaaauuuuau

SEQ ID NO: 48908 - RNA, 20 nt, Yersinia pestis KIM
cagauuguugugcguucauu

SEQ ID NO: 48909 - RNA, 19 nt, Yersinia pestis KIM
cagcaaagccagcaguuuu

SEQ ID NO: 48910 - RNA, 22 nt, Yersinia pestis KIM
cagcaacuggcguuucggaucc

SEQ ID NO: 48911 - RNA, 22 nt, Yersinia pestis KIM
cagccagccauugcaggucgau

SEQ ID NO: 48912 - RNA, 22 nt, Yersinia pestis KIM
cagcggauccugauagcccaca

SEQ ID NO: 48913 - RNA, 22 nt, Yersinia pestis KIM
cagcggcuaacguugaauauuu

SEQ ID NO: 48914 - RNA, 22 nt, Yersinia pestis KIM
cagcgggacggucaauaucacc

SEQ ID NO: 48915 - RNA, 22 nt, Yersinia pestis KIM
cagcgugagcagcgcggcagac

SEQ ID NO: 48916 - RNA, 22 nt, Yersinia pestis KIM
caggacuucaguuaucgcaucg

SEQ ID NO: 48917 - RNA, 22 nt, Yersinia pestis KIM
caggcgauuucgcaaaggcaug

SEQ ID NO: 48918 - RNA, 22 nt, Yersinia pestis KIM
cagggccuuaccaucaacgagc

SEQ ID NO: 48919 - RNA, 22 nt, Yersinia pestis KIM
cagguaacugagguuuauggug

SEQ ID NO: 48920 - RNA, 22 nt, Yersinia pestis KIM
cagucuggcuuuucgcaaaauu

SEQ ID NO: 48921 - RNA, 22 nt, Yersinia pestis KIM
caguggauagacauaauggagu

SEQ ID NO: 48922 - RNA, 22 nt, Yersinia pestis KIM
caguucauugccagugaagaca

SEQ ID NO: 48923 - RNA, 22 nt, Yersinia pestis KIM
cauaacauccuaaaaagcgcga

SEQ ID NO: 48924 - RNA, 22 nt, Yersinia pestis KIM
cauauaguccgguaauuguugc

SEQ ID NO: 48925 - RNA, 22 nt, Yersinia pestis KIM
cauauucgucaacguaguagga

SEQ ID NO: 48926 - RNA, 22 nt, Yersinia pestis KIM
caucaagaugcacgucauacuc

SEQ ID NO: 48927 - RNA, 22 nt, Yersinia pestis KIM
cauccugagaggcuugcaguaa

SEQ ID NO: 48928 - RNA, 22 nt, Yersinia pestis KIM
caucgaggaaauuucagaggug

SEQ ID NO: 48929 - RNA, 22 nt, Yersinia pestis KIM
caucgauuaccgcaugauuaaa

SEQ ID NO: 48930 - RNA, 21 nt, Yersinia pestis KIM
caugaugauguccacucucgc

SEQ ID NO: 48931 - RNA, 22 nt, Yersinia pestis KIM
cauggcuuucgugguuugauca

SEQ ID NO: 48932 - RNA, 22 nt, Yersinia pestis KIM
cauuaaccuguucuugauguua

SEQ ID NO: 48933 - RNA, 22 nt, Yersinia pestis KIM
cauuacugauaguuuguugcgu

SEQ ID NO: 48934 - RNA, 22 nt, Yersinia pestis KIM
cauuacugucaacguuguggca

SEQ ID NO: 48935 - RNA, 22 nt, Yersinia pestis KIM
cauuccgugccggugcugaaga

SEQ ID NO: 48936 - RNA, 22 nt, Yersinia pestis KIM
cauuggcugaaaugucagauag

SEQ ID NO: 48937 - RNA, 22 nt, Yersinia pestis KIM
cauuugugcugaagcuggguuc

SEQ ID NO: 48938 - RNA, 22 nt, Yersinia pestis KIM
ccagauaaguuuaaaugguuuc

SEQ ID NO: 48939 - RNA, 21 nt, Yersinia pestis KIM
ccagauuuucagguacgcugg

SEQ ID NO: 48940 - RNA, 22 nt, Yersinia pestis KIM
ccagcauucauuuuggggaugu

SEQ ID NO: 48941 - RNA, 22 nt, Yersinia pestis KIM
ccagcguuguucugcccugcgu

SEQ ID NO: 48942 - RNA, 22 nt, Yersinia pestis KIM
ccagcuaaucugauggcgaucu

SEQ ID NO: 48943 - RNA, 20 nt, Yersinia pestis KIM
ccagcuugcaauucggcgau

SEQ ID NO: 48944 - RNA, 22 nt, Yersinia pestis KIM
ccaguggcaccacaccgaaacu

SEQ ID NO: 48945 - RNA, 22 nt, Yersinia pestis KIM
ccaguuagcgcuauaugauuua

SEQ ID NO: 48946 - RNA, 20 nt, Yersinia pestis KIM
ccauugguaauaaacgcggu

SEQ ID NO: 48947 - RNA, 23 nt, Yersinia pestis KIM
cccacagguuuuuacccauccuc

SEQ ID NO: 48948 - RNA, 22 nt, Yersinia pestis KIM
cccgauguuggguggugguaca

SEQ ID NO: 48949 - RNA, 20 nt, Yersinia pestis KIM
cccgucagcggcguuauccc

SEQ ID NO: 48950 - RNA, 22 nt, Yersinia pestis KIM
ccgcgaauauccgugguugugg

SEQ ID NO: 48951 - RNA, 22 nt, Yersinia pestis KIM
ccgcgguugagauugcggauga

SEQ ID NO: 48952 - RNA, 20 nt, Yersinia pestis KIM
ccgcgucaaucugauuggcg

SEQ ID NO: 48953 - RNA, 22 nt, Yersinia pestis KIM
ccgguagguaauaucuauccag

SEQ ID NO: 48954 - RNA, 22 nt, Yersinia pestis KIM
ccguacuuggcacaaucugcca

SEQ ID NO: 48955 - RNA, 22 nt, Yersinia pestis KIM
ccugacuauugccgcagcgauu

SEQ ID NO: 48956 - RNA, 22 nt, Yersinia pestis KIM
ccugcucguucaggccacggau

SEQ ID NO: 48957 - RNA, 22 nt, Yersinia pestis KIM
ccuggcucauuucuucacucca

SEQ ID NO: 48958 - RNA, 22 nt, Yersinia pestis KIM
ccuguucacgauaggcgguguu

SEQ ID NO: 48959 - RNA, 22 nt, Yersinia pestis KIM
ccuuacugagaaucgaugagug

SEQ ID NO: 48960 - RNA, 22 nt, Yersinia pestis KIM
cgacauuauucauuucgcuuug

SEQ ID NO: 48961 - RNA, 19 nt, Yersinia pestis KIM
cgagcgaacggauggugac

SEQ ID NO: 48962 - RNA, 22 nt, Yersinia pestis KIM
cgauagcugccauguggacggc

SEQ ID NO: 48963 - RNA, 22 nt, Yersinia pestis KIM
cgaucauuuuggacuuaauucg

SEQ ID NO: 48964 - RNA, 22 nt, Yersinia pestis KIM
cgaucguggucagcauguguug

SEQ ID NO: 48965 - RNA, 22 nt, Yersinia pestis KIM
cgaucuguuagccauuaaaccg

SEQ ID NO: 48966 - RNA, 23 nt, Yersinia pestis KIM
cgcaucaaugccuuuaaagaaac

SEQ ID NO: 48967 - RNA, 22 nt, Yersinia pestis KIM
cgccaacguuccaugccugagc

SEQ ID NO: 48968 - RNA, 22 nt, Yersinia pestis KIM
cgccgguagcgccuuugguugg

SEQ ID NO: 48969 - RNA, 22 nt, Yersinia pestis KIM
cgccguugaacguugcgucgac

SEQ ID NO: 48970 - RNA, 22 nt, Yersinia pestis KIM
cgcggcuaaugagagacuuuaa

SEQ ID NO: 48971 - RNA, 22 nt, Yersinia pestis KIM
gcgauccugucuuagcgaucau

SEQ ID NO: 48972 - RNA, 22 nt, Yersinia pestis KIM
gcgauugagcggggugagucua

SEQ ID NO: 48973 - RNA, 22 nt, Yersinia pestis KIM
gcgcaggaacugauugaccauu

SEQ ID NO: 48974 - RNA, 22 nt, Yersinia pestis KIM
gcgccaguuccccuuccaggcu

SEQ ID NO: 48975 - RNA, 22 nt, Yersinia pestis KIM
gcggauuaccguuuugauaucg

SEQ ID NO: 48976 - RNA, 22 nt, Yersinia pestis KIM
gcggcgaauucuaccuauaaga

SEQ ID NO: 48977 - RNA, 22 nt, Yersinia pestis KIM
gcggcguuucuucaugauugca

SEQ ID NO: 48978 - RNA, 22 nt, Yersinia pestis KIM
gcggguauuggcgcauuuauug

SEQ ID NO: 48979 - RNA, 22 nt, Yersinia pestis KIM
gcggucaguaagacuucuuugg

SEQ ID NO: 48980 - RNA, 22 nt, Yersinia pestis KIM
gcguaacaaauuacucacugaa

SEQ ID NO: 48981 - RNA, 22 nt, Yersinia pestis KIM
gcgucacuucgccacgucauca

SEQ ID NO: 48982 - RNA, 22 nt, Yersinia pestis KIM
gcgucguuuauaucucguugua

SEQ ID NO: 48983 - RNA, 22 nt, Yersinia pestis KIM
gcguugagcgccgcuugcaccg

SEQ ID NO: 48984 - RNA, 22 nt, Yersinia pestis KIM
gcucccaugcucgucugaccua

SEQ ID NO: 48985 - RNA, 22 nt, Yersinia pestis KIM
gcucuacauuguugcucgcgag

SEQ ID NO: 48986 - RNA, 22 nt, Yersinia pestis KIM
gcucuggcacaguaucgugagc

SEQ ID NO: 48987 - RNA, 20 nt, Yersinia pestis KIM
gcucuucggcaauaacagcu

SEQ ID NO: 48988 - RNA, 22 nt, Yersinia pestis KIM
gcugaaagcacccgcgguggca

SEQ ID NO: 48989 - RNA, 22 nt, Yersinia pestis KIM
gcugccagcgcuguuucacggc

SEQ ID NO: 48990 - RNA, 22 nt, Yersinia pestis KIM
gcugcugggauguuucgaugau

SEQ ID NO: 48991 - RNA, 22 nt, Yersinia pestis KIM
gcugcuuaaacccgguaugauu

SEQ ID NO: 48992 - RNA, 22 nt, Yersinia pestis KIM
gcuuaugcauuaggugcgucuu

SEQ ID NO: 48993 - RNA, 22 nt, Yersinia pestis KIM
ggaaacauaaccugaucaauaa

SEQ ID NO: 48994 - RNA, 22 nt, Yersinia pestis KIM
ggaacgccaaguaugcaggccc

SEQ ID NO: 48995 - RNA, 22 nt, Yersinia pestis KIM
ggacgaucagguuuugcucauu

SEQ ID NO: 48996 - RNA, 22 nt, Yersinia pestis KIM
ggagaucagauucucugggugg

SEQ ID NO: 48997 - RNA, 22 nt, Yersinia pestis KIM
ggagugcuuccgccaaccagac

SEQ ID NO: 48998 - RNA, 21 nt, Yersinia pestis KIM
ggauaaucugugcgccggugc

SEQ ID NO: 48999 - RNA, 22 nt, Yersinia pestis KIM
ggauaggcagaagaauaaagcg

SEQ ID NO: 49000 - RNA, 22 nt, Yersinia pestis KIM
ggaucugaacauucuccggcaa

SEQ ID NO: 49001 - RNA, 22 nt, Yersinia pestis KIM
ggaugccguagauuuuuuugcc

SEQ ID NO: 49002 - RNA, 22 nt, Yersinia pestis KIM
ggauuauguuauagucguuaaa

SEQ ID NO: 49003 - RNA, 22 nt, Yersinia pestis KIM
ggcaaacggguugccauugugg

SEQ ID NO: 49004 - RNA, 22 nt, Yersinia pestis KIM
ggcaagacgguauuuaggcgcu

SEQ ID NO: 49005 - RNA, 19 nt, Yersinia pestis KIM
ggcagccuguuuauugcag

SEQ ID NO: 49006 - RNA, 22 nt, Yersinia pestis KIM
ggcagcugugaugauaacugug

SEQ ID NO: 49007 - RNA, 22 nt, Yersinia pestis KIM
ggccagauaguccuugaugggc

SEQ ID NO: 49008 - RNA, 22 nt, Yersinia pestis KIM
ggccaguauuuacuguuccgga

SEQ ID NO: 49009 - RNA, 22 nt, Yersinia pestis KIM
ggccauuugcgguuuagagaaa

SEQ ID NO: 49010 - RNA, 22 nt, Yersinia pestis KIM
ggcgauauugcgucaggcacug

SEQ ID NO: 49011 - RNA, 22 nt, Yersinia pestis KIM
ggcguaauacaccauugauaag

SEQ ID NO: 49012 - RNA, 22 nt, Yersinia pestis KIM
gggaauugauugaggcuaauca

SEQ ID NO: 49013 - RNA, 22 nt, Yersinia pestis KIM
gggaauuuaaugcagggaauac

SEQ ID NO: 49014 - RNA, 19 nt, Yersinia pestis KIM
gggauuuauuuagccugcu

SEQ ID NO: 49015 - RNA, 22 nt, Yersinia pestis KIM
ggguauuacggucugcauccaa

SEQ ID NO: 49016 - RNA, 22 nt, Yersinia pestis KIM
ggguauucgccuuuggucagug

SEQ ID NO: 49017 - RNA, 22 nt, Yersinia pestis KIM
ggguccuucuuguuugcuggcc

SEQ ID NO: 49018 - RNA, 22 nt, Yersinia pestis KIM
gggugcaggcgacggguaucac

SEQ ID NO: 49019 - RNA, 22 nt, Yersinia pestis KIM
gguaucgguauugaugaauugu

SEQ ID NO: 49020 - RNA, 22 nt, Yersinia pestis KIM
ggugauauguaacuguucuugc

SEQ ID NO: 49021 - RNA, 22 nt, Yersinia pestis KIM
ggugccuuaucuggucgcgcca

SEQ ID NO: 49022 - RNA, 22 nt, Yersinia pestis KIM
gguuaagcgguugacugagaug

SEQ ID NO: 49023 - RNA, 22 nt, Yersinia pestis KIM
gguuaucgguggucuaaaaaaa

SEQ ID NO: 49024 - RNA, 22 nt, Yersinia pestis KIM
gguugacauuguugaugagcaa

SEQ ID NO: 49025 - RNA, 22 nt, Yersinia pestis KIM
gguugcgcacgguacgggcauc

SEQ ID NO: 49026 - RNA, 22 nt, Yersinia pestis KIM
guaaaguaucgauggccacggg

SEQ ID NO: 49027 - RNA, 22 nt, Yersinia pestis KIM
guaaugcuucaugaaguugcgg

SEQ ID NO: 49028 - RNA, 22 nt, Yersinia pestis KIM
guaauggucgauguugaucgcg

SEQ ID NO: 49029 - RNA, 21 nt, Yersinia pestis KIM
guagccguagcggauccguug

SEQ ID NO: 49030 - RNA, 22 nt, Yersinia pestis KIM
guagcgggugaauucaaggcuu

SEQ ID NO: 49031 - RNA, 22 nt, Yersinia pestis KIM
gucaaauugaccgaugcugauc

SEQ ID NO: 49032 - RNA, 22 nt, Yersinia pestis KIM
gucacgguugaaauaccgcugu

SEQ ID NO: 49033 - RNA, 22 nt, Yersinia pestis KIM
gucaguuuccugcucuguucca

SEQ ID NO: 49034 - RNA, 22 nt, Yersinia pestis KIM
gucaucaugaagauggcaguga

SEQ ID NO: 49035 - RNA, 22 nt, Yersinia pestis KIM
gucgugaagacaaagccauugu

SEQ ID NO: 49036 - RNA, 22 nt, Yersinia pestis KIM
gucuaucuguuacaaacacgca

SEQ ID NO: 49037 - RNA, 22 nt, Yersinia pestis KIM
gugaaccaauuguuagcuaagg

SEQ ID NO: 49038 - RNA, 22 nt, Yersinia pestis KIM
gugaauaaugcuaacaccaucg

SEQ ID NO: 49039 - RNA, 22 nt, Yersinia pestis KIM
gugacuauugauauguugugcg

SEQ ID NO: 49040 - RNA, 22 nt, Yersinia pestis KIM
gugcaguaucgaucugagcuug

SEQ ID NO: 49041 - RNA, 22 nt, Yersinia pestis KIM
gugcauggcguugcugcagaua

SEQ ID NO: 49042 - RNA, 22 nt, Yersinia pestis KIM
gugcauugcaguucguuacgug

SEQ ID NO: 49043 - RNA, 22 nt, Yersinia pestis KIM
gugcucuucaauauuaauuuua

SEQ ID NO: 49044 - RNA, 22 nt, Yersinia pestis KIM
guggaaauuaucgaguuaccag

SEQ ID NO: 49045 - RNA, 22 nt, Yersinia pestis KIM
guggcacaucuggucgcguugc

SEQ ID NO: 49046 - RNA, 22 nt, Yersinia pestis KIM
guggcccaaucgacauggacau

SEQ ID NO: 49047 - RNA, 22 nt, Yersinia pestis KIM
guggcccugauugguacggcca

SEQ ID NO: 49048 - RNA, 22 nt, Yersinia pestis KIM
guggcgaugcuggcaaugcugg

SEQ ID NO: 49049 - RNA, 22 nt, Yersinia pestis KIM
gugucaaaauagauauuggcca

SEQ ID NO: 49050 - RNA, 22 nt, Yersinia pestis KIM
guuaaccgauaagcgaguuugc

SEQ ID NO: 49051 - RNA, 22 nt, Yersinia pestis KIM
guuagcuguucucgugcuauuc

SEQ ID NO: 49052 - RNA, 22 nt, Yersinia pestis KIM
guuaggcauuauuaaaaauaga

SEQ ID NO: 49053 - RNA, 22 nt, Yersinia pestis KIM
guucauugcuauucugcaucgc

SEQ ID NO: 49054 - RNA, 22 nt, Yersinia pestis KIM
guucccagcucaccgugacggg

SEQ ID NO: 49055 - RNA, 22 nt, Yersinia pestis KIM
guugacguguuguaugccguua

SEQ ID NO: 49056 - RNA, 22 nt, Yersinia pestis KIM
guugaugagcguguuggccgug

SEQ ID NO: 49057 - RNA, 22 nt, Yersinia pestis KIM
guugaugagugccugccgguag

SEQ ID NO: 49058 - RNA, 22 nt, Yersinia pestis KIM
guugcacugaaccccagaucuu

SEQ ID NO: 49059 - RNA, 22 nt, Yersinia pestis KIM
guugucauccaauuggucgcca

SEQ ID NO: 49060 - RNA, 22 nt, Yersinia pestis KIM
uaaaccgauaucauucuggcgc

SEQ ID NO: 49061 - RNA, 22 nt, Yersinia pestis KIM
uaaacguguggccgugaucggg

SEQ ID NO: 49062 - RNA, 22 nt, Yersinia pestis KIM
ugauaucucugcaucaacauag

SEQ ID NO: 49063 - RNA, 22 nt, Yersinia pestis KIM
ugauauugcuggcgugcgucug

SEQ ID NO: 49064 - RNA, 22 nt, Yersinia pestis KIM
uugcaaugaauguuaauggugu

SEQ ID NO: 49065 - RNA, 22 nt, Yersinia pestis KIM
uugccgauaucgauacucguaa

SEQ ID NO: 49066 - RNA, 22 nt, Yersinia pestis KIM
uugccgauaugaacgagguucu

SEQ ID NO: 49067 - RNA, 22 nt, Yersinia pestis KIM
aauugcgggaugauaaacaucg

SEQ ID NO: 49068 - RNA, 17 nt, Yersinia pestis KIM
acacugucuuuauucgg

SEQ ID NO: 49069 - RNA, 22 nt, Yersinia pestis KIM
acagaguauuaccgcaaaauga

SEQ ID NO: 49070 - RNA, 22 nt, Yersinia pestis KIM
acagaugacuacgaugugacua

SEQ ID NO: 49071 - RNA, 20 nt, Yersinia pestis KIM
acagcaguaauaucaguauc

SEQ ID NO: 49072 - RNA, 22 nt, Yersinia pestis KIM
acaggugaaacgcuggggcuga

SEQ ID NO: 49073 - RNA, 22 nt, Yersinia pestis KIM
acauuguuugcggacagaauug

SEQ ID NO: 49074 - RNA, 22 nt, Yersinia pestis KIM
accaacugaccaaaucaugaug

SEQ ID NO: 49075 - RNA, 22 nt, Yersinia pestis KIM
accagagauuaaaucaggggau

SEQ ID NO: 49076 - RNA, 22 nt, Yersinia pestis KIM
accauaggggccgguauugauu

SEQ ID NO: 49077 - RNA, 22 nt, Yersinia pestis KIM
accgguugaaaaaaggacuugu

SEQ ID NO: 49078 - RNA, 22 nt, Yersinia pestis KIM
accucugauuaucucugaacaa

SEQ ID NO: 49079 - RNA, 22 nt, Yersinia pestis KIM
accuguuugaaagccugaaucu

SEQ ID NO: 49080 - RNA, 22 nt, Yersinia pestis KIM
acgauuaacaugaucguguugc

SEQ ID NO: 49081 - RNA, 21 nt, Yersinia pestis KIM
acgcagccgauagagaccgcu

SEQ ID NO: 49082 - RNA, 22 nt, Yersinia pestis KIM
acgccgcuucaaagaugacguu

SEQ ID NO: 49083 - RNA, 22 nt, Yersinia pestis KIM
acgccuuguucgcaaccgaaga

SEQ ID NO: 49084 - RNA, 22 nt, Yersinia pestis KIM
acgcggcauucgcauccuauuu

SEQ ID NO: 49085 - RNA, 22 nt, Yersinia pestis KIM
acgcucuugaugaccuacuuug

SEQ ID NO: 49086 - RNA, 21 nt, Yersinia pestis KIM
acgcugaucagugucaguuuc

SEQ ID NO: 49087 - RNA, 22 nt, Yersinia pestis KIM
acggcaaauauguucuggcugg

SEQ ID NO: 49088 - RNA, 22 nt, Yersinia pestis KIM
acggcuaaccucauagcgcccg

SEQ ID NO: 49089 - RNA, 22 nt, Yersinia pestis KIM
acggguaacgguggcguaaugc

SEQ ID NO: 49090 - RNA, 22 nt, Yersinia pestis KIM
acgucuaaauagaaaaugacgg

SEQ ID NO: 49091 - RNA, 19 nt, Yersinia pestis KIM
acguuaucuugguuugacc

SEQ ID NO: 49092 - RNA, 22 nt, Yersinia pestis KIM
acguuggcaauagugccgucca

SEQ ID NO: 49093 - RNA, 22 nt, Yersinia pestis KIM
acuaaugguuuuaugugcacua

SEQ ID NO: 49094 - RNA, 18 nt, Yersinia pestis KIM
acugggugaaauggguga

SEQ ID NO: 49095 - RNA, 22 nt, Yersinia pestis KIM
acugguugcgcaauaugggaua

SEQ ID NO: 49096 - RNA, 22 nt, Yersinia pestis KIM
acuucaucgcacuuaaucaacg

SEQ ID NO: 49097 - RNA, 18 nt, Yersinia pestis KIM
acuucuuagugcgcuagc

SEQ ID NO: 49098 - RNA, 20 nt, Yersinia pestis KIM
acuugcugaguauuuucgug

SEQ ID NO: 49099 - RNA, 22 nt, Yersinia pestis KIM
agacuauauucuggcaaaugcu

SEQ ID NO: 49100 - RNA, 22 nt, Yersinia pestis KIM
agagcgauaaccaugacgccuu

SEQ ID NO: 49101 - RNA, 22 nt, Yersinia pestis KIM
agauuucagacugcugacaacc

SEQ ID NO: 49102 - RNA, 21 nt, Yersinia pestis KIM
agcaacugagcuggcuuuuuu

SEQ ID NO: 49103 - RNA, 22 nt, Yersinia pestis KIM
agcaaugccgaucaguuaagga

SEQ ID NO: 49104 - RNA, 22 nt, Yersinia pestis KIM
agcagcuuuguuuggcgcuguu

SEQ ID NO: 49105 - RNA, 22 nt, Yersinia pestis KIM
agcaggccaucacgaccuugcu

SEQ ID NO: 49106 - RNA, 22 nt, Yersinia pestis KIM
agccagguauacguuguuugcg

SEQ ID NO: 49107 - RNA, 22 nt, Yersinia pestis KIM
agccaguuaucgauaaucucuu

SEQ ID NO: 49108 - RNA, 22 nt, Yersinia pestis KIM
agccauucgugaaauuauggcg

SEQ ID NO: 49109 - RNA, 22 nt, Yersinia pestis KIM
agcccgauaccauaaaaccgga

SEQ ID NO: 49110 - RNA, 18 nt, Yersinia pestis KIM
agcccgcuuauuggucag

SEQ ID NO: 49111 - RNA, 22 nt, Yersinia pestis KIM
agccgcagggucaguugguggu

SEQ ID NO: 49112 - RNA, 22 nt, Yersinia pestis KIM
agccgccaauauugucaaaauu

SEQ ID NO: 49113 - RNA, 22 nt, Yersinia pestis KIM
agccguccagaaagcgcuuugg

SEQ ID NO: 49114 - RNA, 22 nt, Yersinia pestis KIM
agcgauaaaccgguaugcagga

SEQ ID NO: 49115 - RNA, 22 nt, Yersinia pestis KIM
agcgcauuuaaaaauaaugauc

SEQ ID NO: 49116 - RNA, 22 nt, Yersinia pestis KIM
agcgcugguuuucucgacaaau

SEQ ID NO: 49117 - RNA, 22 nt, Yersinia pestis KIM
agcgcuuucuggguaucugccu

SEQ ID NO: 49118 - RNA, 22 nt, Yersinia pestis KIM
agcguugcacguaugcugaauu

SEQ ID NO: 49119 - RNA, 22 nt, Yersinia pestis KIM
agcuaauuguguuuuuaggcug

SEQ ID NO: 49120 - RNA, 22 nt, Yersinia pestis KIM
agcuugaacagcagguuaucca

SEQ ID NO: 49121 - RNA, 22 nt, Yersinia pestis KIM
agcuuugugggauaccguauca

SEQ ID NO: 49122 - RNA, 22 nt, Yersinia pestis KIM
aggaguuugaaggccauugucu

SEQ ID NO: 49123 - RNA, 19 nt, Yersinia pestis KIM
aggauugcgguggugucuu

SEQ ID NO: 49124 - RNA, 22 nt, Yersinia pestis KIM
aggcaucucugucauccaguaa

SEQ ID NO: 49125 - RNA, 22 nt, Yersinia pestis KIM
aggccacugucagcugaacuga

SEQ ID NO: 49126 - RNA, 22 nt, Yersinia pestis KIM
aggcgcauaugaaaaaccuccg

SEQ ID NO: 49127 - RNA, 22 nt, Yersinia pestis KIM
aggcgguuaguucauguucaaa

SEQ ID NO: 49128 - RNA, 22 nt, Yersinia pestis KIM
aggcuauauuggugaccggcgc

SEQ ID NO: 49129 - RNA, 22 nt, Yersinia pestis KIM
agguaaucgcauugauugguau

SEQ ID NO: 49130 - RNA, 22 nt, Yersinia pestis KIM
agguaaugauuuuguagccagc

SEQ ID NO: 49131 - RNA, 22 nt, Yersinia pestis KIM
agguaguguuguaacagcgggu

SEQ ID NO: 49132 - RNA, 22 nt, Yersinia pestis KIM
aggugcaauuacagaagcuuga

SEQ ID NO: 49133 - RNA, 22 nt, Yersinia pestis KIM
aggugcagccacuaucagcuac

SEQ ID NO: 49134 - RNA, 22 nt, Yersinia pestis KIM
aguaacgaauuacgcugaauug

SEQ ID NO: 49135 - RNA, 22 nt, Yersinia pestis KIM
aguagugccuuacguagcauga

SEQ ID NO: 49136 - RNA, 22 nt, Yersinia pestis KIM
aguauuacuguucuugucuggu

SEQ ID NO: 49137 - RNA, 19 nt, Yersinia pestis KIM
aguccugaccgguaucgcc

SEQ ID NO: 49138 - RNA, 22 nt, Yersinia pestis KIM
agucuaucguuaucugauggca

SEQ ID NO: 49139 - RNA, 22 nt, Yersinia pestis KIM
agucuguuaucaaucugucucg

SEQ ID NO: 49140 - RNA, 22 nt, Yersinia pestis KIM
agucuucgcuggcagugccuau

SEQ ID NO: 49141 - RNA, 22 nt, Yersinia pestis KIM
agugccuuucgcgcggcguugg

SEQ ID NO: 49142 - RNA, 22 nt, Yersinia pestis KIM
aguggucaaauggugcgcuuaa

SEQ ID NO: 49143 - RNA, 22 nt, Yersinia pestis KIM
aguucuauguucgugaacgccg

SEQ ID NO: 49144 - RNA, 22 nt, Yersinia pestis KIM
aguugagcuucaugcacuguug

SEQ ID NO: 49145 - RNA, 22 nt, Yersinia pestis KIM
auaaacaggcgggucgguaacu

SEQ ID NO: 49146 - RNA, 22 nt, Yersinia pestis KIM
auaacgcuauucauauggccag

SEQ ID NO: 49147 - RNA, 22 nt, Yersinia pestis KIM
auaaugccuugauugaaggaga

SEQ ID NO: 49148 - RNA, 22 nt, Yersinia pestis KIM
auacccgugauacuucaaguug

SEQ ID NO: 49149 - RNA, 22 nt, Yersinia pestis KIM
auaccggaagagcuaacgacag

SEQ ID NO: 49150 - RNA, 22 nt, Yersinia pestis KIM
auacugaagucaguuuuucgcc

SEQ ID NO: 49151 - RNA, 22 nt, Yersinia pestis KIM
auaucguauucguaaacccgca

SEQ ID NO: 49152 - RNA, 19 nt, Yersinia pestis KIM
auaugaguuuugaugaauu

SEQ ID NO: 49153 - RNA, 22 nt, Yersinia pestis KIM
auauugucguugauauugucgc

SEQ ID NO: 49154 - RNA, 23 nt, Yersinia pestis KIM
aucacccgcuuccagaaaaucaa

SEQ ID NO: 49155 - RNA, 19 nt, Yersinia pestis KIM
aucagcagagaaaaugcgc

SEQ ID NO: 49156 - RNA, 22 nt, Yersinia pestis KIM
aucauagguauuauucagcuga

SEQ ID NO: 49157 - RNA, 22 nt, Yersinia pestis KIM
auccgguggcguuaccgguuca

SEQ ID NO: 49158 - RNA, 22 nt, Yersinia pestis KIM
ccgaugucuuaaguaacaccac

SEQ ID NO: 49159 - RNA, 22 nt, Yersinia pestis KIM
ccgccauugggcgaucuuugau

SEQ ID NO: 49160 - RNA, 22 nt, Yersinia pestis KIM
ccgccuaugccacccguauugc

SEQ ID NO: 49161 - RNA, 17 nt, Yersinia pestis KIM
ccgcucuggcacuaucu

SEQ ID NO: 49162 - RNA, 22 nt, Yersinia pestis KIM
ccgcuugguuaacugcgucauu

SEQ ID NO: 49163 - RNA, 22 nt, Yersinia pestis KIM
ccgguauuaaagcggcaucacc

SEQ ID NO: 49164 - RNA, 22 nt, Yersinia pestis KIM
ccguagcgaaguaaugucacaa

SEQ ID NO: 49165 - RNA, 22 nt, Yersinia pestis KIM
ccguugaauaauggucguuuua

SEQ ID NO: 49166 - RNA, 22 nt, Yersinia pestis KIM
ccuagccgaaacagugcucuac

SEQ ID NO: 49167 - RNA, 22 nt, Yersinia pestis KIM
ccugacauaggcuagcugauaa

SEQ ID NO: 49168 - RNA, 22 nt, Yersinia pestis KIM
ccugaccuuaacgcacagugaa

SEQ ID NO: 49169 - RNA, 22 nt, Yersinia pestis KIM
ccugacuuucuguuguguuggu

SEQ ID NO: 49170 - RNA, 22 nt, Yersinia pestis KIM
ccugucauguugggugaggcua

SEQ ID NO: 49171 - RNA, 22 nt, Yersinia pestis KIM
ccuuacauccgauagccgguca

SEQ ID NO: 49172 - RNA, 22 nt, Yersinia pestis KIM
ccuuguaaaaaauacgccauuu

SEQ ID NO: 49173 - RNA, 22 nt, Yersinia pestis KIM
ccuuucagcagcgcaggaaggu

SEQ ID NO: 49174 - RNA, 22 nt, Yersinia pestis KIM
cgagaauggcagugguccacuc

SEQ ID NO: 49175 - RNA, 22 nt, Yersinia pestis KIM
cgauugguugguaccgccaggg

SEQ ID NO: 49176 - RNA, 22 nt, Yersinia pestis KIM
cgcaaucacaaugaccguuuug

SEQ ID NO: 49177 - RNA, 22 nt, Yersinia pestis KIM
cgcagaaauauucagagaggcg

SEQ ID NO: 49178 - RNA, 22 nt, Yersinia pestis KIM
cgcaggaaacgaaccauacgca

SEQ ID NO: 49179 - RNA, 22 nt, Yersinia pestis KIM
cgccauggugaucauguccuga

SEQ ID NO: 49180 - RNA, 22 nt, Yersinia pestis KIM
cgccgguuucaagcgucaggua

SEQ ID NO: 49181 - RNA, 22 nt, Yersinia pestis KIM
cgcgcaaauuuuuuagcaagua

SEQ ID NO: 49182 - RNA, 22 nt, Yersinia pestis KIM
cgcggguaacuuccuacacaug

SEQ ID NO: 49183 - RNA, 22 nt, Yersinia pestis KIM
cgcuauuugccgcgcugcuaca

SEQ ID NO: 49184 - RNA, 22 nt, Yersinia pestis KIM
cgcugccuguggauucgccacu

SEQ ID NO: 49185 - RNA, 22 nt, Yersinia pestis KIM
cggcguagugggcgaccugacc

SEQ ID NO: 49186 - RNA, 22 nt, Yersinia pestis KIM
cggcgugaugggucuccgcaga

SEQ ID NO: 49187 - RNA, 22 nt, Yersinia pestis KIM
cgggaugagaaaccgaugcuca

SEQ ID NO: 49188 - RNA, 22 nt, Yersinia pestis KIM
cgguaaccaacgcuugugcaau

SEQ ID NO: 49189 - RNA, 22 nt, Yersinia pestis KIM
cggugagcgaugauaaucaccg

SEQ ID NO: 49190 - RNA, 22 nt, Yersinia pestis KIM
cgguggucucccuugaugguuu

SEQ ID NO: 49191 - RNA, 23 nt, Yersinia pestis KIM
cggugugacccgccaccacgauc

SEQ ID NO: 49192 - RNA, 19 nt, Yersinia pestis KIM
cgguuaugacccucuggcc

SEQ ID NO: 49193 - RNA, 22 nt, Yersinia pestis KIM
cguacuuuacguaaagaaacgu

SEQ ID NO: 49194 - RNA, 22 nt, Yersinia pestis KIM
cgucaauguugaccaggugcug

SEQ ID NO: 49195 - RNA, 22 nt, Yersinia pestis KIM
cgucagccguacccgcucucuc

SEQ ID NO: 49196 - RNA, 21 nt, Yersinia pestis KIM
cgucauguagcuauucuuggu

SEQ ID NO: 49197 - RNA, 22 nt, Yersinia pestis KIM
cguccgaagggcgcuuugugua

SEQ ID NO: 49198 - RNA, 20 nt, Yersinia pestis KIM
cgugauguuggauuaccgua

SEQ ID NO: 49199 - RNA, 22 nt, Yersinia pestis KIM
cgugcggaacaggugaugcagg

SEQ ID NO: 49200 - RNA, 22 nt, Yersinia pestis KIM
cgugcguugcguucuggucauc

SEQ ID NO: 49201 - RNA, 22 nt, Yersinia pestis KIM
cgugcuuucuugaaagaaacgu

SEQ ID NO: 49202 - RNA, 22 nt, Yersinia pestis KIM
cguuggauauugagcacaaauu

SEQ ID NO: 49203 - RNA, 22 nt, Yersinia pestis KIM
cguuucaguacuguugcgccuu

SEQ ID NO: 49204 - RNA, 22 nt, Yersinia pestis KIM
cuaaccucagauaggagacagg

SEQ ID NO: 49205 - RNA, 22 nt, Yersinia pestis KIM
cuagaagaaccgucauuauuac

SEQ ID NO: 49206 - RNA, 22 nt, Yersinia pestis KIM
cucaucaagucaacgcugacuu

SEQ ID NO: 49207 - RNA, 22 nt, Yersinia pestis KIM
cucggcaaguugugguaggaag

SEQ ID NO: 49208 - RNA, 22 nt, Yersinia pestis KIM
cucgucaauuaccugauuacug

SEQ ID NO: 49209 - RNA, 22 nt, Yersinia pestis KIM
cugacgauuauguuuaucaaug

SEQ ID NO: 49210 - RNA, 22 nt, Yersinia pestis KIM
cugaugguggacucuggcgcug

SEQ ID NO: 49211 - RNA, 22 nt, Yersinia pestis KIM
cugauucugguaauccauaauu

SEQ ID NO: 49212 - RNA, 21 nt, Yersinia pestis KIM
cugcagugaaugaccgccuac

SEQ ID NO: 49213 - RNA, 22 nt, Yersinia pestis KIM
cugcauuauuuguugagccaau

SEQ ID NO: 49214 - RNA, 22 nt, Yersinia pestis KIM
cugccgauauuaucgucagaca

SEQ ID NO: 49215 - RNA, 22 nt, Yersinia pestis KIM
cugcgggaauggcaagugcuua

SEQ ID NO: 49216 - RNA, 22 nt, Yersinia pestis KIM
cugcugucggcaauacuucacc

SEQ ID NO: 49217 - RNA, 22 nt, Yersinia pestis KIM
cuggaugcauucaauaaaggcu

SEQ ID NO: 49218 - RNA, 22 nt, Yersinia pestis KIM
cuggaugggagcgagagugcau

SEQ ID NO: 49219 - RNA, 22 nt, Yersinia pestis KIM
cuggcggaucauugcuaccgcg

SEQ ID NO: 49220 - RNA, 22 nt, Yersinia pestis KIM
cuggcuuuuuuauccagauuau

SEQ ID NO: 49221 - RNA, 22 nt, Yersinia pestis KIM
cugggugauccgcgcaucgcca

SEQ ID NO: 49222 - RNA, 22 nt, Yersinia pestis KIM
cuggucgccugcugaaccgggc

SEQ ID NO: 49223 - RNA, 22 nt, Yersinia pestis KIM
cuguagcgugaguggugcuaug

SEQ ID NO: 49224 - RNA, 22 nt, Yersinia pestis KIM
cuguauauaaaaccagucuaua

SEQ ID NO: 49225 - RNA, 22 nt, Yersinia pestis KIM
cuguauugcgccaaugacugug

SEQ ID NO: 49226 - RNA, 22 nt, Yersinia pestis KIM
cugugccgcagcuagccuauua

SEQ ID NO: 49227 - RNA, 21 nt, Yersinia pestis KIM
cugugucagggugauauuggc

SEQ ID NO: 49228 - RNA, 21 nt, Yersinia pestis KIM
cuguucagugcguucgauacu

SEQ ID NO: 49229 - RNA, 22 nt, Yersinia pestis KIM
cuuauguugaucauggauaucg

SEQ ID NO: 49230 - RNA, 22 nt, Yersinia pestis KIM
cuugccgcuucaauuugauuag

SEQ ID NO: 49231 - RNA, 22 nt, Yersinia pestis KIM
cuuggauauuauccgccgcuau

SEQ ID NO: 49232 - RNA, 22 nt, Yersinia pestis KIM
cuuggugcuuagcacgcguuau

SEQ ID NO: 49233 - RNA, 22 nt, Yersinia pestis KIM
cuuugucaauacccugaaggcc

SEQ ID NO: 49234 - RNA, 22 nt, Yersinia pestis KIM
gaaauacuccuguucuaucgaa

SEQ ID NO: 49235 - RNA, 22 nt, Yersinia pestis KIM
gaacauacuuuuagcgauagaa

SEQ ID NO: 49236 - RNA, 22 nt, Yersinia pestis KIM
gaacauaggguggcggcuaaaa

SEQ ID NO: 49237 - RNA, 22 nt, Yersinia pestis KIM
gaacgccucgaucucgaugagc

SEQ ID NO: 49238 - RNA, 21 nt, Yersinia pestis KIM
gaacgucgguacgauggucau

SEQ ID NO: 49239 - RNA, 22 nt, Yersinia pestis KIM
gaacgugauccgcagcguuucc

SEQ ID NO: 49240 - RNA, 22 nt, Yersinia pestis KIM
gaacguuucuacccgcagggga

SEQ ID NO: 49241 - RNA, 22 nt, Yersinia pestis KIM
gaacuugggaucagacagauau

SEQ ID NO: 49242 - RNA, 22 nt, Yersinia pestis KIM
gaagauccgcuggggauggaag

SEQ ID NO: 49243 - RNA, 22 nt, Yersinia pestis KIM
gaagcaguuuccaaugagaaau

SEQ ID NO: 49244 - RNA, 22 nt, Yersinia pestis KIM
gaaugccauuaauacuguggca

SEQ ID NO: 49245 - RNA, 22 nt, Yersinia pestis KIM
gaauucauaagguagacuugga

SEQ ID NO: 49246 - RNA, 19 nt, Yersinia pestis KIM
gaauuccaucgugcucgcu

SEQ ID NO: 49247 - RNA, 22 nt, Yersinia pestis KIM
gaccacaugggacauaugccug

SEQ ID NO: 49248 - RNA, 22 nt, Yersinia pestis KIM
gaccguaagauauacagccaga

SEQ ID NO: 49249 - RNA, 22 nt, Yersinia pestis KIM
gggcacaagaagcaaucgggau

SEQ ID NO: 49250 - RNA, 22 nt, Yersinia pestis KIM
gggcuggauuuaaauggcggua

SEQ ID NO: 49251 - RNA, 22 nt, Yersinia pestis KIM
gggucagcagacgcacgguugu

SEQ ID NO: 49252 - RNA, 20 nt, Yersinia pestis KIM
gguagcgauccucccacugu

SEQ ID NO: 49253 - RNA, 22 nt, Yersinia pestis KIM
gguagcuaaauguuuaucuuga

SEQ ID NO: 49254 - RNA, 22 nt, Yersinia pestis KIM
ggucaauagauguuuggcaggu

SEQ ID NO: 49255 - RNA, 22 nt, Yersinia pestis KIM
ggucggauguuuugaccggugu

SEQ ID NO: 49256 - RNA, 22 nt, Yersinia pestis KIM
ggucuuuaccuucaaugcguug

SEQ ID NO: 49257 - RNA, 22 nt, Yersinia pestis KIM
ggugaacgcuuugguuuggcug

SEQ ID NO: 49258 - RNA, 19 nt, Yersinia pestis KIM
ggugaauauucaucgguug

SEQ ID NO: 49259 - RNA, 21 nt, Yersinia pestis KIM
ggugaucacuuuuauuucucg

SEQ ID NO: 49260 - RNA, 22 nt, Yersinia pestis KIM
ggugcgcauuaccgaucccggc

SEQ ID NO: 49261 - RNA, 22 nt, Yersinia pestis KIM
gguucacuuauuauggaauugg

SEQ ID NO: 49262 - RNA, 22 nt, Yersinia pestis KIM
guaaagccaagaguaugagcau

SEQ ID NO: 49263 - RNA, 18 nt, Yersinia pestis KIM
guaaagcuugcuccugau

SEQ ID NO: 49264 - RNA, 22 nt, Yersinia pestis KIM
guaagucgauguugcucacgua

SEQ ID NO: 49265 - RNA, 23 nt, Yersinia pestis KIM
guacacgaacgcgcaggcuuggc

SEQ ID NO: 49266 - RNA, 22 nt, Yersinia pestis KIM
guagccauuaugucgggaguaa

SEQ ID NO: 49267 - RNA, 22 nt, Yersinia pestis KIM
guagggcgcugauagagugaga

SEQ ID NO: 49268 - RNA, 22 nt, Yersinia pestis KIM
guauggcgguguccaccagcag

SEQ ID NO: 49269 - RNA, 19 nt, Yersinia pestis KIM
gucacgacagcugcugcaa

SEQ ID NO: 49270 - RNA, 23 nt, Yersinia pestis KIM
gucagcagauuaccuauuucggg

SEQ ID NO: 49271 - RNA, 22 nt, Yersinia pestis KIM
gucaggaugccauuuuauucug

SEQ ID NO: 49272 - RNA, 22 nt, Yersinia pestis KIM
gucagggagagauaacggcacc

SEQ ID NO: 49273 - RNA, 22 nt, Yersinia pestis KIM
gucaguuaucugcgucgcuugc

SEQ ID NO: 49274 - RNA, 22 nt, Yersinia pestis KIM
gucaguuuuauuuggcccgcuc

SEQ ID NO: 49275 - RNA, 22 nt, Yersinia pestis KIM
gucaucuucaucgcugauacga

SEQ ID NO: 49276 - RNA, 22 nt, Yersinia pestis KIM
gucauugcuuugauacggcugg

SEQ ID NO: 49277 - RNA, 18 nt, Yersinia pestis KIM
guccugaaguuaucaaug

SEQ ID NO: 49278 - RNA, 22 nt, Yersinia pestis KIM
gucgggcaccguauaccacgac

SEQ ID NO: 49279 - RNA, 22 nt, Yersinia pestis KIM
gucgucauucacacccaaugua

SEQ ID NO: 49280 - RNA, 23 nt, Yersinia pestis KIM
gugaccuguauuucauuauucac

SEQ ID NO: 49281 - RNA, 22 nt, Yersinia pestis KIM
gugagcuguagugggugagcgc

SEQ ID NO: 49282 - RNA, 22 nt, Yersinia pestis KIM
gugauucagcuucugcgcuugc

SEQ ID NO: 49283 - RNA, 18 nt, Yersinia pestis KIM
gugccgaucaccgggugc

SEQ ID NO: 49284 - RNA, 22 nt, Yersinia pestis KIM
gugcuguaugggaagacugaau

SEQ ID NO: 49285 - RNA, 22 nt, Yersinia pestis KIM
guguucauauucaugguuucaa

SEQ ID NO: 49286 - RNA, 22 nt, Yersinia pestis KIM
guuaaagauuauugcacccgag

SEQ ID NO: 49287 - RNA, 22 nt, Yersinia pestis KIM
guuaaugucacuuuaccagguu

SEQ ID NO: 49288 - RNA, 22 nt, Yersinia pestis KIM
guuacccauaaguugccugagu

SEQ ID NO: 49289 - RNA, 22 nt, Yersinia pestis KIM
guuacggugcauguccgucgua

SEQ ID NO: 49290 - RNA, 22 nt, Yersinia pestis KIM
guugcaguucgcgcaaagugcc

SEQ ID NO: 49291 - RNA, 22 nt, Yersinia pestis KIM
guuggaaugcccauggcccguu

SEQ ID NO: 49292 - RNA, 22 nt, Yersinia pestis KIM
guugucagcagucugaaaucuc

SEQ ID NO: 49293 - RNA, 22 nt, Yersinia pestis KIM
guuuaucugcugauuaccaacg

SEQ ID NO: 49294 - RNA, 22 nt, Yersinia pestis KIM
uaaccguaugcgccagcagggg

SEQ ID NO: 49295 - RNA, 22 nt, Yersinia pestis KIM
uaacgccguggaacauuugccu

SEQ ID NO: 49296 - RNA, 22 nt, Yersinia pestis KIM
uaacggguaauuaugccgcaug

SEQ ID NO: 49297 - RNA, 18 nt, Yersinia pestis KIM
uaacuggcuguagcggug

SEQ ID NO: 49298 - RNA, 22 nt, Yersinia pestis KIM
uaauacgcauauucggcuggaa

SEQ ID NO: 49299 - RNA, 22 nt, Yersinia pestis KIM
uaauacguugaucccggaugug

SEQ ID NO: 49300 - RNA, 22 nt, Yersinia pestis KIM
uaaucguuugcuaagcacgaaa

SEQ ID NO: 49301 - RNA, 22 nt, Yersinia pestis KIM
uaaugguauuaucgccgacucu

SEQ ID NO: 49302 - RNA, 22 nt, Yersinia pestis KIM
uacagugccugauauucgcguu

SEQ ID NO: 49303 - RNA, 22 nt, Yersinia pestis KIM
uacauuggcuccccuuuggguu

SEQ ID NO: 49304 - RNA, 22 nt, Yersinia pestis KIM
uaccauauuaagaauugaacaa

SEQ ID NO: 49305 - RNA, 22 nt, Yersinia pestis KIM
uaccgcauuacuaauacucauu

SEQ ID NO: 49306 - RNA, 22 nt, Yersinia pestis KIM
uaccgccgucagguucaggugu

SEQ ID NO: 49307 - RNA, 22 nt, Yersinia pestis KIM
uaccgcuuuaccccgcugcaaa

SEQ ID NO: 49308 - RNA, 22 nt, Yersinia pestis KIM
uacgccauguuuccgaaaccca

SEQ ID NO: 49309 - RNA, 22 nt, Yersinia pestis KIM
uacggcagcgaucaucagcggu

SEQ ID NO: 49310 - RNA, 22 nt, Yersinia pestis KIM
uacguugauuagacggagggau

SEQ ID NO: 49311 - RNA, 22 nt, Yersinia pestis KIM
uacucuguuagcgguguaucug

SEQ ID NO: 49312 - RNA, 22 nt, Yersinia pestis KIM
uacuggaagccagagcagggau

SEQ ID NO: 49313 - RNA, 22 nt, Yersinia pestis KIM
uacuggcugagccacuggucgg

SEQ ID NO: 49314 - RNA, 22 nt, Yersinia pestis KIM
uacuggucccguccacguuggu

SEQ ID NO: 49315 - RNA, 22 nt, Yersinia pestis KIM
uacuugaaucuauuaugauagu

SEQ ID NO: 49316 - RNA, 22 nt, Yersinia pestis KIM
uagaacaagguuuagcgggcaa

SEQ ID NO: 49317 - RNA, 22 nt, Yersinia pestis KIM
uagacagacacgcgccauugcc

SEQ ID NO: 49318 - RNA, 22 nt, Yersinia pestis KIM
uagcaguuuuuggucacugcgg

SEQ ID NO: 49319 - RNA, 22 nt, Yersinia pestis KIM
uagcaugaaugcaguucaaauu

SEQ ID NO: 49320 - RNA, 22 nt, Yersinia pestis KIM
uagccacguucacauacccaga

SEQ ID NO: 49321 - RNA, 22 nt, Yersinia pestis KIM
uagcugccaaucucaucgcuug

SEQ ID NO: 49322 - RNA, 22 nt, Yersinia pestis KIM
uagucggccgggaguucguauu

SEQ ID NO: 49323 - RNA, 22 nt, Yersinia pestis KIM
uagucgguaaggaguuauuugc

SEQ ID NO: 49324 - RNA, 22 nt, Yersinia pestis KIM
uauagcagcaugaauuuaacag

SEQ ID NO: 49325 - RNA, 21 nt, Yersinia pestis KIM
uaucaagguacaagacccuga

SEQ ID NO: 49326 - RNA, 22 nt, Yersinia pestis KIM
uaucaauguuggcuuguaaaua

SEQ ID NO: 49327 - RNA, 22 nt, Yersinia pestis KIM
uaucgauaauaugugcuguuuu

SEQ ID NO: 49328 - RNA, 22 nt, Yersinia pestis KIM
uaucgcuuugggcuugcucccu

SEQ ID NO: 49329 - RNA, 22 nt, Yersinia pestis KIM
uaugcccucacaucugcaacuu

SEQ ID NO: 49330 - RNA, 23 nt, Yersinia pestis KIM
uaugccgguauugauucggggaa

SEQ ID NO: 49331 - RNA, 22 nt, Yersinia pestis KIM
uaugcucaacggagccaaucga

SEQ ID NO: 49332 - RNA, 22 nt, Yersinia pestis KIM
uauuacacaaucuggauaucaa

SEQ ID NO: 49333 - RNA, 22 nt, Yersinia pestis KIM
uauuaggaugguuagaguggga

SEQ ID NO: 49334 - RNA, 22 nt, Yersinia pestis KIM
uauucugaacuggaagaagagu

SEQ ID NO: 49335 - RNA, 20 nt, Yersinia pestis KIM
uauucugcuggaagaguugc

SEQ ID NO: 49336 - RNA, 22 nt, Yersinia pestis KIM
uauugaugacaaaagggccugg

SEQ ID NO: 49337 - RNA, 22 nt, Yersinia pestis KIM
ucaacaucguaccugaacgauc

SEQ ID NO: 49338 - RNA, 22 nt, Yersinia pestis KIM
ucaaccagauuauguuguucug

SEQ ID NO: 49339 - RNA, 21 nt, Yersinia pestis KIM
ucaaucguggauucugcuccc

SEQ ID NO: 49340 - RNA, 22 nt, Yersinia pestis KIM
aaacaguuuggcgauuaucgca

SEQ ID NO: 49341 - RNA, 22 nt, Yersinia pestis KIM
aaacgcauuuauaaguucccga

SEQ ID NO: 49342 - RNA, 23 nt, Yersinia pestis KIM
aaaggccgcgacgaucgacguuu

SEQ ID NO: 49343 - RNA, 22 nt, Yersinia pestis KIM
aaaguaguuaagggcagcgaaa

SEQ ID NO: 49344 - RNA, 22 nt, Yersinia pestis KIM
aaaguggccagagaucuguuua

SEQ ID NO: 49345 - RNA, 22 nt, Yersinia pestis KIM
aaaguuguucaaccaucauguc

SEQ ID NO: 49346 - RNA, 22 nt, Yersinia pestis KIM
aaaucuguguuguacagagggu

SEQ ID NO: 49347 - RNA, 22 nt, Yersinia pestis KIM
aacacaggcguuauguagcgaa

SEQ ID NO: 49348 - RNA, 22 nt, Yersinia pestis KIM
aacacggucgcucuaccugcua

SEQ ID NO: 49349 - RNA, 22 nt, Yersinia pestis KIM
aaccagcguuccagucuuuggu

SEQ ID NO: 49350 - RNA, 22 nt, Yersinia pestis KIM
aacgccgcucuucagcaucagg

SEQ ID NO: 49351 - RNA, 22 nt, Yersinia pestis KIM
aacgguaacgguauaggcgaag

SEQ ID NO: 49352 - RNA, 22 nt, Yersinia pestis KIM
aacgguauuaaguuuuucucca

SEQ ID NO: 49353 - RNA, 22 nt, Yersinia pestis KIM
aacgucagaagacaguugaucg

SEQ ID NO: 49354 - RNA, 22 nt, Yersinia pestis KIM
aacuugaaguaugggggguaua

SEQ ID NO: 49355 - RNA, 22 nt, Yersinia pestis KIM
aagauacccugucgauuuuacg

SEQ ID NO: 49356 - RNA, 22 nt, Yersinia pestis KIM
aagccguauuaacugaauacca

SEQ ID NO: 49357 - RNA, 22 nt, Yersinia pestis KIM
aaggaucgcgcuuugugguggg

SEQ ID NO: 49358 - RNA, 22 nt, Yersinia pestis KIM
aaggauguaugcuugaaggcuu

SEQ ID NO: 49359 - RNA, 22 nt, Yersinia pestis KIM
aagggugccuggcuaacgcucc

SEQ ID NO: 49360 - RNA, 22 nt, Yersinia pestis KIM
aaguaaugcgggugugagugcu

SEQ ID NO: 49361 - RNA, 22 nt, Yersinia pestis KIM
aaguggcuaucggcggcaagcg

SEQ ID NO: 49362 - RNA, 22 nt, Yersinia pestis KIM
aaguguuagugcggauugucgc

SEQ ID NO: 49363 - RNA, 22 nt, Yersinia pestis KIM
aauaacguuagaaaucaacaua

SEQ ID NO: 49364 - RNA, 22 nt, Yersinia pestis KIM
aauaagcgaauuugguugucau

SEQ ID NO: 49365 - RNA, 19 nt, Yersinia pestis KIM
aauaccauauauucccucu

SEQ ID NO: 49366 - RNA, 22 nt, Yersinia pestis KIM
aauacguucgcggaucaccggu

SEQ ID NO: 49367 - RNA, 22 nt, Yersinia pestis KIM
aauaggcuaacguuguauuuau

SEQ ID NO: 49368 - RNA, 22 nt, Yersinia pestis KIM
aauaugcagcuugaacuggcca

SEQ ID NO: 49369 - RNA, 22 nt, Yersinia pestis KIM
aaucacuuuggcuuccaguuuu

SEQ ID NO: 49370 - RNA, 22 nt, Yersinia pestis KIM
aaucgccagacaacucuagcaa

SEQ ID NO: 49371 - RNA, 22 nt, Yersinia pestis KIM
aaugaagccaggguugcagcaa

SEQ ID NO: 49372 - RNA, 22 nt, Yersinia pestis KIM
aaugacugagauuauuaacagu

SEQ ID NO: 49373 - RNA, 22 nt, Yersinia pestis KIM
aaugagguuauuaugucagcga

SEQ ID NO: 49374 - RNA, 22 nt, Yersinia pestis KIM
aauggaaucaggauguggcuga

SEQ ID NO: 49375 - RNA, 22 nt, Yersinia pestis KIM
aauggcagauaucgcaacaauc

SEQ ID NO: 49376 - RNA, 22 nt, Yersinia pestis KIM
aauggugcggcgaugaagucgc

SEQ ID NO: 49377 - RNA, 22 nt, Yersinia pestis KIM
aaugucgaagcagguuuggucg

SEQ ID NO: 49378 - RNA, 22 nt, Yersinia pestis KIM
aaugucuuuauugaucgauuca

SEQ ID NO: 49379 - RNA, 19 nt, Yersinia pestis KIM
aauugaugugcuuucgccg

SEQ ID NO: 49380 - RNA, 22 nt, Yersinia pestis KIM
acaacgguaagaaagccgggcg

SEQ ID NO: 49381 - RNA, 22 nt, Yersinia pestis KIM
acaaggucugaaugccgauaug

SEQ ID NO: 49382 - RNA, 22 nt, Yersinia pestis KIM
acaaugaugacguggcgaagug

SEQ ID NO: 49383 - RNA, 22 nt, Yersinia pestis KIM
acacauauuucaggcuguugcg

SEQ ID NO: 49384 - RNA, 19 nt, Yersinia pestis KIM
acaggacagcaacagcagc

SEQ ID NO: 49385 - RNA, 22 nt, Yersinia pestis KIM
acaguauugggacaguauuugu

SEQ ID NO: 49386 - RNA, 22 nt, Yersinia pestis KIM
acagugauaaaacccgccugca

SEQ ID NO: 49387 - RNA, 22 nt, Yersinia pestis KIM
acagugcaauaucguucagguu

SEQ ID NO: 49388 - RNA, 22 nt, Yersinia pestis KIM
acaugguauuacugacucaacg

SEQ ID NO: 49389 - RNA, 22 nt, Yersinia pestis KIM
accaagguuuaugguuuucaau

SEQ ID NO: 49390 - RNA, 22 nt, Yersinia pestis KIM
accagucaugccuuuuaucaug

SEQ ID NO: 49391 - RNA, 22 nt, Yersinia pestis KIM
accgauggugcggcguuaucaa

SEQ ID NO: 49392 - RNA, 22 nt, Yersinia pestis KIM
accgccugauugccggugaauc

SEQ ID NO: 49393 - RNA, 22 nt, Yersinia pestis KIM
accgcgcacgauaaagguaaua

SEQ ID NO: 49394 - RNA, 22 nt, Yersinia pestis KIM
accgcucaauccguugcagggc

SEQ ID NO: 49395 - RNA, 22 nt, Yersinia pestis KIM
accggcaaugcugaagaaaugg

SEQ ID NO: 49396 - RNA, 22 nt, Yersinia pestis KIM
accgggcagcaaauggagugga

SEQ ID NO: 49397 - RNA, 22 nt, Yersinia pestis KIM
accggugcugcguuugacagcu

SEQ ID NO: 49398 - RNA, 22 nt, Yersinia pestis KIM
accucaguaaagggaggagauc

SEQ ID NO: 49399 - RNA, 22 nt, Yersinia pestis KIM
accugaaggcugggcaagaggu

SEQ ID NO: 49400 - RNA, 22 nt, Yersinia pestis KIM
accugcucuacaggcaauugcg

SEQ ID NO: 49401 - RNA, 22 nt, Yersinia pestis KIM
acgauaucgaaccugaaugacg

SEQ ID NO: 49402 - RNA, 22 nt, Yersinia pestis KIM
acgcgcugcuucaacauuguag

SEQ ID NO: 49403 - RNA, 22 nt, Yersinia pestis KIM
acggaaaccaacuaaaugggua

SEQ ID NO: 49404 - RNA, 22 nt, Yersinia pestis KIM
acggaauauuguuacgguggug

SEQ ID NO: 49405 - RNA, 22 nt, Yersinia pestis KIM
acgguugucugugggaagaggu

SEQ ID NO: 49406 - RNA, 22 nt, Yersinia pestis KIM
acgugcuauuggugaagugggg

SEQ ID NO: 49407 - RNA, 22 nt, Yersinia pestis KIM
acgugguuaaguccagcgucgg

SEQ ID NO: 49408 - RNA, 22 nt, Yersinia pestis KIM
acguuagcaugaugauuguugu

SEQ ID NO: 49409 - RNA, 22 nt, Yersinia pestis KIM
acguuucuuuacguaaaguacg

SEQ ID NO: 49410 - RNA, 22 nt, Yersinia pestis KIM
acguuucuuucaagaaagcacg

SEQ ID NO: 49411 - RNA, 22 nt, Yersinia pestis KIM
acuaacgugucauuaccggcac

SEQ ID NO: 49412 - RNA, 22 nt, Yersinia pestis KIM
acucaauggggugauugguuuu

SEQ ID NO: 49413 - RNA, 20 nt, Yersinia pestis KIM
acucaccgggacucagaaua

SEQ ID NO: 49414 - RNA, 20 nt, Yersinia pestis KIM
acugacuggacgugauugua

SEQ ID NO: 49415 - RNA, 22 nt, Yersinia pestis KIM
acugagauaaaaaggaugacug

SEQ ID NO: 49416 - RNA, 22 nt, Yersinia pestis KIM
acuggaguggaucuaucgcuug

SEQ ID NO: 49417 - RNA, 22 nt, Yersinia pestis KIM
acuguugauggcgacuucguua

SEQ ID NO: 49418 - RNA, 22 nt, Yersinia pestis KIM
acuuccugauacugguacucuu

SEQ ID NO: 49419 - RNA, 22 nt, Yersinia pestis KIM
agaaauugguauccgucgucuu

SEQ ID NO: 49420 - RNA, 22 nt, Yersinia pestis KIM
agaacauacuuuuggucauggu

SEQ ID NO: 49421 - RNA, 22 nt, Yersinia pestis KIM
agacugaugcaagauggcggua

SEQ ID NO: 49422 - RNA, 22 nt, Yersinia pestis KIM
agagauguggcgcgaucaguuc

SEQ ID NO: 49423 - RNA, 22 nt, Yersinia pestis KIM
agagauucuagucgcccacgau

SEQ ID NO: 49424 - RNA, 22 nt, Yersinia pestis KIM
agagcgacugcauggucgcugu

SEQ ID NO: 49425 - RNA, 22 nt, Yersinia pestis KIM
agaggcucuguuagcgguaaag

SEQ ID NO: 49426 - RNA, 22 nt, Yersinia pestis KIM
agauaauggcauacucguuugg

SEQ ID NO: 49427 - RNA, 22 nt, Yersinia pestis KIM
agauggcaucguuggcgacauu

SEQ ID NO: 49428 - RNA, 21 nt, Yersinia pestis KIM
agaugguaucccugcuguggu

SEQ ID NO: 49429 - RNA, 22 nt, Yersinia pestis KIM
agauuaagcgccucaaacaggc

SEQ ID NO: 49430 - RNA, 22 nt, Yersinia pestis KIM
agauuacugacgaucuugcuga

SEQ ID NO: 49431 - RNA, 22 nt, Yersinia pestis KIM
agauuaucgccaccauucuggu

SEQ ID NO: 49432 - RNA, 22 nt, Yersinia pestis KIM
agcagugagcgcagauaacgau

SEQ ID NO: 49433 - RNA, 22 nt, Yersinia pestis KIM
agccaguucuucaucugaugga

SEQ ID NO: 49434 - RNA, 20 nt, Yersinia pestis KIM
agccgcuauuuacggaugcc

SEQ ID NO: 49435 - RNA, 22 nt, Yersinia pestis KIM
agccuguccauaauucugugua

SEQ ID NO: 49436 - RNA, 22 nt, Yersinia pestis KIM
agcgcauuaaccacuggauagu

SEQ ID NO: 49437 - RNA, 22 nt, Yersinia pestis KIM
agcgcuguuaucgccagccacu

SEQ ID NO: 49438 - RNA, 22 nt, Yersinia pestis KIM
aggcgcuguugcgccaguuggc

SEQ ID NO: 49439 - RNA, 22 nt, Yersinia pestis KIM
aggugagcagcaccaaacgguu

SEQ ID NO: 49440 - RNA, 22 nt, Yersinia pestis KIM
agguuaaucacaucguuacuuu

SEQ ID NO: 49441 - RNA, 20 nt, Yersinia pestis KIM
agguuaccguguagucuccc

SEQ ID NO: 49442 - RNA, 22 nt, Yersinia pestis KIM
aguaacguuagucauuaaucag

SEQ ID NO: 49443 - RNA, 17 nt, Yersinia pestis KIM
aguaggguuauguguga

SEQ ID NO: 49444 - RNA, 22 nt, Yersinia pestis KIM
aguaugcuggcgcuguugcugg

SEQ ID NO: 49445 - RNA, 23 nt, Yersinia pestis KIM
agucaaagaauccaugucuggcu

SEQ ID NO: 49446 - RNA, 22 nt, Yersinia pestis KIM
agucgccgcaaccggugauggc

SEQ ID NO: 49447 - RNA, 22 nt, Yersinia pestis KIM
agucucaguucaucaacguauc

SEQ ID NO: 49448 - RNA, 22 nt, Yersinia pestis KIM
agugcacugaaccccagaucuu

SEQ ID NO: 49449 - RNA, 22 nt, Yersinia pestis KIM
agugccugcaucuguuuaccgg

SEQ ID NO: 49450 - RNA, 22 nt, Yersinia pestis KIM
agugcugcuugagaacuuacua

SEQ ID NO: 49451 - RNA, 22 nt, Yersinia pestis KIM
aguggcuuggggcgagacugaa

SEQ ID NO: 49452 - RNA, 22 nt, Yersinia pestis KIM
aguugcugauugcucaaccagc

SEQ ID NO: 49453 - RNA, 22 nt, Yersinia pestis KIM
auaagguugccagucggucgcc

SEQ ID NO: 49454 - RNA, 22 nt, Yersinia pestis KIM
auacuccugccggcugacaggu

SEQ ID NO: 49455 - RNA, 22 nt, Yersinia pestis KIM
auagacgguugaucuguaggua

SEQ ID NO: 49456 - RNA, 22 nt, Yersinia pestis KIM
auagcgaccaucgagacguacu

SEQ ID NO: 49457 - RNA, 22 nt, Yersinia pestis KIM
auaggcaacuucaauuaugcgg

SEQ ID NO: 49458 - RNA, 22 nt, Yersinia pestis KIM
auaucgcuggcugguuagugug

SEQ ID NO: 49459 - RNA, 22 nt, Yersinia pestis KIM
aucaaggauaagcaguucuggc

SEQ ID NO: 49460 - RNA, 22 nt, Yersinia pestis KIM
aucaccgcaucauauuacugac

SEQ ID NO: 49461 - RNA, 23 nt, Yersinia pestis KIM
aucaggucagcagugaugaagug

SEQ ID NO: 49462 - RNA, 22 nt, Yersinia pestis KIM
aucauugauggcguacgguuau

SEQ ID NO: 49463 - RNA, 22 nt, Yersinia pestis KIM
aucgaaaugguagucaaacaau

SEQ ID NO: 49464 - RNA, 21 nt, Yersinia pestis KIM
aucgccauccugguguugaug

SEQ ID NO: 49465 - RNA, 22 nt, Yersinia pestis KIM
aucgggcugagaugcgugccua

SEQ ID NO: 49466 - RNA, 20 nt, Yersinia pestis KIM
aucguuaugccaacaaugau

SEQ ID NO: 49467 - RNA, 22 nt, Yersinia pestis KIM
aucugcugauuauauugguuca

SEQ ID NO: 49468 - RNA, 22 nt, Yersinia pestis KIM
aucuggcucacgauaucuuugc

SEQ ID NO: 49469 - RNA, 22 nt, Yersinia pestis KIM
aucuuuggaucuaaacgggccu

SEQ ID NO: 49470 - RNA, 22 nt, Yersinia pestis KIM
aucuuugguggccagaagguug

SEQ ID NO: 49471 - RNA, 22 nt, Yersinia pestis KIM
augaguauguggagcuugaaca

SEQ ID NO: 49472 - RNA, 18 nt, Yersinia pestis KIM
augcacgacaucuugagu

SEQ ID NO: 49473 - RNA, 22 nt, Yersinia pestis KIM
augcagcaggccugcccggaua

SEQ ID NO: 49474 - RNA, 22 nt, Yersinia pestis KIM
augccaccugccgccgcuuuau

SEQ ID NO: 49475 - RNA, 22 nt, Yersinia pestis KIM
augccauauuuacauucgcgau

SEQ ID NO: 49476 - RNA, 22 nt, Yersinia pestis KIM
augcugaugaugacguuggccg

SEQ ID NO: 49477 - RNA, 22 nt, Yersinia pestis KIM
augcugauuuuguacuguucgu

SEQ ID NO: 49478 - RNA, 22 nt, Yersinia pestis KIM
augcuguugccaagggaacuaa

SEQ ID NO: 49479 - RNA, 22 nt, Yersinia pestis KIM
auggaucuuguccugagugcgg

SEQ ID NO: 49480 - RNA, 22 nt, Yersinia pestis KIM
auggcaagagaguggccgcugg

SEQ ID NO: 49481 - RNA, 22 nt, Yersinia pestis KIM
auggcacgauccacgccgcggg

SEQ ID NO: 49482 - RNA, 22 nt, Yersinia pestis KIM
auggcagaaggugauuaucggg

SEQ ID NO: 49483 - RNA, 22 nt, Yersinia pestis KIM
auggcggcagaggcgcguauug

SEQ ID NO: 49484 - RNA, 22 nt, Yersinia pestis KIM
auggcugauuuuucuggagcgg

SEQ ID NO: 49485 - RNA, 22 nt, Yersinia pestis KIM
augucggcauguuuguuggugc

SEQ ID NO: 49486 - RNA, 22 nt, Yersinia pestis KIM
uugccgguuauuuugcauucac

SEQ ID NO: 49487 - RNA, 22 nt, Yersinia pestis KIM
uugcgaccaucacccugacugc

SEQ ID NO: 49488 - RNA, 22 nt, Yersinia pestis KIM
uugcgcaggguccggugucgcu

SEQ ID NO: 49489 - RNA, 22 nt, Yersinia pestis KIM
uugcucaguccagucgucagca

SEQ ID NO: 49490 - RNA, 22 nt, Yersinia pestis KIM
uugcugaaauuaggcuucaccg

SEQ ID NO: 49491 - RNA, 22 nt, Yersinia pestis KIM
uugcugaccccaaauuauuuua

SEQ ID NO: 49492 - RNA, 22 nt, Yersinia pestis KIM
uugcugaugaaugguuagcuua

SEQ ID NO: 49493 - RNA, 22 nt, Yersinia pestis KIM
uugcuggcccacguguuauuga

SEQ ID NO: 49494 - RNA, 22 nt, Yersinia pestis KIM
uugcuguagaugauugcucuau

SEQ ID NO: 49495 - RNA, 22 nt, Yersinia pestis KIM
uugcuugcgcgagacgaaggga

SEQ ID NO: 49496 - RNA, 22 nt, Yersinia pestis KIM
uuggcagcaaaccgcggaccca

SEQ ID NO: 49497 - RNA, 22 nt, Yersinia pestis KIM
uuggcagucaggccaggaugcu

SEQ ID NO: 49498 - RNA, 22 nt, Yersinia pestis KIM
uuggccauaacacaauauuagu

SEQ ID NO: 49499 - RNA, 23 nt, Yersinia pestis KIM
uuggccaugcucguuuuacauag

SEQ ID NO: 49500 - RNA, 18 nt, Yersinia pestis KIM
uuggcggcauccauccac

SEQ ID NO: 49501 - RNA, 22 nt, Yersinia pestis KIM
uugucucauuuauugauaguga

SEQ ID NO: 49502 - RNA, 22 nt, Yersinia pestis KIM
uuguucaauggcgauuuguuca

SEQ ID NO: 49503 - RNA, 22 nt, Yersinia pestis KIM
uuguugacacuaagcguuucac

SEQ ID NO: 49504 - RNA, 23 nt, Yersinia pestis KIM
uuuaacaguccgguauucgaagu

SEQ ID NO: 49505 - RNA, 22 nt, Yersinia pestis KIM
uuucagacaaguuagugccuaa

SEQ ID NO: 49506 - RNA, 22 nt, Yersinia pestis KIM
uuuccagugccgccuuugccau

SEQ ID NO: 49507 - RNA, 22 nt, Yersinia pestis KIM
uuucgauacgaugcauauuaug

SEQ ID NO: 49508 - RNA, 22 nt, Yersinia pestis KIM
uuugaaucaggcauuaaucaaa

SEQ ID NO: 49509 - RNA, 19 nt, Yersinia pestis KIM
uuugaucaccaguuucggu

SEQ ID NO: 49510 - RNA, 22 nt, Yersinia pestis KIM
uuugcacugaaccccagaucuu

SEQ ID NO: 49511 - RNA, 22 nt, Yersinia pestis KIM
uuugccgauaauuaacauaagc

SEQ ID NO: 49512 - RNA, 22 nt, Yersinia pestis KIM
uuuggcaccuuggauuuuggau

SEQ ID NO: 49513 - RNA, 22 nt, Yersinia pestis KIM
uuuguagacauuguuauuggua

SEQ ID NO: 49514 - RNA, 22 nt, Yersinia pestis KIM
uuugucagcagucugaaaggcc

SEQ ID NO: 49515 - RNA, 23 nt, Yersinia pestis KIM
ugaugcagagcuggauaugcguc

SEQ ID NO: 49516 - RNA, 22 nt, Yersinia pestis KIM
ugaugcuaaaacugugaacuag

SEQ ID NO: 49517 - RNA, 22 nt, Yersinia pestis KIM
ugaugcuaaauuuaucagcaaa

SEQ ID NO: 49518 - RNA, 22 nt, Yersinia pestis KIM
ugauggauaggcccaucgucag

SEQ ID NO: 49519 - RNA, 22 nt, Yersinia pestis KIM
ugauggcggacagugguauaac

SEQ ID NO: 49520 - RNA, 21 nt, Yersinia pestis KIM
ugauugaguuguucaucagcg

SEQ ID NO: 49521 - RNA, 17 nt, Yersinia pestis KIM
ugcaaagggcuguaucg

SEQ ID NO: 49522 - RNA, 22 nt, Yersinia pestis KIM
ugcaaaggucagacgugggggu

SEQ ID NO: 49523 - RNA, 22 nt, Yersinia pestis KIM
ugcacaacgaaccggaaaugcu

SEQ ID NO: 49524 - RNA, 22 nt, Yersinia pestis KIM
ugcacagcuggaugugagucug

SEQ ID NO: 49525 - RNA, 22 nt, Yersinia pestis KIM
ugcaccaggcguuuuuacagca

SEQ ID NO: 49526 - RNA, 22 nt, Yersinia pestis KIM
ugcaccgggccgccgugaugag

SEQ ID NO: 49527 - RNA, 22 nt, Yersinia pestis KIM
ugccagcaauaagauggguggu

SEQ ID NO: 49528 - RNA, 22 nt, Yersinia pestis KIM
ugccauuggcucacauuguuua

SEQ ID NO: 49529 - RNA, 22 nt, Yersinia pestis KIM
ugccgugaaaaucaggcaccgg

SEQ ID NO: 49530 - RNA, 19 nt, Yersinia pestis KIM
ugcgagaaccuggcgacaa

SEQ ID NO: 49531 - RNA, 22 nt, Yersinia pestis KIM
ugcggcugaacgucugcugaug

SEQ ID NO: 49532 - RNA, 22 nt, Yersinia pestis KIM
ugcucagugggcuuaucgcccu

SEQ ID NO: 49533 - RNA, 22 nt, Yersinia pestis KIM
ugcucgcacagggucuggcgua

SEQ ID NO: 49534 - RNA, 22 nt, Yersinia pestis KIM
ugcugccagauacauacccucu

SEQ ID NO: 49535 - RNA, 20 nt, Yersinia pestis KIM
ugcuggcacugaugggggca

SEQ ID NO: 49536 - RNA, 22 nt, Yersinia pestis KIM
ugcugggcauugagccguuauu

SEQ ID NO: 49537 - RNA, 20 nt, Yersinia pestis KIM
ugcuguaacaugacuuauag

SEQ ID NO: 49538 - RNA, 22 nt, Yersinia pestis KIM
ugcugugaguaauacucuugca

SEQ ID NO: 49539 - RNA, 22 nt, Yersinia pestis KIM
ugcuuaucaggugauuggggcg

SEQ ID NO: 49540 - RNA, 22 nt, Yersinia pestis KIM
uggaaaccuugccuggggugga

SEQ ID NO: 49541 - RNA, 22 nt, Yersinia pestis KIM
uggaaguuauggggaauguuuu

SEQ ID NO: 49542 - RNA, 22 nt, Yersinia pestis KIM
uggacgacguguugauucaacu

SEQ ID NO: 49543 - RNA, 22 nt, Yersinia pestis KIM
uggauaacaagauguuuacagu

SEQ ID NO: 49544 - RNA, 22 nt, Yersinia pestis KIM
uggauccuuuagggagcgguau

SEQ ID NO: 49545 - RNA, 22 nt, Yersinia pestis KIM
uggaugaagugcagucaauuug

SEQ ID NO: 49546 - RNA, 22 nt, Yersinia pestis KIM
uggcaggagguucucguucagg

SEQ ID NO: 49547 - RNA, 22 nt, Yersinia pestis KIM
uggcaucauagagccuggagau

SEQ ID NO: 49548 - RNA, 22 nt, Yersinia pestis KIM
uggcauugcuauugguggucgu

SEQ ID NO: 49549 - RNA, 22 nt, Yersinia pestis KIM
uggcgagauggagcuguaccgc

SEQ ID NO: 49550 - RNA, 22 nt, Yersinia pestis KIM
uggcgauugccaguggugugcc

SEQ ID NO: 49551 - RNA, 20 nt, Yersinia pestis KIM
uggcgcagcgcagaugccgc

SEQ ID NO: 49552 - RNA, 23 nt, Yersinia pestis KIM
uggcggaugaugucgcguguggg

SEQ ID NO: 49553 - RNA, 22 nt, Yersinia pestis KIM
uggcggauuauagauggugagg

SEQ ID NO: 49554 - RNA, 22 nt, Yersinia pestis KIM
uggcguuagcccaacgggcaca

SEQ ID NO: 49555 - RNA, 22 nt, Yersinia pestis KIM
uggcuaagacuucauuacgcuc

SEQ ID NO: 49556 - RNA, 22 nt, Yersinia pestis KIM
uggcuagccagccgugcagcca

SEQ ID NO: 49557 - RNA, 22 nt, Yersinia pestis KIM
uggcuauugaugggcaauaugu

SEQ ID NO: 49558 - RNA, 22 nt, Yersinia pestis KIM
uggcugagcagggcauguugga

SEQ ID NO: 49559 - RNA, 22 nt, Yersinia pestis KIM
uggcugcagguaacagccugga

SEQ ID NO: 49560 - RNA, 22 nt, Yersinia pestis KIM
uggcugccagcacuguuuaucc

SEQ ID NO: 49561 - RNA, 22 nt, Yersinia pestis KIM
uggcugcguuagccccugcggc

SEQ ID NO: 49562 - RNA, 22 nt, Yersinia pestis KIM
ugggcauuguucucaauugaga

SEQ ID NO: 49563 - RNA, 22 nt, Yersinia pestis KIM
ugguauaggccugaaaauaagc

SEQ ID NO: 49564 - RNA, 18 nt, Yersinia pestis KIM
uggucaguaaagcggcuu

SEQ ID NO: 49565 - RNA, 22 nt, Yersinia pestis KIM
uggugacgaacugcguucaaug

SEQ ID NO: 49566 - RNA, 22 nt, Yersinia pestis KIM
uggugcuauuaauggggcuugc

SEQ ID NO: 49567 - RNA, 22 nt, Yersinia pestis KIM
ugguuaucuaugaaggcgagcu

SEQ ID NO: 49568 - RNA, 22 nt, Yersinia pestis KIM
ugguugcaccgggcgcugaaag

SEQ ID NO: 49569 - RNA, 22 nt, Yersinia pestis KIM
ugguuucacuuuggcgggugcu

SEQ ID NO: 49570 - RNA, 22 nt, Yersinia pestis KIM
uguaaggaugcaaucaggggca

SEQ ID NO: 49571 - RNA, 22 nt, Yersinia pestis KIM
uguaauccaaccaauuuuauug

SEQ ID NO: 49572 - RNA, 23 nt, Yersinia pestis KIM
uguaaucgcuauucaggcccgcc

SEQ ID NO: 49573 - RNA, 22 nt, Yersinia pestis KIM
ugucgaugaacugcguuuauau

SEQ ID NO: 49574 - RNA, 22 nt, Yersinia pestis KIM
ugugaacagagucaacuuuuuu

SEQ ID NO: 49575 - RNA, 22 nt, Yersinia pestis KIM
ugugacuucaacaugccgcugc

SEQ ID NO: 49576 - RNA, 22 nt, Yersinia pestis KIM
ugugcugauaauaggugugaug

SEQ ID NO: 49577 - RNA, 22 nt, Yersinia pestis KIM
ugugugacggaugcggucaaug

SEQ ID NO: 49578 - RNA, 22 nt, Yersinia pestis KIM
uguucccgcagaugccaguacc

SEQ ID NO: 49579 - RNA, 22 nt, Yersinia pestis KIM
uguuugaagcaccuacugcagg

SEQ ID NO: 49580 - RNA, 22 nt, Yersinia pestis KIM
uuaaggauugucauuagucgcg

SEQ ID NO: 49581 - RNA, 22 nt, Yersinia pestis KIM
uuaaucgacaaguuacuguucu

SEQ ID NO: 49582 - RNA, 22 nt, Yersinia pestis KIM
uuacggacuauccagccgcgcg

SEQ ID NO: 49583 - RNA, 22 nt, Yersinia pestis KIM
uuacggugaucggaauuuguuc

SEQ ID NO: 49584 - RNA, 22 nt, Yersinia pestis KIM
uuagauugcccgguugucuucc

SEQ ID NO: 49585 - RNA, 22 nt, Yersinia pestis KIM
uuagccauaccaugacugacac

SEQ ID NO: 49586 - RNA, 22 nt, Yersinia pestis KIM
uuagcguacagguguacacuga

SEQ ID NO: 49587 - RNA, 22 nt, Yersinia pestis KIM
uuagggauaagcggaaagacga

SEQ ID NO: 49588 - RNA, 22 nt, Yersinia pestis KIM
uuauagguccggcucaggaaga

SEQ ID NO: 49589 - RNA, 22 nt, Yersinia pestis KIM
uucaaugauggucgaagggcgu

SEQ ID NO: 49590 - RNA, 22 nt, Yersinia pestis KIM
uucagauguugagugggcacgu

SEQ ID NO: 49591 - RNA, 22 nt, Yersinia pestis KIM
uucagguagauuucgcgcccuu

SEQ ID NO: 49592 - RNA, 22 nt, Yersinia pestis KIM
uucagguggauacccaguuuca

SEQ ID NO: 49593 - RNA, 22 nt, Yersinia pestis KIM
uucauaggcgguuaagguucgg

SEQ ID NO: 49594 - RNA, 22 nt, Yersinia pestis KIM
uucgccaaucagauugacgcgg

SEQ ID NO: 49595 - RNA, 23 nt, Yersinia pestis KIM
uucgccugaagaaugcacugguu

SEQ ID NO: 49596 - RNA, 22 nt, Yersinia pestis KIM
uucgguaugaguuuauugcuuu

SEQ ID NO: 49597 - RNA, 20 nt, Yersinia pestis KIM
uugaacagaacgcggaagcc

SEQ ID NO: 49598 - RNA, 22 nt, Yersinia pestis KIM
uugaccaguggugcgcuggaau

SEQ ID NO: 49599 - RNA, 22 nt, Yersinia pestis KIM
uugagaaaacucuuauagugcu

SEQ ID NO: 49600 - RNA, 22 nt, Yersinia pestis KIM
uugagucucagggcgaugccag

SEQ ID NO: 49601 - RNA, 22 nt, Yersinia pestis KIM
uugauacgaagaaggauuucaa

SEQ ID NO: 49602 - RNA, 22 nt, Yersinia pestis KIM
uugaucauggcugagguguguc

SEQ ID NO: 49603 - RNA, 22 nt, Yersinia pestis KIM
uugaugacugacgaugggcagu

SEQ ID NO: 49604 - RNA, 22 nt, Yersinia pestis KIM
auguuaucaaggcgcuauuuga

SEQ ID NO: 49605 - RNA, 22 nt, Yersinia pestis KIM
auguucaccuuccauucccaug

SEQ ID NO: 49606 - RNA, 21 nt, Yersinia pestis KIM
cgcuaucaccaagcauuauuu

SEQ ID NO: 49607 - RNA, 23 nt, Yersinia pestis KIM
cgcuauguugaugaacaggcucc

SEQ ID NO: 49608 - RNA, 22 nt, Yersinia pestis KIM
cgcugaugauuauuacagugcu

SEQ ID NO: 49609 - RNA, 22 nt, Yersinia pestis KIM
cgcuguacgccgauccgcauuu

SEQ ID NO: 49610 - RNA, 22 nt, Yersinia pestis KIM
cgcuguaugaugccgccugcgc

SEQ ID NO: 49611 - RNA, 22 nt, Yersinia pestis KIM
cggaggauauuuauuugugcuc

SEQ ID NO: 49612 - RNA, 22 nt, Yersinia pestis KIM
cggcgaucucaugguggugucu

SEQ ID NO: 49613 - RNA, 22 nt, Yersinia pestis KIM
cggcgguugucgguauggcgcu

SEQ ID NO: 49614 - RNA, 18 nt, Yersinia pestis KIM
cggcguaacuggccguua

SEQ ID NO: 49615 - RNA, 23 nt, Yersinia pestis KIM
cggcugagauagagcgccguguu

SEQ ID NO: 49616 - RNA, 22 nt, Yersinia pestis KIM
cggcugguguacagcacgggca

SEQ ID NO: 49617 - RNA, 22 nt, Yersinia pestis KIM
cgggaaauagugaguucgucgc

SEQ ID NO: 49618 - RNA, 18 nt, Yersinia pestis KIM
cgggucacccaacugaau

SEQ ID NO: 49619 - RNA, 22 nt, Yersinia pestis KIM
cgguacgcuuaccuuucagcuc

SEQ ID NO: 49620 - RNA, 21 nt, Yersinia pestis KIM
cggucgucgccgaugcguguu

SEQ ID NO: 49621 - RNA, 22 nt, Yersinia pestis KIM
cguaauggcagaagccgguggu

SEQ ID NO: 49622 - RNA, 22 nt, Yersinia pestis KIM
cguauucugacgauaaguagcc

SEQ ID NO: 49623 - RNA, 22 nt, Yersinia pestis KIM
cguauugacccuaaaaccggua

SEQ ID NO: 49624 - RNA, 22 nt, Yersinia pestis KIM
cgucagugcgcaguaagaccuu

SEQ ID NO: 49625 - RNA, 22 nt, Yersinia pestis KIM
cgugguaugcgccgccagccag

SEQ ID NO: 49626 - RNA, 22 nt, Yersinia pestis KIM
cguucguggauccugcguaacu

SEQ ID NO: 49627 - RNA, 18 nt, Yersinia pestis KIM
cguugaugcagaugaagu

SEQ ID NO: 49628 - RNA, 22 nt, Yersinia pestis KIM
cuacagggcuauagcaugcguc

SEQ ID NO: 49629 - RNA, 22 nt, Yersinia pestis KIM
cucacuggagggauucaucaag

SEQ ID NO: 49630 - RNA, 22 nt, Yersinia pestis KIM
cucagcagcaaaugagagaagu

SEQ ID NO: 49631 - RNA, 22 nt, Yersinia pestis KIM
cucagccgccccggagauagcg

SEQ ID NO: 49632 - RNA, 20 nt, Yersinia pestis KIM
cugaauuagaagcauuaauu

SEQ ID NO: 49633 - RNA, 22 nt, Yersinia pestis KIM
cugaugaauuacgugaugcggu

SEQ ID NO: 49634 - RNA, 22 nt, Yersinia pestis KIM
cugcgucuaugacaucacuaac

SEQ ID NO: 49635 - RNA, 22 nt, Yersinia pestis KIM
cugcgugugccggcccuccgca

SEQ ID NO: 49636 - RNA, 22 nt, Yersinia pestis KIM
cugcuagcaauaucugcguauu

SEQ ID NO: 49637 - RNA, 22 nt, Yersinia pestis KIM
cuggaagguuaauugauggggu

SEQ ID NO: 49638 - RNA, 22 nt, Yersinia pestis KIM
cuggccagacuguacgcuuugg

SEQ ID NO: 49639 - RNA, 22 nt, Yersinia pestis KIM
cuggcgaguugagggagucugu

SEQ ID NO: 49640 - RNA, 22 nt, Yersinia pestis KIM
cuggcguuauacucgugcgcgu

SEQ ID NO: 49641 - RNA, 22 nt, Yersinia pestis KIM
cuggcuauggacugugcggcuu

SEQ ID NO: 49642 - RNA, 22 nt, Yersinia pestis KIM
cuggcugauggcccuaaggcag

SEQ ID NO: 49643 - RNA, 22 nt, Yersinia pestis KIM
cugguauuccgcauugucaauu

SEQ ID NO: 49644 - RNA, 22 nt, Yersinia pestis KIM
cugguuaaugagcgcccgauug

SEQ ID NO: 49645 - RNA, 22 nt, Yersinia pestis KIM
cuguucuauugucuuauugucu

SEQ ID NO: 49646 - RNA, 22 nt, Yersinia pestis KIM
cuuaagguuuaucgagaugccu

SEQ ID NO: 49647 - RNA, 22 nt, Yersinia pestis KIM
cuuaaucugucugguuaucagg

SEQ ID NO: 49648 - RNA, 22 nt, Yersinia pestis KIM
cuugauaccgaugguggauuuc

SEQ ID NO: 49649 - RNA, 22 nt, Yersinia pestis KIM
cuugcgugaacgggcugaagau

SEQ ID NO: 49650 - RNA, 22 nt, Yersinia pestis KIM
cuuggcugaaguuaaucucaau

SEQ ID NO: 49651 - RNA, 22 nt, Yersinia pestis KIM
cuuugucaauaaccucuaaucu

SEQ ID NO: 49652 - RNA, 22 nt, Yersinia pestis KIM
gaacaugauuaugccguauuua

SEQ ID NO: 49653 - RNA, 22 nt, Yersinia pestis KIM
gaauugcggcagcggaaucagu

SEQ ID NO: 49654 - RNA, 22 nt, Yersinia pestis KIM
gagauuagagguuauugacaaa

SEQ ID NO: 49655 - RNA, 22 nt, Yersinia pestis KIM
gagcccgugauuugaaagggau

SEQ ID NO: 49656 - RNA, 22 nt, Yersinia pestis KIM
gagggauuuuugcaguaguccu

SEQ ID NO: 49657 - RNA, 22 nt, Yersinia pestis KIM
gaguaguggccagacgguugag

SEQ ID NO: 49658 - RNA, 22 nt, Yersinia pestis KIM
gagugaugauugaaacacaggu

SEQ ID NO: 49659 - RNA, 22 nt, Yersinia pestis KIM
gagugcuaacucaauagcugaa

SEQ ID NO: 49660 - RNA, 22 nt, Yersinia pestis KIM
gaguugcugcaaaaacuggcag

SEQ ID NO: 49661 - RNA, 22 nt, Yersinia pestis KIM
gauagcgaucaguagugucagu

SEQ ID NO: 49662 - RNA, 18 nt, Yersinia pestis KIM
gauaucauugaaauggau

SEQ ID NO: 49663 - RNA, 22 nt, Yersinia pestis KIM
gauauucgcgcagcacagauug

SEQ ID NO: 49664 - RNA, 23 nt, Yersinia pestis KIM
gaucaacacagcaggaagccgga

SEQ ID NO: 49665 - RNA, 22 nt, Yersinia pestis KIM
gaucgcugaauuacuuuccggu

SEQ ID NO: 49666 - RNA, 22 nt, Yersinia pestis KIM
gaucucccgcaauaccguuaaa

SEQ ID NO: 49667 - RNA, 22 nt, Yersinia pestis KIM
gaugagugauggcgacaauaaa

SEQ ID NO: 49668 - RNA, 22 nt, Yersinia pestis KIM
gaugauguucuucaaaacaaag

SEQ ID NO: 49669 - RNA, 22 nt, Yersinia pestis KIM
gauggugcucuuuagcguuuug

SEQ ID NO: 49670 - RNA, 22 nt, Yersinia pestis KIM
gaugucaaagcaauggaauggc

SEQ ID NO: 49671 - RNA, 22 nt, Yersinia pestis KIM
gauugaugcacuuaaagcagag

SEQ ID NO: 49672 - RNA, 22 nt, Yersinia pestis KIM
gauuggcuggcacagcgugaug

SEQ ID NO: 49673 - RNA, 22 nt, Yersinia pestis KIM
gcaccugguaguuggcaccacu

SEQ ID NO: 49674 - RNA, 17 nt, Yersinia pestis KIM
gcagaacuuacgguuaa

SEQ ID NO: 49675 - RNA, 22 nt, Yersinia pestis KIM
gcagcucuauuccauggguaca

SEQ ID NO: 49676 - RNA, 21 nt, Yersinia pestis KIM
gcaggcugucgccgucagcau

SEQ ID NO: 49677 - RNA, 22 nt, Yersinia pestis KIM
gcaguaagaauaggcugcucau

SEQ ID NO: 49678 - RNA, 22 nt, Yersinia pestis KIM
gcaguagaacuacagccuggac

SEQ ID NO: 49679 - RNA, 22 nt, Yersinia pestis KIM
gcauccagaaugcguugcugau

SEQ ID NO: 49680 - RNA, 22 nt, Yersinia pestis KIM
gcaugguuugggaacgucggug

SEQ ID NO: 49681 - RNA, 22 nt, Yersinia pestis KIM
gccaaaucauugugacuaguuu

SEQ ID NO: 49682 - RNA, 22 nt, Yersinia pestis KIM
gccaagcuugccagaucaugaa

SEQ ID NO: 49683 - RNA, 22 nt, Yersinia pestis KIM
gccaauacacccggaugccgua

SEQ ID NO: 49684 - RNA, 22 nt, Yersinia pestis KIM
gccacgauccccgguuuacuua

SEQ ID NO: 49685 - RNA, 22 nt, Yersinia pestis KIM
gccagagacaaugucgacgacg

SEQ ID NO: 49686 - RNA, 22 nt, Yersinia pestis KIM
gccagguaaaacgaauggauuc

SEQ ID NO: 49687 - RNA, 22 nt, Yersinia pestis KIM
gccaguaggcuaacgcgcuugc

SEQ ID NO: 49688 - RNA, 22 nt, Yersinia pestis KIM
gccauuggcauuaaugccuugg

SEQ ID NO: 49689 - RNA, 21 nt, Yersinia pestis KIM
gccgaagauuuugagcugcuu

SEQ ID NO: 49690 - RNA, 22 nt, Yersinia pestis KIM
gccgguauuggcguuugauaug

SEQ ID NO: 49691 - RNA, 22 nt, Yersinia pestis KIM
gccggugucgagaucauuggcg

SEQ ID NO: 49692 - RNA, 19 nt, Yersinia pestis KIM
gccgucgaaacgcugcaac

SEQ ID NO: 49693 - RNA, 22 nt, Yersinia pestis KIM
gccguggugagcggguauggcu

SEQ ID NO: 49694 - RNA, 21 nt, Yersinia pestis KIM
gccguucaagaggcuuuauua

SEQ ID NO: 49695 - RNA, 22 nt, Yersinia pestis KIM
gccuuucagacugcugacaaac

SEQ ID NO: 49696 - RNA, 22 nt, Yersinia pestis KIM
gcgauaaaaaagguugaguuca

SEQ ID NO: 49697 - RNA, 21 nt, Yersinia pestis KIM
uaacagggcuaguucagcucg

SEQ ID NO: 49698 - RNA, 22 nt, Yersinia pestis KIM
uaaccagugguuuauugcuggu

SEQ ID NO: 49699 - RNA, 21 nt, Yersinia pestis KIM
uaacggcauugcguucacggc

SEQ ID NO: 49700 - RNA, 22 nt, Yersinia pestis KIM
uaacugcacgcaucucaguuug

SEQ ID NO: 49701 - RNA, 22 nt, Yersinia pestis KIM
uaaugcggggguagucauacaa

SEQ ID NO: 49702 - RNA, 18 nt, Yersinia pestis KIM
uaauuggucaccuucugc

SEQ ID NO: 49703 - RNA, 22 nt, Yersinia pestis KIM
uacauucucgcaaaguuugugc

SEQ ID NO: 49704 - RNA, 22 nt, Yersinia pestis KIM
uaccgcucagaaacguuuagau

SEQ ID NO: 49705 - RNA, 22 nt, Yersinia pestis KIM
uaccggcaccaaacaguauugc

SEQ ID NO: 49706 - RNA, 22 nt, Yersinia pestis KIM
uacgcuaauuuauacgucgggu

SEQ ID NO: 49707 - RNA, 22 nt, Yersinia pestis KIM
uacggucauaucgguacucaac

SEQ ID NO: 49708 - RNA, 22 nt, Yersinia pestis KIM
uacugcaucauguuugcugauu

SEQ ID NO: 49709 - RNA, 22 nt, Yersinia pestis KIM
uacuggauguagauuauaauga

SEQ ID NO: 49710 - RNA, 22 nt, Yersinia pestis KIM
uacuguaucuuaauuuuaugcu

SEQ ID NO: 49711 - RNA, 22 nt, Yersinia pestis KIM
uacuugaauggaaaucccggcc

SEQ ID NO: 49712 - RNA, 19 nt, Yersinia pestis KIM
uagauaacauaggguucgc

SEQ ID NO: 49713 - RNA, 22 nt, Yersinia pestis KIM
uagcaaguaaugauagaaaugu

SEQ ID NO: 49714 - RNA, 22 nt, Yersinia pestis KIM
uagccauguauuuauaggcaga

SEQ ID NO: 49715 - RNA, 22 nt, Yersinia pestis KIM
uagccauuauauucagcgccau

SEQ ID NO: 49716 - RNA, 22 nt, Yersinia pestis KIM
uagcccagacgcuauugcgccg

SEQ ID NO: 49717 - RNA, 22 nt, Yersinia pestis KIM
uagcccauugcuggcugauggu

SEQ ID NO: 49718 - RNA, 22 nt, Yersinia pestis KIM
uagccugacagauagaagggcc

SEQ ID NO: 49719 - RNA, 22 nt, Yersinia pestis KIM
uagcugauagucuuuaguagcu

SEQ ID NO: 49720 - RNA, 22 nt, Yersinia pestis KIM
uagcugucaauggugguuuuga

SEQ ID NO: 49721 - RNA, 22 nt, Yersinia pestis KIM
uagcuuaugggguaaugguuac

SEQ ID NO: 49722 - RNA, 22 nt, Yersinia pestis KIM
uagguauaucugugacaccucc

SEQ ID NO: 49723 - RNA, 22 nt, Yersinia pestis KIM
uauaccaaccugcaaggaugcc

SEQ ID NO: 49724 - RNA, 22 nt, Yersinia pestis KIM
uauaggugguguuaccgguguu

SEQ ID NO: 49725 - RNA, 22 nt, Yersinia pestis KIM
uaucagagugcgcugauuuaac

SEQ ID NO: 49726 - RNA, 22 nt, Yersinia pestis KIM
uaucagcccuggaugaagauga

SEQ ID NO: 49727 - RNA, 22 nt, Yersinia pestis KIM
uaucagcgaagcuacgcauauu

SEQ ID NO: 49728 - RNA, 22 nt, Yersinia pestis KIM
uauccauauagcuguucagggu

SEQ ID NO: 49729 - RNA, 22 nt, Yersinia pestis KIM
uauccgauauucaucuuggauu

SEQ ID NO: 49730 - RNA, 22 nt, Yersinia pestis KIM
uaucgccgucauugguucuuga

SEQ ID NO: 49731 - RNA, 21 nt, Yersinia pestis KIM
uaucgcuuucgcuacgccacc

SEQ ID NO: 49732 - RNA, 22 nt, Yersinia pestis KIM
uaucgguauuuaguuguauaag

SEQ ID NO: 49733 - RNA, 22 nt, Yersinia pestis KIM
uaugccguaugaagauaagggg

SEQ ID NO: 49734 - RNA, 22 nt, Yersinia pestis KIM
uaugucacacaguggguuauug

SEQ ID NO: 49735 - RNA, 22 nt, Yersinia pestis KIM
uauugcgcuuuuguuagcgggu

SEQ ID NO: 49736 - RNA, 22 nt, Yersinia pestis KIM
uauugcuguugaauuuacguua

SEQ ID NO: 49737 - RNA, 22 nt, Yersinia pestis KIM
uauugggauuugugcguuugca

SEQ ID NO: 49738 - RNA, 22 nt, Yersinia pestis KIM
ucaauguucgucgugagggcga

SEQ ID NO: 49739 - RNA, 22 nt, Yersinia pestis KIM
ucaccagagacguaucuuuuuc

SEQ ID NO: 49740 - RNA, 20 nt, Yersinia pestis KIM
ucacucacuuauucgccugu

SEQ ID NO: 49741 - RNA, 22 nt, Yersinia pestis KIM
ucacuugggugcauuggaugaa

SEQ ID NO: 49742 - RNA, 20 nt, Yersinia pestis KIM
ucagaugaaucggggagcgc

SEQ ID NO: 49743 - RNA, 22 nt, Yersinia pestis KIM
ucagccaaguacagaagaaauu

SEQ ID NO: 49744 - RNA, 22 nt, Yersinia pestis KIM
ucaggauuauucauuggcacaa

SEQ ID NO: 49745 - RNA, 22 nt, Yersinia pestis KIM
ucaguaagaggggacaggguau

SEQ ID NO: 49746 - RNA, 22 nt, Yersinia pestis KIM
ucagugaacucgaugauaauca

SEQ ID NO: 49747 - RNA, 22 nt, Yersinia pestis KIM
ucaguuaaucugagugcgcuau

SEQ ID NO: 49748 - RNA, 22 nt, Yersinia pestis KIM
ucaguuuaucgggcagguguua

SEQ ID NO: 49749 - RNA, 22 nt, Yersinia pestis KIM
ucaucccauucucuagccgggg

SEQ ID NO: 49750 - RNA, 22 nt, Yersinia pestis KIM
ucaucuuguaagaguucugccc

SEQ ID NO: 49751 - RNA, 17 nt, Yersinia pestis KIM
ucauggcccagucugag

SEQ ID NO: 49752 - RNA, 22 nt, Yersinia pestis KIM
ucauugagcguagcaaugaacu

SEQ ID NO: 49753 - RNA, 22 nt, Yersinia pestis KIM
uccugcuacgcugaaaugugac

SEQ ID NO: 49754 - RNA, 22 nt, Yersinia pestis KIM
ucgaauugaauggucagaaaau

SEQ ID NO: 49755 - RNA, 21 nt, Yersinia pestis KIM
ucgagcagccucaucuggugu

SEQ ID NO: 49756 - RNA, 22 nt, Yersinia pestis KIM
ucgauuaaucuaucauaguaag

SEQ ID NO: 49757 - RNA, 20 nt, Yersinia pestis KIM
ucgauuucacgugcaacaga

SEQ ID NO: 49758 - RNA, 22 nt, Yersinia pestis KIM
ucgcgaauacuauugaugguuu

SEQ ID NO: 49759 - RNA, 22 nt, Yersinia pestis KIM
ucgcgcuggcugaacguuuugg

SEQ ID NO: 49760 - RNA, 22 nt, Yersinia pestis KIM
ucgcgcuuuuuaggauguuucu

SEQ ID NO: 49761 - RNA, 22 nt, Yersinia pestis KIM
ucgcuuguggugcuaucucugg

SEQ ID NO: 49762 - RNA, 23 nt, Yersinia pestis KIM
ucgggaguagcuuucucagugcg

SEQ ID NO: 49763 - RNA, 22 nt, Yersinia pestis KIM
ucguauaccauaaugcgcugua

SEQ ID NO: 49764 - RNA, 22 nt, Yersinia pestis KIM
ucgucgcagucgaaaggccucu

SEQ ID NO: 49765 - RNA, 22 nt, Yersinia pestis KIM
ucguucagugaucaccuaauca

SEQ ID NO: 49766 - RNA, 22 nt, Yersinia pestis KIM
ucuacuggcaggcgagcugccu

SEQ ID NO: 49767 - RNA, 22 nt, Yersinia pestis KIM
ucucaggugugagguuauugac

SEQ ID NO: 49768 - RNA, 18 nt, Yersinia pestis KIM
ucucauugccauuuaaau

SEQ ID NO: 49769 - RNA, 22 nt, Yersinia pestis KIM
ucugaacgucaucuagccguug

SEQ ID NO: 49770 - RNA, 22 nt, Yersinia pestis KIM
ucugaauucuccgaaauugugg

SEQ ID NO: 49771 - RNA, 22 nt, Yersinia pestis KIM
ucugauuuuacugaugucuauu

SEQ ID NO: 49772 - RNA, 22 nt, Yersinia pestis KIM
ucuggcugagcguaucagcgaa

SEQ ID NO: 49773 - RNA, 22 nt, Yersinia pestis KIM
ucuucaguggccgugaugaaau

SEQ ID NO: 49774 - RNA, 22 nt, Yersinia pestis KIM
ucuugcagcuucgccucugcga

SEQ ID NO: 49775 - RNA, 22 nt, Yersinia pestis KIM
ugaaacagcgcuggcagcagca

SEQ ID NO: 49776 - RNA, 22 nt, Yersinia pestis KIM
ugaaaugauuaaacgccuggga

SEQ ID NO: 49777 - RNA, 22 nt, Yersinia pestis KIM
ugaacauauuccacugccugau

SEQ ID NO: 49778 - RNA, 22 nt, Yersinia pestis KIM
ugaagauggcuaugaugcacug

SEQ ID NO: 49779 - RNA, 22 nt, Yersinia pestis KIM
ugaagccagcggcaauccauuu

SEQ ID NO: 49780 - RNA, 20 nt, Yersinia pestis KIM
ugaagccuugcucaauggcc

SEQ ID NO: 49781 - RNA, 21 nt, Yersinia pestis KIM
ugaaucgugcugucaccgugc

SEQ ID NO: 49782 - RNA, 22 nt, Yersinia pestis KIM
ugaauuucacaucacgacauuu

SEQ ID NO: 49783 - RNA, 22 nt, Yersinia pestis KIM
ugacaaaucucugggcgcaggg

SEQ ID NO: 49784 - RNA, 19 nt, Yersinia pestis KIM
ugaccggugcuucauaacc

SEQ ID NO: 49785 - RNA, 22 nt, Yersinia pestis KIM
ugacugaugggcgguuauccaa

SEQ ID NO: 49786 - RNA, 22 nt, Yersinia pestis KIM
ugagaaugccguuguguuuucu

SEQ ID NO: 49787 - RNA, 22 nt, Yersinia pestis KIM
ugaggcaggaaaucggcucuuu

SEQ ID NO: 49788 - RNA, 22 nt, Bordetella pertussis
aaucguucgaucucgccacgau

SEQ ID NO: 49789 - RNA, 18 nt, Bordetella pertussis
cguagucgaucugcugcc

SEQ ID NO: 49790 - RNA, 22 nt, Bordetella pertussis
gcgcgggcguacagcagcaggg

SEQ ID NO: 49791 - RNA, 22 nt, Bordetella pertussis
cgaggccagccaauugcgggcc

SEQ ID NO: 49792 - RNA, 22 nt, Bordetella pertussis
gcgacggugggcgacaccggcc

SEQ ID NO: 49793 - RNA, 22 nt, Bordetella pertussis
gcgucggcggugaucgucgagc

SEQ ID NO: 49794 - RNA, 22 nt, Bordetella pertussis
gcacgcccugcacgccguccag

SEQ ID NO: 49795 - RNA, 22 nt, Bordetella pertussis
agcgcugcugcagggccgcaug

SEQ ID NO: 49796 - RNA, 22 nt, Bordetella pertussis
accagcgccugcaggccgccga

SEQ ID NO: 49797 - RNA, 22 nt, Bordetella pertussis
cuggcguucggcaugcuggccg

SEQ ID NO: 49798 - RNA, 22 nt, Bordetella pertussis
gcccggcgagaacagcgagccc

SEQ ID NO: 49799 - RNA, 22 nt, Bordetella pertussis
acggccuugcgccaauccaugg

SEQ ID NO: 49800 - RNA, 22 nt, Bordetella pertussis
agaucgucgggaugccggcguu

SEQ ID NO: 49801 - RNA, 22 nt, Bordetella pertussis
ccgcugugcagcgaugugacgc

SEQ ID NO: 49802 - RNA, 22 nt, Bordetella pertussis
uucuucgaguacaugaucgacg

SEQ ID NO: 49803 - RNA, 22 nt, Bordetella pertussis
uggacgugcgcgagaacggcgu

SEQ ID NO: 49804 - RNA, 22 nt, Bordetella pertussis
uggaccagcucgcgggcgcgau

SEQ ID NO: 49805 - RNA, 22 nt, Bordetella pertussis
cugcaccggcuggacugcugcg

SEQ ID NO: 49806 - RNA, 22 nt, Bordetella pertussis
gcagcaugaagcggucgcggua

SEQ ID NO: 49807 - RNA, 22 nt, Bordetella pertussis
ucgggauguugcggcgcgccgg

SEQ ID NO: 49808 - RNA, 22 nt, Bordetella pertussis
cugcauggcguugguagccacc

SEQ ID NO: 49809 - RNA, 22 nt, Bordetella pertussis
uccaggaacugcaggccacggu

SEQ ID NO: 49810 - RNA, 22 nt, Bordetella pertussis
ucggcaucgccagcaucaaaca

SEQ ID NO: 49811 - RNA, 17 nt, Bordetella pertussis
ucucgcgcaauuucggc

SEQ ID NO: 49812 - RNA, 22 nt, Bordetella pertussis
cagcgcgucaacgcggugaccg

SEQ ID NO: 49813 - RNA, 22 nt, Bordetella pertussis
cgacggccagacgcguuacgcg

SEQ ID NO: 49814 - RNA, 22 nt, Bordetella pertussis
auggguaucgcgcaccaguugg

SEQ ID NO: 49815 - RNA, 23 nt, Bordetella pertussis
ccugcgucaaaggggaggcggcc

SEQ ID NO: 49816 - RNA, 22 nt, Bordetella pertussis
ggggcugucggucagcagcaug

SEQ ID NO: 49817 - RNA, 22 nt, Bordetella pertussis
agccgcgcuggucgaacagcag

SEQ ID NO: 49818 - RNA, 22 nt, Bordetella pertussis
gcgcguugagcgccuugaccac

SEQ ID NO: 49819 - RNA, 22 nt, Bordetella pertussis
acgccgauggugcgcuugagcu

SEQ ID NO: 49820 - RNA, 22 nt, Bordetella pertussis
cugggcaccgacgugcugcgga

SEQ ID NO: 49821 - RNA, 22 nt, Bordetella pertussis
auggcguuccaucugccuggua

SEQ ID NO: 49822 - RNA, 22 nt, Bordetella pertussis
ccgauaccucggucguguacug

SEQ ID NO: 49823 - RNA, 22 nt, Bordetella pertussis
cgccugagcgagcccagcgugc

SEQ ID NO: 49824 - RNA, 22 nt, Bordetella pertussis
agcagcggcucgaagcggucgc

SEQ ID NO: 49825 - RNA, 19 nt, Bordetella pertussis
ucagccagacgucgcgcga

SEQ ID NO: 49826 - RNA, 22 nt, Bordetella pertussis
gguuguccggguccaccaggcu

SEQ ID NO: 49827 - RNA, 22 nt, Bordetella pertussis
ucgaacauggugggcgaguucc

SEQ ID NO: 49828 - RNA, 22 nt, Bordetella pertussis
ggcggucagccacagcggcgug

SEQ ID NO: 49829 - RNA, 22 nt, Bordetella pertussis
caggaaggggugaccgccggca

SEQ ID NO: 49830 - RNA, 22 nt, Bordetella pertussis
ucgccaucaucaaggcggcgcc

SEQ ID NO: 49831 - RNA, 22 nt, Bordetella pertussis
cgaagcacaugauggacaggcc

SEQ ID NO: 49832 - RNA, 22 nt, Bordetella pertussis
cgcgauucgagcucgccuugcu

SEQ ID NO: 49833 - RNA, 22 nt, Bordetella pertussis
ggcgccaguuguccaugaacca

SEQ ID NO: 49834 - RNA, 22 nt, Bordetella pertussis
cggcaggauaucgauguagcgc

SEQ ID NO: 49835 - RNA, 22 nt, Bordetella pertussis
ugggcgagucgaucuacgccgc

SEQ ID NO: 49836 - RNA, 22 nt, Bordetella pertussis
ccuggcugcccacuucgcggua

SEQ ID NO: 49837 - RNA, 22 nt, Bordetella pertussis
aucagcggccuguugcgcgugg

SEQ ID NO: 49838 - RNA, 23 nt, Bordetella pertussis
cgcgccagcuugauggcgccuuc

SEQ ID NO: 49839 - RNA, 22 nt, Bordetella pertussis
gaaaccgagaucguggaggucg

SEQ ID NO: 49840 - RNA, 22 nt, Bordetella pertussis
gggcgacgaucugccguuucgu

SEQ ID NO: 49841 - RNA, 22 nt, Bordetella pertussis
ucgcggugucgcugggcaugcg

SEQ ID NO: 49842 - RNA, 22 nt, Bordetella pertussis
augggaucgugcaccgccggcg

SEQ ID NO: 49843 - RNA, 22 nt, Bordetella pertussis
gccaggccgagcaggcguucga

SEQ ID NO: 49844 - RNA, 22 nt, Bordetella pertussis
gcgccaucucgucgcuggucau

SEQ ID NO: 49845 - RNA, 22 nt, Bordetella pertussis
ucgggcgggugcgcauggagcu

SEQ ID NO: 49846 - RNA, 22 nt, Bordetella pertussis
ccucgaggccacgcaggggccc

SEQ ID NO: 49847 - RNA, 22 nt, Bordetella pertussis
cggggacaggcgccccgucaug

SEQ ID NO: 49848 - RNA, 22 nt, Bordetella pertussis
ugaugaucagcagcggcgccga

SEQ ID NO: 49849 - RNA, 22 nt, Bordetella pertussis
gccaucuggaacucguacucga

SEQ ID NO: 49850 - RNA, 20 nt, Bordetella pertussis
ugcaggcccuuguccacgcu

SEQ ID NO: 49851 - RNA, 22 nt, Bordetella pertussis
ucgacgugcaugggcgcgcugc

SEQ ID NO: 49852 - RNA, 22 nt, Bordetella pertussis
uucgccacgcgugcaagggccu

SEQ ID NO: 49853 - RNA, 22 nt, Bordetella pertussis
aaaucccaagaaccgcauggau

SEQ ID NO: 49854 - RNA, 22 nt, Bordetella pertussis
gccgucccagcuuugcgccggc

SEQ ID NO: 49855 - RNA, 22 nt, Bordetella pertussis
ggccauguucgucauguuggcg

SEQ ID NO: 49856 - RNA, 22 nt, Bordetella pertussis
ccguucggaauguccagcgaca

SEQ ID NO: 49857 - RNA, 22 nt, Bordetella pertussis
guggccuggguggccagcugcg

SEQ ID NO: 49858 - RNA, 22 nt, Bordetella pertussis
cgccacggauugauguccagcc

SEQ ID NO: 49859 - RNA, 22 nt, Bordetella pertussis
gggccacguccaugccggcgcg

SEQ ID NO: 49860 - RNA, 22 nt, Bordetella pertussis
gauggccugcauggcgucgcgc

SEQ ID NO: 49861 - RNA, 22 nt, Bordetella pertussis
ucgucaacguggcguugcccag

SEQ ID NO: 49862 - RNA, 22 nt, Bordetella pertussis
cugguguuucgacuguggcucg

SEQ ID NO: 49863 - RNA, 22 nt, Bordetella pertussis
cgccuggauccgcuuggccacg

SEQ ID NO: 49864 - RNA, 22 nt, Bordetella pertussis
gcggcccauuggcagcgccagg

SEQ ID NO: 49865 - RNA, 22 nt, Bordetella pertussis
cgguauucggcauuggcguugc

SEQ ID NO: 49866 - RNA, 22 nt, Bordetella pertussis
uuccugguggauguccagcgug

SEQ ID NO: 49867 - RNA, 22 nt, Bordetella pertussis
ccuggccgacggcgauggcguc

SEQ ID NO: 49868 - RNA, 22 nt, Bordetella pertussis
uuguggcgcgucgcgcucaugc

SEQ ID NO: 49869 - RNA, 22 nt, Bordetella pertussis
agccgcgccagcaggaugccgg

SEQ ID NO: 49870 - RNA, 22 nt, Bordetella pertussis
gccaagguguauuucacggugu

SEQ ID NO: 49871 - RNA, 22 nt, Bordetella pertussis
cgcgccgggaaaaagagccugu

SEQ ID NO: 49872 - RNA, 22 nt, Bordetella pertussis
aggucguagcgcugcggcuccu

SEQ ID NO: 49873 - RNA, 22 nt, Bordetella pertussis
ucgcggaucgcuaggaugcggg

SEQ ID NO: 49874 - RNA, 20 nt, Bordetella pertussis
acgcagcaaugugcuggccg

SEQ ID NO: 49875 - RNA, 22 nt, Bordetella pertussis
ggacgcgacaucacgggcgcca

SEQ ID NO: 49876 - RNA, 22 nt, Bordetella pertussis
gugggcgugcgcuucgagcuga

SEQ ID NO: 49877 - RNA, 22 nt, Bordetella pertussis
ggacgcccgcaugagcggcacc

SEQ ID NO: 49878 - RNA, 22 nt, Bordetella pertussis
agccgcaugcccaccggaaagc

SEQ ID NO: 49879 - RNA, 22 nt, Bordetella pertussis
uugauggcgaauuccuuggugu

SEQ ID NO: 49880 - RNA, 22 nt, Bordetella pertussis
uguccaccggcgcgaucauccu

SEQ ID NO: 49881 - RNA, 22 nt, Bordetella pertussis
uuggccugcccuggcugucgcg

SEQ ID NO: 49882 - RNA, 22 nt, Bordetella pertussis
cuggcgcgcguaugccgacagg

SEQ ID NO: 49883 - RNA, 22 nt, Bordetella pertussis
auggagaaugaaccgucagcga

SEQ ID NO: 49884 - RNA, 22 nt, Bordetella pertussis
cgccggccugcgccagcuucga

SEQ ID NO: 49885 - RNA, 22 nt, Bordetella pertussis
ggucaugcgggccgauggcgug

SEQ ID NO: 49886 - RNA, 22 nt, Bordetella pertussis
ugcgcgcuuuugcggcaagcug

SEQ ID NO: 49887 - RNA, 22 nt, Bordetella pertussis
ucguccagcgcccguaccuggc

SEQ ID NO: 49888 - RNA, 22 nt, Bordetella pertussis
ccugaaccaccugaugucgcug

SEQ ID NO: 49889 - RNA, 22 nt, Bordetella pertussis
ugcuuuuguaauccaccgacuc

SEQ ID NO: 49890 - RNA, 20 nt, Bordetella pertussis
aguuugccucggagcuggcc

SEQ ID NO: 49891 - RNA, 22 nt, Bordetella pertussis
caugcucuugccgcugcccgac

SEQ ID NO: 49892 - RNA, 22 nt, Bordetella pertussis
cgccaccucggacggcuacgug

SEQ ID NO: 49893 - RNA, 22 nt, Bordetella pertussis
gagcacaugcugacgcaggccg

SEQ ID NO: 49894 - RNA, 22 nt, Bordetella pertussis
ccacccgggccgcggucgacgc

SEQ ID NO: 49895 - RNA, 22 nt, Bordetella pertussis
ggcgugauggagcugggcaugc

SEQ ID NO: 49896 - RNA, 22 nt, Bordetella pertussis
aguugcuggcggccggcuugug

SEQ ID NO: 49897 - RNA, 22 nt, Bordetella pertussis
ggagugcgcggucaucggcgug

SEQ ID NO: 49898 - RNA, 22 nt, Bordetella pertussis
cagucgaucuacgccggcaucc

SEQ ID NO: 49899 - RNA, 23 nt, Bordetella pertussis
aucagcaucuuuucgggcauguu

SEQ ID NO: 49900 - RNA, 22 nt, Bordetella pertussis
gcaagcagcauccggaauucgc

SEQ ID NO: 49901 - RNA, 22 nt, Bordetella pertussis
uugcggcuugcgccagccaggc

SEQ ID NO: 49902 - RNA, 22 nt, Bordetella pertussis
accuggccgacgugccgaucac

SEQ ID NO: 49903 - RNA, 22 nt, Bordetella pertussis
ggaugaucuugaacguggcggu

SEQ ID NO: 49904 - RNA, 22 nt, Bordetella pertussis
ccggcaccaggcgguggugcag

SEQ ID NO: 49905 - RNA, 22 nt, Bordetella pertussis
gaugcggugaugaacgaguucg

SEQ ID NO: 49906 - RNA, 22 nt, Bordetella pertussis
guacaggcuguaccgcggcggc

SEQ ID NO: 49907 - RNA, 22 nt, Bordetella pertussis
ccagggcuuccucgaugcccug

SEQ ID NO: 49908 - RNA, 22 nt, Bordetella pertussis
uuggcgcuguagcucaccagca

SEQ ID NO: 49909 - RNA, 22 nt, Bordetella pertussis
auggcggugcagcgccaggucg

SEQ ID NO: 49910 - RNA, 22 nt, Bordetella pertussis
ggcgccuugaccugcgacgugg

SEQ ID NO: 49911 - RNA, 22 nt, Bordetella pertussis
auccagggggugauccugcugu

SEQ ID NO: 49912 - RNA, 22 nt, Bordetella pertussis
cuacgagugcgccgauggcgcc

SEQ ID NO: 49913 - RNA, 22 nt, Bordetella pertussis
gaggucgcgcagcgugccgcug

SEQ ID NO: 49914 - RNA, 22 nt, Bordetella pertussis
ucggugaugcgcggccugggcu

SEQ ID NO: 49915 - RNA, 22 nt, Bordetella pertussis
guucggcgauucgacggugcuc

SEQ ID NO: 49916 - RNA, 22 nt, Bordetella pertussis
ugcuggugcgcagcgucgagga

SEQ ID NO: 49917 - RNA, 22 nt, Bordetella pertussis
cuggcugcagccgcaagccagc

SEQ ID NO: 49918 - RNA, 22 nt, Bordetella pertussis
cggccuggaagucggcguggac

SEQ ID NO: 49919 - RNA, 22 nt, Bordetella pertussis
cuccauggaaacgcccaucggu

SEQ ID NO: 49920 - RNA, 22 nt, Bordetella pertussis
gccgggccgccuggugcauguc

SEQ ID NO: 49921 - RNA, 22 nt, Bordetella pertussis
ugugccggcguggaucgcgcca

SEQ ID NO: 49922 - RNA, 22 nt, Bordetella pertussis
gcuugggcucggccgccagcgc

SEQ ID NO: 49923 - RNA, 20 nt, Bordetella pertussis
ggucaaggucucgucguggu

SEQ ID NO: 49924 - RNA, 22 nt, Bordetella pertussis
cugcgugcaauacuggauggcg

SEQ ID NO: 49925 - RNA, 22 nt, Bordetella pertussis
aucgauggugccgaucuccacg

SEQ ID NO: 49926 - RNA, 22 nt, Bordetella pertussis
gccggcaccgcggucggcgucu

SEQ ID NO: 49927 - RNA, 22 nt, Bordetella pertussis
ucgucauugaacagcuugagca

SEQ ID NO: 49928 - RNA, 22 nt, Bordetella pertussis
ggccgcaagcgcaugaucuggg

SEQ ID NO: 49929 - RNA, 21 nt, Bordetella pertussis
uguucggcacgauuucgaucu

SEQ ID NO: 49930 - RNA, 22 nt, Bordetella pertussis
cgccagcgggccaucgcugcug

SEQ ID NO: 49931 - RNA, 22 nt, Bordetella pertussis
cucaccauggugauuccgcugg

SEQ ID NO: 49932 - RNA, 22 nt, Bordetella pertussis
gcugguacuacguggacggcga

SEQ ID NO: 49933 - RNA, 22 nt, Bordetella pertussis
gccgcggcagccguucguccag

SEQ ID NO: 49934 - RNA, 22 nt, Bordetella pertussis
uccagcuggcgcgcaucgagcc

SEQ ID NO: 49935 - RNA, 22 nt, Bordetella pertussis
ucgagcacgaguaccggcugga

SEQ ID NO: 49936 - RNA, 22 nt, Bordetella pertussis
cgcuggugacgggcucggccgu

SEQ ID NO: 49937 - RNA, 22 nt, Bordetella pertussis
augcuguccagcgcguuccauu

SEQ ID NO: 49938 - RNA, 22 nt, Bordetella pertussis
acgaccacgcugccacgcgugg

SEQ ID NO: 49939 - RNA, 19 nt, Bordetella pertussis
cgggccagcugcaggucga

SEQ ID NO: 49940 - RNA, 22 nt, Bordetella pertussis
gccuugauguugcucagcacgu

SEQ ID NO: 49941 - RNA, 22 nt, Bordetella pertussis
ugcgcuggccguacgccugccg

SEQ ID NO: 49942 - RNA, 22 nt, Bordetella pertussis
aggccgcgcccgggcauguccg

SEQ ID NO: 49943 - RNA, 22 nt, Bordetella pertussis
ggugugcugccgcccagggcga

SEQ ID NO: 49944 - RNA, 22 nt, Bordetella pertussis
cgccucgccgcugaacaguuuc

SEQ ID NO: 49945 - RNA, 22 nt, Bordetella pertussis
gcgaugcgcucgggcaggccgu

SEQ ID NO: 49946 - RNA, 20 nt, Bordetella pertussis
ucaggccgaugucgaccuug

SEQ ID NO: 49947 - RNA, 22 nt, Bordetella pertussis
gggccguacuuuccaggagucg

SEQ ID NO: 49948 - RNA, 22 nt, Bordetella pertussis
aggcaccuuggcccggcgggaa

SEQ ID NO: 49949 - RNA, 21 nt, Bordetella pertussis
cccaugaaauccgcgagccgc

SEQ ID NO: 49950 - RNA, 22 nt, Bordetella pertussis
ggcaggaaggccgcuggugcga

SEQ ID NO: 49951 - RNA, 22 nt, Bordetella pertussis
aggccgaagcggcgcugcuggc

SEQ ID NO: 49952 - RNA, 22 nt, Bordetella pertussis
ugcgcgugacggucugccaugc

SEQ ID NO: 49953 - RNA, 22 nt, Bordetella pertussis
ggugugcugcaaucucacuggu

SEQ ID NO: 49954 - RNA, 22 nt, Bordetella pertussis
gccggccguuccgaucggggcc

SEQ ID NO: 49955 - RNA, 21 nt, Bordetella pertussis
ucgaugaucugcucauccugc

SEQ ID NO: 49956 - RNA, 22 nt, Bordetella pertussis
aucugguccaucaggaugcggg

SEQ ID NO: 49957 - RNA, 22 nt, Bordetella pertussis
aagugcgcaauacgcagcucga

SEQ ID NO: 49958 - RNA, 22 nt, Bordetella pertussis
ugcggcugcuccuuguccacca

SEQ ID NO: 49959 - RNA, 22 nt, Bordetella pertussis
auggucacgccgucauccggcu

SEQ ID NO: 49960 - RNA, 22 nt, Bordetella pertussis
uauuacgugcggcugcuggccg

SEQ ID NO: 49961 - RNA, 22 nt, Bordetella pertussis
ccaggucggcggccuggccggc

SEQ ID NO: 49962 - RNA, 22 nt, Bordetella pertussis
guggcgggcugguccauguaug

SEQ ID NO: 49963 - RNA, 22 nt, Bordetella pertussis
cgccaaggccggccugggccag

SEQ ID NO: 49964 - RNA, 22 nt, Bordetella pertussis
ggucgcgguuguacggcgcguc

SEQ ID NO: 49965 - RNA, 22 nt, Bordetella pertussis
acgcccggcccguuguccagca

SEQ ID NO: 49966 - RNA, 21 nt, Bordetella pertussis
cgccaaggacguggugcugca

SEQ ID NO: 49967 - RNA, 22 nt, Bordetella pertussis
gccgguuuccaugcugcucugu

SEQ ID NO: 49968 - RNA, 21 nt, Bordetella pertussis
accaccuugccguugcggcgg

SEQ ID NO: 49969 - RNA, 22 nt, Bordetella pertussis
gguaucgucgaccuggaucacg

SEQ ID NO: 49970 - RNA, 22 nt, Bordetella pertussis
cucguacaccacgcgcgagccg

SEQ ID NO: 49971 - RNA, 22 nt, Bordetella pertussis
gugcgcgucucgauggcgaacu

SEQ ID NO: 49972 - RNA, 22 nt, Bordetella pertussis
gucgccggccuugaccggcgug

SEQ ID NO: 49973 - RNA, 22 nt, Bordetella pertussis
gcaaggaagcccgcuucggcgu

SEQ ID NO: 49974 - RNA, 22 nt, Bordetella pertussis
gacgggucuugggcuucaugcg

SEQ ID NO: 49975 - RNA, 22 nt, Bordetella pertussis
aguccuggccgcgcacgaucag

SEQ ID NO: 49976 - RNA, 18 nt, Bordetella pertussis
cgagccagucgcgcccgu

SEQ ID NO: 49977 - RNA, 22 nt, Bordetella pertussis
guugcgcacguagucgaccgcc

SEQ ID NO: 49978 - RNA, 22 nt, Bordetella pertussis
cugcgguuccggcuugggcugc

SEQ ID NO: 49979 - RNA, 22 nt, Bordetella pertussis
uuugcgccaucucggcgcgcag

SEQ ID NO: 49980 - RNA, 22 nt, Bordetella pertussis
cauguucgaagagcagcgcgcc

SEQ ID NO: 49981 - RNA, 22 nt, Bordetella pertussis
cagcuggcggugcaccggcgag

SEQ ID NO: 49982 - RNA, 23 nt, Bordetella pertussis
gagaacugacggcggcgccuagu

SEQ ID NO: 49983 - RNA, 19 nt, Bordetella pertussis
cgcauggugacgaucugua

SEQ ID NO: 49984 - RNA, 22 nt, Bordetella pertussis
uggugcucggcaugccggugcg

SEQ ID NO: 49985 - RNA, 22 nt, Bordetella pertussis
ccaugcugagucgguaguucug

SEQ ID NO: 49986 - RNA, 22 nt, Bordetella pertussis
uaucucgucgaucgugguacgg

SEQ ID NO: 49987 - RNA, 22 nt, Bordetella pertussis
ggcgaugcucguccagcgugcg

SEQ ID NO: 49988 - RNA, 22 nt, Bordetella pertussis
cgcuggucggcaccggcgucga

SEQ ID NO: 49989 - RNA, 22 nt, Bordetella pertussis
gcgguuguugccgguggcagaa

SEQ ID NO: 49990 - RNA, 22 nt, Bordetella pertussis
ccaugcuguaucgcgacuacag

SEQ ID NO: 49991 - RNA, 22 nt, Bordetella pertussis
ugcagaucaacgucgagggcga

SEQ ID NO: 49992 - RNA, 22 nt, Bordetella pertussis
ggcgugguguaugaccgcgcgu

SEQ ID NO: 49993 - RNA, 22 nt, Bordetella pertussis
agccuugguauagauccggcac

SEQ ID NO: 49994 - RNA, 22 nt, Bordetella pertussis
guuugcccggacggccaucgcg

SEQ ID NO: 49995 - RNA, 21 nt, Bordetella pertussis
gagcuggugaucaugaucgca

SEQ ID NO: 49996 - RNA, 22 nt, Bordetella pertussis
gggcaugcuggagcuguccgcg

SEQ ID NO: 49997 - RNA, 22 nt, Bordetella pertussis
aacggcccagcucggacagcuu

SEQ ID NO: 49998 - RNA, 22 nt, Bordetella pertussis
ugucggccucgggcaagccggg

SEQ ID NO: 49999 - RNA, 22 nt, Bordetella pertussis
acaggcucuuuucauuuggcgu

SEQ ID NO: 50000 - RNA, 20 nt, Bordetella pertussis
gccaucgugggugcacgccu

SEQ ID NO: 50001 - RNA, 22 nt, Bordetella pertussis
ggcauuuucauuugugcgccag

SEQ ID NO: 50002 - RNA, 22 nt, Bordetella pertussis
gucggccugcucggccaucgcg

SEQ ID NO: 50003 - RNA, 22 nt, Bordetella pertussis
gcgcugcuucuggccgcccgag

SEQ ID NO: 50004 - RNA, 22 nt, Bordetella pertussis
cgggcguggugggcgcguccau

SEQ ID NO: 50005 - RNA, 22 nt, Bordetella pertussis
aucgagccguggcguaaugcgc

SEQ ID NO: 50006 - RNA, 22 nt, Bordetella pertussis
uggagacgaaagcgcuguugcu

SEQ ID NO: 50007 - RNA, 22 nt, Bordetella pertussis
ccggcugaggccgcgcggccug

SEQ ID NO: 50008 - RNA, 22 nt, Bordetella pertussis
cggugcgcgaccagcccgucac

SEQ ID NO: 50009 - RNA, 20 nt, Bordetella pertussis
ccggcugaaggccgcgcccg

SEQ ID NO: 50010 - RNA, 22 nt, Bordetella pertussis
augucgaagcuggcgcaggccg

SEQ ID NO: 50011 - RNA, 22 nt, Bordetella pertussis
uguccccgccgggacagauacc

SEQ ID NO: 50012 - RNA, 22 nt, Bordetella pertussis
cugccaggauacccgccugccc

SEQ ID NO: 50013 - RNA, 22 nt, Bordetella pertussis
gccggccugcgugcuggccgac

SEQ ID NO: 50014 - RNA, 22 nt, Bordetella pertussis
gccauggugacuaccgaccccg

SEQ ID NO: 50015 - RNA, 22 nt, Bordetella pertussis
gucgcggucgucuucguagacc

SEQ ID NO: 50016 - RNA, 22 nt, Bordetella pertussis
cagaucgacgaccucgcgcaug

SEQ ID NO: 50017 - RNA, 22 nt, Bordetella pertussis
ccggcgguggugucgcccggcg

SEQ ID NO: 50018 - RNA, 20 nt, Bordetella pertussis
ucgacuucuggucgucgaua

SEQ ID NO: 50019 - RNA, 22 nt, Bordetella pertussis
ucaacgccgccgccugccacgu

SEQ ID NO: 50020 - RNA, 22 nt, Bordetella pertussis
augcuggcggugaacgugaacu

SEQ ID NO: 50021 - RNA, 22 nt, Bordetella pertussis
auggcgaugcuuguuauugugg

SEQ ID NO: 50022 - RNA, 22 nt, Bordetella pertussis
agguuggccaccagcaccguca

SEQ ID NO: 50023 - RNA, 22 nt, Bordetella pertussis
gucaagguggccggccgcauga

SEQ ID NO: 50024 - RNA, 22 nt, Bordetella pertussis
ucaccacgaaaccgagcagcau

SEQ ID NO: 50025 - RNA, 22 nt, Bordetella pertussis
gggcgacgagcugguucugacg

SEQ ID NO: 50026 - RNA, 22 nt, Bordetella pertussis
gcguccucgguggugagcacgc

SEQ ID NO: 50027 - RNA, 22 nt, Bordetella pertussis
ugccugucccccugcggggaca

SEQ ID NO: 50028 - RNA, 22 nt, Bordetella pertussis
ccguuguccagcacgcgcaggc

SEQ ID NO: 50029 - RNA, 22 nt, Bordetella pertussis
aaguggucagcgcauacucggu

SEQ ID NO: 50030 - RNA, 21 nt, Bordetella pertussis
uugacgcgacgcgaggcgcug

SEQ ID NO: 50031 - RNA, 22 nt, Bordetella pertussis
ggugcgcgacgaccucgacccg

SEQ ID NO: 50032 - RNA, 22 nt, Bordetella pertussis
ucggccucgggcacgcgcccuu

SEQ ID NO: 50033 - RNA, 22 nt, Bordetella pertussis
ggcgaucacgcugauguucgag

SEQ ID NO: 50034 - RNA, 22 nt, Bordetella pertussis
ggccgcugacgccggugcuggu

SEQ ID NO: 50035 - RNA, 22 nt, Bordetella pertussis
cggcgcgcuggccauggacgcc

SEQ ID NO: 50036 - RNA, 22 nt, Bordetella pertussis
uaggcgauggcgcgcugguugu

SEQ ID NO: 50037 - RNA, 22 nt, Bordetella pertussis
cacgacacgcaaaggaugucgc

SEQ ID NO: 50038 - RNA, 22 nt, Bordetella pertussis
ucguacgucacgaugggguauu

SEQ ID NO: 50039 - RNA, 22 nt, Bordetella pertussis
gugcgagccgcucaggcccgcg

SEQ ID NO: 50040 - RNA, 22 nt, Bordetella pertussis
ggagcgccauuacccggugcug

SEQ ID NO: 50041 - RNA, 22 nt, Bordetella pertussis
cgugaucggcaccugcucgcca

SEQ ID NO: 50042 - RNA, 22 nt, Bordetella pertussis
gccgcgggccagcagauugcuc

SEQ ID NO: 50043 - RNA, 22 nt, Bordetella pertussis
cagcagcgauggcccgcuggcg

SEQ ID NO: 50044 - RNA, 22 nt, Bordetella pertussis
gcuggggugggcgcgucucgug

SEQ ID NO: 50045 - RNA, 14 nt, Bordetella pertussis
cgacgccaucguca

SEQ ID NO: 50046 - RNA, 22 nt, Bordetella pertussis
ucaucgacgaucucugguugcc

SEQ ID NO: 50047 - RNA, 22 nt, Bordetella pertussis
guucggcaacggcucggacgaa

SEQ ID NO: 50048 - RNA, 22 nt, Bordetella pertussis
gcgcugcagcagguggccgacg

SEQ ID NO: 50049 - RNA, 19 nt, Bordetella pertussis
ccagaucgcgcuggcgcgc

SEQ ID NO: 50050 - RNA, 23 nt, Bordetella pertussis
agcaggaugacgucgccgucgca

SEQ ID NO: 50051 - RNA, 22 nt, Bordetella pertussis
gcgccagcaaggccgcggucaa

SEQ ID NO: 50052 - RNA, 22 nt, Bordetella pertussis
cacggaauuccgggugucuguc

SEQ ID NO: 50053 - RNA, 22 nt, Bordetella pertussis
cacguuggcgacgaucaggccg

SEQ ID NO: 50054 - RNA, 22 nt, Bordetella pertussis
ggcgguuccggcuggcgagcuc

SEQ ID NO: 50055 - RNA, 22 nt, Bordetella pertussis
gggcguugcaugcugcccaccc

SEQ ID NO: 50056 - RNA, 22 nt, Bordetella pertussis
cggcgacaggccggccagaugg

SEQ ID NO: 50057 - RNA, 22 nt, Bordetella pertussis
cgggcaagggcgggguguccua

SEQ ID NO: 50058 - RNA, 22 nt, Bordetella pertussis
acgggcuuuggcauggggcuga

SEQ ID NO: 50059 - RNA, 22 nt, Bordetella pertussis
augcgcucgugccggucggcgg

SEQ ID NO: 50060 - RNA, 22 nt, Bordetella pertussis
cguucgcgcugcagcagcagcu

SEQ ID NO: 50061 - RNA, 22 nt, Bordetella pertussis
guugcuggcaaagcgcgcgucc

SEQ ID NO: 50062 - RNA, 22 nt, Bordetella pertussis
gucggccagccagccgcuguuc

SEQ ID NO: 50063 - RNA, 22 nt, Bordetella pertussis
ugcguuuccaggaaaccccuac

SEQ ID NO: 50064 - RNA, 22 nt, Bordetella pertussis
uagcggccguugcgcucggugg

SEQ ID NO: 50065 - RNA, 22 nt, Bordetella pertussis
gagugccugcugcagcggcugg

SEQ ID NO: 50066 - RNA, 22 nt, Bordetella pertussis
ugaccugcugccagucgcugau

SEQ ID NO: 50067 - RNA, 22 nt, Bordetella pertussis
guggccuaucuauuggcgcgcg

SEQ ID NO: 50068 - RNA, 22 nt, Bordetella pertussis
ugcggcgcauuggauguaucug

SEQ ID NO: 50069 - RNA, 22 nt, Bordetella pertussis
uggccggcgaugucgggcgccg

SEQ ID NO: 50070 - RNA, 22 nt, Bordetella pertussis
ugcuccaugugcgacagcagcc

SEQ ID NO: 50071 - RNA, 22 nt, Bordetella pertussis
cugucccggcggggacaggcac

SEQ ID NO: 50072 - RNA, 22 nt, Bordetella pertussis
cggccuuguucgccgaccggcg

SEQ ID NO: 50073 - RNA, 22 nt, Bordetella pertussis
gaucgacguggcggugaccuau

SEQ ID NO: 50074 - RNA, 22 nt, Bordetella pertussis
aucgugcugaucggauugggcg

SEQ ID NO: 50075 - RNA, 22 nt, Bordetella pertussis
agcaggcuggcgcgggguucuc

SEQ ID NO: 50076 - RNA, 23 nt, Bordetella pertussis
ucgcacuccggcgccagcagcuu

SEQ ID NO: 50077 - RNA, 22 nt, Bordetella pertussis
auggcgucgggcgugcccuugg

SEQ ID NO: 50078 - RNA, 22 nt, Bordetella pertussis
cgaguugccgaccgacaugguc

SEQ ID NO: 50079 - RNA, 22 nt, Bordetella pertussis
ucgcgggucgaugccggggcuu

SEQ ID NO: 50080 - RNA, 22 nt, Bordetella pertussis
gacggccgcgugccgcugaucg

SEQ ID NO: 50081 - RNA, 22 nt, Bordetella pertussis
aucggaugagauccaugcgcaa

SEQ ID NO: 50082 - RNA, 23 nt, Bordetella pertussis
ugcacgugggcgagcgggccauc

SEQ ID NO: 50083 - RNA, 22 nt, Bordetella pertussis
ugccaucgucgaaacggcgcgc

SEQ ID NO: 50084 - RNA, 22 nt, Bordetella pertussis
cgcgcgcuuguaggccuuguug

SEQ ID NO: 50085 - RNA, 22 nt, Bordetella pertussis
ugccgggcgucaaggugucgcu

SEQ ID NO: 50086 - RNA, 22 nt, Bordetella pertussis
uugcgggcguuuuuccuggcgu

SEQ ID NO: 50087 - RNA, 22 nt, Bordetella pertussis
accgccggguuggcgcugaggc

SEQ ID NO: 50088 - RNA, 22 nt, Bordetella pertussis
acaggcacaucgccguacgccg

SEQ ID NO: 50089 - RNA, 22 nt, Bordetella pertussis
agcgucagguccuugccgacga

SEQ ID NO: 50090 - RNA, 22 nt, Bordetella pertussis
acgccgggcaggccgaugcccg

SEQ ID NO: 50091 - RNA, 22 nt, Bordetella pertussis
cagcgugacgccgcguccggcc

SEQ ID NO: 50092 - RNA, 22 nt, Bordetella pertussis
aucgcgcugguagcgguaggcc

SEQ ID NO: 50093 - RNA, 23 nt, Bordetella pertussis
cagccuggcgaugaucacgcugg

SEQ ID NO: 50094 - RNA, 22 nt, Bordetella pertussis
cugguuguacuucgccaugcgg

SEQ ID NO: 50095 - RNA, 22 nt, Bordetella pertussis
caggcccuggccgaccgguauc

SEQ ID NO: 50096 - RNA, 22 nt, Bordetella pertussis
cugcucgagcagugccuuguca

SEQ ID NO: 50097 - RNA, 22 nt, Bordetella pertussis
acagcaggaugucggcggccau

SEQ ID NO: 50098 - RNA, 22 nt, Bordetella pertussis
ggcagcgaauccauguacgacu

SEQ ID NO: 50099 - RNA, 22 nt, Bordetella pertussis
ccgguguugaagucgcgcggcg

SEQ ID NO: 50100 - RNA, 22 nt, Bordetella pertussis
gcaugccaucgagcguauccgc

SEQ ID NO: 50101 - RNA, 21 nt, Bordetella pertussis
ugacgaacacguugucgcgcc

SEQ ID NO: 50102 - RNA, 22 nt, Bordetella pertussis
uugguguccaucauggcgcgga

SEQ ID NO: 50103 - RNA, 22 nt, Bordetella pertussis
ccgcggauugcagggccaguac

SEQ ID NO: 50104 - RNA, 22 nt, Bordetella pertussis
guucuggcccagcgcgaguuca

SEQ ID NO: 50105 - RNA, 22 nt, Bordetella pertussis
guggcgccguccucgaguauga

SEQ ID NO: 50106 - RNA, 22 nt, Bordetella pertussis
uccaccgacgccuggcaggaau

SEQ ID NO: 50107 - RNA, 22 nt, Bordetella pertussis
uggccugcuucccagcgggcga

SEQ ID NO: 50108 - RNA, 22 nt, Bordetella pertussis
uccagcguuucgcgcuggcgca

SEQ ID NO: 50109 - RNA, 22 nt, Bordetella pertussis
cugcaggucgcucugggcgcgc

SEQ ID NO: 50110 - RNA, 22 nt, Bordetella pertussis
aagcugcucaagcagggcgugc

SEQ ID NO: 50111 - RNA, 22 nt, Bordetella pertussis
gguguccauguaggacugcgaa

SEQ ID NO: 50112 - RNA, 22 nt, Bordetella pertussis
gaugucgccuucaccacgcucg

SEQ ID NO: 50113 - RNA, 22 nt, Bordetella pertussis
cgugcgucugcagugccagcuc

SEQ ID NO: 50114 - RNA, 22 nt, Bordetella pertussis
ucgggccaguugcgggcccugg

SEQ ID NO: 50115 - RNA, 22 nt, Bordetella pertussis
ucgcccagauaggcgccccagg

SEQ ID NO: 50116 - RNA, 22 nt, Bordetella pertussis
gauugccaucgccggcauggaa

SEQ ID NO: 50117 - RNA, 22 nt, Bordetella pertussis
aauccugcuugccgcugcauuc

SEQ ID NO: 50118 - RNA, 22 nt, Bordetella pertussis
acggcgaucucgguaucgccca

SEQ ID NO: 50119 - RNA, 22 nt, Bordetella pertussis
uuccaucugcucgauggcgcca

SEQ ID NO: 50120 - RNA, 22 nt, Bordetella pertussis
cggugcucgacggcgccagccu

SEQ ID NO: 50121 - RNA, 22 nt, Bordetella pertussis
agccagacgaaguucacgcuug

SEQ ID NO: 50122 - RNA, 22 nt, Bordetella pertussis
augggccagaugagcggcgagg

SEQ ID NO: 50123 - RNA, 22 nt, Bordetella pertussis
accugugcagccggaaaaugau

SEQ ID NO: 50124 - RNA, 22 nt, Bordetella pertussis
agaccguggccucgucgucguc

SEQ ID NO: 50125 - RNA, 22 nt, Bordetella pertussis
aacagggccugauagaccgguu

SEQ ID NO: 50126 - RNA, 22 nt, Bordetella pertussis
ccugcucggcggucaguucgcc

SEQ ID NO: 50127 - RNA, 22 nt, Bordetella pertussis
caugcugguugucaccggccag

SEQ ID NO: 50128 - RNA, 22 nt, Bordetella pertussis
ccugugccagcgccucgucgaa

SEQ ID NO: 50129 - RNA, 22 nt, Bordetella pertussis
gucggccagcgcuucgacgcgg

SEQ ID NO: 50130 - RNA, 22 nt, Bordetella pertussis
ugggugcgcagggcgccaucgg

SEQ ID NO: 50131 - RNA, 20 nt, Bordetella pertussis
uggacuggaaguggcuguuc

SEQ ID NO: 50132 - RNA, 22 nt, Bordetella pertussis
gcgagcgccucggcguaggccu

SEQ ID NO: 50133 - RNA, 22 nt, Bordetella pertussis
uguccccgcggagacaggcgcc

SEQ ID NO: 50134 - RNA, 22 nt, Bordetella pertussis
agguguccgcgcggcucgagcg

SEQ ID NO: 50135 - RNA, 22 nt, Bordetella pertussis
auggcguugcccaccggcaggu

SEQ ID NO: 50136 - RNA, 22 nt, Bordetella pertussis
uggccaagcaccuggagauggg

SEQ ID NO: 50137 - RNA, 22 nt, Bordetella pertussis
gugcugggucugaccauggugg

SEQ ID NO: 50138 - RNA, 23 nt, Bordetella pertussis
gugcccggggagccaggcaccgg

SEQ ID NO: 50139 - RNA, 18 nt, Bordetella pertussis
auccgccagggacugcaa

SEQ ID NO: 50140 - RNA, 22 nt, Bordetella pertussis
gcggcaagugcaagccggugug

SEQ ID NO: 50141 - RNA, 22 nt, Bordetella pertussis
uggcgaggugcuggccgugguu

SEQ ID NO: 50142 - RNA, 22 nt, Bordetella pertussis
gcgcuccgaggugcgccccagc

SEQ ID NO: 50143 - RNA, 22 nt, Bordetella pertussis
gucgaucucggacugcucgaug

SEQ ID NO: 50144 - RNA, 22 nt, Bordetella pertussis
gccacgaugcguccgccgugcg

SEQ ID NO: 50145 - RNA, 22 nt, Bordetella pertussis
ccgccgagcaguucauccaggc

SEQ ID NO: 50146 - RNA, 22 nt, Bordetella pertussis
cggcggccgcguucucgugguu

SEQ ID NO: 50147 - RNA, 23 nt, Bordetella pertussis
ucaugggcaaggccagcuucgcc

SEQ ID NO: 50148 - RNA, 22 nt, Bordetella pertussis
agccgcugcacaucggcgucgu

SEQ ID NO: 50149 - RNA, 22 nt, Bordetella pertussis
cauggcgaugggauacuucgcc

SEQ ID NO: 50150 - RNA, 22 nt, Bordetella pertussis
gacgucguagaugcugaugucg

SEQ ID NO: 50151 - RNA, 22 nt, Bordetella pertussis
ucgagccaugccccauggcggc

SEQ ID NO: 50152 - RNA, 22 nt, Bordetella pertussis
agcggcucugcgccuggucgga

SEQ ID NO: 50153 - RNA, 22 nt, Bordetella pertussis
cgccggugcgcagcuugguuuc

SEQ ID NO: 50154 - RNA, 22 nt, Bordetella pertussis
ccauccucaacgagccguucgu

SEQ ID NO: 50155 - RNA, 22 nt, Bordetella pertussis
gcgugggcauuuugcugcgccc

SEQ ID NO: 50156 - RNA, 22 nt, Bordetella pertussis
ggcgcuuggacaacgcauugcu

SEQ ID NO: 50157 - RNA, 22 nt, Bordetella pertussis
ccagcggccagaugccuggcgc

SEQ ID NO: 50158 - RNA, 22 nt, Bordetella pertussis
gcuuggcuggcggcaggucggu

SEQ ID NO: 50159 - RNA, 22 nt, Bordetella pertussis
ccgagaucaagacgccgaugau

SEQ ID NO: 50160 - RNA, 22 nt, Bordetella pertussis
ugguggcggugcugucggcggu

SEQ ID NO: 50161 - RNA, 22 nt, Bordetella pertussis
ugugccugucccagcggggaca

SEQ ID NO: 50162 - RNA, 22 nt, Bordetella pertussis
augugcgguuggccgaggcgcc

SEQ ID NO: 50163 - RNA, 22 nt, Bordetella pertussis
cgaccagaucaugcgcuugggu

SEQ ID NO: 50164 - RNA, 22 nt, Bordetella pertussis
auggcugggcgacuacggcagc

SEQ ID NO: 50165 - RNA, 22 nt, Bordetella pertussis
cgcagcguggugcucucggugc

SEQ ID NO: 50166 - RNA, 22 nt, Bordetella pertussis
ucgccgacgccaucaugaugcg

SEQ ID NO: 50167 - RNA, 22 nt, Bordetella pertussis
gaaggcccaagcaaaagcgccc

SEQ ID NO: 50168 - RNA, 22 nt, Bordetella pertussis
ugggcuucgugcagaugccgga

SEQ ID NO: 50169 - RNA, 22 nt, Bordetella pertussis
gcgcuucgaggcgaucgaccag

SEQ ID NO: 50170 - RNA, 22 nt, Bordetella pertussis
agcgcgucacgcauuacauggg

SEQ ID NO: 50171 - RNA, 22 nt, Bordetella pertussis
cgaugccgaugccgcagccgcc

SEQ ID NO: 50172 - RNA, 22 nt, Bordetella pertussis
ccggcggugcccagcagguccc

SEQ ID NO: 50173 - RNA, 22 nt, Bordetella pertussis
uagcuguccaccaccacgucga

SEQ ID NO: 50174 - RNA, 22 nt, Bordetella pertussis
auacgcgcgaugccugacgaau

SEQ ID NO: 50175 - RNA, 22 nt, Bordetella pertussis
accuugugcugggcgcucgguc

SEQ ID NO: 50176 - RNA, 22 nt, Bordetella pertussis
ugcucgagccccugucgccgug

SEQ ID NO: 50177 - RNA, 22 nt, Bordetella pertussis
gcgcuucgaggcaucgcagugg

SEQ ID NO: 50178 - RNA, 22 nt, Bordetella pertussis
ggcgagagagcaacgcuuagug

SEQ ID NO: 50179 - RNA, 22 nt, Bordetella pertussis
cgucccguacaagggcagcgcc

SEQ ID NO: 50180 - RNA, 22 nt, Bordetella pertussis
uggccgcacgcagcccgacgac

SEQ ID NO: 50181 - RNA, 23 nt, Bordetella pertussis
gcgguuuuucaggcugcaucguc

SEQ ID NO: 50182 - RNA, 20 nt, Bordetella pertussis
cccuggucggugugcacgcc

SEQ ID NO: 50183 - RNA, 22 nt, Bordetella pertussis
cgccauccaguauugcacgcag

SEQ ID NO: 50184 - RNA, 21 nt, Bordetella pertussis
gcuugccguugucgaucgacu

SEQ ID NO: 50185 - RNA, 22 nt, Bordetella pertussis
ggcggcaacaucgugcagcccu

SEQ ID NO: 50186 - RNA, 22 nt, Bordetella pertussis
ugucgacgacugggacguccac

SEQ ID NO: 50187 - RNA, 22 nt, Bordetella pertussis
caagccuguccuggacacgguc

SEQ ID NO: 50188 - RNA, 22 nt, Bordetella pertussis
cgccgguucggcaggcguggcg

SEQ ID NO: 50189 - RNA, 22 nt, Bordetella pertussis
gccggaggucacguaccgcggc

SEQ ID NO: 50190 - RNA, 22 nt, Bordetella pertussis
uguaccaguugcccgaccagca

SEQ ID NO: 50191 - RNA, 22 nt, Bordetella pertussis
ggccggcaaccugaucagcauc

SEQ ID NO: 50192 - RNA, 22 nt, Bordetella pertussis
gcgcuucgaccugucgucgguc

SEQ ID NO: 50193 - RNA, 22 nt, Bordetella pertussis
ugcgccuggucgccccgcacac

SEQ ID NO: 50194 - RNA, 23 nt, Bordetella pertussis
cgccaaccugcuguauucgccgc

SEQ ID NO: 50195 - RNA, 22 nt, Bordetella pertussis
gccguggaccaccgauccguuc

SEQ ID NO: 50196 - RNA, 21 nt, Bordetella pertussis
ugccaugggaaugaugauggu

SEQ ID NO: 50197 - RNA, 22 nt, Bordetella pertussis
ugguggcuucgguggcggucug

SEQ ID NO: 50198 - RNA, 22 nt, Bordetella pertussis
gccagcgugcgcugcauggcgu

SEQ ID NO: 50199 - RNA, 22 nt, Bordetella pertussis
cugggcgugcugcugcuggacc

SEQ ID NO: 50200 - RNA, 22 nt, Bordetella pertussis
augcuguuguacgccaccgauu

SEQ ID NO: 50201 - RNA, 22 nt, Bordetella pertussis
augaccaggguggcgucggcgg

SEQ ID NO: 50202 - RNA, 23 nt, Bordetella pertussis
ugcagcggaaucggcauaucgga

SEQ ID NO: 50203 - RNA, 22 nt, Bordetella pertussis
agggcaccgauaucacguucga

SEQ ID NO: 50204 - RNA, 23 nt, Bordetella pertussis
uggacgcgccgucggccagcacg

SEQ ID NO: 50205 - RNA, 22 nt, Bordetella pertussis
uguucgucucgcagccggcggu

SEQ ID NO: 50206 - RNA, 23 nt, Bordetella pertussis
gcugucguaugcccuggucaauc

SEQ ID NO: 50207 - RNA, 22 nt, Bordetella pertussis
augauggcgaacaucaacuccu

SEQ ID NO: 50208 - RNA, 22 nt, Bordetella pertussis
ggccgauauuucgcgugugcag

SEQ ID NO: 50209 - RNA, 22 nt, Bordetella pertussis
ugcgucaugcccaucagccggg

SEQ ID NO: 50210 - RNA, 22 nt, Bordetella pertussis
gucgccucgucgaggaucagga

SEQ ID NO: 50211 - RNA, 22 nt, Bordetella pertussis
acuucgacgcgacccugaccaa

SEQ ID NO: 50212 - RNA, 22 nt, Bordetella pertussis
ccuggcgcaggacccgucguuc

SEQ ID NO: 50213 - RNA, 22 nt, Bordetella pertussis
cccggaaaucgcggcagucggg

SEQ ID NO: 50214 - RNA, 22 nt, Bordetella pertussis
agcugccagccguccacgaugu

SEQ ID NO: 50215 - RNA, 22 nt, Bordetella pertussis
cgaucgccuguuacauggccga

SEQ ID NO: 50216 - RNA, 22 nt, Bordetella pertussis
gcugaaggggucgguaucgcuc

SEQ ID NO: 50217 - RNA, 22 nt, Bordetella pertussis
gcgccaggugcaggccgcgcug

SEQ ID NO: 50218 - RNA, 17 nt, Bordetella pertussis
ucgcgcacauucagccg

SEQ ID NO: 50219 - RNA, 21 nt, Bordetella pertussis
cauggcggccagguuggucag

SEQ ID NO: 50220 - RNA, 22 nt, Bordetella pertussis
ccgacgaauugcagcgccagcu

SEQ ID NO: 50221 - RNA, 22 nt, Bordetella pertussis
ggcggccggcuugaugcgcuug

SEQ ID NO: 50222 - RNA, 22 nt, Bordetella pertussis
ucgaccugcuugccggccuggu

SEQ ID NO: 50223 - RNA, 22 nt, Bordetella pertussis
ccggcuggcauccgcgggccgg

SEQ ID NO: 50224 - RNA, 22 nt, Bordetella pertussis
cgucgaucucgacccaggcgcc

SEQ ID NO: 50225 - RNA, 22 nt, Bordetella pertussis
guggugcgcgaccggcugcgcc

SEQ ID NO: 50226 - RNA, 22 nt, Bordetella pertussis
ccggucgugaugggcuugccgu

SEQ ID NO: 50227 - RNA, 22 nt, Bordetella pertussis
acgacugcguucaguuguccau

SEQ ID NO: 50228 - RNA, 22 nt, Bordetella pertussis
cgcggccuacaucgacacggcc

SEQ ID NO: 50229 - RNA, 22 nt, Bordetella pertussis
gcguucaggccggugaccaccg

SEQ ID NO: 50230 - RNA, 22 nt, Bordetella pertussis
gucgaugcggccggccuccacc

SEQ ID NO: 50231 - RNA, 22 nt, Bordetella pertussis
ccgcagccguugaucugguuca

SEQ ID NO: 50232 - RNA, 20 nt, Bordetella pertussis
ucgugcucagcucggcggug

SEQ ID NO: 50233 - RNA, 22 nt, Bordetella pertussis
agguugacgucguugcccaggg

SEQ ID NO: 50234 - RNA, 22 nt, Bordetella pertussis
agcaggcaggcuuuggcagccu

SEQ ID NO: 50235 - RNA, 22 nt, Bordetella pertussis
cggguugccgcugcaugggcgg

SEQ ID NO: 50236 - RNA, 22 nt, Bordetella pertussis
ugcuggccacgacggccacgcu

SEQ ID NO: 50237 - RNA, 22 nt, Bordetella pertussis
gcccgcugcuuccggcaagacg

SEQ ID NO: 50238 - RNA, 22 nt, Bordetella pertussis
cucggcgauccacagccccucg

SEQ ID NO: 50239 - RNA, 22 nt, Bordetella pertussis
cgcgugaacgugauccgcgacc

SEQ ID NO: 50240 - RNA, 22 nt, Bordetella pertussis
caguugaucggccagcgccugg

SEQ ID NO: 50241 - RNA, 22 nt, Bordetella pertussis
gcgcggcuggaucaggcgcgug

SEQ ID NO: 50242 - RNA, 22 nt, Bordetella pertussis
gcguuucccggggcgcgcuggc

SEQ ID NO: 50243 - RNA, 22 nt, Bordetella pertussis
gacaccuacgagccggcgccgc

SEQ ID NO: 50244 - RNA, 22 nt, Bordetella pertussis
acgcuguucgccuugcucggcc

SEQ ID NO: 50245 - RNA, 22 nt, Bordetella pertussis
acggcgcgcaggcacaucagcu

SEQ ID NO: 50246 - RNA, 22 nt, Bordetella pertussis
cgcuguuccugcugacgcuggc

SEQ ID NO: 50247 - RNA, 22 nt, Bordetella pertussis
uagcggucguagcaaucgccau

SEQ ID NO: 50248 - RNA, 22 nt, Bordetella pertussis
caccaucgucacgcugcugugc

SEQ ID NO: 50249 - RNA, 18 nt, Bordetella pertussis
gacgacaucgccaucgcc

SEQ ID NO: 50250 - RNA, 22 nt, Bordetella pertussis
ucgcugucggccaacgagcggc

SEQ ID NO: 50251 - RNA, 22 nt, Bordetella pertussis
acgccgucgaacagucgcugcu

SEQ ID NO: 50252 - RNA, 23 nt, Bordetella pertussis
gccagccuggagaacaacaccac

SEQ ID NO: 50253 - RNA, 22 nt, Bordetella pertussis
ugcaccuguccguacuaucccu

SEQ ID NO: 50254 - RNA, 22 nt, Bordetella pertussis
gcgcaagguguugacggcgcgc

SEQ ID NO: 50255 - RNA, 22 nt, Bordetella pertussis
cgcugccggaaacccgggcuuu

SEQ ID NO: 50256 - RNA, 22 nt, Bordetella pertussis
cgcaguggaauccaacgaugcc

SEQ ID NO: 50257 - RNA, 22 nt, Bordetella pertussis
auggccgugcucgccgcaugca

SEQ ID NO: 50258 - RNA, 22 nt, Bordetella pertussis
ccaggcacggaaggccggcguu

SEQ ID NO: 50259 - RNA, 22 nt, Bordetella pertussis
ucagcaccuucugguucggcau

SEQ ID NO: 50260 - RNA, 22 nt, Bordetella pertussis
gccugcucggccugcuugcggu

SEQ ID NO: 50261 - RNA, 22 nt, Bordetella pertussis
gcaucgcaauaucaacaacgaa

SEQ ID NO: 50262 - RNA, 22 nt, Bordetella pertussis
ccaaaugacccuugccuauccc

SEQ ID NO: 50263 - RNA, 22 nt, Bordetella pertussis
ccgccgacggcuuucgugucgc

SEQ ID NO: 50264 - RNA, 22 nt, Bordetella pertussis
ugguggcuccagagcgugggag

SEQ ID NO: 50265 - RNA, 22 nt, Bordetella pertussis
gugcgccaguugccgcuggccg

SEQ ID NO: 50266 - RNA, 22 nt, Bordetella pertussis
cggccgcgaaggugaacgggcc

SEQ ID NO: 50267 - RNA, 22 nt, Bordetella pertussis
uuucgccgaucugggccugguu

SEQ ID NO: 50268 - RNA, 22 nt, Bordetella pertussis
cguugcgguccagcguggcgcc

SEQ ID NO: 50269 - RNA, 22 nt, Bordetella pertussis
ugccgggccggcgcauggccuu

SEQ ID NO: 50270 - RNA, 22 nt, Bordetella pertussis
uuugccacgaccgcccaggccu

SEQ ID NO: 50271 - RNA, 22 nt, Bordetella pertussis
cucgggcucgccggaggcgccg

SEQ ID NO: 50272 - RNA, 22 nt, Bordetella pertussis
acgggccaccggaucgagcggc

SEQ ID NO: 50273 - RNA, 22 nt, Bordetella pertussis
uaccgcaggguuucgccggucu

SEQ ID NO: 50274 - RNA, 22 nt, Bordetella pertussis
uacgucgacacggugcuggcgg

SEQ ID NO: 50275 - RNA, 22 nt, Bordetella pertussis
cgcaguggcccagcguguugac

SEQ ID NO: 50276 - RNA, 22 nt, Bordetella pertussis
cugugccugcaggaggacagcg

SEQ ID NO: 50277 - RNA, 22 nt, Bordetella pertussis
ggcgugcuggccauugcgcugg

SEQ ID NO: 50278 - RNA, 22 nt, Bordetella pertussis
gcagggcuggcagacgcgccgu

SEQ ID NO: 50279 - RNA, 22 nt, Bordetella pertussis
gggcaacgcggugauggcgcug

SEQ ID NO: 50280 - RNA, 22 nt, Bordetella pertussis
gguggggccgaacuggucgauc

SEQ ID NO: 50281 - RNA, 22 nt, Bordetella pertussis
ugaccgaagcggaucuggcgcg

SEQ ID NO: 50282 - RNA, 22 nt, Bordetella pertussis
agcacgcauaucgacagcagcg

SEQ ID NO: 50283 - RNA, 22 nt, Bordetella pertussis
gaucuguugcuggucgaucgcg

SEQ ID NO: 50284 - RNA, 23 nt, Bordetella pertussis
agugggcagggugcaugcgcgcc

SEQ ID NO: 50285 - RNA, 22 nt, Bordetella pertussis
cugcgccuuggacagcgggccg

SEQ ID NO: 50286 - RNA, 22 nt, Bordetella pertussis
cccggcgcuaagcaccccggug

SEQ ID NO: 50287 - RNA, 22 nt, Bordetella pertussis
aggcaguucguacgcgcggccg

SEQ ID NO: 50288 - RNA, 22 nt, Bordetella pertussis
caugccuaugucaaccgccuga

SEQ ID NO: 50289 - RNA, 22 nt, Bordetella pertussis
ccacauagcgcuggcagcgcuc

SEQ ID NO: 50290 - RNA, 23 nt, Bordetella pertussis
ccugggccggcgcgauuuccuug

SEQ ID NO: 50291 - RNA, 22 nt, Bordetella pertussis
acuggccggcgccgagcgcauc

SEQ ID NO: 50292 - RNA, 22 nt, Bordetella pertussis
ucacccuguggcaagccuggcg

SEQ ID NO: 50293 - RNA, 21 nt, Bordetella pertussis
ugcaccccuacgaagugccgg

SEQ ID NO: 50294 - RNA, 22 nt, Bordetella pertussis
ggccuguuccaucaucgacagc

SEQ ID NO: 50295 - RNA, 21 nt, Bordetella pertussis
ccccggcaacccgcugggcgc

SEQ ID NO: 50296 - RNA, 22 nt, Bordetella pertussis
cgcucgucggugcgcgaguauc

SEQ ID NO: 50297 - RNA, 22 nt, Bordetella pertussis
uugcuguggcuguucuggacgc

SEQ ID NO: 50298 - RNA, 23 nt, Bordetella pertussis
uguucgaucgggguuaugccgag

SEQ ID NO: 50299 - RNA, 22 nt, Bordetella pertussis
uucgcugggccaguuccuggug

SEQ ID NO: 50300 - RNA, 22 nt, Bordetella pertussis
gcgcgcuuucacucgccgcagg

SEQ ID NO: 50301 - RNA, 22 nt, Bordetella pertussis
cgcgcgcugaccggcaggucuu

SEQ ID NO: 50302 - RNA, 22 nt, Bordetella pertussis
cagugcgaguucaacggcaugu

SEQ ID NO: 50303 - RNA, 22 nt, Bordetella pertussis
cgcccugguacgugccuugcca

SEQ ID NO: 50304 - RNA, 18 nt, Bordetella pertussis
accgcgucgccuauggcc

SEQ ID NO: 50305 - RNA, 22 nt, Bordetella pertussis
ccagcguggcguccaggcuggc

SEQ ID NO: 50306 - RNA, 22 nt, Bordetella pertussis
gaccacgauguacugguccagc

SEQ ID NO: 50307 - RNA, 22 nt, Bordetella pertussis
gguggcgcauagcgugcuggcc

SEQ ID NO: 50308 - RNA, 23 nt, Bordetella pertussis
ugccggcaccauggugggcgcac

SEQ ID NO: 50309 - RNA, 22 nt, Bordetella pertussis
cacguggcggccggcaagcugg

SEQ ID NO: 50310 - RNA, 19 nt, Bordetella pertussis
gcuggccgcgaaccagugc

SEQ ID NO: 50311 - RNA, 23 nt, Bordetella pertussis
ugcucgauugccugucguccugg

SEQ ID NO: 50312 - RNA, 22 nt, Bordetella pertussis
ggcauccugcacaguccggacg

SEQ ID NO: 50313 - RNA, 22 nt, Bordetella pertussis
cggcggcggccaacuggcgcca

SEQ ID NO: 50314 - RNA, 22 nt, Bordetella pertussis
ccugggcgcccuugggcgagac

SEQ ID NO: 50315 - RNA, 22 nt, Bordetella pertussis
ccuagccauaacagugcucuac

SEQ ID NO: 50316 - RNA, 22 nt, Bordetella pertussis
ggccgguguuguugcccugcau

SEQ ID NO: 50317 - RNA, 22 nt, Bordetella pertussis
ugcgccagcgagucgggcaagg

SEQ ID NO: 50318 - RNA, 22 nt, Bordetella pertussis
uuccagcauccgcuggcggccg

SEQ ID NO: 50319 - RNA, 22 nt, Bordetella pertussis
ucgucggagugcgccugggcgg

SEQ ID NO: 50320 - RNA, 22 nt, Bordetella pertussis
acuuccagaauuucgugcuguu

SEQ ID NO: 50321 - RNA, 22 nt, Bordetella pertussis
agcgcgaugagcuucaccggcc

SEQ ID NO: 50322 - RNA, 21 nt, Bordetella pertussis
ucguacauggauucgcugccg

SEQ ID NO: 50323 - RNA, 22 nt, Bordetella pertussis
cgguugcccgauucauuguggg

SEQ ID NO: 50324 - RNA, 22 nt, Bordetella pertussis
gccgucagcgccgauguggcgc

SEQ ID NO: 50325 - RNA, 20 nt, Bordetella pertussis
uugccggcgccauuggcgcc

SEQ ID NO: 50326 - RNA, 22 nt, Bordetella pertussis
ugcacgcugggcucgcucaggc

SEQ ID NO: 50327 - RNA, 22 nt, Bordetella pertussis
uguccggguucacaggcuaucc

SEQ ID NO: 50328 - RNA, 22 nt, Bordetella pertussis
uaguugcccguggcgccauuga

SEQ ID NO: 50329 - RNA, 22 nt, Bordetella pertussis
gcguggaugucaugccauaccg

SEQ ID NO: 50330 - RNA, 22 nt, Bordetella pertussis
agggcguacagcuuccugucgu

SEQ ID NO: 50331 - RNA, 22 nt, Bordetella pertussis
ccacgccgcuguccaggcagau

SEQ ID NO: 50332 - RNA, 20 nt, Bordetella pertussis
ucacggugcugccgcccggc

SEQ ID NO: 50333 - RNA, 22 nt, Bordetella pertussis
gcgccggcuccagccaggugga

SEQ ID NO: 50334 - RNA, 22 nt, Bordetella pertussis
ugaucgaggcggguuuccagcg

SEQ ID NO: 50335 - RNA, 22 nt, Bordetella pertussis
uaccagcgcuucaugccggccg

SEQ ID NO: 50336 - RNA, 22 nt, Bordetella pertussis
acuggaccaggugacauucggc

SEQ ID NO: 50337 - RNA, 22 nt, Bordetella pertussis
ucggggccuguuccucggugcg

SEQ ID NO: 50338 - RNA, 22 nt, Bordetella pertussis
ggcccggccgcauugggacgcg

SEQ ID NO: 50339 - RNA, 22 nt, Bordetella pertussis
ugaccuugaucugcgccaugcc

SEQ ID NO: 50340 - RNA, 22 nt, Bordetella pertussis
ccgugcacgcacaugggcaacc

SEQ ID NO: 50341 - RNA, 22 nt, Bordetella pertussis
gcgccuguccccgccguucaug

SEQ ID NO: 50342 - RNA, 20 nt, Bordetella pertussis
aggugcgcgcgcugucgccc

SEQ ID NO: 50343 - RNA, 22 nt, Bordetella pertussis
ucgcgcgcgaagcccaucucgu

SEQ ID NO: 50344 - RNA, 22 nt, Bordetella pertussis
ccuguccgacccgcagguggug

SEQ ID NO: 50345 - RNA, 18 nt, Bordetella pertussis
accaggaugagcaugcgu

SEQ ID NO: 50346 - RNA, 22 nt, Bordetella pertussis
aucgccguacuucucgccgaac

SEQ ID NO: 50347 - RNA, 22 nt, Bordetella pertussis
ugucgcugauucccggcaagca

SEQ ID NO: 50348 - RNA, 22 nt, Bordetella pertussis
cgaggaaaucgccuggugcagg

SEQ ID NO: 50349 - RNA, 22 nt, Bordetella pertussis
gccgagcugcgcgggcaggcca

SEQ ID NO: 50350 - RNA, 22 nt, Bordetella pertussis
ucggugcuggugucggacaucc

SEQ ID NO: 50351 - RNA, 22 nt, Bordetella pertussis
gccgccuguacgucgauccgga

SEQ ID NO: 50352 - RNA, 22 nt, Bordetella pertussis
accgucaugaucugcgacugcu

SEQ ID NO: 50353 - RNA, 22 nt, Bordetella pertussis
ccgcuggucacgaagggcuuuu

SEQ ID NO: 50354 - RNA, 22 nt, Bordetella pertussis
uaccaguacauccccguggcgc

SEQ ID NO: 50355 - RNA, 22 nt, Bordetella pertussis
gucaggcccaucagcagcacgc

SEQ ID NO: 50356 - RNA, 22 nt, Bordetella pertussis
ucggccagcagaaugccgucgg

SEQ ID NO: 50357 - RNA, 22 nt, Bordetella pertussis
cauggcagaccgucacgcgcag

SEQ ID NO: 50358 - RNA, 22 nt, Bordetella pertussis
gccgcacguugaggucaccguc

SEQ ID NO: 50359 - RNA, 22 nt, Bordetella pertussis
ggcugguggcgucgcccgcggc

SEQ ID NO: 50360 - RNA, 22 nt, Bordetella pertussis
gcugguacggugaaaccggggu

SEQ ID NO: 50361 - RNA, 23 nt, Bordetella pertussis
aucaugcugaauuuguacagguc

SEQ ID NO: 50362 - RNA, 22 nt, Bordetella pertussis
cgacuucggcgaucucaucggu

SEQ ID NO: 50363 - RNA, 22 nt, Bordetella pertussis
ccagcacggccugcgccuggcu

SEQ ID NO: 50364 - RNA, 22 nt, Bordetella pertussis
ggugauguggcugacggccgcc

SEQ ID NO: 50365 - RNA, 20 nt, Bordetella pertussis
cgccgacuuccugugcgcca

SEQ ID NO: 50366 - RNA, 23 nt, Bordetella pertussis
gccguuuucccaaucgcucucgg

SEQ ID NO: 50367 - RNA, 22 nt, Bordetella pertussis
agccgcugcgccucgaguaugc

SEQ ID NO: 50368 - RNA, 22 nt, Bordetella pertussis
gaacaugccgaugccgguauag

SEQ ID NO: 50369 - RNA, 22 nt, Bordetella pertussis
gcuggcggaaggcgaguucuag

SEQ ID NO: 50370 - RNA, 22 nt, Bordetella pertussis
gccgccuacgggcaauggcugg

SEQ ID NO: 50371 - RNA, 22 nt, Bordetella pertussis
ggacccggguuguugcgcagcc

SEQ ID NO: 50372 - RNA, 22 nt, Bordetella pertussis
cugucguacgcuugccagagaa

SEQ ID NO: 50373 - RNA, 22 nt, Bordetella pertussis
gcggccucgauggccuaugucg

SEQ ID NO: 50374 - RNA, 22 nt, Bordetella pertussis
ugcugggcgagccguccggcua

SEQ ID NO: 50375 - RNA, 22 nt, Bordetella pertussis
aggugcgcaccgcccuggcggu

SEQ ID NO: 50376 - RNA, 22 nt, Bordetella pertussis
gugcccgcgucgcgggucacgg

SEQ ID NO: 50377 - RNA, 22 nt, Bordetella pertussis
gccgaugaagacgaugccggcg

SEQ ID NO: 50378 - RNA, 22 nt, Bordetella pertussis
uggucgccaucgcgcugcugcu

SEQ ID NO: 50379 - RNA, 22 nt, Bordetella pertussis
cgccgcagugcugaccggcgac

SEQ ID NO: 50380 - RNA, 22 nt, Bordetella pertussis
uguuccauugccuucugaaccg

SEQ ID NO: 50381 - RNA, 22 nt, Bordetella pertussis
ggcgggaggcgccgaguauggc

SEQ ID NO: 50382 - RNA, 22 nt, Bordetella pertussis
augcugaucgaucccgaugcga

SEQ ID NO: 50383 - RNA, 22 nt, Bordetella pertussis
ggucaggcggaacugcucggcg

SEQ ID NO: 50384 - RNA, 22 nt, Bordetella pertussis
ccgcgcucaugcugaaauccgc

SEQ ID NO: 50385 - RNA, 20 nt, Bordetella pertussis
ggcgccgagcuguaucgcga

SEQ ID NO: 50386 - RNA, 22 nt, Bordetella pertussis
cagguagucgcacagcgcccgc

SEQ ID NO: 50387 - RNA, 22 nt, Bordetella pertussis
gucgggcagcggcaagagcaug

SEQ ID NO: 50388 - RNA, 22 nt, Bordetella pertussis
gcgacccgggcagcagcgccau

SEQ ID NO: 50389 - RNA, 22 nt, Bordetella pertussis
cagggcguagcuuugaaagacc

SEQ ID NO: 50390 - RNA, 22 nt, Bordetella pertussis
gguggccgcugagccaggugcc

SEQ ID NO: 50391 - RNA, 22 nt, Bordetella pertussis
ggccacgaccuguugucgcugc

SEQ ID NO: 50392 - RNA, 22 nt, Bordetella pertussis
gcuggauguugugcgccagcag

SEQ ID NO: 50393 - RNA, 22 nt, Bordetella pertussis
ggacgucaagccggucaacauc

SEQ ID NO: 50394 - RNA, 22 nt, Bordetella pertussis
uacgauccucgugcgcuccggc

SEQ ID NO: 50395 - RNA, 22 nt, Bordetella pertussis
augucggcaaacgaggcgcgca

SEQ ID NO: 50396 - RNA, 22 nt, Bordetella pertussis
cugaccgaucccgaagugcugg

SEQ ID NO: 50397 - RNA, 22 nt, Bordetella pertussis
gcgccggacaaccuggucgacg

SEQ ID NO: 50398 - RNA, 22 nt, Bordetella pertussis
guccaggccauagccggucucg

SEQ ID NO: 50399 - RNA, 22 nt, Bordetella pertussis
ggcguggacaaggugaucauug

SEQ ID NO: 50400 - RNA, 22 nt, Bordetella pertussis
uugccgucggucaggucugcgc

SEQ ID NO: 50401 - RNA, 22 nt, Bordetella pertussis
ucgcggccgucuugcucgccgg

SEQ ID NO: 50402 - RNA, 22 nt, Bordetella pertussis
auagcgggcuguucgggccccg

SEQ ID NO: 50403 - RNA, 22 nt, Bordetella pertussis
gaugaucaauggcucgcugggc

SEQ ID NO: 50404 - RNA, 22 nt, Bordetella pertussis
ccaucgaagcguucgggcucga

SEQ ID NO: 50405 - RNA, 22 nt, Bordetella pertussis
auggagaagcagugugcgggca

SEQ ID NO: 50406 - RNA, 22 nt, Bordetella pertussis
cucggccaccagcuugcgggca

SEQ ID NO: 50407 - RNA, 22 nt, Bordetella pertussis
acccugauggcgcugaccaucg

SEQ ID NO: 50408 - RNA, 22 nt, Bordetella pertussis
ccgaacgcauuaccagggcuau

SEQ ID NO: 50409 - RNA, 21 nt, Bordetella pertussis
cgucaacgugucgguguccag

SEQ ID NO: 50410 - RNA, 22 nt, Bordetella pertussis
uccggugggcuacuucaccaug

SEQ ID NO: 50411 - RNA, 22 nt, Bordetella pertussis
gcaccaugaucgagcgcacauc

SEQ ID NO: 50412 - RNA, 22 nt, Bordetella pertussis
agccggugggcguggugggcau

SEQ ID NO: 50413 - RNA, 22 nt, Bordetella pertussis
gggcgugggccagauccggccg

SEQ ID NO: 50414 - RNA, 22 nt, Bordetella pertussis
ugccguccuugucgaugcgguc

SEQ ID NO: 50415 - RNA, 22 nt, Bordetella pertussis
caucguauggcggggugccugu

SEQ ID NO: 50416 - RNA, 22 nt, Bordetella pertussis
cugacggccaugauccagaagc

SEQ ID NO: 50417 - RNA, 22 nt, Bordetella pertussis
gugauauccguugccguggugc

SEQ ID NO: 50418 - RNA, 22 nt, Bordetella pertussis
ggacgcucguggcccccggcgg

SEQ ID NO: 50419 - RNA, 22 nt, Bordetella pertussis
guguucucggugaaccugggcu

SEQ ID NO: 50420 - RNA, 22 nt, Bordetella pertussis
aucacggugugcucggccuuga

SEQ ID NO: 50421 - RNA, 22 nt, Bordetella pertussis
ucagcgcagaggaagcgaucuu

SEQ ID NO: 50422 - RNA, 22 nt, Bordetella pertussis
gccucgucgcuggucucgccca

SEQ ID NO: 50423 - RNA, 22 nt, Bordetella pertussis
ugcaguccaucaagaccggcca

SEQ ID NO: 50424 - RNA, 22 nt, Bordetella pertussis
ucgauguggaucuugcgcgcau

SEQ ID NO: 50425 - RNA, 22 nt, Bordetella pertussis
auggggaugcaccaacuggcgc

SEQ ID NO: 50426 - RNA, 22 nt, Bordetella pertussis
acggccugauugaaucgugcga

SEQ ID NO: 50427 - RNA, 22 nt, Bordetella pertussis
cugccggauuucgaccagagca

SEQ ID NO: 50428 - RNA, 22 nt, Bordetella pertussis
gccuggcgcgggcgagaucguc

SEQ ID NO: 50429 - RNA, 22 nt, Bordetella pertussis
accgccaacaucgucggcgugc

SEQ ID NO: 50430 - RNA, 22 nt, Bordetella pertussis
gccgaucacgaaaucgccauug

SEQ ID NO: 50431 - RNA, 22 nt, Bordetella pertussis
ccgguggccgcaauugcccgau

SEQ ID NO: 50432 - RNA, 22 nt, Bordetella pertussis
cuggcgccggcccggcgucaau

SEQ ID NO: 50433 - RNA, 22 nt, Bordetella pertussis
ugcuggccgcgcagggcaagcg

SEQ ID NO: 50434 - RNA, 22 nt, Bordetella pertussis
gccuggcgaggucggcgcgcau

SEQ ID NO: 50435 - RNA, 22 nt, Bordetella pertussis
acggcggucaaccuggcgcugg

SEQ ID NO: 50436 - RNA, 22 nt, Bordetella pertussis
ccagacgcggcgcuacgccgac

SEQ ID NO: 50437 - RNA, 22 nt, Bordetella pertussis
cagggacauggcagugccgggu

SEQ ID NO: 50438 - RNA, 22 nt, Bordetella pertussis
gcgcccgagaaaauguugauga

SEQ ID NO: 50439 - RNA, 19 nt, Bordetella pertussis
uugcgcaauaugaccgccg

SEQ ID NO: 50440 - RNA, 22 nt, Bordetella pertussis
cgcccgcgccaucgcucccuuu

SEQ ID NO: 50441 - RNA, 22 nt, Bordetella pertussis
aacgccaccggcccguccggcu

SEQ ID NO: 50442 - RNA, 22 nt, Bordetella pertussis
gcgacgucaugccgcugcugac

SEQ ID NO: 50443 - RNA, 22 nt, Bordetella pertussis
ucggcuucgaaccggugcgcga

SEQ ID NO: 50444 - RNA, 22 nt, Bordetella pertussis
accgcgcuggucuuuuucggcu

SEQ ID NO: 50445 - RNA, 22 nt, Bordetella pertussis
gccaacgaggagcugcgccacc

SEQ ID NO: 50446 - RNA, 22 nt, Bordetella pertussis
gccagguagguggugauggcgg

SEQ ID NO: 50447 - RNA, 22 nt, Bordetella pertussis
gcugucgucguucaucucgccg

SEQ ID NO: 50448 - RNA, 22 nt, Bordetella pertussis
ggagaucccgucgccgcuggac

SEQ ID NO: 50449 - RNA, 22 nt, Bordetella pertussis
gacuggauugauggccggcgcc

SEQ ID NO: 50450 - RNA, 22 nt, Bordetella pertussis
gagcguguagccgucgggcagc

SEQ ID NO: 50451 - RNA, 22 nt, Bordetella pertussis
gaguccugggugcgcggcguca

SEQ ID NO: 50452 - RNA, 22 nt, Bordetella pertussis
gacccagggguucgggccgcag

SEQ ID NO: 50453 - RNA, 22 nt, Bordetella pertussis
uugccgcuggugcgcgguucgg

SEQ ID NO: 50454 - RNA, 22 nt, Bordetella pertussis
ggcugcgacacgaacaggagcu

SEQ ID NO: 50455 - RNA, 22 nt, Bordetella pertussis
gcagcgccgccgaugugaucga

SEQ ID NO: 50456 - RNA, 22 nt, Bordetella pertussis
cggcaucgucaccgccgacaug

SEQ ID NO: 50457 - RNA, 22 nt, Bordetella pertussis
ugccgucgcgcaagucggugcu

SEQ ID NO: 50458 - RNA, 22 nt, Bordetella pertussis
gucggccgaucagcgucgacuu

SEQ ID NO: 50459 - RNA, 22 nt, Bordetella pertussis
acgaucaaggcaugucaaucug

SEQ ID NO: 50460 - RNA, 22 nt, Bordetella pertussis
cggcgcgaacaaggucagcguc

SEQ ID NO: 50461 - RNA, 22 nt, Bordetella pertussis
cuggccgugcugcggcgcauca

SEQ ID NO: 50462 - RNA, 22 nt, Bordetella pertussis
gaguucagccccccggcuugcc

SEQ ID NO: 50463 - RNA, 22 nt, Bordetella pertussis
cgccucguagguguggcgguuc

SEQ ID NO: 50464 - RNA, 22 nt, Bordetella pertussis
acgaucuggccgccgagcuggc

SEQ ID NO: 50465 - RNA, 22 nt, Bordetella pertussis
cggcgccaguugcgauggcggu

SEQ ID NO: 50466 - RNA, 22 nt, Bordetella pertussis
gcaggcggcggaagucggccua

SEQ ID NO: 50467 - RNA, 22 nt, Bordetella pertussis
gggcgcccagcgcgucggccag

SEQ ID NO: 50468 - RNA, 22 nt, Bordetella pertussis
ggaacggcaccagccgggcuuu

SEQ ID NO: 50469 - RNA, 22 nt, Bordetella pertussis
accugcgucauggcggcguccg

SEQ ID NO: 50470 - RNA, 22 nt, Bordetella pertussis
cccagcuggccgagcugauccg

SEQ ID NO: 50471 - RNA, 22 nt, Bordetella pertussis
gugcuggaugcccgcguuguug

SEQ ID NO: 50472 - RNA, 22 nt, Bordetella pertussis
uccaccgucaucugcaccggca

SEQ ID NO: 50473 - RNA, 22 nt, Bordetella pertussis
ccacggcuuccauggccgcacg

SEQ ID NO: 50474 - RNA, 22 nt, Bordetella pertussis
acgcgcggccugccgggcaugg

SEQ ID NO: 50475 - RNA, 22 nt, Bordetella pertussis
gcccauauggugcaugccgcgu

SEQ ID NO: 50476 - RNA, 21 nt, Bordetella pertussis
ucgacgagaacgacgugcguc

SEQ ID NO: 50477 - RNA, 22 nt, Bordetella pertussis
cgcugcgcuuuggcgacggcag

SEQ ID NO: 50478 - RNA, 22 nt, Bordetella pertussis
gccgcugucgcuguucgcgcug

SEQ ID NO: 50479 - RNA, 22 nt, Bordetella pertussis
agcacggccuggucuugccgcg

SEQ ID NO: 50480 - RNA, 22 nt, Bordetella pertussis
gacggcagcuucggcuucaccg

SEQ ID NO: 50481 - RNA, 22 nt, Bordetella pertussis
cguggccgccaaccaguacggc

SEQ ID NO: 50482 - RNA, 22 nt, Bordetella pertussis
uagccgcuuucgagcgagccgu

SEQ ID NO: 50483 - RNA, 22 nt, Bordetella pertussis
gcgggccaggcgcgcaucgaca

SEQ ID NO: 50484 - RNA, 22 nt, Bordetella pertussis
ggucugucagcgccacggccgg

SEQ ID NO: 50485 - RNA, 22 nt, Bordetella pertussis
guugccgcaagucgcgcguaua

SEQ ID NO: 50486 - RNA, 22 nt, Bordetella pertussis
cauguccagcgucacgcccacc

SEQ ID NO: 50487 - RNA, 22 nt, Bordetella pertussis
ccgggccggcuacagcucgccg

SEQ ID NO: 50488 - RNA, 20 nt, Bordetella pertussis
ugcugcggcugcugcccgau

SEQ ID NO: 50489 - RNA, 22 nt, Bordetella pertussis
caaccuggaauucaccgacaug

SEQ ID NO: 50490 - RNA, 22 nt, Bordetella pertussis
accggcguggucagcggcgcau

SEQ ID NO: 50491 - RNA, 22 nt, Bordetella pertussis
agcuggcuuccaugaaguucau

SEQ ID NO: 50492 - RNA, 22 nt, Bordetella pertussis
uucgaaauccauucccuucucg

SEQ ID NO: 50493 - RNA, 22 nt, Bordetella pertussis
gcggcgauggucgacgcgucgu

SEQ ID NO: 50494 - RNA, 22 nt, Bordetella pertussis
gcccgagauuccgcgcguggug

SEQ ID NO: 50495 - RNA, 22 nt, Bordetella pertussis
uugcgcuuguggcgaaggggcg

SEQ ID NO: 50496 - RNA, 22 nt, Bordetella pertussis
uggaugccgcgcaucauggacg

SEQ ID NO: 50497 - RNA, 22 nt, Bordetella pertussis
agcgccuucaggaugucgcgca

SEQ ID NO: 50498 - RNA, 22 nt, Bordetella pertussis
agcaggugcgccuggucagcuc

SEQ ID NO: 50499 - RNA, 22 nt, Bordetella pertussis
ucggcggugcgcucggagguau

SEQ ID NO: 50500 - RNA, 22 nt, Bordetella pertussis
ggggucgaccaugcgcagcgug

SEQ ID NO: 50501 - RNA, 22 nt, Bordetella pertussis
uacggcgccagccccgaccugg

SEQ ID NO: 50502 - RNA, 22 nt, Bordetella pertussis
cuggcgauuucgguguguguga

SEQ ID NO: 50503 - RNA, 23 nt, Bordetella pertussis
ugucggagcaggaacucuccgau

SEQ ID NO: 50504 - RNA, 19 nt, Bordetella pertussis
acguacggauaggacggca

SEQ ID NO: 50505 - RNA, 22 nt, Bordetella pertussis
gauggucuggccggggccgccg

SEQ ID NO: 50506 - RNA, 22 nt, Bordetella pertussis
caucuggaccuugcagaucgcc

SEQ ID NO: 50507 - RNA, 22 nt, Bordetella pertussis
ugagcuacugauccgggcugca

SEQ ID NO: 50508 - RNA, 22 nt, Bordetella pertussis
uggcguguuccuugcccgggau

SEQ ID NO: 50509 - RNA, 22 nt, Bordetella pertussis
ccgaucuucagcuugugcucgc

SEQ ID NO: 50510 - RNA, 20 nt, Bordetella pertussis
guucgccaagaccgauccgg

SEQ ID NO: 50511 - RNA, 22 nt, Bordetella pertussis
cacgccgccaugcaggucauuc

SEQ ID NO: 50512 - RNA, 22 nt, Bordetella pertussis
cgacgaaguugccgugccccug

SEQ ID NO: 50513 - RNA, 22 nt, Bordetella pertussis
uacugccaggugcgcgugucgc

SEQ ID NO: 50514 - RNA, 22 nt, Bordetella pertussis
ggacauguucagcggacugggc

SEQ ID NO: 50515 - RNA, 22 nt, Bordetella pertussis
gccgggcgccaccgugcuggcg

SEQ ID NO: 50516 - RNA, 22 nt, Bordetella pertussis
gccggucgagacauagugcauc

SEQ ID NO: 50517 - RNA, 22 nt, Bordetella pertussis
agaaggcgcucgccgcggucgg

SEQ ID NO: 50518 - RNA, 22 nt, Bordetella pertussis
gaccaggagcugcgccagcagc

SEQ ID NO: 50519 - RNA, 22 nt, Bordetella pertussis
uggggcuggcgcugcuggucgu

SEQ ID NO: 50520 - RNA, 22 nt, Bordetella pertussis
cuccgguggcgcaggcaugguu

SEQ ID NO: 50521 - RNA, 22 nt, Bordetella pertussis
cggucgucacaucggugaucgu

SEQ ID NO: 50522 - RNA, 22 nt, Bordetella pertussis
gaaaccgucaugcggcaggccg

SEQ ID NO: 50523 - RNA, 22 nt, Bordetella pertussis
ugaacccgaucgaucacccgca

SEQ ID NO: 50524 - RNA, 22 nt, Bordetella pertussis
cguucagcucgauggcgcggug

SEQ ID NO: 50525 - RNA, 22 nt, Bordetella pertussis
uugccgcaggcuuggcgggaug

SEQ ID NO: 50526 - RNA, 22 nt, Bordetella pertussis
guggcgccauggcgggcgucau

SEQ ID NO: 50527 - RNA, 22 nt, Bordetella pertussis
ggcgcgccaggaauugauggcg

SEQ ID NO: 50528 - RNA, 22 nt, Bordetella pertussis
caguucaucgugcgccagcagg

SEQ ID NO: 50529 - RNA, 22 nt, Bordetella pertussis
cguggaugauggccucggcgcg

SEQ ID NO: 50530 - RNA, 22 nt, Bordetella pertussis
cgcgucgaugccuucgccggcc

SEQ ID NO: 50531 - RNA, 22 nt, Bordetella pertussis
gaccgcuacggggauuuccugg

SEQ ID NO: 50532 - RNA, 22 nt, Bordetella pertussis
ccgucagccgcuguucgccgac

SEQ ID NO: 50533 - RNA, 22 nt, Bordetella pertussis
gccggugcucagguagcggacg

SEQ ID NO: 50534 - RNA, 22 nt, Bordetella pertussis
uuggcguuuuccguuucgauac

SEQ ID NO: 50535 - RNA, 20 nt, Bordetella pertussis
ugcggaucgccagcaccgcg

SEQ ID NO: 50536 - RNA, 22 nt, Bordetella pertussis
uguacgaugcgccgggcgucgg

SEQ ID NO: 50537 - RNA, 22 nt, Bordetella pertussis
acgggcaaguucacgcgguugg

SEQ ID NO: 50538 - RNA, 22 nt, Bordetella pertussis
guccaggucggcuucggaggcg

SEQ ID NO: 50539 - RNA, 22 nt, Bordetella pertussis
ccacccuggccagacugcgcgc

SEQ ID NO: 50540 - RNA, 22 nt, Bordetella pertussis
uccgccaggucgucgcgcugga

SEQ ID NO: 50541 - RNA, 22 nt, Bordetella pertussis
uggugccgcugccguucaucau

SEQ ID NO: 50542 - RNA, 22 nt, Bordetella pertussis
cuggcgauggccugaugggugu

SEQ ID NO: 50543 - RNA, 22 nt, Bordetella pertussis
cucgucgguggucagcaucaag

SEQ ID NO: 50544 - RNA, 22 nt, Bordetella pertussis
agcagcguggcgcucaauggcg

SEQ ID NO: 50545 - RNA, 22 nt, Bordetella pertussis
caucgacacgcucagcgccgug

SEQ ID NO: 50546 - RNA, 22 nt, Bordetella pertussis
acgcgcgucaagguggaucugc

SEQ ID NO: 50547 - RNA, 22 nt, Bordetella pertussis
accugcggcuuggcguugccgu

SEQ ID NO: 50548 - RNA, 22 nt, Bordetella pertussis
guguuguucuccaggcuggcgu

SEQ ID NO: 50549 - RNA, 22 nt, Bordetella pertussis
cgggcgcgacaucagcgccgug

SEQ ID NO: 50550 - RNA, 22 nt, Bordetella pertussis
cgucgaagaacggcgccacgac

SEQ ID NO: 50551 - RNA, 22 nt, Bordetella pertussis
cgcacccuggaagucgaggcca

SEQ ID NO: 50552 - RNA, 22 nt, Bordetella pertussis
gggaugcgcgucgacgagguca

SEQ ID NO: 50553 - RNA, 21 nt, Bordetella pertussis
cguggcuggcgcugccggugg

SEQ ID NO: 50554 - RNA, 22 nt, Bordetella pertussis
guggccggcauccgcaagcugc

SEQ ID NO: 50555 - RNA, 22 nt, Bordetella pertussis
gcgccucgaugcccuugcggau

SEQ ID NO: 50556 - RNA, 22 nt, Bordetella pertussis
uggcgccgauggccugcagcuc

SEQ ID NO: 50557 - RNA, 22 nt, Bordetella pertussis
ccggauggcggaagucgaucga

SEQ ID NO: 50558 - RNA, 22 nt, Bordetella pertussis
gccugggcugcgccagcgagcg

SEQ ID NO: 50559 - RNA, 22 nt, Bordetella pertussis
aucgggcagcagccgcagcagg

SEQ ID NO: 50560 - RNA, 22 nt, Bordetella pertussis
gcgaccucggccacccagaugg

SEQ ID NO: 50561 - RNA, 22 nt, Bordetella pertussis
uggccgugcugccggacgcgcc

SEQ ID NO: 50562 - RNA, 22 nt, Bordetella pertussis
gcacggucuccaggaagaccag

SEQ ID NO: 50563 - RNA, 22 nt, Bordetella pertussis
cgcuugcugggugacgacuuca

SEQ ID NO: 50564 - RNA, 22 nt, Bordetella pertussis
acgccaugaaucgggucagccu

SEQ ID NO: 50565 - RNA, 22 nt, Bordetella pertussis
uccgccgccgcgaucacuucgu

SEQ ID NO: 50566 - RNA, 22 nt, Bordetella pertussis
caggucgucggccagcgugucg

SEQ ID NO: 50567 - RNA, 22 nt, Bordetella pertussis
aggcgcgaagugggguugaucg

SEQ ID NO: 50568 - RNA, 22 nt, Bordetella pertussis
uggaauucgacccgcaugcggu

SEQ ID NO: 50569 - RNA, 22 nt, Bordetella pertussis
cgcccgacaacagcgugcccag

SEQ ID NO: 50570 - RNA, 22 nt, Bordetella pertussis
gcgcgacccggacaggaacagg

SEQ ID NO: 50571 - RNA, 22 nt, Bordetella pertussis
gcgccgcuccccuuucgucccu

SEQ ID NO: 50572 - RNA, 22 nt, Bordetella pertussis
cggccgugauggucgugcugcg

SEQ ID NO: 50573 - RNA, 22 nt, Bordetella pertussis
gguacggcuggacgggccgcga

SEQ ID NO: 50574 - RNA, 22 nt, Bordetella pertussis
uccaugauggguggcgacgccg

SEQ ID NO: 50575 - RNA, 22 nt, Bordetella pertussis
acgccuucuugaugaggaccgu

SEQ ID NO: 50576 - RNA, 22 nt, Bordetella pertussis
cugcgcgugcugggcacggcca

SEQ ID NO: 50577 - RNA, 22 nt, Bordetella pertussis
uccgcgccaugcgcagguugcu

SEQ ID NO: 50578 - RNA, 22 nt, Bordetella pertussis
gggcgccugggucgagaucgac

SEQ ID NO: 50579 - RNA, 22 nt, Bordetella pertussis
gggcuggccguaucggcccugc

SEQ ID NO: 50580 - RNA, 22 nt, Bordetella pertussis
caggcgaugccgccguucuggu

SEQ ID NO: 50581 - RNA, 22 nt, Bordetella pertussis
cgucaucacgauguaugucgaa

SEQ ID NO: 50582 - RNA, 22 nt, Bordetella pertussis
cucgggcaggaagaaggcgucg

SEQ ID NO: 50583 - RNA, 22 nt, Bordetella pertussis
gcugcccuggaagcggauggcg

SEQ ID NO: 50584 - RNA, 22 nt, Bordetella pertussis
cggccgcagcucgaggcgcugg

SEQ ID NO: 50585 - RNA, 22 nt, Bordetella pertussis
acgggcuugagguugguuucca

SEQ ID NO: 50586 - RNA, 22 nt, Bordetella pertussis
auggccgucaucgccgccugca

SEQ ID NO: 50587 - RNA, 21 nt, Bordetella pertussis
gaagaugacgcgaucggcgac

SEQ ID NO: 50588 - RNA, 22 nt, Bordetella pertussis
ggucggcgauguucugguccgg

SEQ ID NO: 50589 - RNA, 22 nt, Bordetella pertussis
cacgcgggucgagguauugugc

SEQ ID NO: 50590 - RNA, 22 nt, Bordetella pertussis
agcugguggcucaggccgcugu

SEQ ID NO: 50591 - RNA, 22 nt, Bordetella pertussis
auucggcccgcgccaugcucug

SEQ ID NO: 50592 - RNA, 20 nt, Bordetella pertussis
cgcaccgagggccuguccgc

SEQ ID NO: 50593 - RNA, 22 nt, Bordetella pertussis
cuggugcucaagcugaucgacc

SEQ ID NO: 50594 - RNA, 22 nt, Bordetella pertussis
ccucgggcaccacggcagcgac

SEQ ID NO: 50595 - RNA, 22 nt, Bordetella pertussis
gccccugcugcuuggcguccag

SEQ ID NO: 50596 - RNA, 22 nt, Bordetella pertussis
cugcgcgguaucgcgaucgauc

SEQ ID NO: 50597 - RNA, 22 nt, Bordetella pertussis
ccuggcuguacuuggacaucga

SEQ ID NO: 50598 - RNA, 22 nt, Bordetella pertussis
cgcguccuccgucgcugcgcuc

SEQ ID NO: 50599 - RNA, 22 nt, Bordetella pertussis
ggggugcuggucgucggcguac

SEQ ID NO: 50600 - RNA, 22 nt, Bordetella pertussis
cacagcuaguucuccgccuggc

SEQ ID NO: 50601 - RNA, 22 nt, Bordetella pertussis
uggccaggcggccgcgcaacgg

SEQ ID NO: 50602 - RNA, 22 nt, Bordetella pertussis
cgauggcggccaccguggcuuc

SEQ ID NO: 50603 - RNA, 22 nt, Bordetella pertussis
ccgagcugugcgucuugccgcg

SEQ ID NO: 50604 - RNA, 22 nt, Bordetella pertussis
auggcgcgcaucacgauggccu

SEQ ID NO: 50605 - RNA, 22 nt, Bordetella pertussis
cugcuggagcuggaggauggcg

SEQ ID NO: 50606 - RNA, 22 nt, Bordetella pertussis
cgcggcgucuccagcgagccgg

SEQ ID NO: 50607 - RNA, 22 nt, Bordetella pertussis
cguccaggccaucggucagguu

SEQ ID NO: 50608 - RNA, 22 nt, Bordetella pertussis
cggggcugaccagcccguuuuc

SEQ ID NO: 50609 - RNA, 22 nt, Bordetella pertussis
ccagcgcauggucgaggaugcg

SEQ ID NO: 50610 - RNA, 22 nt, Bordetella pertussis
gguuguugaugcugaagccggc

SEQ ID NO: 50611 - RNA, 22 nt, Bordetella pertussis
uugucgcugaucgucggcgugg

SEQ ID NO: 50612 - RNA, 22 nt, Bordetella pertussis
cgcgucgaccuggcggugcgga

SEQ ID NO: 50613 - RNA, 22 nt, Bordetella pertussis
cggcugguucauguggcguccg

SEQ ID NO: 50614 - RNA, 22 nt, Bordetella pertussis
gcgcgguaucgcgaucgaucgg

SEQ ID NO: 50615 - RNA, 22 nt, Bordetella pertussis
gugcugugaacgucaguugcgg

SEQ ID NO: 50616 - RNA, 22 nt, Bordetella pertussis
gcggcgcucaguacacgucgcg

SEQ ID NO: 50617 - RNA, 22 nt, Bordetella pertussis
cggccagguugccgaucuuguc

SEQ ID NO: 50618 - RNA, 22 nt, Bordetella pertussis
ucgccgaucuucucgagcagcc

SEQ ID NO: 50619 - RNA, 22 nt, Bordetella pertussis
cgugcagggcuuccagcgucac

SEQ ID NO: 50620 - RNA, 22 nt, Bordetella pertussis
caaugggccuauuucgcgcgcg

SEQ ID NO: 50621 - RNA, 22 nt, Bordetella pertussis
gucggucagggugccgggcgug

SEQ ID NO: 50622 - RNA, 22 nt, Bordetella pertussis
ggggacgagcuccuggagucug

SEQ ID NO: 50623 - RNA, 22 nt, Bordetella pertussis
ugauggcgcccaggcugcgcaa

SEQ ID NO: 50624 - RNA, 22 nt, Bordetella pertussis
acgaccaccggagcggcggcgg

SEQ ID NO: 50625 - RNA, 22 nt, Bordetella pertussis
gccuggacuccgaugacggcca

SEQ ID NO: 50626 - RNA, 22 nt, Bordetella pertussis
acugcagcguauuggucugggc

SEQ ID NO: 50627 - RNA, 22 nt, Bordetella pertussis
ccuguccucaugcgggacaggc

SEQ ID NO: 50628 - RNA, 22 nt, Bordetella pertussis
gggccacgcccagcagcagggu

SEQ ID NO: 50629 - RNA, 22 nt, Bordetella pertussis
uugcccaggcagaucgucagca

SEQ ID NO: 50630 - RNA, 22 nt, Bordetella pertussis
cccuggugugguucgcccaggg

SEQ ID NO: 50631 - RNA, 22 nt, Bordetella pertussis
augcugcugcugaucggcguau

SEQ ID NO: 50632 - RNA, 22 nt, Bordetella pertussis
ugccugucccagcggggacagg

SEQ ID NO: 50633 - RNA, 22 nt, Bordetella pertussis
ccgcgcagccguaggcgcucag

SEQ ID NO: 50634 - RNA, 22 nt, Bordetella pertussis
acgcgcgcggccuccuucaagu

SEQ ID NO: 50635 - RNA, 22 nt, Bordetella pertussis
cggcgccaagcugaucagcgcc

SEQ ID NO: 50636 - RNA, 19 nt, Bordetella pertussis
gcgcuucgagggcgugcug

SEQ ID NO: 50637 - RNA, 22 nt, Bordetella pertussis
uggcugcgggucaugacggcgc

SEQ ID NO: 50638 - RNA, 22 nt, Bordetella pertussis
gaccgggucuucguuggcgaag

SEQ ID NO: 50639 - RNA, 22 nt, Bordetella pertussis
cagccguuggacguggccagcu

SEQ ID NO: 50640 - RNA, 22 nt, Bordetella pertussis
gugcgcagcuaccucaaccugc

SEQ ID NO: 50641 - RNA, 22 nt, Bordetella pertussis
cugggcguacgcgcggauauga

SEQ ID NO: 50642 - RNA, 22 nt, Bordetella pertussis
ucgucggcccaugucggcgcga

SEQ ID NO: 50643 - RNA, 22 nt, Bordetella pertussis
gcgacagcgcguugucgggcac

SEQ ID NO: 50644 - RNA, 22 nt, Bordetella pertussis
cugcuggugcugggcuuugcca

SEQ ID NO: 50645 - RNA, 22 nt, Bordetella pertussis
cgaggccgaggucgaguacgcc

SEQ ID NO: 50646 - RNA, 22 nt, Bordetella pertussis
ucgggaugagucaccgucgagc

SEQ ID NO: 50647 - RNA, 22 nt, Bordetella pertussis
ccgucgccucccagcuccaugg

SEQ ID NO: 50648 - RNA, 22 nt, Bordetella pertussis
ccaugcugaccaacaugcuggg

SEQ ID NO: 50649 - RNA, 21 nt, Bordetella pertussis
cggcgguggugcugugccagg

SEQ ID NO: 50650 - RNA, 22 nt, Bordetella pertussis
cucgaucggcuguaccaggcgc

SEQ ID NO: 50651 - RNA, 22 nt, Bordetella pertussis
ucgacgugcacgagcgcgucgu

SEQ ID NO: 50652 - RNA, 22 nt, Bordetella pertussis
aguucacguauaucggcggcau

SEQ ID NO: 50653 - RNA, 22 nt, Bordetella pertussis
agcuggucaacgcgccgucgcc

SEQ ID NO: 50654 - RNA, 22 nt, Bordetella pertussis
uacgccgcaucaaaccccggcu

SEQ ID NO: 50655 - RNA, 22 nt, Bordetella pertussis
ucgaauucgcggcggaguauag

SEQ ID NO: 50656 - RNA, 22 nt, Bordetella pertussis
ucguugacgcgcuugggguugu

SEQ ID NO: 50657 - RNA, 22 nt, Bordetella pertussis
gccugcucgaacugccggccgc

SEQ ID NO: 50658 - RNA, 22 nt, Bordetella pertussis
cggccgggcuacugcgcgaccg

SEQ ID NO: 50659 - RNA, 22 nt, Bordetella pertussis
acgaccuugccggucgacgcau

SEQ ID NO: 50660 - RNA, 22 nt, Bordetella pertussis
gccgugcagcacgccgcguauc

SEQ ID NO: 50661 - RNA, 22 nt, Bordetella pertussis
gccgcucgaaccggugcgcgug

SEQ ID NO: 50662 - RNA, 22 nt, Bordetella pertussis
ucgcgggaaagaaggcggcggu

SEQ ID NO: 50663 - RNA, 22 nt, Bordetella pertussis
agcgcgcagcugaccacgcugg

SEQ ID NO: 50664 - RNA, 22 nt, Bordetella pertussis
agccggccgaacagacgccggc

SEQ ID NO: 50665 - RNA, 22 nt, Bordetella pertussis
accugggcgauuucaucgaaga

SEQ ID NO: 50666 - RNA, 22 nt, Bordetella pertussis
gaccacgcuggcauugccgccc

SEQ ID NO: 50667 - RNA, 22 nt, Bordetella pertussis
gcgccaguucgcgcagggcgau

SEQ ID NO: 50668 - RNA, 22 nt, Bordetella pertussis
agccggcacgcgcagcugaauu

SEQ ID NO: 50669 - RNA, 19 nt, Bordetella pertussis
ggacggacgucuccauggc

SEQ ID NO: 50670 - RNA, 22 nt, Bordetella pertussis
gccgaugcggauccggccggag

SEQ ID NO: 50671 - RNA, 22 nt, Bordetella pertussis
ucaagccgcuuuuuugcgccug

SEQ ID NO: 50672 - RNA, 22 nt, Bordetella pertussis
gagcgguaccagcgccagcagc

SEQ ID NO: 50673 - RNA, 22 nt, Bordetella pertussis
ugcccguggugaucggcgcgcu

SEQ ID NO: 50674 - RNA, 22 nt, Bordetella pertussis
gcuggcgcaguggcugggccag

SEQ ID NO: 50675 - RNA, 22 nt, Bordetella pertussis
ucggcgugaacgugccguaguc

SEQ ID NO: 50676 - RNA, 22 nt, Bordetella pertussis
ucagcgcgaacuuguagcggcu

SEQ ID NO: 50677 - RNA, 22 nt, Bordetella pertussis
ucgacucgggcacgaccgugca

SEQ ID NO: 50678 - RNA, 22 nt, Bordetella pertussis
guccuggauccgccagugcgcg

SEQ ID NO: 50679 - RNA, 22 nt, Bordetella pertussis
gggcgcuuuugcuugggccuca

SEQ ID NO: 50680 - RNA, 22 nt, Bordetella pertussis
ggcgccaguucgccggccagcg

SEQ ID NO: 50681 - RNA, 22 nt, Bordetella pertussis
gcgcucaggccagcagcgacac

SEQ ID NO: 50682 - RNA, 22 nt, Bordetella pertussis
ccuguucggcaacggcgagcgc

SEQ ID NO: 50683 - RNA, 22 nt, Bordetella pertussis
cgccggcaugggcgaggucacg

SEQ ID NO: 50684 - RNA, 22 nt, Bordetella pertussis
aggccgauguugccuuccugga

SEQ ID NO: 50685 - RNA, 20 nt, Bordetella pertussis
cacgcgcgccgaauucggcc

SEQ ID NO: 50686 - RNA, 22 nt, Bordetella pertussis
ggaaucagcaucgccagcgcca

SEQ ID NO: 50687 - RNA, 22 nt, Bordetella pertussis
agggcgccgguguaauaggcau

SEQ ID NO: 50688 - RNA, 21 nt, Bordetella pertussis
cguggccgccgugcugggcgu

SEQ ID NO: 50689 - RNA, 22 nt, Bordetella pertussis
ccguccacgugagguccaucgu

SEQ ID NO: 50690 - RNA, 22 nt, Bordetella pertussis
gcgguugggcacggccaggauc

SEQ ID NO: 50691 - RNA, 18 nt, Bordetella pertussis
ggcaggccuucggccagu

SEQ ID NO: 50692 - RNA, 22 nt, Bordetella pertussis
ugccggcgccgguuucgccuug

SEQ ID NO: 50693 - RNA, 22 nt, Bordetella pertussis
gcuguagcugaagccgucggcc

SEQ ID NO: 50694 - RNA, 22 nt, Bordetella pertussis
cuuguugcgcgaaccgccgcga

SEQ ID NO: 50695 - RNA, 22 nt, Bordetella pertussis
uugcuggcggcuuucauggccu

SEQ ID NO: 50696 - RNA, 22 nt, Bordetella pertussis
ucgucggcaccgacgugggcgg

SEQ ID NO: 50697 - RNA, 22 nt, Bordetella pertussis
ccggaucauaagcaauugccgg

SEQ ID NO: 50698 - RNA, 22 nt, Bordetella pertussis
uggcccgguugguggcgauucc

SEQ ID NO: 50699 - RNA, 22 nt, Bordetella pertussis
ggucgaucgccagcggcagguc

SEQ ID NO: 50700 - RNA, 22 nt, Bordetella pertussis
ugaucgaucaguugcggcgcga

SEQ ID NO: 50701 - RNA, 22 nt, Bordetella pertussis
guugggcacgacgacgacggcg

SEQ ID NO: 50702 - RNA, 22 nt, Bordetella pertussis
guucgcgcgaaaaaccgauguc

SEQ ID NO: 50703 - RNA, 20 nt, Bordetella pertussis
ucuucuccagcgucuggugg

SEQ ID NO: 50704 - RNA, 22 nt, Bordetella pertussis
gccgucgaccgggccgguggcg

SEQ ID NO: 50705 - RNA, 22 nt, Bordetella pertussis
ggcgccaguuggccgccgccgg

SEQ ID NO: 50706 - RNA, 22 nt, Bordetella pertussis
ccuggccacgcugcuggccgag

SEQ ID NO: 50707 - RNA, 22 nt, Bordetella pertussis
ggcgcgcggcuuaauccaguuu

SEQ ID NO: 50708 - RNA, 22 nt, Bordetella pertussis
gucggccugcacgaaggccugu

SEQ ID NO: 50709 - RNA, 22 nt, Bordetella pertussis
cuaugugcuggucaaggcggug

SEQ ID NO: 50710 - RNA, 22 nt, Bordetella pertussis
cugccgguauagccgacggccu

SEQ ID NO: 50711 - RNA, 22 nt, Bordetella pertussis
aaguggcgcgugccggucagga

SEQ ID NO: 50712 - RNA, 22 nt, Bordetella pertussis
acggugcuggccgacuggugca

SEQ ID NO: 50713 - RNA, 22 nt, Bordetella pertussis
aucaaggucgagcggccgggcg

SEQ ID NO: 50714 - RNA, 22 nt, Bordetella pertussis
gccgggcagcacggccgaggcg

SEQ ID NO: 50715 - RNA, 22 nt, Bordetella pertussis
ggcaggcucuacaauacgcgcc

SEQ ID NO: 50716 - RNA, 22 nt, Bordetella pertussis
ccgucgcgcccuggugcgcguc

SEQ ID NO: 50717 - RNA, 21 nt, Bordetella pertussis
ccgacgccgacccgcaguucg

SEQ ID NO: 50718 - RNA, 19 nt, Bordetella pertussis
acaucucgugcaccagccc

SEQ ID NO: 50719 - RNA, 22 nt, Bordetella pertussis
aagucgcguaccgcgcuggccg

SEQ ID NO: 50720 - RNA, 22 nt, Bordetella pertussis
augcgcauuuccuccugcagcu

SEQ ID NO: 50721 - RNA, 21 nt, Bordetella pertussis
cgcgucuugcgauccagggcg

SEQ ID NO: 50722 - RNA, 22 nt, Bordetella pertussis
cgcugugggccagcuugaggua

SEQ ID NO: 50723 - RNA, 22 nt, Bordetella pertussis
ccugggcgaagucuucguucuc

SEQ ID NO: 50724 - RNA, 22 nt, Bordetella pertussis
gccgccucaccgaggagcagga

SEQ ID NO: 50725 - RNA, 22 nt, Bordetella pertussis
accgccaagaaucugcugcucg

SEQ ID NO: 50726 - RNA, 22 nt, Bordetella pertussis
cgugucgagcugggcauggcgc

SEQ ID NO: 50727 - RNA, 22 nt, Bordetella pertussis
cgcgucgaccuuggaauggacc

SEQ ID NO: 50728 - RNA, 22 nt, Bordetella pertussis
ucggauuccugcccaccgcgcc

SEQ ID NO: 50729 - RNA, 22 nt, Bordetella pertussis
gggacaggcgcagauccggcag

SEQ ID NO: 50730 - RNA, 22 nt, Bordetella pertussis
gccgauguccugcaggcgcugg

SEQ ID NO: 50731 - RNA, 22 nt, Bordetella pertussis
ggcgcggcgugcgaugauuaca

SEQ ID NO: 50732 - RNA, 22 nt, Bordetella pertussis
gacguugacgaugaugccgcaa

SEQ ID NO: 50733 - RNA, 22 nt, Bordetella pertussis
gcgcaggcgcuucuugccguac

SEQ ID NO: 50734 - RNA, 22 nt, Bordetella pertussis
gcuucgagaccuugaaccugcu

SEQ ID NO: 50735 - RNA, 20 nt, Bordetella pertussis
ucaucucgagcuggccuucg

SEQ ID NO: 50736 - RNA, 22 nt, Bordetella pertussis
guguuccaggugggcuggggca

SEQ ID NO: 50737 - RNA, 22 nt, Bordetella pertussis
cgaggcucgccuugaacgcugc

SEQ ID NO: 50738 - RNA, 22 nt, Bordetella pertussis
gcgucaccgccaccaggacggc

SEQ ID NO: 50739 - RNA, 22 nt, Bordetella pertussis
gccgcccacgccuagcgucguc

SEQ ID NO: 50740 - RNA, 22 nt, Bordetella pertussis
ucuucggcggcgcgcuugaccc

SEQ ID NO: 50741 - RNA, 22 nt, Bordetella pertussis
ggccgugggcgccgacgugcgu

SEQ ID NO: 50742 - RNA, 18 nt, Bordetella pertussis
guucagcagcuuuuuugu

SEQ ID NO: 50743 - RNA, 22 nt, Bordetella pertussis
uccaugccgcccuuggcggcgg

SEQ ID NO: 50744 - RNA, 22 nt, Bordetella pertussis
cuggcgaucgugcugggcauga

SEQ ID NO: 50745 - RNA, 21 nt, Bordetella pertussis
gcgcggcaccauggcggcgua

SEQ ID NO: 50746 - RNA, 22 nt, Bordetella pertussis
cugcgcaccgacucgggcccgu

SEQ ID NO: 50747 - RNA, 20 nt, Bordetella pertussis
cguggcauggccaucgccgc

SEQ ID NO: 50748 - RNA, 22 nt, Bordetella pertussis
ugcggccguuguaggucuugcg

SEQ ID NO: 50749 - RNA, 22 nt, Bordetella pertussis
auauggcgcgauacgacgguau

SEQ ID NO: 50750 - RNA, 22 nt, Bordetella pertussis
uugcaggaugaccgugcggccg

SEQ ID NO: 50751 - RNA, 22 nt, Bordetella pertussis
caucgccucgcucgacgcgcug

SEQ ID NO: 50752 - RNA, 22 nt, Bordetella pertussis
cgguugcuccgcggaaucgggc

SEQ ID NO: 50753 - RNA, 22 nt, Bordetella pertussis
agugccuucaugcagcaggcgc

SEQ ID NO: 50754 - RNA, 22 nt, Bordetella pertussis
ggggucgacaaaggcguugucu

SEQ ID NO: 50755 - RNA, 22 nt, Bordetella pertussis
ggcggguggugguuucgcagca

SEQ ID NO: 50756 - RNA, 22 nt, Bordetella pertussis
agggacgcggucugcgccuuga

SEQ ID NO: 50757 - RNA, 20 nt, Bordetella pertussis
agcgucagccagaacguggc

SEQ ID NO: 50758 - RNA, 22 nt, Bordetella pertussis
gccgaucgcguggcggugaugu

SEQ ID NO: 50759 - RNA, 22 nt, Bordetella pertussis
ggccccgaacgugggcaccagc

SEQ ID NO: 50760 - RNA, 22 nt, Bordetella pertussis
uguacucggugaugccgacggu

SEQ ID NO: 50761 - RNA, 20 nt, Bordetella pertussis
cacgaagacgugcucggcgc

SEQ ID NO: 50762 - RNA, 22 nt, Bordetella pertussis
ggucucgaugaugguggcgagc

SEQ ID NO: 50763 - RNA, 22 nt, Bordetella pertussis
cagccacucgacagccuguacc

SEQ ID NO: 50764 - RNA, 22 nt, Bordetella pertussis
accuggccgggccgcugacgcc

SEQ ID NO: 50765 - RNA, 22 nt, Bordetella pertussis
cuacaacaugaagcugccgcca

SEQ ID NO: 50766 - RNA, 22 nt, Bordetella pertussis
aucacgacguugcgcaggucca

SEQ ID NO: 50767 - RNA, 22 nt, Bordetella pertussis
gucggugcgcauggaacugcag

SEQ ID NO: 50768 - RNA, 22 nt, Bordetella pertussis
gcagcuggacgugcgcagcaug

SEQ ID NO: 50769 - RNA, 22 nt, Bordetella pertussis
cccagcgugucguugaggccca

SEQ ID NO: 50770 - RNA, 20 nt, Bordetella pertussis
uguccucgacgaaggugccg

SEQ ID NO: 50771 - RNA, 22 nt, Bordetella pertussis
cggugucggggguuaccgaggc

SEQ ID NO: 50772 - RNA, 20 nt, Bordetella pertussis
ggccgccagcgaggcggcca

SEQ ID NO: 50773 - RNA, 22 nt, Bordetella pertussis
gucgcgaggacuuagcgcugau

SEQ ID NO: 50774 - RNA, 22 nt, Bordetella pertussis
ucggcguaggccggcucgaccg

SEQ ID NO: 50775 - RNA, 22 nt, Bordetella pertussis
ggcccguugaugguguagagca

SEQ ID NO: 50776 - RNA, 22 nt, Bordetella pertussis
cugcgcccuccuugaccagcgu

SEQ ID NO: 50777 - RNA, 22 nt, Bordetella pertussis
auggcucagcucgcgcagcaug

SEQ ID NO: 50778 - RNA, 22 nt, Bordetella pertussis
uggucaacgccguacucgaagc

SEQ ID NO: 50779 - RNA, 22 nt, Bordetella pertussis
gccgggauccgcuugccguugu

SEQ ID NO: 50780 - RNA, 22 nt, Bordetella pertussis
augcccagcgguugcgcggcca

SEQ ID NO: 50781 - RNA, 22 nt, Bordetella pertussis
ccagcgucagccccaccacggc

SEQ ID NO: 50782 - RNA, 22 nt, Bordetella pertussis
caccaguuccuggcccuugcgc

SEQ ID NO: 50783 - RNA, 22 nt, Bordetella pertussis
gccccuggccgacggccuggug

SEQ ID NO: 50784 - RNA, 22 nt, Bordetella pertussis
accgguuuccugggcgggcuga

SEQ ID NO: 50785 - RNA, 22 nt, Bordetella pertussis
gccgcgauggccggcacgucgu

SEQ ID NO: 50786 - RNA, 22 nt, Bordetella pertussis
gucgucguugcggcagucuucg

SEQ ID NO: 50787 - RNA, 22 nt, Bordetella pertussis
gcgacagcagggucggccccau

SEQ ID NO: 50788 - RNA, 22 nt, Bordetella pertussis
ggugcucgaugauugauuguuu

SEQ ID NO: 50789 - RNA, 22 nt, Bordetella pertussis
guccccgcggggacaggcacac

SEQ ID NO: 50790 - RNA, 19 nt, Bordetella pertussis
acgguugcagcgcaucguc

SEQ ID NO: 50791 - RNA, 22 nt, Bordetella pertussis
ggucggauugaagcgcaggucg

SEQ ID NO: 50792 - RNA, 22 nt, Bordetella pertussis
uggaaaaugcgcucgcggaugu

SEQ ID NO: 50793 - RNA, 22 nt, Bordetella pertussis
auugcccguucugccgccaugc

SEQ ID NO: 50794 - RNA, 22 nt, Bordetella pertussis
cuuggacaucgaauggcgcaac

SEQ ID NO: 50795 - RNA, 22 nt, Bordetella pertussis
ugucggugcccuggccggucuc

SEQ ID NO: 50796 - RNA, 22 nt, Bordetella pertussis
agggcuugccuucgcgcuugaa

SEQ ID NO: 50797 - RNA, 22 nt, Bordetella pertussis
ugcggaucucguacucuuugac

SEQ ID NO: 50798 - RNA, 23 nt, Bordetella pertussis
uggccgagcuggugcgccgccac

SEQ ID NO: 50799 - RNA, 22 nt, Bordetella pertussis
gcccaucuucacgcauuugugg

SEQ ID NO: 50800 - RNA, 22 nt, Bordetella pertussis
gagcuguuggugcugcccacga

SEQ ID NO: 50801 - RNA, 22 nt, Bordetella pertussis
augaggcccaugccaugcgugc

SEQ ID NO: 50802 - RNA, 22 nt, Bordetella pertussis
acgauccgcaggccggcgugcg

SEQ ID NO: 50803 - RNA, 22 nt, Bordetella pertussis
agcggcgccgagacgaucguca

SEQ ID NO: 50804 - RNA, 22 nt, Bordetella pertussis
ugggcuggcagcagauggauca

SEQ ID NO: 50805 - RNA, 22 nt, Bordetella pertussis
augacgugcgauacgcccggua

SEQ ID NO: 50806 - RNA, 22 nt, Bordetella pertussis
acgugcugaccgggcuguacgu

SEQ ID NO: 50807 - RNA, 22 nt, Bordetella pertussis
ggucuucgacgccgugcugcgc

SEQ ID NO: 50808 - RNA, 22 nt, Bordetella pertussis
ggugggcgucgcauuccauguu

SEQ ID NO: 50809 - RNA, 22 nt, Bordetella pertussis
gcgcgcaugcacccugcccacu

SEQ ID NO: 50810 - RNA, 22 nt, Bordetella pertussis
accauggcggccaagcagcccg

SEQ ID NO: 50811 - RNA, 22 nt, Bordetella pertussis
cccgccuuggacgcggcauacg

SEQ ID NO: 50812 - RNA, 22 nt, Bordetella pertussis
ggcuggucaugauggugcgcga

SEQ ID NO: 50813 - RNA, 22 nt, Bordetella pertussis
cgccgccccguaccgcaucagu

SEQ ID NO: 50814 - RNA, 22 nt, Bordetella pertussis
aucuugcgcggcaaggccgccg

SEQ ID NO: 50815 - RNA, 22 nt, Bordetella pertussis
ccuggccucgagcaugagccug

SEQ ID NO: 50816 - RNA, 21 nt, Bordetella pertussis
acuacgccaaggcuggcgcgg

SEQ ID NO: 50817 - RNA, 22 nt, Bordetella pertussis
ucccggcguucgcccugggcau

SEQ ID NO: 50818 - RNA, 22 nt, Bordetella pertussis
cagucgcuguucgugcaggugc

SEQ ID NO: 50819 - RNA, 22 nt, Bordetella pertussis
gaugauggcgggugcguugaag

SEQ ID NO: 50820 - RNA, 22 nt, Bordetella pertussis
cgccauccgcuuccagggcagc

SEQ ID NO: 50821 - RNA, 22 nt, Bordetella pertussis
acgcuggcccgcaucgaagcgg

SEQ ID NO: 50822 - RNA, 22 nt, Bordetella pertussis
cgagaacgggcaggugguuccg

SEQ ID NO: 50823 - RNA, 22 nt, Bordetella pertussis
guccuugccgcugcucaauggc

SEQ ID NO: 50824 - RNA, 22 nt, Bordetella pertussis
cccggcugguggcgaccugggg

SEQ ID NO: 50825 - RNA, 22 nt, Bordetella pertussis
aggcgccguuacgguucacgcg

SEQ ID NO: 50826 - RNA, 22 nt, Bordetella pertussis
ccuguauggcgcugauggccgg

SEQ ID NO: 50827 - RNA, 22 nt, Bordetella pertussis
ugcggcguuggcgucgagcaug

SEQ ID NO: 50828 - RNA, 22 nt, Bordetella pertussis
gcgccgcccgagaagucgcuca

SEQ ID NO: 50829 - RNA, 22 nt, Bordetella pertussis
gcugaaaucgaugugcugccgg

SEQ ID NO: 50830 - RNA, 22 nt, Bordetella pertussis
uggugcuguuccuguucaaggc

SEQ ID NO: 50831 - RNA, 22 nt, Bordetella pertussis
agccuguuucuguccuaccggc

SEQ ID NO: 50832 - RNA, 22 nt, Bordetella pertussis
acgucggcgaggucgaacugug

SEQ ID NO: 50833 - RNA, 22 nt, Bordetella pertussis
gccaucugcauggcaagggcaa

SEQ ID NO: 50834 - RNA, 17 nt, Bordetella pertussis
ucugaucgguaugcagu

SEQ ID NO: 50835 - RNA, 22 nt, Bordetella pertussis
uacgccgccuggcuccauaugc

SEQ ID NO: 50836 - RNA, 22 nt, Bordetella pertussis
accggcgugcugaucggcaugg

SEQ ID NO: 50837 - RNA, 22 nt, Bordetella pertussis
gcccgcaucaagcgccugcugg

SEQ ID NO: 50838 - RNA, 22 nt, Bordetella pertussis
augggcgcgucgcuggcgucga

SEQ ID NO: 50839 - RNA, 22 nt, Bordetella pertussis
ugcgcgacgaaucggugggccg

SEQ ID NO: 50840 - RNA, 22 nt, Bordetella pertussis
gcgcgcccgucuggugcugaua

SEQ ID NO: 50841 - RNA, 22 nt, Bordetella pertussis
ccuguccccgcggggacggaua

SEQ ID NO: 50842 - RNA, 22 nt, Bordetella pertussis
cugguaggcauuucggccggcg

SEQ ID NO: 50843 - RNA, 22 nt, Bordetella pertussis
gggugccuguccccgccgggac

SEQ ID NO: 50844 - RNA, 20 nt, Bordetella pertussis
ugcgcgcggccuggauggcg

SEQ ID NO: 50845 - RNA, 22 nt, Bordetella pertussis
gacaugaucgauugcucgucgg

SEQ ID NO: 50846 - RNA, 22 nt, Bordetella pertussis
cuugccggaacggucggugacg

SEQ ID NO: 50847 - RNA, 22 nt, Bordetella pertussis
cgccgacggcacgaucucgggc

SEQ ID NO: 50848 - RNA, 22 nt, Bordetella pertussis
cgcgcgacuucaacggcuuggu

SEQ ID NO: 50849 - RNA, 22 nt, Bordetella pertussis
cgccacguggaugccggugaag

SEQ ID NO: 50850 - RNA, 22 nt, Bordetella pertussis
ugcccaugacgcgccccggcau

SEQ ID NO: 50851 - RNA, 22 nt, Bordetella pertussis
acguccuucugcggaucgaugc

SEQ ID NO: 50852 - RNA, 22 nt, Bordetella pertussis
ccgggugccggccgaggcgcug

SEQ ID NO: 50853 - RNA, 22 nt, Bordetella pertussis
cgagcuguucgucgacgcggug

SEQ ID NO: 50854 - RNA, 22 nt, Bordetella pertussis
gcgcgcccggcgacgaggugga

SEQ ID NO: 50855 - RNA, 22 nt, Bordetella pertussis
uccgguggcugcgggcccagcc

SEQ ID NO: 50856 - RNA, 22 nt, Bordetella pertussis
auggcgcuggagaugcuguugc

SEQ ID NO: 50857 - RNA, 22 nt, Bordetella pertussis
cgaguggguggcgucgcugucg

SEQ ID NO: 50858 - RNA, 22 nt, Bordetella pertussis
gucgggucagcucggccuaugg

SEQ ID NO: 50859 - RNA, 22 nt, Bordetella pertussis
aucggcguccugcgcguuccag

SEQ ID NO: 50860 - RNA, 22 nt, Bordetella pertussis
ccacgcccgaguucguccgguu

SEQ ID NO: 50861 - RNA, 22 nt, Bordetella pertussis
gcgcgucugggcaugggugcgc

SEQ ID NO: 50862 - RNA, 22 nt, Bordetella pertussis
caugcggcccugcagcagcgcu

SEQ ID NO: 50863 - RNA, 22 nt, Bordetella pertussis
ccacgcguagauggccuggucg

SEQ ID NO: 50864 - RNA, 22 nt, Bordetella pertussis
uucuucagggcgaccuugaaca

SEQ ID NO: 50865 - RNA, 22 nt, Bordetella pertussis
caucagcacgcugcugugggcg

SEQ ID NO: 50866 - RNA, 22 nt, Bordetella pertussis
gcguuguugaguacgaagccua

SEQ ID NO: 50867 - RNA, 22 nt, Bordetella pertussis
caaggugccgucggccucgaug

SEQ ID NO: 50868 - RNA, 22 nt, Bordetella pertussis
gcucagcgugguggcgcugcug

SEQ ID NO: 50869 - RNA, 22 nt, Bordetella pertussis
uccuccacaucggccaccauga

SEQ ID NO: 50870 - RNA, 22 nt, Bordetella pertussis
uacaucaucguggcccugguga

SEQ ID NO: 50871 - RNA, 22 nt, Bordetella pertussis
cuuauauaaugcgucacgcgcu

SEQ ID NO: 50872 - RNA, 21 nt, Bordetella pertussis
cgucauccaggucgacggcga

SEQ ID NO: 50873 - RNA, 22 nt, Bordetella pertussis
cuggcgcugucguucgccuugc

SEQ ID NO: 50874 - RNA, 20 nt, Bordetella pertussis
ugcugcgcggccuggacauc

SEQ ID NO: 50875 - RNA, 22 nt, Bordetella pertussis
cagcugcuggccgucggcgccg

SEQ ID NO: 50876 - RNA, 22 nt, Bordetella pertussis
acgccugggucgucgaagccgc

SEQ ID NO: 50877 - RNA, 22 nt, Bordetella pertussis
auggucaugccgucgcgcgcca

SEQ ID NO: 50878 - RNA, 22 nt, Bordetella pertussis
augacgauuucguggccccauu

SEQ ID NO: 50879 - RNA, 22 nt, Bordetella pertussis
aagcugaccgugaucgaccugg

SEQ ID NO: 50880 - RNA, 22 nt, Bordetella pertussis
gccacgggucgggacaggcacc

SEQ ID NO: 50881 - RNA, 17 nt, Bordetella pertussis
agcagcgccgcacgcug

SEQ ID NO: 50882 - RNA, 22 nt, Bordetella pertussis
ugucgucgaccgaguagaucuc

SEQ ID NO: 50883 - RNA, 19 nt, Bordetella pertussis
cacguccugcuugcgcuug

SEQ ID NO: 50884 - RNA, 22 nt, Bordetella pertussis
accaccaugcggaucgggcguu

SEQ ID NO: 50885 - RNA, 22 nt, Bordetella pertussis
aagagcgacuggcuggacgggc

SEQ ID NO: 50886 - RNA, 22 nt, Bordetella pertussis
uggcgccagcagaucggcgaac

SEQ ID NO: 50887 - RNA, 22 nt, Bordetella pertussis
auccggcucgugguccagcgcg

SEQ ID NO: 50888 - RNA, 22 nt, Bordetella pertussis
gacuucgacgaacagggcgaua

SEQ ID NO: 50889 - RNA, 22 nt, Bordetella pertussis
uuggcgccuucgaucgacacgc

SEQ ID NO: 50890 - RNA, 22 nt, Bordetella pertussis
guccggcucagcggcucagcgg

SEQ ID NO: 50891 - RNA, 22 nt, Bordetella pertussis
cugucccgcaugaggacaggcg

SEQ ID NO: 50892 - RNA, 22 nt, Bordetella pertussis
augcgcaucgauucgugcguca

SEQ ID NO: 50893 - RNA, 22 nt, Bordetella pertussis
ccggccugacccguauccgcug

SEQ ID NO: 50894 - RNA, 22 nt, Bordetella pertussis
gugcucgggcaugggauucgug

SEQ ID NO: 50895 - RNA, 22 nt, Bordetella pertussis
acgcaguuccugcccuaugccc

SEQ ID NO: 50896 - RNA, 21 nt, Bordetella pertussis
gccaugucacggccuugccuu

SEQ ID NO: 50897 - RNA, 22 nt, Bordetella pertussis
cagcguggucgucgccgcguug

SEQ ID NO: 50898 - RNA, 22 nt, Bordetella pertussis
acgggcagucguaggggugcga

SEQ ID NO: 50899 - RNA, 22 nt, Bordetella pertussis
uggaucaguuugauguuguccu

SEQ ID NO: 50900 - RNA, 22 nt, Bordetella pertussis
cgccugcaguccaugcgcggau

SEQ ID NO: 50901 - RNA, 22 nt, Bordetella pertussis
ugcuggaguugcuggcgcgcuu

SEQ ID NO: 50902 - RNA, 22 nt, Bordetella pertussis
guggcggcccuggucgccuucc

SEQ ID NO: 50903 - RNA, 22 nt, Bordetella pertussis
ugccagucccccuguggggaca

SEQ ID NO: 50904 - RNA, 22 nt, Bordetella pertussis
ugcgccggcgacagcggcuggu

SEQ ID NO: 50905 - RNA, 22 nt, Bordetella pertussis
ucgacggcuucggcgugcugcc

SEQ ID NO: 50906 - RNA, 20 nt, Bordetella pertussis
ugcuggcgcuguccugcguc

SEQ ID NO: 50907 - RNA, 22 nt, Bordetella pertussis
gcggccgacaggaugguggcca

SEQ ID NO: 50908 - RNA, 22 nt, Bordetella pertussis
caccgguccgcaaugggcggga

SEQ ID NO: 50909 - RNA, 18 nt, Bordetella pertussis
cgcgaucgaccucgcuga

SEQ ID NO: 50910 - RNA, 22 nt, Bordetella pertussis
ggucagcgugcgcggccaguuc

SEQ ID NO: 50911 - RNA, 20 nt, Bordetella pertussis
gcggucgugaaguagguguu

SEQ ID NO: 50912 - RNA, 22 nt, Bordetella pertussis
cgggcguggccaucagucggcc

SEQ ID NO: 50913 - RNA, 22 nt, Bordetella pertussis
uggcuggcgcgccgcaaggcca

SEQ ID NO: 50914 - RNA, 22 nt, Bordetella pertussis
gcaggggccgcuggcgcaguuc

SEQ ID NO: 50915 - RNA, 22 nt, Bordetella pertussis
guggauggaggcgcgcgacgag

SEQ ID NO: 50916 - RNA, 22 nt, Bordetella pertussis
gcaggggccguuguggcuggcu

SEQ ID NO: 50917 - RNA, 22 nt, Bordetella pertussis
auaccgcccuacuggaagccgc

SEQ ID NO: 50918 - RNA, 22 nt, Bordetella pertussis
ucggcggugacgaugccggugc

SEQ ID NO: 50919 - RNA, 22 nt, Bordetella pertussis
ccagggacgggagggugccgaa

SEQ ID NO: 50920 - RNA, 22 nt, Bordetella pertussis
gcgcgccaccggacuggugucg

SEQ ID NO: 50921 - RNA, 22 nt, Bordetella pertussis
ggccgaguggaucucgucgcug

SEQ ID NO: 50922 - RNA, 22 nt, Bordetella pertussis
caggucaaggugcgcgcggagc

SEQ ID NO: 50923 - RNA, 22 nt, Bordetella pertussis
ccccgcugcggcaagggugccu

SEQ ID NO: 50924 - RNA, 22 nt, Bordetella pertussis
gcgauggggcccgggccgaugg

SEQ ID NO: 50925 - RNA, 22 nt, Bordetella pertussis
cacgucaucguggccggcgccg

SEQ ID NO: 50926 - RNA, 22 nt, Bordetella pertussis
gggcgcugcugauccaggccug

SEQ ID NO: 50927 - RNA, 22 nt, Bordetella pertussis
cggauuccauacaagggcgcgg

SEQ ID NO: 50928 - RNA, 22 nt, Bordetella pertussis
gucucgccgcccggcgccaggu

SEQ ID NO: 50929 - RNA, 22 nt, Bordetella pertussis
cacgcccgggccgcugugccac

SEQ ID NO: 50930 - RNA, 22 nt, Bordetella pertussis
ccguuguggaaauugaaggccu

SEQ ID NO: 50931 - RNA, 22 nt, Bordetella pertussis
cgaccuugaucuugcuggcguc

SEQ ID NO: 50932 - RNA, 22 nt, Bordetella pertussis
ucgcgccugaucgaccguccgc

SEQ ID NO: 50933 - RNA, 22 nt, Bordetella pertussis
gcgcaugaucgccgggcuggau

SEQ ID NO: 50934 - RNA, 22 nt, Bordetella pertussis
cgucgcggcugaguucggccac

SEQ ID NO: 50935 - RNA, 22 nt, Bordetella pertussis
cgcagcucgugcgagacguugg

SEQ ID NO: 50936 - RNA, 22 nt, Bordetella pertussis
aggccacgacuucggcgcccag

SEQ ID NO: 50937 - RNA, 22 nt, Bordetella pertussis
uggccgacggcggcgaaggcac

SEQ ID NO: 50938 - RNA, 22 nt, Bordetella pertussis
gagcauggucgaauuccacaau

SEQ ID NO: 50939 - RNA, 22 nt, Bordetella pertussis
cgcccuguauccguaucucgau

SEQ ID NO: 50940 - RNA, 22 nt, Bordetella pertussis
gucagcgagcugugccagucgg

SEQ ID NO: 50941 - RNA, 22 nt, Bordetella pertussis
ggcgcgcuggucagcagcgucg

SEQ ID NO: 50942 - RNA, 17 nt, Bordetella pertussis
augcgaggcguugaucg

SEQ ID NO: 50943 - RNA, 22 nt, Bordetella pertussis
cggcgagugcgccgccagcagg

SEQ ID NO: 50944 - RNA, 22 nt, Bordetella pertussis
gcggcaauccgcgccaugucgu

SEQ ID NO: 50945 - RNA, 22 nt, Bordetella pertussis
cggcgcugaugucgcgcccgug

SEQ ID NO: 50946 - RNA, 22 nt, Bordetella pertussis
gcgcacgcggguguccuguugc

SEQ ID NO: 50947 - RNA, 22 nt, Bordetella pertussis
cugaucauguuccagcugggcg

SEQ ID NO: 50948 - RNA, 22 nt, Bordetella pertussis
acaucugcugcucgccgcgcca

SEQ ID NO: 50949 - RNA, 22 nt, Bordetella pertussis
ggccugcgucagcaugugcucg

SEQ ID NO: 50950 - RNA, 22 nt, Bordetella pertussis
uggcggccaggcgcugcaggau

SEQ ID NO: 50951 - RNA, 22 nt, Bordetella pertussis
gaugccggcguagaucgacugc

SEQ ID NO: 50952 - RNA, 20 nt, Bordetella pertussis
gccggccggcggccguacag

SEQ ID NO: 50953 - RNA, 22 nt, Bordetella pertussis
caguccgucggucgagcaggau

SEQ ID NO: 50954 - RNA, 22 nt, Bordetella pertussis
gucaugccauauccguccgugu

SEQ ID NO: 50955 - RNA, 22 nt, Bordetella pertussis
uaccugaccgaggcggugcgcc

SEQ ID NO: 50956 - RNA, 22 nt, Bordetella pertussis
agcgcaucaccgagcuggucga

SEQ ID NO: 50957 - RNA, 22 nt, Bordetella pertussis
ggcggcaugcacgagggcaagg

SEQ ID NO: 50958 - RNA, 21 nt, Bordetella pertussis
augaccgcaucgggcguccug

SEQ ID NO: 50959 - RNA, 22 nt, Bordetella pertussis
ucgugcgccgcaaggugccgcu

SEQ ID NO: 50960 - RNA, 22 nt, Bordetella pertussis
agcgccggcucgauggcgggau

SEQ ID NO: 50961 - RNA, 22 nt, Bordetella pertussis
acagcggcguguacguggcgcc

SEQ ID NO: 50962 - RNA, 22 nt, Bordetella pertussis
cggcaggcguacggccagcgca

SEQ ID NO: 50963 - RNA, 19 nt, Bordetella pertussis
gcaugcuguucauguggcc

SEQ ID NO: 50964 - RNA, 22 nt, Bordetella pertussis
cuccccgcgcuuccggggcgag

SEQ ID NO: 50965 - RNA, 20 nt, Bordetella pertussis
gcccacgucccagcguucgc

SEQ ID NO: 50966 - RNA, 22 nt, Bordetella pertussis
cgcgaugucccuugguggcccg

SEQ ID NO: 50967 - RNA, 22 nt, Bordetella pertussis
uuggccaccgccagcggcugca

SEQ ID NO: 50968 - RNA, 22 nt, Bordetella pertussis
gugaaguugaugcgcuggcggc

SEQ ID NO: 50969 - RNA, 22 nt, Bordetella pertussis
aacugggccuugaagucggucu

SEQ ID NO: 50970 - RNA, 23 nt, Bordetella pertussis
auccucaagcaugcgcgagcgcg

SEQ ID NO: 50971 - RNA, 22 nt, Bordetella pertussis
ggucgucacccugggcgccggc

SEQ ID NO: 50972 - RNA, 18 nt, Bordetella pertussis
ggcccgcacaugaccgcg

SEQ ID NO: 50973 - RNA, 22 nt, Bordetella pertussis
cugcgccggcgacagcggcugg

SEQ ID NO: 50974 - RNA, 22 nt, Bordetella pertussis
uugaccggauuccugggcagcg

SEQ ID NO: 50975 - RNA, 22 nt, Bordetella pertussis
cgcggcaucccguacgccgccu

SEQ ID NO: 50976 - RNA, 22 nt, Bordetella pertussis
agugcgucaaccugcccgugcg

SEQ ID NO: 50977 - RNA, 22 nt, Bordetella pertussis
gcuugagcaggaaguugccgaa

SEQ ID NO: 50978 - RNA, 22 nt, Bordetella pertussis
auggaugccguaggcugcguac

SEQ ID NO: 50979 - RNA, 22 nt, Bordetella pertussis
cgcugguggccacgccacgcag

SEQ ID NO: 50980 - RNA, 22 nt, Bordetella pertussis
ccgugcgcaaggcauggcccag

SEQ ID NO: 50981 - RNA, 22 nt, Bordetella pertussis
gcgugcccgaccagaccgucag

SEQ ID NO: 50982 - RNA, 22 nt, Bordetella pertussis
ggcaccgugaugucgccgucgg

SEQ ID NO: 50983 - RNA, 18 nt, Bordetella pertussis
ggaagcgcugccgccggc

SEQ ID NO: 50984 - RNA, 21 nt, Bordetella pertussis
ccgaaccggcguaguacucga

SEQ ID NO: 50985 - RNA, 22 nt, Bordetella pertussis
aagggcagcgugcuggccauca

SEQ ID NO: 50986 - RNA, 22 nt, Bordetella pertussis
ccaugguggaaggcaauccgga

SEQ ID NO: 50987 - RNA, 22 nt, Bordetella pertussis
gccgcagagcacggucaugaug

SEQ ID NO: 50988 - RNA, 22 nt, Bordetella pertussis
gaugaagaucgacagcacgccg

SEQ ID NO: 50989 - RNA, 22 nt, Bordetella pertussis
ucgcggugcugcugaucgagca

SEQ ID NO: 50990 - RNA, 22 nt, Bordetella pertussis
ugccggcacgucgguggugcag

SEQ ID NO: 50991 - RNA, 22 nt, Bordetella pertussis
cacgccgaacugcuggccggca

SEQ ID NO: 50992 - RNA, 22 nt, Bordetella pertussis
ccaucgaacuguuccagcccga

SEQ ID NO: 50993 - RNA, 20 nt, Bordetella pertussis
gcgcuugaccagcuugaugu

SEQ ID NO: 50994 - RNA, 22 nt, Bordetella pertussis
gugaucgucgaggguuucaucg

SEQ ID NO: 50995 - RNA, 22 nt, Bordetella pertussis
ugaucgagcacgacgauguggu

SEQ ID NO: 50996 - RNA, 22 nt, Bordetella pertussis
uguccggcggcgcaucgacgcc

SEQ ID NO: 50997 - RNA, 22 nt, Bordetella pertussis
uaccgggcuggacuggcccggc

SEQ ID NO: 50998 - RNA, 22 nt, Bordetella pertussis
ugcacggccuggcggccgacau

SEQ ID NO: 50999 - RNA, 22 nt, Bordetella pertussis
cgucaugcgccuuguacuuggc

SEQ ID NO: 51000 - RNA, 22 nt, Bordetella pertussis
aggacgugcaggacgcgcuggg

SEQ ID NO: 51001 - RNA, 22 nt, Bordetella pertussis
ggcagcucggccucgggcgcca

SEQ ID NO: 51002 - RNA, 22 nt, Bordetella pertussis
gcugauggccuucguggcucgc

SEQ ID NO: 51003 - RNA, 22 nt, Bordetella pertussis
acuggaccagggccgugcccag

SEQ ID NO: 51004 - RNA, 22 nt, Bordetella pertussis
auuggccaggcuggcgccggug

SEQ ID NO: 51005 - RNA, 22 nt, Bordetella pertussis
cgccuucucgacguugagcacc

SEQ ID NO: 51006 - RNA, 22 nt, Bordetella pertussis
ucuuccagguagugcgucagga

SEQ ID NO: 51007 - RNA, 22 nt, Bordetella pertussis
gcugugccgcgagcugggcgug

SEQ ID NO: 51008 - RNA, 22 nt, Bordetella pertussis
cugggcuugcgcuucggccgcc

SEQ ID NO: 51009 - RNA, 22 nt, Bordetella pertussis
gcuggagcagcugaugggcaaa

SEQ ID NO: 51010 - RNA, 22 nt, Bordetella pertussis
gcgggcggccuaucaccugggc

SEQ ID NO: 51011 - RNA, 22 nt, Bordetella pertussis
agcgggccgcgguucaggcugc

SEQ ID NO: 51012 - RNA, 22 nt, Bordetella pertussis
cgcugggcaucgccaagcugga

SEQ ID NO: 51013 - RNA, 22 nt, Bordetella pertussis
aacaucaccgucaugggcaucu

SEQ ID NO: 51014 - RNA, 22 nt, Bordetella pertussis
cgccaccacccugaucgcccug

SEQ ID NO: 51015 - RNA, 22 nt, Bordetella pertussis
ucauggugcgcgucgccauggu

SEQ ID NO: 51016 - RNA, 22 nt, Bordetella pertussis
cgaacuggccaucgucaucggc

SEQ ID NO: 51017 - RNA, 22 nt, Bordetella pertussis
aucaccgggccggcuucaugca

SEQ ID NO: 51018 - RNA, 22 nt, Bordetella pertussis
uggcgcugagcagcggcacgcu

SEQ ID NO: 51019 - RNA, 22 nt, Bordetella pertussis
gcgugaggcuggcgccgcaggc

SEQ ID NO: 51020 - RNA, 22 nt, Bordetella pertussis
uggcgcccaagguggcgcugcu

SEQ ID NO: 51021 - RNA, 22 nt, Bordetella pertussis
aacgccggcugaagcacggcgg

SEQ ID NO: 51022 - RNA, 22 nt, Bordetella pertussis
gugguguucguccgacgguucg

SEQ ID NO: 51023 - RNA, 22 nt, Bordetella pertussis
ugcugucggcgcuggccgcggu

SEQ ID NO: 51024 - RNA, 23 nt, Bordetella pertussis
gcuaccuggcgucuucgggcaug

SEQ ID NO: 51025 - RNA, 22 nt, Bordetella pertussis
ugccgcagacgaugaucucgcc

SEQ ID NO: 51026 - RNA, 22 nt, Bordetella pertussis
aaccgccacaccuacgaggcgg

SEQ ID NO: 51027 - RNA, 22 nt, Bordetella pertussis
gcccaugcucgacgccaucgcc

SEQ ID NO: 51028 - RNA, 22 nt, Bordetella pertussis
gccugggguugcaggcgguccc

SEQ ID NO: 51029 - RNA, 22 nt, Bordetella pertussis
ucucgcugcugccgcucgagcc

SEQ ID NO: 51030 - RNA, 22 nt, Bordetella pertussis
gccuggccgcgcguggcaugac

SEQ ID NO: 51031 - RNA, 22 nt, Bordetella pertussis
cuggccggcaaccaggcgccca

SEQ ID NO: 51032 - RNA, 19 nt, Bordetella pertussis
ugaccgcgcgcuugaucgc

SEQ ID NO: 51033 - RNA, 22 nt, Bordetella pertussis
augcgccagaugcagggcggcg

SEQ ID NO: 51034 - RNA, 22 nt, Bordetella pertussis
ccagggagaaauccuggcggcc

SEQ ID NO: 51035 - RNA, 22 nt, Bordetella pertussis
ggcgauggccaugccacgucgc

SEQ ID NO: 51036 - RNA, 22 nt, Bordetella pertussis
guugcuugcucaucggcgcagg

SEQ ID NO: 51037 - RNA, 22 nt, Bordetella pertussis
uucgugaucaugaucaugaucg

SEQ ID NO: 51038 - RNA, 22 nt, Bordetella pertussis
gaacagaaccacggcuugcggu

SEQ ID NO: 51039 - RNA, 22 nt, Bordetella pertussis
ccgucgggcgcggccuuggcca

SEQ ID NO: 51040 - RNA, 22 nt, Bordetella pertussis
aauggcguucuuguugaccgug

SEQ ID NO: 51041 - RNA, 22 nt, Bordetella pertussis
uucguuguucagcgugcggcag

SEQ ID NO: 51042 - RNA, 22 nt, Bordetella pertussis
aucgaagucggauucgcgcauc

SEQ ID NO: 51043 - RNA, 22 nt, Bordetella pertussis
cguguugucgaucugguucaug

SEQ ID NO: 51044 - RNA, 22 nt, Bordetella pertussis
ugggcgcugcccugcuggcggu

SEQ ID NO: 51045 - RNA, 22 nt, Bordetella pertussis
ggccggcaacuacggcaugugc

SEQ ID NO: 51046 - RNA, 20 nt, Bordetella pertussis
ggcuggacccggguccgugg

SEQ ID NO: 51047 - RNA, 22 nt, Bordetella pertussis
ucgaugaccaggauggucuggc

SEQ ID NO: 51048 - RNA, 22 nt, Bordetella pertussis
uaccgggcgcgcgcguugauga

SEQ ID NO: 51049 - RNA, 22 nt, Bordetella pertussis
uggcagcagaucgacuacggcu

SEQ ID NO: 51050 - RNA, 22 nt, Bordetella pertussis
gccaggcgcccggcgaggucuu

SEQ ID NO: 51051 - RNA, 22 nt, Bordetella pertussis
ucacgccgaacacgaugguggc

SEQ ID NO: 51052 - RNA, 22 nt, Bordetella pertussis
ugggcugguacuucacgccggc

SEQ ID NO: 51053 - RNA, 22 nt, Bordetella pertussis
gcggucggauauucccaugauc

SEQ ID NO: 51054 - RNA, 22 nt, Bordetella pertussis
gccagcagcuugucgaagcggg

SEQ ID NO: 51055 - RNA, 22 nt, Bordetella pertussis
ggccccaucgaggcgcgcuucu

SEQ ID NO: 51056 - RNA, 22 nt, Bordetella pertussis
gccgcagaucugggggucgggc

SEQ ID NO: 51057 - RNA, 22 nt, Bordetella pertussis
gccgaugacgauggccaguucg

SEQ ID NO: 51058 - RNA, 22 nt, Bordetella pertussis
cuugcgcagguccaccugcacc

SEQ ID NO: 51059 - RNA, 22 nt, Bordetella pertussis
gucgccaucgcgcugcaggucg

SEQ ID NO: 51060 - RNA, 22 nt, Bordetella pertussis
cgaccagcaucgcaugcguacc

SEQ ID NO: 51061 - RNA, 22 nt, Bordetella pertussis
gccgcgguagggaaucacgcgg

SEQ ID NO: 51062 - RNA, 22 nt, Bordetella pertussis
ucggcgcugauuccgcgcaccg

SEQ ID NO: 51063 - RNA, 22 nt, Bordetella pertussis
auccgagagcaugcccacgacg

SEQ ID NO: 51064 - RNA, 22 nt, Bordetella pertussis
ucgauacguucgcccgcgaaac

SEQ ID NO: 51065 - RNA, 22 nt, Bordetella pertussis
gccguccugguggcggugacgc

SEQ ID NO: 51066 - RNA, 22 nt, Bordetella pertussis
uucgcgcgugaugcccuggucg

SEQ ID NO: 51067 - RNA, 22 nt, Bordetella pertussis
cacgguggugccccacagcgcc

SEQ ID NO: 51068 - RNA, 22 nt, Bordetella pertussis
augacgguggcgcccagcgccc

SEQ ID NO: 51069 - RNA, 22 nt, Bordetella pertussis
gucaagaacaggcugacugccg

SEQ ID NO: 51070 - RNA, 21 nt, Bordetella pertussis
uguucgccgguucgggcggcg

SEQ ID NO: 51071 - RNA, 22 nt, Bordetella pertussis
uggugguggugaugucccacgg

SEQ ID NO: 51072 - RNA, 22 nt, Bordetella pertussis
caccuguuccaugccgcgucca

SEQ ID NO: 51073 - RNA, 22 nt, Bordetella pertussis
ggcgccgugguccauggccgcg

SEQ ID NO: 51074 - RNA, 22 nt, Bordetella pertussis
acgucgacgaagagguggccga

SEQ ID NO: 51075 - RNA, 22 nt, Bordetella pertussis
uucuacgucgacgcgcagcguc

SEQ ID NO: 51076 - RNA, 22 nt, Bordetella pertussis
gaugccaagcugcgcgagcacc

SEQ ID NO: 51077 - RNA, 22 nt, Bordetella pertussis
cugaugucgccgaugccgccau

SEQ ID NO: 51078 - RNA, 22 nt, Bordetella pertussis
aggauguugaagauggugcgca

SEQ ID NO: 51079 - RNA, 22 nt, Bordetella pertussis
cggcagcaucgucagcggcgug

SEQ ID NO: 51080 - RNA, 21 nt, Bordetella pertussis
cgguuucgucacggccugcgu

SEQ ID NO: 51081 - RNA, 22 nt, Bordetella pertussis
cuggccaucaacggacgcagcg

SEQ ID NO: 51082 - RNA, 22 nt, Bordetella pertussis
gauggccggaucggccaggaaa

SEQ ID NO: 51083 - RNA, 22 nt, Bordetella pertussis
uagaccggaaacucgauggcga

SEQ ID NO: 51084 - RNA, 22 nt, Bordetella pertussis
ccggagagcccgucgaagugcc

SEQ ID NO: 51085 - RNA, 22 nt, Bordetella pertussis
ggcguaccgcgaucaucugcug

SEQ ID NO: 51086 - RNA, 22 nt, Bordetella pertussis
gccgucuucggugauggcagcc

SEQ ID NO: 51087 - RNA, 20 nt, Bordetella pertussis
gggcaugcgccaggcgcgcc

SEQ ID NO: 51088 - RNA, 22 nt, Bordetella pertussis
ccugcgcgucgauugggaugag

SEQ ID NO: 51089 - RNA, 19 nt, Bordetella pertussis
ugcagcaggaucugcuggu

SEQ ID NO: 51090 - RNA, 22 nt, Bordetella pertussis
ggugcgcgugggcacccggccg

SEQ ID NO: 51091 - RNA, 21 nt, Bordetella pertussis
cgacuccgagaugaccguggu

SEQ ID NO: 51092 - RNA, 22 nt, Bordetella pertussis
aucauggcgguacgggucacgc

SEQ ID NO: 51093 - RNA, 22 nt, Bordetella pertussis
acgugcacaacggcgcgguguu

SEQ ID NO: 51094 - RNA, 22 nt, Bordetella pertussis
ggcaccccgcgcgucggggcag

SEQ ID NO: 51095 - RNA, 22 nt, Bordetella pertussis
caggccagguuccugggcgcgc

SEQ ID NO: 51096 - RNA, 22 nt, Bordetella pertussis
gcugcuguucgaccagcgcggc

SEQ ID NO: 51097 - RNA, 22 nt, Bordetella pertussis
gggccgcuguugcccugggacu

SEQ ID NO: 51098 - RNA, 22 nt, Bordetella pertussis
gcgcguucuggagcacgggccu

SEQ ID NO: 51099 - RNA, 22 nt, Bordetella pertussis
aggucgaacgucaggcgcacgg

SEQ ID NO: 51100 - RNA, 22 nt, Bordetella pertussis
gccgcaaugccgaaggccgcga

SEQ ID NO: 51101 - RNA, 22 nt, Bordetella pertussis
cgagccgaccagcggcgugggg

SEQ ID NO: 51102 - RNA, 22 nt, Bordetella pertussis
gccaccguggugcugguggcgu

SEQ ID NO: 51103 - RNA, 22 nt, Bordetella pertussis
aagcaguaccgaagcggcuuga

SEQ ID NO: 51104 - RNA, 22 nt, Bordetella pertussis
ccgguggauuucgggcgccugc

SEQ ID NO: 51105 - RNA, 22 nt, Bordetella pertussis
caagggcgugggagagugcgcc

SEQ ID NO: 51106 - RNA, 22 nt, Bordetella pertussis
ucuucggugagcucccguuccg

SEQ ID NO: 51107 - RNA, 22 nt, Bordetella pertussis
cagcgcggcgaacauggugcug

SEQ ID NO: 51108 - RNA, 22 nt, Bordetella pertussis
augcgcucgaggacgucgaugg

SEQ ID NO: 51109 - RNA, 22 nt, Bordetella pertussis
ugucgugcuggccgggcgcgcc

SEQ ID NO: 51110 - RNA, 18 nt, Bordetella pertussis
uggucgcccagcugacga

SEQ ID NO: 51111 - RNA, 22 nt, Bordetella pertussis
gguccuucggcggcacguccgu

SEQ ID NO: 51112 - RNA, 22 nt, Bordetella pertussis
aucuggcaucccuggcugccug

SEQ ID NO: 51113 - RNA, 22 nt, Bordetella pertussis
ugccuguccccggcggggacug

SEQ ID NO: 51114 - RNA, 22 nt, Bordetella pertussis
cagcgugccggcggcggucgua

SEQ ID NO: 51115 - RNA, 22 nt, Bordetella pertussis
augugcagcgccaccaggcugg

SEQ ID NO: 51116 - RNA, 22 nt, Bordetella pertussis
gggcuggucgauggcaugcuug

SEQ ID NO: 51117 - RNA, 20 nt, Bordetella pertussis
ggccuggauaauugggcgcg

SEQ ID NO: 51118 - RNA, 22 nt, Bordetella pertussis
gaccaugaccguaggcaugaug

SEQ ID NO: 51119 - RNA, 22 nt, Bordetella pertussis
uuccugcgugacgaagccgauc

SEQ ID NO: 51120 - RNA, 18 nt, Bordetella pertussis
aucagcagaaugccgugc

SEQ ID NO: 51121 - RNA, 22 nt, Bordetella pertussis
ggcgacacgcgcaccuggcagu

SEQ ID NO: 51122 - RNA, 22 nt, Bordetella pertussis
cgccaugugcgacgaauccauc

SEQ ID NO: 51123 - RNA, 22 nt, Bordetella pertussis
ggugcccaacaucgugaucccg

SEQ ID NO: 51124 - RNA, 22 nt, Bordetella pertussis
uggugggcggcauccgcgccuc

SEQ ID NO: 51125 - RNA, 22 nt, Bordetella pertussis
ugcgcgucgacggccagcucga

SEQ ID NO: 51126 - RNA, 22 nt, Bordetella pertussis
aaucgcgugccgacggcgucuu

SEQ ID NO: 51127 - RNA, 20 nt, Bordetella pertussis
gccgucaugcaggugccagc

SEQ ID NO: 51128 - RNA, 22 nt, Bordetella pertussis
gcgcgccggauagggguggauc

SEQ ID NO: 51129 - RNA, 22 nt, Bordetella pertussis
aucaaccgugcgcggauugcgc

SEQ ID NO: 51130 - RNA, 22 nt, Bordetella pertussis
gucgguccgggcagcgguugau

SEQ ID NO: 51131 - RNA, 22 nt, Bordetella pertussis
caggcccugcugcuggaauugc

SEQ ID NO: 51132 - RNA, 22 nt, Bordetella pertussis
gcgccacuuucauucccauggc

SEQ ID NO: 51133 - RNA, 22 nt, Bordetella pertussis
ccugcggcgccagccucacgcu

SEQ ID NO: 51134 - RNA, 20 nt, Bordetella pertussis
gauguucgucgagaagccgg

SEQ ID NO: 51135 - RNA, 22 nt, Bordetella pertussis
uguccccgcagggggacaggca

SEQ ID NO: 51136 - RNA, 22 nt, Bordetella pertussis
gaugcguucgauggcgcgcgug

SEQ ID NO: 51137 - RNA, 22 nt, Bordetella pertussis
aucgugcugaaguacggcgagc

SEQ ID NO: 51138 - RNA, 22 nt, Bordetella pertussis
ccgcgccugguauuucucgagg

SEQ ID NO: 51139 - RNA, 22 nt, Bordetella pertussis
accaggucgucguagcgggcgg

SEQ ID NO: 51140 - RNA, 22 nt, Bordetella pertussis
cggcuugagcgucggauccagg

SEQ ID NO: 51141 - RNA, 22 nt, Bordetella pertussis
accgcguugaagggcggcacgc

SEQ ID NO: 51142 - RNA, 20 nt, Bordetella pertussis
aucaggccaucgccagcggc

SEQ ID NO: 51143 - RNA, 22 nt, Bordetella pertussis
cggccgagucggccggcgugca

SEQ ID NO: 51144 - RNA, 22 nt, Bordetella pertussis
accacgccaucgcgccgcucga

SEQ ID NO: 51145 - RNA, 22 nt, Bordetella pertussis
acgcgaugucucgauagugauc

SEQ ID NO: 51146 - RNA, 22 nt, Bordetella pertussis
cacgggcauccucgaagcccag

SEQ ID NO: 51147 - RNA, 22 nt, Bordetella pertussis
guugcuggguucgucgagcagc

SEQ ID NO: 51148 - RNA, 22 nt, Bordetella pertussis
cgcguguugcgcaggucggggc

SEQ ID NO: 51149 - RNA, 22 nt, Bordetella pertussis
cuguacggccagcggccggcag

SEQ ID NO: 51150 - RNA, 22 nt, Bordetella pertussis
acgcagcagcaccuggacaucc

SEQ ID NO: 51151 - RNA, 22 nt, Bordetella pertussis
ggcggaugaucuugucgucgau

SEQ ID NO: 51152 - RNA, 22 nt, Bordetella pertussis
gcgcggccugauggcgccggug

SEQ ID NO: 51153 - RNA, 22 nt, Bordetella pertussis
ucgggcuuucgcagcgccgucg

SEQ ID NO: 51154 - RNA, 22 nt, Bordetella pertussis
gcccggaccgcgcugggccggc

SEQ ID NO: 51155 - RNA, 22 nt, Bordetella pertussis
cuggaucggcaacggcggcgcg

SEQ ID NO: 51156 - RNA, 22 nt, Bordetella pertussis
ccgcgcauguuucaaucggucu

SEQ ID NO: 51157 - RNA, 19 nt, Bordetella pertussis
ucgggccugcgcguggcca

SEQ ID NO: 51158 - RNA, 22 nt, Bordetella pertussis
cccuggugcagcacggcacgca

SEQ ID NO: 51159 - RNA, 22 nt, Bordetella pertussis
ggcauggagcucggucugccga

SEQ ID NO: 51160 - RNA, 22 nt, Bordetella pertussis
gcgcgcguucggcauggaggug

SEQ ID NO: 51161 - RNA, 22 nt, Bordetella pertussis
ugucgaccguaucgguauaggc

SEQ ID NO: 51162 - RNA, 22 nt, Bordetella pertussis
gcccuggcggccgucgaucucg

SEQ ID NO: 51163 - RNA, 23 nt, Bordetella pertussis
cgacgccacccuggaggcggccg

SEQ ID NO: 51164 - RNA, 22 nt, Bordetella pertussis
uccccgccagcccagcgaucug

SEQ ID NO: 51165 - RNA, 22 nt, Bordetella pertussis
augguggaccagcucgggcugg

SEQ ID NO: 51166 - RNA, 22 nt, Bordetella pertussis
cgcccgaguugcgcgaagcccu

SEQ ID NO: 51167 - RNA, 22 nt, Bordetella pertussis
gccaggucaagagcguggcgua

SEQ ID NO: 51168 - RNA, 22 nt, Bordetella pertussis
ccaggcccagcaguccggcggu

SEQ ID NO: 51169 - RNA, 22 nt, Bordetella pertussis
agccgcgucaggucgggccgcu

SEQ ID NO: 51170 - RNA, 22 nt, Bordetella pertussis
guucuucuugacgaugccgauc

SEQ ID NO: 51171 - RNA, 22 nt, Bordetella pertussis
ugccccgccaugucgucuccgu

SEQ ID NO: 51172 - RNA, 22 nt, Bordetella pertussis
gucggguuggccugcgccaugg

SEQ ID NO: 51173 - RNA, 22 nt, Bordetella pertussis
uugcgcaggguuucgaugucgu

SEQ ID NO: 51174 - RNA, 22 nt, Bordetella pertussis
ggcaaggugcuguucuauggcc

SEQ ID NO: 51175 - RNA, 22 nt, Bordetella pertussis
ccauggcgaucugcgcgccuuc

SEQ ID NO: 51176 - RNA, 22 nt, Bordetella pertussis
cggacugcgggaccaguaucgc

SEQ ID NO: 51177 - RNA, 22 nt, Bordetella pertussis
ugcagcacauggaucaucaggc

SEQ ID NO: 51178 - RNA, 20 nt, Bordetella pertussis
uguugcgcgugaugccgagc

SEQ ID NO: 51179 - RNA, 21 nt, Bordetella pertussis
gucgucggcgaccagcucgcg

SEQ ID NO: 51180 - RNA, 20 nt, Bordetella pertussis
acgcaugcgcagguaaagcc

SEQ ID NO: 51181 - RNA, 22 nt, Bordetella pertussis
gaccggcacccacggaguugcc

SEQ ID NO: 51182 - RNA, 22 nt, Bordetella pertussis
ccaccaggaugcuggcgaugau

SEQ ID NO: 51183 - RNA, 22 nt, Bordetella pertussis
cucgugcggcgugccgccguga

SEQ ID NO: 51184 - RNA, 22 nt, Bordetella pertussis
ugcuggacuucgcccgcacgcu

SEQ ID NO: 51185 - RNA, 22 nt, Bordetella pertussis
cggggugccugucccagcgggg

SEQ ID NO: 51186 - RNA, 22 nt, Bordetella pertussis
gcccucggccagcggcaucacg

SEQ ID NO: 51187 - RNA, 22 nt, Bordetella pertussis
ucggccuggccacggcgcuggu

SEQ ID NO: 51188 - RNA, 22 nt, Bordetella pertussis
gccgagcaaggcgaacagcguc

SEQ ID NO: 51189 - RNA, 22 nt, Bordetella pertussis
ugauggccgccuccagcgccug

SEQ ID NO: 51190 - RNA, 23 nt, Bordetella pertussis
cggcaugucauagcccaggucca

SEQ ID NO: 51191 - RNA, 22 nt, Bordetella pertussis
accaguucaccggcgcugucgc

SEQ ID NO: 51192 - RNA, 22 nt, Bordetella pertussis
accauguucugcggcgcguuga

SEQ ID NO: 51193 - RNA, 18 nt, Bordetella pertussis
gccgucgcggaacaccgg

SEQ ID NO: 51194 - RNA, 22 nt, Bordetella pertussis
guucgauuuauaaaugaggagg

SEQ ID NO: 51195 - RNA, 22 nt, Bordetella pertussis
gaggccgucuuuggcguauggg

SEQ ID NO: 51196 - RNA, 22 nt, Bordetella pertussis
agucccccaguggggacaggca

SEQ ID NO: 51197 - RNA, 22 nt, Bordetella pertussis
gaacugcagcguuucguggcgc

SEQ ID NO: 51198 - RNA, 22 nt, Bordetella pertussis
uccgguuccagcucggcauccg

SEQ ID NO: 51199 - RNA, 22 nt, Bordetella pertussis
gcgcgcugaccugggucagcac

SEQ ID NO: 51200 - RNA, 22 nt, Bordetella pertussis
gcccuugcggaagaagugccgg

SEQ ID NO: 51201 - RNA, 22 nt, Bordetella pertussis
cguccuugaccucggccagggg

SEQ ID NO: 51202 - RNA, 22 nt, Bordetella pertussis
ggccggaucggccggguugugg

SEQ ID NO: 51203 - RNA, 22 nt, Bordetella pertussis
cgaacgccgaugucgacccgcu

SEQ ID NO: 51204 - RNA, 22 nt, Bordetella pertussis
ugcccauggcguauggggcgcc

SEQ ID NO: 51205 - RNA, 20 nt, Bordetella pertussis
ucacgcucucgccgaucguc

SEQ ID NO: 51206 - RNA, 22 nt, Bordetella pertussis
gaccgccagggccaccgcauuu

SEQ ID NO: 51207 - RNA, 22 nt, Bordetella pertussis
ggccaucuggagcgccugcucg

SEQ ID NO: 51208 - RNA, 22 nt, Bordetella pertussis
ccggucaggaaggcugugggaa

SEQ ID NO: 51209 - RNA, 22 nt, Bordetella pertussis
acgaugcguuccagcucgucgg

SEQ ID NO: 51210 - RNA, 22 nt, Bordetella pertussis
ccacggcacugcucaccacgca

SEQ ID NO: 51211 - RNA, 22 nt, Bordetella pertussis
cgcggcgucguucggcauggug

SEQ ID NO: 51212 - RNA, 22 nt, Bordetella pertussis
gcuggacgcgggaucuaugcug

SEQ ID NO: 51213 - RNA, 22 nt, Bordetella pertussis
auccugccggugaucaacgaag

SEQ ID NO: 51214 - RNA, 22 nt, Bordetella pertussis
cccggccgaacugcugggugua

SEQ ID NO: 51215 - RNA, 22 nt, Bordetella pertussis
ggccuugagauaggcguccgac

SEQ ID NO: 51216 - RNA, 23 nt, Bordetella pertussis
acagcgcuugcgcgauuucggcc

SEQ ID NO: 51217 - RNA, 22 nt, Bordetella pertussis
agcugcaggauuugcgccugga

SEQ ID NO: 51218 - RNA, 22 nt, Bordetella pertussis
cccaguucgggggucaggucca

SEQ ID NO: 51219 - RNA, 19 nt, Bordetella pertussis
gcgggcgcccaggguggcc

SEQ ID NO: 51220 - RNA, 22 nt, Bordetella pertussis
gucgggcaggcgcaccaggugg

SEQ ID NO: 51221 - RNA, 22 nt, Bordetella pertussis
gccauggucaacucgcugaucg

SEQ ID NO: 51222 - RNA, 22 nt, Bordetella pertussis
gacgcugcuggacguggugcgc

SEQ ID NO: 51223 - RNA, 22 nt, Bordetella pertussis
cggagggguaucguuuaccugg

SEQ ID NO: 51224 - RNA, 23 nt, Bordetella pertussis
ugaacgagacgucggccagcucg

SEQ ID NO: 51225 - RNA, 22 nt, Bordetella pertussis
ccagcgccugauccaugaauug

SEQ ID NO: 51226 - RNA, 22 nt, Bordetella pertussis
ucaauggcgauuucgugaucgg

SEQ ID NO: 51227 - RNA, 22 nt, Bordetella pertussis
ccugguggcgcuggcgaugcug

SEQ ID NO: 51228 - RNA, 22 nt, Bordetella pertussis
gcggcgguacaggugcugugcg

SEQ ID NO: 51229 - RNA, 22 nt, Bordetella pertussis
gaugucgggcaggcgcagggcc

SEQ ID NO: 51230 - RNA, 22 nt, Bordetella pertussis
ccggccguggccgucgugcagc

SEQ ID NO: 51231 - RNA, 22 nt, Bordetella pertussis
aggacgcucgccgagguccggg

SEQ ID NO: 51232 - RNA, 22 nt, Bordetella pertussis
aucggcggugucgguauugguc

SEQ ID NO: 51233 - RNA, 22 nt, Bordetella pertussis
cugcugggcagcucuggcagcg

SEQ ID NO: 51234 - RNA, 22 nt, Bordetella pertussis
ggcggcgcgaucuugugguucu

SEQ ID NO: 51235 - RNA, 22 nt, Bordetella pertussis
gccagccggugccggccgacca

SEQ ID NO: 51236 - RNA, 22 nt, Bordetella pertussis
cggcgauaugauggaagacggu

SEQ ID NO: 51237 - RNA, 22 nt, Bordetella pertussis
augaugcgguugcuuucgcgca

SEQ ID NO: 51238 - RNA, 22 nt, Bordetella pertussis
cuucggccacgguaugcccagg

SEQ ID NO: 51239 - RNA, 22 nt, Bordetella pertussis
ccggccggugcucgaugccgcc

SEQ ID NO: 51240 - RNA, 22 nt, Bordetella pertussis
accugguccauggcggggaauu

SEQ ID NO: 51241 - RNA, 22 nt, Bordetella pertussis
guggcgcgcaugcagcgccuug

SEQ ID NO: 51242 - RNA, 22 nt, Bordetella pertussis
gcgcccgacuacaagcgaccgg

SEQ ID NO: 51243 - RNA, 22 nt, Bordetella pertussis
auggccuuggcggcgguggcga

SEQ ID NO: 51244 - RNA, 22 nt, Bordetella pertussis
uggccgucaccgaggcguugua

SEQ ID NO: 51245 - RNA, 21 nt, Bordetella pertussis
aucagcgcguaggcguggccc

SEQ ID NO: 51246 - RNA, 22 nt, Bordetella pertussis
ugggaucgguggcgcgcaaggu

SEQ ID NO: 51247 - RNA, 22 nt, Bordetella pertussis
ucgugcgccgacagcagcgcca

SEQ ID NO: 51248 - RNA, 22 nt, Bordetella pertussis
gccggugaacaugauguuccag

SEQ ID NO: 51249 - RNA, 22 nt, Bordetella pertussis
caccgccgcgcccugggacgag

SEQ ID NO: 51250 - RNA, 22 nt, Bordetella pertussis
ugcuggccaucgugcugaccuc

SEQ ID NO: 51251 - RNA, 22 nt, Bordetella pertussis
cccaucucgaagaagcguccca

SEQ ID NO: 51252 - RNA, 22 nt, Bordetella pertussis
cggccgaaggucaugcgguucu

SEQ ID NO: 51253 - RNA, 22 nt, Bordetella pertussis
uucggcgugacccgcccggggc

SEQ ID NO: 51254 - RNA, 22 nt, Bordetella pertussis
cgguggucgccucgucgguggg

SEQ ID NO: 51255 - RNA, 22 nt, Bordetella pertussis
ggccggggugcugcgcuuugcc

SEQ ID NO: 51256 - RNA, 22 nt, Bordetella pertussis
cguuccgccccgaguuccugaa

SEQ ID NO: 51257 - RNA, 22 nt, Bordetella pertussis
caccucgagcguggccggauug

SEQ ID NO: 51258 - RNA, 19 nt, Bordetella pertussis
gcuguuucccagcgcggug

SEQ ID NO: 51259 - RNA, 22 nt, Bordetella pertussis
ggcgggguuacucuugcagcug

SEQ ID NO: 51260 - RNA, 22 nt, Bordetella pertussis
gaucggcacgauuuuucgcugu

SEQ ID NO: 51261 - RNA, 22 nt, Bordetella pertussis
guccgggcaccgccguggugua

SEQ ID NO: 51262 - RNA, 22 nt, Bordetella pertussis
uaugccgugguggggcugacgc

SEQ ID NO: 51263 - RNA, 22 nt, Bordetella pertussis
ccgcgccacgcgcguggucaag

SEQ ID NO: 51264 - RNA, 22 nt, Bordetella pertussis
aggccgcgacauccaccgacca

SEQ ID NO: 51265 - RNA, 22 nt, Bordetella pertussis
ccugggcgaaguagcgcuggug

SEQ ID NO: 51266 - RNA, 22 nt, Bordetella pertussis
ugcgccuggaucugggccuggc

SEQ ID NO: 51267 - RNA, 22 nt, Bordetella pertussis
gugcagcgcuucgaccuggugg

SEQ ID NO: 51268 - RNA, 22 nt, Bordetella pertussis
cguguucaaggagcuggaagcc

SEQ ID NO: 51269 - RNA, 22 nt, Bordetella pertussis
cacaggcugcucguucuucauc

SEQ ID NO: 51270 - RNA, 22 nt, Bordetella pertussis
agaugggcgucgaugcgcguga

SEQ ID NO: 51271 - RNA, 22 nt, Bordetella pertussis
gccgccaugagccuggucgcgg

SEQ ID NO: 51272 - RNA, 22 nt, Bordetella pertussis
gcggcgcgagccgagucaggau

SEQ ID NO: 51273 - RNA, 22 nt, Bordetella pertussis
gccggcguugaccaggcgauug

SEQ ID NO: 51274 - RNA, 22 nt, Bordetella pertussis
ggcugcgcaacggcuaucgcaa

SEQ ID NO: 51275 - RNA, 22 nt, Bordetella pertussis
ugggcgagcgcugcacggccgu

SEQ ID NO: 51276 - RNA, 22 nt, Bordetella pertussis
ugcugcaggcgguucggguuuu

SEQ ID NO: 51277 - RNA, 22 nt, Bordetella pertussis
ccgccgccggcguacugauccg

SEQ ID NO: 51278 - RNA, 20 nt, Bordetella pertussis
caagccggugcugugcuggg

SEQ ID NO: 51279 - RNA, 22 nt, Bordetella pertussis
aagcggagaacugcugcggcgu

SEQ ID NO: 51280 - RNA, 22 nt, Bordetella pertussis
ucaagcuguacgaggggcugcg

SEQ ID NO: 51281 - RNA, 22 nt, Bordetella pertussis
ugcucgagcgugugguggcggc

SEQ ID NO: 51282 - RNA, 22 nt, Bordetella pertussis
uggcgcgcguacuccauggccu

SEQ ID NO: 51283 - RNA, 22 nt, Bordetella pertussis
guucgagcgagcuggcauucca

SEQ ID NO: 51284 - RNA, 22 nt, Bordetella pertussis
ggcgcuaggcgccggccacggu

SEQ ID NO: 51285 - RNA, 20 nt, Bordetella pertussis
uacaggcgcuucauguggcg

SEQ ID NO: 51286 - RNA, 19 nt, Bordetella pertussis
gggguugaucgccagcacc

SEQ ID NO: 51287 - RNA, 22 nt, Bordetella pertussis
gacgguggcguggcgcacgaug

SEQ ID NO: 51288 - RNA, 22 nt, Bordetella pertussis
ucgucacggaucauucaccaau

SEQ ID NO: 51289 - RNA, 22 nt, Bordetella pertussis
ugccuguccccgcugggacagg

SEQ ID NO: 51290 - RNA, 22 nt, Bordetella pertussis
cagcgggagccuguccccgcgg

SEQ ID NO: 51291 - RNA, 22 nt, Bordetella pertussis
gcauacuccgcguagcuggcga

SEQ ID NO: 51292 - RNA, 22 nt, Bordetella pertussis
uggccgccgggcugucgcgcuc

SEQ ID NO: 51293 - RNA, 22 nt, Bordetella pertussis
ugcagcgucuugucgagguucc

SEQ ID NO: 51294 - RNA, 22 nt, Bordetella pertussis
gugaccgacaccgugccguccu

SEQ ID NO: 51295 - RNA, 22 nt, Bordetella pertussis
ggcgugcuggguagugcaagua

SEQ ID NO: 51296 - RNA, 22 nt, Bordetella pertussis
cgcgagaucgucgacauggcgc

SEQ ID NO: 51297 - RNA, 22 nt, Bordetella pertussis
cagggcaucgaggaagcccugg

SEQ ID NO: 51298 - RNA, 20 nt, Bordetella pertussis
gccaguccagcggcucgcuc

SEQ ID NO: 51299 - RNA, 22 nt, Bordetella pertussis
cgagcagcaugacguugugccg

SEQ ID NO: 51300 - RNA, 22 nt, Bordetella pertussis
caggcgguccaggucgaugcgc

SEQ ID NO: 51301 - RNA, 22 nt, Bordetella pertussis
uccagcgugcgcgccaacgaca

SEQ ID NO: 51302 - RNA, 22 nt, Bordetella pertussis
cagcugcccaucgaacgcgugc

SEQ ID NO: 51303 - RNA, 22 nt, Bordetella pertussis
ccggccagcggcaacuggcgca

SEQ ID NO: 51304 - RNA, 22 nt, Bordetella pertussis
ccuggccgggcuguucgagcgg

SEQ ID NO: 51305 - RNA, 22 nt, Bordetella pertussis
ccacggacacgggcauggccac

SEQ ID NO: 51306 - RNA, 22 nt, Bordetella pertussis
gucggccauacgcugggccucg

SEQ ID NO: 51307 - RNA, 22 nt, Bordetella pertussis
auggccuguugcgaacccugca

SEQ ID NO: 51308 - RNA, 23 nt, Bordetella pertussis
auguggccaccucgcguggcgcu

SEQ ID NO: 51309 - RNA, 22 nt, Bordetella pertussis
uugacgcgacgcgaggcgcuga

SEQ ID NO: 51310 - RNA, 22 nt, Bordetella pertussis
agcggcacgcgcuggaauuggc

SEQ ID NO: 51311 - RNA, 22 nt, Bordetella pertussis
ccugaucccgcuggucgaccau

SEQ ID NO: 51312 - RNA, 22 nt, Bordetella pertussis
gcugcgcaauacgcugauggug

SEQ ID NO: 51313 - RNA, 22 nt, Bordetella pertussis
gcugccggucauguuucucgcg

SEQ ID NO: 51314 - RNA, 20 nt, Bordetella pertussis
agagccgcaugucggcgcgc

SEQ ID NO: 51315 - RNA, 23 nt, Bordetella pertussis
gacaggccucguguucggcggcg

SEQ ID NO: 51316 - RNA, 22 nt, Bordetella pertussis
gaucgacucgaugaugucguug

SEQ ID NO: 51317 - RNA, 22 nt, Bordetella pertussis
aaggcagcgccucgaucaccuc

SEQ ID NO: 51318 - RNA, 22 nt, Bordetella pertussis
cuuggucaggaagcgcaugcgc

SEQ ID NO: 51319 - RNA, 20 nt, Bordetella pertussis
cuggucaacgacaccaugau

SEQ ID NO: 51320 - RNA, 22 nt, Bordetella pertussis
auucugggccuaucugcccggg

SEQ ID NO: 51321 - RNA, 22 nt, Bordetella pertussis
uggcuguguauuaugccaagcc

SEQ ID NO: 51322 - RNA, 22 nt, Bordetella pertussis
ggccuugcccgcgccgaugucg

SEQ ID NO: 51323 - RNA, 22 nt, Bordetella pertussis
gagccgcccaccgcgguggugg

SEQ ID NO: 51324 - RNA, 22 nt, Bordetella pertussis
gccaccaggccgucggccaggg

SEQ ID NO: 51325 - RNA, 22 nt, Bordetella pertussis
cguggcguucgugccggugggc

SEQ ID NO: 51326 - RNA, 21 nt, Bordetella pertussis
ucauccaggccuguugcgagc

SEQ ID NO: 51327 - RNA, 22 nt, Bordetella pertussis
ccggaucgagcggguugcccuu

SEQ ID NO: 51328 - RNA, 22 nt, Bordetella pertussis
caucuugcgccgaaaacgcgca

SEQ ID NO: 51329 - RNA, 22 nt, Bordetella pertussis
uguucggcgaccaccaugccua

SEQ ID NO: 51330 - RNA, 22 nt, Bordetella pertussis
ccggcgugcugcagcgccugca

SEQ ID NO: 51331 - RNA, 22 nt, Bordetella pertussis
agcgcccgaugaugcguccgau

SEQ ID NO: 51332 - RNA, 22 nt, Bordetella pertussis
aaaagcugcucuagcaucaacg

SEQ ID NO: 51333 - RNA, 22 nt, Bordetella pertussis
ucgcggacaagagcuucaccuu

SEQ ID NO: 51334 - RNA, 22 nt, Bordetella pertussis
ggcgauggcgaagucgugguac

SEQ ID NO: 51335 - RNA, 22 nt, Bordetella pertussis
ucccauggcgcggggacgccgc

SEQ ID NO: 51336 - RNA, 22 nt, Bordetella pertussis
ggccuggguugcggucaugccg

SEQ ID NO: 51337 - RNA, 22 nt, Bordetella pertussis
agguagccgauguucagccccg

SEQ ID NO: 51338 - RNA, 20 nt, Bordetella pertussis
cgugaugcgcaccguaucca

SEQ ID NO: 51339 - RNA, 22 nt, Bordetella pertussis
gcccugguagcaggcauggugc

SEQ ID NO: 51340 - RNA, 22 nt, Bordetella pertussis
gaucuccaucagccauugcggu

SEQ ID NO: 51341 - RNA, 22 nt, Bordetella pertussis
cagcaaggccugcucggugggc

SEQ ID NO: 51342 - RNA, 22 nt, Bordetella pertussis
ucuggcucugggacaccggcga

SEQ ID NO: 51343 - RNA, 22 nt, Bordetella pertussis
ucgcgcgucauguuuuccuggu

SEQ ID NO: 51344 - RNA, 22 nt, Bordetella pertussis
guuggcgcauccggcguggcaa

SEQ ID NO: 51345 - RNA, 22 nt, Bordetella pertussis
ugggccugcugggcaaccuggu

SEQ ID NO: 51346 - RNA, 22 nt, Bordetella pertussis
caguccccgccggggacaggca

SEQ ID NO: 51347 - RNA, 22 nt, Bordetella pertussis
ccagguucaugggcguacggaa

SEQ ID NO: 51348 - RNA, 22 nt, Bordetella pertussis
ugcccgggcugugcgagguggc

SEQ ID NO: 51349 - RNA, 22 nt, Bordetella pertussis
acgaggcggggcggauugcgcu

SEQ ID NO: 51350 - RNA, 18 nt, Bordetella pertussis
ccugcugcgccagcgcgc

SEQ ID NO: 51351 - RNA, 22 nt, Bordetella pertussis
ccaugcaggaauaccgccggcu

SEQ ID NO: 51352 - RNA, 22 nt, Bordetella pertussis
gcggcuaccuucccgaacgcgu

SEQ ID NO: 51353 - RNA, 22 nt, Bordetella pertussis
cggucugcuugugcagcgaacg

SEQ ID NO: 51354 - RNA, 22 nt, Bordetella pertussis
cuugggccggcgguucuggcac

SEQ ID NO: 51355 - RNA, 22 nt, Bordetella pertussis
agggugccuguccccgcggaga

SEQ ID NO: 51356 - RNA, 22 nt, Bordetella pertussis
cacgccaccacgcgauccggag

SEQ ID NO: 51357 - RNA, 22 nt, Bordetella pertussis
aggccggcgcggccgggucuuc

SEQ ID NO: 51358 - RNA, 22 nt, Bordetella pertussis
augcugaccggcucgaugaacg

SEQ ID NO: 51359 - RNA, 22 nt, Bordetella pertussis
gagcagaccgaguucaccguug

SEQ ID NO: 51360 - RNA, 22 nt, Bordetella pertussis
agcgaugaaagaagagccgcgc

SEQ ID NO: 51361 - RNA, 22 nt, Bordetella pertussis
gccgccgcaucgccgucauggc

SEQ ID NO: 51362 - RNA, 22 nt, Bordetella pertussis
cugugggcgcgacgcgccgacc

SEQ ID NO: 51363 - RNA, 22 nt, Bordetella pertussis
cgucgagcuggucggcgaagac

SEQ ID NO: 51364 - RNA, 22 nt, Bordetella pertussis
aggccgacgccgccgguaacga

SEQ ID NO: 51365 - RNA, 22 nt, Bordetella pertussis
cgacgcgggcgcguuggugcug

SEQ ID NO: 51366 - RNA, 20 nt, Bordetella pertussis
gaccggcgaucccgccacga

SEQ ID NO: 51367 - RNA, 22 nt, Bordetella pertussis
cugggcuucgaggaugcccgug

SEQ ID NO: 51368 - RNA, 22 nt, Bordetella pertussis
ccggugcgcggaaucagcgccg

SEQ ID NO: 51369 - RNA, 22 nt, Bordetella pertussis
gccgucgugcagcgugggcucg

SEQ ID NO: 51370 - RNA, 22 nt, Bordetella pertussis
ggcgcgauccugguggugucgg

SEQ ID NO: 51371 - RNA, 22 nt, Bordetella pertussis
cgccgcuucggcugcgaucugu

SEQ ID NO: 51372 - RNA, 22 nt, Bordetella pertussis
ccugcugcagucgcccuauggc

SEQ ID NO: 51373 - RNA, 22 nt, Bordetella pertussis
agcgugcuggccaggcccaccc

SEQ ID NO: 51374 - RNA, 22 nt, Bordetella pertussis
agggccugcguuucgcuggcau

SEQ ID NO: 51375 - RNA, 23 nt, Bordetella pertussis
ucgagcgucgcgucggccugugc

SEQ ID NO: 51376 - RNA, 22 nt, Bordetella pertussis
gugggcuuguccuugcugucca

SEQ ID NO: 51377 - RNA, 22 nt, Bordetella pertussis
cagcuggccgagcagggcgugg

SEQ ID NO: 51378 - RNA, 22 nt, Bordetella pertussis
gcgacgauuuccggcugauggc

SEQ ID NO: 51379 - RNA, 19 nt, Bordetella pertussis
gcucgcguccugcgccugc

SEQ ID NO: 51380 - RNA, 23 nt, Bordetella pertussis
acggugggcucgauacugggcgg

SEQ ID NO: 51381 - RNA, 22 nt, Bordetella pertussis
gcauggacucgaucucgauggc

SEQ ID NO: 51382 - RNA, 22 nt, Bordetella pertussis
uuggccagguucucgauggugg

SEQ ID NO: 51383 - RNA, 22 nt, Bordetella pertussis
gcguaucgauuaucccgggcgc

SEQ ID NO: 51384 - RNA, 22 nt, Bordetella pertussis
gccgggccgaucagguugcggc

SEQ ID NO: 51385 - RNA, 22 nt, Bordetella pertussis
ccaggcggccagcacggcggga

SEQ ID NO: 51386 - RNA, 22 nt, Bordetella pertussis
cgcgcacgaccuuguugaucga

SEQ ID NO: 51387 - RNA, 22 nt, Bordetella pertussis
cgagcggcgcuccauggugggc

SEQ ID NO: 51388 - RNA, 22 nt, Bordetella pertussis
uucagguggugcgcgacccgcg

SEQ ID NO: 51389 - RNA, 22 nt, Bordetella pertussis
gcgacaccuugacgcccggcag

SEQ ID NO: 51390 - RNA, 22 nt, Bordetella pertussis
cgcaauguagccaagcccgcuu

SEQ ID NO: 51391 - RNA, 22 nt, Bordetella pertussis
aagaaggccgggcugacgcuca

SEQ ID NO: 51392 - RNA, 22 nt, Bordetella pertussis
ucgucggcaugggcgaaucgcg

SEQ ID NO: 51393 - RNA, 22 nt, Bordetella pertussis
gugccgucggccagccuggcca

SEQ ID NO: 51394 - RNA, 22 nt, Bordetella pertussis
ucgaucagcaugcgcgauucca

SEQ ID NO: 51395 - RNA, 22 nt, Bordetella pertussis
uugcgcaguaucucggugucga

SEQ ID NO: 51396 - RNA, 22 nt, Bordetella pertussis
cgggcuugagcacgaccuggua

SEQ ID NO: 51397 - RNA, 22 nt, Bordetella pertussis
ggcaccuugcaggccaucaagg

SEQ ID NO: 51398 - RNA, 22 nt, Bordetella pertussis
aggggucggccaucugccguug

SEQ ID NO: 51399 - RNA, 22 nt, Bordetella pertussis
uggucguggucaugauggucgu

SEQ ID NO: 51400 - RNA, 22 nt, Bordetella pertussis
cgugccgcgcgauccggacugc

SEQ ID NO: 51401 - RNA, 22 nt, Bordetella pertussis
ccggccugaggcccgauggcgg

SEQ ID NO: 51402 - RNA, 22 nt, Bordetella pertussis
gcgucgauggcgcgggcgugac

SEQ ID NO: 51403 - RNA, 18 nt, Bordetella pertussis
auggcgcugacggcccgc

SEQ ID NO: 51404 - RNA, 18 nt, Bordetella pertussis
uggaccuggucgucgguc

SEQ ID NO: 51405 - RNA, 22 nt, Bordetella pertussis
agcgcgacgaugugggccaggc

SEQ ID NO: 51406 - RNA, 22 nt, Bordetella pertussis
ccgcgccgggguccggauacug

SEQ ID NO: 51407 - RNA, 22 nt, Bordetella pertussis
agccauguccugcaggccuuug

SEQ ID NO: 51408 - RNA, 21 nt, Bordetella pertussis
aucagcgcgaucagggugaac

SEQ ID NO: 51409 - RNA, 22 nt, Bordetella pertussis
ucaugaacugcacguucguguc

SEQ ID NO: 51410 - RNA, 22 nt, Bordetella pertussis
uccagcccaggcuggccgccgg

SEQ ID NO: 51411 - RNA, 22 nt, Bordetella pertussis
cuauggccguaguccugaccgg

SEQ ID NO: 51412 - RNA, 22 nt, Bordetella pertussis
ucaggcgagcugcugucgcugg

SEQ ID NO: 51413 - RNA, 22 nt, Bordetella pertussis
ccggucuauaccgugcccaugc

SEQ ID NO: 51414 - RNA, 22 nt, Bordetella pertussis
gcgcgguugagcaccacgucgu

SEQ ID NO: 51415 - RNA, 22 nt, Bordetella pertussis
cgccaugaguuucgauccgcgg

SEQ ID NO: 51416 - RNA, 22 nt, Bordetella pertussis
gggcuucaugcaggacgugcgc

SEQ ID NO: 51417 - RNA, 22 nt, Bordetella pertussis
ugguggcgcccgugguguagcc

SEQ ID NO: 51418 - RNA, 22 nt, Bordetella pertussis
gccuacuuuucuacgccagauc

SEQ ID NO: 51419 - RNA, 22 nt, Bordetella pertussis
guccgggcgaugagcgccaggc

SEQ ID NO: 51420 - RNA, 22 nt, Bordetella pertussis
ccggccugcucaagcccucggc

SEQ ID NO: 51421 - RNA, 22 nt, Bordetella pertussis
gcuggucgacgauuccaucgug

SEQ ID NO: 51422 - RNA, 22 nt, Bordetella pertussis
ucggacagcgcgaaaggcuugg

SEQ ID NO: 51423 - RNA, 22 nt, Bordetella pertussis
ggcuggaggugucgcauggcgu

SEQ ID NO: 51424 - RNA, 22 nt, Bordetella pertussis
ggccaucggcguaugggccgcc

SEQ ID NO: 51425 - RNA, 22 nt, Bordetella pertussis
ggccugauguucggccaggcgu

SEQ ID NO: 51426 - RNA, 22 nt, Bordetella pertussis
ccaggcccuugacgcgcuguuc

SEQ ID NO: 51427 - RNA, 22 nt, Bordetella pertussis
ccagcagcagcgcguggcgcug

SEQ ID NO: 51428 - RNA, 22 nt, Bordetella pertussis
acgauggacaggccgaccgcca

SEQ ID NO: 51429 - RNA, 22 nt, Bordetella pertussis
gcgcgcauucgaucgaagacau

SEQ ID NO: 51430 - RNA, 22 nt, Bordetella pertussis
cacgaugcggcgcucgaccggc

SEQ ID NO: 51431 - RNA, 22 nt, Bordetella pertussis
auggcgggcaaaaaccuucagg

SEQ ID NO: 51432 - RNA, 22 nt, Bordetella pertussis
uggccaggucgauggccuggug

SEQ ID NO: 51433 - RNA, 22 nt, Bordetella pertussis
ggcgcuggcccugaucgacgug

SEQ ID NO: 51434 - RNA, 22 nt, Bordetella pertussis
uacgcgucgacgaccaggccgg

SEQ ID NO: 51435 - RNA, 22 nt, Bordetella pertussis
uugacgggcaauuucgugacga

SEQ ID NO: 51436 - RNA, 22 nt, Bordetella pertussis
cauggauguugaccagcacggg

SEQ ID NO: 51437 - RNA, 22 nt, Bordetella pertussis
gcgcugccagcgcuaugugguc

SEQ ID NO: 51438 - RNA, 22 nt, Bordetella pertussis
ucggcgccauaggcggucaugg

SEQ ID NO: 51439 - RNA, 22 nt, Bordetella pertussis
aaaucguuguacaugaccgggu

SEQ ID NO: 51440 - RNA, 22 nt, Bordetella pertussis
ucgccgaugcuguucggcaucu

SEQ ID NO: 51441 - RNA, 22 nt, Bordetella pertussis
aguucgcguucgaucgacggca

SEQ ID NO: 51442 - RNA, 22 nt, Bordetella pertussis
caccuggcuggagccggcgcgg

SEQ ID NO: 51443 - RNA, 22 nt, Bordetella pertussis
guagcgccggcacagcucgacc

SEQ ID NO: 51444 - RNA, 22 nt, Bordetella pertussis
gcgucauggccgauacgaucag

SEQ ID NO: 51445 - RNA, 22 nt, Bordetella pertussis
cucgggcggcuacggcaccucg

SEQ ID NO: 51446 - RNA, 22 nt, Bordetella pertussis
gccgcgucggcaugauguucca

SEQ ID NO: 51447 - RNA, 22 nt, Bordetella pertussis
gugcccggugcccggcguggcg

SEQ ID NO: 51448 - RNA, 22 nt, Bordetella pertussis
acgugcuggucaaccugcuggu

SEQ ID NO: 51449 - RNA, 22 nt, Bordetella pertussis
uccugcgggggcaggcaccccg

SEQ ID NO: 51450 - RNA, 22 nt, Bordetella pertussis
ugccgguguccuucacccacgg

SEQ ID NO: 51451 - RNA, 19 nt, Bordetella pertussis
ggagccgggcgacgaggcc

SEQ ID NO: 51452 - RNA, 22 nt, Bordetella pertussis
ccagcaggugcgugucggcaaa

SEQ ID NO: 51453 - RNA, 22 nt, Bordetella pertussis
agcccggcaguucuucgagcac

SEQ ID NO: 51454 - RNA, 22 nt, Bordetella pertussis
gucggcaaguucgaccugcuca

SEQ ID NO: 51455 - RNA, 22 nt, Bordetella pertussis
ggccggugcuguacgcccgcuu

SEQ ID NO: 51456 - RNA, 22 nt, Bordetella pertussis
uggcgcuggcggugcuggagac

SEQ ID NO: 51457 - RNA, 22 nt, Bordetella pertussis
gccuuuuccucgucgcgccggg

SEQ ID NO: 51458 - RNA, 22 nt, Bordetella pertussis
ugaugcuggugacugcgcucaa

SEQ ID NO: 51459 - RNA, 22 nt, Bordetella pertussis
acgcccuggguguucugcgcgg

SEQ ID NO: 51460 - RNA, 22 nt, Bordetella pertussis
cugguuuuacgcugcgcggauu

SEQ ID NO: 51461 - RNA, 22 nt, Bordetella pertussis
aaggcgcgcagaucgccauggc

SEQ ID NO: 51462 - RNA, 22 nt, Bordetella pertussis
caggccgacgaacgcagcaugu

SEQ ID NO: 51463 - RNA, 22 nt, Bordetella pertussis
gcuggauucgcguuuuuucagc

SEQ ID NO: 51464 - RNA, 22 nt, Bordetella pertussis
ugccgcggccgacgagcuggcc

SEQ ID NO: 51465 - RNA, 22 nt, Bordetella pertussis
uugccgcaugucugacucugcu

SEQ ID NO: 51466 - RNA, 22 nt, Bordetella pertussis
aggccaccaagaauucgaugcc

SEQ ID NO: 51467 - RNA, 22 nt, Bordetella pertussis
ugcuggccgccaccggcggcca

SEQ ID NO: 51468 - RNA, 22 nt, Bordetella pertussis
auucgcgcaugggcgaugggcg

SEQ ID NO: 51469 - RNA, 22 nt, Bordetella pertussis
gcuuggucagggccucggcggg

SEQ ID NO: 51470 - RNA, 22 nt, Bordetella pertussis
ugcugcgccgcuggcugucguc

SEQ ID NO: 51471 - RNA, 22 nt, Bordetella pertussis
ugggcacgccaagggcaguggc

SEQ ID NO: 51472 - RNA, 22 nt, Bordetella pertussis
cugcugaucuggucggcgccgc

SEQ ID NO: 51473 - RNA, 22 nt, Bordetella pertussis
ucgccgucggggccggucaguu

SEQ ID NO: 51474 - RNA, 22 nt, Bordetella pertussis
augcccgaagccagcgccaggc

SEQ ID NO: 51475 - RNA, 22 nt, Bordetella pertussis
ccgaggccaggaucucgcgcgc

SEQ ID NO: 51476 - RNA, 22 nt, Bordetella pertussis
ggcgcgccuggugggagcgacc

SEQ ID NO: 51477 - RNA, 22 nt, Bordetella pertussis
guugcaugcgcugcgccgcuau

SEQ ID NO: 51478 - RNA, 22 nt, Bordetella pertussis
ugcccggucgacugcaucgaca

SEQ ID NO: 51479 - RNA, 21 nt, Bordetella pertussis
cgcuggacgacaucgccgcgc

SEQ ID NO: 51480 - RNA, 22 nt, Bordetella pertussis
ccaugccgacaccggcacggug

SEQ ID NO: 51481 - RNA, 22 nt, Bordetella pertussis
gcccaccccuucaugcguuggc

SEQ ID NO: 51482 - RNA, 21 nt, Bordetella pertussis
acgcccgccagcgcggccagg

SEQ ID NO: 51483 - RNA, 22 nt, Bordetella pertussis
uugucgccaugggcgcauagcc

SEQ ID NO: 51484 - RNA, 22 nt, Bordetella pertussis
uccaggucaaucuuugcggcua

SEQ ID NO: 51485 - RNA, 21 nt, Bordetella pertussis
gcgagaaauacucgacgcgcc

SEQ ID NO: 51486 - RNA, 22 nt, Bordetella pertussis
uggcgucgaagaugggcaugcc

SEQ ID NO: 51487 - RNA, 22 nt, Bordetella pertussis
ccggugggcaaggacucgcugu

SEQ ID NO: 51488 - RNA, 22 nt, Bordetella pertussis
gcacuacgcggugucgaucgcg

SEQ ID NO: 51489 - RNA, 22 nt, Bordetella pertussis
ugcaccccuacgugcugguuuc

SEQ ID NO: 51490 - RNA, 22 nt, Bordetella pertussis
uggcggccagggccaggccgau

SEQ ID NO: 51491 - RNA, 22 nt, Bordetella pertussis
ggcguaaugccaggugccgcug

SEQ ID NO: 51492 - RNA, 22 nt, Bordetella pertussis
cggccggccaaucuguucgucg

SEQ ID NO: 51493 - RNA, 22 nt, Bordetella pertussis
ucgugcaagagcaugcauaucg

SEQ ID NO: 51494 - RNA, 22 nt, Bordetella pertussis
auccgucggccacgaauuucuc

SEQ ID NO: 51495 - RNA, 22 nt, Bordetella pertussis
uggucggguucgugcgcaaggu

SEQ ID NO: 51496 - RNA, 19 nt, Bordetella pertussis
ccgaccuggcgcuauggcu

SEQ ID NO: 51497 - RNA, 22 nt, Bordetella pertussis
aaggcgcaggcgugcgauggcc

SEQ ID NO: 51498 - RNA, 22 nt, Bordetella pertussis
uauccucgaugucgcucagcga

SEQ ID NO: 51499 - RNA, 23 nt, Bordetella pertussis
ggcuggucuggccaaucacguac

SEQ ID NO: 51500 - RNA, 22 nt, Bordetella pertussis
gcgaucaggcaaaaaacgccaa

SEQ ID NO: 51501 - RNA, 22 nt, Bordetella pertussis
uggccacgcgcuugaucagauc

SEQ ID NO: 51502 - RNA, 22 nt, Bordetella pertussis
cggcagguugaaguugcucggc

SEQ ID NO: 51503 - RNA, 22 nt, Bordetella pertussis
gccgagcgucaauucgucaaca

SEQ ID NO: 51504 - RNA, 22 nt, Bordetella pertussis
acgcggaaucggccccucagcg

SEQ ID NO: 51505 - RNA, 17 nt, Bordetella pertussis
cggcacgcuucaccugu

SEQ ID NO: 51506 - RNA, 22 nt, Bordetella pertussis
ggcgcugaacuggccgccgguc

SEQ ID NO: 51507 - RNA, 22 nt, Bordetella pertussis
cgccgacggccagcccauccgc

SEQ ID NO: 51508 - RNA, 22 nt, Bordetella pertussis
cggccaggggauuggauucggu

SEQ ID NO: 51509 - RNA, 22 nt, Bordetella pertussis
aucgcaggaauugcguguacca

SEQ ID NO: 51510 - RNA, 22 nt, Bordetella pertussis
aucaaggaagucgugugggacg

SEQ ID NO: 51511 - RNA, 22 nt, Bordetella pertussis
aggagcgcugcaucgcgugcaa

SEQ ID NO: 51512 - RNA, 22 nt, Bordetella pertussis
cgggcgguuucuucaagcgcga

SEQ ID NO: 51513 - RNA, 22 nt, Bordetella pertussis
gagccugguacccguggggcau

SEQ ID NO: 51514 - RNA, 22 nt, Bordetella pertussis
uggcccgcuggagcgccaucgc

SEQ ID NO: 51515 - RNA, 22 nt, Bordetella pertussis
gccgcugcaacugcuggcugac

SEQ ID NO: 51516 - RNA, 22 nt, Bordetella pertussis
cagccccgccgcuucgaugacg

SEQ ID NO: 51517 - RNA, 22 nt, Bordetella pertussis
cgacggcgccggacaccaguug

SEQ ID NO: 51518 - RNA, 22 nt, Bordetella pertussis
gcggaugcccaugaguucgguc

SEQ ID NO: 51519 - RNA, 22 nt, Bordetella pertussis
ucguugcgcuguugguccagcu

SEQ ID NO: 51520 - RNA, 22 nt, Bordetella pertussis
ccugaugaugaucgcgcuguac

SEQ ID NO: 51521 - RNA, 22 nt, Bordetella pertussis
gccgaucagcgacagcggcacc

SEQ ID NO: 51522 - RNA, 22 nt, Bordetella pertussis
gcgcccaggucggccaccaggu

SEQ ID NO: 51523 - RNA, 22 nt, Bordetella pertussis
agcagcgggcgcgucccuuccu

SEQ ID NO: 51524 - RNA, 22 nt, Bordetella pertussis
ugaugcuggccgauggcagccg

SEQ ID NO: 51525 - RNA, 22 nt, Bordetella pertussis
ugagcgacuacgguuucggcgc

SEQ ID NO: 51526 - RNA, 22 nt, Bordetella pertussis
cgcguucguuggaguacgacca

SEQ ID NO: 51527 - RNA, 21 nt, Bordetella pertussis
guggggcuucaucggcgccau

SEQ ID NO: 51528 - RNA, 22 nt, Bordetella pertussis
gcagcgcgugcgccaguugcag

SEQ ID NO: 51529 - RNA, 22 nt, Bordetella pertussis
uucgucgccauagaggaugcgg

SEQ ID NO: 51530 - RNA, 22 nt, Bordetella pertussis
ugugcgccgaauagcggcggug

SEQ ID NO: 51531 - RNA, 22 nt, Bordetella pertussis
uggccuggcugagcggcagccu

SEQ ID NO: 51532 - RNA, 21 nt, Bordetella pertussis
gcgagguaugcguaucgggcg

SEQ ID NO: 51533 - RNA, 22 nt, Bordetella pertussis
ccggguuucaucgaugugcacg

SEQ ID NO: 51534 - RNA, 22 nt, Bordetella pertussis
auccgcaucggcgaccgugacg

SEQ ID NO: 51535 - RNA, 22 nt, Bordetella pertussis
ucgacgucgggcagcagguggc

SEQ ID NO: 51536 - RNA, 16 nt, Bordetella pertussis
cgcucgaucauggugc

SEQ ID NO: 51537 - RNA, 22 nt, Bordetella pertussis
cgcacgaugucguggccgucgg

SEQ ID NO: 51538 - RNA, 22 nt, Bordetella pertussis
uugccgaugcccugugcgaacu

SEQ ID NO: 51539 - RNA, 22 nt, Bordetella pertussis
caugcgcgaggucgucgaucug

SEQ ID NO: 51540 - RNA, 22 nt, Bordetella pertussis
cuggcgauccugcacgaugugc

SEQ ID NO: 51541 - RNA, 22 nt, Bordetella pertussis
agccugcugcauccgcgcguca

SEQ ID NO: 51542 - RNA, 22 nt, Bordetella pertussis
ugcugguaauucgacagcgccg

SEQ ID NO: 51543 - RNA, 22 nt, Bordetella pertussis
augcugaucgcccgccugccgu

SEQ ID NO: 51544 - RNA, 22 nt, Bordetella pertussis
gccgggccugcuguucggcugg

SEQ ID NO: 51545 - RNA, 22 nt, Bordetella pertussis
agcgugacggcgcgcugccaug

SEQ ID NO: 51546 - RNA, 22 nt, Bordetella pertussis
aucaggcgcgaggucagcguuu

SEQ ID NO: 51547 - RNA, 22 nt, Bordetella pertussis
auccaguuucgcgacgugggcg

SEQ ID NO: 51548 - RNA, 22 nt, Bordetella pertussis
cgcgacgacgaguauggcggca

SEQ ID NO: 51549 - RNA, 22 nt, Bordetella pertussis
aggccgucaucgcggcgcaucc

SEQ ID NO: 51550 - RNA, 22 nt, Bordetella pertussis
gugccuguccccgcagggggac

SEQ ID NO: 51551 - RNA, 22 nt, Bordetella pertussis
gcagcgucugggggcugcagac

SEQ ID NO: 51552 - RNA, 22 nt, Bordetella pertussis
cgcgacgucuggcugacggcuu

SEQ ID NO: 51553 - RNA, 22 nt, Bordetella pertussis
caugcgcgacguggauuucaag

SEQ ID NO: 51554 - RNA, 22 nt, Bordetella pertussis
ccgaccagcagccgguauaugg

SEQ ID NO: 51555 - RNA, 22 nt, Bordetella pertussis
agcgcuccgcgcuguugccuga

SEQ ID NO: 51556 - RNA, 22 nt, Bordetella pertussis
gagcgcgacaucaccgcgcuca

SEQ ID NO: 51557 - RNA, 19 nt, Bordetella pertussis
ggcgccuacuacgcccagg

SEQ ID NO: 51558 - RNA, 22 nt, Bordetella pertussis
gaugcugaucagguugccggcc

SEQ ID NO: 51559 - RNA, 22 nt, Bordetella pertussis
agccggucuggaucaggaccug

SEQ ID NO: 51560 - RNA, 21 nt, Bordetella pertussis
cgaagaauacgcugacgucgu

SEQ ID NO: 51561 - RNA, 22 nt, Bordetella pertussis
gaucagcgucaggggguucucg

SEQ ID NO: 51562 - RNA, 22 nt, Bordetella pertussis
uugcgccaguccaggcggggcc

SEQ ID NO: 51563 - RNA, 22 nt, Bordetella pertussis
cgccuggcccacaucgucgcgc

SEQ ID NO: 51564 - RNA, 22 nt, Bordetella pertussis
aggcugccgccgccguggccga

SEQ ID NO: 51565 - RNA, 19 nt, Bordetella pertussis
ccaggccggccuggccaug

SEQ ID NO: 51566 - RNA, 22 nt, Bordetella pertussis
uggcgaugaucgugaugauggu

SEQ ID NO: 51567 - RNA, 22 nt, Bordetella pertussis
ggugcucgcgcagcuuggcauc

SEQ ID NO: 51568 - RNA, 22 nt, Bordetella pertussis
cgggccuggcccgccauccgcg

SEQ ID NO: 51569 - RNA, 22 nt, Bordetella pertussis
aacugguguggcgcaugcugcc

SEQ ID NO: 51570 - RNA, 22 nt, Bordetella pertussis
cagcgucuccaggaagccggcg

SEQ ID NO: 51571 - RNA, 17 nt, Bordetella pertussis
cugucguaugucgagca

SEQ ID NO: 51572 - RNA, 22 nt, Bordetella pertussis
uuggcgccgcugcggcccaggc

SEQ ID NO: 51573 - RNA, 19 nt, Bordetella pertussis
uugcgcaacggacgaucga

SEQ ID NO: 51574 - RNA, 22 nt, Bordetella pertussis
caucgucaagcuggcgcuggac

SEQ ID NO: 51575 - RNA, 22 nt, Bordetella pertussis
gcccggccagcagguccugcgc

SEQ ID NO: 51576 - RNA, 22 nt, Bordetella pertussis
gcacagcugcaugagcgcgggu

SEQ ID NO: 51577 - RNA, 22 nt, Bordetella pertussis
ugaacaccggguucucgggaua

SEQ ID NO: 51578 - RNA, 22 nt, Bordetella pertussis
gccgugcugcugucgaccgaca

SEQ ID NO: 51579 - RNA, 22 nt, Bordetella pertussis
caggucgacgaagcguucgaug

SEQ ID NO: 51580 - RNA, 22 nt, Bordetella pertussis
gcgaucauggugccggucggcg

SEQ ID NO: 51581 - RNA, 22 nt, Bordetella pertussis
gccgaucugcugcgucaggccg

SEQ ID NO: 51582 - RNA, 22 nt, Bordetella pertussis
cggccuguccaucaugugcuuc

SEQ ID NO: 51583 - RNA, 22 nt, Bordetella pertussis
gcgcugcugacggugcugccca

SEQ ID NO: 51584 - RNA, 20 nt, Bordetella pertussis
uggccgaccugcccgucgug

SEQ ID NO: 51585 - RNA, 22 nt, Bordetella pertussis
uaccuggacucggucucgcugc

SEQ ID NO: 51586 - RNA, 19 nt, Bordetella pertussis
cuugucggucgggccgguc

SEQ ID NO: 51587 - RNA, 22 nt, Bordetella pertussis
gcaugcaggugguugaagcgca

SEQ ID NO: 51588 - RNA, 22 nt, Bordetella pertussis
ugccagccgggccuuuuccgcc

SEQ ID NO: 51589 - RNA, 22 nt, Bordetella pertussis
cgcacgcugaugcgccuugucg

SEQ ID NO: 51590 - RNA, 18 nt, Bordetella pertussis
cgucccgagcugaucgaa

SEQ ID NO: 51591 - RNA, 22 nt, Bordetella pertussis
ucugcucgcuggcgaugaggcg

SEQ ID NO: 51592 - RNA, 22 nt, Bordetella pertussis
agucaggcuacaggaaucauuc

SEQ ID NO: 51593 - RNA, 22 nt, Bordetella pertussis
uucgauggccaccggcgagguc

SEQ ID NO: 51594 - RNA, 22 nt, Bordetella pertussis
ucuggcugacgcacgacccgca

SEQ ID NO: 51595 - RNA, 22 nt, Bordetella pertussis
cggcgccgauccggccggccag

SEQ ID NO: 51596 - RNA, 22 nt, Bordetella pertussis
ggcgcuguuccuggacggaucg

SEQ ID NO: 51597 - RNA, 22 nt, Bordetella pertussis
agcggcuggaaaucgcgcugcg

SEQ ID NO: 51598 - RNA, 22 nt, Bordetella pertussis
ggggcgcgcacgagcucgaagu

SEQ ID NO: 51599 - RNA, 22 nt, Bordetella pertussis
cuggcccagcggcagguaggug

SEQ ID NO: 51600 - RNA, 22 nt, Bordetella pertussis
ucggcuaugcccugcuggcggc

SEQ ID NO: 51601 - RNA, 22 nt, Bordetella pertussis
ccagcgugcaugagcagggaca

SEQ ID NO: 51602 - RNA, 19 nt, Bordetella pertussis
uccagcccgccauggacau

SEQ ID NO: 51603 - RNA, 22 nt, Bordetella pertussis
uccgcucguaguccuugaccau

SEQ ID NO: 51604 - RNA, 22 nt, Bordetella pertussis
aaggccgaggucggccuguucc

SEQ ID NO: 51605 - RNA, 22 nt, Bordetella pertussis
cgccauugagcgccacgcugcu

SEQ ID NO: 51606 - RNA, 22 nt, Bordetella pertussis
cucgggcgucagcugcucgacc

SEQ ID NO: 51607 - RNA, 21 nt, Bordetella pertussis
ucgccgccuuccucgagcugg

SEQ ID NO: 51608 - RNA, 22 nt, Bordetella pertussis
cgcacaccacccugcagccggg

SEQ ID NO: 51609 - RNA, 22 nt, Bordetella pertussis
cagaacgauguuggccugcuug

SEQ ID NO: 51610 - RNA, 22 nt, Bordetella pertussis
cgcgcgggucggacuggccgcc

SEQ ID NO: 51611 - RNA, 22 nt, Bordetella pertussis
cggcccaguucuuggggaugag

SEQ ID NO: 51612 - RNA, 22 nt, Bordetella pertussis
uggcuggagcugaccggccauc

SEQ ID NO: 51613 - RNA, 22 nt, Bordetella pertussis
guacggcacuucgacauggugc

SEQ ID NO: 51614 - RNA, 22 nt, Bordetella pertussis
ccugcuggcgcacgaugaacug

SEQ ID NO: 51615 - RNA, 19 nt, Bordetella pertussis
ugaacauguuaugcagcgu

SEQ ID NO: 51616 - RNA, 22 nt, Bordetella pertussis
acgcccaggguagccaguuuuu

SEQ ID NO: 51617 - RNA, 22 nt, Bordetella pertussis
ggcgcacucucccacgcccuug

SEQ ID NO: 51618 - RNA, 22 nt, Bordetella pertussis
gcggucgacuacguggggguau

SEQ ID NO: 51619 - RNA, 22 nt, Bordetella pertussis
gccauggugccgcguuuucucg

SEQ ID NO: 51620 - RNA, 22 nt, Bordetella pertussis
gcgucgauggcgccguggguga

SEQ ID NO: 51621 - RNA, 22 nt, Bordetella pertussis
gcgccacgacgucgguaaugcu

SEQ ID NO: 51622 - RNA, 22 nt, Bordetella pertussis
ucacgcgcaucgacgcccaucu

SEQ ID NO: 51623 - RNA, 21 nt, Bordetella pertussis
ugucgcgguacgcgugcugga

SEQ ID NO: 51624 - RNA, 22 nt, Bordetella pertussis
uggcccagcgaauuguugcgcg

SEQ ID NO: 51625 - RNA, 22 nt, Bordetella pertussis
ugcucgacaucccgauggccga

SEQ ID NO: 51626 - RNA, 22 nt, Bordetella pertussis
cgcgaugaaucccgaccgacug

SEQ ID NO: 51627 - RNA, 22 nt, Bordetella pertussis
aucaugagguucuugaugcgca

SEQ ID NO: 51628 - RNA, 22 nt, Bordetella pertussis
ugggcggccgacacgaucgccu

SEQ ID NO: 51629 - RNA, 22 nt, Bordetella pertussis
gccggcgguggugcugcugacg

SEQ ID NO: 51630 - RNA, 22 nt, Bordetella pertussis
ggcgcugcgcuacggcgagaac

SEQ ID NO: 51631 - RNA, 19 nt, Bordetella pertussis
uugccagacgaucagcgac

SEQ ID NO: 51632 - RNA, 22 nt, Bordetella pertussis
gccgccaugagcgauguggacc

SEQ ID NO: 51633 - RNA, 22 nt, Bordetella pertussis
gcgcgaucaccaggucuggccc

SEQ ID NO: 51634 - RNA, 22 nt, Bordetella pertussis
ggcgcgcagguccugauccaga

SEQ ID NO: 51635 - RNA, 22 nt, Bordetella pertussis
uugaugcuggacgacgcgcugu

SEQ ID NO: 51636 - RNA, 22 nt, Bordetella pertussis
gcugggcguggcccugugcguc

SEQ ID NO: 51637 - RNA, 22 nt, Bordetella pertussis
aagcugcuggucaggccgguuu

SEQ ID NO: 51638 - RNA, 22 nt, Bordetella pertussis
acuccaucaggcagcucaugcg

SEQ ID NO: 51639 - RNA, 22 nt, Bordetella pertussis
caaggacgaaaccugggccgac

SEQ ID NO: 51640 - RNA, 22 nt, Bordetella pertussis
ggugcuggccggggccgaacgg

SEQ ID NO: 51641 - RNA, 22 nt, Bordetella pertussis
gcauggcgcggcaugacgccgg

SEQ ID NO: 51642 - RNA, 22 nt, Bordetella pertussis
uccagcagcagaucgagaaucc

SEQ ID NO: 51643 - RNA, 22 nt, Bordetella pertussis
caagggccagguugguuuuccc

SEQ ID NO: 51644 - RNA, 22 nt, Bordetella pertussis
acaccgcugccgccuugcugaa

SEQ ID NO: 51645 - RNA, 22 nt, Bordetella pertussis
uguggauguucucccugguggu

SEQ ID NO: 51646 - RNA, 22 nt, Bordetella pertussis
uugggcaguuccugcagcaggc

SEQ ID NO: 51647 - RNA, 22 nt, Bordetella pertussis
gccugaaggugaucugcugcag

SEQ ID NO: 51648 - RNA, 22 nt, Bordetella pertussis
gccgcguuguuugccggcggcc

SEQ ID NO: 51649 - RNA, 22 nt, Bordetella pertussis
uugcaccgcaugaacgcguuuu

SEQ ID NO: 51650 - RNA, 22 nt, Bordetella pertussis
guauuucggccgcagccugugg

SEQ ID NO: 51651 - RNA, 23 nt, Bordetella pertussis
uggccgcugcugucggccucggc

SEQ ID NO: 51652 - RNA, 22 nt, Bordetella pertussis
cgcucagcgggccgagcgacag

SEQ ID NO: 51653 - RNA, 22 nt, Bordetella pertussis
gugcguuggcugcgccggcugg

SEQ ID NO: 51654 - RNA, 22 nt, Bordetella pertussis
gcccgucaccgugaugcgaccg

SEQ ID NO: 51655 - RNA, 22 nt, Bordetella pertussis
caggcgggcgaauucggccugg

SEQ ID NO: 51656 - RNA, 22 nt, Bordetella pertussis
gcaugccgagaucacgucguuc

SEQ ID NO: 51657 - RNA, 22 nt, Bordetella pertussis
ucagcgccaacgccgucgccaa

SEQ ID NO: 51658 - RNA, 22 nt, Bordetella pertussis
augcgccuggauucgggugucg

SEQ ID NO: 51659 - RNA, 22 nt, Bordetella pertussis
cugggccuguguaucguggcgg

SEQ ID NO: 51660 - RNA, 22 nt, Bordetella pertussis
agcuggugcaccgcaucggcaa

SEQ ID NO: 51661 - RNA, 22 nt, Bordetella pertussis
ggccagcaauccagcacgauca

SEQ ID NO: 51662 - RNA, 22 nt, Bordetella pertussis
cagccgguggucggcagcgcga

SEQ ID NO: 51663 - RNA, 22 nt, Bordetella pertussis
guguccuggaugccgcgcacga

SEQ ID NO: 51664 - RNA, 22 nt, Bordetella pertussis
gaugauguagcgcgugacgcgc

SEQ ID NO: 51665 - RNA, 22 nt, Bordetella pertussis
gagcucgaagucgacaacuggg

SEQ ID NO: 51666 - RNA, 22 nt, Bordetella pertussis
ucgugguggugacggugguuuu

SEQ ID NO: 51667 - RNA, 19 nt, Bordetella pertussis
cggcgacgggcugucggug

SEQ ID NO: 51668 - RNA, 22 nt, Bordetella pertussis
cgccauccuccagcuccagcag

SEQ ID NO: 51669 - RNA, 19 nt, Bordetella pertussis
ggcggcuuccugcgcggcc

SEQ ID NO: 51670 - RNA, 22 nt, Bordetella pertussis
gggugcgucagggcagcgugga

SEQ ID NO: 51671 - RNA, 22 nt, Bordetella pertussis
ucgaggcguucgggccggugcg

SEQ ID NO: 51672 - RNA, 20 nt, Bordetella pertussis
gcgcaccgcggcaacguucu

SEQ ID NO: 51673 - RNA, 22 nt, Bordetella pertussis
aaagccugacgcuggucgagcu

SEQ ID NO: 51674 - RNA, 22 nt, Bordetella pertussis
uacggcugcgacagcgcaucga

SEQ ID NO: 51675 - RNA, 22 nt, Bordetella pertussis
gcguuaucgaugucuguagcaa

SEQ ID NO: 51676 - RNA, 22 nt, Bordetella pertussis
gccccgggcggucugccugggc

SEQ ID NO: 51677 - RNA, 22 nt, Bordetella pertussis
cucgcuggcgcagcccaggcag

SEQ ID NO: 51678 - RNA, 22 nt, Bordetella pertussis
gacggcacggcacaggucgacg

SEQ ID NO: 51679 - RNA, 22 nt, Bordetella pertussis
cugggucugcucgaucugcagg

SEQ ID NO: 51680 - RNA, 22 nt, Bordetella pertussis
uccgccuucgaggcugguuucg

SEQ ID NO: 51681 - RNA, 22 nt, Bordetella pertussis
uggcgaugcugcgcggcagcac

SEQ ID NO: 51682 - RNA, 22 nt, Bordetella pertussis
gugcggucguucaaggauccgu

SEQ ID NO: 51683 - RNA, 22 nt, Bordetella pertussis
ugcggcugguaggccgacuuga

SEQ ID NO: 51684 - RNA, 22 nt, Bordetella pertussis
uaugacggggagccugucccgg

SEQ ID NO: 51685 - RNA, 22 nt, Bordetella pertussis
cgcugaccgauaugcuggagca

SEQ ID NO: 51686 - RNA, 22 nt, Bordetella pertussis
cgcggggucgucgagcugcgcc

SEQ ID NO: 51687 - RNA, 22 nt, Bordetella pertussis
acagcagcuggcuggucaccau

SEQ ID NO: 51688 - RNA, 22 nt, Bordetella pertussis
ucgcgcacguccugcaugaagc

SEQ ID NO: 51689 - RNA, 22 nt, Bordetella pertussis
ugguguacggccugucgcgcgc

SEQ ID NO: 51690 - RNA, 22 nt, Bordetella pertussis
cuggcgggugccggcggccacg

SEQ ID NO: 51691 - RNA, 22 nt, Bordetella pertussis
ucggugcugguggcggccgcgc

SEQ ID NO: 51692 - RNA, 22 nt, Bordetella pertussis
ccuguucggucagcaguuccau

SEQ ID NO: 51693 - RNA, 22 nt, Bordetella pertussis
cgagaucacccugcugacggug

SEQ ID NO: 51694 - RNA, 22 nt, Bordetella pertussis
ugccugcgccaccaugcgggug

SEQ ID NO: 51695 - RNA, 22 nt, Bordetella pertussis
gucgcgcagcaauuguuccaau

SEQ ID NO: 51696 - RNA, 22 nt, Bordetella pertussis
uacgcuggguacggcgcugcgc

SEQ ID NO: 51697 - RNA, 22 nt, Bordetella pertussis
cccgccuggaagcgcuugcgcg

SEQ ID NO: 51698 - RNA, 22 nt, Bordetella pertussis
ugcuggacaagcccgugaccug

SEQ ID NO: 51699 - RNA, 20 nt, Bordetella pertussis
cguuccuguaccagggcgcc

SEQ ID NO: 51700 - RNA, 22 nt, Bordetella pertussis
cgcggccucguggacgcgcugg

SEQ ID NO: 51701 - RNA, 22 nt, Bordetella pertussis
guuggucgaggugucgccgucg

SEQ ID NO: 51702 - RNA, 22 nt, Bordetella pertussis
gauguccaggccgcgcagcauc

SEQ ID NO: 51703 - RNA, 22 nt, Bordetella pertussis
uggcagcgcaucuucuggucca

SEQ ID NO: 51704 - RNA, 22 nt, Bordetella pertussis
aucgaugagcacgguuccguca

SEQ ID NO: 51705 - RNA, 22 nt, Bordetella pertussis
gcgguuccggaggcaggcgccu

SEQ ID NO: 51706 - RNA, 22 nt, Bordetella pertussis
auaugcccaugucgcgccagcu

SEQ ID NO: 51707 - RNA, 22 nt, Bordetella pertussis
aacgugcggcugcgcaucaugg

SEQ ID NO: 51708 - RNA, 22 nt, Bordetella pertussis
augucugauacagccgccagug

SEQ ID NO: 51709 - RNA, 22 nt, Bordetella pertussis
uucgacaugcgugccuuccgga

SEQ ID NO: 51710 - RNA, 22 nt, Bordetella pertussis
agguccacaucgaagucgccga

SEQ ID NO: 51711 - RNA, 22 nt, Bordetella pertussis
agccgcuggugaccgagggcgc

SEQ ID NO: 51712 - RNA, 18 nt, Bordetella pertussis
ugcucgaccgacggacug

SEQ ID NO: 51713 - RNA, 22 nt, Bordetella pertussis
gccgcgccggacagcugguacc

SEQ ID NO: 51714 - RNA, 22 nt, Bordetella pertussis
cgccgcgucgaccuugaccgcg

SEQ ID NO: 51715 - RNA, 22 nt, Bordetella pertussis
cugaacuacugccaccugcuga

SEQ ID NO: 51716 - RNA, 22 nt, Bordetella pertussis
ugcgccugaugccgccgguguu

SEQ ID NO: 51717 - RNA, 22 nt, Bordetella pertussis
gcguugaugaccggucgccagg

SEQ ID NO: 51718 - RNA, 22 nt, Bordetella pertussis
cgcugcucaaucgucuggugca

SEQ ID NO: 51719 - RNA, 22 nt, Bordetella pertussis
gcgugcucaccaccgaggacgc

SEQ ID NO: 51720 - RNA, 22 nt, Bordetella pertussis
cugaaguccuucgccgacaauu

SEQ ID NO: 51721 - RNA, 22 nt, Bordetella pertussis
ggccggcggcgugacccggcug

SEQ ID NO: 51722 - RNA, 20 nt, Bordetella pertussis
accggcguguggcuggucgu

SEQ ID NO: 51723 - RNA, 22 nt, Bordetella pertussis
cgacaggccgcucuuggugaug

SEQ ID NO: 51724 - RNA, 22 nt, Bordetella pertussis
agggcugucugcugggcgcgcg

SEQ ID NO: 51725 - RNA, 22 nt, Bordetella pertussis
cgcggugguguagaugaaaccg

SEQ ID NO: 51726 - RNA, 22 nt, Bordetella pertussis
uugucgcugggcuucgaugugu

SEQ ID NO: 51727 - RNA, 22 nt, Bordetella pertussis
ugcugcgcauccugcaggaggu

SEQ ID NO: 51728 - RNA, 20 nt, Bordetella pertussis
uggcaacgccgcccgcguuc

SEQ ID NO: 51729 - RNA, 22 nt, Bordetella pertussis
gugcgggugaucgaucggguuc

SEQ ID NO: 51730 - RNA, 22 nt, Bordetella pertussis
aggucggguggaaugcugagcg

SEQ ID NO: 51731 - RNA, 22 nt, Bordetella pertussis
aagaacaagggcgucaacaggg

SEQ ID NO: 51732 - RNA, 22 nt, Bordetella pertussis
ccuuccgcauacagcgugucga

SEQ ID NO: 51733 - RNA, 22 nt, Bordetella pertussis
gcuccguuggagccgaugacgg

SEQ ID NO: 51734 - RNA, 22 nt, Bordetella pertussis
ucguucaucccgcugcugaccc

SEQ ID NO: 51735 - RNA, 22 nt, Bordetella pertussis
augagcucguugccagcucauc

SEQ ID NO: 51736 - RNA, 22 nt, Bordetella pertussis
cgcgcucaauccggagaucgcc

SEQ ID NO: 51737 - RNA, 22 nt, Bordetella pertussis
ccaggccaggucgccauggccg

SEQ ID NO: 51738 - RNA, 22 nt, Bordetella pertussis
auggcauggcacucguucggcg

SEQ ID NO: 51739 - RNA, 22 nt, Bordetella pertussis
cgcuggcgguuucggcgggcag

SEQ ID NO: 51740 - RNA, 21 nt, Bordetella pertussis
cggccgcgaagaccuggcgau

SEQ ID NO: 51741 - RNA, 22 nt, Bordetella pertussis
ggcgcggccuuccugcaucugc

SEQ ID NO: 51742 - RNA, 22 nt, Bordetella pertussis
aauccgcaggccgcggcgcuga

SEQ ID NO: 51743 - RNA, 22 nt, Bordetella pertussis
ggccguugcgccaccccuacga

SEQ ID NO: 51744 - RNA, 22 nt, Bordetella pertussis
guggcgauggcgaugucgucga

SEQ ID NO: 51745 - RNA, 22 nt, Bordetella pertussis
cguguggaugcguucgucggcc

SEQ ID NO: 51746 - RNA, 22 nt, Bordetella pertussis
caccagauacugcgccuggccc

SEQ ID NO: 51747 - RNA, 22 nt, Bordetella pertussis
ggcgcauuccagcgcggccggg

SEQ ID NO: 51748 - RNA, 22 nt, Bordetella pertussis
cgugugggccguggccgguacg

SEQ ID NO: 51749 - RNA, 22 nt, Bordetella pertussis
ccguugcagcaccgccuggccg

SEQ ID NO: 51750 - RNA, 22 nt, Bordetella pertussis
augccgagguccugcuggcgca

SEQ ID NO: 51751 - RNA, 22 nt, Bordetella pertussis
cccgugcaccgagauggcguag

SEQ ID NO: 51752 - RNA, 22 nt, Bordetella pertussis
cgcgaugaugggcauggccggc

SEQ ID NO: 51753 - RNA, 22 nt, Bordetella pertussis
uggaugaaggcaccgccgcggc

SEQ ID NO: 51754 - RNA, 22 nt, Bordetella pertussis
uauggccaggcggccugcucgc

SEQ ID NO: 51755 - RNA, 22 nt, Bordetella pertussis
cggcgcgcugaccucgcuggcc

SEQ ID NO: 51756 - RNA, 22 nt, Bordetella pertussis
gauggcguugucgaccagguug

SEQ ID NO: 51757 - RNA, 22 nt, Bordetella pertussis
agcgugugcauggccagcggca

SEQ ID NO: 51758 - RNA, 22 nt, Bordetella pertussis
gcgccagggccgugcuggaagg

SEQ ID NO: 51759 - RNA, 22 nt, Bordetella pertussis
cgucgucggugaucagguagcg

SEQ ID NO: 51760 - RNA, 22 nt, Bordetella pertussis
cugcugucgaugcgcgccuggc

SEQ ID NO: 51761 - RNA, 22 nt, Bordetella pertussis
ugccaugccuggcgcaccagcg

SEQ ID NO: 51762 - RNA, 22 nt, Bordetella pertussis
ugugcgcccugaucgacgcugu

SEQ ID NO: 51763 - RNA, 22 nt, Bordetella pertussis
gcccaagaucucgucgucgcug

SEQ ID NO: 51764 - RNA, 22 nt, Bordetella pertussis
ggcgcccuugcaugcgcgucaa

SEQ ID NO: 51765 - RNA, 22 nt, Bordetella pertussis
caccagguugaacaucuccugg

SEQ ID NO: 51766 - RNA, 22 nt, Bordetella pertussis
gggguacucguguucaaccgug

SEQ ID NO: 51767 - RNA, 22 nt, Bordetella pertussis
cccggcuggaagucggugaccu

SEQ ID NO: 51768 - RNA, 22 nt, Bordetella pertussis
caucaccugcugaugucggcgg

SEQ ID NO: 51769 - RNA, 22 nt, Bordetella pertussis
ugccgcgcaucaugaucucgug

SEQ ID NO: 51770 - RNA, 22 nt, Bordetella pertussis
cgagaacaucuucuuguacggu

SEQ ID NO: 51771 - RNA, 22 nt, Bordetella pertussis
cgugcuggccgauagaaaggcc

SEQ ID NO: 51772 - RNA, 22 nt, Bordetella pertussis
uucggcgugcgcgccgacaaca

SEQ ID NO: 51773 - RNA, 22 nt, Bordetella pertussis
ggugccuguccccgcggggaca

SEQ ID NO: 51774 - RNA, 22 nt, Bordetella pertussis
cgucgccgcccaggcggaucga

SEQ ID NO: 51775 - RNA, 23 nt, Bordetella pertussis
accaccaggcccguggagaucgg

SEQ ID NO: 51776 - RNA, 22 nt, Bordetella pertussis
ggcugugcuacugaugcggcaa

SEQ ID NO: 51777 - RNA, 22 nt, Bordetella pertussis
aaggcagcgccucgaucaccuc

SEQ ID NO: 51778 - RNA, 22 nt, Bordetella pertussis
aagggcagcgugcuggccauca

SEQ ID NO: 51779 - RNA, 22 nt, Bordetella pertussis
acagcaggaugucggcggccau

SEQ ID NO: 51780 - RNA, 22 nt, Bordetella pertussis
acuguaaaccuuuuagaagugc

SEQ ID NO: 51781 - RNA, 22 nt, Bordetella pertussis
agggccugcguuucgcuggcau

SEQ ID NO: 51782 - RNA, 23 nt, Bordetella pertussis
agugggcagggugcaugcgcgcc

SEQ ID NO: 51783 - RNA, 22 nt, Bordetella pertussis
auagacuuuggcgcuugauucc

SEQ ID NO: 51784 - RNA, 22 nt, Bordetella pertussis
augugcagcgccaccaggcugg

SEQ ID NO: 51785 - RNA, 22 nt, Bordetella pertussis
caccagauacugcgccuggccc

SEQ ID NO: 51786 - RNA, 22 nt, Bordetella pertussis
cgaccagaucaugcgcuugggu

SEQ ID NO: 51787 - RNA, 22 nt, Bordetella pertussis
cgcagcucgugcgagacguugg

SEQ ID NO: 51788 - RNA, 22 nt, Bordetella pertussis
cguggaugauggccucggcgcg

SEQ ID NO: 51789 - RNA, 22 nt, Bordetella pertussis
cgugugggccguggccgguacg

SEQ ID NO: 51790 - RNA, 22 nt, Bordetella pertussis
cuacaacaugaagcugccgcca

SEQ ID NO: 51791 - RNA, 22 nt, Bordetella pertussis
cuauuguuuugguaaauggaaa

SEQ ID NO: 51792 - RNA, 22 nt, Bordetella pertussis
gaacucuuccgcaaagcggucg

SEQ ID NO: 51793 - RNA, 22 nt, Bordetella pertussis
gaacugcagcguuucguggcgc

SEQ ID NO: 51794 - RNA, 22 nt, Bordetella pertussis
gacggcacggcacaggucgacg

SEQ ID NO: 51795 - RNA, 22 nt, Bordetella pertussis
gcauacaaccuauugaaucuuc

SEQ ID NO: 51796 - RNA, 22 nt, Bordetella pertussis
gccagccggugccggccgacca

SEQ ID NO: 51797 - RNA, 22 nt, Bordetella pertussis
gcuguagcugaagccgucggcc

SEQ ID NO: 51798 - RNA, 22 nt, Bordetella pertussis
ggcagcucggccucgggcgcca

SEQ ID NO: 51799 - RNA, 22 nt, Bordetella pertussis
ggcauccugcacaguccggacg

SEQ ID NO: 51800 - RNA, 22 nt, Bordetella pertussis
ggccgugggcgccgacgugcgu

SEQ ID NO: 51801 - RNA, 22 nt, Bordetella pertussis
gugcgagccgcucaggcccgcg

SEQ ID NO: 51802 - RNA, 22 nt, Bordetella pertussis
gugcugugaacgucaguugcgg

SEQ ID NO: 51803 - RNA, 22 nt, Bordetella pertussis
uggcagcagaucgacuacggcu

SEQ ID NO: 51804 - RNA, 22 nt, Bordetella pertussis
ugugaagucgaugugguacucg

SEQ ID NO: 51805 - RNA, 22 nt, Bordetella pertussis
uguggauguucucccugguggu

SEQ ID NO: 51806 - RNA, 22 nt, Bordetella pertussis
uguuccauugccuucugaaccg

SEQ ID NO: 51807 - RNA, 22 nt, Bordetella pertussis
aaaagcugcucuagcaucaacg

SEQ ID NO: 51808 - RNA, 22 nt, Bordetella pertussis
aagaaggccgggcugacgcuca

SEQ ID NO: 51809 - RNA, 22 nt, Bordetella pertussis
agcugccagccguccacgaugu

SEQ ID NO: 51810 - RNA, 22 nt, Bordetella pertussis
agcuggugcaccgcaucggcaa

SEQ ID NO: 51811 - RNA, 22 nt, Bordetella pertussis
ccagcaggugcgugucggcaaa

SEQ ID NO: 51812 - RNA, 22 nt, Bordetella pertussis
ccagggacgggagggugccgaa

SEQ ID NO: 51813 - RNA, 22 nt, Bordetella pertussis
ccuguauggcgcugauggccgg

SEQ ID NO: 51814 - RNA, 22 nt, Bordetella pertussis
ccuguccccgcggggacggaua

SEQ ID NO: 51815 - RNA, 21 nt, Bordetella pertussis
cgaagaauacgcugacgucgu

SEQ ID NO: 51816 - RNA, 22 nt, Bordetella pertussis
cggccuguccaucaugugcuuc

SEQ ID NO: 51817 - RNA, 22 nt, Bordetella pertussis
cggcagcaucgucagcggcgug

SEQ ID NO: 51818 - RNA, 22 nt, Bordetella pertussis
cgggccuggcccgccauccgcg

SEQ ID NO: 51819 - RNA, 22 nt, Bordetella pertussis
gaucuccaucagccauugcggu

SEQ ID NO: 51820 - RNA, 22 nt, Bordetella pertussis
gccgugugcuugaugaauggag

SEQ ID NO: 51821 - RNA, 22 nt, Bordetella pertussis
gcgugggcauuuugcugcgccc

SEQ ID NO: 51822 - RNA, 19 nt, Bordetella pertussis
ugcagcaggaucugcuggu

SEQ ID NO: 51823 - RNA, 22 nt, Bordetella pertussis
uggaaaaugcgcucgcggaugu

SEQ ID NO: 51824 - RNA, 22 nt, Bordetella pertussis
uggaccagcucgcgggcgcgau

SEQ ID NO: 51825 - RNA, 22 nt, Bordetella pertussis
ugggccugcugggcaaccuggu

SEQ ID NO: 51826 - RNA, 22 nt, Bordetella pertussis
uucuucagggcgaccuugaaca

SEQ ID NO: 51827 - RNA, 22 nt, Bordetella pertussis
uugauggcgaauuccuuggugu

SEQ ID NO: 51828 - RNA, 20 nt, Human
aaacucucugaucuuacagu

SEQ ID NO: 51829 - RNA, 22 nt, Human
aaacugcuuucucugccuuucc

SEQ ID NO: 51830 - RNA, 22 nt, Human
aaagaacguuucugggaaucag

SEQ ID NO: 51831 - RNA, 21 nt, Human
aaagaagagcucagagguaga

SEQ ID NO: 51832 - RNA, 22 nt, Human
aaagagccaacuaccgcaaauu

SEQ ID NO: 51833 - RNA, 22 nt, Human
aaagagacaacaacaacuucua

SEQ ID NO: 51834 - RNA, 22 nt, Human
aaauucggggaguuuugaggau

SEQ ID NO: 51835 - RNA, 20 nt, Human
aaauucgacuaaaaccagaa

SEQ ID NO: 51836 - RNA, 22 nt, Human
aacaaaacauuuuacgaauaua

SEQ ID NO: 51837 - RNA, 22 nt, Human
aaccagaagucaucagagcuga

SEQ ID NO: 51838 - RNA, 22 nt, Human
aacagggcaguuccuuauagug

SEQ ID NO: 51839 - RNA, 22 nt, Human
aacagggcgugaauaaugaaga

SEQ ID NO: 51840 - RNA, 22 nt, Human
aaccauggauuucaguucaccu

SEQ ID NO: 51841 - RNA, 22 nt, Human
aacaucugagagcccuugugca

SEQ ID NO: 51842 - RNA, 22 nt, Human
aaccucgggcugcacuuggcac

SEQ ID NO: 51843 - RNA, 22 nt, Human
aaccaggcgagagagcggucag

SEQ ID NO: 51844 - RNA, 22 nt, Human
aacccugaacuuaguucuagga

SEQ ID NO: 51845 - RNA, 22 nt, Human
aaccggauugauccuucuuuga

SEQ ID NO: 51846 - RNA, 22 nt, Human
aacgagcugggggggccggggg

SEQ ID NO: 51847 - RNA, 22 nt, Human
aacgcagagaguaaugcugaac

SEQ ID NO: 51848 - RNA, 22 nt, Human
aacgccgggacucgcagggagc

SEQ ID NO: 51849 - RNA, 22 nt, Human
aacccuguuguguacaugcaua

SEQ ID NO: 51850 - RNA, 22 nt, Human
aacgcugugcacuggguccagg

SEQ ID NO: 51851 - RNA, 22 nt, Human
aaccugagggcaggaccccaua

SEQ ID NO: 51852 - RNA, 22 nt, Human
aaccuggguguacauuaugguc

SEQ ID NO: 51853 - RNA, 22 nt, Human
aacgaugauaaauuguucucug

SEQ ID NO: 51854 - RNA, 22 nt, Human
aacgugcuuuacaaaugaccuu

SEQ ID NO: 51855 - RNA, 22 nt, Human
aacucugcaaugaaaucauguu

SEQ ID NO: 51856 - RNA, 23 nt, Human
aacucuggcuagcauagaauaga

SEQ ID NO: 51857 - RNA, 22 nt, Human
aacuguugucacgaauguggcu

SEQ ID NO: 51858 - RNA, 22 nt, Human
aagaaaccauauuaguuccugg

SEQ ID NO: 51859 - RNA, 22 nt, Human
aagaaagaucugaaagaagcga

SEQ ID NO: 51860 - RNA, 22 nt, Human
aagaagcuacugucacuaucag

SEQ ID NO: 51861 - RNA, 22 nt, Human
aagaaugaaaugaaagaacuaa

SEQ ID NO: 51862 - RNA, 22 nt, Human
aagaaguccuugaggcgcaccc

SEQ ID NO: 51863 - RNA, 22 nt, Human
aagaggacagucaaauggccgg

SEQ ID NO: 51864 - RNA, 22 nt, Human
aagacccuaccccuggagagga

SEQ ID NO: 51865 - RNA, 21 nt, Human
aagagcgccgggcagggcuga

SEQ ID NO: 51866 - RNA, 22 nt, Human
aagcacagggacucaggaccgg

SEQ ID NO: 51867 - RNA, 22 nt, Human
aagaugcuucaugagaguuggg

SEQ ID NO: 51868 - RNA, 22 nt, Human
aagcaaaaucgcaucuggggcc

SEQ ID NO: 51869 - RNA, 22 nt, Human
aagccuccgugcugcuggaucu

SEQ ID NO: 51870 - RNA, 22 nt, Human
aagccuguugacagcugucagu

SEQ ID NO: 51871 - RNA, 22 nt, Human
aagcgcggccgccgcggucgcu

SEQ ID NO: 51872 - RNA, 22 nt, Human
aagcgcaaggugucagcagguu

SEQ ID NO: 51873 - RNA, 22 nt, Human
aaggcacauauuuuagagucac

SEQ ID NO: 51874 - RNA, 22 nt, Human
aaggcaguuaauuuggcuagaa

SEQ ID NO: 51875 - RNA, 22 nt, Human
aaggccacacuugcuggccagc

SEQ ID NO: 51876 - RNA, 22 nt, Human
aaggcgaggggcacagcugaga

SEQ ID NO: 51877 - RNA, 22 nt, Human
aaggcggcggcggcggcugcgg

SEQ ID NO: 51878 - RNA, 22 nt, Human
aagggaaacagccaggcccugu

SEQ ID NO: 51879 - RNA, 22 nt, Human
aagggccuccuggggagccugg

SEQ ID NO: 51880 - RNA, 22 nt, Human
aaggggggcaccugcaugcccg

SEQ ID NO: 51881 - RNA, 22 nt, Human
aagguccaugaauaucuaagcc

SEQ ID NO: 51882 - RNA, 22 nt, Human
aaggugcugaggguccuggcuu

SEQ ID NO: 51883 - RNA, 22 nt, Human
aagucgccuaaacaaaguaucu

SEQ ID NO: 51884 - RNA, 17 nt, Human
aagugggcaaagugaga

SEQ ID NO: 51885 - RNA, 23 nt, Human
aaguggucaucuaucccaugguu

SEQ ID NO: 51886 - RNA, 22 nt, Human
aauacagauggcaugugaagau

SEQ ID NO: 51887 - RNA, 22 nt, Human
aaugacagccuauacugucugc

SEQ ID NO: 51888 - RNA, 22 nt, Human
aaugcgcagaguggugugugca

SEQ ID NO: 51889 - RNA, 22 nt, Human
aauguugacguuggccagggcc

SEQ ID NO: 51890 - RNA, 22 nt, Human
acaugcacagcaagggugagag

SEQ ID NO: 51891 - RNA, 22 nt, Human
acaugcuuucuagguccuucug

SEQ ID NO: 51892 - RNA, 22 nt, Human
acauggaaacacgcagccccaa

SEQ ID NO: 51893 - RNA, 22 nt, Human
acauggaauuucagaagagcau

SEQ ID NO: 51894 - RNA, 20 nt, Human
acauccacugagugggauga

SEQ ID NO: 51895 - RNA, 22 nt, Human
acauguggaggaggcgagggua

SEQ ID NO: 51896 - RNA, 22 nt, Human
acauggaccucagauccuggcc

SEQ ID NO: 51897 - RNA, 22 nt, Human
acaugggcaaucgcuuuauuca

SEQ ID NO: 51898 - RNA, 22 nt, Human
acaugggggugggacggcagag

SEQ ID NO: 51899 - RNA, 22 nt, Human
acauggggaaaaaggccugcuc

SEQ ID NO: 51900 - RNA, 22 nt, Human
acaugguguggcacuaggggcu

SEQ ID NO: 51901 - RNA, 22 nt, Human
accaccacugacaccagcucgg

SEQ ID NO: 51902 - RNA, 22 nt, Human
accaccacauaguaggcacuua

SEQ ID NO: 51903 - RNA, 22 nt, Human
accacguccugguggcuguugg

SEQ ID NO: 51904 - RNA, 22 nt, Human
accagcgcguuuucaguuucau

SEQ ID NO: 51905 - RNA, 22 nt, Human
accaggaguuuugaccaggggc

SEQ ID NO: 51906 - RNA, 22 nt, Human
accagccacccugccgcguccg

SEQ ID NO: 51907 - RNA, 22 nt, Human
acauuuccaaagaugccaguca

SEQ ID NO: 51908 - RNA, 22 nt, Human
acauuuugggagaaaguuguua

SEQ ID NO: 51909 - RNA, 22 nt, Human
accagguugagacuucggcuuu

SEQ ID NO: 51910 - RNA, 22 nt, Human
accaguucuauguagauaauga

SEQ ID NO: 51911 - RNA, 22 nt, Human
accaguuuuuugaccaugggug

SEQ ID NO: 51912 - RNA, 22 nt, Human
accauccaaaagcuuuucauca

SEQ ID NO: 51913 - RNA, 20 nt, Human
acccaaagcucagcgugucc

SEQ ID NO: 51914 - RNA, 22 nt, Human
accaagaguccaagugagguug

SEQ ID NO: 51915 - RNA, 22 nt, Human
acccagauauccaggccucugc

SEQ ID NO: 51916 - RNA, 22 nt, Human
accccagcucugagccacacca

SEQ ID NO: 51917 - RNA, 22 nt, Human
acccccaggacacugccucuga

SEQ ID NO: 51918 - RNA, 22 nt, Human
accagccacacacauuagucac

SEQ ID NO: 51919 - RNA, 22 nt, Human
accaggcagcaccaaagccggu

SEQ ID NO: 51920 - RNA, 17 nt, Human
accaggggcagcacugc

SEQ ID NO: 51921 - RNA, 19 nt, Human
accauggguguguuaagaa

SEQ ID NO: 51922 - RNA, 22 nt, Human
acccuucugugaccugccuguc

SEQ ID NO: 51923 - RNA, 22 nt, Human
accgagcaggguguuugcgcac

SEQ ID NO: 51924 - RNA, 19 nt, Human
acccaugcucuguggacuu

SEQ ID NO: 51925 - RNA, 22 nt, Human
acccauggcucucugggaugcu

SEQ ID NO: 51926 - RNA, 22 nt, Human
accccgugucccugaggguccu

SEQ ID NO: 51927 - RNA, 22 nt, Human
accgucagguuagaaugagcac

SEQ ID NO: 51928 - RNA, 22 nt, Human
acccggccuacucagugcccag

SEQ ID NO: 51929 - RNA, 22 nt, Human
acccugacggugggcagcuuga

SEQ ID NO: 51930 - RNA, 22 nt, Human
accucuuucuauggauuuuuug

SEQ ID NO: 51931 - RNA, 22 nt, Human
accucuuuuugaauauagcauu

SEQ ID NO: 51932 - RNA, 22 nt, Human
accugaccagguggcuucccaa

SEQ ID NO: 51933 - RNA, 22 nt, Human
accugcagguguuuccacacuu

SEQ ID NO: 51934 - RNA, 22 nt, Human
accugcucucccucucgcaguc

SEQ ID NO: 51935 - RNA, 23 nt, Human
accgccgcugccgccgcccccgc

SEQ ID NO: 51936 - RNA, 22 nt, Human
accgcuggcacuggggacgggg

SEQ ID NO: 51937 - RNA, 22 nt, Human
accgggcagcucugccccugcc

SEQ ID NO: 51938 - RNA, 22 nt, Human
accggucucaccaaacgcccca

SEQ ID NO: 51939 - RNA, 21 nt, Human
accgucaguacuaguauugac

SEQ ID NO: 51940 - RNA, 22 nt, Human
accgugcccauucauuuacaaa

SEQ ID NO: 51941 - RNA, 22 nt, Human
accucccgacggcgcgggagaa

SEQ ID NO: 51942 - RNA, 22 nt, Human
accugaucugagaaguggaggg

SEQ ID NO: 51943 - RNA, 22 nt, Human
accuggacucugaucacuuuug

SEQ ID NO: 51944 - RNA, 22 nt, Human
accuggauauuuucaguugcau

SEQ ID NO: 51945 - RNA, 21 nt, Human
accuggugaugaaugggaggc

SEQ ID NO: 51946 - RNA, 22 nt, Human
accuguagcccaaucauggcag

SEQ ID NO: 51947 - RNA, 19 nt, Human
accuguucaaccucgugcu

SEQ ID NO: 51948 - RNA, 22 nt, Human
acgaggauuuccuuagaugaaa

SEQ ID NO: 51949 - RNA, 22 nt, Human
accuggaccugccaccuaugag

SEQ ID NO: 51950 - RNA, 22 nt, Human
accuggcccugggucuccugac

SEQ ID NO: 51951 - RNA, 22 nt, Human
accugguaaccugccugacuaa

SEQ ID NO: 51952 - RNA, 23 nt, Human
accuggucccaugggugggccug

SEQ ID NO: 51953 - RNA, 22 nt, Human
accuucugaccucucggacuuc

SEQ ID NO: 51954 - RNA, 23 nt, Human
acgaccuugcccucauuccaaag

SEQ ID NO: 51955 - RNA, 22 nt, Human
acgauacaaucauauaguaccu

SEQ ID NO: 51956 - RNA, 22 nt, Human
acgcaacacugcuauuuuuuuc

SEQ ID NO: 51957 - RNA, 22 nt, Human
acggccgaugacuccagcaugg

SEQ ID NO: 51958 - RNA, 22 nt, Human
acggcggguuccgggccagccc

SEQ ID NO: 51959 - RNA, 22 nt, Human
acgggugcuuguucccgcugcu

SEQ ID NO: 51960 - RNA, 22 nt, Human
acggguuccuugagggcaggau

SEQ ID NO: 51961 - RNA, 20 nt, Human
acugcaagagacagaugaaa

SEQ ID NO: 51962 - RNA, 22 nt, Human
acugagcaaaacugauccuguu

SEQ ID NO: 51963 - RNA, 18 nt, Human
acugagcccaggacacac

SEQ ID NO: 51964 - RNA, 22 nt, Human
acuggagcccguggaggcgcag

SEQ ID NO: 51965 - RNA, 22 nt, Human
acuggcaugauagaccauaaca

SEQ ID NO: 51966 - RNA, 22 nt, Human
acuggcuuggaaauggguauuu

SEQ ID NO: 51967 - RNA, 22 nt, Human
acugggacuguaugugcuggac

SEQ ID NO: 51968 - RNA, 22 nt, Human
acugggcaaggauaugaugggu

SEQ ID NO: 51969 - RNA, 21 nt, Human
acugggcuagccugacuucug

SEQ ID NO: 51970 - RNA, 15 nt, Human
acugggaaggaguau

SEQ ID NO: 51971 - RNA, 22 nt, Human
acuggggcaggaaaguaugcug

SEQ ID NO: 51972 - RNA, 19 nt, Human
acuggggcaggcugggcuu

SEQ ID NO: 51973 - RNA, 22 nt, Human
acuggugcucuggccaccgcug

SEQ ID NO: 51974 - RNA, 22 nt, Human
acuguggcugcuacccuggcuc

SEQ ID NO: 51975 - RNA, 22 nt, Human
acugugcccccucuacugcuga

SEQ ID NO: 51976 - RNA, 22 nt, Human
acuucugcccuggcgagggcgu

SEQ ID NO: 51977 - RNA, 22 nt, Human
acuugagcuugaaagguaugcu

SEQ ID NO: 51978 - RNA, 22 nt, Human
acuuugccagcucccugcuggc

SEQ ID NO: 51979 - RNA, 22 nt, Human
agaacaagaaacccgaaaagug

SEQ ID NO: 51980 - RNA, 22 nt, Human
agaagcaaagcaaacacauucu

SEQ ID NO: 51981 - RNA, 22 nt, Human
agaacaggaggaagccagcucc

SEQ ID NO: 51982 - RNA, 22 nt, Human
agacacugacaggguccaugga

SEQ ID NO: 51983 - RNA, 22 nt, Human
agaaucaggaagacagccuggc

SEQ ID NO: 51984 - RNA, 22 nt, Human
agacagcggugcaauaaauggu

SEQ ID NO: 51985 - RNA, 22 nt, Human
agaccagugaguaggccuuaga

SEQ ID NO: 51986 - RNA, 20 nt, Human
agacauugaggagagagcau

SEQ ID NO: 51987 - RNA, 22 nt, Human
agaccccugcuggggcugcugu

SEQ ID NO: 51988 - RNA, 22 nt, Human
agacgcgcagaaggaagcggcc

SEQ ID NO: 51989 - RNA, 22 nt, Human
agagaacaggcagcuggugccg

SEQ ID NO: 51990 - RNA, 22 nt, Human
agagaacauuuucaggguuuca

SEQ ID NO: 51991 - RNA, 22 nt, Human
agagaaacauuaauugaugagg

SEQ ID NO: 51992 - RNA, 20 nt, Human
agagaacaguuuggucacag

SEQ ID NO: 51993 - RNA, 22 nt, Human
agagcacaggguuuugugccgg

SEQ ID NO: 51994 - RNA, 22 nt, Human
agagccggagucuucuuguuug

SEQ ID NO: 51995 - RNA, 22 nt, Human
agaggaguagcugagcucugca

SEQ ID NO: 51996 - RNA, 22 nt, Human
agaggcacccaguuaagcugca

SEQ ID NO: 51997 - RNA, 22 nt, Human
agagcagcuuuucggaaccacu

SEQ ID NO: 51998 - RNA, 22 nt, Human
agagggcaggcugguugggguc

SEQ ID NO: 51999 - RNA, 22 nt, Human
agauagaaggauugugacacau

SEQ ID NO: 52000 - RNA, 22 nt, Human
agauaggcuuagccaagcuuuc

SEQ ID NO: 52001 - RNA, 22 nt, Human
agcagcaggcugggaugagucu

SEQ ID NO: 52002 - RNA, 22 nt, Human
agcagccgccgccgccgcgcac

SEQ ID NO: 52003 - RNA, 22 nt, Human
agcacggugguuaagagagugg

SEQ ID NO: 52004 - RNA, 22 nt, Human
agcaggaaggcuagaagcagga

SEQ ID NO: 52005 - RNA, 22 nt, Human
agcaggagaaagaguaugggcu

SEQ ID NO: 52006 - RNA, 22 nt, Human
agcaggaggagagccuggcggu

SEQ ID NO: 52007 - RNA, 22 nt, Human
agcaggccuuucaccucugucc

SEQ ID NO: 52008 - RNA, 19 nt, Human
agcaguggagccaugccug

SEQ ID NO: 52009 - RNA, 22 nt, Human
agcaguucucugucuagcuaga

SEQ ID NO: 52010 - RNA, 18 nt, Human
agcaguugucucucucca

SEQ ID NO: 52011 - RNA, 22 nt, Human
agcaggaggguuuuguagaguc

SEQ ID NO: 52012 - RNA, 22 nt, Human
agcaucggacggagcaccugcu

SEQ ID NO: 52013 - RNA, 22 nt, Human
agcaggauggaguaacgugaaa

SEQ ID NO: 52014 - RNA, 22 nt, Human
agcaggucagugguaaucaaaa

SEQ ID NO: 52015 - RNA, 22 nt, Human
agcagguucaagggcaaagcug

SEQ ID NO: 52016 - RNA, 22 nt, Human
agccacagucuguagccagcuu

SEQ ID NO: 52017 - RNA, 22 nt, Human
agccacggcaaugauaggcugc

SEQ ID NO: 52018 - RNA, 22 nt, Human
agccagauuuuuugagaggcga

SEQ ID NO: 52019 - RNA, 22 nt, Human
agccagugcagcuggaaauuca

SEQ ID NO: 52020 - RNA, 22 nt, Human
agcaugucuaacucuucagggu

SEQ ID NO: 52021 - RNA, 22 nt, Human
agcauuucuacugugucagaaa

SEQ ID NO: 52022 - RNA, 22 nt, Human
agccuggagcaggcucugcucu

SEQ ID NO: 52023 - RNA, 22 nt, Human
agccccuaaaguagcuguucuu

SEQ ID NO: 52024 - RNA, 22 nt, Human
agcccugaccuguccuguucug

SEQ ID NO: 52025 - RNA, 22 nt, Human
agcccuucccuuucacuggugc

SEQ ID NO: 52026 - RNA, 22 nt, Human
agccgcgcagccucauuaagga

SEQ ID NO: 52027 - RNA, 22 nt, Human
agccuucccuuucaacaauuug

SEQ ID NO: 52028 - RNA, 22 nt, Human
agccuugcaugauuucauucau

SEQ ID NO: 52029 - RNA, 22 nt, Human
agcgagccugugcacuucuaac

SEQ ID NO: 52030 - RNA, 22 nt, Human
agcgcaguuaccgcgcggggcu

SEQ ID NO: 52031 - RNA, 22 nt, Human
agcgccgcugugauuggugagg

SEQ ID NO: 52032 - RNA, 22 nt, Human
agcgcgcggggcugcggcaggg

SEQ ID NO: 52033 - RNA, 22 nt, Human
agcgcggccuuacacccagggg

SEQ ID NO: 52034 - RNA, 19 nt, Human
agcgccucuacugcaugga

SEQ ID NO: 52035 - RNA, 22 nt, Human
agcggaggaggcggagcaggga

SEQ ID NO: 52036 - RNA, 22 nt, Human
agcggcaggacgucuucuucga

SEQ ID NO: 52037 - RNA, 22 nt, Human
agcggcucaggccccgugggcu

SEQ ID NO: 52038 - RNA, 22 nt, Human
agcgggucaugucggccgccca

SEQ ID NO: 52039 - RNA, 22 nt, Human
agcggugacauccuucugugcu

SEQ ID NO: 52040 - RNA, 22 nt, Human
agcggcgcgucuccgagcugga

SEQ ID NO: 52041 - RNA, 22 nt, Human
agcgucaugugaccagcgcgcc

SEQ ID NO: 52042 - RNA, 19 nt, Human
agcucaggcccaucguccc

SEQ ID NO: 52043 - RNA, 19 nt, Human
agcuccucaccucucgcgg

SEQ ID NO: 52044 - RNA, 22 nt, Human
agcucggcuguccugugccccu

SEQ ID NO: 52045 - RNA, 22 nt, Human
agcucugcuucuugggaagaug

SEQ ID NO: 52046 - RNA, 22 nt, Human
agcucuguugcggucacaggag

SEQ ID NO: 52047 - RNA, 22 nt, Human
agcugaccugauugcuuuucag

SEQ ID NO: 52048 - RNA, 22 nt, Human
agcugagccagacagguaagca

SEQ ID NO: 52049 - RNA, 22 nt, Human
agcugaugucucaccuguuaga

SEQ ID NO: 52050 - RNA, 22 nt, Human
agcucuuccuccauucuggcca

SEQ ID NO: 52051 - RNA, 22 nt, Human
agcugaggccccgcagcagggu

SEQ ID NO: 52052 - RNA, 22 nt, Human
agcugcugcaaguggugcuaac

SEQ ID NO: 52053 - RNA, 19 nt, Human
agcugcugauugguggagg

SEQ ID NO: 52054 - RNA, 22 nt, Human
agcuggauuaaucacagugacu

SEQ ID NO: 52055 - RNA, 22 nt, Human
agcuguugaccuucccuuucag

SEQ ID NO: 52056 - RNA, 22 nt, Human
agcugcuggcggauguuggacu

SEQ ID NO: 52057 - RNA, 22 nt, Human
agcugcuuuacuggucggcugg

SEQ ID NO: 52058 - RNA, 22 nt, Human
agcuggaaucucggcaaagcgu

SEQ ID NO: 52059 - RNA, 20 nt, Human
agcuggcccccgguggccug

SEQ ID NO: 52060 - RNA, 22 nt, Human
agcugugccuauucguggcaag

SEQ ID NO: 52061 - RNA, 20 nt, Human
agcugucccugacacuagga

SEQ ID NO: 52062 - RNA, 22 nt, Human
agcuugcccuuguaccagccag

SEQ ID NO: 52063 - RNA, 22 nt, Human
agcuuggcaagcacuguuugag

SEQ ID NO: 52064 - RNA, 22 nt, Human
aggaagagcuggaccagaggac

SEQ ID NO: 52065 - RNA, 22 nt, Human
aggaagccuggaguccugccca

SEQ ID NO: 52066 - RNA, 22 nt, Human
aggacuggucucuuuucuccaa

SEQ ID NO: 52067 - RNA, 22 nt, Human
aggacagagggaccagagccca

SEQ ID NO: 52068 - RNA, 22 nt, Human
aggacguaacccaggacagccu

SEQ ID NO: 52069 - RNA, 22 nt, Human
aggagaccugguugugugugug

SEQ ID NO: 52070 - RNA, 22 nt, Human
aggauggauagcaaggaagccg

SEQ ID NO: 52071 - RNA, 22 nt, Human
aggagcccaaagcacuuggcug

SEQ ID NO: 52072 - RNA, 22 nt, Human
aggaggaggacucgccaggcca

SEQ ID NO: 52073 - RNA, 22 nt, Human
aggaggcaaaugagagggcuca

SEQ ID NO: 52074 - RNA, 22 nt, Human
aggcccagcaccagcggucuuc

SEQ ID NO: 52075 - RNA, 22 nt, Human
aggccccacaaacucgccuuug

SEQ ID NO: 52076 - RNA, 22 nt, Human
aggcccugcugaggccucccuc

SEQ ID NO: 52077 - RNA, 20 nt, Human
aggccgcccgcugccgcuuc

SEQ ID NO: 52078 - RNA, 22 nt, Human
aggccgcgguggcgaaggcguu

SEQ ID NO: 52079 - RNA, 22 nt, Human
aggccgguggaggagguggagg

SEQ ID NO: 52080 - RNA, 22 nt, Human
aggccugaggaccagauaaaug

SEQ ID NO: 52081 - RNA, 22 nt, Human
aggccugcccuuggggagccuu

SEQ ID NO: 52082 - RNA, 22 nt, Human
aggccugcuccucuucucaucc

SEQ ID NO: 52083 - RNA, 22 nt, Human
aggcgagcgcggccggugcccc

SEQ ID NO: 52084 - RNA, 22 nt, Human
aggcggguuuaggacaaugcuu

SEQ ID NO: 52085 - RNA, 22 nt, Human
aggcguggcuucugcuggguug

SEQ ID NO: 52086 - RNA, 23 nt, Human
aggcugcagaagaauagggucau

SEQ ID NO: 52087 - RNA, 22 nt, Human
aggcugccuaugaaggcagaag

SEQ ID NO: 52088 - RNA, 22 nt, Human
aggccgcuggggcagcgcccga

SEQ ID NO: 52089 - RNA, 22 nt, Human
aggcgaagggaccagacgguag

SEQ ID NO: 52090 - RNA, 22 nt, Human
aggcgguuggcuuugucugggu

SEQ ID NO: 52091 - RNA, 22 nt, Human
aggcugaagcacacucaugcag

SEQ ID NO: 52092 - RNA, 23 nt, Human
aggcugccacucagggugaggcu

SEQ ID NO: 52093 - RNA, 19 nt, Human
aggcugccucacccucccu

SEQ ID NO: 52094 - RNA, 22 nt, Human
aggcugggaaguguguccugag

SEQ ID NO: 52095 - RNA, 18 nt, Human
aggcuggggaucacaggg

SEQ ID NO: 52096 - RNA, 22 nt, Human
aggcugcucucgccggcggugu

SEQ ID NO: 52097 - RNA, 22 nt, Human
aggcugucucaccucaggaggg

SEQ ID NO: 52098 - RNA, 22 nt, Human
aggcugucucagccugcuugca

SEQ ID NO: 52099 - RNA, 22 nt, Human
aggcuucauuacagugguucaa

SEQ ID NO: 52100 - RNA, 21 nt, Human
aggcuuggaucuagacaggcc

SEQ ID NO: 52101 - RNA, 22 nt, Human
aggcuucaaggacagcagccac

SEQ ID NO: 52102 - RNA, 22 nt, Human
agggaaauuaaugugagcaaug

SEQ ID NO: 52103 - RNA, 22 nt, Human
agggaccgugagcuccuugggg

SEQ ID NO: 52104 - RNA, 22 nt, Human
agggcaguuaugaaugucucca

SEQ ID NO: 52105 - RNA, 22 nt, Human
agggcccauagaucgucagcuu

SEQ ID NO: 52106 - RNA, 22 nt, Human
agggccggggagggcugugggg

SEQ ID NO: 52107 - RNA, 22 nt, Human
agggcggucccugagacucucc

SEQ ID NO: 52108 - RNA, 22 nt, Human
agggcccaccuuggugcugagg

SEQ ID NO: 52109 - RNA, 22 nt, Human
agggcugggcuuggcaggcugg

SEQ ID NO: 52110 - RNA, 22 nt, Human
agggcgugguggugcuggagca

SEQ ID NO: 52111 - RNA, 22 nt, Human
aggggcagccucacaauccucu

SEQ ID NO: 52112 - RNA, 22 nt, Human
aggggcugugucauuuguccua

SEQ ID NO: 52113 - RNA, 22 nt, Human
agggggaauccugcuuauggau

SEQ ID NO: 52114 - RNA, 22 nt, Human
agggggccggggcucaggagcc

SEQ ID NO: 52115 - RNA, 22 nt, Human
agggggccucucccgcggcgcc

SEQ ID NO: 52116 - RNA, 22 nt, Human
agggggcuccugcaggccccca

SEQ ID NO: 52117 - RNA, 22 nt, Human
agguagggaggguagaugcucu

SEQ ID NO: 52118 - RNA, 22 nt, Human
aggguggcacucugggggcucc

SEQ ID NO: 52119 - RNA, 22 nt, Human
aggguuucucuccaguguggac

SEQ ID NO: 52120 - RNA, 22 nt, Human
aggguuugugaagacuuggcca

SEQ ID NO: 52121 - RNA, 22 nt, Human
aggugcacugguacaggcuuca

SEQ ID NO: 52122 - RNA, 22 nt, Human
aggugcagcugguggagucugg

SEQ ID NO: 52123 - RNA, 22 nt, Human
aggucggcuuuuuuccuuucac

SEQ ID NO: 52124 - RNA, 21 nt, Human
aggugcccaggauuauuuuuu

SEQ ID NO: 52125 - RNA, 22 nt, Human
aggugcccucucuggcuccucc

SEQ ID NO: 52126 - RNA, 22 nt, Human
agguggcguauguguucguguu

SEQ ID NO: 52127 - RNA, 22 nt, Human
aggugggcuuagaaaucuguau

SEQ ID NO: 52128 - RNA, 22 nt, Human
agguggucccaauggcugggca

SEQ ID NO: 52129 - RNA, 22 nt, Human
agguggucuuguggaugccgca

SEQ ID NO: 52130 - RNA, 22 nt, Human
aggugugcacccggucgcuucc

SEQ ID NO: 52131 - RNA, 21 nt, Human
agucaagcugccugcuuggca

SEQ ID NO: 52132 - RNA, 22 nt, Human
agucacuguuuaaucuagcuaa

SEQ ID NO: 52133 - RNA, 22 nt, Human
agucaggggaucuagacuugaa

SEQ ID NO: 52134 - RNA, 22 nt, Human
agucaagguggaccagaaaaau

SEQ ID NO: 52135 - RNA, 22 nt, Human
agucaguguagaaagcccaggc

SEQ ID NO: 52136 - RNA, 22 nt, Human
aguccagggcuuagucagcggg

SEQ ID NO: 52137 - RNA, 22 nt, Human
agucggggagcgugaccagaga

SEQ ID NO: 52138 - RNA, 22 nt, Human
agucccugauggacuggaugag

SEQ ID NO: 52139 - RNA, 20 nt, Human
agucuucaggugugaggauu

SEQ ID NO: 52140 - RNA, 22 nt, Human
auagagcuggggaagaagcugg

SEQ ID NO: 52141 - RNA, 22 nt, Human
auacaggcaguaagauucucag

SEQ ID NO: 52142 - RNA, 18 nt, Human
auaccaggauagggacaa

SEQ ID NO: 52143 - RNA, 22 nt, Human
auagacacagcuaugauuugag

SEQ ID NO: 52144 - RNA, 22 nt, Human
auaguccuucuuuaacuuagau

SEQ ID NO: 52145 - RNA, 22 nt, Human
auagaugaggaaauucaggugc

SEQ ID NO: 52146 - RNA, 22 nt, Human
auaguguguaaagugcagugau

SEQ ID NO: 52147 - RNA, 22 nt, Human
auauuucuacaggcugauuuua

SEQ ID NO: 52148 - RNA, 20 nt, Human
aucaagugucuugccaggca

SEQ ID NO: 52149 - RNA, 19 nt, Human
aucagcaguuuugccugga

SEQ ID NO: 52150 - RNA, 22 nt, Human
aucagcucuugaugccuuucuu

SEQ ID NO: 52151 - RNA, 21 nt, Human
aucagaggacaucucagggcc

SEQ ID NO: 52152 - RNA, 22 nt, Human
aucagugcacgcgaugggcaga

SEQ ID NO: 52153 - RNA, 22 nt, Human
aucauccuagaaggaagcuagg

SEQ ID NO: 52154 - RNA, 22 nt, Human
aucagagcuaguacuugcaggu

SEQ ID NO: 52155 - RNA, 23 nt, Human
auccacauucuaguccuuuaugc

SEQ ID NO: 52156 - RNA, 22 nt, Human
auccacccugcaggccaacucu

SEQ ID NO: 52157 - RNA, 22 nt, Human
auccacggucaauuccccaucc

SEQ ID NO: 52158 - RNA, 22 nt, Human
aucaucuaaaauuggcucagau

SEQ ID NO: 52159 - RNA, 22 nt, Human
aucaugcgguuaaggagugugu

SEQ ID NO: 52160 - RNA, 22 nt, Human
aucaugcugacacaguuuaucu

SEQ ID NO: 52161 - RNA, 22 nt, Human
auccaggggucugaauggauau

SEQ ID NO: 52162 - RNA, 22 nt, Human
aucaugggauagugggacgagc

SEQ ID NO: 52163 - RNA, 22 nt, Human
aucaugugacuagguuuggcca

SEQ ID NO: 52164 - RNA, 18 nt, Human
auccccagucccuggaau

SEQ ID NO: 52165 - RNA, 22 nt, Human
auccuccuuugcccugagauca

SEQ ID NO: 52166 - RNA, 22 nt, Human
aucccuggccacgaagcugccc

SEQ ID NO: 52167 - RNA, 22 nt, Human
auccugauggaaacugguauga

SEQ ID NO: 52168 - RNA, 20 nt, Human
auccuggucuuuggaagcuu

SEQ ID NO: 52169 - RNA, 22 nt, Human
auccugugggguauugcugcau

SEQ ID NO: 52170 - RNA, 19 nt, Human
auccuugcucacucacuga

SEQ ID NO: 52171 - RNA, 22 nt, Human
auccaggguuggggucacgagu

SEQ ID NO: 52172 - RNA, 22 nt, Human
aucggggaaugaccuuuucauu

SEQ ID NO: 52173 - RNA, 22 nt, Human
aucuacuaagugccaagcacag

SEQ ID NO: 52174 - RNA, 22 nt, Human
auccucucugugacagggaacg

SEQ ID NO: 52175 - RNA, 22 nt, Human
auccuggcuuuccugauuuacu

SEQ ID NO: 52176 - RNA, 22 nt, Human
augaaaacgugugugugugugu

SEQ ID NO: 52177 - RNA, 22 nt, Human
augagcuaagcagaaagcacac

SEQ ID NO: 52178 - RNA, 22 nt, Human
augagcucuaaguacaugccca

SEQ ID NO: 52179 - RNA, 19 nt, Human
augagccccaguucguucc

SEQ ID NO: 52180 - RNA, 22 nt, Human
augcagauguagauucugaaau

SEQ ID NO: 52181 - RNA, 22 nt, Human
augcagcggucagaggaacuca

SEQ ID NO: 52182 - RNA, 22 nt, Human
augcaggcuaagaguaaagacg

SEQ ID NO: 52183 - RNA, 22 nt, Human
augaugaugguuuaacuucagg

SEQ ID NO: 52184 - RNA, 23 nt, Human
augcaacauugccaguaugggca

SEQ ID NO: 52185 - RNA, 22 nt, Human
augccugcugucaggaacucuu

SEQ ID NO: 52186 - RNA, 22 nt, Human
augccugggcuuuaggguucuc

SEQ ID NO: 52187 - RNA, 22 nt, Human
augcggcugugggggaauggga

SEQ ID NO: 52188 - RNA, 18 nt, Human
augcugacacaaugugga

SEQ ID NO: 52189 - RNA, 22 nt, Human
augcugccuccucuucagccgc

SEQ ID NO: 52190 - RNA, 22 nt, Human
augcugcuuguccauuuauuug

SEQ ID NO: 52191 - RNA, 22 nt, Human
augcugugccuggaaagcggcu

SEQ ID NO: 52192 - RNA, 21 nt, Human
augcgcgguggagugagcgaa

SEQ ID NO: 52193 - RNA, 22 nt, Human
augcgcugugcacacucuuaac

SEQ ID NO: 52194 - RNA, 22 nt, Human
augcugacaacaaagaaggaag

SEQ ID NO: 52195 - RNA, 22 nt, Human
augcugccuaaagcuacuuaca

SEQ ID NO: 52196 - RNA, 22 nt, Human
auggccuguuuccucugaaaga

SEQ ID NO: 52197 - RNA, 22 nt, Human
auggccuuucucaguggugcuu

SEQ ID NO: 52198 - RNA, 22 nt, Human
auggcuguguuguuccucugaa

SEQ ID NO: 52199 - RNA, 22 nt, Human
augguuacgcccucacccuacc

SEQ ID NO: 52200 - RNA, 23 nt, Human
auguagcugcucccgaugcccuc

SEQ ID NO: 52201 - RNA, 22 nt, Human
auguccccagacugcugugcag

SEQ ID NO: 52202 - RNA, 22 nt, Human
augugccugagggcuccuugug

SEQ ID NO: 52203 - RNA, 22 nt, Human
auguccugacaguccaagggcg

SEQ ID NO: 52204 - RNA, 22 nt, Human
auuagugguguauuuggcacua

SEQ ID NO: 52205 - RNA, 22 nt, Human
auuuuucucucaugugcaacua

SEQ ID NO: 52206 - RNA, 22 nt, Human
caaaacccaagugcuauugcaa

SEQ ID NO: 52207 - RNA, 22 nt, Human
auuuugcaguuuauugccaauc

SEQ ID NO: 52208 - RNA, 22 nt, Human
caacuucuauucagucugcagu

SEQ ID NO: 52209 - RNA, 22 nt, Human
caagaaccuagcgaucagguaa

SEQ ID NO: 52210 - RNA, 22 nt, Human
caagaugcaagaccagucaggc

SEQ ID NO: 52211 - RNA, 22 nt, Human
caagggcagaggcagggccccg

SEQ ID NO: 52212 - RNA, 22 nt, Human
caaagccuggggagaguaagga

SEQ ID NO: 52213 - RNA, 22 nt, Human
caaugccaggaaccugggggaa

SEQ ID NO: 52214 - RNA, 22 nt, Human
caauuuggaaagcaugcccccc

SEQ ID NO: 52215 - RNA, 22 nt, Human
cacacaccagaaagccugggac

SEQ ID NO: 52216 - RNA, 17 nt, Human
caaccaggaaaggaggg

SEQ ID NO: 52217 - RNA, 22 nt, Human
caaccucuaucggucaggaagc

SEQ ID NO: 52218 - RNA, 22 nt, Human
cacacguuuagcuucuggcggc

SEQ ID NO: 52219 - RNA, 22 nt, Human
cacacguuucuacugcugccaa

SEQ ID NO: 52220 - RNA, 22 nt, Human
caagagcgugugcagggcaagu

SEQ ID NO: 52221 - RNA, 22 nt, Human
cacagcuggggaagcugaggcc

SEQ ID NO: 52222 - RNA, 23 nt, Human
cacaggcagaaaucaagacggua

SEQ ID NO: 52223 - RNA, 22 nt, Human
cacaguccugcauuuacugccu

SEQ ID NO: 52224 - RNA, 22 nt, Human
caagccacugggagcugcacac

SEQ ID NO: 52225 - RNA, 22 nt, Human
cacaucugaaggcggcucuagg

SEQ ID NO: 52226 - RNA, 22 nt, Human
caaggaaaugucagaaaggcaa

SEQ ID NO: 52227 - RNA, 22 nt, Human
caaggaagguugguugaaggua

SEQ ID NO: 52228 - RNA, 22 nt, Human
caaggucagacagccaggacag

SEQ ID NO: 52229 - RNA, 22 nt, Human
caagguugugacccaaugacca

SEQ ID NO: 52230 - RNA, 22 nt, Human
caccaucagacuucugggcagg

SEQ ID NO: 52231 - RNA, 20 nt, Human
cacccgguccucagcgacuc

SEQ ID NO: 52232 - RNA, 22 nt, Human
caccucagagcuccuucuucuc

SEQ ID NO: 52233 - RNA, 22 nt, Human
cagagcugagucuucaagguug

SEQ ID NO: 52234 - RNA, 22 nt, Human
cagagcugucauuugccaguga

SEQ ID NO: 52235 - RNA, 22 nt, Human
cagaggagcgaguuggacgcca

SEQ ID NO: 52236 - RNA, 22 nt, Human
cagagguagaaguagauguuug

SEQ ID NO: 52237 - RNA, 22 nt, Human
cagaucacucugggcggcggga

SEQ ID NO: 52238 - RNA, 22 nt, Human
cagaugccauagguauaguaua

SEQ ID NO: 52239 - RNA, 22 nt, Human
cagauguuugaaugcuuaccac

SEQ ID NO: 52240 - RNA, 22 nt, Human
cagacacgucccuguugaccug

SEQ ID NO: 52241 - RNA, 22 nt, Human
cagaccagaaggaagccgacaa

SEQ ID NO: 52242 - RNA, 22 nt, Human
cagcauggagacaaagugggca

SEQ ID NO: 52243 - RNA, 22 nt, Human
cagcccaggcucagauguuggg

SEQ ID NO: 52244 - RNA, 22 nt, Human
cagaucacauccauccgucacc

SEQ ID NO: 52245 - RNA, 22 nt, Human
cagcuccaucuugcuuauacca

SEQ ID NO: 52246 - RNA, 22 nt, Human
cagcucgaauaauggagaacug

SEQ ID NO: 52247 - RNA, 22 nt, Human
cagcucugcugggaggaugcag

SEQ ID NO: 52248 - RNA, 22 nt, Human
cagcugacaagaguccuuggag

SEQ ID NO: 52249 - RNA, 22 nt, Human
cagcugcgcagcgccgggccug

SEQ ID NO: 52250 - RNA, 22 nt, Human
cagcugcugguguaucgggucc

SEQ ID NO: 52251 - RNA, 22 nt, Human
cagcuggaggagcagcuuccag

SEQ ID NO: 52252 - RNA, 22 nt, Human
cagauggagaaagagugaaugg

SEQ ID NO: 52253 - RNA, 22 nt, Human
cagcacaggugugaggccugau

SEQ ID NO: 52254 - RNA, 22 nt, Human
cagcagaggagguggcagcacc

SEQ ID NO: 52255 - RNA, 21 nt, Human
cagcagaugccagggucucug

SEQ ID NO: 52256 - RNA, 22 nt, Human
cagcagccuccccggccgaccu

SEQ ID NO: 52257 - RNA, 22 nt, Human
cagcuggggagagacauggcag

SEQ ID NO: 52258 - RNA, 22 nt, Human
cagcuguggagauggggugcau

SEQ ID NO: 52259 - RNA, 22 nt, Human
cagcuucaaaggcccugauggu

SEQ ID NO: 52260 - RNA, 22 nt, Human
cagccccagcacuuagcugagu

SEQ ID NO: 52261 - RNA, 22 nt, Human
caggaagagaacugcucagccu

SEQ ID NO: 52262 - RNA, 22 nt, Human
caggcacagcuaagacuggcca

SEQ ID NO: 52263 - RNA, 22 nt, Human
caggcagagagggcagugugga

SEQ ID NO: 52264 - RNA, 22 nt, Human
caggcaggagaaaaggcgcggg

SEQ ID NO: 52265 - RNA, 22 nt, Human
caggcagggcugccuucugcuu

SEQ ID NO: 52266 - RNA, 21 nt, Human
caggccaaaagguucaacauu

SEQ ID NO: 52267 - RNA, 22 nt, Human
cagggcacaguuauggaggugg

SEQ ID NO: 52268 - RNA, 22 nt, Human
cagggcagaguuaagaugcugg

SEQ ID NO: 52269 - RNA, 22 nt, Human
cagggcaucucugaaucuucac

SEQ ID NO: 52270 - RNA, 22 nt, Human
cagggccagggcuauggugaag

SEQ ID NO: 52271 - RNA, 22 nt, Human
caggggacacuccugcuugggc

SEQ ID NO: 52272 - RNA, 23 nt, Human
caggggacaggugaccugggcuc

SEQ ID NO: 52273 - RNA, 22 nt, Human
caggguaccaagcuucgcccuc

SEQ ID NO: 52274 - RNA, 22 nt, Human
caggucagcacuuggaggugca

SEQ ID NO: 52275 - RNA, 22 nt, Human
caggucauaacuaugcaugaac

SEQ ID NO: 52276 - RNA, 21 nt, Human
caguagcgcgacaugguuagc

SEQ ID NO: 52277 - RNA, 22 nt, Human
caguaugagcacagugccugga

SEQ ID NO: 52278 - RNA, 22 nt, Human
caggcagggagcuggaaaggau

SEQ ID NO: 52279 - RNA, 22 nt, Human
caggccacagcuaaagaggauu

SEQ ID NO: 52280 - RNA, 22 nt, Human
caggccagcuggaggggcagcu

SEQ ID NO: 52281 - RNA, 22 nt, Human
caggccccagggacugggcgcu

SEQ ID NO: 52282 - RNA, 22 nt, Human
caggccgccacugcagcagcug

SEQ ID NO: 52283 - RNA, 22 nt, Human
caggccgcccucuccuguuagc

SEQ ID NO: 52284 - RNA, 20 nt, Human
caggccuucaggauggcugg

SEQ ID NO: 52285 - RNA, 22 nt, Human
cagggccaggccucaggggcgc

SEQ ID NO: 52286 - RNA, 22 nt, Human
caggggaagccagcugccaugu

SEQ ID NO: 52287 - RNA, 19 nt, Human
caggggcuuaugcgaccuc

SEQ ID NO: 52288 - RNA, 22 nt, Human
cagggggcccagcugggagggg

SEQ ID NO: 52289 - RNA, 22 nt, Human
caggguaguaauuuaauacaag

SEQ ID NO: 52290 - RNA, 22 nt, Human
cagggugaagaugcgccuccug

SEQ ID NO: 52291 - RNA, 22 nt, Human
caggguugaugaauugucugua

SEQ ID NO: 52292 - RNA, 22 nt, Human
cagguuguucugggcauggagg

SEQ ID NO: 52293 - RNA, 20 nt, Human
cagguugcugcccccgccuc

SEQ ID NO: 52294 - RNA, 22 nt, Human
cauccagagcugccugaccccg

SEQ ID NO: 52295 - RNA, 22 nt, Human
cauccagcuccugggggccacc

SEQ ID NO: 52296 - RNA, 22 nt, Human
cauccagggguacccuggagcc

SEQ ID NO: 52297 - RNA, 22 nt, Human
cagugcuccugccccugcccuu

SEQ ID NO: 52298 - RNA, 22 nt, Human
cagugcuggaggggugcuugca

SEQ ID NO: 52299 - RNA, 22 nt, Human
caucugcagccucugcauuccc

SEQ ID NO: 52300 - RNA, 22 nt, Human
caucuccaagucuguaagcagu

SEQ ID NO: 52301 - RNA, 20 nt, Human
caugaguccgugaguggccc

SEQ ID NO: 52302 - RNA, 22 nt, Human
caguggggaggccaggauagaa

SEQ ID NO: 52303 - RNA, 22 nt, Human
caugaugaacugugcuguuagg

SEQ ID NO: 52304 - RNA, 20 nt, Human
caugaugcaaacaguaacgu

SEQ ID NO: 52305 - RNA, 22 nt, Human
caugccaguagccggcuugacu

SEQ ID NO: 52306 - RNA, 22 nt, Human
caugccugaucagcggccagca

SEQ ID NO: 52307 - RNA, 22 nt, Human
caugcuggcacugaccagccua

SEQ ID NO: 52308 - RNA, 22 nt, Human
cauggcacagaagaugucguuu

SEQ ID NO: 52309 - RNA, 22 nt, Human
cauagcguuuacauguggauua

SEQ ID NO: 52310 - RNA, 22 nt, Human
cauggcggcgcucucccugccu

SEQ ID NO: 52311 - RNA, 19 nt, Human
cauggcgguaaagaggcug

SEQ ID NO: 52312 - RNA, 22 nt, Human
cauggccaaagaauuauauuuu

SEQ ID NO: 52313 - RNA, 22 nt, Human
cauguauguuaguggcugcuuu

SEQ ID NO: 52314 - RNA, 22 nt, Human
ccagaggcuuaugcagcugcug

SEQ ID NO: 52315 - RNA, 22 nt, Human
ccagaugggggcugugggaggg

SEQ ID NO: 52316 - RNA, 22 nt, Human
ccagcaagacucgcagugggau

SEQ ID NO: 52317 - RNA, 22 nt, Human
cccagcccaucauuccugcaaa

SEQ ID NO: 52318 - RNA, 22 nt, Human
cccagccgaaugcucccuuccc

SEQ ID NO: 52319 - RNA, 22 nt, Human
cccagccugaucucggccagcu

SEQ ID NO: 52320 - RNA, 22 nt, Human
cccagccgcuguggucuagggu

SEQ ID NO: 52321 - RNA, 22 nt, Human
cccagccuuugcuuccugguuc

SEQ ID NO: 52322 - RNA, 22 nt, Human
cccagcgccugcccuccgccgc

SEQ ID NO: 52323 - RNA, 22 nt, Human
cccagcuggcaaaggcguccuu

SEQ ID NO: 52324 - RNA, 22 nt, Human
cccaggccguguaaucagcagc

SEQ ID NO: 52325 - RNA, 22 nt, Human
cccaggucgucagcaguguggu

SEQ ID NO: 52326 - RNA, 22 nt, Human
cccaucugugaaauggggcugc

SEQ ID NO: 52327 - RNA, 22 nt, Human
cccauauacuuuuucuggucca

SEQ ID NO: 52328 - RNA, 22 nt, Human
cccauggaaggguuggcccaga

SEQ ID NO: 52329 - RNA, 20 nt, Human
ccccagcauccuuuucaucu

SEQ ID NO: 52330 - RNA, 22 nt, Human
ccccaggcagcccuccaggagc

SEQ ID NO: 52331 - RNA, 22 nt, Human
ccagcaggagacuagcaacaua

SEQ ID NO: 52332 - RNA, 22 nt, Human
ccagccacugacugauuuaaaa

SEQ ID NO: 52333 - RNA, 22 nt, Human
ccagccugccaagcccagcccu

SEQ ID NO: 52334 - RNA, 22 nt, Human
ccagccuucugaugggacccuc

SEQ ID NO: 52335 - RNA, 22 nt, Human
ccccaguuucaccuaccccgcc

SEQ ID NO: 52336 - RNA, 22 nt, Human
cccccauccccugaaggagcug

SEQ ID NO: 52337 - RNA, 22 nt, Human
ccccucuguagcccgagcugcu

SEQ ID NO: 52338 - RNA, 23 nt, Human
ccccugcauggcaccacauuccc

SEQ ID NO: 52339 - RNA, 22 nt, Human
ccccuauaugccugcagugauu

SEQ ID NO: 52340 - RNA, 22 nt, Human
ccccugcucagggaggagaccg

SEQ ID NO: 52341 - RNA, 22 nt, Human
ccccugggcccugagccgcgau

SEQ ID NO: 52342 - RNA, 22 nt, Human
ccagcugcugcaccgugcaugg

SEQ ID NO: 52343 - RNA, 17 nt, Human
ccagcugcucccucaga

SEQ ID NO: 52344 - RNA, 22 nt, Human
ccaggcagaggggucuggagca

SEQ ID NO: 52345 - RNA, 22 nt, Human
ccaggacuuauuacaguauaac

SEQ ID NO: 52346 - RNA, 22 nt, Human
cccgcuaaaucaguucugaguc

SEQ ID NO: 52347 - RNA, 22 nt, Human
cccggcgccucguuuccuaguc

SEQ ID NO: 52348 - RNA, 22 nt, Human
cccggcucggcuucuuccccac

SEQ ID NO: 52349 - RNA, 22 nt, Human
ccaggcccugcuccucacacca

SEQ ID NO: 52350 - RNA, 22 nt, Human
ccaggcucaccuggagccccug

SEQ ID NO: 52351 - RNA, 22 nt, Human
ccagggcggacaaggucuuuga

SEQ ID NO: 52352 - RNA, 22 nt, Human
ccagggaggucauagugcuggu

SEQ ID NO: 52353 - RNA, 22 nt, Human
ccagggcuggaggaggucagga

SEQ ID NO: 52354 - RNA, 22 nt, Human
ccagggcuggguuugucggugu

SEQ ID NO: 52355 - RNA, 22 nt, Human
cccgggcucuggcagaggcggu

SEQ ID NO: 52356 - RNA, 22 nt, Human
cccgugggaugagaggcccugg

SEQ ID NO: 52357 - RNA, 22 nt, Human
cccuaguuuauuugccuucuuu

SEQ ID NO: 52358 - RNA, 22 nt, Human
cccuccgccagugcccgccccg

SEQ ID NO: 52359 - RNA, 19 nt, Human
cccucggcuucugguuacu

SEQ ID NO: 52360 - RNA, 22 nt, Human
ccagggucggcaucagcguggg

SEQ ID NO: 52361 - RNA, 22 nt, Human
ccagucugccggcccggccccu

SEQ ID NO: 52362 - RNA, 22 nt, Human
cccuggcucaggcagcuuuguu

SEQ ID NO: 52363 - RNA, 22 nt, Human
cccuggucucugacuugauccu

SEQ ID NO: 52364 - RNA, 22 nt, Human
ccagugcuuccaggaauacggu

SEQ ID NO: 52365 - RNA, 22 nt, Human
ccaguguguuuuucucugacuc

SEQ ID NO: 52366 - RNA, 21 nt, Human
ccgacggcgcagaugccggcc

SEQ ID NO: 52367 - RNA, 22 nt, Human
ccgaaccacacgacagugcuca

SEQ ID NO: 52368 - RNA, 22 nt, Human
ccgagaucagaguaggauuugg

SEQ ID NO: 52369 - RNA, 21 nt, Human
ccaucuugaaccaugcccacu

SEQ ID NO: 52370 - RNA, 22 nt, Human
ccauggaaaagacgggcaggcc

SEQ ID NO: 52371 - RNA, 22 nt, Human
ccauggccaauugcaccuugcu

SEQ ID NO: 52372 - RNA, 22 nt, Human
ccaugggugucuggagcacccu

SEQ ID NO: 52373 - RNA, 22 nt, Human
ccgagcagggcgcccugcccca

SEQ ID NO: 52374 - RNA, 22 nt, Human
ccgaggaguagggugucuacgg

SEQ ID NO: 52375 - RNA, 21 nt, Human
ccgaggagugcggggagcccc

SEQ ID NO: 52376 - RNA, 22 nt, Human
ccgcaccgucugccauacacgc

SEQ ID NO: 52377 - RNA, 23 nt, Human
ccaugugcaggguucagcacuua

SEQ ID NO: 52378 - RNA, 22 nt, Human
ccauuuuccuguauggacucga

SEQ ID NO: 52379 - RNA, 22 nt, Human
cccacccuacugcuacccagga

SEQ ID NO: 52380 - RNA, 18 nt, Human
cccaccugcccagguuca

SEQ ID NO: 52381 - RNA, 22 nt, Human
ccgccccaggcccugagccaag

SEQ ID NO: 52382 - RNA, 22 nt, Human
ccgcgggcagggcuucaccuuu

SEQ ID NO: 52383 - RNA, 22 nt, Human
ccgcucgggugcagagggcaga

SEQ ID NO: 52384 - RNA, 22 nt, Human
ccgcucuuugagacucucccga

SEQ ID NO: 52385 - RNA, 16 nt, Human
cccaccuggacuaccu

SEQ ID NO: 52386 - RNA, 22 nt, Human
cccacgccuucuuucuucaaau

SEQ ID NO: 52387 - RNA, 22 nt, Human
cccagaccagagugccuggacg

SEQ ID NO: 52388 - RNA, 19 nt, Human
cccagaggaaugccuggaa

SEQ ID NO: 52389 - RNA, 22 nt, Human
cccagagggcugaggauaugaa

SEQ ID NO: 52390 - RNA, 22 nt, Human
cccagcaccauaacucaggccu

SEQ ID NO: 52391 - RNA, 22 nt, Human
ccggaggaaauugcauugguug

SEQ ID NO: 52392 - RNA, 22 nt, Human
ccggcggguggagcaugcgcgg

SEQ ID NO: 52393 - RNA, 22 nt, Human
ccggcugagccucgccgcggcc

SEQ ID NO: 52394 - RNA, 22 nt, Human
cccagcucuggaagguggggga

SEQ ID NO: 52395 - RNA, 22 nt, Human
cccagcugaacuugcauuccaa

SEQ ID NO: 52396 - RNA, 22 nt, Human
cccaggcuggggcuccuccagc

SEQ ID NO: 52397 - RNA, 22 nt, Human
ccgggcuuccuuagagcaagau

SEQ ID NO: 52398 - RNA, 22 nt, Human
ccggguccagugggcacugggc

SEQ ID NO: 52399 - RNA, 22 nt, Human
ccgguguggguuucucgguagu

SEQ ID NO: 52400 - RNA, 22 nt, Human
ccgugcaguuucucacacacau

SEQ ID NO: 52401 - RNA, 22 nt, Human
ccgugccuuuaguuucuucugu

SEQ ID NO: 52402 - RNA, 22 nt, Human
ccccagugguugcaacagcaga

SEQ ID NO: 52403 - RNA, 22 nt, Human
ccccaguuccugucaaggguaa

SEQ ID NO: 52404 - RNA, 22 nt, Human
ccccauggaaaacccaccuagg

SEQ ID NO: 52405 - RNA, 22 nt, Human
ccccccaaaacuacuggccugu

SEQ ID NO: 52406 - RNA, 22 nt, Human
ccccguggcugggggacagagc

SEQ ID NO: 52407 - RNA, 21 nt, Human
ccccuguggagcacauguggc

SEQ ID NO: 52408 - RNA, 22 nt, Human
ccccuuucucccgcgucuggcc

SEQ ID NO: 52409 - RNA, 22 nt, Human
ccuacccucaagggccuggggg

SEQ ID NO: 52410 - RNA, 22 nt, Human
ccuauauaaaugacauauagga

SEQ ID NO: 52411 - RNA, 22 nt, Human
ccuaggcccauuaauuccccuu

SEQ ID NO: 52412 - RNA, 21 nt, Human
ccuccagccagagggucugga

SEQ ID NO: 52413 - RNA, 22 nt, Human
cccgaggagagguccaggcccu

SEQ ID NO: 52414 - RNA, 19 nt, Human
cccgauggagacuuagcag

SEQ ID NO: 52415 - RNA, 22 nt, Human
cccgccggccacaccggccgcc

SEQ ID NO: 52416 - RNA, 22 nt, Human
cccgcucaccccacuccaccag

SEQ ID NO: 52417 - RNA, 22 nt, Human
cccggagcagucgggcuccggg

SEQ ID NO: 52418 - RNA, 19 nt, Human
ccuccguguuaccuguccu

SEQ ID NO: 52419 - RNA, 22 nt, Human
ccuccugggccuugcucuguga

SEQ ID NO: 52420 - RNA, 22 nt, Human
ccuccuggaguuacuuccaaaa

SEQ ID NO: 52421 - RNA, 22 nt, Human
ccucgugcgauaguuaugucag

SEQ ID NO: 52422 - RNA, 22 nt, Human
cccgggccgagucuuccagcga

SEQ ID NO: 52423 - RNA, 22 nt, Human
cccgguggagaugugggacagg

SEQ ID NO: 52424 - RNA, 22 nt, Human
cccgguugggguuccagggcgc

SEQ ID NO: 52425 - RNA, 22 nt, Human
cccguggugggaugacaccaug

SEQ ID NO: 52426 - RNA, 22 nt, Human
cccuccagugucccagugggga

SEQ ID NO: 52427 - RNA, 22 nt, Human
ccugaagaugguugauccccuu

SEQ ID NO: 52428 - RNA, 22 nt, Human
ccugaccauuugccacaugggu

SEQ ID NO: 52429 - RNA, 22 nt, Human
cccugaggcccacaagucccag

SEQ ID NO: 52430 - RNA, 22 nt, Human
cccugcacuguguggacucugg

SEQ ID NO: 52431 - RNA, 17 nt, Human
cccugcacccuacucuc

SEQ ID NO: 52432 - RNA, 20 nt, Human
cccuggaaugagaugcauau

SEQ ID NO: 52433 - RNA, 22 nt, Human
cccugcuuccucuucuguuugu

SEQ ID NO: 52434 - RNA, 22 nt, Human
cccuggacuccauuuucccgua

SEQ ID NO: 52435 - RNA, 22 nt, Human
cccugggccccgaacugcugag

SEQ ID NO: 52436 - RNA, 20 nt, Human
cccuggcuggcaucuggacu

SEQ ID NO: 52437 - RNA, 22 nt, Human
ccugacgcugauauauaguuaa

SEQ ID NO: 52438 - RNA, 21 nt, Human
ccugagccuguuuauccagaa

SEQ ID NO: 52439 - RNA, 22 nt, Human
ccugaggcccuggcugugcuga

SEQ ID NO: 52440 - RNA, 22 nt, Human
cccuguccugcuaggcccuggu

SEQ ID NO: 52441 - RNA, 22 nt, Human
cccuguccuucccuccaucuga

SEQ ID NO: 52442 - RNA, 21 nt, Human
cccuugccugcacuccucggc

SEQ ID NO: 52443 - RNA, 22 nt, Human
cccuugagccuggaggagcucu

SEQ ID NO: 52444 - RNA, 22 nt, Human
ccgaaaaacagaaucuuggaac

SEQ ID NO: 52445 - RNA, 22 nt, Human
ccugcaguuuuuccaugauaca

SEQ ID NO: 52446 - RNA, 22 nt, Human
ccugccagaaaagagggaguuc

SEQ ID NO: 52447 - RNA, 22 nt, Human
ccugcccaucccaccccagcau

SEQ ID NO: 52448 - RNA, 18 nt, Human
ccugcguggauguccucu

SEQ ID NO: 52449 - RNA, 22 nt, Human
ccugcugagccuggugggcagc

SEQ ID NO: 52450 - RNA, 22 nt, Human
ccgagguccugaagcaagggcc

SEQ ID NO: 52451 - RNA, 22 nt, Human
ccgcagggcccggcgggcucag

SEQ ID NO: 52452 - RNA, 22 nt, Human
ccgcagucugcaaucucccugg

SEQ ID NO: 52453 - RNA, 22 nt, Human
ccgccacggggcaugggaggca

SEQ ID NO: 52454 - RNA, 22 nt, Human
ccgccucucgcucccagcuugc

SEQ ID NO: 52455 - RNA, 22 nt, Human
ccucaucagaaagcagaaagca

SEQ ID NO: 52456 - RNA, 19 nt, Human
cgacauggguaaugggaga

SEQ ID NO: 52457 - RNA, 19 nt, Human
ccucggggucugaagucag

SEQ ID NO: 52458 - RNA, 22 nt, Human
ccucuaugcccuucuggggguc

SEQ ID NO: 52459 - RNA, 22 nt, Human
ccucucccugcagggcccaggg

SEQ ID NO: 52460 - RNA, 22 nt, Human
cgacgacaggcgcccgaggagg

SEQ ID NO: 52461 - RNA, 22 nt, Human
cgagcccaacccucccguccuc

SEQ ID NO: 52462 - RNA, 22 nt, Human
cgaggagguccaggagcaguag

SEQ ID NO: 52463 - RNA, 22 nt, Human
cgcacuggagcuggaacgaguc

SEQ ID NO: 52464 - RNA, 22 nt, Human
cgcagcuucagggccaggaggg

SEQ ID NO: 52465 - RNA, 22 nt, Human
cgcacuugugagcgacagggcu

SEQ ID NO: 52466 - RNA, 22 nt, Human
cgccaguggcagcuggaacagg

SEQ ID NO: 52467 - RNA, 22 nt, Human
ccugacagcgugucccuggccc

SEQ ID NO: 52468 - RNA, 22 nt, Human
cgcgcgguguuccgcauucugc

SEQ ID NO: 52469 - RNA, 22 nt, Human
cgcucggcuuucccuccgccgg

SEQ ID NO: 52470 - RNA, 22 nt, Human
cgcucugccugcccuaacuucc

SEQ ID NO: 52471 - RNA, 22 nt, Human
cgcuagggagcacuuggcagug

SEQ ID NO: 52472 - RNA, 22 nt, Human
ccugcacuaccuggggcugcug

SEQ ID NO: 52473 - RNA, 22 nt, Human
ccugcaugacuuugucagaccu

SEQ ID NO: 52474 - RNA, 22 nt, Human
ccugccagccugccaucccaca

SEQ ID NO: 52475 - RNA, 22 nt, Human
cggcccggccucgcggcgcaug

SEQ ID NO: 52476 - RNA, 22 nt, Human
ccugcucccccugcaagccuug

SEQ ID NO: 52477 - RNA, 19 nt, Human
ccugcugaagugaugcagc

SEQ ID NO: 52478 - RNA, 22 nt, Human
ccugcugcugaugcuguuucac

SEQ ID NO: 52479 - RNA, 22 nt, Human
ccugcuggagucuaguuggucu

SEQ ID NO: 52480 - RNA, 22 nt, Human
ccugccugggcucacuugccag

SEQ ID NO: 52481 - RNA, 21 nt, Human
ccuggagacaaagacagggug

SEQ ID NO: 52482 - RNA, 22 nt, Human
cggcggcgaaccgaccugggug

SEQ ID NO: 52483 - RNA, 22 nt, Human
cggcugcagcggagcaggcugg

SEQ ID NO: 52484 - RNA, 22 nt, Human
ccugggcucgcgcacuucaccc

SEQ ID NO: 52485 - RNA, 22 nt, Human
ccuggggcucugcacagagcag

SEQ ID NO: 52486 - RNA, 22 nt, Human
ccuggguccucacaaucccagg

SEQ ID NO: 52487 - RNA, 22 nt, Human
ccugggugaugugcugcccucg

SEQ ID NO: 52488 - RNA, 22 nt, Human
ccugugacucugucugaugguc

SEQ ID NO: 52489 - RNA, 22 nt, Human
cgggcuccaagcuuucacccca

SEQ ID NO: 52490 - RNA, 22 nt, Human
cggggaggagccagcggaggau

SEQ ID NO: 52491 - RNA, 22 nt, Human
cggggcaaggggggcuggugga

SEQ ID NO: 52492 - RNA, 22 nt, Human
cggggcggcgagcgggccgggc

SEQ ID NO: 52493 - RNA, 22 nt, Human
cggggcucugcacaggccagga

SEQ ID NO: 52494 - RNA, 22 nt, Human
cggggcuggcguuagggaggca

SEQ ID NO: 52495 - RNA, 22 nt, Human
ccuguuccaacccucccuggcu

SEQ ID NO: 52496 - RNA, 22 nt, Human
cggggugugacggugcgggccu

SEQ ID NO: 52497 - RNA, 22 nt, Human
cgggucgagugcuguaguucga

SEQ ID NO: 52498 - RNA, 22 nt, Human
cgguccugcucuuccucccguu

SEQ ID NO: 52499 - RNA, 22 nt, Human
ccuucgcuggcaucuccaggua

SEQ ID NO: 52500 - RNA, 22 nt, Human
cggugccccuagcgcgccgccc

SEQ ID NO: 52501 - RNA, 19 nt, Human
cggugcugauuggugcagu

SEQ ID NO: 52502 - RNA, 22 nt, Human
cgguggcccauuguacgcagcu

SEQ ID NO: 52503 - RNA, 22 nt, Human
cgguugcaggaugugcgggcag

SEQ ID NO: 52504 - RNA, 22 nt, Human
cgucagccacagcugccccggg

SEQ ID NO: 52505 - RNA, 22 nt, Human
cgugccugguggagagcgaggg

SEQ ID NO: 52506 - RNA, 22 nt, Human
cgucauacagaugaacaaucuc

SEQ ID NO: 52507 - RNA, 20 nt, Human
cguugccagcccggcccggg

SEQ ID NO: 52508 - RNA, 22 nt, Human
cguucccuccugccacgggagg

SEQ ID NO: 52509 - RNA, 22 nt, Human
cgucauguuauggcucauucua

SEQ ID NO: 52510 - RNA, 22 nt, Human
cgaacggcagagagcccguccc

SEQ ID NO: 52511 - RNA, 22 nt, Human
cgaaggaaucacuuaacacuuu

SEQ ID NO: 52512 - RNA, 22 nt, Human
cgacagauuauuuugugacugc

SEQ ID NO: 52513 - RNA, 22 nt, Human
cgacaagagaaaugcuuuguuu

SEQ ID NO: 52514 - RNA, 22 nt, Human
cgaccccugaaaauggcagcca

SEQ ID NO: 52515 - RNA, 23 nt, Human
cgagagccugcaggaccuucgga

SEQ ID NO: 52516 - RNA, 22 nt, Human
cgccugucugcauggccacugg

SEQ ID NO: 52517 - RNA, 22 nt, Human
cucaccugccuccccgcccucc

SEQ ID NO: 52518 - RNA, 22 nt, Human
cgcucggugagccaguggcgga

SEQ ID NO: 52519 - RNA, 22 nt, Human
cgcugcagcggcugagucccgc

SEQ ID NO: 52520 - RNA, 22 nt, Human
cgcugcugucaucgucuacggu

SEQ ID NO: 52521 - RNA, 22 nt, Human
cgcuuugguaauagggcagccu

SEQ ID NO: 52522 - RNA, 22 nt, Human
cuccccacucaacucccagacc

SEQ ID NO: 52523 - RNA, 22 nt, Human
cuccccauuuucaugggcaggu

SEQ ID NO: 52524 - RNA, 22 nt, Human
cuccuggagcagcaggcgcagg

SEQ ID NO: 52525 - RNA, 21 nt, Human
cuccuguaaaucaccuccgca

SEQ ID NO: 52526 - RNA, 22 nt, Human
cucgccugacucggaugggcug

SEQ ID NO: 52527 - RNA, 22 nt, Human
cucggagggcaaguacuggcug

SEQ ID NO: 52528 - RNA, 22 nt, Human
cucguccugguuuaaguguccu

SEQ ID NO: 52529 - RNA, 22 nt, Human
cucggggcguggcaguagcaug

SEQ ID NO: 52530 - RNA, 22 nt, Human
cggccuuuggcuucuccugugu

SEQ ID NO: 52531 - RNA, 22 nt, Human
cggcgccccgcgcgggcggcuc

SEQ ID NO: 52532 - RNA, 22 nt, Human
cucuccagucauauucucaguc

SEQ ID NO: 52533 - RNA, 22 nt, Human
cucuccaguuauagcugauuug

SEQ ID NO: 52534 - RNA, 18 nt, Human
cucuggacagcaggcauc

SEQ ID NO: 52535 - RNA, 22 nt, Human
cucuggacaucugcggugcuuc

SEQ ID NO: 52536 - RNA, 22 nt, Human
cucuuucauucuuagguugccg

SEQ ID NO: 52537 - RNA, 22 nt, Human
cggcgcugguacaguggaagag

SEQ ID NO: 52538 - RNA, 22 nt, Human
cggcuacccaugucauauucgu

SEQ ID NO: 52539 - RNA, 22 nt, Human
cgggagcagcucuggggcuggg

SEQ ID NO: 52540 - RNA, 22 nt, Human
cgggcccaggcaggggcucccc

SEQ ID NO: 52541 - RNA, 22 nt, Human
cggggcgggcgugggaggugga

SEQ ID NO: 52542 - RNA, 22 nt, Human
cggggcuccgaagagcucgguu

SEQ ID NO: 52543 - RNA, 22 nt, Human
cugaccgugccgcgguacugcu

SEQ ID NO: 52544 - RNA, 19 nt, Human
cugacccaacauuaguuca

SEQ ID NO: 52545 - RNA, 22 nt, Human
cggggccccccagugaaccucu

SEQ ID NO: 52546 - RNA, 22 nt, Human
cgggucgcacaggagaaaggcg

SEQ ID NO: 52547 - RNA, 22 nt, Human
cggucggagagaaugaccugga

SEQ ID NO: 52548 - RNA, 22 nt, Human
cugaccugugagcuaugccggc

SEQ ID NO: 52549 - RNA, 22 nt, Human
cugagaucaugggucagguggu

SEQ ID NO: 52550 - RNA, 22 nt, Human
cuggaaaaauggauccugucuu

SEQ ID NO: 52551 - RNA, 22 nt, Human
cuggaaagauuuacacggggaa

SEQ ID NO: 52552 - RNA, 22 nt, Human
cuggaaauggcagaguugcauu

SEQ ID NO: 52553 - RNA, 22 nt, Human
cuggaagcgucggaggaagggc

SEQ ID NO: 52554 - RNA, 22 nt, Human
cuggagucagcaaggacgaggc

SEQ ID NO: 52555 - RNA, 20 nt, Human
cuggaguguagcaguggcug

SEQ ID NO: 52556 - RNA, 22 nt, Human
cuggaucgccccgaugugcccc

SEQ ID NO: 52557 - RNA, 22 nt, Human
cuggaugagcuucgugcgcacg

SEQ ID NO: 52558 - RNA, 22 nt, Human
cuggccaggugggggguagugg

SEQ ID NO: 52559 - RNA, 22 nt, Human
cuggccugugggcugucuccgg

SEQ ID NO: 52560 - RNA, 22 nt, Human
cuggcgagcugggccuggggga

SEQ ID NO: 52561 - RNA, 22 nt, Human
cucccgagccuuacucuguucc

SEQ ID NO: 52562 - RNA, 22 nt, Human
cugggaaucuagagggcucauu

SEQ ID NO: 52563 - RNA, 22 nt, Human
cuccggccuucugacuccccug

SEQ ID NO: 52564 - RNA, 22 nt, Human
cuccugauuucuaggccuuauc

SEQ ID NO: 52565 - RNA, 22 nt, Human
cuccugcuuuuucuucuuccga

SEQ ID NO: 52566 - RNA, 22 nt, Human
cuccuugguuccggcguuggag

SEQ ID NO: 52567 - RNA, 22 nt, Human
cugggacacguugugcuuuaac

SEQ ID NO: 52568 - RNA, 22 nt, Human
cugggacccagcccaagucuuu

SEQ ID NO: 52569 - RNA, 22 nt, Human
cucggcccuggucuuacgggac

SEQ ID NO: 52570 - RNA, 20 nt, Human
cuggugccuucugcgauuua

SEQ ID NO: 52571 - RNA, 22 nt, Human
cucuggggaagugcacucgcug

SEQ ID NO: 52572 - RNA, 17 nt, Human
cucugggucuccugcuu

SEQ ID NO: 52573 - RNA, 22 nt, Human
cugugcauguucucuagcugau

SEQ ID NO: 52574 - RNA, 22 nt, Human
cugugcuugcugugcuggggcc

SEQ ID NO: 52575 - RNA, 21 nt, Human
cugugggaaggccugaggucu

SEQ ID NO: 52576 - RNA, 22 nt, Human
cuguggguggcugugccccagg

SEQ ID NO: 52577 - RNA, 22 nt, Human
cugaaggcuuugaauggaauga

SEQ ID NO: 52578 - RNA, 22 nt, Human
cugaggaguaguucuggaggac

SEQ ID NO: 52579 - RNA, 22 nt, Human
cuucauccguaccacggccaca

SEQ ID NO: 52580 - RNA, 22 nt, Human
cugcagagaccuaggucagguu

SEQ ID NO: 52581 - RNA, 22 nt, Human
cugcaucacagcaggaggcaca

SEQ ID NO: 52582 - RNA, 22 nt, Human
cugccacuaccaugcuggauga

SEQ ID NO: 52583 - RNA, 22 nt, Human
cugccaggagaggccagggccc

SEQ ID NO: 52584 - RNA, 23 nt, Human
cuucggcgcucgcugggcggagg

SEQ ID NO: 52585 - RNA, 22 nt, Human
cuucuguggaauagguuugaca

SEQ ID NO: 52586 - RNA, 22 nt, Human
cuucuugggaggggcggagcuc

SEQ ID NO: 52587 - RNA, 22 nt, Human
cugcccgcaugcaggaaugcug

SEQ ID NO: 52588 - RNA, 22 nt, Human
cugccggcugcugcagagaggu

SEQ ID NO: 52589 - RNA, 22 nt, Human
cugccucucaugccugcuugcu

SEQ ID NO: 52590 - RNA, 22 nt, Human
cugccuggggaaugugaggauu

SEQ ID NO: 52591 - RNA, 22 nt, Human
cugccugugcgccaagugcacg

SEQ ID NO: 52592 - RNA, 22 nt, Human
cugcgcagaucugcuguucucu

SEQ ID NO: 52593 - RNA, 22 nt, Human
cugcggcaccaaccccuucaug

SEQ ID NO: 52594 - RNA, 22 nt, Human
cugcgguucuguuuaguggcga

SEQ ID NO: 52595 - RNA, 22 nt, Human
cugcuacgguguccgguggggc

SEQ ID NO: 52596 - RNA, 22 nt, Human
cugcucugagaggcucuuccua

SEQ ID NO: 52597 - RNA, 22 nt, Human
cuugcuguccgaugggucugua

SEQ ID NO: 52598 - RNA, 22 nt, Human
cugcugcuugauugcaggaagu

SEQ ID NO: 52599 - RNA, 22 nt, Human
cuuggggcuugcuguuguagcc

SEQ ID NO: 52600 - RNA, 22 nt, Human
cuuggugcgaagagucagggga

SEQ ID NO: 52601 - RNA, 22 nt, Human
cugcuguuuuccccaccaucuc

SEQ ID NO: 52602 - RNA, 22 nt, Human
cugcuguuuucugggcuucuua

SEQ ID NO: 52603 - RNA, 22 nt, Human
cugcuugguuuggagggcccac

SEQ ID NO: 52604 - RNA, 23 nt, Human
cuggacauucgcaaaguucaucu

SEQ ID NO: 52605 - RNA, 22 nt, Human
cuggagaacucugugcuucacu

SEQ ID NO: 52606 - RNA, 22 nt, Human
cuggagaucaguuggacaacag

SEQ ID NO: 52607 - RNA, 22 nt, Human
cuggcagcucugagucccuucu

SEQ ID NO: 52608 - RNA, 22 nt, Human
cuggccagccucccagguaccc

SEQ ID NO: 52609 - RNA, 22 nt, Human
cuggcccugucagcacagaauc

SEQ ID NO: 52610 - RNA, 22 nt, Human
gaaagcauucuggaggggcaga

SEQ ID NO: 52611 - RNA, 22 nt, Human
cugugcuguuaagaaauuuagu

SEQ ID NO: 52612 - RNA, 22 nt, Human
cugugcuguuagcgauuuuuaa

SEQ ID NO: 52613 - RNA, 22 nt, Human
cuguggaaugcaguugcgagca

SEQ ID NO: 52614 - RNA, 22 nt, Human
cuguggcuaggaagcuguggga

SEQ ID NO: 52615 - RNA, 22 nt, Human
cuguggcugcgcccugggggag

SEQ ID NO: 52616 - RNA, 22 nt, Human
cuguguggccuaaguggagaca

SEQ ID NO: 52617 - RNA, 22 nt, Human
cugugugcagggcacaauggaa

SEQ ID NO: 52618 - RNA, 22 nt, Human
cuguguugggauggugcgcgca

SEQ ID NO: 52619 - RNA, 22 nt, Human
gaacaaaagauagcccaaacau

SEQ ID NO: 52620 - RNA, 20 nt, Human
cuguucucuugccacaugag

SEQ ID NO: 52621 - RNA, 20 nt, Human
cuguuugcuaucaugagcug

SEQ ID NO: 52622 - RNA, 22 nt, Human
cuucagagugacucagcaucuu

SEQ ID NO: 52623 - RNA, 22 nt, Human
gaagccaugauaaccagugugg

SEQ ID NO: 52624 - RNA, 22 nt, Human
gaagcccuggaggggcuggagg

SEQ ID NO: 52625 - RNA, 22 nt, Human
gaagcgucaugaaagaaaggcu

SEQ ID NO: 52626 - RNA, 21 nt, Human
gaagcugcuaugaagggggac

SEQ ID NO: 52627 - RNA, 19 nt, Human
cuucaguguucaccuggcc

SEQ ID NO: 52628 - RNA, 22 nt, Human
cuugcugggagagcuuuagaga

SEQ ID NO: 52629 - RNA, 22 nt, Human
cuuggugagcuccuggcgcagc

SEQ ID NO: 52630 - RNA, 22 nt, Human
cuuguuuggccauaggugcugg

SEQ ID NO: 52631 - RNA, 22 nt, Human
gacccgacaaguaaucagguga

SEQ ID NO: 52632 - RNA, 22 nt, Human
gacccggauguuguacucgagg

SEQ ID NO: 52633 - RNA, 20 nt, Human
gacgaacuagaacaguggua

SEQ ID NO: 52634 - RNA, 22 nt, Human
gacggaggacaucagcaguguc

SEQ ID NO: 52635 - RNA, 22 nt, Human
gacuacauuugguauugacgag

SEQ ID NO: 52636 - RNA, 22 nt, Human
gacugacagugguacuguaauu

SEQ ID NO: 52637 - RNA, 22 nt, Human
gacuccuuaauguggcugaugu

SEQ ID NO: 52638 - RNA, 22 nt, Human
gacuggucuuuugugauggaug

SEQ ID NO: 52639 - RNA, 22 nt, Human
gaaaagcucuuuagaagagguu

SEQ ID NO: 52640 - RNA, 22 nt, Human
gagaaugagucagagcuggcug

SEQ ID NO: 52641 - RNA, 22 nt, Human
gagaggcagcucaggaggucag

SEQ ID NO: 52642 - RNA, 22 nt, Human
gaaaugggggcaugcguuacau

SEQ ID NO: 52643 - RNA, 22 nt, Human
gaacaaggauucccaaagaaga

SEQ ID NO: 52644 - RNA, 22 nt, Human
gaacaugaguuuuaugguauuu

SEQ ID NO: 52645 - RNA, 22 nt, Human
gagcagcacagaccaaacagaa

SEQ ID NO: 52646 - RNA, 22 nt, Human
gagcagcaggccagguugcagg

SEQ ID NO: 52647 - RNA, 22 nt, Human
gaaccuggcagcccuauaucug

SEQ ID NO: 52648 - RNA, 22 nt, Human
gaacggccucguuccucggugu

SEQ ID NO: 52649 - RNA, 22 nt, Human
gagcagcucgagaaggaagcag

SEQ ID NO: 52650 - RNA, 22 nt, Human
gagcagcugagcuggaaugaga

SEQ ID NO: 52651 - RNA, 22 nt, Human
gagcaggcuggcagggccaggg

SEQ ID NO: 52652 - RNA, 22 nt, Human
gagcagggagaggcagagaggc

SEQ ID NO: 52653 - RNA, 22 nt, Human
gaacugggguagggguagcuuu

SEQ ID NO: 52654 - RNA, 22 nt, Human
gagcaggucucaguucugccuc

SEQ ID NO: 52655 - RNA, 22 nt, Human
gaagaggaagaggagccagagc

SEQ ID NO: 52656 - RNA, 22 nt, Human
gaagaugacaucggaucugucu

SEQ ID NO: 52657 - RNA, 22 nt, Human
gagccaugagauaagagcaccu

SEQ ID NO: 52658 - RNA, 22 nt, Human
gagauccccagugugucucggc

SEQ ID NO: 52659 - RNA, 23 nt, Human
gaugauggcaacuacauccggug

SEQ ID NO: 52660 - RNA, 18 nt, Human
gagaggcauuuagcugau

SEQ ID NO: 52661 - RNA, 22 nt, Human
gagaggguugggaggcagcaga

SEQ ID NO: 52662 - RNA, 22 nt, Human
gagaucuguguuugcugaagcu

SEQ ID NO: 52663 - RNA, 22 nt, Human
gauggugauggcccuaagcuga

SEQ ID NO: 52664 - RNA, 22 nt, Human
gauggugcaauuaucgugcaug

SEQ ID NO: 52665 - RNA, 22 nt, Human
gagcacauguggagagucuggg

SEQ ID NO: 52666 - RNA, 22 nt, Human
gagcagacugcacaguucuugc

SEQ ID NO: 52667 - RNA, 22 nt, Human
gaugguggggggcagcugggag

SEQ ID NO: 52668 - RNA, 22 nt, Human
gaugucccuggaggggacagga

SEQ ID NO: 52669 - RNA, 22 nt, Human
gagcagccugaggauucugcuc

SEQ ID NO: 52670 - RNA, 22 nt, Human
gagcaggucuuugguaaugcuu

SEQ ID NO: 52671 - RNA, 22 nt, Human
gagcagguuauuagaaauggaa

SEQ ID NO: 52672 - RNA, 22 nt, Human
gagcaguuagggaccgcaggcu

SEQ ID NO: 52673 - RNA, 22 nt, Human
gagcaugacgcaacaccaagug

SEQ ID NO: 52674 - RNA, 22 nt, Human
gagccauggaggaugugcagca

SEQ ID NO: 52675 - RNA, 22 nt, Human
gagccgcagcugcguagggucc

SEQ ID NO: 52676 - RNA, 22 nt, Human
gagcccuguagcaagucauguc

SEQ ID NO: 52677 - RNA, 22 nt, Human
gauuccugcuauucacagggcu

SEQ ID NO: 52678 - RNA, 22 nt, Human
gauucugaaauuaacagacugg

SEQ ID NO: 52679 - RNA, 22 nt, Human
gauugcugccagcguguccgug

SEQ ID NO: 52680 - RNA, 22 nt, Human
gauuucauaaaacgagaaacuc

SEQ ID NO: 52681 - RNA, 22 nt, Human
gagccggggcucccugaggucc

SEQ ID NO: 52682 - RNA, 22 nt, Human
gagccuggagcuggaacgaagc

SEQ ID NO: 52683 - RNA, 22 nt, Human
gagcgacucuuuuaguccagag

SEQ ID NO: 52684 - RNA, 22 nt, Human
gagcgcacagaaggaagcagcc

SEQ ID NO: 52685 - RNA, 22 nt, Human
gagccuuucuggagggcacuug

SEQ ID NO: 52686 - RNA, 22 nt, Human
gagcgcgcaaucucuccagcug

SEQ ID NO: 52687 - RNA, 22 nt, Human
gauuuugcuuuagugaaggaag

SEQ ID NO: 52688 - RNA, 22 nt, Human
gagcggcucaguggccauguga

SEQ ID NO: 52689 - RNA, 22 nt, Human
gagcuggagaaacacauaagaa

SEQ ID NO: 52690 - RNA, 21 nt, Human
gcaaccagaccacagggcagu

SEQ ID NO: 52691 - RNA, 22 nt, Human
gaggaagucuuaucuggaugca

SEQ ID NO: 52692 - RNA, 22 nt, Human
gcaaggaagcagaguugcuauc

SEQ ID NO: 52693 - RNA, 22 nt, Human
gcaaggacagaagcccacacag

SEQ ID NO: 52694 - RNA, 22 nt, Human
gaggagacaguggagccgcuac

SEQ ID NO: 52695 - RNA, 22 nt, Human
gcaaggaggguaaccacauuuc

SEQ ID NO: 52696 - RNA, 22 nt, Human
gaggagcaggcaggaucugguc

SEQ ID NO: 52697 - RNA, 22 nt, Human
gaggagcuucagaggaaucuua

SEQ ID NO: 52698 - RNA, 22 nt, Human
gaggaggagaagcggcggcgga

SEQ ID NO: 52699 - RNA, 22 nt, Human
gcacaaguccuccgacagcacg

SEQ ID NO: 52700 - RNA, 19 nt, Human
gcacacccugcaccaccau

SEQ ID NO: 52701 - RNA, 22 nt, Human
gaggaggucaccuggugagcaa

SEQ ID NO: 52702 - RNA, 22 nt, Human
gaggaucuuuagcgggacugcu

SEQ ID NO: 52703 - RNA, 22 nt, Human
gcacggucagggugggggagug

SEQ ID NO: 52704 - RNA, 22 nt, Human
gcacccagggcaggaagugagg

SEQ ID NO: 52705 - RNA, 22 nt, Human
gaggccagcacccagaugcaug

SEQ ID NO: 52706 - RNA, 22 nt, Human
gaggcccugagauugcugcccu

SEQ ID NO: 52707 - RNA, 22 nt, Human
gaggcggcgacgcgggcccggg

SEQ ID NO: 52708 - RNA, 23 nt, Human
gcacuccgagggcacgugucucu

SEQ ID NO: 52709 - RNA, 22 nt, Human
gcacucugggucaucugcugcc

SEQ ID NO: 52710 - RNA, 22 nt, Human
gaggcuccgccggggcgggccg

SEQ ID NO: 52711 - RNA, 22 nt, Human
gaggcugguucccuugaucuuu

SEQ ID NO: 52712 - RNA, 22 nt, Human
gagggagugggcccgugggcac

SEQ ID NO: 52713 - RNA, 22 nt, Human
gagggcugccacguugggcgag

SEQ ID NO: 52714 - RNA, 22 nt, Human
gcagaggcaaagucuggaugac

SEQ ID NO: 52715 - RNA, 22 nt, Human
gaggggaaggagcgaaggcggg

SEQ ID NO: 52716 - RNA, 22 nt, Human
gaggggcacaguggggccuggg

SEQ ID NO: 52717 - RNA, 22 nt, Human
gaggggcggggcgggaggagag

SEQ ID NO: 52718 - RNA, 22 nt, Human
gaggggcuccagguguugagga

SEQ ID NO: 52719 - RNA, 22 nt, Human
gcagauaguaggagcuaaucuu

SEQ ID NO: 52720 - RNA, 22 nt, Human
gcagcaaucuucacagugucau

SEQ ID NO: 52721 - RNA, 20 nt, Human
gcagcagacagacaggggac

SEQ ID NO: 52722 - RNA, 22 nt, Human
gcagcagugugggcugaaccua

SEQ ID NO: 52723 - RNA, 21 nt, Human
gcagcaugagaaagccccaaa

SEQ ID NO: 52724 - RNA, 22 nt, Human
gagggggaaaagggcagcagag

SEQ ID NO: 52725 - RNA, 22 nt, Human
gagggggcaggcucggcaccgg

SEQ ID NO: 52726 - RNA, 22 nt, Human
gaggguggggaauagacugcua

SEQ ID NO: 52727 - RNA, 22 nt, Human
gcagcauuaccaagacauggca

SEQ ID NO: 52728 - RNA, 23 nt, Human
gcagccaacccacgugagagaag

SEQ ID NO: 52729 - RNA, 22 nt, Human
gcagccaugcacgucauuauga

SEQ ID NO: 52730 - RNA, 22 nt, Human
gcagcccucuuggucacuaggc

SEQ ID NO: 52731 - RNA, 22 nt, Human
gagguagcgugcagggcccgaa

SEQ ID NO: 52732 - RNA, 22 nt, Human
gaggucagugugggggcaaggg

SEQ ID NO: 52733 - RNA, 22 nt, Human
gagguccaggguggggccugag

SEQ ID NO: 52734 - RNA, 22 nt, Human
gcagccucugcaguucaggagg

SEQ ID NO: 52735 - RNA, 22 nt, Human
gcagccuccggccuggcccccu

SEQ ID NO: 52736 - RNA, 21 nt, Human
gcagcucaggauauagacuug

SEQ ID NO: 52737 - RNA, 22 nt, Human
gcaggaagauugcagaaggcug

SEQ ID NO: 52738 - RNA, 22 nt, Human
gcaggagggggccuggagccca

SEQ ID NO: 52739 - RNA, 22 nt, Human
gcaggccgauuuguuagaaguc

SEQ ID NO: 52740 - RNA, 22 nt, Human
gcaggccuccccugcuggagcu

SEQ ID NO: 52741 - RNA, 22 nt, Human
gcauggaaaagggaugcuaacu

SEQ ID NO: 52742 - RNA, 20 nt, Human
gcauggcuggcugcugucug

SEQ ID NO: 52743 - RNA, 22 nt, Human
gauaccugccaagcugcacuca

SEQ ID NO: 52744 - RNA, 22 nt, Human
gccagucgucuuuauuacagcu

SEQ ID NO: 52745 - RNA, 22 nt, Human
gccauggugagccaccuggugg

SEQ ID NO: 52746 - RNA, 22 nt, Human
gauggacgguuuuaccagacag

SEQ ID NO: 52747 - RNA, 22 nt, Human
gccauguuuugguaaauaccau

SEQ ID NO: 52748 - RNA, 22 nt, Human
gcccagccucagggcaucagcu

SEQ ID NO: 52749 - RNA, 22 nt, Human
gcccgccaacuugccagcggug

SEQ ID NO: 52750 - RNA, 22 nt, Human
gcccuagaguugagagcaccca

SEQ ID NO: 52751 - RNA, 22 nt, Human
gcccugaagagguagagaauuu

SEQ ID NO: 52752 - RNA, 22 nt, Human
gcccugaaggccuccaggacuc

SEQ ID NO: 52753 - RNA, 21 nt, Human
gccgaugugacucuacguagu

SEQ ID NO: 52754 - RNA, 22 nt, Human
gccgcaacggacccugggaguc

SEQ ID NO: 52755 - RNA, 22 nt, Human
gccgccgcucaccugggcgccg

SEQ ID NO: 52756 - RNA, 18 nt, Human
gccgccuugcucgugaac

SEQ ID NO: 52757 - RNA, 15 nt, Human
gccgcgcuggggagc

SEQ ID NO: 52758 - RNA, 22 nt, Human
gccgcguggcagucuuggugac

SEQ ID NO: 52759 - RNA, 22 nt, Human
gccgggagaggcggcgcagggg

SEQ ID NO: 52760 - RNA, 20 nt, Human
gccggggcauaggggccguc

SEQ ID NO: 52761 - RNA, 22 nt, Human
gccguuccuacucucucugugu

SEQ ID NO: 52762 - RNA, 22 nt, Human
gccuaagguucuucagcuauaa

SEQ ID NO: 52763 - RNA, 22 nt, Human
gccuagaagaaugagcgcaggg

SEQ ID NO: 52764 - RNA, 22 nt, Human
gccuccgccuuccugucucccc

SEQ ID NO: 52765 - RNA, 22 nt, Human
gccuccggagucgcagugucuu

SEQ ID NO: 52766 - RNA, 22 nt, Human
gcaacccugggucaugguugac

SEQ ID NO: 52767 - RNA, 22 nt, Human
gcaacuccuaggcgaggccuuc

SEQ ID NO: 52768 - RNA, 22 nt, Human
gcacagcuaugagcugaauugu

SEQ ID NO: 52769 - RNA, 22 nt, Human
gccugcuugaaagcacuuucug

SEQ ID NO: 52770 - RNA, 22 nt, Human
gccuggccaaucgccgucuagg

SEQ ID NO: 52771 - RNA, 22 nt, Human
gccuggggaacuugauccuguc

SEQ ID NO: 52772 - RNA, 22 nt, Human
gccugggguuugcggggcugca

SEQ ID NO: 52773 - RNA, 22 nt, Human
gccuucccuccucugcucucag

SEQ ID NO: 52774 - RNA, 22 nt, Human
gccuucgauaugaggguuugcc

SEQ ID NO: 52775 - RNA, 22 nt, Human
gccuuggacuaccacucccaca

SEQ ID NO: 52776 - RNA, 22 nt, Human
gcggagcuaaagauuggcuccu

SEQ ID NO: 52777 - RNA, 22 nt, Human
gcggaucuccuugagugggcaa

SEQ ID NO: 52778 - RNA, 22 nt, Human
gcagccaauggcgagccccaca

SEQ ID NO: 52779 - RNA, 22 nt, Human
gcagccagggaccuuugacuau

SEQ ID NO: 52780 - RNA, 22 nt, Human
gcagccauggcuggccgggcau

SEQ ID NO: 52781 - RNA, 22 nt, Human
gcagccugaguuuagcucgucg

SEQ ID NO: 52782 - RNA, 22 nt, Human
gcagcgcugagaugauuuguug

SEQ ID NO: 52783 - RNA, 22 nt, Human
gcggcaguccuuccaguacagg

SEQ ID NO: 52784 - RNA, 22 nt, Human
gcggcccggguccccagcagca

SEQ ID NO: 52785 - RNA, 22 nt, Human
gcggccucuuugcugccucagg

SEQ ID NO: 52786 - RNA, 19 nt, Human
gcggcggugccggcuggga

SEQ ID NO: 52787 - RNA, 22 nt, Human
gcggcgucccagcuccgacggc

SEQ ID NO: 52788 - RNA, 22 nt, Human
gcgggccggcaggggaggaguu

SEQ ID NO: 52789 - RNA, 22 nt, Human
gcagcguguggcuaauggcucu

SEQ ID NO: 52790 - RNA, 22 nt, Human
gcagcucagcacgcacagguaa

SEQ ID NO: 52791 - RNA, 22 nt, Human
gcggggggcucgggcagcucgg

SEQ ID NO: 52792 - RNA, 22 nt, Human
gcgggugagauucgagagaugg

SEQ ID NO: 52793 - RNA, 22 nt, Human
gcgguggcuacuaaaguucgaa

SEQ ID NO: 52794 - RNA, 22 nt, Human
gcguagaagaaagcugcugcua

SEQ ID NO: 52795 - RNA, 22 nt, Human
gcgucucugggcugacccaggu

SEQ ID NO: 52796 - RNA, 22 nt, Human
gcgugcauguguguaugcgugu

SEQ ID NO: 52797 - RNA, 22 nt, Human
gcguggaugauuuugagucggu

SEQ ID NO: 52798 - RNA, 21 nt, Human
gcaggggugugugagcugggg

SEQ ID NO: 52799 - RNA, 22 nt, Human
gcaguugguccagccucggcug

SEQ ID NO: 52800 - RNA, 22 nt, Human
gcaguugugguuucguuuccuu

SEQ ID NO: 52801 - RNA, 22 nt, Human
gcucaagaccaagggagcgggg

SEQ ID NO: 52802 - RNA, 19 nt, Human
gcuccugcagcuagagugc

SEQ ID NO: 52803 - RNA, 22 nt, Human
gcucuggcuacuguggcuaccg

SEQ ID NO: 52804 - RNA, 22 nt, Human
gcugcaggaggugguagggucu

SEQ ID NO: 52805 - RNA, 22 nt, Human
gcauuucauaaccagccaugcu

SEQ ID NO: 52806 - RNA, 23 nt, Human
gcauuugcaggaaacuggaaaag

SEQ ID NO: 52807 - RNA, 20 nt, Human
gccaaggaggagaaacaggc

SEQ ID NO: 52808 - RNA, 23 nt, Human
gccaaacugcccguucucucugc

SEQ ID NO: 52809 - RNA, 19 nt, Human
gccacguuggcuaguugcc

SEQ ID NO: 52810 - RNA, 22 nt, Human
gcugcagggagcuggaaggcuc

SEQ ID NO: 52811 - RNA, 22 nt, Human
gcugcgccgggagccggggccg

SEQ ID NO: 52812 - RNA, 22 nt, Human
gccacucaguuuaggggcaagc

SEQ ID NO: 52813 - RNA, 21 nt, Human
gccacugcugcucauucucug

SEQ ID NO: 52814 - RNA, 16 nt, Human
gccagauugaacuuug

SEQ ID NO: 52815 - RNA, 18 nt, Human
gccagcccuccaaccucc

SEQ ID NO: 52816 - RNA, 22 nt, Human
gccagccggugaguggaagcgg

SEQ ID NO: 52817 - RNA, 22 nt, Human
gccaggagaaaaggcgaaugau

SEQ ID NO: 52818 - RNA, 22 nt, Human
gccaggcagcagcgaggauggu

SEQ ID NO: 52819 - RNA, 22 nt, Human
gccaggccuggguggagcgcuc

SEQ ID NO: 52820 - RNA, 22 nt, Human
gcugcgcugggacgccaccaac

SEQ ID NO: 52821 - RNA, 22 nt, Human
gcugcucaaaaaaacacuagcu

SEQ ID NO: 52822 - RNA, 22 nt, Human
gcugcuggcuuccugcuguuuu

SEQ ID NO: 52823 - RNA, 22 nt, Human
gcugcuucgcugcacacccgag

SEQ ID NO: 52824 - RNA, 22 nt, Human
gccagggcucgagcaggccagc

SEQ ID NO: 52825 - RNA, 22 nt, Human
gccaguggucagugggagggug

SEQ ID NO: 52826 - RNA, 23 nt, Human
gccaucugcugggugccccggcc

SEQ ID NO: 52827 - RNA, 22 nt, Human
gccaucugcuuagauugcuggg

SEQ ID NO: 52828 - RNA, 22 nt, Human
gcuggcgauggccgagucuccg

SEQ ID NO: 52829 - RNA, 21 nt, Human
gcuggcugucucuuacacggu

SEQ ID NO: 52830 - RNA, 22 nt, Human
gccaugguggggccucccugac

SEQ ID NO: 52831 - RNA, 22 nt, Human
gccauguucuugaaucuggguc

SEQ ID NO: 52832 - RNA, 20 nt, Human
gcccacccgcacucccgccg

SEQ ID NO: 52833 - RNA, 23 nt, Human
gcccagaggccccuggccugagc

SEQ ID NO: 52834 - RNA, 19 nt, Human
gcugggauaggauguauuu

SEQ ID NO: 52835 - RNA, 22 nt, Human
gcuggggaucgaaggcagagcc

SEQ ID NO: 52836 - RNA, 22 nt, Human
gcugggucucucccugguccug

SEQ ID NO: 52837 - RNA, 22 nt, Human
gcuggguuguucuccuggucca

SEQ ID NO: 52838 - RNA, 22 nt, Human
gcccagcuuuuugaggcaggca

SEQ ID NO: 52839 - RNA, 22 nt, Human
gcccauggagaccucaggcugg

SEQ ID NO: 52840 - RNA, 22 nt, Human
ggaagcuguugugagugcagca

SEQ ID NO: 52841 - RNA, 22 nt, Human
ggaaguggauucagggcugcua

SEQ ID NO: 52842 - RNA, 21 nt, Human
gccugcuguucacccugccac

SEQ ID NO: 52843 - RNA, 22 nt, Human
gccuggaaugcaaugugacgaa

SEQ ID NO: 52844 - RNA, 22 nt, Human
ggacagacagcauggaaccaua

SEQ ID NO: 52845 - RNA, 22 nt, Human
ggacagacuuuacagccccggg

SEQ ID NO: 52846 - RNA, 21 nt, Human
ggacccucagauggcagugag

SEQ ID NO: 52847 - RNA, 20 nt, Human
ggacccuggguucuucugag

SEQ ID NO: 52848 - RNA, 22 nt, Human
ggacggggagcuggaaagggga

SEQ ID NO: 52849 - RNA, 23 nt, Human
ggacuaggcaacagaugggacag

SEQ ID NO: 52850 - RNA, 22 nt, Human
ggacugggagaauggaggcaag

SEQ ID NO: 52851 - RNA, 22 nt, Human
gcgauugguuuggggccagagu

SEQ ID NO: 52852 - RNA, 22 nt, Human
gcgcacaaccccguggcgguga

SEQ ID NO: 52853 - RNA, 20 nt, Human
gcgcaguuccgggcgcgucu

SEQ ID NO: 52854 - RNA, 22 nt, Human
ggagaucugggcuguuucuggc

SEQ ID NO: 52855 - RNA, 22 nt, Human
ggagaucucauugauacugaua

SEQ ID NO: 52856 - RNA, 22 nt, Human
ggagaugacaucccagcccggc

SEQ ID NO: 52857 - RNA, 22 nt, Human
ggagccaguuuagaccucaguu

SEQ ID NO: 52858 - RNA, 22 nt, Human
ggagccuggaguuucugauggg

SEQ ID NO: 52859 - RNA, 22 nt, Human
ggaucagcgagaagggcugaaa

SEQ ID NO: 52860 - RNA, 23 nt, Human
ggauccugacauauaccaucacc

SEQ ID NO: 52861 - RNA, 22 nt, Human
ggauggaugugaucugccuccu

SEQ ID NO: 52862 - RNA, 22 nt, Human
ggaugggcuuggggaggucuag

SEQ ID NO: 52863 - RNA, 22 nt, Human
ggauggugauguacccagucau

SEQ ID NO: 52864 - RNA, 22 nt, Human
gcggcggcggaggcgggggcag

SEQ ID NO: 52865 - RNA, 22 nt, Human
gcggcuggcuguccaaacuggg

SEQ ID NO: 52866 - RNA, 23 nt, Human
gcgggcggagccgggaggcgggg

SEQ ID NO: 52867 - RNA, 19 nt, Human
gcgggcucuccaccccauc

SEQ ID NO: 52868 - RNA, 22 nt, Human
gcgggcuuggcuccagggccca

SEQ ID NO: 52869 - RNA, 20 nt, Human
ggcagagcuaugucuguugc

SEQ ID NO: 52870 - RNA, 22 nt, Human
ggcagagcugugcgcccaccca

SEQ ID NO: 52871 - RNA, 22 nt, Human
ggcagaggaagcuggaaguggg

SEQ ID NO: 52872 - RNA, 22 nt, Human
ggcagagguagcuggaaccagg

SEQ ID NO: 52873 - RNA, 20 nt, Human
ggcagcaaccauaugcuaca

SEQ ID NO: 52874 - RNA, 22 nt, Human
gcggggcucuacuuggccugga

SEQ ID NO: 52875 - RNA, 22 nt, Human
gcggguggaggagggacgggca

SEQ ID NO: 52876 - RNA, 22 nt, Human
gcuacaacugugucuguggggc

SEQ ID NO: 52877 - RNA, 22 nt, Human
ggcaggauggagcagggcuaaa

SEQ ID NO: 52878 - RNA, 22 nt, Human
ggcagggagagcaugcugauaa

SEQ ID NO: 52879 - RNA, 22 nt, Human
ggcagggagagcgccgccaugc

SEQ ID NO: 52880 - RNA, 22 nt, Human
gcucagcuggagagggacgggu

SEQ ID NO: 52881 - RNA, 22 nt, Human
gcucaugggcccagagcagccc

SEQ ID NO: 52882 - RNA, 21 nt, Human
gcucccgaagugcucggcguu

SEQ ID NO: 52883 - RNA, 22 nt, Human
gcucugcuccaucuguuuccuc

SEQ ID NO: 52884 - RNA, 22 nt, Human
gcucuugcuuuuucuagaaaga

SEQ ID NO: 52885 - RNA, 23 nt, Human
gcugaagcccacucccugggucu

SEQ ID NO: 52886 - RNA, 22 nt, Human
gcugcacgguccuggcaccacg

SEQ ID NO: 52887 - RNA, 22 nt, Human
gcugcccauugcucucccacuc

SEQ ID NO: 52888 - RNA, 22 nt, Human
gcugcccucccagggcaagcuu

SEQ ID NO: 52889 - RNA, 22 nt, Human
gcugccgcugcggggcgcgggc

SEQ ID NO: 52890 - RNA, 23 nt, Human
gcugccguuucccaucgugguga

SEQ ID NO: 52891 - RNA, 22 nt, Human
ggccccggaggccguuagcuua

SEQ ID NO: 52892 - RNA, 22 nt, Human
ggcccgcgcugcuggcgcgcca

SEQ ID NO: 52893 - RNA, 22 nt, Human
ggccgccacacagauucccccg

SEQ ID NO: 52894 - RNA, 22 nt, Human
ggccgccacuuuccagugcugc

SEQ ID NO: 52895 - RNA, 22 nt, Human
ggccgcuuucuggggagugagg

SEQ ID NO: 52896 - RNA, 22 nt, Human
ggccgggugggaggcagcggag

SEQ ID NO: 52897 - RNA, 22 nt, Human
ggccgggcaugcgagcugagcg

SEQ ID NO: 52898 - RNA, 22 nt, Human
ggccucucuccuuggcuugcag

SEQ ID NO: 52899 - RNA, 20 nt, Human
ggccugagcauggcuggcag

SEQ ID NO: 52900 - RNA, 22 nt, Human
ggccugcuaccagcugugaccu

SEQ ID NO: 52901 - RNA, 22 nt, Human
ggccugcucuggcuguggucag

SEQ ID NO: 52902 - RNA, 22 nt, Human
ggccuggccuccugcuuuucca

SEQ ID NO: 52903 - RNA, 22 nt, Human
ggccuugggauguggcugcagc

SEQ ID NO: 52904 - RNA, 22 nt, Human
ggcgacuacugaaugcuugaaa

SEQ ID NO: 52905 - RNA, 22 nt, Human
ggccuugauuccggucauugaa

SEQ ID NO: 52906 - RNA, 22 nt, Human
gcugccuugaacuuggccuggg

SEQ ID NO: 52907 - RNA, 22 nt, Human
gcugcgcgcagccggcgccgag

SEQ ID NO: 52908 - RNA, 22 nt, Human
gcugcuacagagcuggaggggg

SEQ ID NO: 52909 - RNA, 22 nt, Human
gcugcuggcggagcuggcgcug

SEQ ID NO: 52910 - RNA, 22 nt, Human
ggcgaguacagacggggccugg

SEQ ID NO: 52911 - RNA, 22 nt, Human
ggcgcaguguucgcccucucgc

SEQ ID NO: 52912 - RNA, 22 nt, Human
ggcgccuuguggaaugagagcu

SEQ ID NO: 52913 - RNA, 22 nt, Human
ggcgcuccccgccugcgucgcg

SEQ ID NO: 52914 - RNA, 22 nt, Human
ggcgcccucccuguccgucuuc

SEQ ID NO: 52915 - RNA, 22 nt, Human
ggcggaggucacgcacccgcca

SEQ ID NO: 52916 - RNA, 22 nt, Human
ggcggcaagggaauggagaaga

SEQ ID NO: 52917 - RNA, 22 nt, Human
ggcgggucuagggcccuggagu

SEQ ID NO: 52918 - RNA, 23 nt, Human
ggcgugcugggcugacccuuggc

SEQ ID NO: 52919 - RNA, 22 nt, Human
ggcuaaucaagaaggcccagug

SEQ ID NO: 52920 - RNA, 22 nt, Human
ggcuagggaucuagaccaggac

SEQ ID NO: 52921 - RNA, 22 nt, Human
ggcuccagauguccccuggcaa

SEQ ID NO: 52922 - RNA, 22 nt, Human
ggcuccugggcgucuucgaaca

SEQ ID NO: 52923 - RNA, 22 nt, Human
gcuggaaauaacuuguguagaa

SEQ ID NO: 52924 - RNA, 22 nt, Human
gcuggaagggccagcuuucagg

SEQ ID NO: 52925 - RNA, 22 nt, Human
gcuggaugucugugccaggcac

SEQ ID NO: 52926 - RNA, 22 nt, Human
gcuggccugcgagggcaggcug

SEQ ID NO: 52927 - RNA, 22 nt, Human
ggcucuggcgagcuuuaguaca

SEQ ID NO: 52928 - RNA, 22 nt, Human
ggcugaggccucuggggaggga

SEQ ID NO: 52929 - RNA, 22 nt, Human
ggcugcugcccaccccugcaug

SEQ ID NO: 52930 - RNA, 22 nt, Human
ggcugcuggaguugggucucuc

SEQ ID NO: 52931 - RNA, 22 nt, Human
ggcugcuugggcuguuucuuuu

SEQ ID NO: 52932 - RNA, 22 nt, Human
ggcuggaacuucuucuggcauu

SEQ ID NO: 52933 - RNA, 22 nt, Human
gcuggcggguuggggaggcgga

SEQ ID NO: 52934 - RNA, 22 nt, Human
ggcucccgugggaugguggagc

SEQ ID NO: 52935 - RNA, 22 nt, Human
gcugggacacacagucuucuuu

SEQ ID NO: 52936 - RNA, 22 nt, Human
gcugggagaggcagcuuucgga

SEQ ID NO: 52937 - RNA, 22 nt, Human
gcugggagucgcgucuguggcc

SEQ ID NO: 52938 - RNA, 22 nt, Human
gcugggccucuuacuucuuacg

SEQ ID NO: 52939 - RNA, 22 nt, Human
ggcugggagguggcgaggaggc

SEQ ID NO: 52940 - RNA, 22 nt, Human
ggcugguggcgggcagcacaga

SEQ ID NO: 52941 - RNA, 22 nt, Human
ggcugugaaguacguugaaggu

SEQ ID NO: 52942 - RNA, 22 nt, Human
ggcuguggcagcuggaaguggu

SEQ ID NO: 52943 - RNA, 21 nt, Human
gcuguagauucacaaagaggu

SEQ ID NO: 52944 - RNA, 18 nt, Human
gcuguccgguagcuggug

SEQ ID NO: 52945 - RNA, 22 nt, Human
gcuguccugggaacaggcacua

SEQ ID NO: 52946 - RNA, 22 nt, Human
gcugugacaagaggcugcuucu

SEQ ID NO: 52947 - RNA, 22 nt, Human
ggcuucucuuggccaugguccc

SEQ ID NO: 52948 - RNA, 22 nt, Human
gcuguggacacagcucucuuca

SEQ ID NO: 52949 - RNA, 22 nt, Human
gcuguggagaagcugccuaugg

SEQ ID NO: 52950 - RNA, 23 nt, Human
gcuuugaaaaugcuuucuuccag

SEQ ID NO: 52951 - RNA, 22 nt, Human
gcuuuggcuucuccuggcagga

SEQ ID NO: 52952 - RNA, 22 nt, Human
gggaggcagacgcuggagccca

SEQ ID NO: 52953 - RNA, 22 nt, Human
gggaguggagagugaagcuaau

SEQ ID NO: 52954 - RNA, 22 nt, Human
ggaaaagccauauuauaggcaa

SEQ ID NO: 52955 - RNA, 22 nt, Human
gggcagaaaggaaggcuggggg

SEQ ID NO: 52956 - RNA, 22 nt, Human
gggcaugugauggacgugugcc

SEQ ID NO: 52957 - RNA, 22 nt, Human
gggccaggaugugguucauuuu

SEQ ID NO: 52958 - RNA, 19 nt, Human
ggaacgcugggcuccccuc

SEQ ID NO: 52959 - RNA, 18 nt, Human
ggaaggugcuggagugca

SEQ ID NO: 52960 - RNA, 22 nt, Human
gggcgcgccaggagcugcgcgg

SEQ ID NO: 52961 - RNA, 22 nt, Human
gggcgcgcggagccucgccggg

SEQ ID NO: 52962 - RNA, 22 nt, Human
gggcgcuguguuaggugcugua

SEQ ID NO: 52963 - RNA, 22 nt, Human
gggcgcuuucugggucagggcu

SEQ ID NO: 52964 - RNA, 22 nt, Human
gggcggcguccucagucgggug

SEQ ID NO: 52965 - RNA, 22 nt, Human
gggcggccugcucuguggggag

SEQ ID NO: 52966 - RNA, 22 nt, Human
gggcggggcucacggugcggca

SEQ ID NO: 52967 - RNA, 22 nt, Human
gggcggggcuuccguccuccac

SEQ ID NO: 52968 - RNA, 22 nt, Human
gggcggggggagcuggaaugaa

SEQ ID NO: 52969 - RNA, 22 nt, Human
gggcggugccugucuccgaagc

SEQ ID NO: 52970 - RNA, 22 nt, Human
gggcuagggucagggggccacu

SEQ ID NO: 52971 - RNA, 20 nt, Human
gggcucugcauccaucagcc

SEQ ID NO: 52972 - RNA, 22 nt, Human
ggacagagcaacccuacgcagc

SEQ ID NO: 52973 - RNA, 22 nt, Human
ggacauggaaagugugugauuu

SEQ ID NO: 52974 - RNA, 22 nt, Human
ggacauggccguaguccccacg

SEQ ID NO: 52975 - RNA, 22 nt, Human
gggcugaugcuuauacauacug

SEQ ID NO: 52976 - RNA, 22 nt, Human
gggcuggcaguuuucugaguuc

SEQ ID NO: 52977 - RNA, 22 nt, Human
ggggaagugguggggcuccgag

SEQ ID NO: 52978 - RNA, 22 nt, Human
ggagaagaggagcuggaagccu

SEQ ID NO: 52979 - RNA, 22 nt, Human
ggagacagauggcgucucaguu

SEQ ID NO: 52980 - RNA, 22 nt, Human
ggggacugccgacagucucaaa

SEQ ID NO: 52981 - RNA, 22 nt, Human
ggagagcguggaugggcuucca

SEQ ID NO: 52982 - RNA, 22 nt, Human
ggagagcuagugagcuggaggu

SEQ ID NO: 52983 - RNA, 22 nt, Human
ggagaucuuggacuggccggcc

SEQ ID NO: 52984 - RNA, 22 nt, Human
ggggcugggaggccggcgcgca

SEQ ID NO: 52985 - RNA, 17 nt, Human
ggggcguguauuugaug

SEQ ID NO: 52986 - RNA, 22 nt, Human
gggggggcagguuggaugucag

SEQ ID NO: 52987 - RNA, 22 nt, Human
ggggugaggcagggcagggguc

SEQ ID NO: 52988 - RNA, 22 nt, Human
ggagggagugcaggcaggcaga

SEQ ID NO: 52989 - RNA, 22 nt, Human
gggucagggaggccccaccaug

SEQ ID NO: 52990 - RNA, 22 nt, Human
gggucggcacucuggcagcacc

SEQ ID NO: 52991 - RNA, 22 nt, Human
ggguggugauacugcuucugcc

SEQ ID NO: 52992 - RNA, 22 nt, Human
gggugugcuaaaccuacgcaca

SEQ ID NO: 52993 - RNA, 22 nt, Human
ggaguucacagcaauggaacag

SEQ ID NO: 52994 - RNA, 22 nt, Human
ggaguuucugucaucccguccc

SEQ ID NO: 52995 - RNA, 22 nt, Human
gguaccuggcccuggggcugcu

SEQ ID NO: 52996 - RNA, 22 nt, Human
ggcaaagaguacaucguccugg

SEQ ID NO: 52997 - RNA, 22 nt, Human
ggcaagauccagcacaaacaca

SEQ ID NO: 52998 - RNA, 22 nt, Human
ggcaagcacugggugucuuagc

SEQ ID NO: 52999 - RNA, 22 nt, Human
ggcacgagccaguguguguguu

SEQ ID NO: 53000 - RNA, 22 nt, Human
ggcacuggguugcagagagaga

SEQ ID NO: 53001 - RNA, 22 nt, Human
ggucgguuggagagaucaugaa

SEQ ID NO: 53002 - RNA, 22 nt, Human
ggucggggcuggccggcguggu

SEQ ID NO: 53003 - RNA, 22 nt, Human
ggucgucuguccugucgccgcu

SEQ ID NO: 53004 - RNA, 20 nt, Human
ggucuguuucuucuuuucau

SEQ ID NO: 53005 - RNA, 22 nt, Human
ggucuucauaugccacagaguc

SEQ ID NO: 53006 - RNA, 22 nt, Human
ggucuucauucuaccagacuuu

SEQ ID NO: 53007 - RNA, 22 nt, Human
ggugaaggaucccucuuggccu

SEQ ID NO: 53008 - RNA, 22 nt, Human
ggugcaaagauggcaguugcaa

SEQ ID NO: 53009 - RNA, 22 nt, Human
ggcagcagaacuggcccuguau

SEQ ID NO: 53010 - RNA, 22 nt, Human
ggcagcccuggacccuggagaa

SEQ ID NO: 53011 - RNA, 21 nt, Human
ggcagccuggcaggggcacug

SEQ ID NO: 53012 - RNA, 22 nt, Human
ggcaggaaguaaggaugcuaca

SEQ ID NO: 53013 - RNA, 18 nt, Human
ggcagggcucagcugcuc

SEQ ID NO: 53014 - RNA, 22 nt, Human
ggcagguccugaguccugaggc

SEQ ID NO: 53015 - RNA, 22 nt, Human
ggcagguggcacugcugcuccc

SEQ ID NO: 53016 - RNA, 22 nt, Human
ggcagugguaggagcccaggag

SEQ ID NO: 53017 - RNA, 22 nt, Human
ggugcugcugcugaacccagcu

SEQ ID NO: 53018 - RNA, 22 nt, Human
ggugcuggggaaauuaggguag

SEQ ID NO: 53019 - RNA, 22 nt, Human
ggugggaauccaggccuucauc

SEQ ID NO: 53020 - RNA, 22 nt, Human
gguggggacuuggggucagcgg

SEQ ID NO: 53021 - RNA, 22 nt, Human
ggugggccaaauuaaacauaua

SEQ ID NO: 53022 - RNA, 22 nt, Human
gguggucaggagcgcccguugg

SEQ ID NO: 53023 - RNA, 22 nt, Human
ggccagcuuugagcugcaggaa

SEQ ID NO: 53024 - RNA, 22 nt, Human
gguugcggaccagcugggcugc

SEQ ID NO: 53025 - RNA, 22 nt, Human
ggcccugcuuccccaguguaca

SEQ ID NO: 53026 - RNA, 22 nt, Human
ggcccuggggcaggagcagagg

SEQ ID NO: 53027 - RNA, 22 nt, Human
guacugggaauggagccugggc

SEQ ID NO: 53028 - RNA, 22 nt, Human
guagguggaggcaacacagcca

SEQ ID NO: 53029 - RNA, 22 nt, Human
guagucauugggucugugguca

SEQ ID NO: 53030 - RNA, 22 nt, Human
ggccgccgcuuagcugagcccc

SEQ ID NO: 53031 - RNA, 18 nt, Human
ggccucagccuggccgga

SEQ ID NO: 53032 - RNA, 22 nt, Human
ggccugagaagcaaggacacaa

SEQ ID NO: 53033 - RNA, 22 nt, Human
ggccuccaucuuaucuuacucu

SEQ ID NO: 53034 - RNA, 22 nt, Human
ggccuggcacauaguaggcagu

SEQ ID NO: 53035 - RNA, 22 nt, Human
ggccuugguggcuuugcugaug

SEQ ID NO: 53036 - RNA, 22 nt, Human
gggcagagagcuggaacuccuu

SEQ ID NO: 53037 - RNA, 22 nt, Human
gggcaggcuggguggugguccc

SEQ ID NO: 53038 - RNA, 22 nt, Human
gggcaggggcagugguggcauu

SEQ ID NO: 53039 - RNA, 22 nt, Human
gggcagucagauucgggggccu

SEQ ID NO: 53040 - RNA, 22 nt, Human
gggcaugcagcaauucuguggu

SEQ ID NO: 53041 - RNA, 22 nt, Human
gggccaaggggagcuggaaggg

SEQ ID NO: 53042 - RNA, 22 nt, Human
gggcccaacuguuggcagccuc

SEQ ID NO: 53043 - RNA, 22 nt, Human
gggccgcagccucuccggccug

SEQ ID NO: 53044 - RNA, 22 nt, Human
gggccggagaagguagcugaag

SEQ ID NO: 53045 - RNA, 22 nt, Human
guggcagagagcaagugucuga

SEQ ID NO: 53046 - RNA, 22 nt, Human
guggcagagccuugcggcuuug

SEQ ID NO: 53047 - RNA, 20 nt, Human
guggcagugguggcagcagu

SEQ ID NO: 53048 - RNA, 22 nt, Human
guggcauggggagcagcuagaa

SEQ ID NO: 53049 - RNA, 22 nt, Human
guggcgucgaugauggugucau

SEQ ID NO: 53050 - RNA, 22 nt, Human
guggcuggguggaacugagucu

SEQ ID NO: 53051 - RNA, 22 nt, Human
gugggaguggagcucagcaugu

SEQ ID NO: 53052 - RNA, 18 nt, Human
gugggcacacacucuguu

SEQ ID NO: 53053 - RNA, 22 nt, Human
gugggcuuuuuugaaaccugaa

SEQ ID NO: 53054 - RNA, 22 nt, Human
gugggggcagaagcgagugcag

SEQ ID NO: 53055 - RNA, 22 nt, Human
gugggggcuaaauugaggggug

SEQ ID NO: 53056 - RNA, 22 nt, Human
gggccugcgcuggggggagccg

SEQ ID NO: 53057 - RNA, 22 nt, Human
gggccuguccccccaggagaac

SEQ ID NO: 53058 - RNA, 21 nt, Human
gggccugggccagggccgggu

SEQ ID NO: 53059 - RNA, 22 nt, Human
gggccuuggaggagaaggacuu

SEQ ID NO: 53060 - RNA, 22 nt, Human
gggcgagcgucucagccgggcg

SEQ ID NO: 53061 - RNA, 22 nt, Human
gggcgcaagcaugugucugggu

SEQ ID NO: 53062 - RNA, 22 nt, Human
gggcgccgggagugagagugag

SEQ ID NO: 53063 - RNA, 22 nt, Human
gugggugauacugccgugggag

SEQ ID NO: 53064 - RNA, 22 nt, Human
gugguaccaguaggucagccau

SEQ ID NO: 53065 - RNA, 22 nt, Human
guggugauuugggucuagcuuu

SEQ ID NO: 53066 - RNA, 22 nt, Human
gugguccuaggugcucaaguca

SEQ ID NO: 53067 - RNA, 22 nt, Human
gugguccugguugucugagaga

SEQ ID NO: 53068 - RNA, 22 nt, Human
guggugggcgugguguaugccu

SEQ ID NO: 53069 - RNA, 22 nt, Human
gggcuacugagcuggaacuggg

SEQ ID NO: 53070 - RNA, 22 nt, Human
gugguuugcugguguacguuua

SEQ ID NO: 53071 - RNA, 22 nt, Human
guguccaaagguaggaggaggg

SEQ ID NO: 53072 - RNA, 22 nt, Human
gugucccaaagauuagaaauca

SEQ ID NO: 53073 - RNA, 22 nt, Human
gggcugcuccgcccgcugcgcc

SEQ ID NO: 53074 - RNA, 22 nt, Human
gggcuggggcucuggggcuagg

SEQ ID NO: 53075 - RNA, 22 nt, Human
gggcuguggggccugcagaagg

SEQ ID NO: 53076 - RNA, 22 nt, Human
gggcuuguuaacuuggcuucca

SEQ ID NO: 53077 - RNA, 19 nt, Human
gggcuuguuggcaaaugac

SEQ ID NO: 53078 - RNA, 22 nt, Human
ggggaaauauuucugaccugug

SEQ ID NO: 53079 - RNA, 22 nt, Human
ggggacggcuggccggggcccc

SEQ ID NO: 53080 - RNA, 22 nt, Human
ggggaggaagcuggaacacggg

SEQ ID NO: 53081 - RNA, 23 nt, Human
guguuguugauuuucgaaucuuu

SEQ ID NO: 53082 - RNA, 22 nt, Human
ggggcaucguugauugcauggu

SEQ ID NO: 53083 - RNA, 22 nt, Human
ggggccgggccggcagacuggg

SEQ ID NO: 53084 - RNA, 22 nt, Human
ggggccuuugaguugggucccu

SEQ ID NO: 53085 - RNA, 22 nt, Human
ggggcgaguguggaccgcagcc

SEQ ID NO: 53086 - RNA, 22 nt, Human
ggggcggcgugggcgcggugau

SEQ ID NO: 53087 - RNA, 23 nt, Human
guuaccgaccugauucggcagcc

SEQ ID NO: 53088 - RNA, 22 nt, Human
ggggcggggagcaugagcuggg

SEQ ID NO: 53089 - RNA, 22 nt, Human
ggggcuggguuugcgcaggcuc

SEQ ID NO: 53090 - RNA, 22 nt, Human
ggggcuuggguaagaaugcaaa

SEQ ID NO: 53091 - RNA, 22 nt, Human
gggggaggcucggcgccgcggu

SEQ ID NO: 53092 - RNA, 22 nt, Human
gggggcagguuccaggccagcu

SEQ ID NO: 53093 - RNA, 22 nt, Human
gggggcugugugcccgcucccc

SEQ ID NO: 53094 - RNA, 22 nt, Human
guuccgcggccucgcgcugagc

SEQ ID NO: 53095 - RNA, 22 nt, Human
guuccgcugcaaggccaggaaa

SEQ ID NO: 53096 - RNA, 22 nt, Human
guucggcuuccuaugucaugag

SEQ ID NO: 53097 - RNA, 22 nt, Human
gggucuggagauccgggugaag

SEQ ID NO: 53098 - RNA, 20 nt, Human
gggucuggcaucucucucug

SEQ ID NO: 53099 - RNA, 22 nt, Human
gggugcucauggauaaggcgaa

SEQ ID NO: 53100 - RNA, 22 nt, Human
ggguggcaagucuuucugcaac

SEQ ID NO: 53101 - RNA, 22 nt, Human
ggguggggcaugcucucuucug

SEQ ID NO: 53102 - RNA, 22 nt, Human
ggguggugagagaacuuugcag

SEQ ID NO: 53103 - RNA, 22 nt, Human
gggugguggagguuugacagac

SEQ ID NO: 53104 - RNA, 22 nt, Human
gggugguuccuggaucugacug

SEQ ID NO: 53105 - RNA, 22 nt, Human
ggguuccugaagugguucagga

SEQ ID NO: 53106 - RNA, 22 nt, Human
ggguuuccugcucgcggguagc

SEQ ID NO: 53107 - RNA, 22 nt, Human
ggguuuugugauugccucugaa

SEQ ID NO: 53108 - RNA, 22 nt, Human
guucuucagcccucagguccua

SEQ ID NO: 53109 - RNA, 22 nt, Human
gguauccaaauaaagcagguaa

SEQ ID NO: 53110 - RNA, 20 nt, Human
ggucagccaagaaguuaccu

SEQ ID NO: 53111 - RNA, 22 nt, Human
ggucaucacugagagcagaucc

SEQ ID NO: 53112 - RNA, 22 nt, Human
ggugcuucgauagguguccaua

SEQ ID NO: 53113 - RNA, 22 nt, Human
gguggccggcaccccacccucg

SEQ ID NO: 53114 - RNA, 22 nt, Human
gguggcuugcugguaggugugc

SEQ ID NO: 53115 - RNA, 22 nt, Human
gguguuccgguucugcucuggg

SEQ ID NO: 53116 - RNA, 22 nt, Human
gguuccagacaguuauaugggc

SEQ ID NO: 53117 - RNA, 22 nt, Human
gguugccuguggcucccuguua

SEQ ID NO: 53118 - RNA, 22 nt, Human
guagggguggggagguggucug

SEQ ID NO: 53119 - RNA, 22 nt, Human
gucaccgguuuuuagguaaaca

SEQ ID NO: 53120 - RNA, 22 nt, Human
gucacgucgggacagacugggg

SEQ ID NO: 53121 - RNA, 21 nt, Human
uaaggaagagcauuuuagguc

SEQ ID NO: 53122 - RNA, 22 nt, Human
gucagacugaguuccuggguac

SEQ ID NO: 53123 - RNA, 22 nt, Human
gucugcagcacugugcacgguc

SEQ ID NO: 53124 - RNA, 22 nt, Human
uacaccaugcuccagcaggaca

SEQ ID NO: 53125 - RNA, 22 nt, Human
gucugccagauucugcuggauc

SEQ ID NO: 53126 - RNA, 22 nt, Human
uacaggaggaugugcagccagg

SEQ ID NO: 53127 - RNA, 23 nt, Human
uaccagacccugaaagaaagugu

SEQ ID NO: 53128 - RNA, 22 nt, Human
uaccaugggucaguuggguuug

SEQ ID NO: 53129 - RNA, 20 nt, Human
uacccgcagcugggucuggc

SEQ ID NO: 53130 - RNA, 22 nt, Human
uacugccauuauccugcugaaa

SEQ ID NO: 53131 - RNA, 22 nt, Human
gugaagcaagggucaccugugg

SEQ ID NO: 53132 - RNA, 22 nt, Human
gugaucagaagaaccugccgaa

SEQ ID NO: 53133 - RNA, 19 nt, Human
gugaugaugccacuccaac

SEQ ID NO: 53134 - RNA, 22 nt, Human
gugauggggagagcgcagcuuu

SEQ ID NO: 53135 - RNA, 22 nt, Human
uagaggccagggugucuugagu

SEQ ID NO: 53136 - RNA, 22 nt, Human
gugauuucagguuuuucauacu

SEQ ID NO: 53137 - RNA, 22 nt, Human
gugcagcugguggagucugggg

SEQ ID NO: 53138 - RNA, 22 nt, Human
uagagugcugucaaagacuugu

SEQ ID NO: 53139 - RNA, 22 nt, Human
gugccaccagaugcuguugcua

SEQ ID NO: 53140 - RNA, 22 nt, Human
gugccugcucauucucaauauu

SEQ ID NO: 53141 - RNA, 22 nt, Human
uagcagcacuauuuguuguagu

SEQ ID NO: 53142 - RNA, 22 nt, Human
uagcaggagagaaguuuuaagu

SEQ ID NO: 53143 - RNA, 22 nt, Human
gugccuggugcaggauaaucac

SEQ ID NO: 53144 - RNA, 22 nt, Human
gugcucaagacauuaggaauau

SEQ ID NO: 53145 - RNA, 22 nt, Human
uaguuccucuucucagggccau

SEQ ID NO: 53146 - RNA, 22 nt, Human
uauauauaauguguacagguga

SEQ ID NO: 53147 - RNA, 22 nt, Human
guguccaugugggugcucuccu

SEQ ID NO: 53148 - RNA, 22 nt, Human
guucaccaguagcugggcuguu

SEQ ID NO: 53149 - RNA, 22 nt, Human
ucaaggaagggguaggaauaau

SEQ ID NO: 53150 - RNA, 22 nt, Human
ucacaugcucaccuaagccaca

SEQ ID NO: 53151 - RNA, 22 nt, Human
ucacauggauuaacucauuuau

SEQ ID NO: 53152 - RNA, 22 nt, Human
ucaccaugcccuucucugcucu

SEQ ID NO: 53153 - RNA, 22 nt, Human
ucaccauguacaugaagggcgg

SEQ ID NO: 53154 - RNA, 22 nt, Human
ucaccauguuuucauaggaaca

SEQ ID NO: 53155 - RNA, 22 nt, Human
ucaccugccuggguggucaccu

SEQ ID NO: 53156 - RNA, 22 nt, Human
ucaccuggagagcuugcuaaua

SEQ ID NO: 53157 - RNA, 22 nt, Human
guuuccaagucucucaacaccc

SEQ ID NO: 53158 - RNA, 22 nt, Human
guuucuguggacucugcuuagg

SEQ ID NO: 53159 - RNA, 22 nt, Human
guuugcagacuauguaaacuuc

SEQ ID NO: 53160 - RNA, 19 nt, Human
ucacggucaaccagagccu

SEQ ID NO: 53161 - RNA, 23 nt, Human
ucagaccaaccucuugcuggaac

SEQ ID NO: 53162 - RNA, 21 nt, Human
ucagccuguccaguguuaacc

SEQ ID NO: 53163 - RNA, 22 nt, Human
ucagcugggagaaaguuuuagg

SEQ ID NO: 53164 - RNA, 22 nt, Human
ucaucauccuuuuuugaagagu

SEQ ID NO: 53165 - RNA, 21 nt, Human
ucauccagguccugcuucuuc

SEQ ID NO: 53166 - RNA, 22 nt, Human
ucauccgcaaccacuuuagccu

SEQ ID NO: 53167 - RNA, 22 nt, Human
ucauccucguccucuggugccc

SEQ ID NO: 53168 - RNA, 22 nt, Human
ucauccugaagaaccugcuucc

SEQ ID NO: 53169 - RNA, 22 nt, Human
ucauccugucucuguucggaau

SEQ ID NO: 53170 - RNA, 22 nt, Human
uaaggcuguuaggaggauuaaa

SEQ ID NO: 53171 - RNA, 22 nt, Human
uacagaccaguaguucucagcg

SEQ ID NO: 53172 - RNA, 22 nt, Human
uccacagggaugccugcggcuu

SEQ ID NO: 53173 - RNA, 22 nt, Human
uccaccaccaucacagucagac

SEQ ID NO: 53174 - RNA, 22 nt, Human
uccaccugucccugcuuccugc

SEQ ID NO: 53175 - RNA, 22 nt, Human
uccacgcucuuucuacuuuuca

SEQ ID NO: 53176 - RNA, 22 nt, Human
uccacgggagcgucggucucgg

SEQ ID NO: 53177 - RNA, 20 nt, Human
uaccagggguuugggacagc

SEQ ID NO: 53178 - RNA, 22 nt, Human
uccagagcuguccuacugugag

SEQ ID NO: 53179 - RNA, 22 nt, Human
uccagccauaucuuguagcccu

SEQ ID NO: 53180 - RNA, 19 nt, Human
uacccggauagccagguag

SEQ ID NO: 53181 - RNA, 22 nt, Human
uccaggucgggggugggccggc

SEQ ID NO: 53182 - RNA, 22 nt, Human
uccagguucaguucaucaucua

SEQ ID NO: 53183 - RNA, 22 nt, Human
uccagguggcuuuccuggggga

SEQ ID NO: 53184 - RNA, 22 nt, Human
uccaguggcaccuuggcccuca

SEQ ID NO: 53185 - RNA, 22 nt, Human
ucccagcaggcaccgcuucugc

SEQ ID NO: 53186 - RNA, 22 nt, Human
uccggcgaccuccagauguucc

SEQ ID NO: 53187 - RNA, 22 nt, Human
uccccaccuaagauacccaucu

SEQ ID NO: 53188 - RNA, 22 nt, Human
uagaccugugggggcagcgggc

SEQ ID NO: 53189 - RNA, 22 nt, Human
uagacuggaagcuccuugaggc

SEQ ID NO: 53190 - RNA, 22 nt, Human
uccugaggaaauuucaccuagu

SEQ ID NO: 53191 - RNA, 22 nt, Human
uagcaggaggcaguuccucgcu

SEQ ID NO: 53192 - RNA, 17 nt, Human
uagccagcuugugauuu

SEQ ID NO: 53193 - RNA, 22 nt, Human
uagccguugggguaacuggaca

SEQ ID NO: 53194 - RNA, 22 nt, Human
uagcgggucacccugcugugaa

SEQ ID NO: 53195 - RNA, 22 nt, Human
uccuuuggaaacuggaugucuu

SEQ ID NO: 53196 - RNA, 22 nt, Human
ucgagcacaccagacuugcaga

SEQ ID NO: 53197 - RNA, 22 nt, Human
uaggaucaugaugguaaggcaa

SEQ ID NO: 53198 - RNA, 22 nt, Human
ucgcccagguuggagugcagug

SEQ ID NO: 53199 - RNA, 22 nt, Human
ucgccuccucccagaucaacaa

SEQ ID NO: 53200 - RNA, 22 nt, Human
ucgccccccgccucacccucgg

SEQ ID NO: 53201 - RNA, 22 nt, Human
ucgcgcgugccacgcgccgcgg

SEQ ID NO: 53202 - RNA, 22 nt, Human
ucgcucgcuggcuccugcccgc

SEQ ID NO: 53203 - RNA, 22 nt, Human
uaggcagggauuaggguugauu

SEQ ID NO: 53204 - RNA, 22 nt, Human
ucgcuguguccuuuucacuuau

SEQ ID NO: 53205 - RNA, 22 nt, Human
ucggccuuuucuuauacccaca

SEQ ID NO: 53206 - RNA, 22 nt, Human
ucggcgaccugucauggaccaa

SEQ ID NO: 53207 - RNA, 22 nt, Human
ucggcuccucccuggaaagggg

SEQ ID NO: 53208 - RNA, 22 nt, Human
ucgggcccggcucccgacgccc

SEQ ID NO: 53209 - RNA, 22 nt, Human
ucgggggucgggcggcggucca

SEQ ID NO: 53210 - RNA, 22 nt, Human
ucguccaauaaccugccagcgc

SEQ ID NO: 53211 - RNA, 22 nt, Human
ucguguuggaacugcuuuguaa

SEQ ID NO: 53212 - RNA, 22 nt, Human
ucguggaugaagaauagaggcc

SEQ ID NO: 53213 - RNA, 22 nt, Human
ucuaagcuugaucacuugcuuu

SEQ ID NO: 53214 - RNA, 22 nt, Human
ucuacgugacagaacagacuga

SEQ ID NO: 53215 - RNA, 22 nt, Human
ucuacgugggaguucaggauuc

SEQ ID NO: 53216 - RNA, 22 nt, Human
ucuuccucuccuggggcauuug

SEQ ID NO: 53217 - RNA, 22 nt, Human
ucuucccgggcaucucugcuca

SEQ ID NO: 53218 - RNA, 22 nt, Human
ucuugcuggagucaaggcuaca

SEQ ID NO: 53219 - RNA, 22 nt, Human
ucuuucucuccagccuggaccu

SEQ ID NO: 53220 - RNA, 22 nt, Human
ucuuugcagaauuuaacuuugc

SEQ ID NO: 53221 - RNA, 22 nt, Human
ucuuuuucccugguuccuuuuu

SEQ ID NO: 53222 - RNA, 22 nt, Human
ugaaagccuacagcucacuguu

SEQ ID NO: 53223 - RNA, 22 nt, Human
ugaaaugccucuuugguucuaa

SEQ ID NO: 53224 - RNA, 21 nt, Human
ugaacaccaggagaaaucggu

SEQ ID NO: 53225 - RNA, 22 nt, Human
ugaacuggauuugugagcuccu

SEQ ID NO: 53226 - RNA, 22 nt, Human
ugaagaauuccauggcuuccau

SEQ ID NO: 53227 - RNA, 22 nt, Human
ucaaccagcuuaucugcaggau

SEQ ID NO: 53228 - RNA, 22 nt, Human
ucaagaagauaaugucuagggu

SEQ ID NO: 53229 - RNA, 22 nt, Human
ugaaggccagggauuugcagcc

SEQ ID NO: 53230 - RNA, 22 nt, Human
ucaagcacugugcaaugagcuu

SEQ ID NO: 53231 - RNA, 22 nt, Human
ugaagguggcuugcagcuaguc

SEQ ID NO: 53232 - RNA, 22 nt, Human
ugaaucugagccugcgcaaagu

SEQ ID NO: 53233 - RNA, 22 nt, Human
ucaccaggauugggcuguaggc

SEQ ID NO: 53234 - RNA, 22 nt, Human
ucacccagacugucugacucuu

SEQ ID NO: 53235 - RNA, 22 nt, Human
ucacccuguggcuauaaggcaa

SEQ ID NO: 53236 - RNA, 22 nt, Human
ucaccgucucaguacggaggga

SEQ ID NO: 53237 - RNA, 22 nt, Human
ucacucgccuuuucguucgccg

SEQ ID NO: 53238 - RNA, 22 nt, Human
ugacacagaccaaguggugcug

SEQ ID NO: 53239 - RNA, 22 nt, Human
ugacagaaaccaccccccaggu

SEQ ID NO: 53240 - RNA, 22 nt, Human
ugacagugugcccggagguuag

SEQ ID NO: 53241 - RNA, 22 nt, Human
ugacaucagacugugagaagag

SEQ ID NO: 53242 - RNA, 22 nt, Human
ugaccgucagcugucuuccauu

SEQ ID NO: 53243 - RNA, 22 nt, Human
ugacgcauggccagcucugucu

SEQ ID NO: 53244 - RNA, 22 nt, Human
ucagcaggugcuuuguuuacuc

SEQ ID NO: 53245 - RNA, 23 nt, Human
ucagccgcuggcgaguccacugg

SEQ ID NO: 53246 - RNA, 22 nt, Human
ucagcgucuccaaaagagcccg

SEQ ID NO: 53247 - RNA, 22 nt, Human
ucagcucacaauguugagaaag

SEQ ID NO: 53248 - RNA, 22 nt, Human
ucagcucaggggauguggggga

SEQ ID NO: 53249 - RNA, 21 nt, Human
ucaggaagagccaguucaugc

SEQ ID NO: 53250 - RNA, 22 nt, Human
ucagcuucaucuugagcccaca

SEQ ID NO: 53251 - RNA, 19 nt, Human
ucaggaggucgaccuggca

SEQ ID NO: 53252 - RNA, 22 nt, Human
ucaggcgcucuucguggcugcc

SEQ ID NO: 53253 - RNA, 19 nt, Human
ugacuggguucuaggcagg

SEQ ID NO: 53254 - RNA, 20 nt, Human
ugagaaacaagggcuggucu

SEQ ID NO: 53255 - RNA, 22 nt, Human
ugagugggaggugggaagggua

SEQ ID NO: 53256 - RNA, 20 nt, Human
ugauccacucucauugcucu

SEQ ID NO: 53257 - RNA, 22 nt, Human
ugaugaucaugcagguugguuu

SEQ ID NO: 53258 - RNA, 22 nt, Human
uccaagcgcuucuggagcuccu

SEQ ID NO: 53259 - RNA, 23 nt, Human
uccaagagagauuuuaaauuucu

SEQ ID NO: 53260 - RNA, 22 nt, Human
uccaccacgaaacugcagcugc

SEQ ID NO: 53261 - RNA, 22 nt, Human
uccagggaggggcggcaggggu

SEQ ID NO: 53262 - RNA, 22 nt, Human
uccaggucauucucuccgaccg

SEQ ID NO: 53263 - RNA, 22 nt, Human
ugcaaaaagagcgaggagcccu

SEQ ID NO: 53264 - RNA, 22 nt, Human
uccaugaguuuuuuaguuucac

SEQ ID NO: 53265 - RNA, 22 nt, Human
uccaugauauauaugugcacau

SEQ ID NO: 53266 - RNA, 22 nt, Human
uccaugcaguagaggcgcuggg

SEQ ID NO: 53267 - RNA, 22 nt, Human
uccaugcgcgauggccuggcuu

SEQ ID NO: 53268 - RNA, 22 nt, Human
ugcaaggcacccacucugcuuu

SEQ ID NO: 53269 - RNA, 22 nt, Human
ugcacccacuuagcugaaguuc

SEQ ID NO: 53270 - RNA, 16 nt, Human
ugcaccgggaacacug

SEQ ID NO: 53271 - RNA, 22 nt, Human
ugcacgcacuugcucuccagcg

SEQ ID NO: 53272 - RNA, 22 nt, Human
ugcacgcgcccuucgauggccc

SEQ ID NO: 53273 - RNA, 22 nt, Human
ugcagcagaauauggcugcagg

SEQ ID NO: 53274 - RNA, 22 nt, Human
ugcagcaucuccuugugccaug

SEQ ID NO: 53275 - RNA, 22 nt, Human
ugcagccucacgcauccgcauu

SEQ ID NO: 53276 - RNA, 20 nt, Human
ugcagcucccccgcaguuuc

SEQ ID NO: 53277 - RNA, 19 nt, Human
ugcagcuguaugagcuuaa

SEQ ID NO: 53278 - RNA, 22 nt, Human
ucccuugagcccugaggucccu

SEQ ID NO: 53279 - RNA, 22 nt, Human
ucccuugacauuacuugggagg

SEQ ID NO: 53280 - RNA, 22 nt, Human
ugcaugacugaucuguuuguca

SEQ ID NO: 53281 - RNA, 23 nt, Human
ugcaugagcaucuccaccucagu

SEQ ID NO: 53282 - RNA, 22 nt, Human
ugcauugccucuauucauuaua

SEQ ID NO: 53283 - RNA, 22 nt, Human
uccucagcaagacgcuggcagc

SEQ ID NO: 53284 - RNA, 22 nt, Human
ugccagucggcacuuuaucugg

SEQ ID NO: 53285 - RNA, 22 nt, Human
ugccaucaugucagauuuggga

SEQ ID NO: 53286 - RNA, 22 nt, Human
ugccaucuuugccccuauuuua

SEQ ID NO: 53287 - RNA, 22 nt, Human
uccucuucucuagagccggaau

SEQ ID NO: 53288 - RNA, 23 nt, Human
uccugcagauaagcugguugaca

SEQ ID NO: 53289 - RNA, 21 nt, Human
uccugcagggcagcagagugg

SEQ ID NO: 53290 - RNA, 22 nt, Human
uccugcaugcuagugagugcuu

SEQ ID NO: 53291 - RNA, 22 nt, Human
uccugggcuugcucuuuccauu

SEQ ID NO: 53292 - RNA, 22 nt, Human
ugcccugcagacccugcagugu

SEQ ID NO: 53293 - RNA, 22 nt, Human
ugccgcaggaggggcgauuucu

SEQ ID NO: 53294 - RNA, 22 nt, Human
ugccgcuuucuggcccucaguc

SEQ ID NO: 53295 - RNA, 19 nt, Human
ugccggccgcgggguuccu

SEQ ID NO: 53296 - RNA, 22 nt, Human
ucgaaugccaacaccgaaguuu

SEQ ID NO: 53297 - RNA, 22 nt, Human
ugccuggugcggagugaguggc

SEQ ID NO: 53298 - RNA, 22 nt, Human
ucgagcgcucccugugcucucg

SEQ ID NO: 53299 - RNA, 22 nt, Human
ucgccauguacaugaagggcgg

SEQ ID NO: 53300 - RNA, 22 nt, Human
ugcggugcagcccugcccucuc

SEQ ID NO: 53301 - RNA, 22 nt, Human
ugcggugcgcccgggcgagugc

SEQ ID NO: 53302 - RNA, 22 nt, Human
ugcgucccagcauguagggcag

SEQ ID NO: 53303 - RNA, 22 nt, Human
ugcguggauuuaggagugaggg

SEQ ID NO: 53304 - RNA, 22 nt, Human
ugcguugaggaccgcgagggcg

SEQ ID NO: 53305 - RNA, 20 nt, Human
ugcuccaggaacacuggccg

SEQ ID NO: 53306 - RNA, 23 nt, Human
ugcucgccuucaggacuugggcu

SEQ ID NO: 53307 - RNA, 22 nt, Human
ucggccggagggggcgggcgca

SEQ ID NO: 53308 - RNA, 22 nt, Human
ucgggaggaggcggagcucguu

SEQ ID NO: 53309 - RNA, 22 nt, Human
ucgggccacauccacacaucca

SEQ ID NO: 53310 - RNA, 22 nt, Human
ucgggcgaauguuguuuuucuc

SEQ ID NO: 53311 - RNA, 21 nt, Human
ucgggcggcggcugaggcggc

SEQ ID NO: 53312 - RNA, 22 nt, Human
ucgggggaaccggcccgggccu

SEQ ID NO: 53313 - RNA, 22 nt, Human
ugcugacuauacauuuagcauu

SEQ ID NO: 53314 - RNA, 23 nt, Human
ucgucgucagccacuaccucccc

SEQ ID NO: 53315 - RNA, 22 nt, Human
ugcugcacucacaggaagaguu

SEQ ID NO: 53316 - RNA, 22 nt, Human
ugcugccucccaucccucccga

SEQ ID NO: 53317 - RNA, 22 nt, Human
ugcugccucugaauggagcagu

SEQ ID NO: 53318 - RNA, 22 nt, Human
ucugcagggcccuuggcuccug

SEQ ID NO: 53319 - RNA, 22 nt, Human
ucugcccguucaaauccuuguu

SEQ ID NO: 53320 - RNA, 22 nt, Human
ucugccuucaggagcagacucu

SEQ ID NO: 53321 - RNA, 22 nt, Human
ucugcggccuagcgcccggcgc

SEQ ID NO: 53322 - RNA, 22 nt, Human
ucuggaggucucagggcgggaa

SEQ ID NO: 53323 - RNA, 22 nt, Human
uggaagaagcuacaagcgguga

SEQ ID NO: 53324 - RNA, 22 nt, Human
ucugggccacccgccuccaggg

SEQ ID NO: 53325 - RNA, 22 nt, Human
uggaaggggccaggcgcggagu

SEQ ID NO: 53326 - RNA, 22 nt, Human
uggagccuugugagaccacaau

SEQ ID NO: 53327 - RNA, 22 nt, Human
uggagcuggcuuguggaaguug

SEQ ID NO: 53328 - RNA, 21 nt, Human
uggaggcguaaucacuguuga

SEQ ID NO: 53329 - RNA, 22 nt, Human
uggauaugaaacaaaacaagag

SEQ ID NO: 53330 - RNA, 22 nt, Human
uggaugccuugggggaggagga

SEQ ID NO: 53331 - RNA, 22 nt, Human
uggcacugcccugucucggugg

SEQ ID NO: 53332 - RNA, 22 nt, Human
uggcagcauuuuuuccagaaca

SEQ ID NO: 53333 - RNA, 21 nt, Human
uggcaggcagcuggaagcuug

SEQ ID NO: 53334 - RNA, 22 nt, Human
ucuucuuugugguugcccaagg

SEQ ID NO: 53335 - RNA, 22 nt, Human
ucuugcuguggcagaucuggag

SEQ ID NO: 53336 - RNA, 22 nt, Human
ucuugggcaguccucuacuggu

SEQ ID NO: 53337 - RNA, 22 nt, Human
uggcaguagagcuggaacuuga

SEQ ID NO: 53338 - RNA, 22 nt, Human
uggcccagaucucugaccuuga

SEQ ID NO: 53339 - RNA, 22 nt, Human
uggcccaucagggcaccugaga

SEQ ID NO: 53340 - RNA, 20 nt, Human
uggcccagcacgacgaggac

SEQ ID NO: 53341 - RNA, 22 nt, Human
uggccugauuuugcuaagagaa

SEQ ID NO: 53342 - RNA, 22 nt, Human
uggcugagcugcagcguggcuu

SEQ ID NO: 53343 - RNA, 22 nt, Human
uggcugaggcuuuucuuaaaga

SEQ ID NO: 53344 - RNA, 22 nt, Human
uggcuguuggagcuggaagaug

SEQ ID NO: 53345 - RNA, 22 nt, Human
ugggaacuggaaaaaaugaagu

SEQ ID NO: 53346 - RNA, 22 nt, Human
ugaacagugugagggugugacc

SEQ ID NO: 53347 - RNA, 22 nt, Human
ugaaccgcuucauggugccugu

SEQ ID NO: 53348 - RNA, 22 nt, Human
ugggaaggggagcuggaaagga

SEQ ID NO: 53349 - RNA, 20 nt, Human
ugggauggaaucaccugcac

SEQ ID NO: 53350 - RNA, 22 nt, Human
ugggcagggagcuggaaccaca

SEQ ID NO: 53351 - RNA, 22 nt, Human
ugggcagggauuuggggaaacu

SEQ ID NO: 53352 - RNA, 22 nt, Human
ugggcccaucauugcugugggc

SEQ ID NO: 53353 - RNA, 22 nt, Human
ugggccgugagacgucucuggg

SEQ ID NO: 53354 - RNA, 22 nt, Human
ugaaucagaccuucauugggua

SEQ ID NO: 53355 - RNA, 22 nt, Human
uggggagcucagcaccaucagu

SEQ ID NO: 53356 - RNA, 22 nt, Human
uggggcgccuggcugaggcugc

SEQ ID NO: 53357 - RNA, 22 nt, Human
uggggcgcaggcccagcgggcu

SEQ ID NO: 53358 - RNA, 22 nt, Human
uggggcuggccaggaggagucu

SEQ ID NO: 53359 - RNA, 22 nt, Human
uggggcugguaccguaauauau

SEQ ID NO: 53360 - RNA, 22 nt, Human
ugacaagagaccccuccgcagg

SEQ ID NO: 53361 - RNA, 20 nt, Human
ugggggugcccaucuccccu

SEQ ID NO: 53362 - RNA, 22 nt, Human
ugggguuuuagagcaggcagag

SEQ ID NO: 53363 - RNA, 23 nt, Human
uggugcagcgcaggccggguggc

SEQ ID NO: 53364 - RNA, 22 nt, Human
uggugcaggauuuauuuaacua

SEQ ID NO: 53365 - RNA, 17 nt, Human
ugaggcugucucccugg

SEQ ID NO: 53366 - RNA, 22 nt, Human
uggugugggauccugggaagga

SEQ ID NO: 53367 - RNA, 22 nt, Human
ugaugaugaagaaauauuauca

SEQ ID NO: 53368 - RNA, 22 nt, Human
ugaugaugccaaaauuuggcau

SEQ ID NO: 53369 - RNA, 18 nt, Human
ugauggcuaagagccggg

SEQ ID NO: 53370 - RNA, 22 nt, Human
uguccagcuauauguguaugug

SEQ ID NO: 53371 - RNA, 18 nt, Human
ugcacccuaagggcccca

SEQ ID NO: 53372 - RNA, 22 nt, Human
ugucuucagguuccucaccacu

SEQ ID NO: 53373 - RNA, 20 nt, Human
ugcacggcugugugugugca

SEQ ID NO: 53374 - RNA, 22 nt, Human
ugucuuaggcuccgccggccca

SEQ ID NO: 53375 - RNA, 22 nt, Human
ugugccuguugguguagacaua

SEQ ID NO: 53376 - RNA, 22 nt, Human
ugcaggagaaaguacggagcgu

SEQ ID NO: 53377 - RNA, 22 nt, Human
ugcaggagcaccagcucacccu

SEQ ID NO: 53378 - RNA, 22 nt, Human
ugcaggagcccaggaauacuau

SEQ ID NO: 53379 - RNA, 18 nt, Human
ugcaggggaggggugaua

SEQ ID NO: 53380 - RNA, 22 nt, Human
ugcagggucuccuguacuuggg

SEQ ID NO: 53381 - RNA, 22 nt, Human
ugcagguggcagcggggcacca

SEQ ID NO: 53382 - RNA, 22 nt, Human
ugcagugaugcuucuggcucag

SEQ ID NO: 53383 - RNA, 22 nt, Human
uguggcucugaugucauaaagg

SEQ ID NO: 53384 - RNA, 22 nt, Human
ugcauucugggucgcagagugg

SEQ ID NO: 53385 - RNA, 22 nt, Human
ugcauugccauagcagggggau

SEQ ID NO: 53386 - RNA, 22 nt, Human
ugccaacaggcuugccugaugu

SEQ ID NO: 53387 - RNA, 16 nt, Human
ugccaagggguuaaug

SEQ ID NO: 53388 - RNA, 22 nt, Human
ugccaaugauuccacaauggaa

SEQ ID NO: 53389 - RNA, 22 nt, Human
ugccaugguuguacaguagcag

SEQ ID NO: 53390 - RNA, 22 nt, Human
ugcccacaggaagacaccagcg

SEQ ID NO: 53391 - RNA, 18 nt, Human
ugcccaccagaagaggga

SEQ ID NO: 53392 - RNA, 22 nt, Human
uguggugacuugagcuuccuaa

SEQ ID NO: 53393 - RNA, 22 nt, Human
ugcccacuuugucuccaugcug

SEQ ID NO: 53394 - RNA, 22 nt, Human
ugccuaguuucagagcccccga

SEQ ID NO: 53395 - RNA, 22 nt, Human
ugccugaagccugccccugggu

SEQ ID NO: 53396 - RNA, 20 nt, Human
ugccuuccgccccgggcacc

SEQ ID NO: 53397 - RNA, 17 nt, Human
ugccuucgucuucaguu

SEQ ID NO: 53398 - RNA, 22 nt, Human
ugcgccaggacacccguggcgg

SEQ ID NO: 53399 - RNA, 22 nt, Human
ugcgccuccugcugccugcccu

SEQ ID NO: 53400 - RNA, 22 nt, Human
uguucccgaugacaggaccagg

SEQ ID NO: 53401 - RNA, 22 nt, Human
uguuccuggggaccugccuucc

SEQ ID NO: 53402 - RNA, 22 nt, Human
ugcgccucugucacucagcauc

SEQ ID NO: 53403 - RNA, 22 nt, Human
ugcggaaggcagcgcagggugg

SEQ ID NO: 53404 - RNA, 22 nt, Human
ugcggcucaaagggaaggccuu

SEQ ID NO: 53405 - RNA, 19 nt, Human
ugcgggcugcggucagggc

SEQ ID NO: 53406 - RNA, 22 nt, Human
ugcggagggagcagucggcugu

SEQ ID NO: 53407 - RNA, 22 nt, Human
ugcucagaagacuuacugguua

SEQ ID NO: 53408 - RNA, 22 nt, Human
uggagcugguucuggggaagcu

SEQ ID NO: 53409 - RNA, 22 nt, Human
uggaggcccagcugggggccgg

SEQ ID NO: 53410 - RNA, 19 nt, Human
uggaggcggguggcccaga

SEQ ID NO: 53411 - RNA, 22 nt, Human
uggagucucacuuccuggaauu

SEQ ID NO: 53412 - RNA, 22 nt, Human
uggaguucauauuggacauaag

SEQ ID NO: 53413 - RNA, 22 nt, Human
uggauuguuuacaucaugucug

SEQ ID NO: 53414 - RNA, 22 nt, Human
uggcaaaaccugcaauuacuuu

SEQ ID NO: 53415 - RNA, 22 nt, Human
uggcaacucaauuucuacaaga

SEQ ID NO: 53416 - RNA, 22 nt, Human
uggcaaggccacaggugcaguu

SEQ ID NO: 53417 - RNA, 22 nt, Human
uggcagccucugguccuuaguu

SEQ ID NO: 53418 - RNA, 22 nt, Human
uggcagccugcgugaaggagcu

SEQ ID NO: 53419 - RNA, 22 nt, Human
uggcagcucauuuggaaaugga

SEQ ID NO: 53420 - RNA, 22 nt, Human
uggcaguaaagcuggaaaagug

SEQ ID NO: 53421 - RNA, 22 nt, Human
uggcagugggaagcuggaaguc

SEQ ID NO: 53422 - RNA, 22 nt, Human
uggcaucucggugcugguucuu

SEQ ID NO: 53423 - RNA, 22 nt, Human
uucagcugcuugccugaaguca

SEQ ID NO: 53424 - RNA, 22 nt, Human
uggcaggggaaaagggguggga

SEQ ID NO: 53425 - RNA, 21 nt, Human
uggccaaggaauagaagcucu

SEQ ID NO: 53426 - RNA, 22 nt, Human
uggccagucuuagcugugccug

SEQ ID NO: 53427 - RNA, 22 nt, Human
uggccaugagaaucuuugcugu

SEQ ID NO: 53428 - RNA, 22 nt, Human
uggcccaagggaggcuuggccu

SEQ ID NO: 53429 - RNA, 22 nt, Human
uggcccauccggcuccuccuug

SEQ ID NO: 53430 - RNA, 22 nt, Human
uucagugggggcuuuccuucug

SEQ ID NO: 53431 - RNA, 22 nt, Human
uggccccauuuuucuggagccu

SEQ ID NO: 53432 - RNA, 22 nt, Human
uucauacucuucccugggcaaa

SEQ ID NO: 53433 - RNA, 22 nt, Human
uggcccugaaucaaggccagca

SEQ ID NO: 53434 - RNA, 20 nt, Human
uggccgacccugaggaguug

SEQ ID NO: 53435 - RNA, 23 nt, Human
uggccguccccugacucucuggc

SEQ ID NO: 53436 - RNA, 20 nt, Human
uggcccgcgcuccuccugcu

SEQ ID NO: 53437 - RNA, 22 nt, Human
uucaucauuuuccauuccucuu

SEQ ID NO: 53438 - RNA, 22 nt, Human
uucauccucuaguacugaagug

SEQ ID NO: 53439 - RNA, 22 nt, Human
uucaugcgcuuuucaggagugu

SEQ ID NO: 53440 - RNA, 22 nt, Human
uucauccucuuuaucuaccugu

SEQ ID NO: 53441 - RNA, 22 nt, Human
uggcgcgcagccugcuggugcu

SEQ ID NO: 53442 - RNA, 22 nt, Human
uggcgcucacccugcggcccug

SEQ ID NO: 53443 - RNA, 22 nt, Human
uggcucaggccuacgacgccuu

SEQ ID NO: 53444 - RNA, 22 nt, Human
uggcucaguaaucgagucuccu

SEQ ID NO: 53445 - RNA, 23 nt, Human
uggcucugagcuuccugguggcc

SEQ ID NO: 53446 - RNA, 22 nt, Human
uuccagcaaagguaguguguua

SEQ ID NO: 53447 - RNA, 22 nt, Human
uggcuucagacuucugcuacgu

SEQ ID NO: 53448 - RNA, 22 nt, Human
uuccccaccagagacagagcug

SEQ ID NO: 53449 - RNA, 22 nt, Human
ugggagccuuccacugggggaa

SEQ ID NO: 53450 - RNA, 23 nt, Human
ugggagcuauguuuggaaugggg

SEQ ID NO: 53451 - RNA, 22 nt, Human
ugggauauagaauuggcagagu

SEQ ID NO: 53452 - RNA, 22 nt, Human
ugggcagagggugaggaaggcg

SEQ ID NO: 53453 - RNA, 22 nt, Human
ugggccacguggagucuguagg

SEQ ID NO: 53454 - RNA, 22 nt, Human
ugggccucuguuuccucaucug

SEQ ID NO: 53455 - RNA, 22 nt, Human
uggggcuuucgcggagcgucgg

SEQ ID NO: 53456 - RNA, 22 nt, Human
ugggggcacccagccgaugagg

SEQ ID NO: 53457 - RNA, 22 nt, Human
uggggggacagauggagaggac

SEQ ID NO: 53458 - RNA, 22 nt, Human
ugggucagauugagccccuggu

SEQ ID NO: 53459 - RNA, 22 nt, Human
uucugagguagccacucacugg

SEQ ID NO: 53460 - RNA, 18 nt, Human
uucugcggugacagauau

SEQ ID NO: 53461 - RNA, 22 nt, Human
ugguggccucaguggcuucugu

SEQ ID NO: 53462 - RNA, 22 nt, Human
ugguggcuuuucguagguucac

SEQ ID NO: 53463 - RNA, 22 nt, Human
ugguggagucugggggaggcuu

SEQ ID NO: 53464 - RNA, 21 nt, Human
ugguguacauuuccauaguuu

SEQ ID NO: 53465 - RNA, 20 nt, Human
ugguguacauuuccauaguu

SEQ ID NO: 53466 - RNA, 22 nt, Human
uucuuugcucaccugccgcucc

SEQ ID NO: 53467 - RNA, 22 nt, Human
uugaagaagucaaaagcugcag

SEQ ID NO: 53468 - RNA, 22 nt, Human
uguauagcaggguucuuccucc

SEQ ID NO: 53469 - RNA, 23 nt, Human
ugucacuuguggucacuaggcug

SEQ ID NO: 53470 - RNA, 22 nt, Human
ugucagacagggcugcagucag

SEQ ID NO: 53471 - RNA, 22 nt, Human
ugucauggacuggauuucugcu

SEQ ID NO: 53472 - RNA, 22 nt, Human
ugucauuggugaucugaugccu

SEQ ID NO: 53473 - RNA, 21 nt, Human
uguccucggaucaguccacaa

SEQ ID NO: 53474 - RNA, 22 nt, Human
uugcaagcccugaagggcugga

SEQ ID NO: 53475 - RNA, 22 nt, Human
ugucugggauguuggcagccac

SEQ ID NO: 53476 - RNA, 22 nt, Human
ugugccuagauuccaugcacuc

SEQ ID NO: 53477 - RNA, 22 nt, Human
ugugcgcgugugcuuugugugu

SEQ ID NO: 53478 - RNA, 22 nt, Human
ugugcgucuguguacagaugug

SEQ ID NO: 53479 - RNA, 22 nt, Human
ugugcugcagcgagagcuacga

SEQ ID NO: 53480 - RNA, 22 nt, Human
ugugcuugucguggagccaggc

SEQ ID NO: 53481 - RNA, 22 nt, Human
uugcugagcugaaccagccacc

SEQ ID NO: 53482 - RNA, 22 nt, Human
uugcugccagcgcccugcaggg

SEQ ID NO: 53483 - RNA, 22 nt, Human
ugugggcguggguuggggaggg

SEQ ID NO: 53484 - RNA, 23 nt, Human
uugcuugagcccaggaaguggag

SEQ ID NO: 53485 - RNA, 22 nt, Human
uugcuugcggccuuugugccuu

SEQ ID NO: 53486 - RNA, 22 nt, Human
uguggugcagcgggaacagcuu

SEQ ID NO: 53487 - RNA, 22 nt, Human
uuggaaauguagaaaagcagau

SEQ ID NO: 53488 - RNA, 22 nt, Human
uuggccauuacugagccuggag

SEQ ID NO: 53489 - RNA, 22 nt, Human
uuggccugcuccagaacaaggg

SEQ ID NO: 53490 - RNA, 22 nt, Human
uugggaaauuugaaaauaaaag

SEQ ID NO: 53491 - RNA, 22 nt, Human
uguuccggucuaucgugucaau

SEQ ID NO: 53492 - RNA, 20 nt, Human
uugggaagccuacaccauuc

SEQ ID NO: 53493 - RNA, 20 nt, Human
uuggggacaggagugugaug

SEQ ID NO: 53494 - RNA, 19 nt, Human
uguugcagcuugaucggua

SEQ ID NO: 53495 - RNA, 22 nt, Human
uuggugaugaaagugcugcgcu

SEQ ID NO: 53496 - RNA, 22 nt, Human
uuggugauugggaauggauggg

SEQ ID NO: 53497 - RNA, 21 nt, Human
uguuggccuucauucucuguc

SEQ ID NO: 53498 - RNA, 22 nt, Human
uuguaugcugggaagcgggagg

SEQ ID NO: 53499 - RNA, 22 nt, Human
uuaccugcagagacguggaggc

SEQ ID NO: 53500 - RNA, 22 nt, Human
uuagcagacagauggagagaga

SEQ ID NO: 53501 - RNA, 22 nt, Human
uuucugcauuuguauuggaaaa

SEQ ID NO: 53502 - RNA, 22 nt, Human
uucaggucauuuuuagcccuag

SEQ ID NO: 53503 - RNA, 22 nt, Human
uucauacuguuuaaguucuguu

SEQ ID NO: 53504 - RNA, 22 nt, Human
uucauuuuauauuagagcuguu

SEQ ID NO: 53505 - RNA, 22 nt, Human
uuccaugccuaagagccugaag

SEQ ID NO: 53506 - RNA, 22 nt, Human
uuccccgagccuggggaagcug

SEQ ID NO: 53507 - RNA, 22 nt, Human
uuuuccuguccuugggucugca

SEQ ID NO: 53508 - RNA, 21 nt, Human
uucugcuguucaccaccaccc

SEQ ID NO: 53509 - RNA, 22 nt, Human
uucuggggccgugacgaggggc

SEQ ID NO: 53510 - RNA, 22 nt, Human
uucugggguaagcacugaggau

SEQ ID NO: 53511 - RNA, 22 nt, Human
uucuggugauuugccucuuuag

SEQ ID NO: 53512 - RNA, 19 nt, Human
uucuguggucccaggccuu

SEQ ID NO: 53513 - RNA, 22 nt, Human
uugcagauuucuuguccccauu

SEQ ID NO: 53514 - RNA, 22 nt, Human
uugccaggagacaucuggagcc

SEQ ID NO: 53515 - RNA, 22 nt, Human
uugcggaucuucauggccucag

SEQ ID NO: 53516 - RNA, 22 nt, Human
uugcggauguccacgucacacu

SEQ ID NO: 53517 - RNA, 22 nt, Human
uugcugcgcugaccuccaguga

SEQ ID NO: 53518 - RNA, 22 nt, Human
uugcuggaguagaaaacuuaac

SEQ ID NO: 53519 - RNA, 21 nt, Human
uugcuggagcaauguaaauca

SEQ ID NO: 53520 - RNA, 22 nt, Human
uugcugggauucauugaagggu

SEQ ID NO: 53521 - RNA, 22 nt, Human
uugcugguggcucugauuucau

SEQ ID NO: 53522 - RNA, 22 nt, Human
uugcugugucauuuguuuaauc

SEQ ID NO: 53523 - RNA, 22 nt, Human
uuggacugggauggccgaggcu

SEQ ID NO: 53524 - RNA, 22 nt, Human
uuggccaaaaaagucauuagaa

SEQ ID NO: 53525 - RNA, 22 nt, Human
uuggccaaggaccuuuuuggag

SEQ ID NO: 53526 - RNA, 22 nt, Human
uuggggccggcgcggaggaggg

SEQ ID NO: 53527 - RNA, 22 nt, Human
uuuucaaucaaguuuauuuaua

SEQ ID NO: 53528 - RNA, 22 nt, Human
uuuucaauuuucauuugcaaga

SEQ ID NO: 53529 - RNA, 22 nt, Human
uuuuccuucuuccugccuugcc

SEQ ID NO: 53530 - RNA, 22 nt, Human
uuuucuugagucacuccaguga

SEQ ID NO: 53531 - RNA, 22 nt, Human
aaaccgguacccuccugccugc

SEQ ID NO: 53532 - RNA, 22 nt, Human
aaacgcaauuucuugcauguca

SEQ ID NO: 53533 - RNA, 22 nt, Human
aaagcaaagaucuguagcccaa

SEQ ID NO: 53534 - RNA, 22 nt, Human
aaagcagguugcaauuacagug

SEQ ID NO: 53535 - RNA, 22 nt, Human
aaagccuacagucaugguuaga

SEQ ID NO: 53536 - RNA, 22 nt, Human
aaagcgagccggcuuggaggga

SEQ ID NO: 53537 - RNA, 22 nt, Human
aaagccagggacagugugcaug

SEQ ID NO: 53538 - RNA, 22 nt, Human
aaaggugccucuuacaaggcuu

SEQ ID NO: 53539 - RNA, 17 nt, Human
aaagccgaucagauguu

SEQ ID NO: 53540 - RNA, 22 nt, Human
aaagcuccaaauggguggaagu

SEQ ID NO: 53541 - RNA, 22 nt, Human
aaagguggugguuagggaauau

SEQ ID NO: 53542 - RNA, 22 nt, Human
aaaucgcuugaacccaggaagu

SEQ ID NO: 53543 - RNA, 22 nt, Human
aagaacaugggugugggcauuc

SEQ ID NO: 53544 - RNA, 22 nt, Human
aagaaggcggaccagaagggag

SEQ ID NO: 53545 - RNA, 22 nt, Human
aacaggcuaaauuguccauuuc

SEQ ID NO: 53546 - RNA, 22 nt, Human
aagaucugaccgugauggcggc

SEQ ID NO: 53547 - RNA, 22 nt, Human
aagaugaucagagggcaagagg

SEQ ID NO: 53548 - RNA, 22 nt, Human
aagcagcauaugacagcaucca

SEQ ID NO: 53549 - RNA, 22 nt, Human
aagcaggaaaugaaaugcuugc

SEQ ID NO: 53550 - RNA, 23 nt, Human
aagcaacagacuucaucagauau

SEQ ID NO: 53551 - RNA, 22 nt, Human
aagcagaaaaacugagcuccaa

SEQ ID NO: 53552 - RNA, 22 nt, Human
aagccagccaguuccagcagcu

SEQ ID NO: 53553 - RNA, 22 nt, Human
aagccugguuauuugaggaugu

SEQ ID NO: 53554 - RNA, 22 nt, Human
aagcugcagacccccugucuca

SEQ ID NO: 53555 - RNA, 22 nt, Human
aagcugccugggaggaagggcu

SEQ ID NO: 53556 - RNA, 22 nt, Human
aaggauuuccaggccugcgccu

SEQ ID NO: 53557 - RNA, 22 nt, Human
aaggcgauuuaaagauguuagg

SEQ ID NO: 53558 - RNA, 22 nt, Human
aagcgggcagcggccugcgcca

SEQ ID NO: 53559 - RNA, 22 nt, Human
aaggcgccacagugauugcaaa

SEQ ID NO: 53560 - RNA, 22 nt, Human
aaggagcuuucauuacagccuu

SEQ ID NO: 53561 - RNA, 22 nt, Human
aaggcgguuccgguucgcggcg

SEQ ID NO: 53562 - RNA, 22 nt, Human
aaggcuguuugagcacuggagc

SEQ ID NO: 53563 - RNA, 19 nt, Human
aaggcuuucugagugaaaa

SEQ ID NO: 53564 - RNA, 23 nt, Human
aagggcgauuaacauucgcucga

SEQ ID NO: 53565 - RNA, 22 nt, Human
aagggccacaugccauuuaaaa

SEQ ID NO: 53566 - RNA, 22 nt, Human
aagguccuguagccacagagcc

SEQ ID NO: 53567 - RNA, 23 nt, Human
aaggugaagccaccaggugagga

SEQ ID NO: 53568 - RNA, 22 nt, Human
aaggugccacuucccucagacu

SEQ ID NO: 53569 - RNA, 22 nt, Human
aaggugggacugagaggggaca

SEQ ID NO: 53570 - RNA, 22 nt, Human
aagugauuuucccaccaucuac

SEQ ID NO: 53571 - RNA, 22 nt, Human
aagugcuggccuacucaaucga

SEQ ID NO: 53572 - RNA, 20 nt, Human
aagugcuguuagcugccuga

SEQ ID NO: 53573 - RNA, 22 nt, Human
aaguggcccuaauugggccaaa

SEQ ID NO: 53574 - RNA, 22 nt, Human
aaguuccacuagugacccagaa

SEQ ID NO: 53575 - RNA, 22 nt, Human
aauaaugguuugauucucacau

SEQ ID NO: 53576 - RNA, 22 nt, Human
aauacagcacucacaccucccu

SEQ ID NO: 53577 - RNA, 22 nt, Human
aaucacuggcuccucacggcaa

SEQ ID NO: 53578 - RNA, 22 nt, Human
aaucaugagguguuucuuugca

SEQ ID NO: 53579 - RNA, 22 nt, Human
aauggaaaggagccugacuaua

SEQ ID NO: 53580 - RNA, 22 nt, Human
aauggcaaaaguuucggaaauu

SEQ ID NO: 53581 - RNA, 23 nt, Human
aaugggcggaaguguuaaguugc

SEQ ID NO: 53582 - RNA, 22 nt, Human
aaugugcugguaacugcuuugc

SEQ ID NO: 53583 - RNA, 21 nt, Human
acaaaaccuaacuuggcugcu

SEQ ID NO: 53584 - RNA, 22 nt, Human
acaaacugggauaggauccugu

SEQ ID NO: 53585 - RNA, 20 nt, Human
acaaccacugcucacaguuu

SEQ ID NO: 53586 - RNA, 22 nt, Human
acaaggaagaaaacauuacuuu

SEQ ID NO: 53587 - RNA, 22 nt, Human
acaagguugauucuggcaucug

SEQ ID NO: 53588 - RNA, 22 nt, Human
acaaggccaagcauucuagcaa

SEQ ID NO: 53589 - RNA, 22 nt, Human
acaaggccugagggugacagca

SEQ ID NO: 53590 - RNA, 20 nt, Human
acacaccugcucagacugag

SEQ ID NO: 53591 - RNA, 22 nt, Human
acacaggacacaaaagucacca

SEQ ID NO: 53592 - RNA, 20 nt, Human
acacagccuagaguuuggcu

SEQ ID NO: 53593 - RNA, 22 nt, Human
acacccuugcagacgguuccuu

SEQ ID NO: 53594 - RNA, 22 nt, Human
acacgauguuuuaagccccuaa

SEQ ID NO: 53595 - RNA, 22 nt, Human
acacgcacaccugugcacucgu

SEQ ID NO: 53596 - RNA, 22 nt, Human
acacgguggccagcaguaggug

SEQ ID NO: 53597 - RNA, 22 nt, Human
acagagcucccagccaucuccu

SEQ ID NO: 53598 - RNA, 23 nt, Human
acagcaagaggaccagaugugag

SEQ ID NO: 53599 - RNA, 22 nt, Human
acagaucugcacagugaacaau

SEQ ID NO: 53600 - RNA, 22 nt, Human
acagcagguuauuguuauggca

SEQ ID NO: 53601 - RNA, 22 nt, Human
acagccacccuggaacgguugu

SEQ ID NO: 53602 - RNA, 22 nt, Human
acagccacuaugacagauuuag

SEQ ID NO: 53603 - RNA, 19 nt, Human
acagccuguugguggggcu

SEQ ID NO: 53604 - RNA, 23 nt, Human
acagaggcaucagagcagcaggc

SEQ ID NO: 53605 - RNA, 22 nt, Human
acagaucuauauuauauauaca

SEQ ID NO: 53606 - RNA, 22 nt, Human
acagcaauccuggcagaggguu

SEQ ID NO: 53607 - RNA, 22 nt, Human
acagcugagaugcuacuugugg

SEQ ID NO: 53608 - RNA, 22 nt, Human
acagcugguugaaggggaccaa

SEQ ID NO: 53609 - RNA, 19 nt, Human
acaggaaggaaaauuucaa

SEQ ID NO: 53610 - RNA, 22 nt, Human
acaggacaaaaaucuggauggc

SEQ ID NO: 53611 - RNA, 22 nt, Human
acagcucaggcccaucaacccc

SEQ ID NO: 53612 - RNA, 22 nt, Human
acagcuggaggucugugagcac

SEQ ID NO: 53613 - RNA, 22 nt, Human
acaggacgugugugcgcaugug

SEQ ID NO: 53614 - RNA, 22 nt, Human
acaggcgucgccugcucuugcc

SEQ ID NO: 53615 - RNA, 22 nt, Human
acaggcugcccgcuccccaccu

SEQ ID NO: 53616 - RNA, 22 nt, Human
acagugguggagggcuguccug

SEQ ID NO: 53617 - RNA, 22 nt, Human
acauaaacaugcagccugccaa

SEQ ID NO: 53618 - RNA, 22 nt, Human
acauccagcagauuguccagag

SEQ ID NO: 53619 - RNA, 21 nt, Human
acauccaggguccucacugcc

SEQ ID NO: 53620 - RNA, 22 nt, Human
acauccaguaucagaagcauca

SEQ ID NO: 53621 - RNA, 22 nt, Human
acaucccccuacuuguguccug

SEQ ID NO: 53622 - RNA, 22 nt, Human
acaucuucuauggagguucgga

SEQ ID NO: 53623 - RNA, 20 nt, Human
acgccgcgaggugagcuggu

SEQ ID NO: 53624 - RNA, 22 nt, Human
acgccuugagccuugccugaau

SEQ ID NO: 53625 - RNA, 22 nt, Human
acgcgcuccagcaggugcuuca

SEQ ID NO: 53626 - RNA, 23 nt, Human
acgcagacacauguaugggccuc

SEQ ID NO: 53627 - RNA, 22 nt, Human
acgccaggagcuucuccguuca

SEQ ID NO: 53628 - RNA, 22 nt, Human
acgccggguaaggucauucugc

SEQ ID NO: 53629 - RNA, 22 nt, Human
acgccugccuguacuugugggg

SEQ ID NO: 53630 - RNA, 22 nt, Human
acgcugagcucauggagaugca

SEQ ID NO: 53631 - RNA, 21 nt, Human
acggaucucgcaccucuccug

SEQ ID NO: 53632 - RNA, 22 nt, Human
acggcuugaacgcgccuguggg

SEQ ID NO: 53633 - RNA, 23 nt, Human
acgggaggcggggcagggcugag

SEQ ID NO: 53634 - RNA, 22 nt, Human
acggggagcgucggccucuccc

SEQ ID NO: 53635 - RNA, 22 nt, Human
acgucaucguugucaucgucau

SEQ ID NO: 53636 - RNA, 22 nt, Human
acguccaccccguaccagauca

SEQ ID NO: 53637 - RNA, 22 nt, Human
acguccgcugauucuuuggaag

SEQ ID NO: 53638 - RNA, 22 nt, Human
acgugcauuacucaaaucucaa

SEQ ID NO: 53639 - RNA, 22 nt, Human
acgugaccuuauuugaaaaaug

SEQ ID NO: 53640 - RNA, 22 nt, Human
acuauauaaugcacacaguaua

SEQ ID NO: 53641 - RNA, 20 nt, Human
acuaccaugcaauuccgcuu

SEQ ID NO: 53642 - RNA, 22 nt, Human
acuaggugggugucacugacuc

SEQ ID NO: 53643 - RNA, 22 nt, Human
acucaucauuuuacggagcagc

SEQ ID NO: 53644 - RNA, 21 nt, Human
acuccagccacugacugucuc

SEQ ID NO: 53645 - RNA, 22 nt, Human
acucggcggccucgagugcugg

SEQ ID NO: 53646 - RNA, 18 nt, Human
acucugaagcuaagucac

SEQ ID NO: 53647 - RNA, 22 nt, Human
acucgggggccgcugcagggag

SEQ ID NO: 53648 - RNA, 22 nt, Human
acucucaauuaucuggacugaa

SEQ ID NO: 53649 - RNA, 22 nt, Human
acucugcaguaaggaauuguuu

SEQ ID NO: 53650 - RNA, 22 nt, Human
acugcaggucccaucaccugcg

SEQ ID NO: 53651 - RNA, 22 nt, Human
acugcauuaucaccaagaugua

SEQ ID NO: 53652 - RNA, 22 nt, Human
acugccauauuaggagcuucag

SEQ ID NO: 53653 - RNA, 21 nt, Human
acugccaugcaggagccucca

SEQ ID NO: 53654 - RNA, 22 nt, Human
acugcugauuauugaaguagag

SEQ ID NO: 53655 - RNA, 22 nt, Human
acugcuguugugauggguauuu

SEQ ID NO: 53656 - RNA, 22 nt, Human
acuggauucucuuacacagaug

SEQ ID NO: 53657 - RNA, 22 nt, Human
acuggcauuccuaggggagggg

SEQ ID NO: 53658 - RNA, 22 nt, Human
acuggcgucugucuccccugcc

SEQ ID NO: 53659 - RNA, 22 nt, Human
acuguugagggaagcagaugaa

SEQ ID NO: 53660 - RNA, 22 nt, Human
acuuuccuggcuuugcaaggua

SEQ ID NO: 53661 - RNA, 22 nt, Human
agaagaagacccuaaggaaagg

SEQ ID NO: 53662 - RNA, 22 nt, Human
agaagguggaguagaacaagcu

SEQ ID NO: 53663 - RNA, 19 nt, Human
agaacccccuuccucugcu

SEQ ID NO: 53664 - RNA, 22 nt, Human
agaagcaauuggaaaguacagg

SEQ ID NO: 53665 - RNA, 22 nt, Human
agaagcagaaggaagcagggcc

SEQ ID NO: 53666 - RNA, 22 nt, Human
agaaucagagcagaaucuucau

SEQ ID NO: 53667 - RNA, 21 nt, Human
agaagcggucgaaucgcagac

SEQ ID NO: 53668 - RNA, 22 nt, Human
agaccauguuauccuucauuuu

SEQ ID NO: 53669 - RNA, 22 nt, Human
agacccugauucugcuggcggu

SEQ ID NO: 53670 - RNA, 22 nt, Human
agacaagagcugaggacauauu

SEQ ID NO: 53671 - RNA, 22 nt, Human
agacaaggggauuuuugauggu

SEQ ID NO: 53672 - RNA, 22 nt, Human
agaccguguguggguugcggug

SEQ ID NO: 53673 - RNA, 22 nt, Human
agacgacucuuaaggcagaauu

SEQ ID NO: 53674 - RNA, 22 nt, Human
agacacauuuucagcucugcca

SEQ ID NO: 53675 - RNA, 22 nt, Human
agagcagaggcauggccguggg

SEQ ID NO: 53676 - RNA, 22 nt, Human
agagcagauggagcuggaagag

SEQ ID NO: 53677 - RNA, 22 nt, Human
agagcugggacuuggacucaau

SEQ ID NO: 53678 - RNA, 22 nt, Human
agagcccagaucccacccugga

SEQ ID NO: 53679 - RNA, 22 nt, Human
agaggcaggcagcagagaagau

SEQ ID NO: 53680 - RNA, 22 nt, Human
agaggugcuuaugcucaugguu

SEQ ID NO: 53681 - RNA, 19 nt, Human
agaucaggauguauuuuug

SEQ ID NO: 53682 - RNA, 22 nt, Human
agaugaccaguaagugguugaa

SEQ ID NO: 53683 - RNA, 22 nt, Human
agauaggccauuaagaaggaua

SEQ ID NO: 53684 - RNA, 22 nt, Human
agaugaugugugucuucagcua

SEQ ID NO: 53685 - RNA, 19 nt, Human
agauggcaaaaugcaaaga

SEQ ID NO: 53686 - RNA, 22 nt, Human
agaucugucaccauccuggagc

SEQ ID NO: 53687 - RNA, 22 nt, Human
agaugacuuuguccugagcuga

SEQ ID NO: 53688 - RNA, 21 nt, Human
agaugaggauacugaggccua

SEQ ID NO: 53689 - RNA, 23 nt, Human
agaugaugaauaaagagugagga

SEQ ID NO: 53690 - RNA, 22 nt, Human
agauuuucuuuuccaucuuugu

SEQ ID NO: 53691 - RNA, 22 nt, Human
agcaacauggaguuugugcgca

SEQ ID NO: 53692 - RNA, 22 nt, Human
agcacauguuucuuuugcaauu

SEQ ID NO: 53693 - RNA, 22 nt, Human
agcacgcccaccuccugcggcg

SEQ ID NO: 53694 - RNA, 22 nt, Human
agcaaaacuaaagacacagaca

SEQ ID NO: 53695 - RNA, 22 nt, Human
agcaaggagcugaaaccgggcu

SEQ ID NO: 53696 - RNA, 22 nt, Human
agcaagggucucucauggcuug

SEQ ID NO: 53697 - RNA, 22 nt, Human
agcaaggguugguuuucugaca

SEQ ID NO: 53698 - RNA, 22 nt, Human
agcaauucagagcauggacuuu

SEQ ID NO: 53699 - RNA, 22 nt, Human
agcagcaaugacaauucaacca

SEQ ID NO: 53700 - RNA, 22 nt, Human
agcagcaccuguccucgcugcu

SEQ ID NO: 53701 - RNA, 22 nt, Human
agcagcaggugaccucgaugcc

SEQ ID NO: 53702 - RNA, 19 nt, Human
agcagccaucgaccaugga

SEQ ID NO: 53703 - RNA, 22 nt, Human
agcagcugagccccagcuguga

SEQ ID NO: 53704 - RNA, 17 nt, Human
agcagcuggguugaucu

SEQ ID NO: 53705 - RNA, 22 nt, Human
agcaggacuugcugagcccucc

SEQ ID NO: 53706 - RNA, 22 nt, Human
agcaggagagacuggcccaaaa

SEQ ID NO: 53707 - RNA, 22 nt, Human
agcagggagacagugcagcauu

SEQ ID NO: 53708 - RNA, 22 nt, Human
agcaggggcaggguuuugugcu

SEQ ID NO: 53709 - RNA, 22 nt, Human
agcaggguggcaagucuuucug

SEQ ID NO: 53710 - RNA, 22 nt, Human
agccagugucgugugacaugag

SEQ ID NO: 53711 - RNA, 22 nt, Human
agccaucuggugucaaugauuc

SEQ ID NO: 53712 - RNA, 22 nt, Human
agccaugcuguuuugccuggga

SEQ ID NO: 53713 - RNA, 22 nt, Human
agccauggaggaugugcagcau

SEQ ID NO: 53714 - RNA, 22 nt, Human
agccccaauuacagcugugcug

SEQ ID NO: 53715 - RNA, 22 nt, Human
agccccuucuuuggggagcuga

SEQ ID NO: 53716 - RNA, 22 nt, Human
agcccgggagggcugucuggga

SEQ ID NO: 53717 - RNA, 22 nt, Human
agccaagucucacugagucugu

SEQ ID NO: 53718 - RNA, 22 nt, Human
agccagcauauauauaguugaa

SEQ ID NO: 53719 - RNA, 21 nt, Human
agccagguuuccuuugaagag

SEQ ID NO: 53720 - RNA, 22 nt, Human
agccauggagaacagacuugaa

SEQ ID NO: 53721 - RNA, 22 nt, Human
agccauggagauguggguuggg

SEQ ID NO: 53722 - RNA, 23 nt, Human
agcccagcagagaaccuaggucc

SEQ ID NO: 53723 - RNA, 22 nt, Human
agcccagguggagugugugggg

SEQ ID NO: 53724 - RNA, 22 nt, Human
agccccggugagggaguccugu

SEQ ID NO: 53725 - RNA, 22 nt, Human
agccgcgcuguuccugcugcug

SEQ ID NO: 53726 - RNA, 22 nt, Human
agccgcugaauuugaaacaagc

SEQ ID NO: 53727 - RNA, 22 nt, Human
agccggccucggacagagggag

SEQ ID NO: 53728 - RNA, 22 nt, Human
agccuacauuugacuauagucu

SEQ ID NO: 53729 - RNA, 22 nt, Human
agccugaaccaauauagcagcc

SEQ ID NO: 53730 - RNA, 22 nt, Human
agccuggacagcuacggagaac

SEQ ID NO: 53731 - RNA, 22 nt, Human
agcgacuguaagagggccccgg

SEQ ID NO: 53732 - RNA, 21 nt, Human
agccgggacaacguggacccc

SEQ ID NO: 53733 - RNA, 22 nt, Human
agccugggucgagagacgagaa

SEQ ID NO: 53734 - RNA, 22 nt, Human
agccugugacucugugaaacca

SEQ ID NO: 53735 - RNA, 22 nt, Human
agccugugcuguguuugcucca

SEQ ID NO: 53736 - RNA, 22 nt, Human
agccuguuacuguccugugcca

SEQ ID NO: 53737 - RNA, 22 nt, Human
agcgcccguugagucgcgcggu

SEQ ID NO: 53738 - RNA, 22 nt, Human
agcgcucauuuuccuccugcuc

SEQ ID NO: 53739 - RNA, 22 nt, Human
agcgcugugaaggcugggccac

SEQ ID NO: 53740 - RNA, 21 nt, Human
agcgcugcauccaccauggcu

SEQ ID NO: 53741 - RNA, 22 nt, Human
agcggcaagguguauguggcag

SEQ ID NO: 53742 - RNA, 22 nt, Human
agcggcaggaagcgcgcaagcg

SEQ ID NO: 53743 - RNA, 19 nt, Human
agcggccgccgcgggcgcc

SEQ ID NO: 53744 - RNA, 22 nt, Human
agcggccucgcugccugcucag

SEQ ID NO: 53745 - RNA, 22 nt, Human
agcgcuguguucccgugggcau

SEQ ID NO: 53746 - RNA, 22 nt, Human
aggaauuucacugcguuuuuua

SEQ ID NO: 53747 - RNA, 20 nt, Human
aggaacuggaagggaggaaa

SEQ ID NO: 53748 - RNA, 22 nt, Human
aggagcugccggauggggcaug

SEQ ID NO: 53749 - RNA, 22 nt, Human
aggaggcguuugcuaaacgggc

SEQ ID NO: 53750 - RNA, 17 nt, Human
aggagcuagaaaggaga

SEQ ID NO: 53751 - RNA, 22 nt, Human
aggacaagacaaggaccagaga

SEQ ID NO: 53752 - RNA, 22 nt, Human
aggcagagaggucuuccuggaa

SEQ ID NO: 53753 - RNA, 22 nt, Human
aggcagagauggcugcagggcc

SEQ ID NO: 53754 - RNA, 22 nt, Human
aggauucuccuguuucccaccc

SEQ ID NO: 53755 - RNA, 22 nt, Human
aggcaagauuaggaccagaaga

SEQ ID NO: 53756 - RNA, 22 nt, Human
aggcaauagagggugaggagga

SEQ ID NO: 53757 - RNA, 22 nt, Human
aggcacagaauccagucugcug

SEQ ID NO: 53758 - RNA, 20 nt, Human
aggcagacaaggagucuguu

SEQ ID NO: 53759 - RNA, 22 nt, Human
aggcaguggagcuggaauaggc

SEQ ID NO: 53760 - RNA, 23 nt, Human
aggcagcaugcaacaggccauuu

SEQ ID NO: 53761 - RNA, 19 nt, Human
aggcagccccaacuugcau

SEQ ID NO: 53762 - RNA, 21 nt, Human
aggcagcgauuuucauauugc

SEQ ID NO: 53763 - RNA, 22 nt, Human
aggcaggcucaaugcccagucu

SEQ ID NO: 53764 - RNA, 22 nt, Human
aggcagcagggagggagaaaug

SEQ ID NO: 53765 - RNA, 22 nt, Human
aggcaggggagcuggaagggua

SEQ ID NO: 53766 - RNA, 21 nt, Human
aggccaaguuggauuucuuca

SEQ ID NO: 53767 - RNA, 22 nt, Human
aggcaguguguagcuggaagag

SEQ ID NO: 53768 - RNA, 22 nt, Human
aggcaucguguuuuucugcuuu

SEQ ID NO: 53769 - RNA, 22 nt, Human
aggccacucagggggccaagau

SEQ ID NO: 53770 - RNA, 22 nt, Human
aggccaggcgccggcgcgagac

SEQ ID NO: 53771 - RNA, 22 nt, Human
aggccagggacaaugaggcaga

SEQ ID NO: 53772 - RNA, 22 nt, Human
aggccagugcagcuggaacaga

SEQ ID NO: 53773 - RNA, 22 nt, Human
aggccgagaugacagagccacu

SEQ ID NO: 53774 - RNA, 22 nt, Human
aggcccucucggucccccgccg

SEQ ID NO: 53775 - RNA, 22 nt, Human
aggcugcuggcaggcguggacg

SEQ ID NO: 53776 - RNA, 22 nt, Human
aggcuguagaucuagacaugua

SEQ ID NO: 53777 - RNA, 23 nt, Human
agggcacugaagcuggaauuggg

SEQ ID NO: 53778 - RNA, 22 nt, Human
agggcacuuccucugggucccu

SEQ ID NO: 53779 - RNA, 22 nt, Human
agggcaggguuggugcuggugc

SEQ ID NO: 53780 - RNA, 22 nt, Human
agggcauacauuuuccugagau

SEQ ID NO: 53781 - RNA, 22 nt, Human
agggcaugugaaguaaccuagg

SEQ ID NO: 53782 - RNA, 21 nt, Human
agggccagaucaccaaggagc

SEQ ID NO: 53783 - RNA, 22 nt, Human
agggccagcagcuuggccaacc

SEQ ID NO: 53784 - RNA, 22 nt, Human
agggagucuggccgucggcugg

SEQ ID NO: 53785 - RNA, 22 nt, Human
agggcaguguggugggacugac

SEQ ID NO: 53786 - RNA, 22 nt, Human
agggccaagaaagaguggcuuu

SEQ ID NO: 53787 - RNA, 22 nt, Human
aggggcagaggaugauggaaga

SEQ ID NO: 53788 - RNA, 22 nt, Human
agggcugcugcuccgggcccag

SEQ ID NO: 53789 - RNA, 22 nt, Human
agggcuucugcugcagagaccu

SEQ ID NO: 53790 - RNA, 19 nt, Human
aggggccugcuuggccuug

SEQ ID NO: 53791 - RNA, 22 nt, Human
aggggcugagaguuugaugugg

SEQ ID NO: 53792 - RNA, 20 nt, Human
aggggcuguaguuagaugac

SEQ ID NO: 53793 - RNA, 22 nt, Human
aggguggcuggaguggucuggu

SEQ ID NO: 53794 - RNA, 22 nt, Human
agggggcaugaaauaaaggaaa

SEQ ID NO: 53795 - RNA, 22 nt, Human
agggggccuauucuuggacugc

SEQ ID NO: 53796 - RNA, 22 nt, Human
aggucguauaguuaccuccuug

SEQ ID NO: 53797 - RNA, 22 nt, Human
aggucgugggugagagagagac

SEQ ID NO: 53798 - RNA, 22 nt, Human
aggucugcccaggaugcugcuu

SEQ ID NO: 53799 - RNA, 22 nt, Human
agguccugucuuaucucuguaa

SEQ ID NO: 53800 - RNA, 22 nt, Human
aggugcauuuacuuggggcccu

SEQ ID NO: 53801 - RNA, 22 nt, Human
aggugcccaaaucuucuguuuu

SEQ ID NO: 53802 - RNA, 22 nt, Human
aggugcucaguaauugauuguu

SEQ ID NO: 53803 - RNA, 22 nt, Human
agguggugacgaugcuccguac

SEQ ID NO: 53804 - RNA, 22 nt, Human
agguggcuaugaggaugcaguc

SEQ ID NO: 53805 - RNA, 22 nt, Human
aggugcuugcauacugcuugac

SEQ ID NO: 53806 - RNA, 21 nt, Human
aguaccugugugccugugugu

SEQ ID NO: 53807 - RNA, 22 nt, Human
agugccuggcugauggguccug

SEQ ID NO: 53808 - RNA, 22 nt, Human
aguggcuggcaggggagggucc

SEQ ID NO: 53809 - RNA, 23 nt, Human
aguggccgaucaucucgggcuug

SEQ ID NO: 53810 - RNA, 22 nt, Human
aguggcugugaaauacauggga

SEQ ID NO: 53811 - RNA, 19 nt, Human
agugggcaaggaagaugac

SEQ ID NO: 53812 - RNA, 22 nt, Human
aguggcuguuccaggugaggac

SEQ ID NO: 53813 - RNA, 22 nt, Human
aguggggaaauaucaauauuug

SEQ ID NO: 53814 - RNA, 22 nt, Human
aguggggcccaagaaucugcau

SEQ ID NO: 53815 - RNA, 22 nt, Human
agugugacccauggcaagggca

SEQ ID NO: 53816 - RNA, 22 nt, Human
aguggugccuaagcgcggaggc

SEQ ID NO: 53817 - RNA, 22 nt, Human
agugucugcgggcagaggagcg

SEQ ID NO: 53818 - RNA, 22 nt, Human
aguguucaucacaggcuagaga

SEQ ID NO: 53819 - RNA, 17 nt, Human
aguuacugcacuugcca

SEQ ID NO: 53820 - RNA, 22 nt, Human
aguucaugugguuuaacuuaau

SEQ ID NO: 53821 - RNA, 22 nt, Human
aguucaugcuuagaucucauuu

SEQ ID NO: 53822 - RNA, 22 nt, Human
aguucauccucauuuacaagga

SEQ ID NO: 53823 - RNA, 22 nt, Human
aguucccgcgggagggcgcagg

SEQ ID NO: 53824 - RNA, 22 nt, Human
aguuccucagaagggccuggga

SEQ ID NO: 53825 - RNA, 22 nt, Human
aguucucaagguuaggaaaagu

SEQ ID NO: 53826 - RNA, 22 nt, Human
aguucuggcccugaaacaggga

SEQ ID NO: 53827 - RNA, 22 nt, Human
aguugcugccagguccugggag

SEQ ID NO: 53828 - RNA, 22 nt, Human
aguuuguagguuaggaucagca

SEQ ID NO: 53829 - RNA, 22 nt, Human
auaaggacuugaauuagacauu

SEQ ID NO: 53830 - RNA, 22 nt, Human
auacagccuaguuugaguccca

SEQ ID NO: 53831 - RNA, 22 nt, Human
aucuccaguuagcaguacugau

SEQ ID NO: 53832 - RNA, 22 nt, Human
aucuccagcagugcuuuugagc

SEQ ID NO: 53833 - RNA, 18 nt, Human
auccuucggccuagugga

SEQ ID NO: 53834 - RNA, 22 nt, Human
aucugcugcuccuucuucuugc

SEQ ID NO: 53835 - RNA, 22 nt, Human
aucugcuguaguuggugccagu

SEQ ID NO: 53836 - RNA, 23 nt, Human
aucugagccuggucccacccgcu

SEQ ID NO: 53837 - RNA, 22 nt, Human
aucuguuccccuaugcucucua

SEQ ID NO: 53838 - RNA, 23 nt, Human
aucgcccggguccagucccggcu

SEQ ID NO: 53839 - RNA, 22 nt, Human
aucguggcacgucgccgcagcg

SEQ ID NO: 53840 - RNA, 22 nt, Human
aucucaaagauaugcugguaaa

SEQ ID NO: 53841 - RNA, 22 nt, Human
aucuuggccuucuccuggagug

SEQ ID NO: 53842 - RNA, 22 nt, Human
augaacuaagagucauuagugu

SEQ ID NO: 53843 - RNA, 22 nt, Human
augacagcucuagcacacagua

SEQ ID NO: 53844 - RNA, 22 nt, Human
augaccauccagaaguccagcu

SEQ ID NO: 53845 - RNA, 22 nt, Human
aucuuugccuuuaugccucuag

SEQ ID NO: 53846 - RNA, 22 nt, Human
augaaaacggaccagagcuauu

SEQ ID NO: 53847 - RNA, 22 nt, Human
augcacaagguagauuauuauu

SEQ ID NO: 53848 - RNA, 22 nt, Human
augaggccuaauacccauuccu

SEQ ID NO: 53849 - RNA, 22 nt, Human
augcauaucuccuaucuccuca

SEQ ID NO: 53850 - RNA, 22 nt, Human
augccaccucuucugauuccag

SEQ ID NO: 53851 - RNA, 22 nt, Human
augcccagaacccccuggaugg

SEQ ID NO: 53852 - RNA, 17 nt, Human
augcccagggcucccug

SEQ ID NO: 53853 - RNA, 22 nt, Human
augcccugggagugcuguacca

SEQ ID NO: 53854 - RNA, 22 nt, Human
augccgggguggcuccagcacc

SEQ ID NO: 53855 - RNA, 22 nt, Human
auggacguuuguguauuaugua

SEQ ID NO: 53856 - RNA, 22 nt, Human
auggagcgggaggauggaggag

SEQ ID NO: 53857 - RNA, 22 nt, Human
augcugcuccuuuucaggcauu

SEQ ID NO: 53858 - RNA, 22 nt, Human
auggcaucuucgguuggacugc

SEQ ID NO: 53859 - RNA, 22 nt, Human
auggccguggccagggucaggg

SEQ ID NO: 53860 - RNA, 22 nt, Human
auggccugaagcuaaccccccu

SEQ ID NO: 53861 - RNA, 22 nt, Human
augggcggugcauuugcacagu

SEQ ID NO: 53862 - RNA, 22 nt, Human
auggagcagagcugaugggccu

SEQ ID NO: 53863 - RNA, 22 nt, Human
auggauggaagcagccugaacu

SEQ ID NO: 53864 - RNA, 22 nt, Human
auggcagcggagcuggaaauga

SEQ ID NO: 53865 - RNA, 22 nt, Human
augggcauacaaaugcuacccu

SEQ ID NO: 53866 - RNA, 22 nt, Human
augggcauggauggccgagucu

SEQ ID NO: 53867 - RNA, 22 nt, Human
augggggccagggacccuggca

SEQ ID NO: 53868 - RNA, 22 nt, Human
auguccugguccacagaaggga

SEQ ID NO: 53869 - RNA, 22 nt, Human
augguguaagacuguauuucuu

SEQ ID NO: 53870 - RNA, 23 nt, Human
augugaggcaaaggcaggcacuc

SEQ ID NO: 53871 - RNA, 22 nt, Human
augugccuuaauauaggcgcug

SEQ ID NO: 53872 - RNA, 22 nt, Human
auguugcugauccuguggcugu

SEQ ID NO: 53873 - RNA, 22 nt, Human
auguuguugaacucuuugcaug

SEQ ID NO: 53874 - RNA, 22 nt, Human
auguuguuuauggguuaucaag

SEQ ID NO: 53875 - RNA, 22 nt, Human
auucgaucacugccgaggaccu

SEQ ID NO: 53876 - RNA, 22 nt, Human
auucgcggcuugaucugcuugc

SEQ ID NO: 53877 - RNA, 22 nt, Human
auucugcauuucuaaccagguc

SEQ ID NO: 53878 - RNA, 22 nt, Human
auuggcugucagcccggauggg

SEQ ID NO: 53879 - RNA, 22 nt, Human
auugccauaauagagccaugua

SEQ ID NO: 53880 - RNA, 22 nt, Human
auuggccaguggacagcgccgu

SEQ ID NO: 53881 - RNA, 22 nt, Human
auuuccugugaacuuuucugau

SEQ ID NO: 53882 - RNA, 23 nt, Human
auuuuuccacacacagacucagu

SEQ ID NO: 53883 - RNA, 22 nt, Human
caagcagauauuuuagucaaga

SEQ ID NO: 53884 - RNA, 22 nt, Human
caagcgcgccgcuuccuuccgc

SEQ ID NO: 53885 - RNA, 23 nt, Human
cacucgcaggcccagcucucagg

SEQ ID NO: 53886 - RNA, 22 nt, Human
cacugcugaggcccguguuacu

SEQ ID NO: 53887 - RNA, 22 nt, Human
cacacgagcccuggagccagca

SEQ ID NO: 53888 - RNA, 22 nt, Human
cacagauaaggcuuugucccca

SEQ ID NO: 53889 - RNA, 22 nt, Human
cacagcagcaucauuuaucugg

SEQ ID NO: 53890 - RNA, 22 nt, Human
cacagcaggcagaacgugggca

SEQ ID NO: 53891 - RNA, 19 nt, Human
cacuguccuagucgaggcc

SEQ ID NO: 53892 - RNA, 22 nt, Human
cacagccaagacuuggccccau

SEQ ID NO: 53893 - RNA, 19 nt, Human
cacagcccucacuuuuagc

SEQ ID NO: 53894 - RNA, 20 nt, Human
cacagcugacgaguauccaa

SEQ ID NO: 53895 - RNA, 22 nt, Human
cagaaagaaguggggauagagg

SEQ ID NO: 53896 - RNA, 22 nt, Human
cacaucucagggcuacaggcag

SEQ ID NO: 53897 - RNA, 22 nt, Human
cacaugugggcacagggcugca

SEQ ID NO: 53898 - RNA, 22 nt, Human
cagaacugaauaaagccaggau

SEQ ID NO: 53899 - RNA, 22 nt, Human
caccaccaguaccaucacacgc

SEQ ID NO: 53900 - RNA, 22 nt, Human
caccagcgacugugaccagcaa

SEQ ID NO: 53901 - RNA, 22 nt, Human
caccaucugaauauucuccaag

SEQ ID NO: 53902 - RNA, 22 nt, Human
cacccccaggcuccccuucugg

SEQ ID NO: 53903 - RNA, 22 nt, Human
cacccgacugaggacgccgccc

SEQ ID NO: 53904 - RNA, 22 nt, Human
cacccugacuggcccugcagga

SEQ ID NO: 53905 - RNA, 22 nt, Human
caccuggaggcagcaccgggcu

SEQ ID NO: 53906 - RNA, 22 nt, Human
cacgggcgacgugaucuaggac

SEQ ID NO: 53907 - RNA, 22 nt, Human
caccuuccgcccacugaccgcc

SEQ ID NO: 53908 - RNA, 22 nt, Human
cagaccuggaaaacaggcuugc

SEQ ID NO: 53909 - RNA, 22 nt, Human
cacugcaaccuccaccucccgg

SEQ ID NO: 53910 - RNA, 22 nt, Human
cacugcacuccagccugggcaa

SEQ ID NO: 53911 - RNA, 22 nt, Human
cacuucaguacuagaggaugaa

SEQ ID NO: 53912 - RNA, 22 nt, Human
cagcagaugacuauuggagcug

SEQ ID NO: 53913 - RNA, 23 nt, Human
cagaccccuggcucugacccccu

SEQ ID NO: 53914 - RNA, 22 nt, Human
cagacuccugcuccucuggggc

SEQ ID NO: 53915 - RNA, 22 nt, Human
cagcccuggccucuucgcuuuc

SEQ ID NO: 53916 - RNA, 22 nt, Human
cagcccuguugcgcuuccggcg

SEQ ID NO: 53917 - RNA, 22 nt, Human
cagcccugagagaaccaucuau

SEQ ID NO: 53918 - RNA, 22 nt, Human
cagagaugaggcuggcgugguu

SEQ ID NO: 53919 - RNA, 22 nt, Human
cagagccagcuguccuuggcau

SEQ ID NO: 53920 - RNA, 22 nt, Human
cagagcucacaaacugaaaacc

SEQ ID NO: 53921 - RNA, 22 nt, Human
cagcccuugcgacacccuggcu

SEQ ID NO: 53922 - RNA, 22 nt, Human
cagccgcucaugggcccggagc

SEQ ID NO: 53923 - RNA, 22 nt, Human
cagccuggccucuggauauuug

SEQ ID NO: 53924 - RNA, 22 nt, Human
cagcuccagcccaggcagcucc

SEQ ID NO: 53925 - RNA, 22 nt, Human
cagcuucacuuaaaacaugcaa

SEQ ID NO: 53926 - RNA, 22 nt, Human
cagcaugcaaguccagaugugg

SEQ ID NO: 53927 - RNA, 22 nt, Human
cagcaugguggagcugcucuuu

SEQ ID NO: 53928 - RNA, 22 nt, Human
caggaacagcaccaggagcuag

SEQ ID NO: 53929 - RNA, 22 nt, Human
cagccccaguuuucauaagacu

SEQ ID NO: 53930 - RNA, 21 nt, Human
cagcccccauacccugcccag

SEQ ID NO: 53931 - RNA, 22 nt, Human
cagccccgcuggccucgccucc

SEQ ID NO: 53932 - RNA, 22 nt, Human
cagccccucuucucuccucgga

SEQ ID NO: 53933 - RNA, 19 nt, Human
caggacaguuugccaagaa

SEQ ID NO: 53934 - RNA, 22 nt, Human
caggacagaaauaaggaauaua

SEQ ID NO: 53935 - RNA, 22 nt, Human
caggacccaacggugcaauguc

SEQ ID NO: 53936 - RNA, 22 nt, Human
cagcgguggcaaggugacugug

SEQ ID NO: 53937 - RNA, 22 nt, Human
cagcuauggaauuggcccagau

SEQ ID NO: 53938 - RNA, 22 nt, Human
caggaggugugucccaccgggu

SEQ ID NO: 53939 - RNA, 22 nt, Human
caggcacaagaucggcuagaua

SEQ ID NO: 53940 - RNA, 22 nt, Human
caggcgcauggugagcagauga

SEQ ID NO: 53941 - RNA, 22 nt, Human
caggcgcugacgggaccgggcu

SEQ ID NO: 53942 - RNA, 22 nt, Human
cagggacgugagccaugucagu

SEQ ID NO: 53943 - RNA, 22 nt, Human
caggggcuccaggugagccugg

SEQ ID NO: 53944 - RNA, 22 nt, Human
caggugcucugauauggggcug

SEQ ID NO: 53945 - RNA, 22 nt, Human
caggacccaaccucccugcucu

SEQ ID NO: 53946 - RNA, 22 nt, Human
cagguggauggcgagcccugca

SEQ ID NO: 53947 - RNA, 22 nt, Human
caggugggauuuugcugcuuga

SEQ ID NO: 53948 - RNA, 22 nt, Human
cagguugaaaguggaggagcua

SEQ ID NO: 53949 - RNA, 22 nt, Human
cagguugucuaauuccaagggg

SEQ ID NO: 53950 - RNA, 22 nt, Human
caggauuuaauaagauaguguu

SEQ ID NO: 53951 - RNA, 22 nt, Human
caggcacaaugagcgccaucuu

SEQ ID NO: 53952 - RNA, 22 nt, Human
cagguuucuggaugcagcccca

SEQ ID NO: 53953 - RNA, 22 nt, Human
cagugccggccaggaccuccug

SEQ ID NO: 53954 - RNA, 22 nt, Human
cagugcucauagcuguuccucc

SEQ ID NO: 53955 - RNA, 22 nt, Human
caguggggcuuccagacgcuga

SEQ ID NO: 53956 - RNA, 22 nt, Human
caggaucccuggccuccgccca

SEQ ID NO: 53957 - RNA, 21 nt, Human
caguuugcuauuuuaguauga

SEQ ID NO: 53958 - RNA, 22 nt, Human
cagguggccggguaggaggugg

SEQ ID NO: 53959 - RNA, 22 nt, Human
caggugccucugccccacgcgg

SEQ ID NO: 53960 - RNA, 22 nt, Human
caucagucugaaagccagggag

SEQ ID NO: 53961 - RNA, 22 nt, Human
cauuccccaacucaacagggcu

SEQ ID NO: 53962 - RNA, 21 nt, Human
caucaagaucaauggagggcu

SEQ ID NO: 53963 - RNA, 22 nt, Human
caucacggagcaugagaagaca

SEQ ID NO: 53964 - RNA, 22 nt, Human
caucgagaauuggcagcuaaag

SEQ ID NO: 53965 - RNA, 22 nt, Human
cauugggcggggaccucggcug

SEQ ID NO: 53966 - RNA, 22 nt, Human
caugaccauuuggguuugugcg

SEQ ID NO: 53967 - RNA, 22 nt, Human
caugaugacagcauuccuuuua

SEQ ID NO: 53968 - RNA, 22 nt, Human
cauuucuugugagccgcauccu

SEQ ID NO: 53969 - RNA, 22 nt, Human
caugaugagaguaauaacacag

SEQ ID NO: 53970 - RNA, 22 nt, Human
caugauguuaucaagcacaaag

SEQ ID NO: 53971 - RNA, 22 nt, Human
caugcagcagaauaaugacuau

SEQ ID NO: 53972 - RNA, 22 nt, Human
caugcgucugcauuggguggug

SEQ ID NO: 53973 - RNA, 22 nt, Human
ccaaccaguuaucuccuaaggu

SEQ ID NO: 53974 - RNA, 22 nt, Human
ccaagcguguuuaggaaaugcu

SEQ ID NO: 53975 - RNA, 22 nt, Human
ccaaggcugcagccgugacgcg

SEQ ID NO: 53976 - RNA, 22 nt, Human
ccaaggcuggagggcuuaugua

SEQ ID NO: 53977 - RNA, 22 nt, Human
caugcuucccacauuccgauuu

SEQ ID NO: 53978 - RNA, 22 nt, Human
cauggcaggugcagauucugug

SEQ ID NO: 53979 - RNA, 22 nt, Human
caugggcucuucuggacugcac

SEQ ID NO: 53980 - RNA, 21 nt, Human
ccacaucaugucaccuccuag

SEQ ID NO: 53981 - RNA, 22 nt, Human
ccaccacugaggcacaggagcc

SEQ ID NO: 53982 - RNA, 22 nt, Human
ccacccacuucucugcccucca

SEQ ID NO: 53983 - RNA, 22 nt, Human
ccaccccagaaagggaaggcca

SEQ ID NO: 53984 - RNA, 22 nt, Human
ccacccugguuacugugccagg

SEQ ID NO: 53985 - RNA, 22 nt, Human
ccaccuggcagcaggcucggca

SEQ ID NO: 53986 - RNA, 16 nt, Human
ccacccagagaauauu

SEQ ID NO: 53987 - RNA, 22 nt, Human
ccacuuucuaaauuggcgauuu

SEQ ID NO: 53988 - RNA, 19 nt, Human
ccagaagggcaagcaaagg

SEQ ID NO: 53989 - RNA, 22 nt, Human
ccagaacgacgggcagaggcgc

SEQ ID NO: 53990 - RNA, 22 nt, Human
cauugcugugggcauuugcugc

SEQ ID NO: 53991 - RNA, 22 nt, Human
cauugcugccaaggugagcugg

SEQ ID NO: 53992 - RNA, 22 nt, Human
cauugcuguuaauugucucuag

SEQ ID NO: 53993 - RNA, 22 nt, Human
ccagacuggggcuccuugaggg

SEQ ID NO: 53994 - RNA, 22 nt, Human
ccagcaaguaagucagugucag

SEQ ID NO: 53995 - RNA, 22 nt, Human
ccagcagaagcucccgcugggu

SEQ ID NO: 53996 - RNA, 22 nt, Human
ccagcaugcucagucuaaauug

SEQ ID NO: 53997 - RNA, 22 nt, Human
ccagccacagcuuccagcuccu

SEQ ID NO: 53998 - RNA, 22 nt, Human
ccagcaucagcucuuggcuggc

SEQ ID NO: 53999 - RNA, 22 nt, Human
ccagccugagcuugcugcccuc

SEQ ID NO: 54000 - RNA, 22 nt, Human
cauuucuggccuggggagcggg

SEQ ID NO: 54001 - RNA, 22 nt, Human
ccagcucgaggcaggggcugca

SEQ ID NO: 54002 - RNA, 22 nt, Human
ccagcugggucccugcuggggc

SEQ ID NO: 54003 - RNA, 23 nt, Human
ccagcugugccuggcccaggagc

SEQ ID NO: 54004 - RNA, 22 nt, Human
ccagcuuuucagaaucugccug

SEQ ID NO: 54005 - RNA, 22 nt, Human
ccaggcccugccugugguuccu

SEQ ID NO: 54006 - RNA, 22 nt, Human
ccaggcuccccaggaggcccuu

SEQ ID NO: 54007 - RNA, 22 nt, Human
ccagggaagaaagaugaagugc

SEQ ID NO: 54008 - RNA, 22 nt, Human
ccagggagggccacagggccau

SEQ ID NO: 54009 - RNA, 22 nt, Human
ccagggcugcugccugggcugg

SEQ ID NO: 54010 - RNA, 22 nt, Human
ccaggggagagucugagucguu

SEQ ID NO: 54011 - RNA, 22 nt, Human
ccaagagcuucccauagcuucu

SEQ ID NO: 54012 - RNA, 22 nt, Human
ccagguggacggcgaguacagg

SEQ ID NO: 54013 - RNA, 22 nt, Human
ccagguuggccaccuucacggg

SEQ ID NO: 54014 - RNA, 22 nt, Human
ccagucagccuaguucuucuuu

SEQ ID NO: 54015 - RNA, 22 nt, Human
ccaguccugucaggggagggga

SEQ ID NO: 54016 - RNA, 23 nt, Human
ccagucgagucccaaccuucgcc

SEQ ID NO: 54017 - RNA, 22 nt, Human
ccagugagauagugguauaugc

SEQ ID NO: 54018 - RNA, 22 nt, Human
ccaaggcuguggggcugugcag

SEQ ID NO: 54019 - RNA, 22 nt, Human
ccaaggugcagcccauggugaa

SEQ ID NO: 54020 - RNA, 16 nt, Human
ccaguggacuugcuac

SEQ ID NO: 54021 - RNA, 22 nt, Human
ccauagucacuuguccucuuuu

SEQ ID NO: 54022 - RNA, 22 nt, Human
ccaccucuaccuggccggccuu

SEQ ID NO: 54023 - RNA, 22 nt, Human
ccaugauguugccuacacugcu

SEQ ID NO: 54024 - RNA, 22 nt, Human
ccauggauacuaagguauguga

SEQ ID NO: 54025 - RNA, 22 nt, Human
ccacucucucccucuguagggg

SEQ ID NO: 54026 - RNA, 22 nt, Human
ccagaacguuugugcgaggcag

SEQ ID NO: 54027 - RNA, 19 nt, Human
ccacuucuuugugugugag

SEQ ID NO: 54028 - RNA, 22 nt, Human
cccagagacuuuguccgacgac

SEQ ID NO: 54029 - RNA, 18 nt, Human
cccagaggaaugccugga

SEQ ID NO: 54030 - RNA, 22 nt, Human
cccagaggcugaguugggagca

SEQ ID NO: 54031 - RNA, 22 nt, Human
ccuggaccgacacaggaaggga

SEQ ID NO: 54032 - RNA, 19 nt, Human
ccuggccaacgucaacauu

SEQ ID NO: 54033 - RNA, 19 nt, Human
ccgagcagauugauguuuc

SEQ ID NO: 54034 - RNA, 22 nt, Human
ccgcgcccccggcugugccccc

SEQ ID NO: 54035 - RNA, 22 nt, Human
ccgcggauggggagucaccacc

SEQ ID NO: 54036 - RNA, 22 nt, Human
ccgcggcagaggcgggggcgcc

SEQ ID NO: 54037 - RNA, 22 nt, Human
ccgcggcugcgcggugccccuc

SEQ ID NO: 54038 - RNA, 22 nt, Human
ccuggccacagggcucugcauu

SEQ ID NO: 54039 - RNA, 22 nt, Human
ccuggcccagcuggaagcggga

SEQ ID NO: 54040 - RNA, 22 nt, Human
ccuggcccugcugcuugccagc

SEQ ID NO: 54041 - RNA, 23 nt, Human
ccuggcugaccugaagguguagu

SEQ ID NO: 54042 - RNA, 22 nt, Human
ccugggcauaaaucacuccaag

SEQ ID NO: 54043 - RNA, 22 nt, Human
ccugggcauuuguuucacaggu

SEQ ID NO: 54044 - RNA, 22 nt, Human
ccugggccuaaacaaacaagag

SEQ ID NO: 54045 - RNA, 20 nt, Human
ccugggcuccaggagccccg

SEQ ID NO: 54046 - RNA, 21 nt, Human
ccugucagcccaacuuuugga

SEQ ID NO: 54047 - RNA, 22 nt, Human
ccugugcuucacucaacaagcc

SEQ ID NO: 54048 - RNA, 22 nt, Human
ccugugucaucagcuguggcua

SEQ ID NO: 54049 - RNA, 20 nt, Human
ccuguucacugcgcaguuuc

SEQ ID NO: 54050 - RNA, 18 nt, Human
ccuucaucucugcuucuu

SEQ ID NO: 54051 - RNA, 22 nt, Human
ccuuccaguucuugguuguaau

SEQ ID NO: 54052 - RNA, 22 nt, Human
ccgcggcuguaguggaggugga

SEQ ID NO: 54053 - RNA, 22 nt, Human
ccgcuggaagcgaguggugggc

SEQ ID NO: 54054 - RNA, 22 nt, Human
ccgcuggccgacuuccgagagc

SEQ ID NO: 54055 - RNA, 22 nt, Human
ccggcggaaacauggcggcgcc

SEQ ID NO: 54056 - RNA, 22 nt, Human
ccggcugcugaggcggccccgg

SEQ ID NO: 54057 - RNA, 22 nt, Human
ccgggcggcauccagccguucc

SEQ ID NO: 54058 - RNA, 22 nt, Human
ccguccgcuccuccagccgcug

SEQ ID NO: 54059 - RNA, 22 nt, Human
ccgugggugggguacgggcugg

SEQ ID NO: 54060 - RNA, 22 nt, Human
ccuuuuuagaugugcgaauguu

SEQ ID NO: 54061 - RNA, 22 nt, Human
ccucggacuugggugggcuccu

SEQ ID NO: 54062 - RNA, 22 nt, Human
cgagugauuauucuggcugaga

SEQ ID NO: 54063 - RNA, 22 nt, Human
cgcacacaaaugcauacgccag

SEQ ID NO: 54064 - RNA, 22 nt, Human
cgcacaggcacagacacuggga

SEQ ID NO: 54065 - RNA, 22 nt, Human
cgcccguacuuugccggcauga

SEQ ID NO: 54066 - RNA, 22 nt, Human
cgccgccgccugcccgcgcccc

SEQ ID NO: 54067 - RNA, 21 nt, Human
cgcccggccggaaaccccuuc

SEQ ID NO: 54068 - RNA, 22 nt, Human
ccugacucugauuucgcugcau

SEQ ID NO: 54069 - RNA, 22 nt, Human
ccugagacucuccugugcagcc

SEQ ID NO: 54070 - RNA, 22 nt, Human
ccugagccgagcgcucuuucuc

SEQ ID NO: 54071 - RNA, 19 nt, Human
cgcugcucccgcuguggcu

SEQ ID NO: 54072 - RNA, 22 nt, Human
cgcuggagagcaagugcgugca

SEQ ID NO: 54073 - RNA, 22 nt, Human
cgcuucauugugggggccccca

SEQ ID NO: 54074 - RNA, 22 nt, Human
cggaggagcugcgcggaggggg

SEQ ID NO: 54075 - RNA, 22 nt, Human
cggcugcgguucaccuagggca

SEQ ID NO: 54076 - RNA, 22 nt, Human
cggcuucucgggucggauuccg

SEQ ID NO: 54077 - RNA, 22 nt, Human
cgggacaauagcagugcugaug

SEQ ID NO: 54078 - RNA, 20 nt, Human
cgggacacucaagcucuggg

SEQ ID NO: 54079 - RNA, 22 nt, Human
cgggaggcggagcuccgcgggg

SEQ ID NO: 54080 - RNA, 22 nt, Human
ccuggcauuagaaauuccguca

SEQ ID NO: 54081 - RNA, 22 nt, Human
ccuucugcuggucaucccagug

SEQ ID NO: 54082 - RNA, 21 nt, Human
ccuugcacucaucccaugccc

SEQ ID NO: 54083 - RNA, 22 nt, Human
ccuuggcuuaccuucugugugg

SEQ ID NO: 54084 - RNA, 17 nt, Human
cgugaggaccaggcagc

SEQ ID NO: 54085 - RNA, 22 nt, Human
cgaaaaagaagugcaccauguu

SEQ ID NO: 54086 - RNA, 21 nt, Human
cgucccggcgugagagagcug

SEQ ID NO: 54087 - RNA, 22 nt, Human
cgugcuaccugagcugacagcu

SEQ ID NO: 54088 - RNA, 22 nt, Human
cguggaggucgcauauuccucu

SEQ ID NO: 54089 - RNA, 22 nt, Human
cguggcaguagagcuggaacuu

SEQ ID NO: 54090 - RNA, 22 nt, Human
cuaccagcacgccuuccucuac

SEQ ID NO: 54091 - RNA, 22 nt, Human
cuaccccaggccccucgaugcc

SEQ ID NO: 54092 - RNA, 22 nt, Human
cgaggccgcuucauggcuggca

SEQ ID NO: 54093 - RNA, 22 nt, Human
cgaggcuugcaaggacgaggag

SEQ ID NO: 54094 - RNA, 22 nt, Human
cgagggcuggaggggagacaga

SEQ ID NO: 54095 - RNA, 22 nt, Human
cgcaucggguagaggagcugga

SEQ ID NO: 54096 - RNA, 22 nt, Human
cgcauugcaauucaggggauaa

SEQ ID NO: 54097 - RNA, 22 nt, Human
cgccaaccaggcuguccuccca

SEQ ID NO: 54098 - RNA, 22 nt, Human
cuagcaggacucagcagauauu

SEQ ID NO: 54099 - RNA, 22 nt, Human
cgcccccgaucggggccgccgc

SEQ ID NO: 54100 - RNA, 22 nt, Human
cgcccggcugagacgcucgccc

SEQ ID NO: 54101 - RNA, 22 nt, Human
cgccgugucuggucuguacguc

SEQ ID NO: 54102 - RNA, 22 nt, Human
cgccgugcagucagcccagaag

SEQ ID NO: 54103 - RNA, 22 nt, Human
cgccuggccccgcagcgcuugu

SEQ ID NO: 54104 - RNA, 22 nt, Human
cucaagagaaaucggaaucaga

SEQ ID NO: 54105 - RNA, 22 nt, Human
cucagcgggagucuggccgaac

SEQ ID NO: 54106 - RNA, 22 nt, Human
cucagcacauuccuaagggaug

SEQ ID NO: 54107 - RNA, 22 nt, Human
cgcgcuuugggcaguguggcug

SEQ ID NO: 54108 - RNA, 22 nt, Human
cgcgggcuugggcaccugcgga

SEQ ID NO: 54109 - RNA, 22 nt, Human
cgcugggugguugauguacagc

SEQ ID NO: 54110 - RNA, 22 nt, Human
cuccacccuagagggcccaugc

SEQ ID NO: 54111 - RNA, 22 nt, Human
cuccagcagaaagggcgagugg

SEQ ID NO: 54112 - RNA, 22 nt, Human
cuccagcucgcgagcucugcuc

SEQ ID NO: 54113 - RNA, 22 nt, Human
cuccaggacugaggacagagcu

SEQ ID NO: 54114 - RNA, 22 nt, Human
cuccaggcccagggccaagagc

SEQ ID NO: 54115 - RNA, 22 nt, Human
cuccgcagcugggguuggcgcu

SEQ ID NO: 54116 - RNA, 22 nt, Human
cuccggggacgcagucgccgcc

SEQ ID NO: 54117 - RNA, 22 nt, Human
cuccucccagcccaggcgccac

SEQ ID NO: 54118 - RNA, 20 nt, Human
cuccuccccucggccccacc

SEQ ID NO: 54119 - RNA, 22 nt, Human
cggagggcccucaggacugggu

SEQ ID NO: 54120 - RNA, 22 nt, Human
cggccgcgggauggcgggcagc

SEQ ID NO: 54121 - RNA, 22 nt, Human
cucugcccacaguccccgagga

SEQ ID NO: 54122 - RNA, 22 nt, Human
cugagcaucaaaugggcaauua

SEQ ID NO: 54123 - RNA, 22 nt, Human
cggugcuuuccauaucagcagc

SEQ ID NO: 54124 - RNA, 22 nt, Human
cugagcugcucccgcugcagcg

SEQ ID NO: 54125 - RNA, 22 nt, Human
cgugaagaaguaauagguggug

SEQ ID NO: 54126 - RNA, 22 nt, Human
cgugcaggagcuggagguccga

SEQ ID NO: 54127 - RNA, 22 nt, Human
cguggccacaguggagcugagc

SEQ ID NO: 54128 - RNA, 22 nt, Human
cgugggggcaacgaccccuccc

SEQ ID NO: 54129 - RNA, 22 nt, Human
cgugucauggcggcgcaggugg

SEQ ID NO: 54130 - RNA, 22 nt, Human
cgugugugugcgugugcgugug

SEQ ID NO: 54131 - RNA, 22 nt, Human
cguugguggguguguggucgga

SEQ ID NO: 54132 - RNA, 20 nt, Human
cugauguucgugcuuccugg

SEQ ID NO: 54133 - RNA, 22 nt, Human
cugauuucaaauggugcuagau

SEQ ID NO: 54134 - RNA, 22 nt, Human
cugcacagucauuuccucucaa

SEQ ID NO: 54135 - RNA, 22 nt, Human
cugcagauaaguguuuugaaaa

SEQ ID NO: 54136 - RNA, 22 nt, Human
cuacaaggucuuuaucugcuuu

SEQ ID NO: 54137 - RNA, 22 nt, Human
cugccaguaucuuuggggcugu

SEQ ID NO: 54138 - RNA, 22 nt, Human
cugcccauggcuccuggcugug

SEQ ID NO: 54139 - RNA, 22 nt, Human
cugccccucgcucaccagcucu

SEQ ID NO: 54140 - RNA, 22 nt, Human
cugcccugcagcuccacggacu

SEQ ID NO: 54141 - RNA, 22 nt, Human
cugccgaugcgcaguggcgccu

SEQ ID NO: 54142 - RNA, 22 nt, Human
cuagaucuggcaggcacaaggu

SEQ ID NO: 54143 - RNA, 22 nt, Human
cugcgcgagcacugccggcggg

SEQ ID NO: 54144 - RNA, 22 nt, Human
cugcguugaccagacuccuggg

SEQ ID NO: 54145 - RNA, 22 nt, Human
cuagguggcagcacuccgaggu

SEQ ID NO: 54146 - RNA, 22 nt, Human
cugcugccagcuuaauacucac

SEQ ID NO: 54147 - RNA, 22 nt, Human
cugcuggugcugcccacacggu

SEQ ID NO: 54148 - RNA, 22 nt, Human
cugcugucuuuauuucacugcu

SEQ ID NO: 54149 - RNA, 22 nt, Human
cugcugugcagacagacucucu

SEQ ID NO: 54150 - RNA, 22 nt, Human
cugcuguugagguuccaggcca

SEQ ID NO: 54151 - RNA, 22 nt, Human
cugcuucacccugccugagaac

SEQ ID NO: 54152 - RNA, 22 nt, Human
cucaagacacccuggccucuac

SEQ ID NO: 54153 - RNA, 22 nt, Human
cucaagugacucagccugguug

SEQ ID NO: 54154 - RNA, 22 nt, Human
cugcuuguguugcucagaguca

SEQ ID NO: 54155 - RNA, 22 nt, Human
cugcuuuggaucucucucugcc

SEQ ID NO: 54156 - RNA, 22 nt, Human
cucacgguuugcaucaagagug

SEQ ID NO: 54157 - RNA, 22 nt, Human
cucagcgagggaaagaggccgc

SEQ ID NO: 54158 - RNA, 22 nt, Human
cuggcaguguccagcucgugau

SEQ ID NO: 54159 - RNA, 22 nt, Human
cucaugcugcaaauggcuguuu

SEQ ID NO: 54160 - RNA, 22 nt, Human
cuggcggugaucccgauggugu

SEQ ID NO: 54161 - RNA, 22 nt, Human
cuccaccucagugucaucuucu

SEQ ID NO: 54162 - RNA, 22 nt, Human
cuccagagagaaaggaggccgc

SEQ ID NO: 54163 - RNA, 22 nt, Human
cuccgccuguccugggcccacg

SEQ ID NO: 54164 - RNA, 21 nt, Human
cuggcucgccaugguucuuuu

SEQ ID NO: 54165 - RNA, 22 nt, Human
cugggaguugacgaggcuugua

SEQ ID NO: 54166 - RNA, 22 nt, Human
cugggcaugggaacuucaaggc

SEQ ID NO: 54167 - RNA, 22 nt, Human
cugggcucccucucccgccucg

SEQ ID NO: 54168 - RNA, 22 nt, Human
cugggcuuucaggcccuaaggc

SEQ ID NO: 54169 - RNA, 22 nt, Human
cugggguggugcaggccucaug

SEQ ID NO: 54170 - RNA, 22 nt, Human
cugggugggcacccagccuggg

SEQ ID NO: 54171 - RNA, 22 nt, Human
cuggguguggugggugcugccg

SEQ ID NO: 54172 - RNA, 22 nt, Human
cucuaccugcacaugccugacu

SEQ ID NO: 54173 - RNA, 22 nt, Human
cucuggagggaggcugagcugg

SEQ ID NO: 54174 - RNA, 22 nt, Human
cucuggcaacgauggugcuuau

SEQ ID NO: 54175 - RNA, 22 nt, Human
cuggugcuguagccugauugag

SEQ ID NO: 54176 - RNA, 22 nt, Human
cuguccugauggugccacuggu

SEQ ID NO: 54177 - RNA, 22 nt, Human
cugugccagucagggggcaagu

SEQ ID NO: 54178 - RNA, 22 nt, Human
cugugggcucucaugggaccug

SEQ ID NO: 54179 - RNA, 22 nt, Human
cugaaagacgaggggaagucgg

SEQ ID NO: 54180 - RNA, 22 nt, Human
cugaagaaagaaaauggccauc

SEQ ID NO: 54181 - RNA, 22 nt, Human
cugaacuaagcccaaagacacu

SEQ ID NO: 54182 - RNA, 20 nt, Human
cugaccagcagccugucucc

SEQ ID NO: 54183 - RNA, 19 nt, Human
cugagcagggaaaaacccu

SEQ ID NO: 54184 - RNA, 22 nt, Human
cugagcggugagggcauacagc

SEQ ID NO: 54185 - RNA, 22 nt, Human
cugagggagcugcuggccuugg

SEQ ID NO: 54186 - RNA, 22 nt, Human
cugaugcucuggauguagucaa

SEQ ID NO: 54187 - RNA, 23 nt, Human
cuucagaccucagaaggucuguu

SEQ ID NO: 54188 - RNA, 22 nt, Human
cuggagcucugggcaucucagg

SEQ ID NO: 54189 - RNA, 22 nt, Human
cuggagcuucaggguucucggg

SEQ ID NO: 54190 - RNA, 22 nt, Human
cuggauagaggaugguaggcac

SEQ ID NO: 54191 - RNA, 22 nt, Human
cuggcgauugcgagagucgccu

SEQ ID NO: 54192 - RNA, 22 nt, Human
cuuuugcaauagugacacugau

SEQ ID NO: 54193 - RNA, 22 nt, Human
cuggcggcccgaggcagaggag

SEQ ID NO: 54194 - RNA, 22 nt, Human
cuggcuguguguuugugcaucu

SEQ ID NO: 54195 - RNA, 19 nt, Human
cugggacaaugaaagcauc

SEQ ID NO: 54196 - RNA, 22 nt, Human
cugggaccugugugccugggcc

SEQ ID NO: 54197 - RNA, 22 nt, Human
cugggguaucugccacaacucu

SEQ ID NO: 54198 - RNA, 22 nt, Human
cuggggccccagcucggccccu

SEQ ID NO: 54199 - RNA, 22 nt, Human
cugggguaucuggugucuuggu

SEQ ID NO: 54200 - RNA, 22 nt, Human
cugggguuggccagggcccuag

SEQ ID NO: 54201 - RNA, 22 nt, Human
cugggugagcuggccagagggu

SEQ ID NO: 54202 - RNA, 22 nt, Human
cugguacuggaggaguucagag

SEQ ID NO: 54203 - RNA, 22 nt, Human
cuggucaauaaucauguaguac

SEQ ID NO: 54204 - RNA, 22 nt, Human
cuggugaagccuucggagaccc

SEQ ID NO: 54205 - RNA, 22 nt, Human
gaaaacccuguauguagcguuu

SEQ ID NO: 54206 - RNA, 22 nt, Human
cuggugggucacgugugggugg

SEQ ID NO: 54207 - RNA, 22 nt, Human
cugguuuuccaauguuuugacu

SEQ ID NO: 54208 - RNA, 22 nt, Human
gaaaauaguucaucacaaugau

SEQ ID NO: 54209 - RNA, 21 nt, Human
gaaaaucuaaugugacaaugc

SEQ ID NO: 54210 - RNA, 19 nt, Human
cuguccacacacucgcuuc

SEQ ID NO: 54211 - RNA, 22 nt, Human
cuguccccauugcugucccugg

SEQ ID NO: 54212 - RNA, 22 nt, Human
cuguccuguggccugcuccggu

SEQ ID NO: 54213 - RNA, 22 nt, Human
cugucucugauaagcucgaggg

SEQ ID NO: 54214 - RNA, 22 nt, Human
gaacaguuucccuguagaaaau

SEQ ID NO: 54215 - RNA, 22 nt, Human
cuguuguucacuuugcugguga

SEQ ID NO: 54216 - RNA, 22 nt, Human
gaagaugcugcuuguucacggg

SEQ ID NO: 54217 - RNA, 22 nt, Human
gaagcaccuggacggugccugg

SEQ ID NO: 54218 - RNA, 21 nt, Human
cuucgcuguuccagcucuugg

SEQ ID NO: 54219 - RNA, 22 nt, Human
gaaggugcugaaacagaaauuu

SEQ ID NO: 54220 - RNA, 22 nt, Human
gaaguggggaggagaagacuga

SEQ ID NO: 54221 - RNA, 22 nt, Human
cuugagcugaguuugcagcucu

SEQ ID NO: 54222 - RNA, 22 nt, Human
cuugcagccuggagcucagccu

SEQ ID NO: 54223 - RNA, 22 nt, Human
cuugccagggacucagucaggg

SEQ ID NO: 54224 - RNA, 22 nt, Human
cuugccaguguugcagaagcuc

SEQ ID NO: 54225 - RNA, 20 nt, Human
gacaagccacagcucccaga

SEQ ID NO: 54226 - RNA, 19 nt, Human
cuuguggcuaugcagauac

SEQ ID NO: 54227 - RNA, 22 nt, Human
gacacaacuauccaguauggga

SEQ ID NO: 54228 - RNA, 22 nt, Human
gacacccgccggcgccugccuc

SEQ ID NO: 54229 - RNA, 22 nt, Human
gacaggaccgagguggggcggg

SEQ ID NO: 54230 - RNA, 22 nt, Human
gacaguggagccacguugggag

SEQ ID NO: 54231 - RNA, 22 nt, Human
cuuugugcagcagaaaugugug

SEQ ID NO: 54232 - RNA, 22 nt, Human
gaccgggcucugcugacggucu

SEQ ID NO: 54233 - RNA, 22 nt, Human
gacuggaaucucugcuuguuaa

SEQ ID NO: 54234 - RNA, 22 nt, Human
cuuuuugccuugaagugaccuc

SEQ ID NO: 54235 - RNA, 22 nt, Human
gagaaaaauuucuuugcugcac

SEQ ID NO: 54236 - RNA, 22 nt, Human
gagaaaacauacuuaguguccu

SEQ ID NO: 54237 - RNA, 22 nt, Human
gaaaaauggguuguuugaagau

SEQ ID NO: 54238 - RNA, 22 nt, Human
gagacugcguggcucugacaca

SEQ ID NO: 54239 - RNA, 22 nt, Human
gaagauucugacccugacucag

SEQ ID NO: 54240 - RNA, 22 nt, Human
gaagcagguucuucaggaugaa

SEQ ID NO: 54241 - RNA, 19 nt, Human
gagccgcucccgcagccgg

SEQ ID NO: 54242 - RNA, 22 nt, Human
gagccuguuaggcaccuguguu

SEQ ID NO: 54243 - RNA, 22 nt, Human
gagcggcggugagaaguguggg

SEQ ID NO: 54244 - RNA, 22 nt, Human
gaagcggguucacuggauggcu

SEQ ID NO: 54245 - RNA, 22 nt, Human
gaagcuccaggaugccugcacu

SEQ ID NO: 54246 - RNA, 22 nt, Human
gagcgugaggcagcuuucuaag

SEQ ID NO: 54247 - RNA, 22 nt, Human
gagcuggacauacaggaaacca

SEQ ID NO: 54248 - RNA, 22 nt, Human
gaaggagaggauugugaggcug

SEQ ID NO: 54249 - RNA, 22 nt, Human
gaaggaagcugucuggaugugu

SEQ ID NO: 54250 - RNA, 22 nt, Human
gaaggcagucuggggagcagcc

SEQ ID NO: 54251 - RNA, 22 nt, Human
gaaggcugaauuauuuguuccu

SEQ ID NO: 54252 - RNA, 22 nt, Human
gaaggcuguggcuggucucagu

SEQ ID NO: 54253 - RNA, 22 nt, Human
gaggacuucaggccuggccagg

SEQ ID NO: 54254 - RNA, 22 nt, Human
gaggagcggugcaugugggggc

SEQ ID NO: 54255 - RNA, 22 nt, Human
gaggagcugggucagggagaca

SEQ ID NO: 54256 - RNA, 22 nt, Human
gaagggccaggggcaggcugga

SEQ ID NO: 54257 - RNA, 22 nt, Human
gaaggggccuggggcaaggcua

SEQ ID NO: 54258 - RNA, 22 nt, Human
gaaguaaugugauugcucaggg

SEQ ID NO: 54259 - RNA, 22 nt, Human
gaggagggagcuggaagcucuu

SEQ ID NO: 54260 - RNA, 22 nt, Human
gaggaggcuggagaggccagga

SEQ ID NO: 54261 - RNA, 22 nt, Human
gaggaugacaaagaaggcagac

SEQ ID NO: 54262 - RNA, 22 nt, Human
gaggcaggaagggaggguugug

SEQ ID NO: 54263 - RNA, 22 nt, Human
gaggcaggcggggcccaggugg

SEQ ID NO: 54264 - RNA, 22 nt, Human
gaggauuugagggucacuccac

SEQ ID NO: 54265 - RNA, 22 nt, Human
gaggccauguggcccgggcugc

SEQ ID NO: 54266 - RNA, 22 nt, Human
gaggccuucauuucuccgucug

SEQ ID NO: 54267 - RNA, 22 nt, Human
gaggcgcgcugcgagggcgcgg

SEQ ID NO: 54268 - RNA, 22 nt, Human
gaggcggugguggcgagaguca

SEQ ID NO: 54269 - RNA, 22 nt, Human
gaaugccugggguucuucgauc

SEQ ID NO: 54270 - RNA, 22 nt, Human
gagggcauugucuucuuaguuu

SEQ ID NO: 54271 - RNA, 22 nt, Human
gaggggcgaggacgcugaagua

SEQ ID NO: 54272 - RNA, 22 nt, Human
gaggggacugucuggcuccgag

SEQ ID NO: 54273 - RNA, 22 nt, Human
gaggggcucuugggcaugaagg

SEQ ID NO: 54274 - RNA, 22 nt, Human
gaggggcugggguugacuccaa

SEQ ID NO: 54275 - RNA, 22 nt, Human
gacaagaugacaucauggcuuc

SEQ ID NO: 54276 - RNA, 22 nt, Human
gagggggcggccccugugggca

SEQ ID NO: 54277 - RNA, 22 nt, Human
gagggugguggcggccggcacc

SEQ ID NO: 54278 - RNA, 22 nt, Human
gacaccuucuacugacuaugga

SEQ ID NO: 54279 - RNA, 22 nt, Human
gacacugccaagugccccgaga

SEQ ID NO: 54280 - RNA, 22 nt, Human
gaggucagcaagccaugcuugu

SEQ ID NO: 54281 - RNA, 22 nt, Human
gaggugaacccaggugcuucac

SEQ ID NO: 54282 - RNA, 22 nt, Human
gaggugauuccucccauguaau

SEQ ID NO: 54283 - RNA, 22 nt, Human
gacagaccucugcugacuggag

SEQ ID NO: 54284 - RNA, 22 nt, Human
gacagcaggaugugaggggaug

SEQ ID NO: 54285 - RNA, 22 nt, Human
gacagcguguuuugcaugaaca

SEQ ID NO: 54286 - RNA, 22 nt, Human
gacaggcagagaggaagagaga

SEQ ID NO: 54287 - RNA, 22 nt, Human
gacagggacacagccagugagg

SEQ ID NO: 54288 - RNA, 22 nt, Human
gaggugcaggggcccgggcugg

SEQ ID NO: 54289 - RNA, 22 nt, Human
gaggugggaggcgggccugcau

SEQ ID NO: 54290 - RNA, 22 nt, Human
gagguucacgcagggaggggac

SEQ ID NO: 54291 - RNA, 22 nt, Human
gacagugucccucuggggugga

SEQ ID NO: 54292 - RNA, 22 nt, Human
gacaucuguccauggcacugga

SEQ ID NO: 54293 - RNA, 22 nt, Human
gacauugaauugaauccagauu

SEQ ID NO: 54294 - RNA, 22 nt, Human
gaccaggagauuugagcuaggc

SEQ ID NO: 54295 - RNA, 22 nt, Human
gaccacugaaugcacuucuaau

SEQ ID NO: 54296 - RNA, 22 nt, Human
gaguaaggaaguguuggccaca

SEQ ID NO: 54297 - RNA, 22 nt, Human
gacccugaggauucccugcuga

SEQ ID NO: 54298 - RNA, 22 nt, Human
gaccugaccucauuagcaaguu

SEQ ID NO: 54299 - RNA, 22 nt, Human
gaccugcucagcccuguguguu

SEQ ID NO: 54300 - RNA, 22 nt, Human
gaccugguggccauugucccag

SEQ ID NO: 54301 - RNA, 22 nt, Human
gaccuuguucuggcauucucag

SEQ ID NO: 54302 - RNA, 22 nt, Human
gagucuacaugcaggcaauugu

SEQ ID NO: 54303 - RNA, 22 nt, Human
gaguccuggagagcccgagcgc

SEQ ID NO: 54304 - RNA, 22 nt, Human
gacgacgggccccguggccacc

SEQ ID NO: 54305 - RNA, 22 nt, Human
gacggagugcgcuugcuguuca

SEQ ID NO: 54306 - RNA, 22 nt, Human
gacggggcagccagcugguggc

SEQ ID NO: 54307 - RNA, 22 nt, Human
gacuggcucuaucaggauaaau

SEQ ID NO: 54308 - RNA, 22 nt, Human
gacugggacucaacccaccauu

SEQ ID NO: 54309 - RNA, 22 nt, Human
gacuggggcauuagaguagcuu

SEQ ID NO: 54310 - RNA, 22 nt, Human
gauaagugauucugauucacau

SEQ ID NO: 54311 - RNA, 22 nt, Human
gacuucaucagagcguacuguu

SEQ ID NO: 54312 - RNA, 22 nt, Human
gacuuguguagcuucagaauuu

SEQ ID NO: 54313 - RNA, 22 nt, Human
gagaaagauuguccuucagggg

SEQ ID NO: 54314 - RNA, 22 nt, Human
gauccucagacccuccucuggu

SEQ ID NO: 54315 - RNA, 21 nt, Human
gaucgcaaugugggaaucaug

SEQ ID NO: 54316 - RNA, 22 nt, Human
gaugaagaaacucaaccaagaa

SEQ ID NO: 54317 - RNA, 22 nt, Human
gcagggcucuggagucaggcug

SEQ ID NO: 54318 - RNA, 22 nt, Human
gcaggggguaaggggcagggcu

SEQ ID NO: 54319 - RNA, 22 nt, Human
gcaggguaggugacagguaguc

SEQ ID NO: 54320 - RNA, 22 nt, Human
gcagguccgagagggucgggua

SEQ ID NO: 54321 - RNA, 22 nt, Human
gcagguggaagcagcagacuca

SEQ ID NO: 54322 - RNA, 22 nt, Human
gaguacagaagauaaaggcaca

SEQ ID NO: 54323 - RNA, 22 nt, Human
gcagugccauguggaggaucuc

SEQ ID NO: 54324 - RNA, 22 nt, Human
gcauauuuuaaaguguaaccug

SEQ ID NO: 54325 - RNA, 22 nt, Human
gaguggccugccccagccaggc

SEQ ID NO: 54326 - RNA, 22 nt, Human
gagugaucuguaggcagcaugg

SEQ ID NO: 54327 - RNA, 22 nt, Human
gcaugaauggaacccccugagu

SEQ ID NO: 54328 - RNA, 22 nt, Human
gcaugcaggaagggcuugggga

SEQ ID NO: 54329 - RNA, 23 nt, Human
gcaugcccauauguguauauaua

SEQ ID NO: 54330 - RNA, 22 nt, Human
gccaaccagucgguccaggaag

SEQ ID NO: 54331 - RNA, 22 nt, Human
gccaaucaggaggcuguacauc

SEQ ID NO: 54332 - RNA, 22 nt, Human
gauccagauauuugggcuggua

SEQ ID NO: 54333 - RNA, 22 nt, Human
gaucuguccuggcaguuaacac

SEQ ID NO: 54334 - RNA, 18 nt, Human
gaugaagaggaagaggag

SEQ ID NO: 54335 - RNA, 22 nt, Human
gccagcuuagaucccccagccc

SEQ ID NO: 54336 - RNA, 22 nt, Human
gccaggcggcccaggagauggc

SEQ ID NO: 54337 - RNA, 22 nt, Human
gccaggugauuucaaaguccuu

SEQ ID NO: 54338 - RNA, 22 nt, Human
gaugcauccuuucugucuucuc

SEQ ID NO: 54339 - RNA, 22 nt, Human
gaugccggggucguagccgugg

SEQ ID NO: 54340 - RNA, 22 nt, Human
gccauaggggcuuacauaguua

SEQ ID NO: 54341 - RNA, 22 nt, Human
gccaucuucggcagccgccugg

SEQ ID NO: 54342 - RNA, 22 nt, Human
gcccagcucucuggccugucuu

SEQ ID NO: 54343 - RNA, 22 nt, Human
gccccaaccccuccuuggucua

SEQ ID NO: 54344 - RNA, 22 nt, Human
gccccaggggaggugcccugca

SEQ ID NO: 54345 - RNA, 22 nt, Human
gaugguggaggaaucgcugaag

SEQ ID NO: 54346 - RNA, 22 nt, Human
gcccccauuccugcggccuuca

SEQ ID NO: 54347 - RNA, 22 nt, Human
gcccgaccgcgccggcccgcac

SEQ ID NO: 54348 - RNA, 22 nt, Human
gcccugccauugaucggcccag

SEQ ID NO: 54349 - RNA, 22 nt, Human
gcccuggcauuucuauucaugu

SEQ ID NO: 54350 - RNA, 22 nt, Human
gcccuggucguggagggcaaca

SEQ ID NO: 54351 - RNA, 22 nt, Human
gcccugucagcucucauggaca

SEQ ID NO: 54352 - RNA, 22 nt, Human
gcccuguguguuugcacugauu

SEQ ID NO: 54353 - RNA, 22 nt, Human
gccucuuugcucuuugguuguu

SEQ ID NO: 54354 - RNA, 22 nt, Human
gccugaaaugaaccagaggacu

SEQ ID NO: 54355 - RNA, 22 nt, Human
gccugcacucaaacacucucuu

SEQ ID NO: 54356 - RNA, 22 nt, Human
gccugcaggaaggugugccugu

SEQ ID NO: 54357 - RNA, 22 nt, Human
gccugccucugacuggggcuga

SEQ ID NO: 54358 - RNA, 22 nt, Human
gcacaggcugcacgaccccagc

SEQ ID NO: 54359 - RNA, 22 nt, Human
gcacauaugcuguaagcacaug

SEQ ID NO: 54360 - RNA, 22 nt, Human
gcaccacccaaaggcggggcuc

SEQ ID NO: 54361 - RNA, 22 nt, Human
gcaccgagaaggaagcaugccu

SEQ ID NO: 54362 - RNA, 22 nt, Human
gcagagcacccugcagugguau

SEQ ID NO: 54363 - RNA, 22 nt, Human
gcagaggcugccgugggcagga

SEQ ID NO: 54364 - RNA, 22 nt, Human
gcagaugagagugugaucuggg

SEQ ID NO: 54365 - RNA, 22 nt, Human
gcagauccaaauauaguucuug

SEQ ID NO: 54366 - RNA, 22 nt, Human
gcgcagugagguuaagaaugca

SEQ ID NO: 54367 - RNA, 22 nt, Human
gcgccgacccucccugccggac

SEQ ID NO: 54368 - RNA, 22 nt, Human
gcgccuugccuguccucuaacc

SEQ ID NO: 54369 - RNA, 22 nt, Human
gcgcgccugccucccgcggugc

SEQ ID NO: 54370 - RNA, 21 nt, Human
gcgcgcucgugcucgacgcgc

SEQ ID NO: 54371 - RNA, 22 nt, Human
gcgcgcucugcgaggacacgcu

SEQ ID NO: 54372 - RNA, 22 nt, Human
gcgcgggugagucacgggcgga

SEQ ID NO: 54373 - RNA, 22 nt, Human
gcgcucuccugcagacagccuc

SEQ ID NO: 54374 - RNA, 20 nt, Human
gcgcuucccuacgcucugcu

SEQ ID NO: 54375 - RNA, 20 nt, Human
gcagcugacccuagugcuug

SEQ ID NO: 54376 - RNA, 22 nt, Human
gcgggcgcuguggccccggccu

SEQ ID NO: 54377 - RNA, 22 nt, Human
gcaggcagauccagaagcacua

SEQ ID NO: 54378 - RNA, 22 nt, Human
gcagggcucagccgcucccacc

SEQ ID NO: 54379 - RNA, 22 nt, Human
gcgguuggacguucgccucggg

SEQ ID NO: 54380 - RNA, 22 nt, Human
gcaggucacagcugauuggcca

SEQ ID NO: 54381 - RNA, 22 nt, Human
gcaguagauccagcagccugca

SEQ ID NO: 54382 - RNA, 22 nt, Human
gcguggccugcugaaggacuuc

SEQ ID NO: 54383 - RNA, 23 nt, Human
gcagugacugggauggaaguaga

SEQ ID NO: 54384 - RNA, 22 nt, Human
gcagugcugcgacagucgggug

SEQ ID NO: 54385 - RNA, 23 nt, Human
gcaguggagcgagaacuuccugu

SEQ ID NO: 54386 - RNA, 22 nt, Human
gcaguccuuaggagaggaagua

SEQ ID NO: 54387 - RNA, 22 nt, Human
gcuagcugugcuuggaaguuug

SEQ ID NO: 54388 - RNA, 22 nt, Human
gcauagacaccuuagagcaaua

SEQ ID NO: 54389 - RNA, 22 nt, Human
gcauccugacuauggugguggu

SEQ ID NO: 54390 - RNA, 22 nt, Human
gcaucuccugagucagauuuug

SEQ ID NO: 54391 - RNA, 22 nt, Human
gcuccagcuccauaaacauaag

SEQ ID NO: 54392 - RNA, 22 nt, Human
gcucccagcuuuuguccacggc

SEQ ID NO: 54393 - RNA, 22 nt, Human
gcaugcgugcgugcgugcaugu

SEQ ID NO: 54394 - RNA, 22 nt, Human
gcaugcuguuuggaaacgauaa

SEQ ID NO: 54395 - RNA, 22 nt, Human
gcucuagcuggcgcugaccugg

SEQ ID NO: 54396 - RNA, 20 nt, Human
gcucuucuccgggucugccu

SEQ ID NO: 54397 - RNA, 22 nt, Human
gcauuccagaguugcuggaaaa

SEQ ID NO: 54398 - RNA, 15 nt, Human
gccccaggaaucaaa

SEQ ID NO: 54399 - RNA, 22 nt, Human
gcccccgccuugcugggccagg

SEQ ID NO: 54400 - RNA, 22 nt, Human
gccccgcgcgcguagcgccgcu

SEQ ID NO: 54401 - RNA, 22 nt, Human
gcccccagcuggcuugaggauu

SEQ ID NO: 54402 - RNA, 22 nt, Human
gccccucuccuugugcaccugc

SEQ ID NO: 54403 - RNA, 22 nt, Human
gcugguggcagagcuccgcggc

SEQ ID NO: 54404 - RNA, 22 nt, Human
gcuggugugagauucucgaggg

SEQ ID NO: 54405 - RNA, 22 nt, Human
gcuguacugucugccaagccag

SEQ ID NO: 54406 - RNA, 22 nt, Human
gcugucauggacaugucuguuu

SEQ ID NO: 54407 - RNA, 22 nt, Human
gcuguaacuuuuucauuuucaa

SEQ ID NO: 54408 - RNA, 22 nt, Human
gcugucaggaacaugccuuggu

SEQ ID NO: 54409 - RNA, 22 nt, Human
gcugucccccaaagaugcuccu

SEQ ID NO: 54410 - RNA, 22 nt, Human
gcccucugccacaggacgccag

SEQ ID NO: 54411 - RNA, 22 nt, Human
gcccuguuauagucugaggccu

SEQ ID NO: 54412 - RNA, 20 nt, Human
gcccuucccccuccgcgagc

SEQ ID NO: 54413 - RNA, 20 nt, Human
gcugugccaugacccucgag

SEQ ID NO: 54414 - RNA, 22 nt, Human
gcuguggaaaaugggucuccaa

SEQ ID NO: 54415 - RNA, 22 nt, Human
gcuguggcuccaauggugagcc

SEQ ID NO: 54416 - RNA, 22 nt, Human
gcuguggguuccuccccugucc

SEQ ID NO: 54417 - RNA, 22 nt, Human
gcuguguucauccugcccaggu

SEQ ID NO: 54418 - RNA, 22 nt, Human
gcuguugcaaucaaggccaugg

SEQ ID NO: 54419 - RNA, 22 nt, Human
gcuucugugagugcagaugcug

SEQ ID NO: 54420 - RNA, 22 nt, Human
gccgcagauucugagacgugua

SEQ ID NO: 54421 - RNA, 22 nt, Human
gccgccgccgccuuuguugcgg

SEQ ID NO: 54422 - RNA, 22 nt, Human
gccgcgggucugggucuggcuc

SEQ ID NO: 54423 - RNA, 20 nt, Human
gcuugcggacagguggcuca

SEQ ID NO: 54424 - RNA, 22 nt, Human
gcuugcugaacaggaaccuggc

SEQ ID NO: 54425 - RNA, 22 nt, Human
gcuugggcugaaggccuggguc

SEQ ID NO: 54426 - RNA, 22 nt, Human
gcuuucauuauguuguguuuuu

SEQ ID NO: 54427 - RNA, 22 nt, Human
gcuuuugcaaagcuggagaauu

SEQ ID NO: 54428 - RNA, 22 nt, Human
gccggagagccaacaccacgga

SEQ ID NO: 54429 - RNA, 22 nt, Human
gccggcccugcgcggggcggaa

SEQ ID NO: 54430 - RNA, 22 nt, Human
gccggcugggggcggagggcag

SEQ ID NO: 54431 - RNA, 22 nt, Human
gccgggagugcagcgggcgcgc

SEQ ID NO: 54432 - RNA, 22 nt, Human
gccggguguuccugggaagaug

SEQ ID NO: 54433 - RNA, 21 nt, Human
gccgugcgccuccaggcgcgc

SEQ ID NO: 54434 - RNA, 22 nt, Human
gccuccagaggggacaaaaauu

SEQ ID NO: 54435 - RNA, 18 nt, Human
gccucuguugacagaguu

SEQ ID NO: 54436 - RNA, 22 nt, Human
ggaaaaugcugaagcaucugaa

SEQ ID NO: 54437 - RNA, 22 nt, Human
gccugagucaagauguggcacc

SEQ ID NO: 54438 - RNA, 22 nt, Human
gccugcaaagacuuccuucucu

SEQ ID NO: 54439 - RNA, 22 nt, Human
gccugcagccagggaguucucu

SEQ ID NO: 54440 - RNA, 18 nt, Human
gccugccagccgagggac

SEQ ID NO: 54441 - RNA, 22 nt, Human
gccugcugggcucuuccugcug

SEQ ID NO: 54442 - RNA, 22 nt, Human
ggaagaggaagaugaggcagca

SEQ ID NO: 54443 - RNA, 20 nt, Human
gccugggagaagaucaggga

SEQ ID NO: 54444 - RNA, 20 nt, Human
ggaacccuagacuugcgcag

SEQ ID NO: 54445 - RNA, 22 nt, Human
gccugggccgggcgcggccccc

SEQ ID NO: 54446 - RNA, 22 nt, Human
gccugggcuuccgggacccggg

SEQ ID NO: 54447 - RNA, 22 nt, Human
gccugggugcugugggguggag

SEQ ID NO: 54448 - RNA, 22 nt, Human
gccuucauuggaaucuagcuuc

SEQ ID NO: 54449 - RNA, 22 nt, Human
ggacauuguuguuggauccuug

SEQ ID NO: 54450 - RNA, 22 nt, Human
ggaccagagcuaaugcgcgccc

SEQ ID NO: 54451 - RNA, 22 nt, Human
ggagaaacuaguuagauccaau

SEQ ID NO: 54452 - RNA, 22 nt, Human
ggagaccaauuaaugaaggaau

SEQ ID NO: 54453 - RNA, 22 nt, Human
ggagaccagaaggaagcuucga

SEQ ID NO: 54454 - RNA, 22 nt, Human
gcgcggcgcggguccucggccu

SEQ ID NO: 54455 - RNA, 22 nt, Human
gcggacaauggaagaugucauu

SEQ ID NO: 54456 - RNA, 22 nt, Human
gcggagaggcagagacuccgcg

SEQ ID NO: 54457 - RNA, 22 nt, Human
gcgcugagcuuuucuuauugaa

SEQ ID NO: 54458 - RNA, 22 nt, Human
ggaggaagagaccagggggcuu

SEQ ID NO: 54459 - RNA, 22 nt, Human
ggaggagggaguucaggaguau

SEQ ID NO: 54460 - RNA, 22 nt, Human
ggaggcccagaaggaagcccag

SEQ ID NO: 54461 - RNA, 22 nt, Human
ggaggccgugcugugcugccag

SEQ ID NO: 54462 - RNA, 22 nt, Human
ggaggcggaaguccaagcaggu

SEQ ID NO: 54463 - RNA, 23 nt, Human
ggaggcccagaggucggccccac

SEQ ID NO: 54464 - RNA, 22 nt, Human
ggagguggagcuggaaguucca

SEQ ID NO: 54465 - RNA, 22 nt, Human
ggagugaaugguggccguguuu

SEQ ID NO: 54466 - RNA, 19 nt, Human
ggaguugccaggagaagga

SEQ ID NO: 54467 - RNA, 22 nt, Human
ggcacccugcauuggcuugagu

SEQ ID NO: 54468 - RNA, 22 nt, Human
ggcaccuuucaucccaucuaga

SEQ ID NO: 54469 - RNA, 22 nt, Human
gcgguuguucugugugcaugga

SEQ ID NO: 54470 - RNA, 22 nt, Human
gcguaccugaaauuacggcacu

SEQ ID NO: 54471 - RNA, 22 nt, Human
gcgugcauggccguguguaugc

SEQ ID NO: 54472 - RNA, 22 nt, Human
ggcagcgcuuggcugcucgaca

SEQ ID NO: 54473 - RNA, 22 nt, Human
gcucaaggucacacagggguga

SEQ ID NO: 54474 - RNA, 22 nt, Human
gcucagagaugucugcugccuu

SEQ ID NO: 54475 - RNA, 22 nt, Human
gcucggcuggcucaucucaugu

SEQ ID NO: 54476 - RNA, 22 nt, Human
gcucucucuucugcaggccuua

SEQ ID NO: 54477 - RNA, 22 nt, Human
gcugagcaaugcacugccgcau

SEQ ID NO: 54478 - RNA, 23 nt, Human
gcugagcaccagccauaucuuuu

SEQ ID NO: 54479 - RNA, 22 nt, Human
gcugagcagcgaaggcacaugc

SEQ ID NO: 54480 - RNA, 22 nt, Human
ggcauuccucucuguucaugga

SEQ ID NO: 54481 - RNA, 22 nt, Human
ggcauugauggggucuugggga

SEQ ID NO: 54482 - RNA, 22 nt, Human
ggccaagagaggauggagggau

SEQ ID NO: 54483 - RNA, 22 nt, Human
ggccacauuccagagggcugaa

SEQ ID NO: 54484 - RNA, 22 nt, Human
ggccagcgugggggaguagcgg

SEQ ID NO: 54485 - RNA, 19 nt, Human
ggcuuugcccuucgcuccg

SEQ ID NO: 54486 - RNA, 22 nt, Human
ggcuuugggaggaugaggcggu

SEQ ID NO: 54487 - RNA, 22 nt, Human
ggcuuuuguuauaaucaggccu

SEQ ID NO: 54488 - RNA, 22 nt, Human
gcuguuggaggaguucagugcu

SEQ ID NO: 54489 - RNA, 22 nt, Human
gcuuacuguuccuguuggugcu

SEQ ID NO: 54490 - RNA, 22 nt, Human
gcuucccagaccaggcucccuc

SEQ ID NO: 54491 - RNA, 22 nt, Human
gggaagagggagcuggaaugau

SEQ ID NO: 54492 - RNA, 22 nt, Human
gggacagcuggggguaaagcau

SEQ ID NO: 54493 - RNA, 22 nt, Human
gggacugcgagauucucaaggg

SEQ ID NO: 54494 - RNA, 22 nt, Human
gggacugguuguguguggugug

SEQ ID NO: 54495 - RNA, 22 nt, Human
gggagcugagcuggaagagaau

SEQ ID NO: 54496 - RNA, 22 nt, Human
gggaugaaugccuggcuccccc

SEQ ID NO: 54497 - RNA, 22 nt, Human
gggcagagggcgagcugggaga

SEQ ID NO: 54498 - RNA, 22 nt, Human
gggcaggacccguuagaguggc

SEQ ID NO: 54499 - RNA, 22 nt, Human
ggaagaagagggagcuguggga

SEQ ID NO: 54500 - RNA, 20 nt, Human
gggccagguggaccaggggc

SEQ ID NO: 54501 - RNA, 22 nt, Human
gggccccgggcgcggcugcggg

SEQ ID NO: 54502 - RNA, 22 nt, Human
gggcccggguaggggaagagag

SEQ ID NO: 54503 - RNA, 22 nt, Human
gggccggcuggggcggggcggg

SEQ ID NO: 54504 - RNA, 19 nt, Human
gggccucacccacaccucc

SEQ ID NO: 54505 - RNA, 22 nt, Human
ggaagcugucugcccggcgcuc

SEQ ID NO: 54506 - RNA, 22 nt, Human
gggccucccggagcugcuccca

SEQ ID NO: 54507 - RNA, 22 nt, Human
gggcugagagcuggaaucugag

SEQ ID NO: 54508 - RNA, 22 nt, Human
ggacccagggcuuauucauguu

SEQ ID NO: 54509 - RNA, 22 nt, Human
ggaccucagccaucccucggag

SEQ ID NO: 54510 - RNA, 22 nt, Human
ggacuggugaagccuucggaga

SEQ ID NO: 54511 - RNA, 22 nt, Human
ggagcaagagugagcaagcaga

SEQ ID NO: 54512 - RNA, 22 nt, Human
gggggacaggaugaauaucugu

SEQ ID NO: 54513 - RNA, 22 nt, Human
gggggacagugugccuggugug

SEQ ID NO: 54514 - RNA, 22 nt, Human
gggggagcuacaggucccuugg

SEQ ID NO: 54515 - RNA, 22 nt, Human
gggggcgccgccgcucaucuca

SEQ ID NO: 54516 - RNA, 22 nt, Human
gggggcgcguggagggccgugg

SEQ ID NO: 54517 - RNA, 22 nt, Human
ggagcaucuaccauuucuagau

SEQ ID NO: 54518 - RNA, 22 nt, Human
ggagcauggcuucuuggggcug

SEQ ID NO: 54519 - RNA, 22 nt, Human
ggaggccagagaagagccaggc

SEQ ID NO: 54520 - RNA, 22 nt, Human
ggaggccccccaugcagcucca

SEQ ID NO: 54521 - RNA, 22 nt, Human
gggugcucagugccaaggagug

SEQ ID NO: 54522 - RNA, 22 nt, Human
ggaggucagcuggaggggaggc

SEQ ID NO: 54523 - RNA, 22 nt, Human
ggagucugugucuugaagcagu

SEQ ID NO: 54524 - RNA, 22 nt, Human
gggugggguaggugacucucgc

SEQ ID NO: 54525 - RNA, 22 nt, Human
ggguucauuugccggguaguuu

SEQ ID NO: 54526 - RNA, 20 nt, Human
ggguugagcguggccccucu

SEQ ID NO: 54527 - RNA, 22 nt, Human
ggaucaccagguuuguuguugg

SEQ ID NO: 54528 - RNA, 22 nt, Human
ggaucccaucgagcuggcuguc

SEQ ID NO: 54529 - RNA, 22 nt, Human
ggaugcugcuccacaucccaca

SEQ ID NO: 54530 - RNA, 22 nt, Human
ggcaaggaagaaagcagaaguu

SEQ ID NO: 54531 - RNA, 22 nt, Human
ggucauacaaggcacuggugau

SEQ ID NO: 54532 - RNA, 22 nt, Human
ggcacagcgacuaccaucgaaa

SEQ ID NO: 54533 - RNA, 19 nt, Human
ggcacccagagucccccug

SEQ ID NO: 54534 - RNA, 22 nt, Human
ggugaggagaaacucugccccu

SEQ ID NO: 54535 - RNA, 18 nt, Human
ggugagggagcuggaagc

SEQ ID NO: 54536 - RNA, 22 nt, Human
ggcagcagaaccaacuguggcu

SEQ ID NO: 54537 - RNA, 22 nt, Human
gguggcagaggaggcgggagag

SEQ ID NO: 54538 - RNA, 22 nt, Human
gguggccuaacaaugguggcaa

SEQ ID NO: 54539 - RNA, 20 nt, Human
ggcaucugacaacuaguugc

SEQ ID NO: 54540 - RNA, 22 nt, Human
ggcaugcaaaugugggugaccu

SEQ ID NO: 54541 - RNA, 22 nt, Human
ggcauggugggggaggacuugg

SEQ ID NO: 54542 - RNA, 21 nt, Human
ggcauguagccagcaaaggua

SEQ ID NO: 54543 - RNA, 20 nt, Human
ggcauuuuuuaguugagcuu

SEQ ID NO: 54544 - RNA, 22 nt, Human
ggccaccuaagguugugcauca

SEQ ID NO: 54545 - RNA, 22 nt, Human
ggccacgggguuugcugaaacu

SEQ ID NO: 54546 - RNA, 21 nt, Human
ggccagauucucccauagcug

SEQ ID NO: 54547 - RNA, 22 nt, Human
gguugggauuauccaaggcaga

SEQ ID NO: 54548 - RNA, 22 nt, Human
ggccaguauacaaacuuccggu

SEQ ID NO: 54549 - RNA, 22 nt, Human
ggccagucaaggggauccugaa

SEQ ID NO: 54550 - RNA, 22 nt, Human
ggccccagggauuaggccaacc

SEQ ID NO: 54551 - RNA, 22 nt, Human
ggcgaggcgggccgcggggucu

SEQ ID NO: 54552 - RNA, 22 nt, Human
ggcgaugaggucuuagaaucua

SEQ ID NO: 54553 - RNA, 22 nt, Human
ggcgauuggccgggaggaggca

SEQ ID NO: 54554 - RNA, 22 nt, Human
ggcgccauuuuugccuucggag

SEQ ID NO: 54555 - RNA, 22 nt, Human
ggcgccugguauucuuccucuc

SEQ ID NO: 54556 - RNA, 22 nt, Human
ggcggagggcuguguccccggc

SEQ ID NO: 54557 - RNA, 22 nt, Human
gucaaugcuuaguuugccugaa

SEQ ID NO: 54558 - RNA, 22 nt, Human
gucaggaugagggaugaggagu

SEQ ID NO: 54559 - RNA, 22 nt, Human
gucaggugcaccuccaccaaca

SEQ ID NO: 54560 - RNA, 22 nt, Human
ggcggcccaggugcuccaggcg

SEQ ID NO: 54561 - RNA, 22 nt, Human
ggcggcugcuccuugcccucgg

SEQ ID NO: 54562 - RNA, 22 nt, Human
ggcgggggagccaggaacccag

SEQ ID NO: 54563 - RNA, 22 nt, Human
ggcggugcgaggaugcagggcu

SEQ ID NO: 54564 - RNA, 22 nt, Human
ggcguccuccucgucugaggcg

SEQ ID NO: 54565 - RNA, 22 nt, Human
ggcgucuugcgggcgguagcgc

SEQ ID NO: 54566 - RNA, 22 nt, Human
ggcuaaggacgggcaaguccca

SEQ ID NO: 54567 - RNA, 22 nt, Human
ggcucacuguaccugccgccgc

SEQ ID NO: 54568 - RNA, 22 nt, Human
ggcuccaggguaccccuggaug

SEQ ID NO: 54569 - RNA, 23 nt, Human
gucauuacuguuaccuuauucuu

SEQ ID NO: 54570 - RNA, 22 nt, Human
guccaucuugcaaugagaccua

SEQ ID NO: 54571 - RNA, 22 nt, Human
guccccuauaugaggaagccau

SEQ ID NO: 54572 - RNA, 22 nt, Human
guccccugcguguucauccugg

SEQ ID NO: 54573 - RNA, 22 nt, Human
ggcucguaaaggccucacaggu

SEQ ID NO: 54574 - RNA, 22 nt, Human
ggcugaugacgccugagucuga

SEQ ID NO: 54575 - RNA, 22 nt, Human
ggcugcagugcaacucuuucua

SEQ ID NO: 54576 - RNA, 22 nt, Human
ggcugcagggaacaggaugggu

SEQ ID NO: 54577 - RNA, 22 nt, Human
gucccuggucuaccguggcuuc

SEQ ID NO: 54578 - RNA, 22 nt, Human
guccucgugucuuuuucucuaa

SEQ ID NO: 54579 - RNA, 22 nt, Human
guccuguccuguccuggagaca

SEQ ID NO: 54580 - RNA, 22 nt, Human
guccuucgcggcugaggccauu

SEQ ID NO: 54581 - RNA, 22 nt, Human
gucgguacuaguacugguguug

SEQ ID NO: 54582 - RNA, 22 nt, Human
gucgucgcucccaccuuccgcu

SEQ ID NO: 54583 - RNA, 17 nt, Human
ggcugccaggcaacaua

SEQ ID NO: 54584 - RNA, 22 nt, Human
ggcugcuugauagauaugagua

SEQ ID NO: 54585 - RNA, 22 nt, Human
ggcuggacuuucugcugggcuc

SEQ ID NO: 54586 - RNA, 22 nt, Human
gucuccugcccacccugguccc

SEQ ID NO: 54587 - RNA, 22 nt, Human
gucugcacgugccagggagggg

SEQ ID NO: 54588 - RNA, 22 nt, Human
gucugcccuuggccugggacuu

SEQ ID NO: 54589 - RNA, 22 nt, Human
ggcuggagcaggcugcacagug

SEQ ID NO: 54590 - RNA, 22 nt, Human
ggcugggaggcggaggcugaga

SEQ ID NO: 54591 - RNA, 22 nt, Human
ggcuggggccuguugaagaugc

SEQ ID NO: 54592 - RNA, 18 nt, Human
ggcugggcugugccccuu

SEQ ID NO: 54593 - RNA, 22 nt, Human
ggcugugguggacgcgggaaac

SEQ ID NO: 54594 - RNA, 22 nt, Human
ggcuuacgcgcuaacagugaau

SEQ ID NO: 54595 - RNA, 22 nt, Human
ggcugugggguccuguggugug

SEQ ID NO: 54596 - RNA, 22 nt, Human
ggcuuguccuucugguugucuu

SEQ ID NO: 54597 - RNA, 22 nt, Human
gugaagcacaugggcguugggu

SEQ ID NO: 54598 - RNA, 21 nt, Human
gugaccuguuaugcaaaggca

SEQ ID NO: 54599 - RNA, 22 nt, Human
gggaacuguaguuuacgcugcc

SEQ ID NO: 54600 - RNA, 17 nt, Human
gugagcugagucaggac

SEQ ID NO: 54601 - RNA, 22 nt, Human
gugaugugugaaggucugcagg

SEQ ID NO: 54602 - RNA, 22 nt, Human
gggacaggacuccuggggccug

SEQ ID NO: 54603 - RNA, 22 nt, Human
gggacgggcuagcugccguggc

SEQ ID NO: 54604 - RNA, 22 nt, Human
gugcagcugggcgcugaccuuc

SEQ ID NO: 54605 - RNA, 22 nt, Human
gggagcccuggacgggcgguau

SEQ ID NO: 54606 - RNA, 22 nt, Human
gggagccagcagggcauggagc

SEQ ID NO: 54607 - RNA, 22 nt, Human
gggagccucccacugggggaag

SEQ ID NO: 54608 - RNA, 22 nt, Human
gggagcuggagcuggaagacuc

SEQ ID NO: 54609 - RNA, 22 nt, Human
gugcccaguugaggccaggacu

SEQ ID NO: 54610 - RNA, 22 nt, Human
gugccgcuggagcuggaauuga

SEQ ID NO: 54611 - RNA, 22 nt, Human
gugccgaugaggccuggcauuc

SEQ ID NO: 54612 - RNA, 22 nt, Human
gugccgggcugcggcaaggugu

SEQ ID NO: 54613 - RNA, 22 nt, Human
gggagggggauucuggcgagaa

SEQ ID NO: 54614 - RNA, 22 nt, Human
gggagggucugagagcugcacc

SEQ ID NO: 54615 - RNA, 20 nt, Human
gggaucgaguaccuccgggu

SEQ ID NO: 54616 - RNA, 22 nt, Human
gugccuggaaucuuuucuucac

SEQ ID NO: 54617 - RNA, 20 nt, Human
gugcggcucuaccacucggu

SEQ ID NO: 54618 - RNA, 22 nt, Human
gugcucgagcugugcgcgcugc

SEQ ID NO: 54619 - RNA, 22 nt, Human
gggcaagaagcuggaagcauuc

SEQ ID NO: 54620 - RNA, 22 nt, Human
gggcaagagaggaagagauggc

SEQ ID NO: 54621 - RNA, 22 nt, Human
gggcaagaggguuugacaugag

SEQ ID NO: 54622 - RNA, 22 nt, Human
gggcacggaaggcgccaggggu

SEQ ID NO: 54623 - RNA, 22 nt, Human
gugcugcaaggauggagaggca

SEQ ID NO: 54624 - RNA, 22 nt, Human
guuggggccuggagucucuugg

SEQ ID NO: 54625 - RNA, 22 nt, Human
guuggugagaguuagggauuua

SEQ ID NO: 54626 - RNA, 22 nt, Human
gguccgcgcgcagaggcccugg

SEQ ID NO: 54627 - RNA, 19 nt, Human
gguccguuacaggcuuucc

SEQ ID NO: 54628 - RNA, 22 nt, Human
ggucgagcagcacccguucggc

SEQ ID NO: 54629 - RNA, 22 nt, Human
ggucuagcucggugcuggcgac

SEQ ID NO: 54630 - RNA, 22 nt, Human
ggucugagcaaguuaccauggg

SEQ ID NO: 54631 - RNA, 22 nt, Human
ggucugcgauggcaagggucuu

SEQ ID NO: 54632 - RNA, 19 nt, Human
ggucugcggggugaccgug

SEQ ID NO: 54633 - RNA, 22 nt, Human
ggucuuccuugggggacuugaa

SEQ ID NO: 54634 - RNA, 22 nt, Human
ggugaggggauccuguuaccau

SEQ ID NO: 54635 - RNA, 22 nt, Human
guuuccaggcuuugguaugguu

SEQ ID NO: 54636 - RNA, 22 nt, Human
guuucuguguugauugugcccu

SEQ ID NO: 54637 - RNA, 19 nt, Human
ggugaucugucccuugcuc

SEQ ID NO: 54638 - RNA, 22 nt, Human
ggugccugggcacggaaagcau

SEQ ID NO: 54639 - RNA, 22 nt, Human
ggugcguggcccauccuccacc

SEQ ID NO: 54640 - RNA, 22 nt, Human
ggugucagccacuuugucggag

SEQ ID NO: 54641 - RNA, 22 nt, Human
gguguggcaguggaccugugaa

SEQ ID NO: 54642 - RNA, 22 nt, Human
ggugugggcagaugcccuacuu

SEQ ID NO: 54643 - RNA, 22 nt, Human
gguuucuuuccucucugugccu

SEQ ID NO: 54644 - RNA, 22 nt, Human
gguuugccagugcuggaaugca

SEQ ID NO: 54645 - RNA, 21 nt, Human
uaagaacauuaucuucuuccu

SEQ ID NO: 54646 - RNA, 22 nt, Human
guccagaguagucgaguauucu

SEQ ID NO: 54647 - RNA, 22 nt, Human
guccaggucauuuaaaaagucc

SEQ ID NO: 54648 - RNA, 22 nt, Human
guccccugcuguggaucugugg

SEQ ID NO: 54649 - RNA, 22 nt, Human
guccucugggagccuugagccu

SEQ ID NO: 54650 - RNA, 22 nt, Human
guccuggagcagcuggaagaug

SEQ ID NO: 54651 - RNA, 22 nt, Human
guccuggugccaccugcgggau

SEQ ID NO: 54652 - RNA, 22 nt, Human
guccuguccugcugagcuccug

SEQ ID NO: 54653 - RNA, 22 nt, Human
gucgagaacauucauuaugcaa

SEQ ID NO: 54654 - RNA, 22 nt, Human
gucgccuaauuaggguauccua

SEQ ID NO: 54655 - RNA, 22 nt, Human
gucggagcggcugcacaggggg

SEQ ID NO: 54656 - RNA, 22 nt, Human
gucuggagccacugcugcugcu

SEQ ID NO: 54657 - RNA, 22 nt, Human
uacauagaauauauaaaugucg

SEQ ID NO: 54658 - RNA, 21 nt, Human
uacugugccagggcagcucug

SEQ ID NO: 54659 - RNA, 23 nt, Human
gugaacaaugcuccaggagauac

SEQ ID NO: 54660 - RNA, 22 nt, Human
gugaaggcaugugugcugugcu

SEQ ID NO: 54661 - RNA, 20 nt, Human
gugaaguuuucugaagacag

SEQ ID NO: 54662 - RNA, 22 nt, Human
gugaccagacagagucuagccc

SEQ ID NO: 54663 - RNA, 22 nt, Human
uagccuguuuuuaugagaauuu

SEQ ID NO: 54664 - RNA, 23 nt, Human
uagcggccaugacgggggucaca

SEQ ID NO: 54665 - RNA, 19 nt, Human
uagcuguucuugaguguga

SEQ ID NO: 54666 - RNA, 22 nt, Human
gugcucaucuucuguaacuguu

SEQ ID NO: 54667 - RNA, 22 nt, Human
gugcugcaugagcaucacguag

SEQ ID NO: 54668 - RNA, 22 nt, Human
gugcuggcaaagagaacaucuu

SEQ ID NO: 54669 - RNA, 22 nt, Human
gugcuguuagcgguuuauaaca

SEQ ID NO: 54670 - RNA, 22 nt, Human
gugcugggaggcccaggaugga

SEQ ID NO: 54671 - RNA, 22 nt, Human
gugcugucguggaacugggcug

SEQ ID NO: 54672 - RNA, 22 nt, Human
gugcuugcgcauaacuggggcc

SEQ ID NO: 54673 - RNA, 22 nt, Human
guggaagggaaaccgcacuggc

SEQ ID NO: 54674 - RNA, 22 nt, Human
guggauggagcuggaagccauu

SEQ ID NO: 54675 - RNA, 22 nt, Human
guggcaaguuuucugacaagga

SEQ ID NO: 54676 - RNA, 22 nt, Human
uaggcaaguggaccagagguuu

SEQ ID NO: 54677 - RNA, 22 nt, Human
uaggccugcugaagagcaagcu

SEQ ID NO: 54678 - RNA, 22 nt, Human
uaggggcccgugggauggacag

SEQ ID NO: 54679 - RNA, 22 nt, Human
uaggucaaggccacuucuugga

SEQ ID NO: 54680 - RNA, 22 nt, Human
guggcagguguacagcucagcu

SEQ ID NO: 54681 - RNA, 22 nt, Human
guggccaaggcagagaaagagc

SEQ ID NO: 54682 - RNA, 22 nt, Human
guggccugacagaucggaacag

SEQ ID NO: 54683 - RNA, 18 nt, Human
guggccauugaccagcuu

SEQ ID NO: 54684 - RNA, 22 nt, Human
guggcuugguauuaaggugcca

SEQ ID NO: 54685 - RNA, 22 nt, Human
gugggaaacagccuugcuucua

SEQ ID NO: 54686 - RNA, 22 nt, Human
gugggcacguccuacugucacu

SEQ ID NO: 54687 - RNA, 22 nt, Human
gugggccaguuccucacaggua

SEQ ID NO: 54688 - RNA, 22 nt, Human
gugggcccaagcagcggcggcc

SEQ ID NO: 54689 - RNA, 22 nt, Human
guggggcgggucccccgccugg

SEQ ID NO: 54690 - RNA, 22 nt, Human
uagucggcuaggagggccuucu

SEQ ID NO: 54691 - RNA, 22 nt, Human
guggguccaaccugugugugug

SEQ ID NO: 54692 - RNA, 22 nt, Human
gugggugaguggggccgccuga

SEQ ID NO: 54693 - RNA, 22 nt, Human
guggucaagaccgggaauagga

SEQ ID NO: 54694 - RNA, 22 nt, Human
guggugaacauuugcaucugcu

SEQ ID NO: 54695 - RNA, 22 nt, Human
gugguggggaguuggauggaag

SEQ ID NO: 54696 - RNA, 22 nt, Human
guggugguguuggugacaaguu

SEQ ID NO: 54697 - RNA, 22 nt, Human
gugguggugaggcaaggggugu

SEQ ID NO: 54698 - RNA, 22 nt, Human
uaucauuaggagugcugcucgg

SEQ ID NO: 54699 - RNA, 20 nt, Human
uaugcgaagccuuucuggac

SEQ ID NO: 54700 - RNA, 22 nt, Human
uaugcgguccaucaggggcacu

SEQ ID NO: 54701 - RNA, 22 nt, Human
guguggcgacucagagcugccu

SEQ ID NO: 54702 - RNA, 19 nt, Human
guguucuguuauacaguug

SEQ ID NO: 54703 - RNA, 23 nt, Human
gugugccuuuaucuucuguacuc

SEQ ID NO: 54704 - RNA, 22 nt, Human
guucaaggagcagcuugcuaca

SEQ ID NO: 54705 - RNA, 22 nt, Human
guuccugagcaguuccuggcca

SEQ ID NO: 54706 - RNA, 22 nt, Human
guucuacaacuucgcuugcaga

SEQ ID NO: 54707 - RNA, 22 nt, Human
guucuggaggagagccuggugu

SEQ ID NO: 54708 - RNA, 22 nt, Human
guugccugguuucaaaaggaau

SEQ ID NO: 54709 - RNA, 23 nt, Human
guugccuuugcaucuucauccau

SEQ ID NO: 54710 - RNA, 22 nt, Human
guugcggaguguagcgaugcuu

SEQ ID NO: 54711 - RNA, 22 nt, Human
guugcuggggcugaguccccag

SEQ ID NO: 54712 - RNA, 21 nt, Human
ucaaccagguguugaaggcac

SEQ ID NO: 54713 - RNA, 21 nt, Human
ucaagcggcagagcaguuauu

SEQ ID NO: 54714 - RNA, 22 nt, Human
ucaagcuggaaaugaagaaucu

SEQ ID NO: 54715 - RNA, 22 nt, Human
ucagguuuaagcuacuggaauc

SEQ ID NO: 54716 - RNA, 22 nt, Human
ucagucacugucucagacagga

SEQ ID NO: 54717 - RNA, 23 nt, Human
ucagugccaaggagaacuuggug

SEQ ID NO: 54718 - RNA, 22 nt, Human
ucaugagcacaggugcagggac

SEQ ID NO: 54719 - RNA, 22 nt, Human
ucaugcagaguagaaagggcaa

SEQ ID NO: 54720 - RNA, 23 nt, Human
uacagccaugucgcugauuuaac

SEQ ID NO: 54721 - RNA, 22 nt, Human
uccaagacagauaccuagaaga

SEQ ID NO: 54722 - RNA, 22 nt, Human
uccaaggacuaaauucuagauu

SEQ ID NO: 54723 - RNA, 22 nt, Human
uccaaggacucuugucagcugu

SEQ ID NO: 54724 - RNA, 22 nt, Human
uccaaggcagacacauuuuuug

SEQ ID NO: 54725 - RNA, 22 nt, Human
uccacagcagagcacgguaccu

SEQ ID NO: 54726 - RNA, 22 nt, Human
uacaguauuuuuuaagaaaaaa

SEQ ID NO: 54727 - RNA, 22 nt, Human
uccaggagucagacagauggug

SEQ ID NO: 54728 - RNA, 22 nt, Human
uccaggcagcugcuugaugaua

SEQ ID NO: 54729 - RNA, 22 nt, Human
uccagguaggagaccaggcugu

SEQ ID NO: 54730 - RNA, 22 nt, Human
uccagguccuacuggcccauag

SEQ ID NO: 54731 - RNA, 22 nt, Human
uaccuggauaaauguacaaccg

SEQ ID NO: 54732 - RNA, 22 nt, Human
uacguggcucguuaauuuccug

SEQ ID NO: 54733 - RNA, 22 nt, Human
uccaucauucagaaauuuuuga

SEQ ID NO: 54734 - RNA, 23 nt, Human
uccccagcugcccgugucccggg

SEQ ID NO: 54735 - RNA, 22 nt, Human
uccccgcuccguagagaaagag

SEQ ID NO: 54736 - RNA, 22 nt, Human
uccccggagucccuggccaggg

SEQ ID NO: 54737 - RNA, 21 nt, Human
uccccugugccuggcauacag

SEQ ID NO: 54738 - RNA, 22 nt, Human
ucccgcccugcguucucccaug

SEQ ID NO: 54739 - RNA, 22 nt, Human
ucccggcaccgggagccccugc

SEQ ID NO: 54740 - RNA, 22 nt, Human
ucccugcaggcauguacucuga

SEQ ID NO: 54741 - RNA, 22 nt, Human
ucccugcagggccauugugcag

SEQ ID NO: 54742 - RNA, 22 nt, Human
ucccugccuccuggcagugcca

SEQ ID NO: 54743 - RNA, 22 nt, Human
ucccugcgugagaaagcacuua

SEQ ID NO: 54744 - RNA, 22 nt, Human
ucccuguggauuaaggagaugu

SEQ ID NO: 54745 - RNA, 22 nt, Human
uagaagaacaugucaaacuaua

SEQ ID NO: 54746 - RNA, 22 nt, Human
uccgaccuuuacuucuugucuc

SEQ ID NO: 54747 - RNA, 22 nt, Human
uccgagggugacuaccgcuucc

SEQ ID NO: 54748 - RNA, 22 nt, Human
uccgcguugguuagagagggcu

SEQ ID NO: 54749 - RNA, 21 nt, Human
uagaccagcugugcuccucgg

SEQ ID NO: 54750 - RNA, 22 nt, Human
uccgggagcccccggaggagga

SEQ ID NO: 54751 - RNA, 22 nt, Human
uccgucucucccuccccaucac

SEQ ID NO: 54752 - RNA, 22 nt, Human
uccgugguguuggcucuccggc

SEQ ID NO: 54753 - RNA, 21 nt, Human
uccguucgguuaaaaaggccc

SEQ ID NO: 54754 - RNA, 22 nt, Human
uagaggccguagguggcugguu

SEQ ID NO: 54755 - RNA, 22 nt, Human
uagcacauaguaggcacaggcu

SEQ ID NO: 54756 - RNA, 22 nt, Human
uagcaccuagaguauuuuauca

SEQ ID NO: 54757 - RNA, 20 nt, Human
uccugaaauuacgugauuca

SEQ ID NO: 54758 - RNA, 22 nt, Human
uccugcuucaaucugcugcugg

SEQ ID NO: 54759 - RNA, 22 nt, Human
uagcuggaggggcaggaugcug

SEQ ID NO: 54760 - RNA, 22 nt, Human
ucgagcucagcagggaggugcg

SEQ ID NO: 54761 - RNA, 22 nt, Human
ucgaggagagucgccagcugcu

SEQ ID NO: 54762 - RNA, 22 nt, Human
ucgauccaggaaggcugguuua

SEQ ID NO: 54763 - RNA, 22 nt, Human
ucuccaccccugggaggcagaa

SEQ ID NO: 54764 - RNA, 19 nt, Human
ucucccaugccugugucua

SEQ ID NO: 54765 - RNA, 23 nt, Human
ucucccagaaguucucggggacu

SEQ ID NO: 54766 - RNA, 22 nt, Human
uauagcccaaucuggaugcagu

SEQ ID NO: 54767 - RNA, 18 nt, Human
ucuccgaccccgcggucc

SEQ ID NO: 54768 - RNA, 17 nt, Human
ucuccuggcucuaucag

SEQ ID NO: 54769 - RNA, 22 nt, Human
ucucuacugcuucugugaguga

SEQ ID NO: 54770 - RNA, 21 nt, Human
ucucuaucguauaccagccgg

SEQ ID NO: 54771 - RNA, 22 nt, Human
ucucuucggagagaccuuugga

SEQ ID NO: 54772 - RNA, 22 nt, Human
uaucugcuggagguaauuacuc

SEQ ID NO: 54773 - RNA, 22 nt, Human
ucugaucagaagacaaaugagg

SEQ ID NO: 54774 - RNA, 17 nt, Human
ucugcagaggcaaaccu

SEQ ID NO: 54775 - RNA, 22 nt, Human
uaugcacacguguccaugugca

SEQ ID NO: 54776 - RNA, 22 nt, Human
ucugcaugccucaggaggccug

SEQ ID NO: 54777 - RNA, 22 nt, Human
ucugcccaggaggucccauggg

SEQ ID NO: 54778 - RNA, 22 nt, Human
ucugcggccggaauucccuuca

SEQ ID NO: 54779 - RNA, 22 nt, Human
uauggacagcuuucuuuguguu

SEQ ID NO: 54780 - RNA, 22 nt, Human
ucugcguggcgugguucugugc

SEQ ID NO: 54781 - RNA, 22 nt, Human
ucugcuggugucauuuuugcua

SEQ ID NO: 54782 - RNA, 22 nt, Human
ucugcuguugaucaugacuagc

SEQ ID NO: 54783 - RNA, 22 nt, Human
ucuggcacuugccaguuucuau

SEQ ID NO: 54784 - RNA, 22 nt, Human
ucuggcaguugccgcuucaguc

SEQ ID NO: 54785 - RNA, 21 nt, Human
ucuggccuauaaaguagucgc

SEQ ID NO: 54786 - RNA, 22 nt, Human
ucugggccaacccuuccauggg

SEQ ID NO: 54787 - RNA, 21 nt, Human
ucuggggacaagguccaggaa

SEQ ID NO: 54788 - RNA, 22 nt, Human
uauguggcaggugggagaucag

SEQ ID NO: 54789 - RNA, 22 nt, Human
ucuggugcacucugauauuuga

SEQ ID NO: 54790 - RNA, 22 nt, Human
ucugguuccugcauucauucaa

SEQ ID NO: 54791 - RNA, 22 nt, Human
ucuguagcuuuagaggacagga

SEQ ID NO: 54792 - RNA, 21 nt, Human
ucugugcuuuuuuggcuccua

SEQ ID NO: 54793 - RNA, 20 nt, Human
ucuguggcagguggcgcuug

SEQ ID NO: 54794 - RNA, 19 nt, Human
ucuguggccuucccugaug

SEQ ID NO: 54795 - RNA, 17 nt, Human
ucuguguccgcucaguc

SEQ ID NO: 54796 - RNA, 22 nt, Human
ucuguuuuccaggaaucucaua

SEQ ID NO: 54797 - RNA, 22 nt, Human
ucuucauuucuggggaauuggc

SEQ ID NO: 54798 - RNA, 22 nt, Human
ucuuccagauacuuccugacuu

SEQ ID NO: 54799 - RNA, 22 nt, Human
ucagguuuaagugacuggaauc

SEQ ID NO: 54800 - RNA, 22 nt, Human
ugagaacacuuuucucuuugcu

SEQ ID NO: 54801 - RNA, 22 nt, Human
ugagcaccaggcaccacagcuc

SEQ ID NO: 54802 - RNA, 22 nt, Human
ugagccugaguguguauugaac

SEQ ID NO: 54803 - RNA, 19 nt, Human
ucagugggacauuugcuuu

SEQ ID NO: 54804 - RNA, 21 nt, Human
ugaggccugccagucucagaa

SEQ ID NO: 54805 - RNA, 22 nt, Human
ugaggccaagccuccucugcca

SEQ ID NO: 54806 - RNA, 22 nt, Human
ucaucagccaaagaguccuuca

SEQ ID NO: 54807 - RNA, 22 nt, Human
ucaucgauggggagcucuacaa

SEQ ID NO: 54808 - RNA, 22 nt, Human
ucaucggcugucaucuucacgu

SEQ ID NO: 54809 - RNA, 22 nt, Human
ucaugggcaaacuuggggauca

SEQ ID NO: 54810 - RNA, 22 nt, Human
ucauguauucugggcaggagau

SEQ ID NO: 54811 - RNA, 22 nt, Human
ugaugaugauacauuucuucag

SEQ ID NO: 54812 - RNA, 22 nt, Human
ugauggaucuguuggcggguuu

SEQ ID NO: 54813 - RNA, 22 nt, Human
ugauggugagaugucccguguu

SEQ ID NO: 54814 - RNA, 22 nt, Human
uccaaggcuggaucuuuucuuu

SEQ ID NO: 54815 - RNA, 19 nt, Human
uccaccgcgugcaccucua

SEQ ID NO: 54816 - RNA, 22 nt, Human
uccagcacacagguggcucuca

SEQ ID NO: 54817 - RNA, 22 nt, Human
uccagcugugcuccaggaggug

SEQ ID NO: 54818 - RNA, 22 nt, Human
uccaggacgccgacgugucggc

SEQ ID NO: 54819 - RNA, 22 nt, Human
uccaggaggacugagggggcug

SEQ ID NO: 54820 - RNA, 22 nt, Human
ucccaagugcuccucuggcccc

SEQ ID NO: 54821 - RNA, 22 nt, Human
ucccaaguguuuggcgaggaga

SEQ ID NO: 54822 - RNA, 22 nt, Human
ucccagccugacagugcaucaa

SEQ ID NO: 54823 - RNA, 22 nt, Human
ucccagguugaggccuugccug

SEQ ID NO: 54824 - RNA, 22 nt, Human
uccccgcugcgcccgcugcugc

SEQ ID NO: 54825 - RNA, 20 nt, Human
uccccuccacuuuccuccua

SEQ ID NO: 54826 - RNA, 22 nt, Human
uccccugccccccauccucugg

SEQ ID NO: 54827 - RNA, 22 nt, Human
ucccucacacagcugggagaac

SEQ ID NO: 54828 - RNA, 21 nt, Human
ucccugcagccccaggccccc

SEQ ID NO: 54829 - RNA, 22 nt, Human
ucccugccuuauuuucauaugc

SEQ ID NO: 54830 - RNA, 22 nt, Human
ucccugcugggcgaucuucucu

SEQ ID NO: 54831 - RNA, 22 nt, Human
uccgacacacgugcucgcagcg

SEQ ID NO: 54832 - RNA, 22 nt, Human
ugcaggaacucgaaaacuauag

SEQ ID NO: 54833 - RNA, 22 nt, Human
ugcaggguuucaauacacagga

SEQ ID NO: 54834 - RNA, 22 nt, Human
ugcaggucuggacccccacuuu

SEQ ID NO: 54835 - RNA, 18 nt, Human
uccggaggucagaguaaa

SEQ ID NO: 54836 - RNA, 22 nt, Human
uccgggcagcuccuggagcugu

SEQ ID NO: 54837 - RNA, 22 nt, Human
uccguugaggcugccaggcgag

SEQ ID NO: 54838 - RNA, 22 nt, Human
ugcagguuuucagauguguguu

SEQ ID NO: 54839 - RNA, 22 nt, Human
ugcauaugcauguaccuguguu

SEQ ID NO: 54840 - RNA, 22 nt, Human
ugcaucugagcacuacggugga

SEQ ID NO: 54841 - RNA, 22 nt, Human
ugcaugacaauugccgucaagu

SEQ ID NO: 54842 - RNA, 22 nt, Human
ugcauguuauuguggcaagaau

SEQ ID NO: 54843 - RNA, 22 nt, Human
uccucgccgucacgcagccucu

SEQ ID NO: 54844 - RNA, 22 nt, Human
uccugcccuguccuugccucug

SEQ ID NO: 54845 - RNA, 19 nt, Human
ugccccuucuucauccauc

SEQ ID NO: 54846 - RNA, 22 nt, Human
uccuggaagggaugguugagga

SEQ ID NO: 54847 - RNA, 22 nt, Human
uccuggccucugagucaagaac

SEQ ID NO: 54848 - RNA, 22 nt, Human
uccuggcgugggcuggcugcag

SEQ ID NO: 54849 - RNA, 22 nt, Human
uccuggccuuggggagagaagu

SEQ ID NO: 54850 - RNA, 22 nt, Human
uccuggcuguuagagaggcaag

SEQ ID NO: 54851 - RNA, 22 nt, Human
ugccucucuggaucugcuguga

SEQ ID NO: 54852 - RNA, 20 nt, Human
ugccugagcgcagcuccagg

SEQ ID NO: 54853 - RNA, 22 nt, Human
ugccuggacgacaucacaguga

SEQ ID NO: 54854 - RNA, 21 nt, Human
ugccuggccuuugcuuuuccu

SEQ ID NO: 54855 - RNA, 19 nt, Human
ugccuggcaccagcuccac

SEQ ID NO: 54856 - RNA, 22 nt, Human
uccuuguucugauuuuucuggg

SEQ ID NO: 54857 - RNA, 22 nt, Human
uccuuuauuuaugggcagugua

SEQ ID NO: 54858 - RNA, 22 nt, Human
ugccuguguuugggguggggaa

SEQ ID NO: 54859 - RNA, 22 nt, Human
ugccuuccuucuccccuccuuc

SEQ ID NO: 54860 - RNA, 22 nt, Human
ugccuuguagccaccgggucac

SEQ ID NO: 54861 - RNA, 22 nt, Human
ugcgcgcaccugcauauauaug

SEQ ID NO: 54862 - RNA, 22 nt, Human
ugcgcgccgacggcuccgugac

SEQ ID NO: 54863 - RNA, 22 nt, Human
ugcgccccgcgggccuucgggc

SEQ ID NO: 54864 - RNA, 22 nt, Human
ucgcggccgcuccacaugcaca

SEQ ID NO: 54865 - RNA, 20 nt, Human
ucgcugcaagggaaauggag

SEQ ID NO: 54866 - RNA, 22 nt, Human
ucucaaagagcuacuggucuau

SEQ ID NO: 54867 - RNA, 23 nt, Human
ucucaccaggauaugacugucac

SEQ ID NO: 54868 - RNA, 22 nt, Human
ugcugcggauauacaggaucug

SEQ ID NO: 54869 - RNA, 22 nt, Human
ugcugcggcgcaggcacuccag

SEQ ID NO: 54870 - RNA, 22 nt, Human
ugcugcucaagcugcagcaaaa

SEQ ID NO: 54871 - RNA, 22 nt, Human
ugcugcuguuaucauuuuacca

SEQ ID NO: 54872 - RNA, 22 nt, Human
ugcugcuguuuccuacaucuca

SEQ ID NO: 54873 - RNA, 22 nt, Human
ucucaggcuuccuggugcugug

SEQ ID NO: 54874 - RNA, 21 nt, Human
ucucauuuuaacacagaguug

SEQ ID NO: 54875 - RNA, 22 nt, Human
ugcuggaaggguaguauuaacu

SEQ ID NO: 54876 - RNA, 22 nt, Human
ugcuggagccauguuuucucua

SEQ ID NO: 54877 - RNA, 22 nt, Human
ugcuggaguggcacuguguggc

SEQ ID NO: 54878 - RNA, 22 nt, Human
ugcugggagcugggccucgaca

SEQ ID NO: 54879 - RNA, 22 nt, Human
ucuccaggaaagacacuggacu

SEQ ID NO: 54880 - RNA, 22 nt, Human
ucuccagcugaggccuucuucc

SEQ ID NO: 54881 - RNA, 22 nt, Human
ucuccaggggcagggucuggag

SEQ ID NO: 54882 - RNA, 22 nt, Human
ucucccgcuuccugcuggcugc

SEQ ID NO: 54883 - RNA, 22 nt, Human
ugcugugcuggcggcagaggcc

SEQ ID NO: 54884 - RNA, 20 nt, Human
ugcuguggguaagcuuuaua

SEQ ID NO: 54885 - RNA, 22 nt, Human
ucucgcuguuccugcuucaggu

SEQ ID NO: 54886 - RNA, 22 nt, Human
ugcuugaacccaggaaguggag

SEQ ID NO: 54887 - RNA, 22 nt, Human
ugcuuggagaaucagucccagc

SEQ ID NO: 54888 - RNA, 22 nt, Human
ugcuuggauuuccaaaugguuu

SEQ ID NO: 54889 - RNA, 22 nt, Human
ucucuugcuauugcgaacaggu

SEQ ID NO: 54890 - RNA, 22 nt, Human
ugcuuucagauaucuguuucaa

SEQ ID NO: 54891 - RNA, 21 nt, Human
ugcuuucugugcuuuuucugc

SEQ ID NO: 54892 - RNA, 18 nt, Human
ucugaaggaaugauucca

SEQ ID NO: 54893 - RNA, 22 nt, Human
ucugaccaggcucuuguagccu

SEQ ID NO: 54894 - RNA, 22 nt, Human
ucugaccccccuugccuccacu

SEQ ID NO: 54895 - RNA, 17 nt, Human
ucugaccuuuacuccug

SEQ ID NO: 54896 - RNA, 22 nt, Human
ucugaugaccacaugugggacu

SEQ ID NO: 54897 - RNA, 22 nt, Human
ucugcgggccuggcucccagcg

SEQ ID NO: 54898 - RNA, 22 nt, Human
ucugggaccuagacccauuguu

SEQ ID NO: 54899 - RNA, 22 nt, Human
uggaagugucagcaggcugguu

SEQ ID NO: 54900 - RNA, 22 nt, Human
ucuguaccuuauguucagagug

SEQ ID NO: 54901 - RNA, 22 nt, Human
ucuguggcaaacacagugacca

SEQ ID NO: 54902 - RNA, 19 nt, Human
ucuguggagcucagaguag

SEQ ID NO: 54903 - RNA, 20 nt, Human
uggaucgaccucacuuccau

SEQ ID NO: 54904 - RNA, 20 nt, Human
uggaugacuucaggcagccu

SEQ ID NO: 54905 - RNA, 22 nt, Human
uggcaagcuguuggcagauagc

SEQ ID NO: 54906 - RNA, 22 nt, Human
ucuucaucucuaaaaugggaac

SEQ ID NO: 54907 - RNA, 22 nt, Human
uggcagugagauuucucuucug

SEQ ID NO: 54908 - RNA, 18 nt, Human
uggcaaugccaaaggcuu

SEQ ID NO: 54909 - RNA, 22 nt, Human
uggcaucacagacaaggcagca

SEQ ID NO: 54910 - RNA, 22 nt, Human
ucuugcuguagcuguuucuucu

SEQ ID NO: 54911 - RNA, 21 nt, Human
uggcccgagccgggguuggcu

SEQ ID NO: 54912 - RNA, 22 nt, Human
uggccgaugagcaugcgcugau

SEQ ID NO: 54913 - RNA, 22 nt, Human
uggcgcgcucgcucucgcugag

SEQ ID NO: 54914 - RNA, 22 nt, Human
uggcggagacauggacuucaga

SEQ ID NO: 54915 - RNA, 22 nt, Human
uggcggcggggagguaggcaga

SEQ ID NO: 54916 - RNA, 22 nt, Human
uggccuucagcucuggggugca

SEQ ID NO: 54917 - RNA, 22 nt, Human
uggcggcuggacuggggggcca

SEQ ID NO: 54918 - RNA, 22 nt, Human
uggcgugaagcuggaaggcgga

SEQ ID NO: 54919 - RNA, 22 nt, Human
uggcucagcgcggccuggucuu

SEQ ID NO: 54920 - RNA, 22 nt, Human
ugaaaaaugcuuuaaugcaugu

SEQ ID NO: 54921 - RNA, 22 nt, Human
ugacugagacugcaaugaccga

SEQ ID NO: 54922 - RNA, 22 nt, Human
ugguagacaacagcagugggac

SEQ ID NO: 54923 - RNA, 22 nt, Human
ugagacagaccuuggaccaugu

SEQ ID NO: 54924 - RNA, 22 nt, Human
ugagagcuccacaccuugcccu

SEQ ID NO: 54925 - RNA, 22 nt, Human
ugguccaaaccagugcuguggu

SEQ ID NO: 54926 - RNA, 22 nt, Human
ugguccaugcuccaggcacauu

SEQ ID NO: 54927 - RNA, 22 nt, Human
ugagcaaacacagauaggcuua

SEQ ID NO: 54928 - RNA, 22 nt, Human
ugguccucacccuacccagcug

SEQ ID NO: 54929 - RNA, 22 nt, Human
uggugcucucgauauauaaggc

SEQ ID NO: 54930 - RNA, 22 nt, Human
uggugcucuugauauauaaggc

SEQ ID NO: 54931 - RNA, 22 nt, Human
ugaggaugaggaagaagaagaa

SEQ ID NO: 54932 - RNA, 22 nt, Human
ugguggcaauuuuuggggucaa

SEQ ID NO: 54933 - RNA, 22 nt, Human
uggugguaggggugguuucuga

SEQ ID NO: 54934 - RNA, 22 nt, Human
ugagugccagugcuugcucuac

SEQ ID NO: 54935 - RNA, 22 nt, Human
ugguucugucugugcugggggg

SEQ ID NO: 54936 - RNA, 22 nt, Human
ugaugaaguuggaaggaaaguu

SEQ ID NO: 54937 - RNA, 22 nt, Human
ugucacggccggguggcaccga

SEQ ID NO: 54938 - RNA, 20 nt, Human
ugucccuggagagcugcaga

SEQ ID NO: 54939 - RNA, 22 nt, Human
ugucugaauuguaauguugcgu

SEQ ID NO: 54940 - RNA, 21 nt, Human
ugcaaugcauugacagcagca

SEQ ID NO: 54941 - RNA, 22 nt, Human
ugcaauggauaucugaacgugg

SEQ ID NO: 54942 - RNA, 22 nt, Human
ugcagacuguuucuugacugaa

SEQ ID NO: 54943 - RNA, 19 nt, Human
ugcagcacuaaaaacuuuc

SEQ ID NO: 54944 - RNA, 22 nt, Human
ugugacaugauggcgucaugua

SEQ ID NO: 54945 - RNA, 22 nt, Human
ugcagccuuuguccuugggcua

SEQ ID NO: 54946 - RNA, 22 nt, Human
ugcagcgugaggacagcugagc

SEQ ID NO: 54947 - RNA, 22 nt, Human
ugcaggaagcucagcggggccg

SEQ ID NO: 54948 - RNA, 22 nt, Human
ugugcuggcuucugugagcuga

SEQ ID NO: 54949 - RNA, 22 nt, Human
ugcaugcagcuggucgggcgcc

SEQ ID NO: 54950 - RNA, 17 nt, Human
ugcaugcgucugugaua

SEQ ID NO: 54951 - RNA, 22 nt, Human
ugcauguuuuaagugaagcuga

SEQ ID NO: 54952 - RNA, 22 nt, Human
ugccagcuccgaggagcugcag

SEQ ID NO: 54953 - RNA, 23 nt, Human
ugccaggaagaaugaccucugcu

SEQ ID NO: 54954 - RNA, 22 nt, Human
ugccagauuaugucuccagggc

SEQ ID NO: 54955 - RNA, 22 nt, Human
ugccaguaauuguccuguagcu

SEQ ID NO: 54956 - RNA, 22 nt, Human
ugccagugugccuuccgcucac

SEQ ID NO: 54957 - RNA, 22 nt, Human
ugcccagcagggagcuaccugg

SEQ ID NO: 54958 - RNA, 22 nt, Human
uguggccaccagagcugcuauu

SEQ ID NO: 54959 - RNA, 19 nt, Human
ugccccacccucuauccag

SEQ ID NO: 54960 - RNA, 22 nt, Human
ugccccagcacauuuacuaucc

SEQ ID NO: 54961 - RNA, 22 nt, Human
ugcccccggcugcccaggggaa

SEQ ID NO: 54962 - RNA, 22 nt, Human
ugccccuggaggagagcaaugg

SEQ ID NO: 54963 - RNA, 22 nt, Human
ugcccugucccuagguuugugg

SEQ ID NO: 54964 - RNA, 22 nt, Human
ugccgccccggggcccccagcc

SEQ ID NO: 54965 - RNA, 23 nt, Human
ugccggaucuacuuuggguucuc

SEQ ID NO: 54966 - RNA, 22 nt, Human
ugccgccgugggucccgacgcg

SEQ ID NO: 54967 - RNA, 22 nt, Human
ugccgggcugagcaagugcugc

SEQ ID NO: 54968 - RNA, 22 nt, Human
uguguggccuccauaggguacu

SEQ ID NO: 54969 - RNA, 22 nt, Human
ugccugucuaucuuugucaucu

SEQ ID NO: 54970 - RNA, 22 nt, Human
ugccuguguauuuccggccugc

SEQ ID NO: 54971 - RNA, 22 nt, Human
ugcuccucugcaugucugcggc

SEQ ID NO: 54972 - RNA, 22 nt, Human
ugcucgggcuccuuugagugag

SEQ ID NO: 54973 - RNA, 22 nt, Human
ugcucugguccucccucggcgc

SEQ ID NO: 54974 - RNA, 22 nt, Human
uguuguuguuguuguuguuguu

SEQ ID NO: 54975 - RNA, 22 nt, Human
ugcugaccggccuccccccagc

SEQ ID NO: 54976 - RNA, 22 nt, Human
ugcugcacuuauggcucugagg

SEQ ID NO: 54977 - RNA, 19 nt, Human
ugcugcaggaauucucaag

SEQ ID NO: 54978 - RNA, 22 nt, Human
ugcugccgccgccaccgccgcc

SEQ ID NO: 54979 - RNA, 22 nt, Human
ugcugcacccuucauuuuccca

SEQ ID NO: 54980 - RNA, 23 nt, Human
ugcugcgggacccgagcgcgcgc

SEQ ID NO: 54981 - RNA, 22 nt, Human
ugcugcucuucaccauggccuc

SEQ ID NO: 54982 - RNA, 23 nt, Human
ugcugcuggaguaucuacaaugc

SEQ ID NO: 54983 - RNA, 22 nt, Human
ugcuggagucucuugacccugg

SEQ ID NO: 54984 - RNA, 20 nt, Human
ugcugggccaucuugcaugc

SEQ ID NO: 54985 - RNA, 22 nt, Human
ugcuggugauuaaauccugaag

SEQ ID NO: 54986 - RNA, 22 nt, Human
ugcuguacaagacccucuguuu

SEQ ID NO: 54987 - RNA, 22 nt, Human
ugcuguugacuuuguuguucuu

SEQ ID NO: 54988 - RNA, 22 nt, Human
ugcuugacucagcaucggcaau

SEQ ID NO: 54989 - RNA, 22 nt, Human
ugcuuguuuuguggcuucagcu

SEQ ID NO: 54990 - RNA, 22 nt, Human
uuaccugccucaaacacgaaug

SEQ ID NO: 54991 - RNA, 21 nt, Human
ugcuuuuguugucagcugcug

SEQ ID NO: 54992 - RNA, 22 nt, Human
uggaaagcagcccugcucccca

SEQ ID NO: 54993 - RNA, 22 nt, Human
uggaaaugcuuagaggugaucu

SEQ ID NO: 54994 - RNA, 22 nt, Human
uggaacugauuaaaagggcaga

SEQ ID NO: 54995 - RNA, 22 nt, Human
uggaagaaaacuuggaaggcau

SEQ ID NO: 54996 - RNA, 22 nt, Human
uggaagaaaugguugagccaug

SEQ ID NO: 54997 - RNA, 22 nt, Human
uggaagcccagaaggaagcaga

SEQ ID NO: 54998 - RNA, 22 nt, Human
uggaagcuggcugaucugacuu

SEQ ID NO: 54999 - RNA, 21 nt, Human
uggaagggaagucuugguugu

SEQ ID NO: 55000 - RNA, 22 nt, Human
uggaagucuucucucccaugga

SEQ ID NO: 55001 - RNA, 22 nt, Human
uggaaugccgggccaggcuccg

SEQ ID NO: 55002 - RNA, 22 nt, Human
uggacagguacuucacauuauu

SEQ ID NO: 55003 - RNA, 22 nt, Human
uggacccaccccagggccugcu

SEQ ID NO: 55004 - RNA, 22 nt, Human
uggagaugcacgagcaggugga

SEQ ID NO: 55005 - RNA, 22 nt, Human
uggagcaagaagggaggcagaa

SEQ ID NO: 55006 - RNA, 22 nt, Human
uggagccagcaggacucagagg

SEQ ID NO: 55007 - RNA, 22 nt, Human
uggagcugaaguacucucacua

SEQ ID NO: 55008 - RNA, 22 nt, Human
uuccaagcaccaugaaggccuc

SEQ ID NO: 55009 - RNA, 21 nt, Human
uuccauggacccugucagugu

SEQ ID NO: 55010 - RNA, 22 nt, Human
uggcugagugaacauguccauu

SEQ ID NO: 55011 - RNA, 22 nt, Human
uggcugaugucuguucuguuau

SEQ ID NO: 55012 - RNA, 22 nt, Human
uggcugggagcuggaacugggc

SEQ ID NO: 55013 - RNA, 22 nt, Human
ugggaagcugagccucgaugug

SEQ ID NO: 55014 - RNA, 22 nt, Human
uucccggccgccccccgcucgg

SEQ ID NO: 55015 - RNA, 22 nt, Human
uucccugggggggccgcuuucc

SEQ ID NO: 55016 - RNA, 21 nt, Human
uuccuggaggcagaaacguga

SEQ ID NO: 55017 - RNA, 22 nt, Human
uuccuggaguggagggagguga

SEQ ID NO: 55018 - RNA, 22 nt, Human
uggggccaggcuguuggcuucc

SEQ ID NO: 55019 - RNA, 22 nt, Human
uucggugagcugcgggcgagga

SEQ ID NO: 55020 - RNA, 22 nt, Human
uucgcggccaggcggggaggcc

SEQ ID NO: 55021 - RNA, 22 nt, Human
uggggcggaaggaggagaggug

SEQ ID NO: 55022 - RNA, 22 nt, Human
uggggcuauggcccgaccacgu

SEQ ID NO: 55023 - RNA, 22 nt, Human
uggggcuccaguagagaaggca

SEQ ID NO: 55024 - RNA, 22 nt, Human
uggggcuccuccuggcaggagg

SEQ ID NO: 55025 - RNA, 22 nt, Human
uggguagggagcuggaauccua

SEQ ID NO: 55026 - RNA, 22 nt, Human
ugggucacuggccaagcucgac

SEQ ID NO: 55027 - RNA, 22 nt, Human
ugggugccgcaucuugcuguuc

SEQ ID NO: 55028 - RNA, 22 nt, Human
uggguggugaaauggaugggaa

SEQ ID NO: 55029 - RNA, 23 nt, Human
uggguuucagugccaaugcugcc

SEQ ID NO: 55030 - RNA, 22 nt, Human
uggguuugcuuguucagguucu

SEQ ID NO: 55031 - RNA, 22 nt, Human
uucuggccagggaagagggguc

SEQ ID NO: 55032 - RNA, 22 nt, Human
uucuggucucucugaccuagga

SEQ ID NO: 55033 - RNA, 22 nt, Human
uggucaagcaaugaauuuauuu

SEQ ID NO: 55034 - RNA, 22 nt, Human
uggucacgucgggguauugcca

SEQ ID NO: 55035 - RNA, 22 nt, Human
ugguccaccgccucauucucug

SEQ ID NO: 55036 - RNA, 22 nt, Human
ugguccgagaacuguccugguu

SEQ ID NO: 55037 - RNA, 22 nt, Human
uggucccuagugugggagcuug

SEQ ID NO: 55038 - RNA, 22 nt, Human
uggugacaucuaccuagguaaa

SEQ ID NO: 55039 - RNA, 22 nt, Human
uggugcacgugggcagucggcc

SEQ ID NO: 55040 - RNA, 22 nt, Human
uggugcagacaggagccccgcu

SEQ ID NO: 55041 - RNA, 22 nt, Human
uggugcccguggaaagagggag

SEQ ID NO: 55042 - RNA, 22 nt, Human
uggugccuuccgagagcuguga

SEQ ID NO: 55043 - RNA, 19 nt, Human
uggugcgcuguuccugagc

SEQ ID NO: 55044 - RNA, 22 nt, Human
uggugcuuuuguggaugcuaac

SEQ ID NO: 55045 - RNA, 19 nt, Human
ugguggaggugcaccugac

SEQ ID NO: 55046 - RNA, 20 nt, Human
ugguguccuaugcuugugcu

SEQ ID NO: 55047 - RNA, 22 nt, Human
ugucacagagcgugcaacagaa

SEQ ID NO: 55048 - RNA, 22 nt, Human
uugaggaagggaggcaaaacug

SEQ ID NO: 55049 - RNA, 22 nt, Human
uugaggguggauugucagggga

SEQ ID NO: 55050 - RNA, 22 nt, Human
ugucagccacggugugaccggc

SEQ ID NO: 55051 - RNA, 22 nt, Human
ugucccuggacuccaggagcca

SEQ ID NO: 55052 - RNA, 22 nt, Human
uguccccugcccagggauggga

SEQ ID NO: 55053 - RNA, 21 nt, Human
ugucugcaauuccagggaacc

SEQ ID NO: 55054 - RNA, 20 nt, Human
ugucugguaagacgcccauc

SEQ ID NO: 55055 - RNA, 22 nt, Human
ugucuucauuccccaugaaguc

SEQ ID NO: 55056 - RNA, 22 nt, Human
uugcagcuguugcaaagucucu

SEQ ID NO: 55057 - RNA, 22 nt, Human
uugcagugucaucuagacgugg

SEQ ID NO: 55058 - RNA, 20 nt, Human
uugcaugcagccggaugcug

SEQ ID NO: 55059 - RNA, 22 nt, Human
uugccaggggacaucuggagcc

SEQ ID NO: 55060 - RNA, 22 nt, Human
uugccgacuggccaaggaguaa

SEQ ID NO: 55061 - RNA, 22 nt, Human
uugccuguuugagagcuguguu

SEQ ID NO: 55062 - RNA, 20 nt, Human
uugcggccuaacagccccuu

SEQ ID NO: 55063 - RNA, 22 nt, Human
uuggcacagagcugcagccugg

SEQ ID NO: 55064 - RNA, 19 nt, Human
uguguuccauccaccaccc

SEQ ID NO: 55065 - RNA, 22 nt, Human
uguguuguuggggauguuuuca

SEQ ID NO: 55066 - RNA, 22 nt, Human
uguguuguuuggggauguccau

SEQ ID NO: 55067 - RNA, 22 nt, Human
uguguuucucugaggggucccu

SEQ ID NO: 55068 - RNA, 22 nt, Human
uuggcaggcugcauguuuaugu

SEQ ID NO: 55069 - RNA, 22 nt, Human
uuggcuguguugaaaacgugga

SEQ ID NO: 55070 - RNA, 23 nt, Human
uguuccugaugccucguccuguc

SEQ ID NO: 55071 - RNA, 22 nt, Human
uguucggaaaagggcaagcuau

SEQ ID NO: 55072 - RNA, 22 nt, Human
uugucuguacuggcugcaucga

SEQ ID NO: 55073 - RNA, 21 nt, Human
uugugaaaguccaggaacaac

SEQ ID NO: 55074 - RNA, 22 nt, Human
uugugccuuaauauaggcgcug

SEQ ID NO: 55075 - RNA, 22 nt, Human
uuguuguuguuguuauuuaguu

SEQ ID NO: 55076 - RNA, 22 nt, Human
uuguuuuucucuagggaaggcu

SEQ ID NO: 55077 - RNA, 22 nt, Human
uucaaccuucagcuugaguugg

SEQ ID NO: 55078 - RNA, 22 nt, Human
uucaaugcaagggaggucugaa

SEQ ID NO: 55079 - RNA, 22 nt, Human
uucacccaaaucaagcuggccu

SEQ ID NO: 55080 - RNA, 23 nt, Human
uucaccaaugcuguccaaguacc

SEQ ID NO: 55081 - RNA, 22 nt, Human
uucacccuucucuggcuuucag

SEQ ID NO: 55082 - RNA, 22 nt, Human
uucagcacuggacagcgagucu

SEQ ID NO: 55083 - RNA, 22 nt, Human
uucagcauaggcugcucuucaa

SEQ ID NO: 55084 - RNA, 22 nt, Human
uuugccggaucugucuccagcu

SEQ ID NO: 55085 - RNA, 22 nt, Human
uucaggaaacaaauuugcaguu

SEQ ID NO: 55086 - RNA, 22 nt, Human
uucaggacuauccaguggucuc

SEQ ID NO: 55087 - RNA, 22 nt, Human
uucauuauuaauaauagcagcu

SEQ ID NO: 55088 - RNA, 22 nt, Human
uuccauggggcuguugcgcaga

SEQ ID NO: 55089 - RNA, 22 nt, Human
uuccauuacuaaugccugcaau

SEQ ID NO: 55090 - RNA, 20 nt, Human
uuccucaaaagucugaugcu

SEQ ID NO: 55091 - RNA, 22 nt, Human
uuccucauuuauaggaaagaga

SEQ ID NO: 55092 - RNA, 22 nt, Human
uuccugcuggucaaaguugccu

SEQ ID NO: 55093 - RNA, 22 nt, Human
uucgucaauaugcagccuguga

SEQ ID NO: 55094 - RNA, 22 nt, Human
uucgucauuaugcagccuguga

SEQ ID NO: 55095 - RNA, 22 nt, Human
uuuuaucagagcuugcagugug

SEQ ID NO: 55096 - RNA, 22 nt, Human
uuuuccuucugauacuccauuu

SEQ ID NO: 55097 - RNA, 22 nt, Human
uuuucuuggaguggcuguccuu

SEQ ID NO: 55098 - RNA, 22 nt, Human
uuuugcaaauuacuaaauuucu

SEQ ID NO: 55099 - RNA, 22 nt, Human
uugaccagaaaaguuaguaauu

SEQ ID NO: 55100 - RNA, 22 nt, Human
uugaccauguggcccaggccaa

SEQ ID NO: 55101 - RNA, 20 nt, Human
uugagccucauggauugucu

SEQ ID NO: 55102 - RNA, 22 nt, Human
uuggaggcagagucuugcugag

SEQ ID NO: 55103 - RNA, 22 nt, Human
uuggaggccacagucaucuuua

SEQ ID NO: 55104 - RNA, 22 nt, Human
uuggccguuucacugggcaguu

SEQ ID NO: 55105 - RNA, 22 nt, Human
uuggccuuacgcauggucggca

SEQ ID NO: 55106 - RNA, 22 nt, Human
uuggcgcuauuauuaccacauu

SEQ ID NO: 55107 - RNA, 22 nt, Human
uuggcguuuccuguucugggug

SEQ ID NO: 55108 - RNA, 22 nt, Human
uugggcauuucuuauguauuuu

SEQ ID NO: 55109 - RNA, 22 nt, Human
uugguguuucacuuccuugucg

SEQ ID NO: 55110 - RNA, 18 nt, Human
uugugccugagaaggugg

SEQ ID NO: 55111 - RNA, 22 nt, Human
uugugcucaguuguggucuauu

SEQ ID NO: 55112 - RNA, 22 nt, Human
uuuaguauaguaugugcucaaa

SEQ ID NO: 55113 - RNA, 22 nt, Human
uuucacagcgucuuucucuugc

SEQ ID NO: 55114 - RNA, 22 nt, Human
uuucuggaaacuguaaagagga

SEQ ID NO: 55115 - RNA, 22 nt, Human
uuugcugggaagccuucacucu

SEQ ID NO: 55116 - RNA, 22 nt, Human
uuugcuguccaauauucagggu

SEQ ID NO: 55117 - RNA, 22 nt, Human
gcuggggaucgaaggcagagcc

SEQ ID NO: 55118 - RNA, 22 nt, Human
uuuacuguuuacagcuaaugca

SEQ ID NO: 55119 - RNA, 22 nt, Human
uuauuucaggcauuuguaaaug

SEQ ID NO: 55120 - RNA, 22 nt, Human
uuaacauuguccuuagcagauu

SEQ ID NO: 55121 - RNA, 22 nt, Human
aaucacuucuuugucuucuuca

SEQ ID NO: 55122 - RNA, 22 nt, Human
aagaggcagcuugguaggcauc

SEQ ID NO: 55123 - RNA, 22 nt, Human
uggaaaguuggaagucucagga

SEQ ID NO: 55124 - RNA, 22 nt, Human
uggaguuuuaaucuguacagaa

SEQ ID NO: 55125 - RNA, 22 nt, Human
aacacuaaaggucaguuagaag

SEQ ID NO: 55126 - RNA, 22 nt, Human
uggaaggggagcuggaaagggg

SEQ ID NO: 55127 - RNA, 22 nt, Human
ucuucacagaugcauauacuuc

SEQ ID NO: 55128 - RNA, 22 nt, Human
uguuuuuuagagugauacuuuu

SEQ ID NO: 55129 - RNA, 22 nt, Human
aaauggaaguuuguucucagcc

SEQ ID NO: 55130 - RNA, 22 nt, Human
uuuaaucaguugguaauauuga

SEQ ID NO: 55131 - RNA, 22 nt, Human
gguagacugagcuccuugagga

SEQ ID NO: 55132 - RNA, 22 nt, Human
ggggaaggaaggggagggcacg

SEQ ID NO: 55133 - RNA, 22 nt, Human
aaggugcauuaguuuggagggg

SEQ ID NO: 55134 - RNA, 22 nt, Human
gaaacauuuguugaguacuugc

SEQ ID NO: 55135 - RNA, 22 nt, Human
cuccaugagccaggagggcuac

SEQ ID NO: 55136 - RNA, 22 nt, Human
aagaggcuacagcccugugucu

SEQ ID NO: 55137 - RNA, 22 nt, Human
uuguuuucuaguguuuugaaua

SEQ ID NO: 55138 - RNA, 22 nt, Human
augggagggugaggaggcagcu

SEQ ID NO: 55139 - RNA, 22 nt, Human
uauuuuaaaagcauuaauucuu

SEQ ID NO: 55140 - RNA, 22 nt, Human
uuuaaauuucugaaucuugagg

SEQ ID NO: 55141 - RNA, 20 nt, Human
uuuuuuaaauagagcuguug

SEQ ID NO: 55142 - RNA, 22 nt, Human
guuuuaucuauguaauuauaaa

SEQ ID NO: 55143 - RNA, 22 nt, Human
ccauuucacaucccugacaugu

SEQ ID NO: 55144 - RNA, 22 nt, Human
ugcagcagaauauggcugcagg

SEQ ID NO: 55145 - RNA, 22 nt, Human
aaauguauuagccuaugugaga

SEQ ID NO: 55146 - RNA, 22 nt, Human
uggucuuuccuucauuguccag

SEQ ID NO: 55147 - RNA, 22 nt, Human
uauuguuuuaagguguauuaau

SEQ ID NO: 55148 - RNA, 22 nt, Human
ugcauucugaacguaaauguga

SEQ ID NO: 55149 - RNA, 22 nt, Human
ccccauggaaaacccaccuagg

SEQ ID NO: 55150 - RNA, 22 nt, Human
guccccugcguguucauccugg

SEQ ID NO: 55151 - RNA, 22 nt, Human
aaaauauguugagauacugaaa

SEQ ID NO: 55152 - RNA, 22 nt, Human
gaggaugacaaagaaggcagac

SEQ ID NO: 55153 - RNA, 22 nt, Human
ggaaggggagcuggaaagggua

SEQ ID NO: 55154 - RNA, 22 nt, Human
uauuuuuacuguuugaugauuc

SEQ ID NO: 55155 - RNA, 22 nt, Human
uuauuugcccauguuuagcaga

SEQ ID NO: 55156 - RNA, 22 nt, Human
uuguuauuauuauuuucguucu

SEQ ID NO: 55157 - RNA, 22 nt, Human
guuuaaaagcaaccaacaggcu

SEQ ID NO: 55158 - RNA, 22 nt, Human
uuauaucagaaggugagauuga

SEQ ID NO: 55159 - RNA, 22 nt, Human
gaacucuugguggucauuagau

SEQ ID NO: 55160 - RNA, 22 nt, Human
uauauacacgcacauauacaua

SEQ ID NO: 55161 - RNA, 22 nt, Human
ugauucaguacuuucucuaacu

SEQ ID NO: 55162 - RNA, 22 nt, Human
uuauauuuuauuuaauuaaaua

SEQ ID NO: 55163 - RNA, 22 nt, Human
aacugcauaagcuucgggaccu

SEQ ID NO: 55164 - RNA, 22 nt, Human
gaggcagaggaugggacuguau

SEQ ID NO: 55165 - RNA, 22 nt, Human
uauauaauacacaaauauguac

SEQ ID NO: 55166 - RNA, 22 nt, Human
aggggaagagugagguuuuggu

SEQ ID NO: 55167 - RNA, 22 nt, Human
agcagggagacagugcagcauu

SEQ ID NO: 55168 - RNA, 22 nt, Human
cuaaauuuuuuagugaaauagg

SEQ ID NO: 55169 - RNA, 22 nt, Human
uaccuggauaaauguacaaccg

SEQ ID NO: 55170 - RNA, 22 nt, Human
cuucuuaaaguugucacagcug

SEQ ID NO: 55171 - RNA, 22 nt, Human
uuuucucaguuuuuuucaaaag

SEQ ID NO: 55172 - RNA, 22 nt, Human
uguccuuuauauguuuuuuagu

SEQ ID NO: 55173 - RNA, 22 nt, Human
gcuguggagaagcugccuaugg

SEQ ID NO: 55174 - RNA, 22 nt, Human
guucuucagcccucagguccua

SEQ ID NO: 55175 - RNA, 22 nt, Human
uuaaaauuguuaacuuugguga

SEQ ID NO: 55176 - RNA, 23 nt, Human
uugcuuuugccccaaaagaguua

SEQ ID NO: 55177 - RNA, 22 nt, Human
cuauguuucagauauauauaua

SEQ ID NO: 55178 - RNA, 22 nt, Human
aggcauauaguguuuaaaaaaa

SEQ ID NO: 55179 - RNA, 22 nt, Human
ggagcagaggaaagaguagcau

SEQ ID NO: 55180 - RNA, 22 nt, Human
uauccaaaggaacaaucacagc

SEQ ID NO: 55181 - RNA, 17 nt, Human
ccacuagauagguugug

SEQ ID NO: 55182 - RNA, 22 nt, Human
uccauuuacuauucucauaucg

SEQ ID NO: 55183 - RNA, 22 nt, Human
ugagaaaacaguuuguaauaau

SEQ ID NO: 55184 - RNA, 22 nt, Human
cuucuuuuggggaugaaaaugg

SEQ ID NO: 55185 - RNA, 22 nt, Human
uuauuuuauaaagagaagacuu

SEQ ID NO: 55186 - RNA, 22 nt, Human
aagaguggagcuggaaaguggg

SEQ ID NO: 55187 - RNA, 22 nt, Human
uucagaauguacugauagaaca

SEQ ID NO: 55188 - RNA, 22 nt, Human
aaugaauaaauuuuaaagacag

SEQ ID NO: 55189 - RNA, 22 nt, Human
uuuuacaaugcaaauucuugcu

SEQ ID NO: 55190 - RNA, 22 nt, Human
aggcaguguguagcuggaagag

SEQ ID NO: 55191 - RNA, 20 nt, Human
uggaugacuucaggcagccu

SEQ ID NO: 55192 - RNA, 22 nt, Human
auuuuauuuugggaucuuuuua

SEQ ID NO: 55193 - RNA, 22 nt, Human
ggcagaggagcuggaaacaugg

SEQ ID NO: 55194 - RNA, 22 nt, Human
auacauauaugcacauuaauau

SEQ ID NO: 55195 - RNA, 22 nt, Human
uuuauguuuguuuuugaaauaa

SEQ ID NO: 55196 - RNA, 21 nt, Human
uuucauuaguacaucaauuug

SEQ ID NO: 55197 - RNA, 16 nt, Human
gaauuccauugcucug

SEQ ID NO: 55198 - RNA, 22 nt, Human
acauuuuaaaaacaguaccugg

SEQ ID NO: 55199 - RNA, 22 nt, Human
uuauuuuuaggaauguagaggu

SEQ ID NO: 55200 - RNA, 22 nt, Human
uggacagugguggggaggagga

SEQ ID NO: 55201 - RNA, 22 nt, Human
ucucucucucuuccagcauguu

SEQ ID NO: 55202 - RNA, 22 nt, Human
aauauuuugggacugaggaauu

SEQ ID NO: 55203 - RNA, 22 nt, Human
uuuuaaaacaugucaaaaugug

SEQ ID NO: 55204 - RNA, 22 nt, Human
aaauucagauggcuuucuuuuc

SEQ ID NO: 55205 - RNA, 22 nt, Human
uacuauuuugacaugaaauuga

SEQ ID NO: 55206 - RNA, 22 nt, Human
guuuccaggcuuugguaugguu

SEQ ID NO: 55207 - RNA, 22 nt, Human
auuuuugugucacaucuaggaa

SEQ ID NO: 55208 - RNA, 22 nt, Human
uuuuuuguggcuggaagaaaaa

SEQ ID NO: 55209 - RNA, 22 nt, Human
gucuuuguaguuuuaauuugag

SEQ ID NO: 55210 - RNA, 22 nt, Human
agcaggaaggcuagaagcagga

SEQ ID NO: 55211 - RNA, 22 nt, Human
ucacugaacucucauagagaaa

SEQ ID NO: 55212 - RNA, 22 nt, Human
gcuuauuagguuauuucaagga

SEQ ID NO: 55213 - RNA, 22 nt, Human
auaucugaugacgugacuaugu

SEQ ID NO: 55214 - RNA, 22 nt, Human
gggaggcagacgcuggagccca

SEQ ID NO: 55215 - RNA, 22 nt, Human
uaaaaucaugacagauugacau

SEQ ID NO: 55216 - RNA, 22 nt, Human
ugcuuucaaugaauuguauacu

SEQ ID NO: 55217 - RNA, 22 nt, Human
aaugauuuucugcaaacaguga

SEQ ID NO: 55218 - RNA, 22 nt, Human
uucaaaaugcagaauaguuugg

SEQ ID NO: 55219 - RNA, 22 nt, Human
uagcugucauuggaucagaagg

SEQ ID NO: 55220 - RNA, 22 nt, Human
aaauauagugacacuuauaguc

SEQ ID NO: 55221 - RNA, 22 nt, Human
acaauaauguuuuuagguuauu

SEQ ID NO: 55222 - RNA, 23 nt, Human
uucuuuccuuaucccauuuacuu

SEQ ID NO: 55223 - RNA, 22 nt, Human
uuuccuaggaaaugauugaagu

SEQ ID NO: 55224 - RNA, 22 nt, Human
uuuaaaauguuuuauuuauuua

SEQ ID NO: 55225 - RNA, 22 nt, Human
auauauguauauaugugugugu

SEQ ID NO: 55226 - RNA, 22 nt, Human
aacccugaacuuaguucuagga

SEQ ID NO: 55227 - RNA, 22 nt, Human
uuaucaaaaaauaguacuuuga

SEQ ID NO: 55228 - RNA, 22 nt, Human
ucuucaugaaauugauugcuua

SEQ ID NO: 55229 - RNA, 22 nt, Human
ggaaguggauucagggcugcua

SEQ ID NO: 55230 - RNA, 22 nt, Human
guucuucagauuccauuucagu

SEQ ID NO: 55231 - RNA, 22 nt, Human
uucauaugaauuggguuuuuuu

SEQ ID NO: 55232 - RNA, 22 nt, Human
cagaccuggaaaacaggcuugc

SEQ ID NO: 55233 - RNA, 22 nt, Human
auauaguuggguuucauucuac

SEQ ID NO: 55234 - RNA, 22 nt, Human
guuauuuugucuuguucaugaa

SEQ ID NO: 55235 - RNA, 22 nt, Human
uucacugugauugggguggauu

SEQ ID NO: 55236 - RNA, 22 nt, Human
ucacucuuuaucuuuuaugucu

SEQ ID NO: 55237 - RNA, 22 nt, Human
ggaggaagagaccagggggcuu

SEQ ID NO: 55238 - RNA, 22 nt, Human
uguuuuuauucuuaauguuuca

SEQ ID NO: 55239 - RNA, 22 nt, Human
uaugugaaauggaauauagaaa

SEQ ID NO: 55240 - RNA, 22 nt, Human
uucauuagcacauuuccuuggu

SEQ ID NO: 55241 - RNA, 22 nt, Human
aaaugcuuuaauugaguucaug

SEQ ID NO: 55242 - RNA, 22 nt, Human
aggaaauaggaccagacaaagc

SEQ ID NO: 55243 - RNA, 22 nt, Human
uuuaaauaguugguuuuuuugc

SEQ ID NO: 55244 - RNA, 22 nt, Human
uagacauuuacuuugaaaaaau

SEQ ID NO: 55245 - RNA, 23 nt, Human
uggaaguugagagucugcuuugu

SEQ ID NO: 55246 - RNA, 22 nt, Human
auaucuaggcugaauguaaaau

SEQ ID NO: 55247 - RNA, 22 nt, Human
ucuuuuucccugguuccuuuuu

SEQ ID NO: 55248 - RNA, 22 nt, Human
ggggaggaagcuggaacacggg

SEQ ID NO: 55249 - RNA, 22 nt, Human
ucuuuauuucccuaacuugcua

SEQ ID NO: 55250 - RNA, 22 nt, Human
uucaaacaguguagaauauaug

SEQ ID NO: 55251 - RNA, 22 nt, Human
aaggggaauaguaggaccuggg

SEQ ID NO: 55252 - RNA, 22 nt, Human
uaguauuuguaauuaucaaagc

SEQ ID NO: 55253 - RNA, 22 nt, Human
agaaacaagcccuagaaguccu

SEQ ID NO: 55254 - RNA, 22 nt, Human
ucuucaaauacagucauauuga

SEQ ID NO: 55255 - RNA, 22 nt, Human
aauuucagaccaacgagucagg

SEQ ID NO: 55256 - RNA, 22 nt, Human
ggggacggcuggccggggcccc

SEQ ID NO: 55257 - RNA, 22 nt, Human
uauauuaaagugcuuugcagug

SEQ ID NO: 55258 - RNA, 22 nt, Human
uggaagggagcuggaauuugga

SEQ ID NO: 55259 - RNA, 22 nt, Human
agggacuugugucuguguuuuu

SEQ ID NO: 55260 - RNA, 20 nt, Human
cuuauuuuggagaacuuuuc

SEQ ID NO: 55261 - RNA, 22 nt, Human
ugggaagaggaggcagggggca

SEQ ID NO: 55262 - RNA, 22 nt, Human
uuauuuuuguaacacuguauag

SEQ ID NO: 55263 - RNA, 22 nt, Human
uaauuuagugcauuuccuagua

SEQ ID NO: 55264 - RNA, 22 nt, Human
gaaaaauggguuguuugaagau

SEQ ID NO: 55265 - RNA, 22 nt, Human
aaucauaacaaaagcaauuaua

SEQ ID NO: 55266 - RNA, 22 nt, Human
gaagaaggaagaucaugcuuga

SEQ ID NO: 55267 - RNA, 22 nt, Human
augggagggagcagugaguguu

SEQ ID NO: 55268 - RNA, 21 nt, Human
cugugggaaggccugaggucu

SEQ ID NO: 55269 - RNA, 22 nt, Human
uaaaugauaguauugaagguag

SEQ ID NO: 55270 - RNA, 22 nt, Human
cuucuucaucuuuuggaggaac

SEQ ID NO: 55271 - RNA, 22 nt, Human
ugagauguaauguaguacuuug

SEQ ID NO: 55272 - RNA, 22 nt, Human
aagugaggagaccucuucuuca

SEQ ID NO: 55273 - RNA, 22 nt, Human
uugccaggagacaucuggagcc

SEQ ID NO: 55274 - RNA, 22 nt, Human
uggaagugucagcaggcugguu

SEQ ID NO: 55275 - RNA, 22 nt, Human
auaaaaauguuuuuguguggua

SEQ ID NO: 55276 - RNA, 22 nt, Human
uucuucuuuccuauaauuaauu

SEQ ID NO: 55277 - RNA, 22 nt, Human
ugaaugaacugaugaacuuaac

SEQ ID NO: 55278 - RNA, 19 nt, Human
uagaggagaauggcaaaga

SEQ ID NO: 55279 - RNA, 22 nt, Human
ucuucaucucuaaaaugggaac

SEQ ID NO: 55280 - RNA, 22 nt, Human
cagcuccagcccaggcagcucc

SEQ ID NO: 55281 - RNA, 22 nt, Human
aagcucuuuccacuaaaccacu

SEQ ID NO: 55282 - RNA, 22 nt, Human
agagcagauggagcuggaagag

SEQ ID NO: 55283 - RNA, 22 nt, Human
auuuucuucauuuugauuguau

SEQ ID NO: 55284 - RNA, 22 nt, Human
uuuugcuucuaguauauuuuuu

SEQ ID NO: 55285 - RNA, 22 nt, Human
agcaaaauuccaaaaugcuaau

SEQ ID NO: 55286 - RNA, 22 nt, Human
ucucuucacuuguaugcuauca

SEQ ID NO: 55287 - RNA, 22 nt, Human
uuuacaaggcaguuauuuuccu

SEQ ID NO: 55288 - RNA, 22 nt, Human
ugauucacagacuucacaaggc

SEQ ID NO: 55289 - RNA, 22 nt, Human
cagaaaaaaaugcagacuagca

SEQ ID NO: 55290 - RNA, 22 nt, Human
uuuuagaagcauuuaugagauu

SEQ ID NO: 55291 - RNA, 22 nt, Human
guuauuguuauugcguugucga

SEQ ID NO: 55292 - RNA, 22 nt, Human
auggacagcucuuaugugggca

SEQ ID NO: 55293 - RNA, 17 nt, Human
uuuguuucauacuucau

SEQ ID NO: 55294 - RNA, 22 nt, Human
uacauuugauuuuugcuucuuu

SEQ ID NO: 55295 - RNA, 22 nt, Human
agacuguuuucccaucucuugg

SEQ ID NO: 55296 - RNA, 22 nt, Human
ccuuuuaucgcgaagaacucca

SEQ ID NO: 55297 - RNA, 22 nt, Human
aaugcuuuuugcgaaaugugca

SEQ ID NO: 55298 - RNA, 22 nt, Human
uuaucuuuuaaaaacacuugug

SEQ ID NO: 55299 - RNA, 22 nt, Human
guuuucuccugcuauacagugc

SEQ ID NO: 55300 - RNA, 22 nt, Human
uggaugagugaauggauaaauc

SEQ ID NO: 55301 - RNA, 22 nt, Human
gcuuucacugcaauagaugaau

SEQ ID NO: 55302 - RNA, 22 nt, Human
ugucuuuuaaaaauguguaaaa

SEQ ID NO: 55303 - RNA, 22 nt, Human
ugcuuucagauaucuguuucaa

SEQ ID NO: 55304 - RNA, 22 nt, Human
uuguuauaggaucagugucacu

SEQ ID NO: 55305 - RNA, 20 nt, Human
cauuccaugcaucuuggucc

SEQ ID NO: 55306 - RNA, 22 nt, Human
acuuuauacuagugauaguuug

SEQ ID NO: 55307 - RNA, 22 nt, Human
gugacugagcuggcaaaguaug

SEQ ID NO: 55308 - RNA, 22 nt, Human
aucacuagaguuacauugccag

SEQ ID NO: 55309 - RNA, 22 nt, Human
uauuuaaagucagcaacuuuuc

SEQ ID NO: 55310 - RNA, 23 nt, Human
uuucugaguuuuuuaaaagucca

SEQ ID NO: 55311 - RNA, 18 nt, Human
gagaggcauuuagcugau

SEQ ID NO: 55312 - RNA, 22 nt, Human
auuuccagcagcauauuugucu

SEQ ID NO: 55313 - RNA, 22 nt, Human
uuucuaaaaccagaguuuauaa

SEQ ID NO: 55314 - RNA, 22 nt, Human
ugggcagggagcuggaaccaca

SEQ ID NO: 55315 - RNA, 22 nt, Human
agucugugguccucuguaucuc

SEQ ID NO: 55316 - RNA, 22 nt, Human
uuuuccuuccugucucuuuauu

SEQ ID NO: 55317 - RNA, 23 nt, Human
cagagaaaauagaauaugcugug

SEQ ID NO: 55318 - RNA, 22 nt, Human
acuugcauuguguaguguuuuu

SEQ ID NO: 55319 - RNA, 22 nt, Human
cagaaauuggcagagaagaccu

SEQ ID NO: 55320 - RNA, 22 nt, Human
gaauauuuaucucagcugcaga

SEQ ID NO: 55321 - RNA, 22 nt, Human
caggaagucugaauucugagag

SEQ ID NO: 55322 - RNA, 23 nt, Human
uuugaaucauuguggggcuuuug

SEQ ID NO: 55323 - RNA, 22 nt, Human
uaguuucuucaacugucccagc

SEQ ID NO: 55324 - RNA, 22 nt, Human
auagaaauagacaaugcaaaga

SEQ ID NO: 55325 - RNA, 22 nt, Human
augggaggguagagugaacaga

SEQ ID NO: 55326 - RNA, 22 nt, Human
uucuuuuaauagagauccugug

SEQ ID NO: 55327 - RNA, 22 nt, Human
acucauuuggauuuuggaguuu

SEQ ID NO: 55328 - RNA, 22 nt, Human
uucuugucuuuguuauguagga

SEQ ID NO: 55329 - RNA, 22 nt, Human
uuaaaagaauccuguuauccuc

SEQ ID NO: 55330 - RNA, 20 nt, Human
ucucuuuuucuucuuuucuc

SEQ ID NO: 55331 - RNA, 22 nt, Human
aucuucuuucaucagccccuca

SEQ ID NO: 55332 - RNA, 22 nt, Human
ggcagcagaaccaacuguggcu

SEQ ID NO: 55333 - RNA, 22 nt, Human
gaaggggacuccauggaaugau

SEQ ID NO: 55334 - RNA, 22 nt, Human
ugagagaggugaaaugacuuuc

SEQ ID NO: 55335 - RNA, 22 nt, Human
gaugggaggaugaauuggaccu

SEQ ID NO: 55336 - RNA, 22 nt, Human
uuuuaaaguaauugaagcuugu

SEQ ID NO: 55337 - RNA, 19 nt, Human
ggacuuaggcagacuaauu

SEQ ID NO: 55338 - RNA, 22 nt, Human
uuuuauaauacccuugacuaau

SEQ ID NO: 55339 - RNA, 22 nt, Human
uuauuuuuguuuguuaagccua

SEQ ID NO: 55340 - RNA, 22 nt, Human
uggaagggguuacgcagcagga

SEQ ID NO: 55341 - RNA, 22 nt, Human
aaauuuuguugaaaaauauuuu

SEQ ID NO: 55342 - RNA, 22 nt, Human
uucuucuucuuccucauccuca

SEQ ID NO: 55343 - RNA, 22 nt, Human
uuguuuuaguagaaguuacaug

SEQ ID NO: 55344 - RNA, 22 nt, Human
ugcagcuuuugguuucuagaug

SEQ ID NO: 55345 - RNA, 22 nt, Human
auugcaggucguguggaaguga

SEQ ID NO: 55346 - RNA, 22 nt, Human
auacaucuuaacgcgcucuugg

SEQ ID NO: 55347 - RNA, 22 nt, Human
augaaaacgugugugugugugu

SEQ ID NO: 55348 - RNA, 22 nt, Human
gaaaagcucuuuagaagagguu

SEQ ID NO: 55349 - RNA, 22 nt, Human
aggaauuugggguuacaugaug

SEQ ID NO: 55350 - RNA, 22 nt, Human
auguuccaugacuaugcaugaa

SEQ ID NO: 55351 - RNA, 22 nt, Human
uuaaacauuuccacuugccagu

SEQ ID NO: 55352 - RNA, 22 nt, Human
uugaaaauuaauagguguacaa

SEQ ID NO: 55353 - RNA, 22 nt, Human
ucauuauuuugauguauuuccu

SEQ ID NO: 55354 - RNA, 20 nt, Human
aauaaauauaacccauaauu

SEQ ID NO: 55355 - RNA, 22 nt, Human
uuuaugucaaaaguaaaaugaa

SEQ ID NO: 55356 - RNA, 22 nt, Human
uuuauaauuacguaaaauauuu

SEQ ID NO: 55357 - RNA, 22 nt, Human
uauuucaguuaagaugagguca

SEQ ID NO: 55358 - RNA, 22 nt, Human
acugucuuguuguaugugagcu

SEQ ID NO: 55359 - RNA, 20 nt, Human
cucuuuaugagaccacuguc

SEQ ID NO: 55360 - RNA, 22 nt, Human
ggcagagguagcuggaaccagg

SEQ ID NO: 55361 - RNA, 22 nt, Human
guuguuuuuguuaaaacaguga

SEQ ID NO: 55362 - RNA, 22 nt, Human
auuuucuugucucuguuguagg

SEQ ID NO: 55363 - RNA, 22 nt, Human
auguaugagagauucuuuuauu

SEQ ID NO: 55364 - RNA, 22 nt, Human
aaugaaaaucugucaguucaag

SEQ ID NO: 55365 - RNA, 18 nt, Human
acaaaaauagugcuuugg

SEQ ID NO: 55366 - RNA, 22 nt, Human
uuuuuuccuguuugucuuuggg

SEQ ID NO: 55367 - RNA, 22 nt, Human
ucauacuuuuuugacccuugug

SEQ ID NO: 55368 - RNA, 22 nt, Human
cagggacugcaggaggacaggu

SEQ ID NO: 55369 - RNA, 22 nt, Human
uauaagaaaagucauuaucaaa

SEQ ID NO: 55370 - RNA, 22 nt, Human
ggcuguggcagcuggaaguggu

SEQ ID NO: 55371 - RNA, 22 nt, Human
uaaaaaccuuguauuuaacucu

SEQ ID NO: 55372 - RNA, 22 nt, Human
acuuuuccuggguagcuccugg

SEQ ID NO: 55373 - RNA, 20 nt, Human
gagaauuccagguuucugug

SEQ ID NO: 55374 - RNA, 22 nt, Human
ucuggggaugagugaugucgua

SEQ ID NO: 55375 - RNA, 22 nt, Human
ucauuguuucugcuuuucauga

SEQ ID NO: 55376 - RNA, 22 nt, Human
aaauuaaaguuuuauuuagagc

SEQ ID NO: 55377 - RNA, 22 nt, Human
augcaaaaucuuauuuuuucua

SEQ ID NO: 55378 - RNA, 22 nt, Human
aauucuguugguuagaguugga

SEQ ID NO: 55379 - RNA, 22 nt, Human
cuucuuuucuacuggccuagaa

SEQ ID NO: 55380 - RNA, 22 nt, Human
uuauuccauagaagucaaggaa

SEQ ID NO: 55381 - RNA, 22 nt, Human
uagacugugagcuccuugaggg

SEQ ID NO: 55382 - RNA, 22 nt, Human
uauuuguauugucuuaucacuu

SEQ ID NO: 55383 - RNA, 22 nt, Human
aguuuccacuggagacacugug

SEQ ID NO: 55384 - RNA, 22 nt, Human
aaaauauaaaggauguggguuu

SEQ ID NO: 55385 - RNA, 23 nt, Human
aggcagcaugcaacaggccauuu

SEQ ID NO: 55386 - RNA, 22 nt, Human
cuaaauucuauauccuugcuuc

SEQ ID NO: 55387 - RNA, 22 nt, Human
uugaaucauauguaauugacuu

SEQ ID NO: 55388 - RNA, 22 nt, Human
augaaaacggaccagagcuauu

SEQ ID NO: 55389 - RNA, 22 nt, Human
uauaaagaccuuauccuucaua

SEQ ID NO: 55390 - RNA, 22 nt, Human
ccuaggcuggcugucuucaggu

SEQ ID NO: 55391 - RNA, 22 nt, Human
auuuuucuuucacauuuucuua

SEQ ID NO: 55392 - RNA, 22 nt, Human
uauuuuagccaacagaaugaug

SEQ ID NO: 55393 - RNA, 22 nt, Human
auuguuuugugaaacauaguga

SEQ ID NO: 55394 - RNA, 22 nt, Human
ugaggaggugcuaccagcgucu

SEQ ID NO: 55395 - RNA, 22 nt, Human
aaauguuucauucuauuuuuag

SEQ ID NO: 55396 - RNA, 22 nt, Human
caaauguuugguggcauuuugu

SEQ ID NO: 55397 - RNA, 22 nt, Human
cuccccuuauuccucaacauga

SEQ ID NO: 55398 - RNA, 22 nt, Human
ucauuguuuacugucuuuuuuc

SEQ ID NO: 55399 - RNA, 17 nt, Human
ugucuuuuuccuccucc

SEQ ID NO: 55400 - RNA, 22 nt, Human
auuaaaaaaagauaaugaguua

SEQ ID NO: 55401 - RNA, 22 nt, Human
ccagcaugcucagucuaaauug

SEQ ID NO: 55402 - RNA, 22 nt, Human
auuuuugguuucaccugcacgc

SEQ ID NO: 55403 - RNA, 22 nt, Human
uguagcucaaggaauuguucuc

SEQ ID NO: 55404 - RNA, 22 nt, Human
gcuggaaauaacuuguguagaa

SEQ ID NO: 55405 - RNA, 22 nt, Human
uuauuucauguaaaauuuaugu

SEQ ID NO: 55406 - RNA, 20 nt, Human
uugauucacaaaaagcuuag

SEQ ID NO: 55407 - RNA, 22 nt, Human
cagcuuguucugaccugugauu

SEQ ID NO: 55408 - RNA, 22 nt, Human
uugccaggggacaucuggagcc

SEQ ID NO: 55409 - RNA, 22 nt, Human
aauaucuugaguuauaaauuca

SEQ ID NO: 55410 - RNA, 22 nt, Human
uggaaguggcaggggagacgua

SEQ ID NO: 55411 - RNA, 22 nt, Human
guuuucuuguuaauuuugaacg

SEQ ID NO: 55412 - RNA, 22 nt, Human
agagcuccaggguuuuguagug

SEQ ID NO: 55413 - RNA, 22 nt, Human
uucauagaagggaguuuuuccu

SEQ ID NO: 55414 - RNA, 22 nt, Human
caacuucuauucagucugcagu

SEQ ID NO: 55415 - RNA, 22 nt, Human
cuagcacagugcuuggcacaca

SEQ ID NO: 55416 - RNA, 22 nt, Human
uccaugaguuuuuuaguuucac

SEQ ID NO: 55417 - RNA, 22 nt, Human
cucuggggaagugcacucgcug

SEQ ID NO: 55418 - RNA, 19 nt, Human
agugaacuccauaucaggu

SEQ ID NO: 55419 - RNA, 19 nt, Human
augaaauagcauuuucuga

SEQ ID NO: 55420 - RNA, 22 nt, Human
ugcuuggagaaucagucccagc

SEQ ID NO: 55421 - RNA, 22 nt, Human
gugucccaaagauuagaaauca

SEQ ID NO: 55422 - RNA, 22 nt, Human
agaauaagucuaauauauuggu

SEQ ID NO: 55423 - RNA, 22 nt, Human
uugucuuucguauggaacacua

SEQ ID NO: 55424 - RNA, 22 nt, Human
uucuuuuaauuucugucugcag

SEQ ID NO: 55425 - RNA, 22 nt, Human
gaauuccaggugagagaaggua

SEQ ID NO: 55426 - RNA, 22 nt, Human
ucuguucaugucuuuuuaagug

SEQ ID NO: 55427 - RNA, 21 nt, Human
uccccugugccuggcauacag

SEQ ID NO: 55428 - RNA, 20 nt, Human
aaccuauuguaauauucuaa

SEQ ID NO: 55429 - RNA, 22 nt, Human
acauuugauauggaguugugua

SEQ ID NO: 55430 - RNA, 22 nt, Human
ugaggaagugguuguaugguuu

SEQ ID NO: 55431 - RNA, 20 nt, Human
gaacauaaauaacucuuuac

SEQ ID NO: 55432 - RNA, 22 nt, Human
agcagggagaccaucucuuccu

SEQ ID NO: 55433 - RNA, 22 nt, Human
aacgagcugggggggccggggg

SEQ ID NO: 55434 - RNA, 22 nt, Human
aaggcuguuugagcacuggagc

SEQ ID NO: 55435 - RNA, 22 nt, Human
aaugcugaaugcauguuuccau

SEQ ID NO: 55436 - RNA, 22 nt, Human
aaauucagcagguuucaaaagc

SEQ ID NO: 55437 - RNA, 22 nt, Human
uuuuaaauaaacuacacugauu

SEQ ID NO: 55438 - RNA, 22 nt, Human
ucgagcucagcagggaggugcg

SEQ ID NO: 55439 - RNA, 22 nt, Human
uauuuucucugccacacuucca

SEQ ID NO: 55440 - RNA, 22 nt, Human
aaauauugaauuugaggaugua

SEQ ID NO: 55441 - RNA, 22 nt, Human
aggugcagcugguggagucugg

SEQ ID NO: 55442 - RNA, 22 nt, Human
caaaaauacuugccuguaucug

SEQ ID NO: 55443 - RNA, 22 nt, Human
ggcacaggcugguaccaguuca

SEQ ID NO: 55444 - RNA, 22 nt, Human
guuaaaaugauuugugauuuau

SEQ ID NO: 55445 - RNA, 18 nt, Human
auucauuugcguuuggcu

SEQ ID NO: 55446 - RNA, 22 nt, Human
aucuaaaacuacgaauacuacc

SEQ ID NO: 55447 - RNA, 22 nt, Human
uauuucuagggcaugaaaauaa

SEQ ID NO: 55448 - RNA, 22 nt, Human
uauuuuuuuaacauuuauugua

SEQ ID NO: 55449 - RNA, 22 nt, Human
ucuguucacaauuacacacacu

SEQ ID NO: 55450 - RNA, 22 nt, Human
uguacauacauagauauacaca

SEQ ID NO: 55451 - RNA, 22 nt, Human
guuguuuucagcccagcauuag

SEQ ID NO: 55452 - RNA, 22 nt, Human
cucacugugggcuaugaauggg

SEQ ID NO: 55453 - RNA, 22 nt, Human
uucacuuuuucucugcuugaga

SEQ ID NO: 55454 - RNA, 22 nt, Human
auagagcuggggaagaagcugg

SEQ ID NO: 55455 - RNA, 22 nt, Human
uaauauaacugccaguuaaggu

SEQ ID NO: 55456 - RNA, 22 nt, Human
caaugaaaauuuaaguugcagc

SEQ ID NO: 55457 - RNA, 22 nt, Human
ucuguucagaagaggugaaagu

SEQ ID NO: 55458 - RNA, 22 nt, Human
uuuuucuccucucucuuucauu

SEQ ID NO: 55459 - RNA, 22 nt, Human
uuuuccuucuuccugccuugcc

SEQ ID NO: 55460 - RNA, 22 nt, Human
ugcuuucaaaacucagaggaau

SEQ ID NO: 55461 - RNA, 22 nt, Human
uucacuguucuuagagaagacc

SEQ ID NO: 55462 - RNA, 22 nt, Human
uuuucucuuugcuucucuaaaa

SEQ ID NO: 55463 - RNA, 22 nt, Human
uaauaaaaauuuaauucacauu

SEQ ID NO: 55464 - RNA, 22 nt, Human
aaaauacuaggaaaauaaauca

SEQ ID NO: 55465 - RNA, 22 nt, Human
uccugaaugguguaauagguuu

SEQ ID NO: 55466 - RNA, 22 nt, Human
aaauguuugguggauaaaagga

SEQ ID NO: 55467 - RNA, 17 nt, Human
auucaugaacauguccu

SEQ ID NO: 55468 - RNA, 22 nt, Human
cugcaucacagcaggaggcaca

SEQ ID NO: 55469 - RNA, 22 nt, Human
uuauuuaagaucuuaauauaua

SEQ ID NO: 55470 - RNA, 22 nt, Human
caaaaaauccauagaaagaggu

SEQ ID NO: 55471 - RNA, 22 nt, Human
aggcaguguggagggcuguugc

SEQ ID NO: 55472 - RNA, 22 nt, Human
uuacuuuuuucccccuuagaug

SEQ ID NO: 55473 - RNA, 22 nt, Human
gauuuuaaaagauguauaaggu

SEQ ID NO: 55474 - RNA, 22 nt, Human
ggagaagaggagcuggaagccu

SEQ ID NO: 55475 - RNA, 22 nt, Human
auuuuacuaugauaguugagaa

SEQ ID NO: 55476 - RNA, 22 nt, Human
ugagguauuuggauuuauauuu

SEQ ID NO: 55477 - RNA, 22 nt, Human
aagugugugugcgcaugugcau

SEQ ID NO: 55478 - RNA, 22 nt, Human
ggcagucuuucccuugagcucu

SEQ ID NO: 55479 - RNA, 17 nt, Human
auuguuuuuaauuugca

SEQ ID NO: 55480 - RNA, 22 nt, Human
augaagguggacagauuuuuuu

SEQ ID NO: 55481 - RNA, 22 nt, Human
guaagaauauacccaggaguca

SEQ ID NO: 55482 - RNA, 22 nt, Human
ugcuuggauuuccaaaugguuu

SEQ ID NO: 55483 - RNA, 22 nt, Human
ucuuuuaucuguuguguaacaa

SEQ ID NO: 55484 - RNA, 22 nt, Human
uguuuucuuuccccuucuuuuc

SEQ ID NO: 55485 - RNA, 22 nt, Human
aaggaacuucagggcgaaugga

SEQ ID NO: 55486 - RNA, 22 nt, Human
uuauuuaaguauuuauugaagu

SEQ ID NO: 55487 - RNA, 22 nt, Human
auaaaucaagggcaguauuucc

SEQ ID NO: 55488 - RNA, 22 nt, Human
auuucacucuuaauugcuuccu

SEQ ID NO: 55489 - RNA, 22 nt, Human
uaaaugaaaugaagugaaagcu

SEQ ID NO: 55490 - RNA, 22 nt, Human
uuuguuugcugagugaauucaa

SEQ ID NO: 55491 - RNA, 22 nt, Human
aguaaaugaaagcaauuuuaga

SEQ ID NO: 55492 - RNA, 22 nt, Human
aaaacauuuaggguuuuuuuua

SEQ ID NO: 55493 - RNA, 22 nt, Human
uuuucaauuuucauuugcaaga

SEQ ID NO: 55494 - RNA, 22 nt, Human
uguauuuuuucccugaaauaaa

SEQ ID NO: 55495 - RNA, 22 nt, Human
cauaggcucuucagagaacuga

SEQ ID NO: 55496 - RNA, 22 nt, Human
auucuuuauuuucuguacuugc

SEQ ID NO: 55497 - RNA, 22 nt, Human
cuuuuuuucuccauauuucugg

SEQ ID NO: 55498 - RNA, 22 nt, Human
ccagaugggggcugugggaggg

SEQ ID NO: 55499 - RNA, 22 nt, Human
uuuuuaaaagaugauuuaauga

SEQ ID NO: 55500 - RNA, 22 nt, Human
ccagucuuggugucuguagcac

SEQ ID NO: 55501 - RNA, 20 nt, Human
agugauuuguuaguacauug

SEQ ID NO: 55502 - RNA, 22 nt, Human
gcacaaaagguacuucauguag

SEQ ID NO: 55503 - RNA, 22 nt, Human
aauaagaguuaagaaguauauu

SEQ ID NO: 55504 - RNA, 20 nt, Human
ugauuauuccaacaagaaug

SEQ ID NO: 55505 - RNA, 22 nt, Human
uacuuuaauugcaaaaauaaau

SEQ ID NO: 55506 - RNA, 22 nt, Human
uucuuuucuucccuguuuauua

SEQ ID NO: 55507 - RNA, 22 nt, Human
uagcacauaguaggcacaggcu

SEQ ID NO: 55508 - RNA, 22 nt, Human
uuucacugaguaggagagcacu

SEQ ID NO: 55509 - RNA, 22 nt, Human
aggcaguggagcuggaauaggc

SEQ ID NO: 55510 - RNA, 22 nt, Human
uucacugugauguuuaagagaa

SEQ ID NO: 55511 - RNA, 22 nt, Human
aucguuaugauagagaaagaga

SEQ ID NO: 55512 - RNA, 22 nt, Human
uuucagaaauggcacugaaauc

SEQ ID NO: 55513 - RNA, 22 nt, Human
ugaguugcagucaauauugcaa

SEQ ID NO: 55514 - RNA, 22 nt, Human
agauggggccugaggacacugu

SEQ ID NO: 55515 - RNA, 22 nt, Human
aauguaaauaauuguaaaauuu

SEQ ID NO: 55516 - RNA, 22 nt, Human
auuuucauauggguuauuugua

SEQ ID NO: 55517 - RNA, 22 nt, Human
uccauguauugcuaacaaauag

SEQ ID NO: 55518 - RNA, 22 nt, Human
uauuuuuaccuaauuuaugaga

SEQ ID NO: 55519 - RNA, 22 nt, Human
auucuucauguugaagcuguca

SEQ ID NO: 55520 - RNA, 22 nt, Human
gacaagaagaacggagguuuca

SEQ ID NO: 55521 - RNA, 22 nt, Human
cauuucaaacaguuacagcugc

SEQ ID NO: 55522 - RNA, 22 nt, Human
uucacccuucucuggcuuucag

SEQ ID NO: 55523 - RNA, 22 nt, Human
gcauaauauugagaaauuauua

SEQ ID NO: 55524 - RNA, 22 nt, Human
acagugugcaagaaauggggga

SEQ ID NO: 55525 - RNA, 22 nt, Human
agcacagugccugacauauaug

SEQ ID NO: 55526 - RNA, 22 nt, Human
ugaaauuuuuuggagauaauuu

SEQ ID NO: 55527 - RNA, 22 nt, Human
aauuauguugaaauaugagaac

SEQ ID NO: 55528 - RNA, 22 nt, Human
guaaauaucucacgaaugauuc

SEQ ID NO: 55529 - RNA, 22 nt, Human
aggaagaagggacagaauuuug

SEQ ID NO: 55530 - RNA, 22 nt, Human
ugggagagaagcugaggcaggg

SEQ ID NO: 55531 - RNA, 22 nt, Human
ucacugaauuucaagcuagugg

SEQ ID NO: 55532 - RNA, 22 nt, Human
gcugucccccaaagaugcuccu

SEQ ID NO: 55533 - RNA, 22 nt, Human
cagcuccaucuugcuuauacca

SEQ ID NO: 55534 - RNA, 22 nt, Human
uuauuguuuggguauaauuuga

SEQ ID NO: 55535 - RNA, 22 nt, Human
augugaaagagguguucagugg

SEQ ID NO: 55536 - RNA, 22 nt, Human
aggggaggggaguaucaggauu

SEQ ID NO: 55537 - RNA, 20 nt, Human
ccuguucacugcgcaguuuc

SEQ ID NO: 55538 - RNA, 21 nt, Human
uuccuggaggcagaaacguga

SEQ ID NO: 55539 - RNA, 22 nt, Human
auauguuaugccauuuucaagg

SEQ ID NO: 55540 - RNA, 22 nt, Human
auuuuagagaaacaaacguagg

SEQ ID NO: 55541 - RNA, 23 nt, Human
uuuuccaaaucgacucucuaguu

SEQ ID NO: 55542 - RNA, 22 nt, Human
gaaggaagcugucuggaugugu

SEQ ID NO: 55543 - RNA, 22 nt, Human
uucuaauauuaugauuucuaag

SEQ ID NO: 55544 - RNA, 22 nt, Human
aaauucuuccaggaggaaauac

SEQ ID NO: 55545 - RNA, 22 nt, Human
gacuugauugguuugucaaguu

SEQ ID NO: 55546 - RNA, 22 nt, Human
uauuaaaagagaaaaagccacc

SEQ ID NO: 55547 - RNA, 22 nt, Human
cucaggaaaauauugaagaagu

SEQ ID NO: 55548 - RNA, 22 nt, Human
auauuuuugcagaauuuuucgu

SEQ ID NO: 55549 - RNA, 22 nt, Human
gcaguccuuaggagaggaagua

SEQ ID NO: 55550 - RNA, 22 nt, Human
uacagauaaaaaugcuguucuu

SEQ ID NO: 55551 - RNA, 22 nt, Human
aaaauaauauuauaccacugcu

SEQ ID NO: 55552 - RNA, 22 nt, Human
cuuacaauuuucuuggacuuuu

SEQ ID NO: 55553 - RNA, 22 nt, Human
gcuccagcuccauaaacauaag

SEQ ID NO: 55554 - RNA, 22 nt, Human
aagaaggaaggcaagagauggg

SEQ ID NO: 55555 - RNA, 22 nt, Human
uggggagacauggaguaaaaga

SEQ ID NO: 55556 - RNA, 22 nt, Human
auuuuguugaaacccuuguugu

SEQ ID NO: 55557 - RNA, 23 nt, Human
ucagugaaggaacaacuaaauag

SEQ ID NO: 55558 - RNA, 22 nt, Human
uggagucuugcuuugggagugc

SEQ ID NO: 55559 - RNA, 22 nt, Human
auuuuuauuugccuaugauaua

SEQ ID NO: 55560 - RNA, 22 nt, Human
uuuaacauaugaaagaauauuu

SEQ ID NO: 55561 - RNA, 22 nt, Human
uugugugugcccaccuguggcc

SEQ ID NO: 55562 - RNA, 21 nt, Human
cuauaaaaaugguucuuugcg

SEQ ID NO: 55563 - RNA, 22 nt, Human
agaggcagagcugggguuugac

SEQ ID NO: 55564 - RNA, 22 nt, Human
uaaaacuaugcaaccuacuacc

SEQ ID NO: 55565 - RNA, 22 nt, Human
uauuucaugagugaauaucuag

SEQ ID NO: 55566 - RNA, 22 nt, Human
auucaggacucuuccuugaaga

SEQ ID NO: 55567 - RNA, 22 nt, Human
aaaauauucuauaucaaagaua

SEQ ID NO: 55568 - RNA, 22 nt, Human
gaaugggaauuauggugggacu

SEQ ID NO: 55569 - RNA, 22 nt, Human
uccuuucaaauuuauuugacau

SEQ ID NO: 55570 - RNA, 22 nt, Human
uuuuaaaagguugcuguuauaa

SEQ ID NO: 55571 - RNA, 22 nt, Human
aacagaauaucaaaagauuaug

SEQ ID NO: 55572 - RNA, 22 nt, Human
gcauccugacuauggugguggu

SEQ ID NO: 55573 - RNA, 22 nt, Human
aaauauuugaaugguguaagau

SEQ ID NO: 55574 - RNA, 22 nt, Human
uuuucauuguuaguuucuccuu

SEQ ID NO: 55575 - RNA, 22 nt, Human
uuucuggacuaaagggagagau

SEQ ID NO: 55576 - RNA, 22 nt, Human
ugggaaggggagcuggaaagga

SEQ ID NO: 55577 - RNA, 22 nt, Human
gggccuguccccccaggagaac

SEQ ID NO: 55578 - RNA, 22 nt, Human
aggggauggagcuggaaggcag

SEQ ID NO: 55579 - RNA, 22 nt, Human
ugcuuacauuuugcuggucucc

SEQ ID NO: 55580 - RNA, 22 nt, Human
gugugucucaguugcuccgaag

SEQ ID NO: 55581 - RNA, 22 nt, Human
auauuuuacagcucucguugaa

SEQ ID NO: 55582 - RNA, 19 nt, Human
ggagcagauaaacauacuu

SEQ ID NO: 55583 - RNA, 22 nt, Human
auauucaaugaggucauauaag

SEQ ID NO: 55584 - RNA, 22 nt, Human
guccuguguaaguacuugcuca

SEQ ID NO: 55585 - RNA, 22 nt, Human
gaggugcaggggcccgggcugg

SEQ ID NO: 55586 - RNA, 22 nt, Human
aaaucauagccaugaacauuug

SEQ ID NO: 55587 - RNA, 22 nt, Human
gauggggaaaaaauggaucuuu

SEQ ID NO: 55588 - RNA, 22 nt, Human
ggcagcagaacuggcccuguau

SEQ ID NO: 55589 - RNA, 22 nt, Human
gcuucuguuaggauguggcuua

SEQ ID NO: 55590 - RNA, 22 nt, Human
auuaauaucaauauauuauaug

SEQ ID NO: 55591 - RNA, 22 nt, Human
uuucauguuggauacuguuuca

SEQ ID NO: 55592 - RNA, 22 nt, Human
uguagcuccuaaagcccagcug

SEQ ID NO: 55593 - RNA, 22 nt, Human
auuuuuuuuccugucucuuuca

SEQ ID NO: 55594 - RNA, 22 nt, Human
uuuguuuccagccuuuugucuu

SEQ ID NO: 55595 - RNA, 22 nt, Human
ugugugcuaguuuugucaguau

SEQ ID NO: 55596 - RNA, 22 nt, Human
auuaaauagcagaagaaagaug

SEQ ID NO: 55597 - RNA, 22 nt, Human
gcuucucacccuuacuaucucu

SEQ ID NO: 55598 - RNA, 22 nt, Human
auauaguacauguauauauaua

SEQ ID NO: 55599 - RNA, 22 nt, Human
ggaccagagcuaaugcgcgccc

SEQ ID NO: 55600 - RNA, 17 nt, Human
ucuuuuacuuucucucc

SEQ ID NO: 55601 - RNA, 22 nt, Human
ucauaucauuuugaaagcugag

SEQ ID NO: 55602 - RNA, 22 nt, Human
uuauuuucgugugugugugugu

SEQ ID NO: 55603 - RNA, 22 nt, Human
gagaggcagcucaggaggucag

SEQ ID NO: 55604 - RNA, 22 nt, Human
agcuccugcgcacggugcacac

SEQ ID NO: 55605 - RNA, 22 nt, Human
cuuucuuucaaguucugcuuua

SEQ ID NO: 55606 - RNA, 22 nt, Human
uuuucauagccagaaacugaaa

SEQ ID NO: 55607 - RNA, 22 nt, Human
cuuuaaaaauguauuuuugugg

SEQ ID NO: 55608 - RNA, 22 nt, Human
ugggaagaguuagagacagcug

SEQ ID NO: 55609 - RNA, 22 nt, Human
uucauacuguuuaaguucuguu

SEQ ID NO: 55610 - RNA, 22 nt, Human
uacuuacacugaagcaaagaua

SEQ ID NO: 55611 - RNA, 22 nt, Human
gagagaggggaagagaagcucu

SEQ ID NO: 55612 - RNA, 22 nt, Human
gggaggaagaguaggaauuuga

SEQ ID NO: 55613 - RNA, 22 nt, Human
gacagugucccucuggggugga

SEQ ID NO: 55614 - RNA, 22 nt, Human
guugagaaucucuagcuuagga

SEQ ID NO: 55615 - RNA, 22 nt, Human
aacuuucagaauccuaugcauu

SEQ ID NO: 55616 - RNA, 22 nt, Human
uuuuaaauggcuuuuacuuuuc

SEQ ID NO: 55617 - RNA, 22 nt, Human
aaauauuaaugaugaagguagu

SEQ ID NO: 55618 - RNA, 22 nt, Human
acuguucacccagcacuagcag

SEQ ID NO: 55619 - RNA, 22 nt, Human
uuuauuuuccaugucucuaggu

SEQ ID NO: 55620 - RNA, 22 nt, Human
uuuuguuuacauuaaauuuuga

SEQ ID NO: 55621 - RNA, 22 nt, Human
uuuuucuuugcuuuccacuggc

SEQ ID NO: 55622 - RNA, 22 nt, Human
uggaaaauuuagaaagauuuau

SEQ ID NO: 55623 - RNA, 18 nt, Human
augcugacacaaugugga

SEQ ID NO: 55624 - RNA, 22 nt, Human
uuagaaauguccuacuaauaug

SEQ ID NO: 55625 - RNA, 22 nt, Human
agagauacugcaggccauaaau

SEQ ID NO: 55626 - RNA, 22 nt, Human
aguuauuuuucacuauuaggcu

SEQ ID NO: 55627 - RNA, 22 nt, Human
aaauguaaacuguauuuauaaa

SEQ ID NO: 55628 - RNA, 22 nt, Human
aaauauauauaauauauauauu

SEQ ID NO: 55629 - RNA, 22 nt, Human
auuuaaaaacugguacaacagg

SEQ ID NO: 55630 - RNA, 22 nt, Human
ggagaggaaguuuaaagaauug

SEQ ID NO: 55631 - RNA, 21 nt, Human
auauuguugggguuuucuuuu

SEQ ID NO: 55632 - RNA, 22 nt, Human
uuuuauuuguauguugaaugua

SEQ ID NO: 55633 - RNA, 22 nt, Human
uuauuuaaaauguagguuggga

SEQ ID NO: 55634 - RNA, 22 nt, Human
gagaaaaauuucuuugcugcac

SEQ ID NO: 55635 - RNA, 22 nt, Human
auucuuuucucuaaaugaugaa

SEQ ID NO: 55636 - RNA, 22 nt, Human
aauguugaaccuuuuuggccug

SEQ ID NO: 55637 - RNA, 22 nt, Human
gagggggaaaagggcagcagag

SEQ ID NO: 55638 - RNA, 19 nt, Human
caggucuucuuggaggacu

SEQ ID NO: 55639 - RNA, 22 nt, Human
uauuuuauuuagguuuaguugu

SEQ ID NO: 55640 - RNA, 22 nt, Human
guuuauuucuuaucaucacuau

SEQ ID NO: 55641 - RNA, 22 nt, Human
uucucuugccuucucuuuuauc

SEQ ID NO: 55642 - RNA, 22 nt, Human
uaauuccacacucccgcaagcg

SEQ ID NO: 55643 - RNA, 23 nt, Human
cuuauauaaucauuagaaaccau

SEQ ID NO: 55644 - RNA, 19 nt, Human
ccaguuuuuuaauauucaa

SEQ ID NO: 55645 - RNA, 22 nt, Human
ugaaaaauauuuuuagaaauaa

SEQ ID NO: 55646 - RNA, 22 nt, Human
uuuugaauaauucagaaacagc

SEQ ID NO: 55647 - RNA, 22 nt, Human
uguuggaaucuucuagucuucc

SEQ ID NO: 55648 - RNA, 22 nt, Human
agaggcaggcagcagagaagau

SEQ ID NO: 55649 - RNA, 22 nt, Human
uuuuuaaaauuaggacggcacg

SEQ ID NO: 55650 - RNA, 22 nt, Human
ucugaggacagugcugugccug

SEQ ID NO: 55651 - RNA, 22 nt, Human
acauauaugugcauacaacuau

SEQ ID NO: 55652 - RNA, 22 nt, Human
uggaugcuccaaguagaccuua

SEQ ID NO: 55653 - RNA, 22 nt, Human
uuguacaaauaggaaccucuga

SEQ ID NO: 55654 - RNA, 22 nt, Human
gugugugucuacuuucaucucu

SEQ ID NO: 55655 - RNA, 22 nt, Human
aaacaaauccaauaauaaaauu

SEQ ID NO: 55656 - RNA, 22 nt, Human
ggacauugaagcuggaaaggga

SEQ ID NO: 55657 - RNA, 22 nt, Human
uuuaaaacagcauuuaaaaggu

SEQ ID NO: 55658 - RNA, 21 nt, Human
ucuggggacaagguccaggaa

SEQ ID NO: 55659 - RNA, 22 nt, Human
cuggagaacucugugcuucacu

SEQ ID NO: 55660 - RNA, 22 nt, Human
accuccauggcccacaucuagu

SEQ ID NO: 55661 - RNA, 22 nt, Human
uuuucacugacuuggucuggaa

SEQ ID NO: 55662 - RNA, 20 nt, Human
acuagaaagucacugggggg

SEQ ID NO: 55663 - RNA, 22 nt, Human
ucaaauaugggccagaggaaau

SEQ ID NO: 55664 - RNA, 22 nt, Human
uacaaaugaucaucucuuugaa

SEQ ID NO: 55665 - RNA, 22 nt, Human
cucaaugagcuauuuguuucau

SEQ ID NO: 55666 - RNA, 22 nt, Human
ggaaauguguguaagaaaguau

SEQ ID NO: 55667 - RNA, 22 nt, Brucella suis 1330
uuuucgcucggacggccuucac

SEQ ID NO: 55668 - RNA, 22 nt, Brucella suis 1330
uacgccgauagcgggcaauugc

SEQ ID NO: 55669 - RNA, 22 nt, Brucella suis 1330
cagugacgaugcgaacuucauc

SEQ ID NO: 55670 - RNA, 22 nt, Brucella suis 1330
aggccgaucuuaccgccgggcu

SEQ ID NO: 55671 - RNA, 18 nt, Brucella suis 1330
gccgugcuuccuuccgag

SEQ ID NO: 55672 - RNA, 22 nt, Brucella suis 1330
uugccauugcacagcaucaugg

SEQ ID NO: 55673 - RNA, 22 nt, Brucella suis 1330
cgccgggcuucuugauccaucc

SEQ ID NO: 55674 - RNA, 22 nt, Brucella suis 1330
ugcgcaggccugccgggacgcu

SEQ ID NO: 55675 - RNA, 22 nt, Brucella suis 1330
auauuucuucuccgcgucuggg

SEQ ID NO: 55676 - RNA, 22 nt, Brucella suis 1330
ccuucggcucggcugcaagcag

SEQ ID NO: 55677 - RNA, 22 nt, Brucella suis 1330
guucugguugauuauaucgugg

SEQ ID NO: 55678 - RNA, 22 nt, Brucella suis 1330
cgacauggaaucggccacgauu

SEQ ID NO: 55679 - RNA, 22 nt, Brucella suis 1330
caacaugccgcuucugaacggc

SEQ ID NO: 55680 - RNA, 22 nt, Brucella suis 1330
aagcgccuucagcgugcgcucg

SEQ ID NO: 55681 - RNA, 22 nt, Brucella suis 1330
gccgaaaucucugccgaagccg

SEQ ID NO: 55682 - RNA, 22 nt, Brucella suis 1330
caaauaugccuucagcuuuuuc

SEQ ID NO: 55683 - RNA, 22 nt, Brucella suis 1330
uggggcgguuucgguuaaaccc

SEQ ID NO: 55684 - RNA, 22 nt, Brucella suis 1330
acggccaaccggcggguaguuu

SEQ ID NO: 55685 - RNA, 22 nt, Brucella suis 1330
aaaagcgcagcagaucguccuu

SEQ ID NO: 55686 - RNA, 22 nt, Brucella suis 1330
gcugccgacgguccgcuucucg

SEQ ID NO: 55687 - RNA, 22 nt, Brucella suis 1330
uuugcggucgggucggcaaggg

SEQ ID NO: 55688 - RNA, 22 nt, Brucella suis 1330
uucaaacgucaaauucaaucca

SEQ ID NO: 55689 - RNA, 22 nt, Brucella suis 1330
uggcggagcgguggaguucggu

SEQ ID NO: 55690 - RNA, 22 nt, Brucella suis 1330
gugacgacgauaguuugcggcc

SEQ ID NO: 55691 - RNA, 22 nt, Brucella suis 1330
ucgccgugccggaagugcgcgg

SEQ ID NO: 55692 - RNA, 22 nt, Brucella suis 1330
gccgcauuggaagcugccggug

SEQ ID NO: 55693 - RNA, 22 nt, Brucella suis 1330
cggcaaugucaccuauggccac

SEQ ID NO: 55694 - RNA, 23 nt, Brucella suis 1330
gucguucucgcugacggcggcgc

SEQ ID NO: 55695 - RNA, 22 nt, Brucella suis 1330
cuuuucaugcggauaguucagc

SEQ ID NO: 55696 - RNA, 22 nt, Brucella suis 1330
ccggugcgugucuucauugaug

SEQ ID NO: 55697 - RNA, 22 nt, Brucella suis 1330
gugcuugcaaguggagauccga

SEQ ID NO: 55698 - RNA, 21 nt, Brucella suis 1330
gucaggggugcgaugggcgga

SEQ ID NO: 55699 - RNA, 22 nt, Brucella suis 1330
ucgggcguaugcugauggaugg

SEQ ID NO: 55700 - RNA, 22 nt, Brucella suis 1330
gccggggcugaucgcauuggcg

SEQ ID NO: 55701 - RNA, 22 nt, Brucella suis 1330
uuuugggagacaugcauuagau

SEQ ID NO: 55702 - RNA, 22 nt, Brucella suis 1330
auugcccgacauggugcgggcc

SEQ ID NO: 55703 - RNA, 22 nt, Brucella suis 1330
ggaaaugcagauuggccgcuau

SEQ ID NO: 55704 - RNA, 22 nt, Brucella suis 1330
ugguucaucacggaauauuaau

SEQ ID NO: 55705 - RNA, 22 nt, Brucella suis 1330
augagcugauguaggaagauuu

SEQ ID NO: 55706 - RNA, 22 nt, Brucella suis 1330
ggacggucgaucaggcgcgaaa

SEQ ID NO: 55707 - RNA, 22 nt, Brucella suis 1330
gcgcauucgccgugcagaucgu

SEQ ID NO: 55708 - RNA, 22 nt, Brucella suis 1330
gccucgucgccgaacggcaccu

SEQ ID NO: 55709 - RNA, 23 nt, Brucella suis 1330
gaagagccaugcuuuucgggcag

SEQ ID NO: 55710 - RNA, 22 nt, Brucella suis 1330
ucugcccggugaugagaaagca

SEQ ID NO: 55711 - RNA, 22 nt, Brucella suis 1330
ugcuaucuggugcucgauaaug

SEQ ID NO: 55712 - RNA, 22 nt, Brucella suis 1330
cuugcgcagccccgacgggcgc

SEQ ID NO: 55713 - RNA, 22 nt, Brucella suis 1330
gucgggcuggcgcucgccaucg

SEQ ID NO: 55714 - RNA, 22 nt, Brucella suis 1330
cugaucgucggagagcggcacu

SEQ ID NO: 55715 - RNA, 22 nt, Brucella suis 1330
ccggcgcgggcaagacgacgcu

SEQ ID NO: 55716 - RNA, 21 nt, Brucella suis 1330
cggcagcuuuccugccgggcg

SEQ ID NO: 55717 - RNA, 22 nt, Brucella suis 1330
gucgacgacuucacgggucacg

SEQ ID NO: 55718 - RNA, 22 nt, Brucella suis 1330
aucaugcgcaccggaacgguug

SEQ ID NO: 55719 - RNA, 22 nt, Brucella suis 1330
gccgcggcgucagcgccaucac

SEQ ID NO: 55720 - RNA, 22 nt, Brucella suis 1330
cgccuaucauaugcgccaggau

SEQ ID NO: 55721 - RNA, 22 nt, Brucella suis 1330
aagacgaucuucuaaagacgcu

SEQ ID NO: 55722 - RNA, 22 nt, Brucella suis 1330
gacaugaacgaauuccgguuuc

SEQ ID NO: 55723 - RNA, 22 nt, Brucella suis 1330
gcgcuguucccuguugagggaa

SEQ ID NO: 55724 - RNA, 22 nt, Brucella suis 1330
uccggcaucgggaucguaacac

SEQ ID NO: 55725 - RNA, 22 nt, Brucella suis 1330
ucgcugcuucugcucuucgugg

SEQ ID NO: 55726 - RNA, 21 nt, Brucella suis 1330
auucaagcggcuugauccggc

SEQ ID NO: 55727 - RNA, 22 nt, Brucella suis 1330
auguucacauuuuaagaccgug

SEQ ID NO: 55728 - RNA, 22 nt, Brucella suis 1330
ggcuucuggcagagcuugccau

SEQ ID NO: 55729 - RNA, 22 nt, Brucella suis 1330
gccguuccggccgugugcuggc

SEQ ID NO: 55730 - RNA, 22 nt, Brucella suis 1330
cgccggacaaucucuaccgcga

SEQ ID NO: 55731 - RNA, 22 nt, Brucella suis 1330
cgcccgucaccgugcggucgau

SEQ ID NO: 55732 - RNA, 22 nt, Brucella suis 1330
caccaaugcugcacgucacccu

SEQ ID NO: 55733 - RNA, 22 nt, Brucella suis 1330
gcuggcgcguucagauuuucga

SEQ ID NO: 55734 - RNA, 22 nt, Brucella suis 1330
aggucggcggcgaucugccgga

SEQ ID NO: 55735 - RNA, 22 nt, Brucella suis 1330
ucgauaugggcuugccgguuga

SEQ ID NO: 55736 - RNA, 22 nt, Brucella suis 1330
uggauggcauguuugccacccg

SEQ ID NO: 55737 - RNA, 22 nt, Brucella suis 1330
ucgcgcgguguggugcuggucg

SEQ ID NO: 55738 - RNA, 22 nt, Brucella suis 1330
gccgguauauuccuugucgaga

SEQ ID NO: 55739 - RNA, 22 nt, Brucella suis 1330
ucggcggguggcaagcgcauug

SEQ ID NO: 55740 - RNA, 22 nt, Brucella suis 1330
gcugaaaauccgguccaugaug

SEQ ID NO: 55741 - RNA, 23 nt, Brucella suis 1330
cgagccgcuuuucaaccucgcgc

SEQ ID NO: 55742 - RNA, 22 nt, Brucella suis 1330
augcgcgauuugccgcaagcca

SEQ ID NO: 55743 - RNA, 22 nt, Brucella suis 1330
aaccggcgaccccaucagccug

SEQ ID NO: 55744 - RNA, 22 nt, Brucella suis 1330
cuguuuccggcaaaagcggcaa

SEQ ID NO: 55745 - RNA, 22 nt, Brucella suis 1330
ggucaaggacgccgaagccaau

SEQ ID NO: 55746 - RNA, 22 nt, Brucella suis 1330
gcucaaagugcaggccacuucg

SEQ ID NO: 55747 - RNA, 22 nt, Brucella suis 1330
ucugcauggacaucauccguga

SEQ ID NO: 55748 - RNA, 22 nt, Brucella suis 1330
aagaucgucaucgacgcuggcc

SEQ ID NO: 55749 - RNA, 22 nt, Brucella suis 1330
gacauguggccaugcgugcguu

SEQ ID NO: 55750 - RNA, 22 nt, Brucella suis 1330
augucauguucucgcagcgcgg

SEQ ID NO: 55751 - RNA, 22 nt, Brucella suis 1330
gcgcgcgggaugaucgaucugc

SEQ ID NO: 55752 - RNA, 22 nt, Brucella suis 1330
uccauggugaagucgcgugagg

SEQ ID NO: 55753 - RNA, 22 nt, Brucella suis 1330
cggcucugauccacauaggaaa

SEQ ID NO: 55754 - RNA, 22 nt, Brucella suis 1330
cccgccagauagagcgauccgc

SEQ ID NO: 55755 - RNA, 22 nt, Brucella suis 1330
aagcagcuugcuuuugugcaug

SEQ ID NO: 55756 - RNA, 22 nt, Brucella suis 1330
ugaaggaucguaucgggcuugc

SEQ ID NO: 55757 - RNA, 22 nt, Brucella suis 1330
auucgcuuuuccaugccgcgca

SEQ ID NO: 55758 - RNA, 22 nt, Brucella suis 1330
acgcaaauguuggaaucagaca

SEQ ID NO: 55759 - RNA, 22 nt, Brucella suis 1330
augcgucgcauuggcgcggcca

SEQ ID NO: 55760 - RNA, 22 nt, Brucella suis 1330
aaaccggaauucguucaugucu

SEQ ID NO: 55761 - RNA, 22 nt, Brucella suis 1330
ccggcggaugggcaggccgcuu

SEQ ID NO: 55762 - RNA, 22 nt, Brucella suis 1330
ggccgugugcgugccgcgcagg

SEQ ID NO: 55763 - RNA, 22 nt, Brucella suis 1330
gugggccuugaaauucugccag

SEQ ID NO: 55764 - RNA, 22 nt, Brucella suis 1330
gcuugccgcgcuuuccugcgac

SEQ ID NO: 55765 - RNA, 22 nt, Brucella suis 1330
ggccaucaggucuauucggcag

SEQ ID NO: 55766 - RNA, 20 nt, Brucella suis 1330
cgagcgcgcgcacuguggaa

SEQ ID NO: 55767 - RNA, 22 nt, Brucella suis 1330
acgaccgugacuuucaucguuu

SEQ ID NO: 55768 - RNA, 21 nt, Brucella suis 1330
ggugcgcuggucuaugccccg

SEQ ID NO: 55769 - RNA, 22 nt, Brucella suis 1330
aagccgcugagcuguccaagcu

SEQ ID NO: 55770 - RNA, 22 nt, Brucella suis 1330
uggcgcauacggugcaugacgu

SEQ ID NO: 55771 - RNA, 22 nt, Brucella suis 1330
cagcgcgugguuuugcgcuggc

SEQ ID NO: 55772 - RNA, 20 nt, Brucella suis 1330
uucaggcggcgauacggcgg

SEQ ID NO: 55773 - RNA, 23 nt, Brucella suis 1330
ugugaagcugcaccgcaagcggc

SEQ ID NO: 55774 - RNA, 22 nt, Brucella suis 1330
gcgcggggaaucaucacguccu

SEQ ID NO: 55775 - RNA, 22 nt, Brucella suis 1330
uggcggcucaggcauuggcacg

SEQ ID NO: 55776 - RNA, 22 nt, Brucella suis 1330
uugcggccaucgagaaccgccu

SEQ ID NO: 55777 - RNA, 22 nt, Brucella suis 1330
cgagggugaggcugagcgcggc

SEQ ID NO: 55778 - RNA, 22 nt, Brucella suis 1330
gcggucgagaugcuuggcgauc

SEQ ID NO: 55779 - RNA, 22 nt, Brucella suis 1330
aguuuuccaggauugcuccgaa

SEQ ID NO: 55780 - RNA, 22 nt, Brucella suis 1330
cuuuggcgcggaaggauaccug

SEQ ID NO: 55781 - RNA, 22 nt, Brucella suis 1330
gcuucccguugucuugcccgug

SEQ ID NO: 55782 - RNA, 22 nt, Brucella suis 1330
ggucaacgcugcucaccucacc

SEQ ID NO: 55783 - RNA, 22 nt, Brucella suis 1330
ucgucaaccagcuuaccggcga

SEQ ID NO: 55784 - RNA, 22 nt, Brucella suis 1330
gucgucaucaguggcgaaugac

SEQ ID NO: 55785 - RNA, 22 nt, Brucella suis 1330
cgcguuucggcaucgaugcgga

SEQ ID NO: 55786 - RNA, 22 nt, Brucella suis 1330
ugccgcauugauugcggguuuc

SEQ ID NO: 55787 - RNA, 22 nt, Brucella suis 1330
gaagcggcuuugcuuuggauaa

SEQ ID NO: 55788 - RNA, 22 nt, Brucella suis 1330
uggcgagcuaaggucgccgguu

SEQ ID NO: 55789 - RNA, 22 nt, Brucella suis 1330
uggaaggcuucuaugccaucca

SEQ ID NO: 55790 - RNA, 22 nt, Brucella suis 1330
ugcgcggcaucgugccggaugg

SEQ ID NO: 55791 - RNA, 22 nt, Brucella suis 1330
ccucuggccccaugcugcgcgg

SEQ ID NO: 55792 - RNA, 22 nt, Brucella suis 1330
cgcuuccaccgucuugccaucc

SEQ ID NO: 55793 - RNA, 22 nt, Brucella suis 1330
auugcgguguccgcuucggcca

SEQ ID NO: 55794 - RNA, 22 nt, Brucella suis 1330
cgcgaaggccgcaacaagucgc

SEQ ID NO: 55795 - RNA, 19 nt, Brucella suis 1330
gacgaguugaacaugcguu

SEQ ID NO: 55796 - RNA, 22 nt, Brucella suis 1330
guggcuuuccucagcaauuggc

SEQ ID NO: 55797 - RNA, 22 nt, Brucella suis 1330
uuugacgcgcaucuuuuccgaa

SEQ ID NO: 55798 - RNA, 22 nt, Brucella suis 1330
uucucggacuuuucgacacauc

SEQ ID NO: 55799 - RNA, 22 nt, Brucella suis 1330
cggggcagaugucgucgugcuu

SEQ ID NO: 55800 - RNA, 22 nt, Brucella suis 1330
aucgcucgugauagggcauggc

SEQ ID NO: 55801 - RNA, 19 nt, Brucella suis 1330
augcaugucggccauugcc

SEQ ID NO: 55802 - RNA, 22 nt, Brucella suis 1330
cgucauccaugugcuggguguc

SEQ ID NO: 55803 - RNA, 23 nt, Brucella suis 1330
aagacgggcaaccggaacaggcc

SEQ ID NO: 55804 - RNA, 22 nt, Brucella suis 1330
ggaugaaaaacucaucagcaac

SEQ ID NO: 55805 - RNA, 22 nt, Brucella suis 1330
gcccgguuggcgaugcccauga

SEQ ID NO: 55806 - RNA, 22 nt, Brucella suis 1330
ucgaucuuuaccggaacaccgg

SEQ ID NO: 55807 - RNA, 20 nt, Brucella suis 1330
cguucauccgccugucgggc

SEQ ID NO: 55808 - RNA, 22 nt, Brucella suis 1330
guugagcaaauguuggaaucac

SEQ ID NO: 55809 - RNA, 20 nt, Brucella suis 1330
ggugggauuuccuauuaccu

SEQ ID NO: 55810 - RNA, 23 nt, Brucella suis 1330
acuuuugcuggaaaugcuuuagg

SEQ ID NO: 55811 - RNA, 22 nt, Brucella suis 1330
gccguucgugaagcuugccgau

SEQ ID NO: 55812 - RNA, 22 nt, Brucella suis 1330
cgucuuuagaagaucgucuucc

SEQ ID NO: 55813 - RNA, 22 nt, Brucella suis 1330
ucugcgcgauguggaaacggcc

SEQ ID NO: 55814 - RNA, 22 nt, Brucella suis 1330
ucggaagucggugccggccugc

SEQ ID NO: 55815 - RNA, 20 nt, Brucella suis 1330
aauccagcacgaaaccggug

SEQ ID NO: 55816 - RNA, 22 nt, Brucella suis 1330
ggcuuaucccaauauuuagcgu

SEQ ID NO: 55817 - RNA, 22 nt, Brucella suis 1330
ucuuccugcaugagguggcaaa

SEQ ID NO: 55818 - RNA, 22 nt, Brucella suis 1330
ucgagcguugccaugccguuca

SEQ ID NO: 55819 - RNA, 22 nt, Brucella suis 1330
ucgacuguuuucggcgacaagc

SEQ ID NO: 55820 - RNA, 22 nt, Brucella suis 1330
gacgcugacgaccgcagggcga

SEQ ID NO: 55821 - RNA, 22 nt, Brucella suis 1330
guuaagcuuuaaagcgaaaggg

SEQ ID NO: 55822 - RNA, 22 nt, Brucella suis 1330
cgcgucuucguucacaagaaua

SEQ ID NO: 55823 - RNA, 22 nt, Brucella suis 1330
cgcgccugaaaucuuucucgga

SEQ ID NO: 55824 - RNA, 20 nt, Brucella suis 1330
uuugcuggaaaugcucuaaa

SEQ ID NO: 55825 - RNA, 22 nt, Brucella suis 1330
cuccagaaucuucuuguugcca

SEQ ID NO: 55826 - RNA, 20 nt, Brucella suis 1330
gcccggcgggugguuucggc

SEQ ID NO: 55827 - RNA, 22 nt, Brucella suis 1330
uuuccauuggauugcugcggca

SEQ ID NO: 55828 - RNA, 22 nt, Brucella suis 1330
uccauugccgcaauuccgauac

SEQ ID NO: 55829 - RNA, 22 nt, Brucella suis 1330
aacgucaaauucaauccacuag

SEQ ID NO: 55830 - RNA, 22 nt, Brucella suis 1330
uucuucccugcgugccagaugc

SEQ ID NO: 55831 - RNA, 22 nt, Brucella suis 1330
ugcguuugcccuugaugucgcu

SEQ ID NO: 55832 - RNA, 22 nt, Brucella suis 1330
uugccgauuucgcuugcauaug

SEQ ID NO: 55833 - RNA, 22 nt, Brucella suis 1330
gauuuuuuguaucuugaggaau

SEQ ID NO: 55834 - RNA, 22 nt, Brucella suis 1330
ggcguucagccaguugccgcgc

SEQ ID NO: 55835 - RNA, 22 nt, Brucella suis 1330
cggcggccagcaggcacagcgu

SEQ ID NO: 55836 - RNA, 19 nt, Brucella suis 1330
ucgcuuuaaccggcguauu

SEQ ID NO: 55837 - RNA, 22 nt, Brucella suis 1330
uacugccugcgcgcuggcuuua

SEQ ID NO: 55838 - RNA, 22 nt, Brucella suis 1330
cuggccggucagguucgcgcag

SEQ ID NO: 55839 - RNA, 22 nt, Brucella suis 1330
uuuucggaaaagaugcgcguca

SEQ ID NO: 55840 - RNA, 22 nt, Brucella suis 1330
uuggaugauggcacuuaugguu

SEQ ID NO: 55841 - RNA, 22 nt, Brucella suis 1330
gcuguuccguccggcgcaucga

SEQ ID NO: 55842 - RNA, 18 nt, Brucella suis 1330
uccaaggaugccgucuuc

SEQ ID NO: 55843 - RNA, 22 nt, Brucella suis 1330
cuggccguggccuggaugcaag

SEQ ID NO: 55844 - RNA, 22 nt, Brucella suis 1330
agcaaaucauugaugauacggu

SEQ ID NO: 55845 - RNA, 22 nt, Brucella suis 1330
uggcggcgcgcgcuuccaccca

SEQ ID NO: 55846 - RNA, 18 nt, Brucella suis 1330
gccugcggcggcggcguc

SEQ ID NO: 55847 - RNA, 22 nt, Brucella suis 1330
caugggcgagccgaaaucggcg

SEQ ID NO: 55848 - RNA, 22 nt, Brucella suis 1330
uggccuguguuuccuugccacc

SEQ ID NO: 55849 - RNA, 18 nt, Brucella suis 1330
uugcgucgccgugucggg

SEQ ID NO: 55850 - RNA, 22 nt, Brucella suis 1330
gagcgucgucuugcccgcgccg

SEQ ID NO: 55851 - RNA, 22 nt, Brucella suis 1330
agcgguuuugcguuggauaaug

SEQ ID NO: 55852 - RNA, 22 nt, Brucella suis 1330
cgauuuguuuaccuugucggcu

SEQ ID NO: 55853 - RNA, 22 nt, Brucella suis 1330
ucugacggaguugaacgcuguu

SEQ ID NO: 55854 - RNA, 22 nt, Brucella suis 1330
cggaacuguggcuuggcgauuu

SEQ ID NO: 55855 - RNA, 19 nt, Brucella suis 1330
ucugcggaaaaacuugcaa

SEQ ID NO: 55856 - RNA, 22 nt, Brucella suis 1330
gaacccggcggaugucgaugcc

SEQ ID NO: 55857 - RNA, 22 nt, Brucella suis 1330
gucggcaaggauaucgagcuca

SEQ ID NO: 55858 - RNA, 21 nt, Brucella suis 1330
gcuuucuuguacauucacaau

SEQ ID NO: 55859 - RNA, 22 nt, Brucella suis 1330
gcggcaauggcggcaauggccg

SEQ ID NO: 55860 - RNA, 22 nt, Brucella suis 1330
cugccuuugcacaagguaugga

SEQ ID NO: 55861 - RNA, 22 nt, Brucella suis 1330
cgggccaugggcuggagauugc

SEQ ID NO: 55862 - RNA, 17 nt, Brucella suis 1330
ugcgcgcgccaagcuuc

SEQ ID NO: 55863 - RNA, 22 nt, Brucella suis 1330
aguggcggguuacggugccgug

SEQ ID NO: 55864 - RNA, 22 nt, Brucella suis 1330
gcgggcauggcgcacugacgau

SEQ ID NO: 55865 - RNA, 22 nt, Brucella suis 1330
cuuccagcuugauccaguucgu

SEQ ID NO: 55866 - RNA, 22 nt, Brucella suis 1330
gcaggcuuuguugcaucggcag

SEQ ID NO: 55867 - RNA, 22 nt, Brucella suis 1330
ucagccuggugcagauucaccu

SEQ ID NO: 55868 - RNA, 22 nt, Brucella suis 1330
ccuuuugcuauguucgguccgc

SEQ ID NO: 55869 - RNA, 22 nt, Brucella suis 1330
augaagcgauugcccggcuuug

SEQ ID NO: 55870 - RNA, 22 nt, Brucella suis 1330
ggugaucgauacgggugcggca

SEQ ID NO: 55871 - RNA, 23 nt, Brucella suis 1330
ccuggagcagaaauucuacaccg

SEQ ID NO: 55872 - RNA, 22 nt, Brucella suis 1330
gcaauaacuucggcugcuaugc

SEQ ID NO: 55873 - RNA, 22 nt, Brucella suis 1330
gucgauccagcgcuccggcuga

SEQ ID NO: 55874 - RNA, 22 nt, Brucella suis 1330
gggcuugcaggguucgggcaag

SEQ ID NO: 55875 - RNA, 22 nt, Brucella suis 1330
agccgaaaugcccgccgggcca

SEQ ID NO: 55876 - RNA, 22 nt, Brucella suis 1330
ugccgcucuccgacgaucaggc

SEQ ID NO: 55877 - RNA, 22 nt, Brucella suis 1330
uucgccggucgccuggaaggaa

SEQ ID NO: 55878 - RNA, 22 nt, Brucella suis 1330
acgcauugcaucaggccgauaa

SEQ ID NO: 55879 - RNA, 18 nt, Brucella suis 1330
ccuguuccggcgaaagau

SEQ ID NO: 55880 - RNA, 22 nt, Brucella suis 1330
ccuccgccaaugucgccuucaa

SEQ ID NO: 55881 - RNA, 22 nt, Brucella suis 1330
gauggccagcguggagacggcu

SEQ ID NO: 55882 - RNA, 22 nt, Brucella suis 1330
cugcugccgcagaagaaaagac

SEQ ID NO: 55883 - RNA, 23 nt, Brucella suis 1330
ugccaaugccacggccauggcgc

SEQ ID NO: 55884 - RNA, 22 nt, Brucella suis 1330
acgaagccggcgaaaaucggua

SEQ ID NO: 55885 - RNA, 22 nt, Brucella suis 1330
auggggaagccgucguccucga

SEQ ID NO: 55886 - RNA, 22 nt, Brucella suis 1330
cagccggaaugaaaccagcguu

SEQ ID NO: 55887 - RNA, 22 nt, Brucella suis 1330
gcuugcuugccauucugucggc

SEQ ID NO: 55888 - RNA, 22 nt, Brucella suis 1330
cuucggcacgauggggccggau

SEQ ID NO: 55889 - RNA, 19 nt, Brucella suis 1330
ccgugcguggccuugccau

SEQ ID NO: 55890 - RNA, 23 nt, Brucella suis 1330
gccuuugguccacuggcccuggc

SEQ ID NO: 55891 - RNA, 22 nt, Brucella suis 1330
ccguaaggugugaugucauauu

SEQ ID NO: 55892 - RNA, 22 nt, Brucella suis 1330
gggaauaugucagugaaggcga

SEQ ID NO: 55893 - RNA, 18 nt, Brucella suis 1330
cgacuaucguccagcaga

SEQ ID NO: 55894 - RNA, 22 nt, Brucella suis 1330
agcggcgauggugucaacaagc

SEQ ID NO: 55895 - RNA, 22 nt, Brucella suis 1330
ugaaaauuucuuaaucgcguga

SEQ ID NO: 55896 - RNA, 22 nt, Brucella suis 1330
cacggauacgguucuugcgcau

SEQ ID NO: 55897 - RNA, 22 nt, Brucella suis 1330
caggcgcugaucgacgagaaug

SEQ ID NO: 55898 - RNA, 22 nt, Brucella suis 1330
acgcgcucaauacggugauugg

SEQ ID NO: 55899 - RNA, 22 nt, Brucella suis 1330
ucgugcggucagaagccuugcg

SEQ ID NO: 55900 - RNA, 22 nt, Brucella suis 1330
agugccgcacccguaucgauca

SEQ ID NO: 55901 - RNA, 22 nt, Brucella suis 1330
aggcgcgcgaaguugaaugcgg

SEQ ID NO: 55902 - RNA, 21 nt, Brucella suis 1330
aaucuggauaccguugccgcc

SEQ ID NO: 55903 - RNA, 20 nt, Brucella suis 1330
cauuuuucgacgcaauauca

SEQ ID NO: 55904 - RNA, 22 nt, Brucella suis 1330
acccgcaucuuccugcgugccg

SEQ ID NO: 55905 - RNA, 22 nt, Brucella suis 1330
aguuuuggcucgaaaaugcucu

SEQ ID NO: 55906 - RNA, 22 nt, Brucella suis 1330
gcgcguggaacaaagcgcugcu

SEQ ID NO: 55907 - RNA, 22 nt, Brucella suis 1330
cccgcagcgacgaucaucucac

SEQ ID NO: 55908 - RNA, 22 nt, Brucella suis 1330
gggccguuuuuggcuuggugau

SEQ ID NO: 55909 - RNA, 22 nt, Brucella suis 1330
gcggccauguucuguguugagc

SEQ ID NO: 55910 - RNA, 22 nt, Brucella suis 1330
gugcgcgauuucugcggucaug

SEQ ID NO: 55911 - RNA, 18 nt, Brucella suis 1330
gccugcuuucgcggcgau

SEQ ID NO: 55912 - RNA, 22 nt, Brucella suis 1330
aucgaccgugucaucauguugc

SEQ ID NO: 55913 - RNA, 22 nt, Brucella suis 1330
uuccagaccgucgagccgcuca

SEQ ID NO: 55914 - RNA, 22 nt, Brucella suis 1330
cgaugcgcuuuggcuggcggcg

SEQ ID NO: 55915 - RNA, 22 nt, Brucella suis 1330
ggcucgucuuccucacggauga

SEQ ID NO: 55916 - RNA, 20 nt, Brucella suis 1330
gaugacuucaugauggcauc

SEQ ID NO: 55917 - RNA, 22 nt, Brucella suis 1330
uuugaugugccgccgcaggcuu

SEQ ID NO: 55918 - RNA, 22 nt, Brucella suis 1330
cuguggcucccgccaugucggc

SEQ ID NO: 55919 - RNA, 22 nt, Brucella suis 1330
uucggcauugaacgggaagggg

SEQ ID NO: 55920 - RNA, 22 nt, Brucella suis 1330
ggcugcacgaagcgcgggucuu

SEQ ID NO: 55921 - RNA, 22 nt, Brucella suis 1330
uggccgauggagcaggcgcuuc

SEQ ID NO: 55922 - RNA, 22 nt, Brucella suis 1330
gccguuuccauuccggugauug

SEQ ID NO: 55923 - RNA, 22 nt, Brucella suis 1330
ucagcgaugugaagccggguga

SEQ ID NO: 55924 - RNA, 22 nt, Brucella suis 1330
ugccgguuuuuccagccugaug

SEQ ID NO: 55925 - RNA, 21 nt, Brucella suis 1330
cgcagcuauuuccgcgacauc

SEQ ID NO: 55926 - RNA, 22 nt, Brucella suis 1330
gccgaugggcagaaggccauag

SEQ ID NO: 55927 - RNA, 22 nt, Brucella suis 1330
ucgcggcagauaaagcgcaagc

SEQ ID NO: 55928 - RNA, 22 nt, Brucella suis 1330
ucgucgguggugcugucgggau

SEQ ID NO: 55929 - RNA, 22 nt, Brucella suis 1330
aucguggcuucggucgugggcg

SEQ ID NO: 55930 - RNA, 20 nt, Brucella suis 1330
uggcggcgauagccgccaaa

SEQ ID NO: 55931 - RNA, 22 nt, Brucella suis 1330
guuuuucggugguaacaggaua

SEQ ID NO: 55932 - RNA, 22 nt, Brucella suis 1330
gaagcccaguuccgcauauucu

SEQ ID NO: 55933 - RNA, 22 nt, Brucella suis 1330
auggcgggccauuccuucucga

SEQ ID NO: 55934 - RNA, 22 nt, Brucella suis 1330
aacgcucgaccugcuuggccuu

SEQ ID NO: 55935 - RNA, 21 nt, Brucella suis 1330
ggccacacugcgcguccuuga

SEQ ID NO: 55936 - RNA, 22 nt, Brucella suis 1330
ugggcggucugguuggcgaaau

SEQ ID NO: 55937 - RNA, 22 nt, Brucella suis 1330
uuguuucggauggcggacagcu

SEQ ID NO: 55938 - RNA, 22 nt, Brucella suis 1330
agggcucgauugccgucguugc

SEQ ID NO: 55939 - RNA, 22 nt, Brucella suis 1330
cuggcgcuccgauggggacuca

SEQ ID NO: 55940 - RNA, 22 nt, Brucella suis 1330
ggcugaugacgccugaagguga

SEQ ID NO: 55941 - RNA, 22 nt, Brucella suis 1330
aagccauggugccgcaggcccu

SEQ ID NO: 55942 - RNA, 22 nt, Brucella suis 1330
uuaucggcuaugcgagcgugga

SEQ ID NO: 55943 - RNA, 22 nt, Brucella suis 1330
uuucgggaugcgcucuaaaauc

SEQ ID NO: 55944 - RNA, 22 nt, Brucella suis 1330
gauuugauuguagcggcaucuu

SEQ ID NO: 55945 - RNA, 20 nt, Brucella suis 1330
uccaugccguucggaggcag

SEQ ID NO: 55946 - RNA, 22 nt, Brucella suis 1330
ucgcuguuuuucuucggcugug

SEQ ID NO: 55947 - RNA, 22 nt, Brucella suis 1330
uguuuccagagcgcgaugcgug

SEQ ID NO: 55948 - RNA, 22 nt, Brucella suis 1330
uauuccauauagagcauaaucu

SEQ ID NO: 55949 - RNA, 22 nt, Brucella suis 1330
aacuggcagaacgagaccgagg

SEQ ID NO: 55950 - RNA, 22 nt, Brucella suis 1330
cacuugugcgggaaucgcaugg

SEQ ID NO: 55951 - RNA, 22 nt, Brucella suis 1330
ucgugaugauauucaagcguuu

SEQ ID NO: 55952 - RNA, 22 nt, Brucella suis 1330
ccgcacccugcacggcgcauug

SEQ ID NO: 55953 - RNA, 22 nt, Brucella suis 1330
caagauggacaagcgccgcggc

SEQ ID NO: 55954 - RNA, 22 nt, Brucella suis 1330
gcgcgcuuuccgguuuucagaa

SEQ ID NO: 55955 - RNA, 22 nt, Brucella suis 1330
auccgguuccgucaacuuuaug

SEQ ID NO: 55956 - RNA, 21 nt, Brucella suis 1330
gcguaucggccuugcgcauga

SEQ ID NO: 55957 - RNA, 21 nt, Brucella suis 1330
ggcgcgguaauggccgugcgc

SEQ ID NO: 55958 - RNA, 22 nt, Brucella suis 1330
ugugccugcccguuucggcugc

SEQ ID NO: 55959 - RNA, 22 nt, Brucella suis 1330
ggugcgggagccuuugcugccc

SEQ ID NO: 55960 - RNA, 20 nt, Brucella suis 1330
ccuugcugucccauggcgcc

SEQ ID NO: 55961 - RNA, 22 nt, Brucella suis 1330
gccuuuuuauugcucuauugga

SEQ ID NO: 55962 - RNA, 22 nt, Brucella suis 1330
uuuuaggcauugaucgcaguca

SEQ ID NO: 55963 - RNA, 22 nt, Brucella suis 1330
gggcgcuuguuccggcuuccgg

SEQ ID NO: 55964 - RNA, 22 nt, Brucella suis 1330
caccggaacgaagguuuuugaa

SEQ ID NO: 55965 - RNA, 22 nt, Brucella suis 1330
aucgggagcaaccggcauggcg

SEQ ID NO: 55966 - RNA, 22 nt, Brucella suis 1330
gcggagaugcgcacggaauuga

SEQ ID NO: 55967 - RNA, 22 nt, Brucella suis 1330
ggucaggccgcccgaagccuga

SEQ ID NO: 55968 - RNA, 22 nt, Brucella suis 1330
cgcggcggccagaaugggacag

SEQ ID NO: 55969 - RNA, 22 nt, Brucella suis 1330
ucgcugaugggcauucgcgucg

SEQ ID NO: 55970 - RNA, 22 nt, Brucella suis 1330
uguuucaaacgucaaauucuaa

SEQ ID NO: 55971 - RNA, 21 nt, Brucella suis 1330
ccugcuccagagcgacaucga

SEQ ID NO: 55972 - RNA, 22 nt, Brucella suis 1330
ccagccgaggccggaaagcucg

SEQ ID NO: 55973 - RNA, 22 nt, Brucella suis 1330
accgcugauaaggaggcgcuug

SEQ ID NO: 55974 - RNA, 22 nt, Brucella suis 1330
gagcggcggucgucacgaucau

SEQ ID NO: 55975 - RNA, 19 nt, Brucella suis 1330
uggccgucaaaaacacuga

SEQ ID NO: 55976 - RNA, 22 nt, Brucella suis 1330
cagcuucgugacgcacuuuuug

SEQ ID NO: 55977 - RNA, 22 nt, Brucella suis 1330
uggcgggcggcuaucgcaucag

SEQ ID NO: 55978 - RNA, 22 nt, Brucella suis 1330
uucagagcauuuucccgcgcag

SEQ ID NO: 55979 - RNA, 22 nt, Brucella suis 1330
cugcgagaugccgguugaggau

SEQ ID NO: 55980 - RNA, 22 nt, Brucella suis 1330
uuggauggcauagaagccuucc

SEQ ID NO: 55981 - RNA, 22 nt, Brucella suis 1330
augggcaaugauuucauguucg

SEQ ID NO: 55982 - RNA, 22 nt, Brucella suis 1330
cuuuggcuggaaugucucgccc

SEQ ID NO: 55983 - RNA, 22 nt, Brucella suis 1330
gaucggcauugguuuugcuauu

SEQ ID NO: 55984 - RNA, 22 nt, Brucella suis 1330
gggaugcaaauguuggaaucag

SEQ ID NO: 55985 - RNA, 22 nt, Brucella suis 1330
ugcggcacgcccggcccguuau

SEQ ID NO: 55986 - RNA, 22 nt, Brucella suis 1330
ucggccauggcugccuguuuga

SEQ ID NO: 55987 - RNA, 22 nt, Brucella suis 1330
cggcccuucccaugcugcucgu

SEQ ID NO: 55988 - RNA, 22 nt, Brucella suis 1330
ugggcgcugccuucggcggucc

SEQ ID NO: 55989 - RNA, 23 nt, Brucella suis 1330
ccgaaaucagccagcgcaucggc

SEQ ID NO: 55990 - RNA, 22 nt, Brucella suis 1330
cgguuucggcaggcucuuuccg

SEQ ID NO: 55991 - RNA, 22 nt, Brucella suis 1330
gcgcaugguaaucaucgugccu

SEQ ID NO: 55992 - RNA, 22 nt, Brucella suis 1330
gccguucccgucugugcuguuu

SEQ ID NO: 55993 - RNA, 22 nt, Brucella suis 1330
ccgcagaucagccuugaggcug

SEQ ID NO: 55994 - RNA, 22 nt, Brucella suis 1330
gauguggcugucgauggugcga

SEQ ID NO: 55995 - RNA, 22 nt, Brucella suis 1330
gaccgccauugccgcgcugcug

SEQ ID NO: 55996 - RNA, 22 nt, Brucella suis 1330
cgugaccacgacauuuucgcuu

SEQ ID NO: 55997 - RNA, 22 nt, Brucella suis 1330
ucguggaagcguaauccugguc

SEQ ID NO: 55998 - RNA, 21 nt, Brucella suis 1330
ugcaacagggucagauggcgg

SEQ ID NO: 55999 - RNA, 22 nt, Brucella suis 1330
ucuggcguucgaugaucgugcc

SEQ ID NO: 56000 - RNA, 22 nt, Brucella suis 1330
aucuggucgcuuucgaugguga

SEQ ID NO: 56001 - RNA, 22 nt, Brucella suis 1330
uggaaagcugaugagucgcccg

SEQ ID NO: 56002 - RNA, 22 nt, Brucella suis 1330
aagggcgaguuuggcgucuauc

SEQ ID NO: 56003 - RNA, 22 nt, Brucella suis 1330
cuuggcaucgggauagaaggag

SEQ ID NO: 56004 - RNA, 22 nt, Brucella suis 1330
aagccguuuuugugcugcucgg

SEQ ID NO: 56005 - RNA, 22 nt, Brucella suis 1330
aucgccaacgcgguugacaacg

SEQ ID NO: 56006 - RNA, 22 nt, Brucella suis 1330
ugcuuccaccgccgcaucgagc

SEQ ID NO: 56007 - RNA, 22 nt, Brucella suis 1330
uggaacgaguggucguacaugg

SEQ ID NO: 56008 - RNA, 22 nt, Brucella suis 1330
ggaaaaugucgcgggcgagaug

SEQ ID NO: 56009 - RNA, 21 nt, Brucella suis 1330
acauauucaaaguccggcgua

SEQ ID NO: 56010 - RNA, 22 nt, Brucella suis 1330
gucgagcacaagcaggcuuuug

SEQ ID NO: 56011 - RNA, 22 nt, Brucella suis 1330
augcgcucugcaagcguuaugg

SEQ ID NO: 56012 - RNA, 22 nt, Brucella suis 1330
gaggcuggucuccgccaugcgc

SEQ ID NO: 56013 - RNA, 22 nt, Brucella suis 1330
cgacgagcaggcuuugcgcggc

SEQ ID NO: 56014 - RNA, 22 nt, Brucella suis 1330
gcauuuuaagagcauaauccag

SEQ ID NO: 56015 - RNA, 22 nt, Brucella suis 1330
auugucgagggucugcuugagg

SEQ ID NO: 56016 - RNA, 22 nt, Brucella suis 1330
cauugcggcggcauuggccgaa

SEQ ID NO: 56017 - RNA, 22 nt, Brucella suis 1330
gcuccgaagucuuguguucggu

SEQ ID NO: 56018 - RNA, 20 nt, Brucella suis 1330
cggcugcaagcaaggcuguc

SEQ ID NO: 56019 - RNA, 18 nt, Brucella suis 1330
acgucggcagugaaacgg

SEQ ID NO: 56020 - RNA, 22 nt, Brucella suis 1330
uuuugcuggaaaugcucuaaau

SEQ ID NO: 56021 - RNA, 22 nt, Brucella suis 1330
auaucgccgccuuccaugggag

SEQ ID NO: 56022 - RNA, 21 nt, Brucella suis 1330
aagcgcaucauagucauacgg

SEQ ID NO: 56023 - RNA, 22 nt, Brucella suis 1330
ugaucgggcuuggcuuccguuc

SEQ ID NO: 56024 - RNA, 22 nt, Brucella suis 1330
uggugcaguucuggcccgacug

SEQ ID NO: 56025 - RNA, 22 nt, Brucella suis 1330
cgcaauauugcgcauuuccgcc

SEQ ID NO: 56026 - RNA, 22 nt, Brucella suis 1330
gcagcaggaugcgcgggugaag

SEQ ID NO: 56027 - RNA, 22 nt, Brucella suis 1330
cgcguuuucggaucgaagccug

SEQ ID NO: 56028 - RNA, 22 nt, Brucella suis 1330
cgcgcccagaccaucgccuaug

SEQ ID NO: 56029 - RNA, 22 nt, Brucella suis 1330
ugccgcugaucuggccggagcc

SEQ ID NO: 56030 - RNA, 20 nt, Brucella suis 1330
ucgagcgcaucggcaagugc

SEQ ID NO: 56031 - RNA, 22 nt, Brucella suis 1330
gugcggugacacugcuuucacc

SEQ ID NO: 56032 - RNA, 22 nt, Brucella suis 1330
cgcgauccuuguauucgucaua

SEQ ID NO: 56033 - RNA, 22 nt, Brucella suis 1330
acgaucucacacgcgaugccuu

SEQ ID NO: 56034 - RNA, 22 nt, Brucella suis 1330
ccagugauuggccggaccagaa

SEQ ID NO: 56035 - RNA, 22 nt, Brucella suis 1330
cgucggcgggcaucauuuuuuc

SEQ ID NO: 56036 - RNA, 22 nt, Brucella suis 1330
uugcugauugcccuugccguua

SEQ ID NO: 56037 - RNA, 22 nt, Brucella suis 1330
aagcggucugcuggaaggcgau

SEQ ID NO: 56038 - RNA, 18 nt, Brucella suis 1330
ucucaagacggucgcuug

SEQ ID NO: 56039 - RNA, 22 nt, Brucella suis 1330
gcuuuucaagcggcaguugccc

SEQ ID NO: 56040 - RNA, 22 nt, Brucella suis 1330
gaacaugacguucgauagauca

SEQ ID NO: 56041 - RNA, 22 nt, Brucella suis 1330
agcagguucgguuagagcauuu

SEQ ID NO: 56042 - RNA, 22 nt, Brucella suis 1330
agagcauuuucgagccaaaacu

SEQ ID NO: 56043 - RNA, 22 nt, Brucella suis 1330
cguaggcaguuuuggaagagcc

SEQ ID NO: 56044 - RNA, 20 nt, Brucella suis 1330
ggcauuccaccuuguccagc

SEQ ID NO: 56045 - RNA, 22 nt, Brucella suis 1330
aucaucgccacgcacgaucuuu

SEQ ID NO: 56046 - RNA, 22 nt, Brucella suis 1330
agcugcauguuucacgugaauc

SEQ ID NO: 56047 - RNA, 22 nt, Brucella suis 1330
auggccuuggccugcgugucgg

SEQ ID NO: 56048 - RNA, 22 nt, Brucella suis 1330
aucggaaugcgaggcaagugaa

SEQ ID NO: 56049 - RNA, 22 nt, Brucella suis 1330
auuggcaagaucaaggcgauau

SEQ ID NO: 56050 - RNA, 23 nt, Brucella suis 1330
ggcugcaaccagcgaagagugcu

SEQ ID NO: 56051 - RNA, 22 nt, Brucella suis 1330
gaaaucugcgccugugucggcu

SEQ ID NO: 56052 - RNA, 22 nt, Brucella suis 1330
ucagugcgggcgacuggauggg

SEQ ID NO: 56053 - RNA, 22 nt, Brucella suis 1330
ggcggcaugcguuuuggcgcgu

SEQ ID NO: 56054 - RNA, 22 nt, Brucella suis 1330
uuggccaaaagcaguggaagcc

SEQ ID NO: 56055 - RNA, 22 nt, Brucella suis 1330
ggcgaaagcgcuggaauauugc

SEQ ID NO: 56056 - RNA, 22 nt, Brucella suis 1330
cggcccgacaucauagaggcga

SEQ ID NO: 56057 - RNA, 22 nt, Brucella suis 1330
gaagaccgcuaucgcaagaugu

SEQ ID NO: 56058 - RNA, 22 nt, Brucella suis 1330
cugggcaaggagcgugucggcc

SEQ ID NO: 56059 - RNA, 22 nt, Brucella suis 1330
cgaucaucaugacaguacugcu

SEQ ID NO: 56060 - RNA, 22 nt, Brucella suis 1330
ggauggauggcgaggccgauau

SEQ ID NO: 56061 - RNA, 21 nt, Brucella suis 1330
ugcgaccgccguugucgaggu

SEQ ID NO: 56062 - RNA, 22 nt, Brucella suis 1330
gcgauggaucaucgccgcgcgg

SEQ ID NO: 56063 - RNA, 22 nt, Brucella suis 1330
uuccauauccaucccgaagggg

SEQ ID NO: 56064 - RNA, 22 nt, Brucella suis 1330
ggcggcacggcuucugggucuu

SEQ ID NO: 56065 - RNA, 22 nt, Brucella suis 1330
gcauggcgaaggcgaggauggc

SEQ ID NO: 56066 - RNA, 22 nt, Brucella suis 1330
caucauggaacgagaacgcccc

SEQ ID NO: 56067 - RNA, 22 nt, Brucella suis 1330
cgacaagcugcgguucgucuuc

SEQ ID NO: 56068 - RNA, 22 nt, Brucella suis 1330
gaaggcaaccuucuuguccggg

SEQ ID NO: 56069 - RNA, 22 nt, Brucella suis 1330
acaaagaguuagggcuguuccg

SEQ ID NO: 56070 - RNA, 22 nt, Brucella suis 1330
aucuggcuuucgggcugggcuc

SEQ ID NO: 56071 - RNA, 22 nt, Brucella suis 1330
gaaggcgaggugcugcggguug

SEQ ID NO: 56072 - RNA, 22 nt, Brucella suis 1330
aaggucaucgauuucgaugucg

SEQ ID NO: 56073 - RNA, 22 nt, Brucella suis 1330
gacgauuuugaugucagccgcc

SEQ ID NO: 56074 - RNA, 22 nt, Brucella suis 1330
gacuggcagcuucugccguggc

SEQ ID NO: 56075 - RNA, 22 nt, Brucella suis 1330
cggcagcucaagcgggccuuug

SEQ ID NO: 56076 - RNA, 22 nt, Brucella suis 1330
gcgguaaauguaaaagugagug

SEQ ID NO: 56077 - RNA, 22 nt, Brucella suis 1330
aagcugcgcuuuucuccccaga

SEQ ID NO: 56078 - RNA, 22 nt, Brucella suis 1330
gcguggcccgguugauaucuuc

SEQ ID NO: 56079 - RNA, 22 nt, Brucella suis 1330
ccgguucgacugacgauuccgc

SEQ ID NO: 56080 - RNA, 22 nt, Brucella suis 1330
cggcggaauucggcccgacuac

SEQ ID NO: 56081 - RNA, 22 nt, Brucella suis 1330
guugaagcggcgaaacgccaaa

SEQ ID NO: 56082 - RNA, 22 nt, Brucella suis 1330
agcagguucagggagugcuugc

SEQ ID NO: 56083 - RNA, 22 nt, Brucella suis 1330
uucggcagcgguugccgcaugu

SEQ ID NO: 56084 - RNA, 22 nt, Brucella suis 1330
gugaaauggaucgugcgggaau

SEQ ID NO: 56085 - RNA, 22 nt, Brucella suis 1330
ucaucgggcuugacgaagcgga

SEQ ID NO: 56086 - RNA, 22 nt, Brucella suis 1330
gucggcgcguaucaugcgccag

SEQ ID NO: 56087 - RNA, 22 nt, Brucella suis 1330
ccagcuucaggaaauggccgau

SEQ ID NO: 56088 - RNA, 21 nt, Brucella suis 1330
cuugaucucgaugaugccguc

SEQ ID NO: 56089 - RNA, 22 nt, Brucella suis 1330
acgcuucauucccugauuuauc

SEQ ID NO: 56090 - RNA, 22 nt, Brucella suis 1330
aauguuggaaucagaccacuag

SEQ ID NO: 56091 - RNA, 22 nt, Brucella suis 1330
gucgagcaaauguuggaaucac

SEQ ID NO: 56092 - RNA, 22 nt, Brucella suis 1330
cauuugccgauaaucgcaucgg

SEQ ID NO: 56093 - RNA, 23 nt, Brucella suis 1330
aauggccgccggugucaucgauc

SEQ ID NO: 56094 - RNA, 22 nt, Brucella suis 1330
uuuuccgcgauaugcuuaaguu

SEQ ID NO: 56095 - RNA, 22 nt, Brucella suis 1330
aaggcguuccgauccaccggug

SEQ ID NO: 56096 - RNA, 22 nt, Brucella suis 1330
aucgguacggucgccaucacgg

SEQ ID NO: 56097 - RNA, 22 nt, Brucella suis 1330
uugaagcggcagcuugcgcauu

SEQ ID NO: 56098 - RNA, 22 nt, Brucella suis 1330
gaucucgaaaauuccgggugcu

SEQ ID NO: 56099 - RNA, 22 nt, Brucella suis 1330
gaugaaaagccauuuccagucg

SEQ ID NO: 56100 - RNA, 22 nt, Brucella suis 1330
ggugccgcacgaaacucaucgu

SEQ ID NO: 56101 - RNA, 22 nt, Brucella suis 1330
ggcgccacuuucguuucaacag

SEQ ID NO: 56102 - RNA, 22 nt, Brucella suis 1330
uugcccggaucguguuugccgu

SEQ ID NO: 56103 - RNA, 22 nt, Brucella suis 1330
ugcagccuugagacgugaugcg

SEQ ID NO: 56104 - RNA, 22 nt, Brucella suis 1330
aggcaucgcgugugagaucgua

SEQ ID NO: 56105 - RNA, 22 nt, Brucella suis 1330
aucguuccggcauggugcugaa

SEQ ID NO: 56106 - RNA, 22 nt, Brucella suis 1330
ucgauggaugcggagcugaugc

SEQ ID NO: 56107 - RNA, 22 nt, Brucella suis 1330
uggcgugcgauaccgucgucaa

SEQ ID NO: 56108 - RNA, 22 nt, Brucella suis 1330
uggcggauauuuucggcuauga

SEQ ID NO: 56109 - RNA, 22 nt, Brucella suis 1330
cgccauucugguggccaucaau

SEQ ID NO: 56110 - RNA, 22 nt, Brucella suis 1330
cgaccccgcccgaucugcuucg

SEQ ID NO: 56111 - RNA, 22 nt, Brucella suis 1330
ggugaucgcuggauggucugcc

SEQ ID NO: 56112 - RNA, 22 nt, Brucella suis 1330
gcaggccauugaagauuucgcc

SEQ ID NO: 56113 - RNA, 22 nt, Brucella suis 1330
caagaccugaucgcagaaccuu

SEQ ID NO: 56114 - RNA, 22 nt, Brucella suis 1330
ggugccgauaacaaaggaggga

SEQ ID NO: 56115 - RNA, 22 nt, Brucella suis 1330
gcggggcgcgugaacauggaug

SEQ ID NO: 56116 - RNA, 22 nt, Brucella suis 1330
uggauugcaaggcauucacgca

SEQ ID NO: 56117 - RNA, 22 nt, Brucella suis 1330
cgcuggaggcaucgaagguugc

SEQ ID NO: 56118 - RNA, 19 nt, Brucella suis 1330
uccguuuucgaugcgccag

SEQ ID NO: 56119 - RNA, 22 nt, Brucella suis 1330
aggccggugauaucgaugccca

SEQ ID NO: 56120 - RNA, 22 nt, Brucella suis 1330
cgcgaugaaaaugugaagcucg

SEQ ID NO: 56121 - RNA, 22 nt, Brucella suis 1330
gguguugacgguuuccagauuc

SEQ ID NO: 56122 - RNA, 22 nt, Brucella suis 1330
gauuccaacauuugccucccuc

SEQ ID NO: 56123 - RNA, 22 nt, Brucella suis 1330
ggcugucgcgccuuuucuaugg

SEQ ID NO: 56124 - RNA, 22 nt, Brucella suis 1330
ggcgaugaacgcuugcaagcug

SEQ ID NO: 56125 - RNA, 22 nt, Brucella suis 1330
gcggcaucagacgccuucugca

SEQ ID NO: 56126 - RNA, 22 nt, Brucella suis 1330
aaggaaucgauuucggccgcgg

SEQ ID NO: 56127 - RNA, 22 nt, Brucella suis 1330
ugcgcgccguugaaaccgugcg

SEQ ID NO: 56128 - RNA, 18 nt, Brucella suis 1330
gcaggcggccuugccaug

SEQ ID NO: 56129 - RNA, 22 nt, Brucella suis 1330
ugcaagccgcaagcccggcagc

SEQ ID NO: 56130 - RNA, 22 nt, Brucella suis 1330
cggacgaaaacucggccauugg

SEQ ID NO: 56131 - RNA, 22 nt, Brucella suis 1330
gacggcucgacggugcuguuuu

SEQ ID NO: 56132 - RNA, 22 nt, Brucella suis 1330
aggugaaggucauuuccacgcc

SEQ ID NO: 56133 - RNA, 22 nt, Brucella suis 1330
gaugcggcagcuuucggcgccu

SEQ ID NO: 56134 - RNA, 22 nt, Brucella suis 1330
ugacgcaugauuccaucggucu

SEQ ID NO: 56135 - RNA, 22 nt, Brucella suis 1330
gcguucaaccgugauagcguuc

SEQ ID NO: 56136 - RNA, 22 nt, Brucella suis 1330
cgucgauguggcuccgcugauc

SEQ ID NO: 56137 - RNA, 22 nt, Brucella suis 1330
gacggcaugggacaggugagcg

SEQ ID NO: 56138 - RNA, 22 nt, Brucella suis 1330
aaggcgcaguucugcaagcagu

SEQ ID NO: 56139 - RNA, 22 nt, Brucella suis 1330
cccggcucgauuucgacgaacg

SEQ ID NO: 56140 - RNA, 22 nt, Brucella suis 1330
gucgaugucagcguggccgauc

SEQ ID NO: 56141 - RNA, 22 nt, Brucella suis 1330
caugcucgccuauauccucugg

SEQ ID NO: 56142 - RNA, 22 nt, Brucella suis 1330
aaggaugucguaaacauugaug

SEQ ID NO: 56143 - RNA, 22 nt, Brucella suis 1330
gcuggugcugccggggcgcgau

SEQ ID NO: 56144 - RNA, 22 nt, Brucella suis 1330
augcagcgcgucuuccggugug

SEQ ID NO: 56145 - RNA, 21 nt, Brucella suis 1330
aaguuucuugucgugaaucgc

SEQ ID NO: 56146 - RNA, 19 nt, Brucella suis 1330
ccuccgauccgaaauggua

SEQ ID NO: 56147 - RNA, 22 nt, Brucella suis 1330
gaugaaaauauggaggaguugg

SEQ ID NO: 56148 - RNA, 22 nt, Brucella suis 1330
cucggcguuggagacgcgccag

SEQ ID NO: 56149 - RNA, 22 nt, Brucella suis 1330
ggaaugcugaucaaauuguugc

SEQ ID NO: 56150 - RNA, 22 nt, Brucella suis 1330
caugaugcgccgaauauccugc

SEQ ID NO: 56151 - RNA, 22 nt, Brucella suis 1330
cuaaagcauuuccagcaaaagu

SEQ ID NO: 56152 - RNA, 22 nt, Brucella suis 1330
aauucucgggcgcaauaucgac

SEQ ID NO: 56153 - RNA, 20 nt, Brucella suis 1330
gcaaaacgaggagacuuguc

SEQ ID NO: 56154 - RNA, 22 nt, Brucella suis 1330
uaagagcaggcaguuccagcgg

SEQ ID NO: 56155 - RNA, 22 nt, Brucella suis 1330
cgcccggcacuucugguuuuug

SEQ ID NO: 56156 - RNA, 22 nt, Brucella suis 1330
uggucgcaaucaggcagcgcca

SEQ ID NO: 56157 - RNA, 22 nt, Brucella suis 1330
ucgaggaugcgggaaaggccga

SEQ ID NO: 56158 - RNA, 22 nt, Brucella suis 1330
aauaucggccuugaugucgaua

SEQ ID NO: 56159 - RNA, 22 nt, Brucella suis 1330
accgaacacaagacuucggagc

SEQ ID NO: 56160 - RNA, 22 nt, Brucella suis 1330
aucggccucuccuucaugucgu

SEQ ID NO: 56161 - RNA, 22 nt, Brucella suis 1330
aaggaccggucuaugugaacau

SEQ ID NO: 56162 - RNA, 22 nt, Brucella suis 1330
gucucgaucaaggccgcggcaa

SEQ ID NO: 56163 - RNA, 20 nt, Brucella suis 1330
augcggcgcaucggcugucg

SEQ ID NO: 56164 - RNA, 22 nt, Brucella suis 1330
gcugcucgacugggaccgcaug

SEQ ID NO: 56165 - RNA, 22 nt, Brucella suis 1330
ccaguucgucggcaugugccag

SEQ ID NO: 56166 - RNA, 22 nt, Brucella suis 1330
ucgauauguauuacucgguaua

SEQ ID NO: 56167 - RNA, 22 nt, Brucella suis 1330
ggguggcaaacaugccauccau

SEQ ID NO: 56168 - RNA, 22 nt, Brucella suis 1330
aggcugccauggccgcaacggc

SEQ ID NO: 56169 - RNA, 22 nt, Brucella suis 1330
cauguguccgcagucgccaaag

SEQ ID NO: 56170 - RNA, 22 nt, Brucella suis 1330
ugcaggcgaacuggguggucaa

SEQ ID NO: 56171 - RNA, 22 nt, Brucella suis 1330
gacggcacacugaucgacuucg

SEQ ID NO: 56172 - RNA, 22 nt, Brucella suis 1330
cgugaaaucgauccgugccguc

SEQ ID NO: 56173 - RNA, 22 nt, Brucella suis 1330
gacgaggccgaguuucgcaauu

SEQ ID NO: 56174 - RNA, 22 nt, Brucella suis 1330
ugguucggucggcgauugccug

SEQ ID NO: 56175 - RNA, 22 nt, Brucella suis 1330
aggcgcaugacugcgccgcguc

SEQ ID NO: 56176 - RNA, 22 nt, Brucella suis 1330
cguaacauugcgugagaucggg

SEQ ID NO: 56177 - RNA, 22 nt, Brucella suis 1330
uucgcgaaaacaucaagaggcu

SEQ ID NO: 56178 - RNA, 22 nt, Brucella suis 1330
uggcugaagugaugcguuuuga

SEQ ID NO: 56179 - RNA, 22 nt, Brucella suis 1330
ccuuucuguuucgugggguuca

SEQ ID NO: 56180 - RNA, 22 nt, Brucella suis 1330
augcgaucgaguucgccgagcg

SEQ ID NO: 56181 - RNA, 22 nt, Brucella suis 1330
uggcaaugauaauacucuggag

SEQ ID NO: 56182 - RNA, 22 nt, Brucella suis 1330
cggcgcaagccugccaauggug

SEQ ID NO: 56183 - RNA, 22 nt, Brucella suis 1330
ugggccguccugaacagcgcaa

SEQ ID NO: 56184 - RNA, 22 nt, Brucella suis 1330
uauggcggauagcgauaugauc

SEQ ID NO: 56185 - RNA, 22 nt, Brucella suis 1330
uggccgaugaaaaccaugcugg

SEQ ID NO: 56186 - RNA, 22 nt, Brucella suis 1330
ucccgcaagcgaggugauggcc

SEQ ID NO: 56187 - RNA, 22 nt, Brucella suis 1330
aucguuucaaauccgucuccgc

SEQ ID NO: 56188 - RNA, 22 nt, Brucella suis 1330
ugcguggacuuucgauauggug

SEQ ID NO: 56189 - RNA, 22 nt, Brucella suis 1330
augaaaccgaaacccguaugcc

SEQ ID NO: 56190 - RNA, 22 nt, Brucella suis 1330
gguucaggaagugcgccuggcc

SEQ ID NO: 56191 - RNA, 22 nt, Brucella suis 1330
uggcggauaaugccgauaucau

SEQ ID NO: 56192 - RNA, 22 nt, Brucella suis 1330
aaggcgcacaaugccggaacgg

SEQ ID NO: 56193 - RNA, 21 nt, Brucella suis 1330
uggaaaugcucuaaaaagaua

SEQ ID NO: 56194 - RNA, 22 nt, Brucella suis 1330
gcgcauugucaucugcaagguc

SEQ ID NO: 56195 - RNA, 22 nt, Brucella suis 1330
ucguaauucucauauucggcuu

SEQ ID NO: 56196 - RNA, 22 nt, Brucella suis 1330
augagguggaucccgaacuucu

SEQ ID NO: 56197 - RNA, 22 nt, Brucella suis 1330
ucgccgacaacgaugcggccac

SEQ ID NO: 56198 - RNA, 22 nt, Brucella suis 1330
ggagccugccagaaaagguagg

SEQ ID NO: 56199 - RNA, 22 nt, Brucella suis 1330
cgccguugcgaucaugaugccu

SEQ ID NO: 56200 - RNA, 22 nt, Brucella suis 1330
aacgcguuuuaaucgucuuagu

SEQ ID NO: 56201 - RNA, 21 nt, Brucella suis 1330
ugcagacauggacauauuccc

SEQ ID NO: 56202 - RNA, 22 nt, Brucella suis 1330
agggcuuuacagguuucuugug

SEQ ID NO: 56203 - RNA, 22 nt, Brucella suis 1330
uauuuucgcuuaucaagaauac

SEQ ID NO: 56204 - RNA, 22 nt, Brucella suis 1330
cugguaaagcuugaauucuuca

SEQ ID NO: 56205 - RNA, 22 nt, Brucella suis 1330
gccgugacgguuuccgugcgga

SEQ ID NO: 56206 - RNA, 22 nt, Brucella suis 1330
gaucgcgcgcagccaugcaagu

SEQ ID NO: 56207 - RNA, 22 nt, Brucella suis 1330
gcggcgaugguucauugugcgg

SEQ ID NO: 56208 - RNA, 22 nt, Brucella suis 1330
gcccgccaucgggaucaccgcu

SEQ ID NO: 56209 - RNA, 22 nt, Brucella suis 1330
gaaccgcucugauuauuuguuu

SEQ ID NO: 56210 - RNA, 21 nt, Brucella suis 1330
cagcacuugauggcgggccgg

SEQ ID NO: 56211 - RNA, 22 nt, Brucella suis 1330
aucuagagcauuuccagcaaaa

SEQ ID NO: 56212 - RNA, 18 nt, Brucella suis 1330
uggcacugaucucaucgc

SEQ ID NO: 56213 - RNA, 22 nt, Brucella suis 1330
uaucgaagcuuuuuucggucga

SEQ ID NO: 56214 - RNA, 22 nt, Brucella suis 1330
ucgacaagggccgcauugugga

SEQ ID NO: 56215 - RNA, 22 nt, Brucella suis 1330
cagccguuuccggcgugauggc

SEQ ID NO: 56216 - RNA, 22 nt, Brucella suis 1330
augaugcaucguugaucaagau

SEQ ID NO: 56217 - RNA, 22 nt, Brucella suis 1330
ucguggucugcggcgcguugaa

SEQ ID NO: 56218 - RNA, 22 nt, Brucella suis 1330
cgguuggcgcaaacgcaggucu

SEQ ID NO: 56219 - RNA, 21 nt, Brucella suis 1330
cgcgugugcuugcggggcggg

SEQ ID NO: 56220 - RNA, 18 nt, Brucella suis 1330
ggcgccuugucgaguuuc

SEQ ID NO: 56221 - RNA, 18 nt, Brucella suis 1330
cagaaaagaaccgcuuga

SEQ ID NO: 56222 - RNA, 22 nt, Brucella suis 1330
cugccuuuugagcagacagcuu

SEQ ID NO: 56223 - RNA, 22 nt, Brucella suis 1330
cacugguccgccguucgcugag

SEQ ID NO: 56224 - RNA, 22 nt, Brucella suis 1330
ggugccguuuugcagcgacugg

SEQ ID NO: 56225 - RNA, 22 nt, Brucella suis 1330
gcuucuugauuucggugcgcau

SEQ ID NO: 56226 - RNA, 22 nt, Brucella suis 1330
gguggagcauaucaagcucauc

SEQ ID NO: 56227 - RNA, 22 nt, Brucella suis 1330
uugagggcugccaccguaucgc

SEQ ID NO: 56228 - RNA, 22 nt, Brucella suis 1330
uuuaugguggggcaaauggcga

SEQ ID NO: 56229 - RNA, 22 nt, Brucella suis 1330
ugcgcuugaccuguucaucgac

SEQ ID NO: 56230 - RNA, 22 nt, Brucella suis 1330
agggcagugaagaauauggucg

SEQ ID NO: 56231 - RNA, 22 nt, Brucella suis 1330
ccuugcggcgauccucgcguac

SEQ ID NO: 56232 - RNA, 22 nt, Brucella suis 1330
cagaucaauuuccauuugcagc

SEQ ID NO: 56233 - RNA, 22 nt, Brucella suis 1330
agccggaucaaacgcuggcgac

SEQ ID NO: 56234 - RNA, 22 nt, Brucella suis 1330
ucaucgagaagcaggagcuucg

SEQ ID NO: 56235 - RNA, 22 nt, Brucella suis 1330
gcgccggggucaacaugcccga

SEQ ID NO: 56236 - RNA, 22 nt, Brucella suis 1330
acaaugauauagcccuuuucgg

SEQ ID NO: 56237 - RNA, 22 nt, Brucella suis 1330
ucaauauugcggccuguucgcu

SEQ ID NO: 56238 - RNA, 22 nt, Brucella suis 1330
gaagcucggcuaucucuacaau

SEQ ID NO: 56239 - RNA, 22 nt, Brucella suis 1330
cagcaauagaggaaaccaaggc

SEQ ID NO: 56240 - RNA, 22 nt, Brucella suis 1330
augacgugaauuguugcuggug

SEQ ID NO: 56241 - RNA, 22 nt, Brucella suis 1330
gagauauaggugaagucgucga

SEQ ID NO: 56242 - RNA, 22 nt, Brucella suis 1330
uaccggucuucagggcuaugau

SEQ ID NO: 56243 - RNA, 22 nt, Brucella suis 1330
ucaaguauuuccugaugcaaaa

SEQ ID NO: 56244 - RNA, 22 nt, Brucella suis 1330
uguggacguguucaaggccgau

SEQ ID NO: 56245 - RNA, 22 nt, Brucella suis 1330
aacgccaucaugcuugucaucg

SEQ ID NO: 56246 - RNA, 22 nt, Brucella suis 1330
acaggcguagcuggaucgggcu

SEQ ID NO: 56247 - RNA, 22 nt, Brucella suis 1330
cugccugcggaaugcgggcaag

SEQ ID NO: 56248 - RNA, 20 nt, Brucella suis 1330
uggcaucgagguucgagagc

SEQ ID NO: 56249 - RNA, 22 nt, Brucella suis 1330
gcuggaacugcauggccccgga

SEQ ID NO: 56250 - RNA, 22 nt, Brucella suis 1330
ucaagcggaaucacauuuugca

SEQ ID NO: 56251 - RNA, 22 nt, Brucella suis 1330
aggcggcaucuucgaucacugg

SEQ ID NO: 56252 - RNA, 22 nt, Brucella suis 1330
ucgccgaucggccauuugcagg

SEQ ID NO: 56253 - RNA, 22 nt, Brucella suis 1330
aauagcugucgaacugguugga

SEQ ID NO: 56254 - RNA, 22 nt, Brucella suis 1330
ccggccuuauuuccgaccuuuc

SEQ ID NO: 56255 - RNA, 22 nt, Brucella suis 1330
cguguucgccgguucacuucau

SEQ ID NO: 56256 - RNA, 20 nt, Brucella suis 1330
cgggaaggucgcauugucau

SEQ ID NO: 56257 - RNA, 22 nt, Brucella suis 1330
ggggcgcaacacuccauauugc

SEQ ID NO: 56258 - RNA, 22 nt, Brucella suis 1330
uuuggcggcaauugccgccaug

SEQ ID NO: 56259 - RNA, 22 nt, Brucella suis 1330
cugcgggcgcgguggaaaagua

SEQ ID NO: 56260 - RNA, 22 nt, Brucella suis 1330
ccuguuccagcgcacugaccug

SEQ ID NO: 56261 - RNA, 22 nt, Brucella suis 1330
cggugcgucguccgauagcguc

SEQ ID NO: 56262 - RNA, 22 nt, Brucella suis 1330
aggcggcguucaguaucugcuc

SEQ ID NO: 56263 - RNA, 22 nt, Brucella suis 1330
gauccgcgccauacguugaacg

SEQ ID NO: 56264 - RNA, 22 nt, Brucella suis 1330
gcgggucagcggcggcgucagg

SEQ ID NO: 56265 - RNA, 21 nt, Brucella suis 1330
uugccucgccauugaugagau

SEQ ID NO: 56266 - RNA, 20 nt, Brucella suis 1330
cgccauccacacucgccagc

SEQ ID NO: 56267 - RNA, 22 nt, Brucella suis 1330
acggugacgguggcgccauguu

SEQ ID NO: 56268 - RNA, 22 nt, Brucella suis 1330
ccgcucuaggauuuuugcuguu

SEQ ID NO: 56269 - RNA, 22 nt, Brucella suis 1330
aguucaggucgauuuggggagc

SEQ ID NO: 56270 - RNA, 23 nt, Brucella suis 1330
ucgaaggguucaagcgcggcgug

SEQ ID NO: 56271 - RNA, 23 nt, Brucella suis 1330
augucguuauccggcugcuguuc

SEQ ID NO: 56272 - RNA, 22 nt, Brucella suis 1330
uggggcgguacugcaugagggc

SEQ ID NO: 56273 - RNA, 20 nt, Brucella suis 1330
uucucugccgccggaugcuc

SEQ ID NO: 56274 - RNA, 22 nt, Brucella suis 1330
agcggggucaaaaacgcgcugc

SEQ ID NO: 56275 - RNA, 22 nt, Brucella suis 1330
uuucaucggaaaugcggucgca

SEQ ID NO: 56276 - RNA, 22 nt, Brucella suis 1330
guucugguucgugcaaagcuua

SEQ ID NO: 56277 - RNA, 22 nt, Brucella suis 1330
gcggcuaucaccggcggcuggg

SEQ ID NO: 56278 - RNA, 21 nt, Brucella suis 1330
cggaucggcucguugauccau

SEQ ID NO: 56279 - RNA, 22 nt, Brucella suis 1330
agcgaagaagacaauucgggca

SEQ ID NO: 56280 - RNA, 22 nt, Brucella suis 1330
ggucgagcgcaucgccgcccug

SEQ ID NO: 56281 - RNA, 22 nt, Brucella suis 1330
gugggcgucgagcgugucgaga

SEQ ID NO: 56282 - RNA, 22 nt, Brucella suis 1330
gccguugcaauguuucacguga

SEQ ID NO: 56283 - RNA, 22 nt, Brucella suis 1330
augucggucauuucgggcaagu

SEQ ID NO: 56284 - RNA, 22 nt, Brucella suis 1330
ucacuuccucgaucauuucgcc

SEQ ID NO: 56285 - RNA, 22 nt, Brucella suis 1330
uuggccuguuguucgcuucgau

SEQ ID NO: 56286 - RNA, 22 nt, Brucella suis 1330
cagcgggcuguuucucgaccau

SEQ ID NO: 56287 - RNA, 22 nt, Brucella suis 1330
gaugcgccccugccgggaaaca

SEQ ID NO: 56288 - RNA, 20 nt, Brucella suis 1330
ugaaaggaucaugcaguuuu

SEQ ID NO: 56289 - RNA, 22 nt, Brucella suis 1330
ccggccauucacuucaaaaugu

SEQ ID NO: 56290 - RNA, 22 nt, Brucella suis 1330
accuggaagggugagccgguua

SEQ ID NO: 56291 - RNA, 22 nt, Brucella suis 1330
ccgcgaucuggccgugaucgaa

SEQ ID NO: 56292 - RNA, 22 nt, Brucella suis 1330
aaugccguuggugccuucauag

SEQ ID NO: 56293 - RNA, 22 nt, Brucella suis 1330
ccgccuauggcuuuacccugaa

SEQ ID NO: 56294 - RNA, 22 nt, Brucella suis 1330
ccccucgcucugaucggggcgc

SEQ ID NO: 56295 - RNA, 22 nt, Brucella suis 1330
aagacgauuuuugugcgcgccg

SEQ ID NO: 56296 - RNA, 22 nt, Brucella suis 1330
ucgccgauacgucaccaucgau

SEQ ID NO: 56297 - RNA, 22 nt, Brucella suis 1330
aucguggugacgagccuucaga

SEQ ID NO: 56298 - RNA, 22 nt, Brucella suis 1330
ggcgaagacguaauggaacugc

SEQ ID NO: 56299 - RNA, 22 nt, Brucella suis 1330
gacggcgaucuuggcgcgggaa

SEQ ID NO: 56300 - RNA, 22 nt, Brucella suis 1330
aucagcaugauggccggaucga

SEQ ID NO: 56301 - RNA, 22 nt, Brucella suis 1330
ugaaacgcaggaggcguugaaa

SEQ ID NO: 56302 - RNA, 22 nt, Brucella suis 1330
acgccggucgaaccgucugcgg

SEQ ID NO: 56303 - RNA, 22 nt, Brucella suis 1330
aaaccgauaaaggugggcguug

SEQ ID NO: 56304 - RNA, 22 nt, Brucella suis 1330
gcgcggcauuggugaagagcug

SEQ ID NO: 56305 - RNA, 22 nt, Brucella suis 1330
uguggcggaugauuguagguga

SEQ ID NO: 56306 - RNA, 22 nt, Brucella suis 1330
uuucuggauuccaaaauuugcu

SEQ ID NO: 56307 - RNA, 22 nt, Brucella suis 1330
aggcgcugaucugggcgcauca

SEQ ID NO: 56308 - RNA, 22 nt, Brucella suis 1330
cccggaucuucuggguggauca

SEQ ID NO: 56309 - RNA, 22 nt, Brucella suis 1330
cagggcgaauucauugucggcg

SEQ ID NO: 56310 - RNA, 22 nt, Brucella suis 1330
gaauuugccgggcgcgaauggg

SEQ ID NO: 56311 - RNA, 22 nt, Brucella suis 1330
ccgguuugucgcgcgaagugcg

SEQ ID NO: 56312 - RNA, 22 nt, Brucella suis 1330
cgccggugugaacgcccaucgg

SEQ ID NO: 56313 - RNA, 22 nt, Brucella suis 1330
gcucgaaaaggcucuaaggaaa

SEQ ID NO: 56314 - RNA, 22 nt, Brucella suis 1330
uuuugcugcuucacgcucgaug

SEQ ID NO: 56315 - RNA, 22 nt, Brucella suis 1330
ucagugccguugaaggccagcu

SEQ ID NO: 56316 - RNA, 20 nt, Brucella suis 1330
ucgauaugcgcauggggguu

SEQ ID NO: 56317 - RNA, 22 nt, Brucella suis 1330
gauuccaacauuugcaucccuc

SEQ ID NO: 56318 - RNA, 22 nt, Brucella suis 1330
cgugaccuucuauuaucucgug

SEQ ID NO: 56319 - RNA, 22 nt, Brucella suis 1330
ugcugauugagauuggcuaucu

SEQ ID NO: 56320 - RNA, 22 nt, Brucella suis 1330
aaggcugcggaugcgcguaucg

SEQ ID NO: 56321 - RNA, 22 nt, Brucella suis 1330
cgccagcaaacacuuagagcgg

SEQ ID NO: 56322 - RNA, 22 nt, Brucella suis 1330
uugacgauggugaugacgcuca

SEQ ID NO: 56323 - RNA, 22 nt, Brucella suis 1330
augucaccaugcgggugaagga

SEQ ID NO: 56324 - RNA, 22 nt, Brucella suis 1330
uggcugcgggccugccgcuuga

SEQ ID NO: 56325 - RNA, 22 nt, Brucella suis 1330
gcauuuuucgcccaugugcagg

SEQ ID NO: 56326 - RNA, 20 nt, Brucella suis 1330
augaagucgaaaucgcgcug

SEQ ID NO: 56327 - RNA, 22 nt, Brucella suis 1330
uggcgauugccccggcugggau

SEQ ID NO: 56328 - RNA, 22 nt, Brucella suis 1330
aagcgucgccgcacagucacgg

SEQ ID NO: 56329 - RNA, 22 nt, Brucella suis 1330
ucguucgcaaguucgauuaugc

SEQ ID NO: 56330 - RNA, 22 nt, Brucella suis 1330
ccgacgagucgacugguaucac

SEQ ID NO: 56331 - RNA, 22 nt, Brucella suis 1330
ucgucgcguucaauggcgucga

SEQ ID NO: 56332 - RNA, 22 nt, Brucella suis 1330
gagcaggaacuggcgcgcaauc

SEQ ID NO: 56333 - RNA, 22 nt, Brucella suis 1330
aucgugggcgugguucuggccu

SEQ ID NO: 56334 - RNA, 22 nt, Brucella suis 1330
aaggcggucgccgaauauaccg

SEQ ID NO: 56335 - RNA, 21 nt, Brucella suis 1330
agcuugcaagcguucaucgcc

SEQ ID NO: 56336 - RNA, 21 nt, Brucella suis 1330
uccuuccgccgccgcacaggc

SEQ ID NO: 56337 - RNA, 22 nt, Brucella suis 1330
guuucgauauuuccgaccgcgc

SEQ ID NO: 56338 - RNA, 22 nt, Brucella suis 1330
guggccgaggugaugaagggcg

SEQ ID NO: 56339 - RNA, 22 nt, Brucella suis 1330
uucgcgcgagaacgucucggug

SEQ ID NO: 56340 - RNA, 22 nt, Brucella suis 1330
gcaggggcauaccgucaucguc

SEQ ID NO: 56341 - RNA, 21 nt, Brucella suis 1330
cgauugagugagauggucgcu

SEQ ID NO: 56342 - RNA, 22 nt, Brucella suis 1330
uucuuggcgcaggguucgcagg

SEQ ID NO: 56343 - RNA, 22 nt, Brucella suis 1330
gauuccaacauuugcucgacgc

SEQ ID NO: 56344 - RNA, 22 nt, Brucella suis 1330
agaaaaccuugcaagcugcugu

SEQ ID NO: 56345 - RNA, 20 nt, Brucella suis 1330
ugaaggaccgucuucacgau

SEQ ID NO: 56346 - RNA, 22 nt, Brucella suis 1330
cacgaaaaagacaaaugccuga

SEQ ID NO: 56347 - RNA, 22 nt, Brucella suis 1330
gcgccguguucauuuaguuucg

SEQ ID NO: 56348 - RNA, 22 nt, Brucella suis 1330
gaccuguagccugaaccaccug

SEQ ID NO: 56349 - RNA, 22 nt, Brucella suis 1330
cucuucugaaaaccggaaagcg

SEQ ID NO: 56350 - RNA, 19 nt, Brucella suis 1330
gcggcggcugcgcgauaua

SEQ ID NO: 56351 - RNA, 22 nt, Brucella suis 1330
ggcguggugaucucgaccgcuu

SEQ ID NO: 56352 - RNA, 18 nt, Brucella suis 1330
gcaugcucguauguccau

SEQ ID NO: 56353 - RNA, 19 nt, Brucella suis 1330
ucgcagggagcccgcuauc

SEQ ID NO: 56354 - RNA, 22 nt, Brucella suis 1330
gauuauccgaacagaaagaaga

SEQ ID NO: 56355 - RNA, 17 nt, Brucella suis 1330
gcaaaugucggaaucaa

SEQ ID NO: 56356 - RNA, 22 nt, Brucella suis 1330
ccugccggucguggcugucgau

SEQ ID NO: 56357 - RNA, 22 nt, Brucella suis 1330
acugguucuggaagcgcagcgg

SEQ ID NO: 56358 - RNA, 22 nt, Brucella suis 1330
ugaucugaacgcgccugcgccc

SEQ ID NO: 56359 - RNA, 22 nt, Brucella suis 1330
cgcgccuugaucugccacagaa

SEQ ID NO: 56360 - RNA, 22 nt, Brucella suis 1330
aacugauugacgucagguggaa

SEQ ID NO: 56361 - RNA, 22 nt, Brucella suis 1330
guccgcucaggagcagcccguu

SEQ ID NO: 56362 - RNA, 22 nt, Brucella suis 1330
aaugccgcgauaggcagccgaa

SEQ ID NO: 56363 - RNA, 22 nt, Brucella suis 1330
cgcuggaggucuuccggcucga

SEQ ID NO: 56364 - RNA, 22 nt, Brucella suis 1330
gcggcgaaaaucgugcaggcug

SEQ ID NO: 56365 - RNA, 22 nt, Brucella suis 1330
ugaaggguguggggcaugucau

SEQ ID NO: 56366 - RNA, 22 nt, Brucella suis 1330
ccgucuucacagcuuuggcguc

SEQ ID NO: 56367 - RNA, 22 nt, Brucella suis 1330
ucgccgccgagcgucagcagaa

SEQ ID NO: 56368 - RNA, 22 nt, Brucella suis 1330
aagcccuuugucuugccgaugg

SEQ ID NO: 56369 - RNA, 22 nt, Brucella suis 1330
cccagugcgaaagccgugucuu

SEQ ID NO: 56370 - RNA, 22 nt, Brucella suis 1330
ucauggaaaucgccacgaaaag

SEQ ID NO: 56371 - RNA, 22 nt, Brucella suis 1330
gaucgggcgaaauuucgcugaa

SEQ ID NO: 56372 - RNA, 22 nt, Brucella suis 1330
augcgacuuuaucgcaaugcag

SEQ ID NO: 56373 - RNA, 22 nt, Brucella suis 1330
caucgauguucgggauauucga

SEQ ID NO: 56374 - RNA, 22 nt, Brucella suis 1330
ugcaugggauaaugccaagaaa

SEQ ID NO: 56375 - RNA, 22 nt, Brucella suis 1330
gcggcguuuaucaucgcggcau

SEQ ID NO: 56376 - RNA, 22 nt, Brucella suis 1330
aaugcuggagcuuuugaccggg

SEQ ID NO: 56377 - RNA, 22 nt, Brucella suis 1330
uugggcgaaagugccgcaguuu

SEQ ID NO: 56378 - RNA, 22 nt, Brucella suis 1330
gcggcuuugcgggcuguuugca

SEQ ID NO: 56379 - RNA, 22 nt, Brucella suis 1330
ucaucuggaacgugaaggugag

SEQ ID NO: 56380 - RNA, 22 nt, Brucella suis 1330
aagcaggaacaggaaaauccac

SEQ ID NO: 56381 - RNA, 22 nt, Brucella suis 1330
agaugccggauuuggcuucgcg

SEQ ID NO: 56382 - RNA, 22 nt, Brucella suis 1330
uaucagaugacaccuuuauggu

SEQ ID NO: 56383 - RNA, 22 nt, Brucella suis 1330
cauccgugcugcggguguuccc

SEQ ID NO: 56384 - RNA, 20 nt, Brucella suis 1330
gcgcaucgaugccgagcgca

SEQ ID NO: 56385 - RNA, 22 nt, Brucella suis 1330
agggcggcaucuaugcccgccu

SEQ ID NO: 56386 - RNA, 22 nt, Brucella suis 1330
uugcccucaugucucgcgcuac

SEQ ID NO: 56387 - RNA, 22 nt, Brucella suis 1330
ucauccagauugagauaggcga

SEQ ID NO: 56388 - RNA, 22 nt, Brucella suis 1330
agcgccauuaaugcggucacgc

SEQ ID NO: 56389 - RNA, 22 nt, Brucella suis 1330
ccagcgcagcgaugaaggcggu

SEQ ID NO: 56390 - RNA, 22 nt, Brucella suis 1330
ggcgaagauuauccggucgaug

SEQ ID NO: 56391 - RNA, 22 nt, Brucella suis 1330
aucaaaggauuucugucugaua

SEQ ID NO: 56392 - RNA, 22 nt, Brucella suis 1330
gcugaucgaauauugccuugcc

SEQ ID NO: 56393 - RNA, 22 nt, Brucella suis 1330
ucgaaccgguccgaaccuucga

SEQ ID NO: 56394 - RNA, 22 nt, Brucella suis 1330
uggaaaagauuuccguuuccau

SEQ ID NO: 56395 - RNA, 22 nt, Brucella suis 1330
cugucaucgggguaauucguca

SEQ ID NO: 56396 - RNA, 22 nt, Brucella suis 1330
accuugauaucggucguguagc

SEQ ID NO: 56397 - RNA, 22 nt, Brucella suis 1330
ucuggaagacgaugaaggucgc

SEQ ID NO: 56398 - RNA, 22 nt, Brucella suis 1330
ucgccuucgagccugcguuucg

SEQ ID NO: 56399 - RNA, 22 nt, Brucella suis 1330
gccgguuuccacguugauggug

SEQ ID NO: 56400 - RNA, 22 nt, Brucella suis 1330
cugaccgacuaccgcaauauca

SEQ ID NO: 56401 - RNA, 19 nt, Brucella suis 1330
gcgcuuccgauuucgucga

SEQ ID NO: 56402 - RNA, 22 nt, Brucella suis 1330
cucggccauaucgaggaacugg

SEQ ID NO: 56403 - RNA, 22 nt, Brucella suis 1330
ccgcgcaggccggcauugauca

SEQ ID NO: 56404 - RNA, 22 nt, Brucella suis 1330
ccagaagcagacgacgcagacg

SEQ ID NO: 56405 - RNA, 22 nt, Brucella suis 1330
gucgaaaguuuuggcaugaugu

SEQ ID NO: 56406 - RNA, 22 nt, Brucella suis 1330
ggcgacaggccgucaaucuggu

SEQ ID NO: 56407 - RNA, 22 nt, Brucella suis 1330
uuuuggaagacaugcucuggca

SEQ ID NO: 56408 - RNA, 20 nt, Brucella suis 1330
uauggcgaacugaugcgggu

SEQ ID NO: 56409 - RNA, 22 nt, Brucella suis 1330
auuucccggaacugaccgcugg

SEQ ID NO: 56410 - RNA, 22 nt, Brucella suis 1330
cugcgcugcacgauacggacgg

SEQ ID NO: 56411 - RNA, 22 nt, Brucella suis 1330
gcggggcuugccucggcccuga

SEQ ID NO: 56412 - RNA, 22 nt, Brucella suis 1330
cggcuucaauccgaaaucaaga

SEQ ID NO: 56413 - RNA, 22 nt, Brucella suis 1330
uucaauuccgugcgcaucuccg

SEQ ID NO: 56414 - RNA, 22 nt, Brucella suis 1330
ccagaugccggucaacgaauau

SEQ ID NO: 56415 - RNA, 22 nt, Brucella suis 1330
gcccgcaucuuccgcuguuugu

SEQ ID NO: 56416 - RNA, 22 nt, Brucella suis 1330
ugugcgggccaaauucuggcga

SEQ ID NO: 56417 - RNA, 21 nt, Brucella suis 1330
auccgucuugcaguuauagga

SEQ ID NO: 56418 - RNA, 22 nt, Brucella suis 1330
uucguugaaauguucgucggug

SEQ ID NO: 56419 - RNA, 22 nt, Brucella suis 1330
ugugcggcugcaaauggaaauu

SEQ ID NO: 56420 - RNA, 22 nt, Brucella suis 1330
auaccggggacaauucauucga

SEQ ID NO: 56421 - RNA, 22 nt, Brucella suis 1330
uuuagagcauuuccggcaaauc

SEQ ID NO: 56422 - RNA, 22 nt, Brucella suis 1330
gauccgauggucaccaaggaca

SEQ ID NO: 56423 - RNA, 22 nt, Brucella suis 1330
gaagcgacgccaggccugauag

SEQ ID NO: 56424 - RNA, 22 nt, Brucella suis 1330
ugccucuuuccgggcgcuguug

SEQ ID NO: 56425 - RNA, 22 nt, Brucella suis 1330
cagccuuugucgaguucggcgc

SEQ ID NO: 56426 - RNA, 22 nt, Brucella suis 1330
ucauccggccccaucgugccga

SEQ ID NO: 56427 - RNA, 22 nt, Brucella suis 1330
uccgcuuucgcccccuuggcga

SEQ ID NO: 56428 - RNA, 21 nt, Brucella suis 1330
cagcaugugcgcaucgcggcc

SEQ ID NO: 56429 - RNA, 22 nt, Brucella suis 1330
aucgcacgcguuuccuggcgau

SEQ ID NO: 56430 - RNA, 22 nt, Brucella suis 1330
ugcgcaugaucaagaucaugug

SEQ ID NO: 56431 - RNA, 22 nt, Brucella suis 1330
aggucaaugcgcggcgcaugau

SEQ ID NO: 56432 - RNA, 19 nt, Brucella suis 1330
auuucaaggaagaugcgau

SEQ ID NO: 56433 - RNA, 22 nt, Brucella suis 1330
ccugucgcuggaacaggugcgg

SEQ ID NO: 56434 - RNA, 22 nt, Brucella suis 1330
gcgaugacaagcaugauggcgu

SEQ ID NO: 56435 - RNA, 22 nt, Brucella suis 1330
cgcgauuaccugauggggcgua

SEQ ID NO: 56436 - RNA, 22 nt, Brucella suis 1330
gggacggugaauucuuccgccg

SEQ ID NO: 56437 - RNA, 22 nt, Brucella suis 1330
cuugccgucggcuauggccuuu

SEQ ID NO: 56438 - RNA, 22 nt, Brucella suis 1330
ugcaggccggcggcaaucagac

SEQ ID NO: 56439 - RNA, 22 nt, Brucella suis 1330
cggcaucgucauccauggccgc

SEQ ID NO: 56440 - RNA, 22 nt, Brucella suis 1330
ucaugguaggcugcaugguggg

SEQ ID NO: 56441 - RNA, 22 nt, Brucella suis 1330
gcgcaagugcugaacgaucugg

SEQ ID NO: 56442 - RNA, 22 nt, Brucella suis 1330
ccgugcugaaaggcugccgauc

SEQ ID NO: 56443 - RNA, 22 nt, Brucella suis 1330
acgccggauuuugaacggauga

SEQ ID NO: 56444 - RNA, 22 nt, Brucella suis 1330
guaguuuucggggucgcugcuu

SEQ ID NO: 56445 - RNA, 22 nt, Brucella suis 1330
auggucaaagccugcgcgucgg

SEQ ID NO: 56446 - RNA, 19 nt, Brucella suis 1330
uacggugcuggacagcgcg

SEQ ID NO: 56447 - RNA, 21 nt, Brucella suis 1330
ucgucgguuugcgcccagcca

SEQ ID NO: 56448 - RNA, 22 nt, Brucella suis 1330
aggcuugucgcuuuguuauucg

SEQ ID NO: 56449 - RNA, 22 nt, Brucella suis 1330
gacacgcuugacggugccguug

SEQ ID NO: 56450 - RNA, 18 nt, Brucella suis 1330
gaugcgccauugaccguc

SEQ ID NO: 56451 - RNA, 22 nt, Brucella suis 1330
ggcaauauggaguguugcgccc

SEQ ID NO: 56452 - RNA, 22 nt, Brucella suis 1330
ggguggagcgaucucacgcuaa

SEQ ID NO: 56453 - RNA, 22 nt, Brucella suis 1330
gaugcgucggauaaugcgacaa

SEQ ID NO: 56454 - RNA, 22 nt, Brucella suis 1330
aagcgugacggaaucaccguca

SEQ ID NO: 56455 - RNA, 22 nt, Brucella suis 1330
auauccuucacugcccuacugc

SEQ ID NO: 56456 - RNA, 21 nt, Brucella suis 1330
ugcauggacagaaaaugucgc

SEQ ID NO: 56457 - RNA, 22 nt, Brucella suis 1330
aacaggccggugcugugcgagg

SEQ ID NO: 56458 - RNA, 20 nt, Brucella suis 1330
guuucuggcccagcgcccag

SEQ ID NO: 56459 - RNA, 22 nt, Brucella suis 1330
ccugggcaagaacguugauugc

SEQ ID NO: 56460 - RNA, 18 nt, Brucella suis 1330
gaacuggcgcauggaaag

SEQ ID NO: 56461 - RNA, 22 nt, Brucella suis 1330
auucggcguuaugagcugcauc

SEQ ID NO: 56462 - RNA, 22 nt, Brucella suis 1330
uaugucauggucaaccagccug

SEQ ID NO: 56463 - RNA, 22 nt, Brucella suis 1330
agggccuuguacaaugaaucga

SEQ ID NO: 56464 - RNA, 22 nt, Brucella suis 1330
cucggcauggccccugccgucc

SEQ ID NO: 56465 - RNA, 22 nt, Brucella suis 1330
gacgccgaaaaagguugaccag

SEQ ID NO: 56466 - RNA, 22 nt, Brucella suis 1330
uaccguucauggacggaaggaa

SEQ ID NO: 56467 - RNA, 22 nt, Brucella suis 1330
gacaagguggaaugccccacga

SEQ ID NO: 56468 - RNA, 22 nt, Brucella suis 1330
aggcggaagaacgucugaccac

SEQ ID NO: 56469 - RNA, 22 nt, Brucella suis 1330
aagccagaaugacaucggugau

SEQ ID NO: 56470 - RNA, 22 nt, Brucella suis 1330
acgcgaauaucgagaucaaugc

SEQ ID NO: 56471 - RNA, 22 nt, Brucella suis 1330
aagggcguggaccaugcgcguu

SEQ ID NO: 56472 - RNA, 22 nt, Brucella suis 1330
gcgagcugccuuccgguuucga

SEQ ID NO: 56473 - RNA, 22 nt, Brucella suis 1330
aggcaucaagcacggcgauggc

SEQ ID NO: 56474 - RNA, 22 nt, Brucella suis 1330
cugggaaaacuacgagccggug

SEQ ID NO: 56475 - RNA, 22 nt, Brucella suis 1330
aggugguucucuuugcggugcc

SEQ ID NO: 56476 - RNA, 22 nt, Brucella suis 1330
gugcuggauagagaaacgcacc

SEQ ID NO: 56477 - RNA, 22 nt, Brucella suis 1330
ugcccgaauugucuucuucgcu

SEQ ID NO: 56478 - RNA, 22 nt, Brucella suis 1330
auugccagcaccgugcggccgu

SEQ ID NO: 56479 - RNA, 22 nt, Brucella suis 1330
gggaucaacugggauucgacgc

SEQ ID NO: 56480 - RNA, 22 nt, Brucella suis 1330
gaagcuuggaaugucgcgcgga

SEQ ID NO: 56481 - RNA, 22 nt, Brucella suis 1330
cgggccuuaucugaauuugcua

SEQ ID NO: 56482 - RNA, 22 nt, Brucella suis 1330
gaugccgauuuugccgguuugg

SEQ ID NO: 56483 - RNA, 22 nt, Brucella suis 1330
aucgugcuggaagaugccgauc

SEQ ID NO: 56484 - RNA, 22 nt, Brucella suis 1330
gaauaugccgaacccgaauggu

SEQ ID NO: 56485 - RNA, 22 nt, Brucella suis 1330
gcgccggcguuguacggaggaa

SEQ ID NO: 56486 - RNA, 18 nt, Brucella suis 1330
cuucaggcgucaucagcc

SEQ ID NO: 56487 - RNA, 22 nt, Brucella suis 1330
guucacgcuucccugaaauaau

SEQ ID NO: 56488 - RNA, 22 nt, Brucella suis 1330
gaaggacaagcucggcaucgca

SEQ ID NO: 56489 - RNA, 23 nt, Brucella suis 1330
cgggccgauccguuauggcguca

SEQ ID NO: 56490 - RNA, 23 nt, Brucella suis 1330
guuuggccccuaaagccgcucca

SEQ ID NO: 56491 - RNA, 22 nt, Brucella suis 1330
ggucaaugucgaauauguaucg

SEQ ID NO: 56492 - RNA, 20 nt, Brucella suis 1330
cgauauuccccgcccgccuu

SEQ ID NO: 56493 - RNA, 22 nt, Brucella suis 1330
auuuugcaaguguaacggucag

SEQ ID NO: 56494 - RNA, 22 nt, Brucella suis 1330
caugguccugaucgccgauggg

SEQ ID NO: 56495 - RNA, 22 nt, Brucella suis 1330
cuguggaagucaucaaggccgg

SEQ ID NO: 56496 - RNA, 22 nt, Brucella suis 1330
aucacggaaggccagagcgaag

SEQ ID NO: 56497 - RNA, 22 nt, Brucella suis 1330
ucggagauuucgagcugguuua

SEQ ID NO: 56498 - RNA, 22 nt, Brucella suis 1330
cgcggcgcgaccugcucgaucu

SEQ ID NO: 56499 - RNA, 22 nt, Brucella suis 1330
cgcacgauuccggcucgagccu

SEQ ID NO: 56500 - RNA, 22 nt, Brucella suis 1330
uugggcgcaaccaccagcaaua

SEQ ID NO: 56501 - RNA, 22 nt, Brucella suis 1330
guugaucaaauguuggaaucac

SEQ ID NO: 56502 - RNA, 22 nt, Brucella suis 1330
gcuuggcggaauguucgcgcug

SEQ ID NO: 56503 - RNA, 17 nt, Brucella suis 1330
cuugucgagcgcacgcg

SEQ ID NO: 56504 - RNA, 22 nt, Brucella suis 1330
aguggggcguuucggcugcugc

SEQ ID NO: 56505 - RNA, 22 nt, Brucella suis 1330
ucaggcuucgggcggccugacc

SEQ ID NO: 56506 - RNA, 22 nt, Brucella suis 1330
agcgggaucagccaugccaccg

SEQ ID NO: 56507 - RNA, 22 nt, Brucella suis 1330
caccauggcaauucgcgcgccg

SEQ ID NO: 56508 - RNA, 22 nt, Brucella suis 1330
uucaaucccuaucgcguuucga

SEQ ID NO: 56509 - RNA, 22 nt, Brucella suis 1330
gcgaaacaguuucaauuuccgu

SEQ ID NO: 56510 - RNA, 22 nt, Brucella suis 1330
gccgggugucgaacugcaugau

SEQ ID NO: 56511 - RNA, 22 nt, Brucella suis 1330
cugcacauuccaaauugacaag

SEQ ID NO: 56512 - RNA, 21 nt, Brucella suis 1330
uggcggcgaucaagcguuucc

SEQ ID NO: 56513 - RNA, 22 nt, Brucella suis 1330
aagaccgacgaucuugccguca

SEQ ID NO: 56514 - RNA, 22 nt, Brucella suis 1330
acuugucguaaacgccgcgcug

SEQ ID NO: 56515 - RNA, 22 nt, Brucella suis 1330
ccgggcuuuuccuguucuuccg

SEQ ID NO: 56516 - RNA, 22 nt, Brucella suis 1330
uuuccacagugcgcgcgcucga

SEQ ID NO: 56517 - RNA, 22 nt, Brucella suis 1330
cgccggcaagacugucgggcag

SEQ ID NO: 56518 - RNA, 22 nt, Brucella suis 1330
cuugcgcuuuaucugccgcgaa

SEQ ID NO: 56519 - RNA, 22 nt, Brucella suis 1330
ccguuaucggcacggccgguuu

SEQ ID NO: 56520 - RNA, 22 nt, Brucella suis 1330
ggauugaauuugacguuugaau

SEQ ID NO: 56521 - RNA, 19 nt, Brucella suis 1330
ccauuucacucgccuucgc

SEQ ID NO: 56522 - RNA, 22 nt, Brucella suis 1330
ugcgaacguugaagucguuaau

SEQ ID NO: 56523 - RNA, 21 nt, Brucella suis 1330
augccggcaauauucgccaga

SEQ ID NO: 56524 - RNA, 22 nt, Brucella suis 1330
aggcagcgaaguucuugaggau

SEQ ID NO: 56525 - RNA, 22 nt, Brucella suis 1330
uacgaucugcacggcgaaugcg

SEQ ID NO: 56526 - RNA, 22 nt, Brucella suis 1330
cauuuccagccaaaagugcaaa

SEQ ID NO: 56527 - RNA, 22 nt, Brucella suis 1330
uucggaaagcgccagaacaucg

SEQ ID NO: 56528 - RNA, 22 nt, Brucella suis 1330
uuugcuggaaaugcucuagauu

SEQ ID NO: 56529 - RNA, 22 nt, Brucella suis 1330
acggcugcuucuacagccggac

SEQ ID NO: 56530 - RNA, 22 nt, Brucella suis 1330
accugcugcuccaagcgucgcg

SEQ ID NO: 56531 - RNA, 22 nt, Brucella suis 1330
caugccgguuucgcgccgcaau

SEQ ID NO: 56532 - RNA, 22 nt, Brucella suis 1330
acaugcugucgcaccugucgau

SEQ ID NO: 56533 - RNA, 22 nt, Brucella suis 1330
ugcgauccgcauucgugaggga

SEQ ID NO: 56534 - RNA, 22 nt, Brucella suis 1330
auugcccuaucgaugacggcug

SEQ ID NO: 56535 - RNA, 22 nt, Brucella suis 1330
uuugcggucgaucucaucgagc

SEQ ID NO: 56536 - RNA, 22 nt, Brucella suis 1330
aagcucgauggcgucaaugccg

SEQ ID NO: 56537 - RNA, 22 nt, Brucella suis 1330
ggcuuuucugcugccugugcag

SEQ ID NO: 56538 - RNA, 22 nt, Brucella suis 1330
cgcgccgaggugaucgauguuu

SEQ ID NO: 56539 - RNA, 22 nt, Brucella suis 1330
ggcgucgagcgggugaugggcu

SEQ ID NO: 56540 - RNA, 22 nt, Brucella suis 1330
gucgcagagcauuuccggcaaa

SEQ ID NO: 56541 - RNA, 22 nt, Brucella suis 1330
uccgaaacgcugaauuccagca

SEQ ID NO: 56542 - RNA, 22 nt, Brucella suis 1330
gcaggcggccugggaugcuugc

SEQ ID NO: 56543 - RNA, 22 nt, Brucella suis 1330
uuguuuugacgaaugcaucgca

SEQ ID NO: 56544 - RNA, 22 nt, Brucella suis 1330
ugggcgcgaucuuuggccggug

SEQ ID NO: 56545 - RNA, 23 nt, Brucella suis 1330
auccggccaucaugcugaugccg

SEQ ID NO: 56546 - RNA, 22 nt, Brucella suis 1330
acaugaaaccugugugaaaauu

SEQ ID NO: 56547 - RNA, 22 nt, Brucella suis 1330
ugauauugcggcgcggaauggc

SEQ ID NO: 56548 - RNA, 22 nt, Brucella suis 1330
gaaaaccgguugaaauccccga

SEQ ID NO: 56549 - RNA, 22 nt, Brucella suis 1330
gcggcgguaucgaucuugucuu

SEQ ID NO: 56550 - RNA, 22 nt, Brucella suis 1330
ucagcucgcuugauauuucacc

SEQ ID NO: 56551 - RNA, 17 nt, Brucella suis 1330
ucgcggcgccggacgac

SEQ ID NO: 56552 - RNA, 22 nt, Brucella suis 1330
gcaucgaaaucucccgccgcau

SEQ ID NO: 56553 - RNA, 22 nt, Brucella suis 1330
ccggcuagaaaggagcacgaga

SEQ ID NO: 56554 - RNA, 22 nt, Brucella suis 1330
ccugcgcuggauggaagcgcgc

SEQ ID NO: 56555 - RNA, 22 nt, Brucella suis 1330
ucgagcguauagggcgcgaugg

SEQ ID NO: 56556 - RNA, 22 nt, Brucella suis 1330
gcaugguggcucucgguuucgu

SEQ ID NO: 56557 - RNA, 23 nt, Brucella suis 1330
uguucgugacggugccggugauc

SEQ ID NO: 56558 - RNA, 22 nt, Brucella suis 1330
gccggguucccggacggauuga

SEQ ID NO: 56559 - RNA, 22 nt, Brucella suis 1330
gcuguuccgccuugcgcgcauu

SEQ ID NO: 56560 - RNA, 22 nt, Brucella suis 1330
ugcguuuuauuucugauggccg

SEQ ID NO: 56561 - RNA, 21 nt, Brucella suis 1330
uugccgcggccuugaucgaga

SEQ ID NO: 56562 - RNA, 22 nt, Brucella suis 1330
cgccgauagaggaugagacgcc

SEQ ID NO: 56563 - RNA, 22 nt, Brucella suis 1330
ccgggcgcgguuucucgucgga

SEQ ID NO: 56564 - RNA, 22 nt, Brucella suis 1330
cggcuuggcauugcugaguaua

SEQ ID NO: 56565 - RNA, 22 nt, Brucella suis 1330
cgggccgcucaguuuugcagga

SEQ ID NO: 56566 - RNA, 20 nt, Brucella suis 1330
cgguggugacgcccaucugc

SEQ ID NO: 56567 - RNA, 22 nt, Brucella suis 1330
aaggcuggagcuuccagaagca

SEQ ID NO: 56568 - RNA, 22 nt, Brucella suis 1330
gucacggaucgccaucuggcgc

SEQ ID NO: 56569 - RNA, 22 nt, Brucella suis 1330
cuuuucguggcgauuuccauga

SEQ ID NO: 56570 - RNA, 22 nt, Brucella suis 1330
gccagcuucugauuuucgauau

SEQ ID NO: 56571 - RNA, 22 nt, Brucella suis 1330
uucaauaugggcaagugcaugc

SEQ ID NO: 56572 - RNA, 22 nt, Brucella suis 1330
aucagcacgauagccagaauaa

SEQ ID NO: 56573 - RNA, 22 nt, Brucella suis 1330
ugcgcaaauggugauuuucgag

SEQ ID NO: 56574 - RNA, 22 nt, Brucella suis 1330
ugaagccgcccuucgacggaga

SEQ ID NO: 56575 - RNA, 20 nt, Brucella suis 1330
gcgcccuguuuggcaccggc

SEQ ID NO: 56576 - RNA, 22 nt, Brucella suis 1330
gugcgcaggccaugcucggcaa

SEQ ID NO: 56577 - RNA, 22 nt, Brucella suis 1330
gucgccgggcugcuucucccaa

SEQ ID NO: 56578 - RNA, 22 nt, Brucella suis 1330
ggcaaggcaaugcgcgagcguu

SEQ ID NO: 56579 - RNA, 22 nt, Brucella suis 1330
agacgcuugccgaucuuguugu

SEQ ID NO: 56580 - RNA, 22 nt, Brucella suis 1330
cccgcgcccggugcagccgggu

SEQ ID NO: 56581 - RNA, 22 nt, Brucella suis 1330
gcgugcguccuuucaucgguca

SEQ ID NO: 56582 - RNA, 22 nt, Brucella suis 1330
cgucaagggcgaugugcacgau

SEQ ID NO: 56583 - RNA, 22 nt, Brucella suis 1330
cuucgagcacaacgacuucgac

SEQ ID NO: 56584 - RNA, 22 nt, Brucella suis 1330
gcgugcgcaauauagacggcuu

SEQ ID NO: 56585 - RNA, 22 nt, Brucella suis 1330
cggcggcguucccauugagcca

SEQ ID NO: 56586 - RNA, 22 nt, Brucella suis 1330
ucggcgaugaucggcggcgcaa

SEQ ID NO: 56587 - RNA, 22 nt, Brucella suis 1330
gaagcgguucaaaguucaucgc

SEQ ID NO: 56588 - RNA, 22 nt, Brucella suis 1330
uucggcccgcaucgcguugcug

SEQ ID NO: 56589 - RNA, 22 nt, Brucella suis 1330
agaagcugggcauuccgcuucg

SEQ ID NO: 56590 - RNA, 22 nt, Brucella suis 1330
agcagcucguccgcgucugaau

SEQ ID NO: 56591 - RNA, 22 nt, Brucella suis 1330
ucguggucgcccagcuauugcg

SEQ ID NO: 56592 - RNA, 22 nt, Brucella suis 1330
aaccugcauccaaccggccgca

SEQ ID NO: 56593 - RNA, 22 nt, Brucella suis 1330
ucgccgcagacgcugguggccu

SEQ ID NO: 56594 - RNA, 22 nt, Brucella suis 1330
cgccgacagaauggcaagcaag

SEQ ID NO: 56595 - RNA, 22 nt, Brucella suis 1330
guuugcaaucucgacggaagaa

SEQ ID NO: 56596 - RNA, 22 nt, Brucella suis 1330
ccauggccuugucugcgcaagu

SEQ ID NO: 56597 - RNA, 22 nt, Brucella suis 1330
ggccuuaccuuugaucuuugug

SEQ ID NO: 56598 - RNA, 22 nt, Brucella suis 1330
ugcuugccggauggcgcacaca

SEQ ID NO: 56599 - RNA, 22 nt, Brucella suis 1330
gaggacgaugauuucuugucgg

SEQ ID NO: 56600 - RNA, 22 nt, Brucella suis 1330
ugcgcgaaauucccgacaugua

SEQ ID NO: 56601 - RNA, 20 nt, Brucella suis 1330
gagucgcagaucagcgccag

SEQ ID NO: 56602 - RNA, 22 nt, Brucella suis 1330
uccucaagaacuucgcugccuu

SEQ ID NO: 56603 - RNA, 22 nt, Brucella suis 1330
uuugcugaugauagucgcguuc

SEQ ID NO: 56604 - RNA, 22 nt, Brucella suis 1330
auguggugggcuuucaucuggu

SEQ ID NO: 56605 - RNA, 22 nt, Brucella suis 1330
aaaaguugaguaucggcgcgcg

SEQ ID NO: 56606 - RNA, 22 nt, Brucella suis 1330
agcgggcgcaucgccgaugcau

SEQ ID NO: 56607 - RNA, 22 nt, Brucella suis 1330
cgcucgaucuuauccgcgcguu

SEQ ID NO: 56608 - RNA, 22 nt, Brucella suis 1330
ggcuugccaucgggccgcagga

SEQ ID NO: 56609 - RNA, 22 nt, Brucella suis 1330
ugaucggcaagacgaucuggag

SEQ ID NO: 56610 - RNA, 22 nt, Brucella suis 1330
gucgggccgacgagcagaaugu

SEQ ID NO: 56611 - RNA, 22 nt, Brucella suis 1330
auuucggagcaucaucacgcag

SEQ ID NO: 56612 - RNA, 22 nt, Brucella suis 1330
gaauaucauugacgauggugag

SEQ ID NO: 56613 - RNA, 21 nt, Human
aaauccagugaucuccucuaa

SEQ ID NO: 56614 - RNA, 22 nt, Human
aaauagucagaaaucaacgugc

SEQ ID NO: 56615 - RNA, 22 nt, Human
aaaucaaaagugguuauuuuau

SEQ ID NO: 56616 - RNA, 17 nt, Human
aaagccgaucagauguu

SEQ ID NO: 56617 - RNA, 22 nt, Human
aaagcugaaacgaaaugacaac

SEQ ID NO: 56618 - RNA, 22 nt, Human
aaaucauguuaaagagggaguu

SEQ ID NO: 56619 - RNA, 22 nt, Human
aaaucgcuugaacccaggaagu

SEQ ID NO: 56620 - RNA, 22 nt, Human
aaaucuuccugaaauuuguuca

SEQ ID NO: 56621 - RNA, 22 nt, Human
aaaugcuuuaauugaguucaug

SEQ ID NO: 56622 - RNA, 22 nt, Human
aaaugcucgccagguuuuauua

SEQ ID NO: 56623 - RNA, 22 nt, Human
aaauguaaacuguauuuauaaa

SEQ ID NO: 56624 - RNA, 22 nt, Human
aaauugucuuuaaucaggucau

SEQ ID NO: 56625 - RNA, 21 nt, Human
aacaaaagggaagaacagcug

SEQ ID NO: 56626 - RNA, 20 nt, Human
aacagcucucgacuuaucuu

SEQ ID NO: 56627 - RNA, 22 nt, Human
aacaggcuaaauuguccauuuc

SEQ ID NO: 56628 - RNA, 22 nt, Human
aacagguucaagccuugcagca

SEQ ID NO: 56629 - RNA, 19 nt, Human
aacaaaauaguucuaguua

SEQ ID NO: 56630 - RNA, 22 nt, Human
aaagguguagacucaguuaugc

SEQ ID NO: 56631 - RNA, 22 nt, Human
aaagggcugaaguagucucugu

SEQ ID NO: 56632 - RNA, 22 nt, Human
aaagccagggacagugugcaug

SEQ ID NO: 56633 - RNA, 22 nt, Human
aaaggagugaaaugagaggaaa

SEQ ID NO: 56634 - RNA, 22 nt, Human
aaagcauuuguuucuccuggaa

SEQ ID NO: 56635 - RNA, 22 nt, Human
aaagccauaucuauucuauucu

SEQ ID NO: 56636 - RNA, 22 nt, Human
aaagaucaguuaacgccaucaa

SEQ ID NO: 56637 - RNA, 22 nt, Human
aaagaugaaguucagcgaagaa

SEQ ID NO: 56638 - RNA, 22 nt, Human
aaacgcaauuucuugcauguca

SEQ ID NO: 56639 - RNA, 22 nt, Human
aaaccgguacccuccugccugc

SEQ ID NO: 56640 - RNA, 18 nt, Human
aaacgguuucaugcugua

SEQ ID NO: 56641 - RNA, 22 nt, Human
aaagacagccuguuggcuuucu

SEQ ID NO: 56642 - RNA, 22 nt, Human
aaagcaaagaucuguagcccaa

SEQ ID NO: 56643 - RNA, 22 nt, Human
aaacgcauucuuacaugcuucc

SEQ ID NO: 56644 - RNA, 22 nt, Human
aaacaccaagagcuagcuauua

SEQ ID NO: 56645 - RNA, 22 nt, Human
aaaagguauuuagcgauugcau

SEQ ID NO: 56646 - RNA, 22 nt, Human
aaaauuuccuuggaccauuuuu

SEQ ID NO: 56647 - RNA, 17 nt, Human
aaaaucaaaggaggugc

SEQ ID NO: 56648 - RNA, 22 nt, Human
aaacagcugcaguacacggccu

SEQ ID NO: 56649 - RNA, 22 nt, Human
aaaagaaugaugggagcugggu

SEQ ID NO: 56650 - RNA, 22 nt, Human
aaaagauguaaacauauauuaa

SEQ ID NO: 56651 - RNA, 22 nt, Human
aaaaggacaguagccuugaggu

SEQ ID NO: 56652 - RNA, 22 nt, Human
aaaagggucugacacugcuuga

SEQ ID NO: 56653 - RNA, 22 nt, Human
acauauggcagguugaucaaug

SEQ ID NO: 56654 - RNA, 22 nt, Human
acaggcgucgccugcucuugcc

SEQ ID NO: 56655 - RNA, 22 nt, Human
acaggccuggguucaaauuugg

SEQ ID NO: 56656 - RNA, 22 nt, Human
acagguuucuccccugguuauu

SEQ ID NO: 56657 - RNA, 19 nt, Human
acaggaaggaaaauuucaa

SEQ ID NO: 56658 - RNA, 22 nt, Human
acaggacgugugugcgcaugug

SEQ ID NO: 56659 - RNA, 22 nt, Human
acagcucaggcccaucaacccc

SEQ ID NO: 56660 - RNA, 19 nt, Human
acagccuguugguggggcu

SEQ ID NO: 56661 - RNA, 22 nt, Human
acaggaaaugaaaugguaucua

SEQ ID NO: 56662 - RNA, 22 nt, Human
acagcuggaggucugugagcac

SEQ ID NO: 56663 - RNA, 22 nt, Human
acagcaauccuggcagaggguu

SEQ ID NO: 56664 - RNA, 22 nt, Human
acagaucugcacagugaacaau

SEQ ID NO: 56665 - RNA, 22 nt, Human
acagcagguuauuguuauggca

SEQ ID NO: 56666 - RNA, 22 nt, Human
acagaucuauauuauauauaca

SEQ ID NO: 56667 - RNA, 22 nt, Human
acacuuuugcgagagcaugcag

SEQ ID NO: 56668 - RNA, 23 nt, Human
acagcaagaggaccagaugugag

SEQ ID NO: 56669 - RNA, 23 nt, Human
acagaggcaucagagcagcaggc

SEQ ID NO: 56670 - RNA, 22 nt, Human
acagacuuuuagacuuaugagu

SEQ ID NO: 56671 - RNA, 22 nt, Human
acagacuuaguauccugcugcu

SEQ ID NO: 56672 - RNA, 22 nt, Human
acagacuugaccuuggagaggc

SEQ ID NO: 56673 - RNA, 22 nt, Human
acagacaucaucaacaucuucc

SEQ ID NO: 56674 - RNA, 22 nt, Human
acacgcacaccugugcacucgu

SEQ ID NO: 56675 - RNA, 21 nt, Human
acacagcuggagcaucccggu

SEQ ID NO: 56676 - RNA, 20 nt, Human
acacagccuagaguuuggcu

SEQ ID NO: 56677 - RNA, 22 nt, Human
acacaagaaugugcacucagcc

SEQ ID NO: 56678 - RNA, 17 nt, Human
acaaugggcaacaauau

SEQ ID NO: 56679 - RNA, 22 nt, Human
acaaugugcuuaugaaggcagu

SEQ ID NO: 56680 - RNA, 22 nt, Human
acaaggccaagcauucuagcaa

SEQ ID NO: 56681 - RNA, 22 nt, Human
acaagaccagcagggagggugc

SEQ ID NO: 56682 - RNA, 22 nt, Human
acaaucagcacugaguuuaucu

SEQ ID NO: 56683 - RNA, 22 nt, Human
acaagguugauucuggcaucug

SEQ ID NO: 56684 - RNA, 22 nt, Human
acaaggaagaaaacauuacuuu

SEQ ID NO: 56685 - RNA, 22 nt, Human
acaaggccugagggugacagca

SEQ ID NO: 56686 - RNA, 22 nt, Human
acaaaucccuguaaacacagcu

SEQ ID NO: 56687 - RNA, 22 nt, Human
acaaagugaaaagcaucgaauu

SEQ ID NO: 56688 - RNA, 21 nt, Human
acaaaaccuaacuuggcugcu

SEQ ID NO: 56689 - RNA, 21 nt, Human
aauugccuaauauaugggaag

SEQ ID NO: 56690 - RNA, 22 nt, Human
aauuguuagaaaugacuguuuu

SEQ ID NO: 56691 - RNA, 22 nt, Human
aaugugguauuuuggcauucuu

SEQ ID NO: 56692 - RNA, 23 nt, Human
aaugugaaauugaguuuuuguua

SEQ ID NO: 56693 - RNA, 23 nt, Human
aaugggcggaaguguuaaguugc

SEQ ID NO: 56694 - RNA, 22 nt, Human
aauguuuuucaaguguggagca

SEQ ID NO: 56695 - RNA, 22 nt, Human
aauggaugauuaaauggaugaa

SEQ ID NO: 56696 - RNA, 22 nt, Human
aauggaaaaagaacuguuuaaa

SEQ ID NO: 56697 - RNA, 22 nt, Human
aaugcugugggauagggcuccu

SEQ ID NO: 56698 - RNA, 22 nt, Human
aaucaugguacaaguaagcacg

SEQ ID NO: 56699 - RNA, 22 nt, Human
aauccucguagugguuagaaag

SEQ ID NO: 56700 - RNA, 22 nt, Human
aauaugccaaauccugucacau

SEQ ID NO: 56701 - RNA, 19 nt, Human
aaucacaagcaauaggggu

SEQ ID NO: 56702 - RNA, 22 nt, Human
aauacagcacucacaccucccu

SEQ ID NO: 56703 - RNA, 20 nt, Human
aagugcuguuagcugccuga

SEQ ID NO: 56704 - RNA, 22 nt, Human
aauaaagcuugaaagcagggaa

SEQ ID NO: 56705 - RNA, 22 nt, Human
aaggugcugaggguccuggcuu

SEQ ID NO: 56706 - RNA, 22 nt, Human
aaggggaauaguaggaccuggg

SEQ ID NO: 56707 - RNA, 23 nt, Human
aagggcgauuaacauucgcucga

SEQ ID NO: 56708 - RNA, 22 nt, Human
aagggaccucagcaaucaggga

SEQ ID NO: 56709 - RNA, 19 nt, Human
aaggcuuucugagugaaaa

SEQ ID NO: 56710 - RNA, 22 nt, Human
aaggcugugaacuuuucgggaa

SEQ ID NO: 56711 - RNA, 22 nt, Human
aaggagaggagucauugggaua

SEQ ID NO: 56712 - RNA, 22 nt, Human
aaggacaccaaacuaauuggga

SEQ ID NO: 56713 - RNA, 22 nt, Human
aagcgcaaggugucagcagguu

SEQ ID NO: 56714 - RNA, 22 nt, Human
aagcuguuagggagugguaggu

SEQ ID NO: 56715 - RNA, 22 nt, Human
aagcuuugaauauuagaccuug

SEQ ID NO: 56716 - RNA, 22 nt, Human
aaggcaggagaguaggaggugg

SEQ ID NO: 56717 - RNA, 22 nt, Human
aaggcgaggggcacagcugaga

SEQ ID NO: 56718 - RNA, 22 nt, Human
aaggaguacagggagggucccu

SEQ ID NO: 56719 - RNA, 22 nt, Human
aagcugccugggaggaagggcu

SEQ ID NO: 56720 - RNA, 22 nt, Human
aagcugcagacccccugucuca

SEQ ID NO: 56721 - RNA, 22 nt, Human
aagcugaguaggaaugguaggu

SEQ ID NO: 56722 - RNA, 22 nt, Human
aagccuguugacagcugucagu

SEQ ID NO: 56723 - RNA, 22 nt, Human
aaggaaaaccugacugaagaac

SEQ ID NO: 56724 - RNA, 22 nt, Human
aaggaaaguuaagguaaacucu

SEQ ID NO: 56725 - RNA, 22 nt, Human
aaggaacuucagggcgaaugga

SEQ ID NO: 56726 - RNA, 22 nt, Human
aagccucaugccagauccaggu

SEQ ID NO: 56727 - RNA, 22 nt, Human
aagcgggcagcggccugcgcca

SEQ ID NO: 56728 - RNA, 22 nt, Human
aagcucagcugguggugauugc

SEQ ID NO: 56729 - RNA, 22 nt, Human
aagcucuauaggagauacagua

SEQ ID NO: 56730 - RNA, 22 nt, Human
aagcacagggacucaggaccgg

SEQ ID NO: 56731 - RNA, 22 nt, Human
aagcaauucacaguucacuuaa

SEQ ID NO: 56732 - RNA, 22 nt, Human
aagcagcauaugacagcaucca

SEQ ID NO: 56733 - RNA, 22 nt, Human
aagcaacccagugcuuguauag

SEQ ID NO: 56734 - RNA, 23 nt, Human
aagcaacagacuucaucagauau

SEQ ID NO: 56735 - RNA, 22 nt, Human
aagaucugaccgugauggcggc

SEQ ID NO: 56736 - RNA, 22 nt, Human
aagaugaucagagggcaagagg

SEQ ID NO: 56737 - RNA, 22 nt, Human
aagaugcaagcauuuugaacug

SEQ ID NO: 56738 - RNA, 22 nt, Human
aagcaaaagguuacacuucugg

SEQ ID NO: 56739 - RNA, 22 nt, Human
aagcaaagucaucuagaguagu

SEQ ID NO: 56740 - RNA, 22 nt, Human
aagaggaggcuggaauccuaaa

SEQ ID NO: 56741 - RNA, 22 nt, Human
aagagaaaaaucuuaaucuagu

SEQ ID NO: 56742 - RNA, 22 nt, Human
aagaagcuacugucacuaucag

SEQ ID NO: 56743 - RNA, 22 nt, Human
aagaaaccauauuaguuccugg

SEQ ID NO: 56744 - RNA, 22 nt, Human
aagaaagaucugaaagaagcga

SEQ ID NO: 56745 - RNA, 22 nt, Human
auaaugccucauaggguguucc

SEQ ID NO: 56746 - RNA, 22 nt, Human
auaaaaauguuuuuguguggua

SEQ ID NO: 56747 - RNA, 22 nt, Human
aguuuuugccucgaauucugcg

SEQ ID NO: 56748 - RNA, 22 nt, Human
auaaaucaagggcaguauuucc

SEQ ID NO: 56749 - RNA, 22 nt, Human
auaaggaaagugagugcuuaaa

SEQ ID NO: 56750 - RNA, 22 nt, Human
auaaggcauagugagucaucau

SEQ ID NO: 56751 - RNA, 23 nt, Human
auaaugauaaugcuauuuuuugu

SEQ ID NO: 56752 - RNA, 22 nt, Human
aguuugauuugucuaucuucau

SEQ ID NO: 56753 - RNA, 22 nt, Human
aguuuuugagaauucuucugaa

SEQ ID NO: 56754 - RNA, 22 nt, Human
aguuuccacuggagacacugug

SEQ ID NO: 56755 - RNA, 22 nt, Human
auaaaaaguggcugcuauugga

SEQ ID NO: 56756 - RNA, 22 nt, Human
aguugcugccagguccugggag

SEQ ID NO: 56757 - RNA, 22 nt, Human
aguuggaagacacccugaaauc

SEQ ID NO: 56758 - RNA, 22 nt, Human
aguucugggaggugcacgucca

SEQ ID NO: 56759 - RNA, 22 nt, Human
aguucuuugcucccugcuuuuu

SEQ ID NO: 56760 - RNA, 22 nt, Human
aguuccucagaagggccuggga

SEQ ID NO: 56761 - RNA, 22 nt, Human
aguugcagguucacguaucuug

SEQ ID NO: 56762 - RNA, 22 nt, Human
aguucuggcccugaaacaggga

SEQ ID NO: 56763 - RNA, 22 nt, Human
aguucaauuguuuuguaaaagu

SEQ ID NO: 56764 - RNA, 20 nt, Human
aguucagguuauuuuccucc

SEQ ID NO: 56765 - RNA, 22 nt, Human
aguguuuuaagaaaguaauuuu

SEQ ID NO: 56766 - RNA, 22 nt, Human
aguguuuuaugugccaguuuaa

SEQ ID NO: 56767 - RNA, 22 nt, Human
aguggugccuaagcgcggaggc

SEQ ID NO: 56768 - RNA, 22 nt, Human
aguggcuguuccaggugaggac

SEQ ID NO: 56769 - RNA, 19 nt, Human
agugggcaaggaagaugac

SEQ ID NO: 56770 - RNA, 22 nt, Human
aguggggaaauaucaauauuug

SEQ ID NO: 56771 - RNA, 23 nt, Human
aguggaggucgggguggggagac

SEQ ID NO: 56772 - RNA, 22 nt, Human
agugcgagaugaggacagaagc

SEQ ID NO: 56773 - RNA, 22 nt, Human
agugccaucuuuaacuguccca

SEQ ID NO: 56774 - RNA, 22 nt, Human
agugccuuaaaggucuugcagc

SEQ ID NO: 56775 - RNA, 22 nt, Human
aguggagguuacagcuguacau

SEQ ID NO: 56776 - RNA, 21 nt, Human
aguggcacuguuucuucccua

SEQ ID NO: 56777 - RNA, 23 nt, Human
aguggccgaucaucucgggcuug

SEQ ID NO: 56778 - RNA, 23 nt, Human
agugaugcaguaucugggucugu

SEQ ID NO: 56779 - RNA, 22 nt, Human
agucugaguaucucugagccag

SEQ ID NO: 56780 - RNA, 21 nt, Human
agugaagagugggcuugauca

SEQ ID NO: 56781 - RNA, 22 nt, Human
agugaagauagagccaggucug

SEQ ID NO: 56782 - RNA, 23 nt, Human
agugaagcugguuagugaugacc

SEQ ID NO: 56783 - RNA, 22 nt, Human
agugacuguccuacuuuguaga

SEQ ID NO: 56784 - RNA, 22 nt, Human
agugagaguauuaaugugaacu

SEQ ID NO: 56785 - RNA, 20 nt, Human
agugauuuguuaguacauug

SEQ ID NO: 56786 - RNA, 20 nt, Human
agguuugcuguauaucaugg

SEQ ID NO: 56787 - RNA, 22 nt, Human
agguuuuugucauuuucuggua

SEQ ID NO: 56788 - RNA, 22 nt, Human
agguggcuaugaggaugcaguc

SEQ ID NO: 56789 - RNA, 22 nt, Human
agguggcguauguguucguguu

SEQ ID NO: 56790 - RNA, 22 nt, Human
agguucaucaauaacucagaga

SEQ ID NO: 56791 - RNA, 18 nt, Human
agguugcaucugugcaga

SEQ ID NO: 56792 - RNA, 21 nt, Human
aggugaaggcgagggggacag

SEQ ID NO: 56793 - RNA, 22 nt, Human
aggucuugcggaagauauggcu

SEQ ID NO: 56794 - RNA, 18 nt, Human
aggugagaauuuggcuuu

SEQ ID NO: 56795 - RNA, 22 nt, Human
aggucugcccaggaugcugcuu

SEQ ID NO: 56796 - RNA, 22 nt, Human
aggucgugggugagagagagac

SEQ ID NO: 56797 - RNA, 22 nt, Human
aggguaauaacaguauggugau

SEQ ID NO: 56798 - RNA, 22 nt, Human
aggguggcuggaguggucuggu

SEQ ID NO: 56799 - RNA, 22 nt, Human
aggggcuuguggaguugcuggu

SEQ ID NO: 56800 - RNA, 22 nt, Human
agggguuugggaaggguuaggg

SEQ ID NO: 56801 - RNA, 22 nt, Human
agggcugggcuuggcaggcugg

SEQ ID NO: 56802 - RNA, 22 nt, Human
agggcccaccuuggugcugagg

SEQ ID NO: 56803 - RNA, 22 nt, Human
agggcccauagaucgucagcuu

SEQ ID NO: 56804 - RNA, 22 nt, Human
agggcaguguggugggacugac

SEQ ID NO: 56805 - RNA, 19 nt, Human
agggaggcaagagaaaugu

SEQ ID NO: 56806 - RNA, 22 nt, Human
agggccaagaaagaguggcuuu

SEQ ID NO: 56807 - RNA, 22 nt, Human
agggcaugugaaguaaccuagg

SEQ ID NO: 56808 - RNA, 22 nt, Human
agggcaguuaugaaugucucca

SEQ ID NO: 56809 - RNA, 18 nt, Human
aggcuggggaucacaggg

SEQ ID NO: 56810 - RNA, 22 nt, Human
aggcuuuugcucuggcuccucu

SEQ ID NO: 56811 - RNA, 22 nt, Human
aggcugcuggcaggcguggacg

SEQ ID NO: 56812 - RNA, 22 nt, Human
aggccgcgguggcgaaggcguu

SEQ ID NO: 56813 - RNA, 20 nt, Human
aggccgcccgcugccgcuuc

SEQ ID NO: 56814 - RNA, 22 nt, Human
aggccauuucacagguuuugga

SEQ ID NO: 56815 - RNA, 22 nt, Human
aggccagggacaaugaggcaga

SEQ ID NO: 56816 - RNA, 22 nt, Human
aggcugcucucgccggcggugu

SEQ ID NO: 56817 - RNA, 22 nt, Human
aggcauuuaucaggaaauguuc

SEQ ID NO: 56818 - RNA, 22 nt, Human
aggcagugguguuugcuggugg

SEQ ID NO: 56819 - RNA, 22 nt, Human
aggcaguguggagggcuguugc

SEQ ID NO: 56820 - RNA, 22 nt, Human
aggcauuuucuuguuauuuuua

SEQ ID NO: 56821 - RNA, 22 nt, Human
aggccaggcgccggcgcgagac

SEQ ID NO: 56822 - RNA, 22 nt, Human
aggcaguggagcuggaauaggc

SEQ ID NO: 56823 - RNA, 22 nt, Human
aggcauuuaaagauguaagacu

SEQ ID NO: 56824 - RNA, 21 nt, Human
aggcauuuucuuggagauucu

SEQ ID NO: 56825 - RNA, 22 nt, Human
aggcaggagcugugguggugag

SEQ ID NO: 56826 - RNA, 22 nt, Human
aggcagaugggagcuggaaguu

SEQ ID NO: 56827 - RNA, 23 nt, Human
aggcagaguccuggggcacagcc

SEQ ID NO: 56828 - RNA, 22 nt, Human
aggcaggcucaaugcccagucu

SEQ ID NO: 56829 - RNA, 22 nt, Human
aggcaucguguuuuucugcuuu

SEQ ID NO: 56830 - RNA, 22 nt, Human
aggcaguguguagcuggaagag

SEQ ID NO: 56831 - RNA, 20 nt, Human
aggcagacaaggagucuguu

SEQ ID NO: 56832 - RNA, 22 nt, Human
aggcaggauuugcgaugugguu

SEQ ID NO: 56833 - RNA, 22 nt, Human
aggcaagauuaggaccagaaga

SEQ ID NO: 56834 - RNA, 23 nt, Human
aggcaagaacggguuguucaccc

SEQ ID NO: 56835 - RNA, 22 nt, Human
aggcagcagggagggagaaaug

SEQ ID NO: 56836 - RNA, 23 nt, Human
aggcagcaugcaacaggccauuu

SEQ ID NO: 56837 - RNA, 19 nt, Human
aggcagccccaacuugcau

SEQ ID NO: 56838 - RNA, 22 nt, Human
aggcagagauggcugcagggcc

SEQ ID NO: 56839 - RNA, 22 nt, Human
aggcagagaggucuuccuggaa

SEQ ID NO: 56840 - RNA, 20 nt, Human
aggauuauguacauggaugc

SEQ ID NO: 56841 - RNA, 22 nt, Human
aggcaacagacaggcuugguuc

SEQ ID NO: 56842 - RNA, 22 nt, Human
aggcaauagagggugaggagga

SEQ ID NO: 56843 - RNA, 22 nt, Human
aggcacagaauccagucugcug

SEQ ID NO: 56844 - RNA, 22 nt, Human
aggacaagacaaggaccagaga

SEQ ID NO: 56845 - RNA, 22 nt, Human
aggauugauggcauguuuacug

SEQ ID NO: 56846 - RNA, 22 nt, Human
aggauauguccuuuuuuucccc

SEQ ID NO: 56847 - RNA, 22 nt, Human
aggaagaagggacagaauuuug

SEQ ID NO: 56848 - RNA, 22 nt, Human
aggaauguugagacauggcuaa

SEQ ID NO: 56849 - RNA, 19 nt, Human
agcggccgccgcgggcgcc

SEQ ID NO: 56850 - RNA, 22 nt, Human
agcggcaggaagcgcgcaagcg

SEQ ID NO: 56851 - RNA, 22 nt, Human
agcggcaagguguauguggcag

SEQ ID NO: 56852 - RNA, 21 nt, Human
agcgcugcauccaccauggcu

SEQ ID NO: 56853 - RNA, 22 nt, Human
agcgcucauuuuccuccugcuc

SEQ ID NO: 56854 - RNA, 22 nt, Human
agcgccgcugugauuggugagg

SEQ ID NO: 56855 - RNA, 19 nt, Human
agcgccucuacugcaugga

SEQ ID NO: 56856 - RNA, 22 nt, Human
agccugggucgagagacgagaa

SEQ ID NO: 56857 - RNA, 22 nt, Human
agccugaaccaauauagcagcc

SEQ ID NO: 56858 - RNA, 22 nt, Human
agccucucugaugugacagcua

SEQ ID NO: 56859 - RNA, 21 nt, Human
agccgggacaacguggacccc

SEQ ID NO: 56860 - RNA, 22 nt, Human
agccggccucggacagagggag

SEQ ID NO: 56861 - RNA, 22 nt, Human
agccgcgcagccucauuaagga

SEQ ID NO: 56862 - RNA, 22 nt, Human
agccccggugagggaguccugu

SEQ ID NO: 56863 - RNA, 22 nt, Human
agcccuucccuuucacuggugc

SEQ ID NO: 56864 - RNA, 22 nt, Human
agccauggaggaugugcagcau

SEQ ID NO: 56865 - RNA, 22 nt, Human
agccauggagaacagacuugaa

SEQ ID NO: 56866 - RNA, 22 nt, Human
agccagugucgugugacaugag

SEQ ID NO: 56867 - RNA, 22 nt, Human
agccaugcuguuuugccuggga

SEQ ID NO: 56868 - RNA, 22 nt, Human
agcccgggagggcugucuggga

SEQ ID NO: 56869 - RNA, 22 nt, Human
agcccugugugcuuguguuccu

SEQ ID NO: 56870 - RNA, 22 nt, Human
agcaucggacggagcaccugcu

SEQ ID NO: 56871 - RNA, 22 nt, Human
agcccagguggagugugugggg

SEQ ID NO: 56872 - RNA, 22 nt, Human
agcagggagacagugcagcauu

SEQ ID NO: 56873 - RNA, 22 nt, Human
agcaggaaggcuagaagcagga

SEQ ID NO: 56874 - RNA, 19 nt, Human
agcagccaucgaccaugga

SEQ ID NO: 56875 - RNA, 22 nt, Human
agcagcaggugaccucgaugcc

SEQ ID NO: 56876 - RNA, 22 nt, Human
agcagcaccuguccucgcugcu

SEQ ID NO: 56877 - RNA, 22 nt, Human
agcagcaggcugggaugagucu

SEQ ID NO: 56878 - RNA, 22 nt, Human
agcaaggguugguuuucugaca

SEQ ID NO: 56879 - RNA, 22 nt, Human
agcaauguuggccuauauaccu

SEQ ID NO: 56880 - RNA, 22 nt, Human
agcacuuuagaauuuagaguug

SEQ ID NO: 56881 - RNA, 22 nt, Human
agcaaaacuaaagacacagaca

SEQ ID NO: 56882 - RNA, 22 nt, Human
agcacgcccaccuccugcggcg

SEQ ID NO: 56883 - RNA, 22 nt, Human
agcaccuuguucagaucuuaca

SEQ ID NO: 56884 - RNA, 20 nt, Human
agcacaggcagucauucagu

SEQ ID NO: 56885 - RNA, 22 nt, Human
agauucucccuccuggcgcugu

SEQ ID NO: 56886 - RNA, 22 nt, Human
agcaauucagagcauggacuuu

SEQ ID NO: 56887 - RNA, 22 nt, Human
agcaaggagcugaaaccgggcu

SEQ ID NO: 56888 - RNA, 22 nt, Human
agcaaagccucuuugaaaaaaa

SEQ ID NO: 56889 - RNA, 22 nt, Human
agcaaagguagcagcucccagg

SEQ ID NO: 56890 - RNA, 22 nt, Human
agcaagggucucucauggcuug

SEQ ID NO: 56891 - RNA, 22 nt, Human
agauggcugggagcucuguuug

SEQ ID NO: 56892 - RNA, 22 nt, Human
agauggaguccugaagccagaa

SEQ ID NO: 56893 - RNA, 22 nt, Human
agauugaugugaccauuggaag

SEQ ID NO: 56894 - RNA, 22 nt, Human
agaugaugugugucuucagcua

SEQ ID NO: 56895 - RNA, 22 nt, Human
agauggcuccaguguccagagg

SEQ ID NO: 56896 - RNA, 22 nt, Human
agaugucauguguugcuccaag

SEQ ID NO: 56897 - RNA, 19 nt, Human
agauggcaaaaugcaaaga

SEQ ID NO: 56898 - RNA, 19 nt, Human
agaucaggauguauuuuug

SEQ ID NO: 56899 - RNA, 21 nt, Human
agaugcaguuugcaggugggu

SEQ ID NO: 56900 - RNA, 21 nt, Human
agaugaggauacugaggccua

SEQ ID NO: 56901 - RNA, 23 nt, Human
agaugaugaauaaagagugagga

SEQ ID NO: 56902 - RNA, 22 nt, Human
agaugacuuuguccugagcuga

SEQ ID NO: 56903 - RNA, 22 nt, Human
agauauucugccuaacagguuu

SEQ ID NO: 56904 - RNA, 22 nt, Human
agaucugucaccauccuggagc

SEQ ID NO: 56905 - RNA, 22 nt, Human
agaguguguggggcugagguca

SEQ ID NO: 56906 - RNA, 22 nt, Human
agauaaacaacucuuagcuguu

SEQ ID NO: 56907 - RNA, 22 nt, Human
agauaucuuguuggcauaaaug

SEQ ID NO: 56908 - RNA, 22 nt, Human
agaggggaaggaugugauguga

SEQ ID NO: 56909 - RNA, 22 nt, Human
agagccggagucuucuuguuug

SEQ ID NO: 56910 - RNA, 22 nt, Human
agagccaugcuugugcauauau

SEQ ID NO: 56911 - RNA, 22 nt, Human
agagcagauggagcuggaagag

SEQ ID NO: 56912 - RNA, 22 nt, Human
agaccauuuuguagccagcaua

SEQ ID NO: 56913 - RNA, 22 nt, Human
agacaaucaacuguugaugccu

SEQ ID NO: 56914 - RNA, 22 nt, Human
agaauccucuagggauggcagg

SEQ ID NO: 56915 - RNA, 22 nt, Human
agaauccugagggaaauuuggc

SEQ ID NO: 56916 - RNA, 22 nt, Human
agaaucugcauuuuaacaagau

SEQ ID NO: 56917 - RNA, 22 nt, Human
agaagcagaaggaagcagggcc

SEQ ID NO: 56918 - RNA, 22 nt, Human
agaagcaauuggaaaguacagg

SEQ ID NO: 56919 - RNA, 19 nt, Human
agaacccccuuccucugcu

SEQ ID NO: 56920 - RNA, 22 nt, Human
agaagggcugcuuagaauauac

SEQ ID NO: 56921 - RNA, 22 nt, Human
agaagaucccugugguuacgac

SEQ ID NO: 56922 - RNA, 22 nt, Human
agaagaagacccuaaggaaagg

SEQ ID NO: 56923 - RNA, 22 nt, Human
agaaggcaucugcucgcuucca

SEQ ID NO: 56924 - RNA, 22 nt, Human
agaaaaggaagcuuagacugua

SEQ ID NO: 56925 - RNA, 22 nt, Human
agaaauggggugaagcaaaugg

SEQ ID NO: 56926 - RNA, 22 nt, Human
acuugaugcauauggaagagca

SEQ ID NO: 56927 - RNA, 16 nt, Human
acuuguuguuuugguu

SEQ ID NO: 56928 - RNA, 22 nt, Human
acuuugaauuagaauuuugcug

SEQ ID NO: 56929 - RNA, 22 nt, Human
agaaaagaggcuuucuaagcau

SEQ ID NO: 56930 - RNA, 20 nt, Human
agaaaggaguaaagaagaga

SEQ ID NO: 56931 - RNA, 19 nt, Human
agaaauagccuuccuuguc

SEQ ID NO: 56932 - RNA, 22 nt, Human
acuugauggaguuucacuguau

SEQ ID NO: 56933 - RNA, 22 nt, Human
acuugcauuguguaguguuuuu

SEQ ID NO: 56934 - RNA, 22 nt, Human
acugcucugugguuggaagccu

SEQ ID NO: 56935 - RNA, 22 nt, Human
acuggcauuccuaggggagggg

SEQ ID NO: 56936 - RNA, 22 nt, Human
acuucugcccuggcgagggcgu

SEQ ID NO: 56937 - RNA, 22 nt, Human
acuucuuuugcaugauucuuua

SEQ ID NO: 56938 - RNA, 22 nt, Human
acugcauuucauaaauuacaau

SEQ ID NO: 56939 - RNA, 22 nt, Human
acugcauuaucaccaagaugua

SEQ ID NO: 56940 - RNA, 22 nt, Human
acugcaggucccaucaccugcg

SEQ ID NO: 56941 - RNA, 22 nt, Human
acugauuccaagcuuguggagg

SEQ ID NO: 56942 - RNA, 22 nt, Human
acucuugacuaaugcuaauguc

SEQ ID NO: 56943 - RNA, 22 nt, Human
acugaaaguugaugagucacug

SEQ ID NO: 56944 - RNA, 22 nt, Human
acugaaauggggacaguccuua

SEQ ID NO: 56945 - RNA, 22 nt, Human
acugaaggcuggaccaugcauc

SEQ ID NO: 56946 - RNA, 22 nt, Human
acucugcaguaaggaauuguuu

SEQ ID NO: 56947 - RNA, 22 nt, Human
acucucaauuaucuggacugaa

SEQ ID NO: 56948 - RNA, 22 nt, Human
acuccuucauauuuuaauugaa

SEQ ID NO: 56949 - RNA, 22 nt, Human
acucagcaccuagaaagugugc

SEQ ID NO: 56950 - RNA, 21 nt, Human
acucaucuuuuuggagaccag

SEQ ID NO: 56951 - RNA, 22 nt, Human
acuaucaacagcaucagggugu

SEQ ID NO: 56952 - RNA, 22 nt, Human
acuauggaguucagaucuugag

SEQ ID NO: 56953 - RNA, 22 nt, Human
acuaggaaguaaauaugucauc

SEQ ID NO: 56954 - RNA, 22 nt, Human
acgugcauuacucaaaucucaa

SEQ ID NO: 56955 - RNA, 22 nt, Human
acguuuuagccauguaguuucu

SEQ ID NO: 56956 - RNA, 22 nt, Human
acguccgcugauucuuuggaag

SEQ ID NO: 56957 - RNA, 22 nt, Human
acgggaggcguggucuuguagu

SEQ ID NO: 56958 - RNA, 22 nt, Human
acggcuugaacgcgccuguggg

SEQ ID NO: 56959 - RNA, 22 nt, Human
acgcuucacaggugcgcauugu

SEQ ID NO: 56960 - RNA, 22 nt, Human
acgccggguaaggucauucugc

SEQ ID NO: 56961 - RNA, 22 nt, Human
acgccuugagccuugccugaau

SEQ ID NO: 56962 - RNA, 23 nt, Human
acgcagacacauguaugggccuc

SEQ ID NO: 56963 - RNA, 22 nt, Human
acgcacuuuaugcuuuuaacaa

SEQ ID NO: 56964 - RNA, 22 nt, Human
acgcgcuccagcaggugcuuca

SEQ ID NO: 56965 - RNA, 22 nt, Human
acgccugccuguacuugugggg

SEQ ID NO: 56966 - RNA, 20 nt, Human
acgccgcgaggugagcuggu

SEQ ID NO: 56967 - RNA, 22 nt, Human
acgccaggagcuucuccguuca

SEQ ID NO: 56968 - RNA, 22 nt, Human
gagaacaaggaagagucggcag

SEQ ID NO: 56969 - RNA, 22 nt, Human
gauaccugccaagcugcacuca

SEQ ID NO: 56970 - RNA, 22 nt, Human
gauacuugaggagaucaccaca

SEQ ID NO: 56971 - RNA, 22 nt, Human
gacuggaaucucugcuuguuaa

SEQ ID NO: 56972 - RNA, 22 nt, Human
gaguucaaagaucuaggaagag

SEQ ID NO: 56973 - RNA, 22 nt, Human
gaguccuggagagcccgagcgc

SEQ ID NO: 56974 - RNA, 22 nt, Human
gaguauucuauguauauuauug

SEQ ID NO: 56975 - RNA, 22 nt, Human
gaguaugugaggaaguaaagaa

SEQ ID NO: 56976 - RNA, 22 nt, Human
gaccgggcucugcugacggucu

SEQ ID NO: 56977 - RNA, 22 nt, Human
gaccaggagauuugagcuaggc

SEQ ID NO: 56978 - RNA, 22 nt, Human
gagguucgauacagcguauuua

SEQ ID NO: 56979 - RNA, 22 nt, Human
gaguaaaagaugaggcaguaga

SEQ ID NO: 56980 - RNA, 22 nt, Human
gacagcguaucaauugaacaua

SEQ ID NO: 56981 - RNA, 22 nt, Human
gaggggcucuugggcaugaagg

SEQ ID NO: 56982 - RNA, 22 nt, Human
gaggggcuccagguguugagga

SEQ ID NO: 56983 - RNA, 22 nt, Human
gacaagaagaacggagguuuca

SEQ ID NO: 56984 - RNA, 22 nt, Human
gaggggaaggguguucaauggg

SEQ ID NO: 56985 - RNA, 22 nt, Human
gaaugguuagugaacaaauuug

SEQ ID NO: 56986 - RNA, 22 nt, Human
gaggggaagaacaauuuaauuu

SEQ ID NO: 56987 - RNA, 22 nt, Human
gaggggaaggagcgaaggcggg

SEQ ID NO: 56988 - RNA, 22 nt, Human
gaauggaacauagcaacaucuu

SEQ ID NO: 56989 - RNA, 22 nt, Human
gaggcugguucccuugaucuuu

SEQ ID NO: 56990 - RNA, 22 nt, Human
gaaugcacacgugugugcaugc

SEQ ID NO: 56991 - RNA, 22 nt, Human
gaggccuucauuucuccgucug

SEQ ID NO: 56992 - RNA, 22 nt, Human
gaggccagcacccagaugcaug

SEQ ID NO: 56993 - RNA, 22 nt, Human
gaaguucuuagucucauuugca

SEQ ID NO: 56994 - RNA, 22 nt, Human
gaauagauuagaaagaguaugu

SEQ ID NO: 56995 - RNA, 22 nt, Human
gaauauuuaucucagcugcaga

SEQ ID NO: 56996 - RNA, 22 nt, Human
gaggagggagcuggaagcucuu

SEQ ID NO: 56997 - RNA, 22 nt, Human
gaaggggccuggggcaaggcua

SEQ ID NO: 56998 - RNA, 22 nt, Human
gaagguuuacugaagauuuaaa

SEQ ID NO: 56999 - RNA, 22 nt, Human
gaagggccaggggcaggcugga

SEQ ID NO: 57000 - RNA, 22 nt, Human
gaggagcaggcaggaucugguc

SEQ ID NO: 57001 - RNA, 22 nt, Human
gaggagaaacagccgugauagu

SEQ ID NO: 57002 - RNA, 22 nt, Human
gaggagacaguggagccgcuac

SEQ ID NO: 57003 - RNA, 22 nt, Human
gaaggcuguggcuggucucagu

SEQ ID NO: 57004 - RNA, 22 nt, Human
gaaggcugaauuauuuguuccu

SEQ ID NO: 57005 - RNA, 22 nt, Human
gaaggcagucuggggagcagcc

SEQ ID NO: 57006 - RNA, 22 nt, Human
gaggaagucuuaucuggaugca

SEQ ID NO: 57007 - RNA, 22 nt, Human
gaaggcaguaaauggcuguuuu

SEQ ID NO: 57008 - RNA, 22 nt, Human
gaaggaaaagacgugcuaagua

SEQ ID NO: 57009 - RNA, 22 nt, Human
gagcuggacauacaggaaacca

SEQ ID NO: 57010 - RNA, 22 nt, Human
gaggaaaauggaguguaauuaa

SEQ ID NO: 57011 - RNA, 21 nt, Human
gaagcugcuaugaagggggac

SEQ ID NO: 57012 - RNA, 22 nt, Human
gaagcccuggaggggcuggagg

SEQ ID NO: 57013 - RNA, 22 nt, Human
gagccuuucuggagggcacuug

SEQ ID NO: 57014 - RNA, 19 nt, Human
gagccgcucccgcagccgg

SEQ ID NO: 57015 - RNA, 22 nt, Human
gagccucaggguuuuguugaca

SEQ ID NO: 57016 - RNA, 22 nt, Human
gaagcaagagggaucaggaucu

SEQ ID NO: 57017 - RNA, 22 nt, Human
gaaaauaguucaucacaaugau

SEQ ID NO: 57018 - RNA, 22 nt, Human
gagaaaacauacuuaguguccu

SEQ ID NO: 57019 - RNA, 22 nt, Human
gagaaagauuguccuucagggg

SEQ ID NO: 57020 - RNA, 22 nt, Human
gagaaaaauuucuuugcugcac

SEQ ID NO: 57021 - RNA, 22 nt, Human
gaaaaaccacaauugguauuuu

SEQ ID NO: 57022 - RNA, 19 nt, Human
cuuugugguuuucagaacu

SEQ ID NO: 57023 - RNA, 22 nt, Human
gacaucuguccauggcacugga

SEQ ID NO: 57024 - RNA, 22 nt, Human
cuuuugcaauagugacacugau

SEQ ID NO: 57025 - RNA, 22 nt, Human
gaccuccauucugucaugacug

SEQ ID NO: 57026 - RNA, 22 nt, Human
gaccuuguucuggcauucucag

SEQ ID NO: 57027 - RNA, 22 nt, Human
gaccuuucccuaucucacucuc

SEQ ID NO: 57028 - RNA, 22 nt, Human
cuuugugcagcagaaaugugug

SEQ ID NO: 57029 - RNA, 22 nt, Human
cuuuggacaacugagugacguu

SEQ ID NO: 57030 - RNA, 22 nt, Human
gacaggaauuaucuaaaguaga

SEQ ID NO: 57031 - RNA, 22 nt, Human
gacaggcagagaggaagagaga

SEQ ID NO: 57032 - RNA, 22 nt, Human
gacagcguguuuugcaugaaca

SEQ ID NO: 57033 - RNA, 22 nt, Human
cuuuccaugucuucuuucucca

SEQ ID NO: 57034 - RNA, 22 nt, Human
cuuuccugaaaucucuucugca

SEQ ID NO: 57035 - RNA, 22 nt, Human
gacacccgccggcgccugccuc

SEQ ID NO: 57036 - RNA, 19 nt, Human
cuuguggcuaugcagauac

SEQ ID NO: 57037 - RNA, 20 nt, Human
gacaagccacagcucccaga

SEQ ID NO: 57038 - RNA, 22 nt, Human
cuugccagggacucagucaggg

SEQ ID NO: 57039 - RNA, 22 nt, Human
gaaugggaauuauggugggacu

SEQ ID NO: 57040 - RNA, 22 nt, Human
gaauuagguaauagaacuagua

SEQ ID NO: 57041 - RNA, 22 nt, Human
gaauuccaggugagagaaggua

SEQ ID NO: 57042 - RNA, 22 nt, Human
cuugcaaugaaggcacacuuau

SEQ ID NO: 57043 - RNA, 22 nt, Human
gaagguuuuguuugcaaaucau

SEQ ID NO: 57044 - RNA, 22 nt, Human
cuucucugcugccugccucuuu

SEQ ID NO: 57045 - RNA, 22 nt, Human
gaaggugcugaaacagaaauuu

SEQ ID NO: 57046 - RNA, 22 nt, Human
gaaggggacuccauggaaugau

SEQ ID NO: 57047 - RNA, 22 nt, Human
cuuccuuucagaggaaggccug

SEQ ID NO: 57048 - RNA, 22 nt, Human
gaagauucugacccugacucag

SEQ ID NO: 57049 - RNA, 18 nt, Human
gaagcaacaguucugagu

SEQ ID NO: 57050 - RNA, 22 nt, Human
gaagaugcugcuuguucacggg

SEQ ID NO: 57051 - RNA, 22 nt, Human
gaagaugacaucggaucugucu

SEQ ID NO: 57052 - RNA, 22 nt, Human
gaacuugagugugcuauuucuu

SEQ ID NO: 57053 - RNA, 22 nt, Human
gaacggccucguuccucggugu

SEQ ID NO: 57054 - RNA, 22 nt, Human
gaacugaauguguaauguuggc

SEQ ID NO: 57055 - RNA, 22 nt, Human
cuguccugauggugccacuggu

SEQ ID NO: 57056 - RNA, 22 nt, Human
gaaaucuggugauuuucuguug

SEQ ID NO: 57057 - RNA, 22 nt, Human
gaaaugaaacacacaugcagcu

SEQ ID NO: 57058 - RNA, 21 nt, Human
gaaaaucuaaugugacaaugc

SEQ ID NO: 57059 - RNA, 22 nt, Human
gaaaaugcacacauacacaccc

SEQ ID NO: 57060 - RNA, 22 nt, Human
cuguauggaggaggugcuagcc

SEQ ID NO: 57061 - RNA, 22 nt, Human
gaaaaguuuaaccuuguacauu

SEQ ID NO: 57062 - RNA, 22 nt, Human
gaaaaucaggauggaugugagg

SEQ ID NO: 57063 - RNA, 22 nt, Human
cuggugcuguagccugauugag

SEQ ID NO: 57064 - RNA, 22 nt, Human
gaaaagcucuuuagaagagguu

SEQ ID NO: 57065 - RNA, 22 nt, Human
gaaaacccuguauguagcguuu

SEQ ID NO: 57066 - RNA, 22 nt, Human
cuggugaagccuucggagaccc

SEQ ID NO: 57067 - RNA, 22 nt, Human
gaaaagaaaggaugguaugugu

SEQ ID NO: 57068 - RNA, 22 nt, Human
gaaaagaaggcaggagcccaag

SEQ ID NO: 57069 - RNA, 22 nt, Human
cuuuuuuucuccauauuucugg

SEQ ID NO: 57070 - RNA, 22 nt, Human
cuggggccccagcucggccccu

SEQ ID NO: 57071 - RNA, 22 nt, Human
cugggcucccucucccgccucg

SEQ ID NO: 57072 - RNA, 22 nt, Human
gaaaaagagaaggaguucagua

SEQ ID NO: 57073 - RNA, 22 nt, Human
gaaaaauggguuguuugaagau

SEQ ID NO: 57074 - RNA, 22 nt, Human
cugggugggcacccagccuggg

SEQ ID NO: 57075 - RNA, 22 nt, Human
cugggaccugugugccugggcc

SEQ ID NO: 57076 - RNA, 22 nt, Human
cugggagggguagccaauccua

SEQ ID NO: 57077 - RNA, 22 nt, Human
cuuuuggcaucagccucaggaa

SEQ ID NO: 57078 - RNA, 22 nt, Human
cuuuuucuuaucuuuuucuaug

SEQ ID NO: 57079 - RNA, 22 nt, Human
cuuuuugcccuugggcuuccug

SEQ ID NO: 57080 - RNA, 22 nt, Human
cugggcaugggaacuucaaggc

SEQ ID NO: 57081 - RNA, 22 nt, Human
cuggcggcccgaggcagaggag

SEQ ID NO: 57082 - RNA, 22 nt, Human
cuggcgagcugggccuggggga

SEQ ID NO: 57083 - RNA, 22 nt, Human
cuuuuccuccaggaagccaagc

SEQ ID NO: 57084 - RNA, 22 nt, Human
cuggauagaggaugguaggcac

SEQ ID NO: 57085 - RNA, 22 nt, Human
cuggaugagcuucgugcgcacg

SEQ ID NO: 57086 - RNA, 22 nt, Human
cuucagcgucgucaguguugcu

SEQ ID NO: 57087 - RNA, 22 nt, Human
cuuugcaaagagagaaaguggg

SEQ ID NO: 57088 - RNA, 23 nt, Human
cuucagaccucagaaggucuguu

SEQ ID NO: 57089 - RNA, 22 nt, Human
cugaucuuaaguaacauuauuu

SEQ ID NO: 57090 - RNA, 23 nt, Human
cugagggcuggucugaagucugc

SEQ ID NO: 57091 - RNA, 22 nt, Human
cugagcggugagggcauacagc

SEQ ID NO: 57092 - RNA, 22 nt, Human
cuguuucuuugcugucagagag

SEQ ID NO: 57093 - RNA, 20 nt, Human
cuguuugcuaucaugagcug

SEQ ID NO: 57094 - RNA, 22 nt, Human
cugaagcugggcacuuccuuuu

SEQ ID NO: 57095 - RNA, 22 nt, Human
cugaagaaagaaaauggccauc

SEQ ID NO: 57096 - RNA, 22 nt, Human
cugaaagacgaggggaagucgg

SEQ ID NO: 57097 - RNA, 20 nt, Human
cugaaaggaaagaaauuuuu

SEQ ID NO: 57098 - RNA, 22 nt, Human
cuguucuccacuccugacuucu

SEQ ID NO: 57099 - RNA, 22 nt, Human
cugugcuguuagcgauuuuuaa

SEQ ID NO: 57100 - RNA, 22 nt, Human
cugaaacuauggggaggggagc

SEQ ID NO: 57101 - RNA, 22 nt, Human
cugugcuguuaagaaauuuagu

SEQ ID NO: 57102 - RNA, 22 nt, Human
cucuuucauucuuagguugccg

SEQ ID NO: 57103 - RNA, 22 nt, Human
cuguccuguggccugcuccggu

SEQ ID NO: 57104 - RNA, 22 nt, Human
cucuggcaacgauggugcuuau

SEQ ID NO: 57105 - RNA, 22 nt, Human
cuggguuuggcugugcuugaau

SEQ ID NO: 57106 - RNA, 21 nt, Human
cuggcucgccaugguucuuuu

SEQ ID NO: 57107 - RNA, 22 nt, Human
cuggcuguguguuugugcaucu

SEQ ID NO: 57108 - RNA, 22 nt, Human
cuccagagagaaaggaggccgc

SEQ ID NO: 57109 - RNA, 22 nt, Human
cucccucauaugguugcuuauc

SEQ ID NO: 57110 - RNA, 22 nt, Human
cuggcggugaucccgauggugu

SEQ ID NO: 57111 - RNA, 22 nt, Human
cucaugcugcaaauggcuguuu

SEQ ID NO: 57112 - RNA, 22 nt, Human
cuggcaguguccagcucgugau

SEQ ID NO: 57113 - RNA, 22 nt, Human
cucagcgggagucuggccgaac

SEQ ID NO: 57114 - RNA, 22 nt, Human
cucacugugggcuaugaauggg

SEQ ID NO: 57115 - RNA, 22 nt, Human
cuauuauuauugucguuuuaca

SEQ ID NO: 57116 - RNA, 22 nt, Human
cugcugugcagacagacucucu

SEQ ID NO: 57117 - RNA, 22 nt, Human
cugcugucuuuauuucacugcu

SEQ ID NO: 57118 - RNA, 22 nt, Human
cugcuggugcugcccacacggu

SEQ ID NO: 57119 - RNA, 22 nt, Human
cugcucugagaggcucuuccua

SEQ ID NO: 57120 - RNA, 22 nt, Human
cugcguugaccagacuccuggg

SEQ ID NO: 57121 - RNA, 22 nt, Human
cugcgguucuguuuaguggcga

SEQ ID NO: 57122 - RNA, 22 nt, Human
cugcgcgagcacugccggcggg

SEQ ID NO: 57123 - RNA, 22 nt, Human
cugcggcaccaaccccuucaug

SEQ ID NO: 57124 - RNA, 22 nt, Human
cugccuuggcccuaguucaugg

SEQ ID NO: 57125 - RNA, 22 nt, Human
cugcgcagaucugcuguucucu

SEQ ID NO: 57126 - RNA, 22 nt, Human
cugccgaugcgcaguggcgccu

SEQ ID NO: 57127 - RNA, 22 nt, Human
cugccucucaugccugcuugcu

SEQ ID NO: 57128 - RNA, 22 nt, Human
cugcccugcagcuccacggacu

SEQ ID NO: 57129 - RNA, 22 nt, Human
cugcccgcaugcaggaaugcug

SEQ ID NO: 57130 - RNA, 22 nt, Human
cugccccucgcucaccagcucu

SEQ ID NO: 57131 - RNA, 22 nt, Human
cugcccauggcuccuggcugug

SEQ ID NO: 57132 - RNA, 22 nt, Human
cugccaguaucuuuggggcugu

SEQ ID NO: 57133 - RNA, 22 nt, Human
cuaacuuugucuugguaauugc

SEQ ID NO: 57134 - RNA, 22 nt, Human
cugcagauaaguguuuugaaaa

SEQ ID NO: 57135 - RNA, 22 nt, Human
cugcaucacagcaggaggcaca

SEQ ID NO: 57136 - RNA, 22 nt, Human
cguuuugaguagauagccauau

SEQ ID NO: 57137 - RNA, 22 nt, Human
cuaaaacuuuuccaaauuaugu

SEQ ID NO: 57138 - RNA, 22 nt, Human
cguuugagggaguuggaacugc

SEQ ID NO: 57139 - RNA, 17 nt, Human
cguuccagaacaaauga

SEQ ID NO: 57140 - RNA, 22 nt, Human
cgugugugugcgugugcgugug

SEQ ID NO: 57141 - RNA, 22 nt, Human
cgugucauggcggcgcaggugg

SEQ ID NO: 57142 - RNA, 22 nt, Human
cguggcaguagagcuggaacuu

SEQ ID NO: 57143 - RNA, 22 nt, Human
cgugcaggagcuggagguccga

SEQ ID NO: 57144 - RNA, 22 nt, Human
cguggaggucgcauauuccucu

SEQ ID NO: 57145 - RNA, 22 nt, Human
cgugaaaugcagaaaguugugg

SEQ ID NO: 57146 - RNA, 22 nt, Human
cugaugcucuggauguagucaa

SEQ ID NO: 57147 - RNA, 22 nt, Human
cggugcuuuccauaucagcagc

SEQ ID NO: 57148 - RNA, 22 nt, Human
cucugcguggcugggcccaggg

SEQ ID NO: 57149 - RNA, 22 nt, Human
cgguuuuuaaaagucucuucua

SEQ ID NO: 57150 - RNA, 22 nt, Human
cgguugcaggaugugcgggcag

SEQ ID NO: 57151 - RNA, 22 nt, Human
cggccuuugcccgucauucugg

SEQ ID NO: 57152 - RNA, 22 nt, Human
cuccugcuuuuucuucuuccga

SEQ ID NO: 57153 - RNA, 22 nt, Human
cuccggccuucugacuccccug

SEQ ID NO: 57154 - RNA, 20 nt, Human
cucauugcuuucauuuucuu

SEQ ID NO: 57155 - RNA, 22 nt, Human
cucaucagagcccuccucuggc

SEQ ID NO: 57156 - RNA, 22 nt, Human
cucaugaauggcucuuugugcu

SEQ ID NO: 57157 - RNA, 22 nt, Human
cgcgcuuugggcaguguggcug

SEQ ID NO: 57158 - RNA, 22 nt, Human
cgcgcgguguuccgcauucugc

SEQ ID NO: 57159 - RNA, 22 nt, Human
cucaagugacucagccugguug

SEQ ID NO: 57160 - RNA, 22 nt, Human
cucaauuguuuggucucugguu

SEQ ID NO: 57161 - RNA, 22 nt, Human
cgcccggcugagacgcucgccc

SEQ ID NO: 57162 - RNA, 22 nt, Human
cgcccccgaucggggccgccgc

SEQ ID NO: 57163 - RNA, 22 nt, Human
cgcccguacuuugccggcauga

SEQ ID NO: 57164 - RNA, 22 nt, Human
cgccgccgccugcccgcgcccc

SEQ ID NO: 57165 - RNA, 22 nt, Human
cgcaucggguagaggagcugga

SEQ ID NO: 57166 - RNA, 22 nt, Human
cgagugauuauucuggcugaga

SEQ ID NO: 57167 - RNA, 22 nt, Human
cgcacacaaaugcauacgccag

SEQ ID NO: 57168 - RNA, 22 nt, Human
cgcacuugugagcgacagggcu

SEQ ID NO: 57169 - RNA, 22 nt, Human
cguggccacaguggagcugagc

SEQ ID NO: 57170 - RNA, 17 nt, Human
cgugaggaccaggcagc

SEQ ID NO: 57171 - RNA, 22 nt, Human
ccuuucucuuggauaccgauug

SEQ ID NO: 57172 - RNA, 22 nt, Human
ccuuugcccugagaaauguucc

SEQ ID NO: 57173 - RNA, 22 nt, Human
ccuuucuggucucugagagacu

SEQ ID NO: 57174 - RNA, 21 nt, Human
ccuugcacucaucccaugccc

SEQ ID NO: 57175 - RNA, 22 nt, Human
ccuugauaugcuucagagaauu

SEQ ID NO: 57176 - RNA, 22 nt, Human
ccuggccacagggcucugcauu

SEQ ID NO: 57177 - RNA, 22 nt, Human
ccuggcccagcuggaagcggga

SEQ ID NO: 57178 - RNA, 22 nt, Human
cgggaggcggagcuccgcgggg

SEQ ID NO: 57179 - RNA, 22 nt, Human
cgggagcagcucuggggcuggg

SEQ ID NO: 57180 - RNA, 20 nt, Human
cgggacacucaagcucuggg

SEQ ID NO: 57181 - RNA, 22 nt, Human
cggcuucucgggucggauuccg

SEQ ID NO: 57182 - RNA, 22 nt, Human
cggcugcgguucaccuagggca

SEQ ID NO: 57183 - RNA, 22 nt, Human
cggaggcugcuuucuguugcua

SEQ ID NO: 57184 - RNA, 22 nt, Human
cggagggcccucaggacugggu

SEQ ID NO: 57185 - RNA, 22 nt, Human
cggagcauacugccuggagaug

SEQ ID NO: 57186 - RNA, 22 nt, Human
cggacugaccugcucggggaga

SEQ ID NO: 57187 - RNA, 22 nt, Human
cgcuggagagcaagugcgugca

SEQ ID NO: 57188 - RNA, 22 nt, Human
cgcuuuccaggcacauccucuu

SEQ ID NO: 57189 - RNA, 22 nt, Human
cgcuuugguaauagggcagccu

SEQ ID NO: 57190 - RNA, 22 nt, Human
cgcugcugucaucgucuacggu

SEQ ID NO: 57191 - RNA, 22 nt, Human
cgcugggugguugauguacagc

SEQ ID NO: 57192 - RNA, 21 nt, Human
cgcccggccggaaaccccuuc

SEQ ID NO: 57193 - RNA, 22 nt, Human
cgccgugucuggucuguacguc

SEQ ID NO: 57194 - RNA, 22 nt, Human
cgccgugcagucagcccagaag

SEQ ID NO: 57195 - RNA, 22 nt, Human
cgcacaggcacagacacuggga

SEQ ID NO: 57196 - RNA, 22 nt, Human
cgaggagguccaggagcaguag

SEQ ID NO: 57197 - RNA, 22 nt, Human
cgaggccgcuucauggcuggca

SEQ ID NO: 57198 - RNA, 22 nt, Human
cgaggcuugcaaggacgaggag

SEQ ID NO: 57199 - RNA, 22 nt, Human
ccucccuucccggcauggcucu

SEQ ID NO: 57200 - RNA, 21 nt, Human
ccuaugucucaaagguucucc

SEQ ID NO: 57201 - RNA, 22 nt, Human
ccuccacgaggggucuucucuu

SEQ ID NO: 57202 - RNA, 22 nt, Human
cgaaaaagaagugcaccauguu

SEQ ID NO: 57203 - RNA, 22 nt, Human
cgaacggcagagagcccguccc

SEQ ID NO: 57204 - RNA, 22 nt, Human
ccuauauuacaggcuugcucua

SEQ ID NO: 57205 - RNA, 22 nt, Human
ccgggcggcauccagccguucc

SEQ ID NO: 57206 - RNA, 22 nt, Human
ccgggcuuccuuagagcaagau

SEQ ID NO: 57207 - RNA, 22 nt, Human
ccggcugcugaggcggccccgg

SEQ ID NO: 57208 - RNA, 21 nt, Human
ccuuuggagacugcagcaaug

SEQ ID NO: 57209 - RNA, 22 nt, Human
ccggcugagccucgccgcggcc

SEQ ID NO: 57210 - RNA, 22 nt, Human
ccggcggguggagcaugcgcgg

SEQ ID NO: 57211 - RNA, 22 nt, Human
ccgcuggccgacuuccgagagc

SEQ ID NO: 57212 - RNA, 22 nt, Human
ccgcgggcagggcuucaccuuu

SEQ ID NO: 57213 - RNA, 17 nt, Human
ccuuucugaucaucuga

SEQ ID NO: 57214 - RNA, 22 nt, Human
ccuugggagcgcccuguccggg

SEQ ID NO: 57215 - RNA, 22 nt, Human
ccuuccaguucuugguuguaau

SEQ ID NO: 57216 - RNA, 22 nt, Human
ccuucugcuggucaucccagug

SEQ ID NO: 57217 - RNA, 22 nt, Human
ccuguuccaacccucccuggcu

SEQ ID NO: 57218 - RNA, 22 nt, Human
ccuuagaaaaucauggaauauu

SEQ ID NO: 57219 - RNA, 22 nt, Human
ccugucuuuucugaucauacua

SEQ ID NO: 57220 - RNA, 22 nt, Human
ccuggcccugcugcuugccagc

SEQ ID NO: 57221 - RNA, 22 nt, Human
ccgcggauggggagucaccacc

SEQ ID NO: 57222 - RNA, 22 nt, Human
ccgagcagggcgcccugcccca

SEQ ID NO: 57223 - RNA, 19 nt, Human
ccgagcagauugauguuuc

SEQ ID NO: 57224 - RNA, 22 nt, Human
ccuggcauuagaaauuccguca

SEQ ID NO: 57225 - RNA, 22 nt, Human
ccgaaccacacgacagugcuca

SEQ ID NO: 57226 - RNA, 19 nt, Human
ccagaagggcaagcaaagg

SEQ ID NO: 57227 - RNA, 22 nt, Human
cccagaaugauucagcgacagu

SEQ ID NO: 57228 - RNA, 22 nt, Human
ccacucagaagaaacaagagag

SEQ ID NO: 57229 - RNA, 22 nt, Human
ccacuuucuaaauuggcgauuu

SEQ ID NO: 57230 - RNA, 22 nt, Human
ccauggccaauugcaccuugcu

SEQ ID NO: 57231 - RNA, 22 nt, Human
ccauggaaaagacgggcaggcc

SEQ ID NO: 57232 - RNA, 23 nt, Human
ccacaugugagcccaccgugccc

SEQ ID NO: 57233 - RNA, 22 nt, Human
ccaccacauuugccuagacuuu

SEQ ID NO: 57234 - RNA, 22 nt, Human
ccaauguuaggcucugguuuua

SEQ ID NO: 57235 - RNA, 22 nt, Human
ccaaggcugcagccgugacgcg

SEQ ID NO: 57236 - RNA, 22 nt, Human
ccagugacaaagucggaagucc

SEQ ID NO: 57237 - RNA, 22 nt, Human
ccagugcagacgcggaacuggc

SEQ ID NO: 57238 - RNA, 22 nt, Human
ccaguccugucaggggagggga

SEQ ID NO: 57239 - RNA, 22 nt, Human
ccaagcguguuuaggaaaugcu

SEQ ID NO: 57240 - RNA, 22 nt, Human
ccaagagcuucccauagcuucu

SEQ ID NO: 57241 - RNA, 19 nt, Human
ccaacaguacugaagcacu

SEQ ID NO: 57242 - RNA, 22 nt, Human
ccagggagggccacagggccau

SEQ ID NO: 57243 - RNA, 22 nt, Human
ccagggcggacaaggucuuuga

SEQ ID NO: 57244 - RNA, 22 nt, Human
ccaggcagaggggucuggagca

SEQ ID NO: 57245 - RNA, 17 nt, Human
ccagcugcucccucaga

SEQ ID NO: 57246 - RNA, 22 nt, Human
cauuuuuccucaggcaauuuga

SEQ ID NO: 57247 - RNA, 22 nt, Human
cauuuucugcaagucugcucaa

SEQ ID NO: 57248 - RNA, 22 nt, Human
cauuuuaucagcacacgucacu

SEQ ID NO: 57249 - RNA, 22 nt, Human
cauuuuccucugcugguguuca

SEQ ID NO: 57250 - RNA, 22 nt, Human
ccagccugagcuugcugcccuc

SEQ ID NO: 57251 - RNA, 22 nt, Human
ccagcaggagacuagcaacaua

SEQ ID NO: 57252 - RNA, 22 nt, Human
ccagcaaguaagucagugucag

SEQ ID NO: 57253 - RNA, 22 nt, Human
ccagagaugcagugggugcagu

SEQ ID NO: 57254 - RNA, 22 nt, Human
ccagcaagacucgcagugggau

SEQ ID NO: 57255 - RNA, 22 nt, Human
cauuuaucacuugcuaaacaua

SEQ ID NO: 57256 - RNA, 22 nt, Human
cauuggcacauguauucugggc

SEQ ID NO: 57257 - RNA, 22 nt, Human
ccagaggcuuaugcagcugcug

SEQ ID NO: 57258 - RNA, 22 nt, Human
cauugcugugggcauuugcugc

SEQ ID NO: 57259 - RNA, 20 nt, Human
ccagaagagaagaaaaggaa

SEQ ID NO: 57260 - RNA, 19 nt, Human
ccacuucuuugugugugag

SEQ ID NO: 57261 - RNA, 22 nt, Human
cauuccuucucagguacuggca

SEQ ID NO: 57262 - RNA, 22 nt, Human
cauugcaaccauuccaaauggc

SEQ ID NO: 57263 - RNA, 22 nt, Human
cauugcaaccccaaaaagaaca

SEQ ID NO: 57264 - RNA, 16 nt, Human
ccacccagagaauauu

SEQ ID NO: 57265 - RNA, 22 nt, Human
ccacuacauugagugcuuucuc

SEQ ID NO: 57266 - RNA, 20 nt, Human
cauuccaugcaucuuggucc

SEQ ID NO: 57267 - RNA, 22 nt, Human
caugugcaucagccaauuggag

SEQ ID NO: 57268 - RNA, 22 nt, Human
caugguaccuagccucauggau

SEQ ID NO: 57269 - RNA, 22 nt, Human
caugggcucuucuggacugcac

SEQ ID NO: 57270 - RNA, 22 nt, Human
cauggcaggugcagauucugug

SEQ ID NO: 57271 - RNA, 22 nt, Human
cauggccaaagaauuauauuuu

SEQ ID NO: 57272 - RNA, 22 nt, Human
ccaaggcuggagggcuuaugua

SEQ ID NO: 57273 - RNA, 22 nt, Human
caugccaguagccggcuugacu

SEQ ID NO: 57274 - RNA, 22 nt, Human
caugcagcagaauaaugacuau

SEQ ID NO: 57275 - RNA, 22 nt, Human
caugccugaucagcggccagca

SEQ ID NO: 57276 - RNA, 20 nt, Human
caugaugcaaacaguaacgu

SEQ ID NO: 57277 - RNA, 22 nt, Human
ccaaagaagcaaugagaauagu

SEQ ID NO: 57278 - RNA, 22 nt, Human
ccaaagaauuuggaaaaucuga

SEQ ID NO: 57279 - RNA, 22 nt, Human
caugaugaacugugcuguuagg

SEQ ID NO: 57280 - RNA, 22 nt, Human
cauccuauuacugaggcucccc

SEQ ID NO: 57281 - RNA, 22 nt, Human
caucugcagccucugcauuccc

SEQ ID NO: 57282 - RNA, 22 nt, Human
cauugcuguuaauugucucuag

SEQ ID NO: 57283 - RNA, 22 nt, Human
caucacggagcaugagaagaca

SEQ ID NO: 57284 - RNA, 22 nt, Human
caucaacagucuacuuuuugcc

SEQ ID NO: 57285 - RNA, 22 nt, Human
cauuccuaccauaucugcucuu

SEQ ID NO: 57286 - RNA, 22 nt, Human
caucaggcugggaacacagauc

SEQ ID NO: 57287 - RNA, 20 nt, Human
cauuccugaggaauucaugu

SEQ ID NO: 57288 - RNA, 22 nt, Human
cauugcugccaaggugagcugg

SEQ ID NO: 57289 - RNA, 22 nt, Human
caucagucugaaagccagggag

SEQ ID NO: 57290 - RNA, 23 nt, Human
cauauucagaaacaccuaguggu

SEQ ID NO: 57291 - RNA, 22 nt, Human
cauguggaaaugcaugcuuuuu

SEQ ID NO: 57292 - RNA, 22 nt, Human
caggugccucugccccacgcgg

SEQ ID NO: 57293 - RNA, 22 nt, Human
cauagcguuuacauguggauua

SEQ ID NO: 57294 - RNA, 22 nt, Human
cauaucuccagguucugcugga

SEQ ID NO: 57295 - RNA, 21 nt, Human
caguuugcuauuuuaguauga

SEQ ID NO: 57296 - RNA, 22 nt, Human
caguucuguaccaggagaagcu

SEQ ID NO: 57297 - RNA, 22 nt, Human
caggggcuccaggugagccugg

SEQ ID NO: 57298 - RNA, 22 nt, Human
caguggaugucucauaguguga

SEQ ID NO: 57299 - RNA, 22 nt, Human
cagugccggccaggaccuccug

SEQ ID NO: 57300 - RNA, 22 nt, Human
cagugcaacguugugcauucaa

SEQ ID NO: 57301 - RNA, 22 nt, Human
cagguuuuuauuacaacuuuga

SEQ ID NO: 57302 - RNA, 22 nt, Human
caggcacaaugagcgccaucuu

SEQ ID NO: 57303 - RNA, 22 nt, Human
caggcacaagaucggcuagaua

SEQ ID NO: 57304 - RNA, 22 nt, Human
cagguuuggaagucacgaagcu

SEQ ID NO: 57305 - RNA, 22 nt, Human
caggaggaggccgggaggaagc

SEQ ID NO: 57306 - RNA, 22 nt, Human
cagguggccggguaggaggugg

SEQ ID NO: 57307 - RNA, 22 nt, Human
cagguggauggcgagcccugca

SEQ ID NO: 57308 - RNA, 22 nt, Human
caggaagagaacugcucagccu

SEQ ID NO: 57309 - RNA, 22 nt, Human
caggugcucugauauggggcug

SEQ ID NO: 57310 - RNA, 22 nt, Human
cagcuugcccugauguggaaga

SEQ ID NO: 57311 - RNA, 22 nt, Human
cagcuucacuuaaaacaugcaa

SEQ ID NO: 57312 - RNA, 22 nt, Human
cagcuggaggagcagcuuccag

SEQ ID NO: 57313 - RNA, 22 nt, Human
caggguuuuaguugcagguuau

SEQ ID NO: 57314 - RNA, 22 nt, Human
cagcuuaccucccacagcucuc

SEQ ID NO: 57315 - RNA, 22 nt, Human
caggcgcauggugagcagauga

SEQ ID NO: 57316 - RNA, 22 nt, Human
caggccgcccucuccuguuagc

SEQ ID NO: 57317 - RNA, 22 nt, Human
caggccccagggacugggcgcu

SEQ ID NO: 57318 - RNA, 22 nt, Human
caggccgccacugcagcagcug

SEQ ID NO: 57319 - RNA, 22 nt, Human
caggauauguucaagguuuucu

SEQ ID NO: 57320 - RNA, 22 nt, Human
caggacuuccucuaugguggcg

SEQ ID NO: 57321 - RNA, 21 nt, Human
cagcccccauacccugcccag

SEQ ID NO: 57322 - RNA, 22 nt, Human
caggaacucggagcccaucucu

SEQ ID NO: 57323 - RNA, 22 nt, Human
caggaacagcaccaggagcuag

SEQ ID NO: 57324 - RNA, 22 nt, Human
cagcauucuacuuugugaacug

SEQ ID NO: 57325 - RNA, 22 nt, Human
caggaaaauaauggugauggga

SEQ ID NO: 57326 - RNA, 22 nt, Human
cagcuucaugacaaacaguuuu

SEQ ID NO: 57327 - RNA, 22 nt, Human
cagccuuuucuuaaaaugcaag

SEQ ID NO: 57328 - RNA, 22 nt, Human
cagcgguggcaaggugacugug

SEQ ID NO: 57329 - RNA, 22 nt, Human
cagcccuugcgacacccuggcu

SEQ ID NO: 57330 - RNA, 21 nt, Human
cagagcuuuggagacggagga

SEQ ID NO: 57331 - RNA, 22 nt, Human
cagcccugagagaaccaucuau

SEQ ID NO: 57332 - RNA, 22 nt, Human
cagcccuguugcgcuuccggcg

SEQ ID NO: 57333 - RNA, 22 nt, Human
cagccccgcuggccucgccucc

SEQ ID NO: 57334 - RNA, 22 nt, Human
cagacaaauccuuaugagacug

SEQ ID NO: 57335 - RNA, 22 nt, Human
cagcauugagcacagaaggaaa

SEQ ID NO: 57336 - RNA, 22 nt, Human
cagcagccuccccggccgaccu

SEQ ID NO: 57337 - RNA, 22 nt, Human
cagaaauuggcagagaagaccu

SEQ ID NO: 57338 - RNA, 22 nt, Human
cagaaagugauuugcuauucca

SEQ ID NO: 57339 - RNA, 22 nt, Human
cagcacaggugugaggccugau

SEQ ID NO: 57340 - RNA, 22 nt, Human
cacugcugaggcccguguuacu

SEQ ID NO: 57341 - RNA, 22 nt, Human
cagaccuggaaaacaggcuugc

SEQ ID NO: 57342 - RNA, 23 nt, Human
cagagaaaauagaauaugcugug

SEQ ID NO: 57343 - RNA, 22 nt, Human
caccgagagccacuuccggaac

SEQ ID NO: 57344 - RNA, 22 nt, Human
caccagcgacugugaccagcaa

SEQ ID NO: 57345 - RNA, 22 nt, Human
cagacacgucccuguugaccug

SEQ ID NO: 57346 - RNA, 22 nt, Human
cagaccagaaggaagccgacaa

SEQ ID NO: 57347 - RNA, 22 nt, Human
cacaucugaaggcggcucuagg

SEQ ID NO: 57348 - RNA, 22 nt, Human
cacauuucagcacucagggcau

SEQ ID NO: 57349 - RNA, 22 nt, Human
cacauuuuccagaagaaucaga

SEQ ID NO: 57350 - RNA, 22 nt, Human
cagaaagaaguggggauagagg

SEQ ID NO: 57351 - RNA, 22 nt, Human
cacaucaaacuuacuaagauuu

SEQ ID NO: 57352 - RNA, 22 nt, Human
cacagccaagacuuggccccau

SEQ ID NO: 57353 - RNA, 22 nt, Human
cacagcuggggaagcugaggcc

SEQ ID NO: 57354 - RNA, 22 nt, Human
cacugugagugcaagcaggggu

SEQ ID NO: 57355 - RNA, 22 nt, Human
cacuguugagcaauguacagug

SEQ ID NO: 57356 - RNA, 22 nt, Human
cacagaggaugcccaagcgauc

SEQ ID NO: 57357 - RNA, 22 nt, Human
cacugcacuccagccugggcaa

SEQ ID NO: 57358 - RNA, 22 nt, Human
cacuauguacauaauagcugcu

SEQ ID NO: 57359 - RNA, 20 nt, Human
caauguuggcaguauagagc

SEQ ID NO: 57360 - RNA, 22 nt, Human
caaugcacauggacaucaggcu

SEQ ID NO: 57361 - RNA, 22 nt, Human
auuuuuuuaggcugucagccgc

SEQ ID NO: 57362 - RNA, 22 nt, Human
auuuuuaucuaaaauccacuuu

SEQ ID NO: 57363 - RNA, 22 nt, Human
auuuuuauuugccuaugauaua

SEQ ID NO: 57364 - RNA, 22 nt, Human
auuuuauuuugggaucuuuuua

SEQ ID NO: 57365 - RNA, 22 nt, Human
auuuucauauggguuauuugua

SEQ ID NO: 57366 - RNA, 22 nt, Human
auuuucuucauuuugauuguau

SEQ ID NO: 57367 - RNA, 22 nt, Human
auuuugcaguuuauugccaauc

SEQ ID NO: 57368 - RNA, 22 nt, Human
auuuuguugaaacccuuguugu

SEQ ID NO: 57369 - RNA, 22 nt, Human
auuuuuagagugaaagaauuaa

SEQ ID NO: 57370 - RNA, 22 nt, Human
caaaggaauuacauguuucgga

SEQ ID NO: 57371 - RNA, 22 nt, Human
caaaugcaguggucgugcugga

SEQ ID NO: 57372 - RNA, 22 nt, Human
auuuuugugucacaucuaggaa

SEQ ID NO: 57373 - RNA, 22 nt, Human
auuuuuucaugugugguugaga

SEQ ID NO: 57374 - RNA, 22 nt, Human
caagagcgugugcagggcaagu

SEQ ID NO: 57375 - RNA, 21 nt, Human
auuggcagaucucuggauugu

SEQ ID NO: 57376 - RNA, 22 nt, Human
auuugaaguauaaguaauugcu

SEQ ID NO: 57377 - RNA, 22 nt, Human
auuugcaucagugagcgaugug

SEQ ID NO: 57378 - RNA, 23 nt, Human
auuugcugaucguagaugacuag

SEQ ID NO: 57379 - RNA, 22 nt, Human
auuuaucugcucuucgcguuga

SEQ ID NO: 57380 - RNA, 22 nt, Human
auuucccugcagugcuuaggaa

SEQ ID NO: 57381 - RNA, 22 nt, Human
auugcauucaugcuccccuuag

SEQ ID NO: 57382 - RNA, 22 nt, Human
auugaugaaaauaguuauuuua

SEQ ID NO: 57383 - RNA, 22 nt, Human
auugaugccugaaaaauaugua

SEQ ID NO: 57384 - RNA, 22 nt, Human
auugagaaaauucgagcaaguu

SEQ ID NO: 57385 - RNA, 18 nt, Human
auugagcaugacagaccu

SEQ ID NO: 57386 - RNA, 22 nt, Human
auuggcugucagcccggauggg

SEQ ID NO: 57387 - RNA, 22 nt, Human
auugaagcauggagaugaggca

SEQ ID NO: 57388 - RNA, 22 nt, Human
auuguuuccccggaauuauuca

SEQ ID NO: 57389 - RNA, 22 nt, Human
auucugcauuucuaaccagguc

SEQ ID NO: 57390 - RNA, 22 nt, Human
auucugcugccuaguuuaugaa

SEQ ID NO: 57391 - RNA, 21 nt, Human
auucugauguuucuauuguuu

SEQ ID NO: 57392 - RNA, 22 nt, Human
auucugcaauaaucaguccuua

SEQ ID NO: 57393 - RNA, 22 nt, Human
auucucugaugcagguggaaga

SEQ ID NO: 57394 - RNA, 22 nt, Human
auugcaggucguguggaaguga

SEQ ID NO: 57395 - RNA, 22 nt, Human
auuccguuuuaaaaccuuaagc

SEQ ID NO: 57396 - RNA, 16 nt, Human
auucuuccaccauuac

SEQ ID NO: 57397 - RNA, 22 nt, Human
auuccauccuggcuuuuuccug

SEQ ID NO: 57398 - RNA, 22 nt, Human
auucuaugaaugacuguuagau

SEQ ID NO: 57399 - RNA, 22 nt, Human
auguugcugauccuguggcugu

SEQ ID NO: 57400 - RNA, 22 nt, Human
auuccuguggcuggguaaagua

SEQ ID NO: 57401 - RNA, 22 nt, Human
auucgaucacugccgaggaccu

SEQ ID NO: 57402 - RNA, 22 nt, Human
auuaucuauccgccaacaguaa

SEQ ID NO: 57403 - RNA, 22 nt, Human
auuaucugacugaguagucugu

SEQ ID NO: 57404 - RNA, 23 nt, Human
auuaugaagaagacucgccuguu

SEQ ID NO: 57405 - RNA, 22 nt, Human
auucuccucaaaacaucugcug

SEQ ID NO: 57406 - RNA, 22 nt, Human
auucguguauauacacauccac

SEQ ID NO: 57407 - RNA, 22 nt, Human
auucaagauagaaggauuuuca

SEQ ID NO: 57408 - RNA, 22 nt, Human
auucaggacucuuccuugaaga

SEQ ID NO: 57409 - RNA, 22 nt, Human
auucaucuguacuucaauaucu

SEQ ID NO: 57410 - RNA, 22 nt, Human
auucauauagcgcuuacagccu

SEQ ID NO: 57411 - RNA, 22 nt, Human
augugccuuaauauaggcgcug

SEQ ID NO: 57412 - RNA, 19 nt, Human
auguuuccauuucuggaua

SEQ ID NO: 57413 - RNA, 22 nt, Human
auguuuucuugucuggagaagu

SEQ ID NO: 57414 - RNA, 22 nt, Human
auguuuuuugaaaauguauuuu

SEQ ID NO: 57415 - RNA, 20 nt, Human
augugcuaauauuaauaugu

SEQ ID NO: 57416 - RNA, 22 nt, Human
augggggccagggacccuggca

SEQ ID NO: 57417 - RNA, 19 nt, Human
augguauugcuggguuuuu

SEQ ID NO: 57418 - RNA, 22 nt, Human
augggcggugcauuugcacagu

SEQ ID NO: 57419 - RNA, 22 nt, Human
augggcauacaaaugcuacccu

SEQ ID NO: 57420 - RNA, 22 nt, Human
auguaacauaugugaucgcauu

SEQ ID NO: 57421 - RNA, 22 nt, Human
auggggaauugaccguggaucu

SEQ ID NO: 57422 - RNA, 22 nt, Human
auggugugugugugugugugug

SEQ ID NO: 57423 - RNA, 22 nt, Human
auggcagcggagcuggaaauga

SEQ ID NO: 57424 - RNA, 22 nt, Human
augggaauggauugagugggug

SEQ ID NO: 57425 - RNA, 19 nt, Human
augggaagcggccagcgga

SEQ ID NO: 57426 - RNA, 22 nt, Human
auggauggaagcagccugaacu

SEQ ID NO: 57427 - RNA, 22 nt, Human
auggaggaugugcagcaugggc

SEQ ID NO: 57428 - RNA, 22 nt, Human
auggagggguuguugcuugagu

SEQ ID NO: 57429 - RNA, 22 nt, Human
auggagugggaggacaugaagg

SEQ ID NO: 57430 - RNA, 22 nt, Human
auggaguguggccaggcaguaa

SEQ ID NO: 57431 - RNA, 18 nt, Human
augggggaggaggaaagg

SEQ ID NO: 57432 - RNA, 22 nt, Human
auggggaucugcaguguugauc

SEQ ID NO: 57433 - RNA, 22 nt, Human
auggccguggccagggucaggg

SEQ ID NO: 57434 - RNA, 22 nt, Human
auggauuggguugauggcauac

SEQ ID NO: 57435 - RNA, 20 nt, Human
auggaaacacgcagccccaa

SEQ ID NO: 57436 - RNA, 22 nt, Human
auggaacauuaaucuucaaaug

SEQ ID NO: 57437 - RNA, 22 nt, Human
auggaacccgggcgucugcucu

SEQ ID NO: 57438 - RNA, 22 nt, Human
augggcauggauggccgagucu

SEQ ID NO: 57439 - RNA, 22 nt, Human
auggagcgggaggauggaggag

SEQ ID NO: 57440 - RNA, 22 nt, Human
auggagcagagcugaugggccu

SEQ ID NO: 57441 - RNA, 22 nt, Human
auggacguuuguguauuaugua

SEQ ID NO: 57442 - RNA, 22 nt, Human
auggaauuuaaauuuugguguc

SEQ ID NO: 57443 - RNA, 22 nt, Human
auggaagagacaaugcuaucug

SEQ ID NO: 57444 - RNA, 22 nt, Human
augcccugggagugcuguacca

SEQ ID NO: 57445 - RNA, 14 nt, Human
augauuucugggaa

SEQ ID NO: 57446 - RNA, 22 nt, Human
augcaugaucccgguaugugaa

SEQ ID NO: 57447 - RNA, 22 nt, Human
augcccagaacccccuggaugg

SEQ ID NO: 57448 - RNA, 19 nt, Human
augcacgugaaaugcauuu

SEQ ID NO: 57449 - RNA, 22 nt, Human
augaggagucaaggagucggag

SEQ ID NO: 57450 - RNA, 22 nt, Human
augaaaacggaccagagcuauu

SEQ ID NO: 57451 - RNA, 22 nt, Human
aucuuguuagaaggcaguaggu

SEQ ID NO: 57452 - RNA, 22 nt, Human
augaggccacaguuauagauuu

SEQ ID NO: 57453 - RNA, 22 nt, Human
augacagcucuagcacacagua

SEQ ID NO: 57454 - RNA, 22 nt, Human
aucuguggguaaggauaagcau

SEQ ID NO: 57455 - RNA, 22 nt, Human
augacagcuaaggaauguguag

SEQ ID NO: 57456 - RNA, 22 nt, Human
aucuguuccccuaugcucucua

SEQ ID NO: 57457 - RNA, 22 nt, Human
aucuuggccuucuccuggagug

SEQ ID NO: 57458 - RNA, 22 nt, Human
aucuuggauccuuugccagcuu

SEQ ID NO: 57459 - RNA, 19 nt, Human
aucuuucagcagcuccccu

SEQ ID NO: 57460 - RNA, 22 nt, Human
aucuuugccuuuaugccucuag

SEQ ID NO: 57461 - RNA, 22 nt, Human
aucuccagcagugcuuuugagc

SEQ ID NO: 57462 - RNA, 22 nt, Human
aucguggcacgucgccgcagcg

SEQ ID NO: 57463 - RNA, 22 nt, Human
aucguuaugauagagaaagaga

SEQ ID NO: 57464 - RNA, 22 nt, Human
aucggucuccuauaauucaaac

SEQ ID NO: 57465 - RNA, 23 nt, Human
aucgcccggguccagucccggcu

SEQ ID NO: 57466 - RNA, 23 nt, Human
aucugagccuggucccacccgcu

SEQ ID NO: 57467 - RNA, 22 nt, Human
aucuggaacuucucugcauuga

SEQ ID NO: 57468 - RNA, 22 nt, Human
aucugcuguaguuggugccagu

SEQ ID NO: 57469 - RNA, 20 nt, Human
aucugguggggaauaacuuc

SEQ ID NO: 57470 - RNA, 22 nt, Human
aucugugauuuuggcaagauuu

SEQ ID NO: 57471 - RNA, 22 nt, Human
aucugugguacaugacggcugc

SEQ ID NO: 57472 - RNA, 18 nt, Human
auccuuugaucaucuguc

SEQ ID NO: 57473 - RNA, 22 nt, Human
aucugcugccuaggguuugucu

SEQ ID NO: 57474 - RNA, 22 nt, Human
uuugcuguccaauauucagggu

SEQ ID NO: 57475 - RNA, 22 nt, Human
uuuggcugucauuugaaaaugu

SEQ ID NO: 57476 - RNA, 18 nt, Human
uuugggauccucuuuucu

SEQ ID NO: 57477 - RNA, 22 nt, Human
uuugggcauuuuuaaggaucuu

SEQ ID NO: 57478 - RNA, 19 nt, Human
uuugguaggcuugagggaa

SEQ ID NO: 57479 - RNA, 22 nt, Human
uuugucauuuagcccauggugg

SEQ ID NO: 57480 - RNA, 22 nt, Human
uuugccccacaggcagcuuugg

SEQ ID NO: 57481 - RNA, 22 nt, Human
uuugcugaaaaaccacuugagu

SEQ ID NO: 57482 - RNA, 22 nt, Human
uuugcauuugagagaggaaaca

SEQ ID NO: 57483 - RNA, 22 nt, Human
uuugccggaucugucuccagcu

SEQ ID NO: 57484 - RNA, 22 nt, Human
uuugcauuaguuuagauuucaa

SEQ ID NO: 57485 - RNA, 22 nt, Human
uuugaugagaaaugacuuaagu

SEQ ID NO: 57486 - RNA, 22 nt, Human
uuugaugauuuucuagagugua

SEQ ID NO: 57487 - RNA, 22 nt, Human
uuucuggauaagcagggucucu

SEQ ID NO: 57488 - RNA, 19 nt, Human
uuucucacugagucguuug

SEQ ID NO: 57489 - RNA, 22 nt, Human
uuucucagcauauugccuuuga

SEQ ID NO: 57490 - RNA, 22 nt, Human
uuucucagccuccuugcuggag

SEQ ID NO: 57491 - RNA, 22 nt, Human
uuucuguuuguaacuccagcaa

SEQ ID NO: 57492 - RNA, 22 nt, Human
uuucuugggaaaugucagaagu

SEQ ID NO: 57493 - RNA, 22 nt, Human
uuucuuuuucuacaccuuagcu

SEQ ID NO: 57494 - RNA, 22 nt, Human
uuugaaaggagcuuuauccaga

SEQ ID NO: 57495 - RNA, 22 nt, Human
uuucagugaaugaauggcuaac

SEQ ID NO: 57496 - RNA, 22 nt, Human
uuucauagaggcagcggcggau

SEQ ID NO: 57497 - RNA, 22 nt, Human
uuucaucccugucagugaaggc

SEQ ID NO: 57498 - RNA, 22 nt, Human
uuucauguuggauacuguuuca

SEQ ID NO: 57499 - RNA, 22 nt, Human
uuuccacacucacugcacucau

SEQ ID NO: 57500 - RNA, 22 nt, Human
uuucgggauuucaaagagcaaa

SEQ ID NO: 57501 - RNA, 22 nt, Human
uuguugcuguugaacccugcug

SEQ ID NO: 57502 - RNA, 22 nt, Human
uuuauuuggugguguuacuguu

SEQ ID NO: 57503 - RNA, 22 nt, Human
uugugcagugccuggacccagg

SEQ ID NO: 57504 - RNA, 22 nt, Human
uugucaagauauuuuaggaggc

SEQ ID NO: 57505 - RNA, 22 nt, Human
uugucaguggccugaggacaga

SEQ ID NO: 57506 - RNA, 22 nt, Human
uugguugcugaugagcuuugag

SEQ ID NO: 57507 - RNA, 22 nt, Human
uugggagaaauaguugauccgc

SEQ ID NO: 57508 - RNA, 22 nt, Human
uuggccuuacgcauggucggca

SEQ ID NO: 57509 - RNA, 22 nt, Human
uuggaggccacagucaucuuua

SEQ ID NO: 57510 - RNA, 22 nt, Human
uugauuuccauuguccagcauu

SEQ ID NO: 57511 - RNA, 22 nt, Human
uugaccauguggcccaggccaa

SEQ ID NO: 57512 - RNA, 22 nt, Human
uuuuuugucuugaagaaauggu

SEQ ID NO: 57513 - RNA, 22 nt, Human
uugaaaucuucccuccugucug

SEQ ID NO: 57514 - RNA, 22 nt, Human
uuuuuuccugguuacagauugu

SEQ ID NO: 57515 - RNA, 22 nt, Human
uucuuccagugaaacgugcauc

SEQ ID NO: 57516 - RNA, 22 nt, Human
uucuucuguuggcagagcauac

SEQ ID NO: 57517 - RNA, 22 nt, Human
uucuugcgaaagaaugagcuga

SEQ ID NO: 57518 - RNA, 22 nt, Human
uucuugcuuccggugcuccagg

SEQ ID NO: 57519 - RNA, 22 nt, Human
uucuugcuucucugucugccuc

SEQ ID NO: 57520 - RNA, 22 nt, Human
uuuuguggacugugagggugca

SEQ ID NO: 57521 - RNA, 22 nt, Human
uucuuguccacagaagagcuca

SEQ ID NO: 57522 - RNA, 22 nt, Human
uucuugucuuuguuauguagga

SEQ ID NO: 57523 - RNA, 22 nt, Human
uucuuugcucaccugccgcucc

SEQ ID NO: 57524 - RNA, 21 nt, Human
uucuuugcugcuguuuuugua

SEQ ID NO: 57525 - RNA, 22 nt, Human
uucuuuguccuagcauucuaca

SEQ ID NO: 57526 - RNA, 22 nt, Human
uuuuugcuuuuuugucaucuaa

SEQ ID NO: 57527 - RNA, 22 nt, Human
uucuuuucuucccuguuuauua

SEQ ID NO: 57528 - RNA, 22 nt, Human
uuuugagucuggcaguuuuguu

SEQ ID NO: 57529 - RNA, 22 nt, Human
uuuucggagaauguuaaugugu

SEQ ID NO: 57530 - RNA, 22 nt, Human
uucugagccacaguaaggaucu

SEQ ID NO: 57531 - RNA, 22 nt, Human
uuuucugauccuucuaacuuga

SEQ ID NO: 57532 - RNA, 22 nt, Human
uuuucaguuccaucucugcucu

SEQ ID NO: 57533 - RNA, 22 nt, Human
uucuagacaauugaaaacuguu

SEQ ID NO: 57534 - RNA, 23 nt, Human
uuuuccaaaucgacucucuaguu

SEQ ID NO: 57535 - RNA, 22 nt, Human
uucgucauuaugcagccuguga

SEQ ID NO: 57536 - RNA, 22 nt, Human
uucgucaauaugcagccuguga

SEQ ID NO: 57537 - RNA, 22 nt, Human
uucggcagaaagucauuugucu

SEQ ID NO: 57538 - RNA, 22 nt, Human
uuccugcuggucaaaguugccu

SEQ ID NO: 57539 - RNA, 22 nt, Human
uuuguuugcuaguauuuuguuu

SEQ ID NO: 57540 - RNA, 17 nt, Human
uuuguuucauacuucau

SEQ ID NO: 57541 - RNA, 21 nt, Human
uucgaaugggucguugcugcc

SEQ ID NO: 57542 - RNA, 22 nt, Human
uucgcggccaggcggggaggcc

SEQ ID NO: 57543 - RNA, 22 nt, Human
uuuguguuggaagaaaugcuac

SEQ ID NO: 57544 - RNA, 22 nt, Human
uucccagggaucucuaguauuu

SEQ ID NO: 57545 - RNA, 21 nt, Human
uuccauggacccugucagugu

SEQ ID NO: 57546 - RNA, 21 nt, Human
uuuguucacacacagggcagc

SEQ ID NO: 57547 - RNA, 22 nt, Human
uucccggccgccccccgcucgg

SEQ ID NO: 57548 - RNA, 23 nt, Human
uuuguugguuuaagaguagcaga

SEQ ID NO: 57549 - RNA, 19 nt, Human
uuuguuguaucagagcuuu

SEQ ID NO: 57550 - RNA, 22 nt, Human
uucccuauaauauggcucuucu

SEQ ID NO: 57551 - RNA, 22 nt, Human
uuuguuguauuaacccagggua

SEQ ID NO: 57552 - RNA, 20 nt, Human
uucaggaccuuccaguccau

SEQ ID NO: 57553 - RNA, 22 nt, Human
uucaucauuuuccauuccucuu

SEQ ID NO: 57554 - RNA, 22 nt, Human
uucauccucuaguacugaagug

SEQ ID NO: 57555 - RNA, 22 nt, Human
uuugcuguaaugcaugucagag

SEQ ID NO: 57556 - RNA, 22 nt, Human
uuugccaucagaugugguaggu

SEQ ID NO: 57557 - RNA, 20 nt, Human
uucacagaucucuaacugag

SEQ ID NO: 57558 - RNA, 22 nt, Human
uucaaccuucagcuugaguugg

SEQ ID NO: 57559 - RNA, 22 nt, Human
uuguuuucuaguguuuugaaua

SEQ ID NO: 57560 - RNA, 22 nt, Human
uuguuuucuugaugaaauuauu

SEQ ID NO: 57561 - RNA, 22 nt, Human
uuguugcaagccuggaaucugg

SEQ ID NO: 57562 - RNA, 22 nt, Human
uuguuucauggggacgacuggc

SEQ ID NO: 57563 - RNA, 22 nt, Human
uuguuccuuucuucuguagucg

SEQ ID NO: 57564 - RNA, 22 nt, Human
uuaagggauugagauggaauga

SEQ ID NO: 57565 - RNA, 22 nt, Human
uuuaccugucuguagaacauaa

SEQ ID NO: 57566 - RNA, 22 nt, Human
uugugcauuugcuaugggccau

SEQ ID NO: 57567 - RNA, 22 nt, Human
uguuuuuuagagugauacuuuu

SEQ ID NO: 57568 - RNA, 22 nt, Human
uguuuuuucccccccuucuaaa

SEQ ID NO: 57569 - RNA, 21 nt, Human
uugugaaaguccaggaacaac

SEQ ID NO: 57570 - RNA, 22 nt, Human
uugucucuacagagaguaguag

SEQ ID NO: 57571 - RNA, 22 nt, Human
uguuuucuuuccccuucuuuuc

SEQ ID NO: 57572 - RNA, 21 nt, Human
uguuuuguaauagauacuaug

SEQ ID NO: 57573 - RNA, 22 nt, Human
uugggucaugggaucccagcau

SEQ ID NO: 57574 - RNA, 22 nt, Human
uuguauuaauacacuccuuuuc

SEQ ID NO: 57575 - RNA, 22 nt, Human
uguuccuggggaccugccuucc

SEQ ID NO: 57576 - RNA, 20 nt, Human
uuggggacaggagugugaug

SEQ ID NO: 57577 - RNA, 22 nt, Human
uuggcuguguugaaaacgugga

SEQ ID NO: 57578 - RNA, 22 nt, Human
uuggcguuuccuguucugggug

SEQ ID NO: 57579 - RNA, 22 nt, Human
uuggcaggcugcauguuuaugu

SEQ ID NO: 57580 - RNA, 22 nt, Human
uguguuucggauagcagauucu

SEQ ID NO: 57581 - RNA, 22 nt, Human
uuggcaaaaauacuguaggccu

SEQ ID NO: 57582 - RNA, 22 nt, Human
uuggcacagagcugcagccugg

SEQ ID NO: 57583 - RNA, 22 nt, Human
uuggcaaagagaugcauaagga

SEQ ID NO: 57584 - RNA, 20 nt, Human
uugcggccuaacagccccuu

SEQ ID NO: 57585 - RNA, 22 nt, Human
uuggaagacagccgucuuuauu

SEQ ID NO: 57586 - RNA, 22 nt, Human
uuggaagagagauggggagaga

SEQ ID NO: 57587 - RNA, 22 nt, Human
uuggauugugaaaguauucucu

SEQ ID NO: 57588 - RNA, 22 nt, Human
uugcccuaccccaggccuuuuu

SEQ ID NO: 57589 - RNA, 22 nt, Human
ugugccuguugguguagacaua

SEQ ID NO: 57590 - RNA, 22 nt, Human
uugccuacaaacgaaucuaucu

SEQ ID NO: 57591 - RNA, 23 nt, Human
uugcauuaauguggaggcacagg

SEQ ID NO: 57592 - RNA, 22 nt, Human
ugucuucauuccccaugaaguc

SEQ ID NO: 57593 - RNA, 20 nt, Human
uugcaaagugaauagcaauu

SEQ ID NO: 57594 - RNA, 22 nt, Human
ugucugucugccauuuauucuc

SEQ ID NO: 57595 - RNA, 21 nt, Human
ugucugcaauuccagggaacc

SEQ ID NO: 57596 - RNA, 22 nt, Human
uugaggcugaucacuccuauaa

SEQ ID NO: 57597 - RNA, 21 nt, Human
uugaaguggguagcuggcggg

SEQ ID NO: 57598 - RNA, 22 nt, Human
uugaauaaggcauaaagauacu

SEQ ID NO: 57599 - RNA, 22 nt, Human
uugaaucauauguaauugacuu

SEQ ID NO: 57600 - RNA, 22 nt, Human
uucuuggcacagaugagauucu

SEQ ID NO: 57601 - RNA, 22 nt, Human
uucuugagaacaaauuccugga

SEQ ID NO: 57602 - RNA, 22 nt, Human
uggugcuuuuguggaugcuaac

SEQ ID NO: 57603 - RNA, 22 nt, Human
uggugcucuugauauauaaggc

SEQ ID NO: 57604 - RNA, 22 nt, Human
uucuguuuuuauucuaucucug

SEQ ID NO: 57605 - RNA, 22 nt, Human
uggugccuuccgagagcuguga

SEQ ID NO: 57606 - RNA, 22 nt, Human
uggucugggaagaucacaauua

SEQ ID NO: 57607 - RNA, 22 nt, Human
ugguucugucugugcugggggg

SEQ ID NO: 57608 - RNA, 22 nt, Human
ugguugauuaauuuugccaagc

SEQ ID NO: 57609 - RNA, 22 nt, Human
ugguugagguugacucuauaua

SEQ ID NO: 57610 - RNA, 22 nt, Human
ugguugcaguggugcuuauaca

SEQ ID NO: 57611 - RNA, 22 nt, Human
uugaaaaaauguguuuaaggag

SEQ ID NO: 57612 - RNA, 22 nt, Human
uugaaaacugucaccuuuauuc

SEQ ID NO: 57613 - RNA, 22 nt, Human
uugaaagucuaagaauagguau

SEQ ID NO: 57614 - RNA, 22 nt, Human
uugaagccaccacuguaaguca

SEQ ID NO: 57615 - RNA, 22 nt, Human
uggucacgucgggguauugcca

SEQ ID NO: 57616 - RNA, 22 nt, Human
uucuggugauuugccucuuuag

SEQ ID NO: 57617 - RNA, 22 nt, Human
uucuggagucuauuuugaaaag

SEQ ID NO: 57618 - RNA, 23 nt, Human
uggguuucagugccaaugcugcc

SEQ ID NO: 57619 - RNA, 22 nt, Human
uggguucaaauccugguuccac

SEQ ID NO: 57620 - RNA, 22 nt, Human
uucuccucagcaaggcagcuuu

SEQ ID NO: 57621 - RNA, 22 nt, Human
uggggcgcaggcccagcgggcu

SEQ ID NO: 57622 - RNA, 18 nt, Human
uucgucauggggaucgua

SEQ ID NO: 57623 - RNA, 22 nt, Human
uucgcucuucacacagugcuga

SEQ ID NO: 57624 - RNA, 22 nt, Human
uggggccaggcuguuggcuucc

SEQ ID NO: 57625 - RNA, 22 nt, Human
uuccuucccccuucuuugccuu

SEQ ID NO: 57626 - RNA, 21 nt, Human
uuccuggaggcagaaacguga

SEQ ID NO: 57627 - RNA, 22 nt, Human
uuccgcuuucaauggcuuggcu

SEQ ID NO: 57628 - RNA, 20 nt, Human
uuccucaaaagucugaugcu

SEQ ID NO: 57629 - RNA, 22 nt, Human
uuccucauucuggggcauguug

SEQ ID NO: 57630 - RNA, 22 nt, Human
uuccugacacuggcaggcuucu

SEQ ID NO: 57631 - RNA, 22 nt, Human
uggcugaugucuguucuguuau

SEQ ID NO: 57632 - RNA, 22 nt, Human
uuccauggggcuguugcgcaga

SEQ ID NO: 57633 - RNA, 22 nt, Human
uggcuuuuuauuccuaugugau

SEQ ID NO: 57634 - RNA, 22 nt, Human
uggcuuuuuucuccccuuggau

SEQ ID NO: 57635 - RNA, 22 nt, Human
uuccaugccccucuuuggguac

SEQ ID NO: 57636 - RNA, 22 nt, Human
uuccaugccuaagagccugaag

SEQ ID NO: 57637 - RNA, 22 nt, Human
uucauuuuauauuagagcuguu

SEQ ID NO: 57638 - RNA, 22 nt, Human
uggagcugaaguacucucacua

SEQ ID NO: 57639 - RNA, 22 nt, Human
uggagcaagaagggaggcagaa

SEQ ID NO: 57640 - RNA, 22 nt, Human
uggaaugccgggccaggcuccg

SEQ ID NO: 57641 - RNA, 21 nt, Human
uggaauuggaaaccauucuau

SEQ ID NO: 57642 - RNA, 22 nt, Human
uggaagugggcaucaccaucca

SEQ ID NO: 57643 - RNA, 22 nt, Human
uggaagugucagcaggcugguu

SEQ ID NO: 57644 - RNA, 23 nt, Human
uggaaguugagagucugcuuugu

SEQ ID NO: 57645 - RNA, 22 nt, Human
uggaaggggccaggcgcggagu

SEQ ID NO: 57646 - RNA, 22 nt, Human
uggaaggggagcuggaaagggg

SEQ ID NO: 57647 - RNA, 22 nt, Human
uggaagaaaugguugagccaug

SEQ ID NO: 57648 - RNA, 22 nt, Human
uggaagaucugguguagcuccu

SEQ ID NO: 57649 - RNA, 22 nt, Human
uggaagaagcuacaagcgguga

SEQ ID NO: 57650 - RNA, 22 nt, Human
uuagcgcucucuccauucuuaa

SEQ ID NO: 57651 - RNA, 22 nt, Human
uggaagaaaacuuggaaggcau

SEQ ID NO: 57652 - RNA, 22 nt, Human
uggaacuagugucugagauggg

SEQ ID NO: 57653 - RNA, 22 nt, Human
uggaacugauuaaaagggcaga

SEQ ID NO: 57654 - RNA, 22 nt, Human
uggaaauaguugugagucaggc

SEQ ID NO: 57655 - RNA, 22 nt, Human
uggaaagcagcccugcucccca

SEQ ID NO: 57656 - RNA, 22 nt, Human
uggaaagaagacugugguugag

SEQ ID NO: 57657 - RNA, 22 nt, Human
uggaaauacaagaaguauguca

SEQ ID NO: 57658 - RNA, 22 nt, Human
ugcuuuuguaucagaguauuca

SEQ ID NO: 57659 - RNA, 22 nt, Human
ugcuuuggcccaacauugaugc

SEQ ID NO: 57660 - RNA, 22 nt, Human
ugcuuuauucgacaucugguag

SEQ ID NO: 57661 - RNA, 22 nt, Human
ugcuuucaaaacucagaggaau

SEQ ID NO: 57662 - RNA, 22 nt, Human
ugcuuuccuucccuauguugag

SEQ ID NO: 57663 - RNA, 22 nt, Human
uuacaacgcacacagauuucac

SEQ ID NO: 57664 - RNA, 22 nt, Human
ugcuggugauuaaauccugaag

SEQ ID NO: 57665 - RNA, 22 nt, Human
ugcuggagucucuugacccugg

SEQ ID NO: 57666 - RNA, 22 nt, Human
ugcuggaguggcacuguguggc

SEQ ID NO: 57667 - RNA, 23 nt, Human
ugcugcuggaguaucuacaaugc

SEQ ID NO: 57668 - RNA, 23 nt, Human
ugcugcgggacccgagcgcgcgc

SEQ ID NO: 57669 - RNA, 22 nt, Human
ugcugcggcgcaggcacuccag

SEQ ID NO: 57670 - RNA, 22 nt, Human
uuaaaucaggcaucauuucagu

SEQ ID NO: 57671 - RNA, 22 nt, Human
ugcuggaaggguaguauuaacu

SEQ ID NO: 57672 - RNA, 22 nt, Human
uguuuguaugauggcacaucca

SEQ ID NO: 57673 - RNA, 22 nt, Human
uguuuucuauuaccugagauug

SEQ ID NO: 57674 - RNA, 22 nt, Human
uguuuuucaagcauuuauuaau

SEQ ID NO: 57675 - RNA, 19 nt, Human
ugcugcaggaauucucaag

SEQ ID NO: 57676 - RNA, 22 nt, Human
ugcugcacuuauggcucugagg

SEQ ID NO: 57677 - RNA, 22 nt, Human
uguuucguugguggagagcuac

SEQ ID NO: 57678 - RNA, 22 nt, Human
ugcugcacucacaggaagaguu

SEQ ID NO: 57679 - RNA, 22 nt, Human
ugcuccugaacacagcccuaug

SEQ ID NO: 57680 - RNA, 22 nt, Human
uguuguuguuguuguuguuguu

SEQ ID NO: 57681 - RNA, 22 nt, Human
uguuuaaauagaacauacugca

SEQ ID NO: 57682 - RNA, 22 nt, Human
uguuguucuuuuucuucuuguu

SEQ ID NO: 57683 - RNA, 22 nt, Human
uguuguagacaguucacucgug

SEQ ID NO: 57684 - RNA, 22 nt, Human
uguugguuucaagcaggagccu

SEQ ID NO: 57685 - RNA, 22 nt, Human
ugcucuguucaguguaucuugu

SEQ ID NO: 57686 - RNA, 22 nt, Human
ugcucgauuauuucauuuugca

SEQ ID NO: 57687 - RNA, 23 nt, Human
ugcucgccuucaggacuugggcu

SEQ ID NO: 57688 - RNA, 22 nt, Human
ugccugucuaucuuugucaucu

SEQ ID NO: 57689 - RNA, 21 nt, Human
ugccuggccuuugcuuuuccu

SEQ ID NO: 57690 - RNA, 22 nt, Human
ugugucuuuggcgaugucugga

SEQ ID NO: 57691 - RNA, 19 nt, Human
ugccggccgcgggguuccu

SEQ ID NO: 57692 - RNA, 22 nt, Human
ugccgccccggggcccccagcc

SEQ ID NO: 57693 - RNA, 22 nt, Human
ugcccugucccuagguuugugg

SEQ ID NO: 57694 - RNA, 22 nt, Human
ugcccugaagcugucaauuuug

SEQ ID NO: 57695 - RNA, 22 nt, Human
ugccccuagaggcguugcagcu

SEQ ID NO: 57696 - RNA, 23 nt, Human
ugccaggaagaaugaccucugcu

SEQ ID NO: 57697 - RNA, 22 nt, Human
ugccaauuaccuauuucugaga

SEQ ID NO: 57698 - RNA, 20 nt, Human
ugccagagagcucauacccu

SEQ ID NO: 57699 - RNA, 22 nt, Human
ugccagcuccgaggagcugcag

SEQ ID NO: 57700 - RNA, 22 nt, Human
ugcauguuauuguggcaagaau

SEQ ID NO: 57701 - RNA, 17 nt, Human
ugcaugcgucugugaua

SEQ ID NO: 57702 - RNA, 22 nt, Human
ugcaugcagcuggucgggcgcc

SEQ ID NO: 57703 - RNA, 22 nt, Human
ugcaucccaaacaugguuuccu

SEQ ID NO: 57704 - RNA, 22 nt, Human
ugcaucugagcacuacggugga

SEQ ID NO: 57705 - RNA, 22 nt, Human
ugugcugcagcgagagcuacga

SEQ ID NO: 57706 - RNA, 22 nt, Human
ugugcuugucguggagccaggc

SEQ ID NO: 57707 - RNA, 22 nt, Human
ugcaggaagcucagcggggccg

SEQ ID NO: 57708 - RNA, 22 nt, Human
ugugcagaaaacacuuaagaac

SEQ ID NO: 57709 - RNA, 22 nt, Human
ugcagcuuuugguuucuagaug

SEQ ID NO: 57710 - RNA, 22 nt, Human
ugugauuucaaagggugucuuu

SEQ ID NO: 57711 - RNA, 22 nt, Human
ugcagcgugaggacagcugagc

SEQ ID NO: 57712 - RNA, 22 nt, Human
ugcagccuuuguccuugggcua

SEQ ID NO: 57713 - RNA, 20 nt, Human
ugcagcucccccgcaguuuc

SEQ ID NO: 57714 - RNA, 22 nt, Human
ugcagcagaauauggcugcagg

SEQ ID NO: 57715 - RNA, 22 nt, Human
ugcagcaucuccuugugccaug

SEQ ID NO: 57716 - RNA, 22 nt, Human
ugcagccucacgcauccgcauu

SEQ ID NO: 57717 - RNA, 22 nt, Human
ugugaagaauuaaugugaauca

SEQ ID NO: 57718 - RNA, 19 nt, Human
ugugaagaccucagugcgg

SEQ ID NO: 57719 - RNA, 22 nt, Human
ugugaagcgugugcaggggaca

SEQ ID NO: 57720 - RNA, 22 nt, Human
ugugaaugacuuuguucuuugc

SEQ ID NO: 57721 - RNA, 19 nt, Human
ugcagcacuaaaaacuuuc

SEQ ID NO: 57722 - RNA, 22 nt, Human
ugucuuucuuucucuugacaga

SEQ ID NO: 57723 - RNA, 22 nt, Human
ugcacagagggaggcauaaaau

SEQ ID NO: 57724 - RNA, 23 nt, Human
ugcaaugcagcuagauguaaaau

SEQ ID NO: 57725 - RNA, 21 nt, Human
ugcaaugcauugacagcagca

SEQ ID NO: 57726 - RNA, 22 nt, Human
ugucugaauuguaauguugcgu

SEQ ID NO: 57727 - RNA, 22 nt, Human
ugcaagugccauggauucaggu

SEQ ID NO: 57728 - RNA, 22 nt, Human
ugucaucuuggugcugugagag

SEQ ID NO: 57729 - RNA, 22 nt, Human
ugucacggccggguggcaccga

SEQ ID NO: 57730 - RNA, 22 nt, Human
ugauaugguaauaagauauucu

SEQ ID NO: 57731 - RNA, 23 nt, Human
ugguuuucagaagaccuuguuag

SEQ ID NO: 57732 - RNA, 22 nt, Human
ugguuuuuuguaggauaaacau

SEQ ID NO: 57733 - RNA, 22 nt, Human
ugguggccucaguggcuucugu

SEQ ID NO: 57734 - RNA, 22 nt, Human
ugguggcuuuucguagguucac

SEQ ID NO: 57735 - RNA, 22 nt, Human
ugaggaggugcuaccagcgucu

SEQ ID NO: 57736 - RNA, 22 nt, Human
ugagggagggggagccguucua

SEQ ID NO: 57737 - RNA, 19 nt, Human
uggugcgcuguuccugagc

SEQ ID NO: 57738 - RNA, 22 nt, Human
uggugcucucgauauauaaggc

SEQ ID NO: 57739 - RNA, 22 nt, Human
uggucucuacggaggaaagcug

SEQ ID NO: 57740 - RNA, 22 nt, Human
ugagcagagcacuugggaacga

SEQ ID NO: 57741 - RNA, 22 nt, Human
ugguccgagaacuguccugguu

SEQ ID NO: 57742 - RNA, 22 nt, Human
ugagauuuagaacuggauuuca

SEQ ID NO: 57743 - RNA, 22 nt, Human
ugguccaugcuccaggcacauu

SEQ ID NO: 57744 - RNA, 22 nt, Human
ugguaugaaggaggccggcagc

SEQ ID NO: 57745 - RNA, 22 nt, Human
uggucacagauuuacaggaaug

SEQ ID NO: 57746 - RNA, 22 nt, Human
ugagacuugaacuccagugcca

SEQ ID NO: 57747 - RNA, 20 nt, Human
uggguucaguuguuucuggc

SEQ ID NO: 57748 - RNA, 22 nt, Human
ugagaaauauacaccagacaca

SEQ ID NO: 57749 - RNA, 22 nt, Human
ugguaaaguguacugaauauga

SEQ ID NO: 57750 - RNA, 22 nt, Human
ugacuuuucuccucugaaguuu

SEQ ID NO: 57751 - RNA, 22 nt, Human
ugggugugggguaggguaagag

SEQ ID NO: 57752 - RNA, 22 nt, Human
uggguguuccuggggugcaagg

SEQ ID NO: 57753 - RNA, 22 nt, Human
ugaaagccuacagcucacuguu

SEQ ID NO: 57754 - RNA, 22 nt, Human
ucuuuuucccugguuccuuuuu

SEQ ID NO: 57755 - RNA, 22 nt, Human
uggcgugaagcuggaaggcgga

SEQ ID NO: 57756 - RNA, 22 nt, Human
uggcgcucacccugcggcccug

SEQ ID NO: 57757 - RNA, 22 nt, Human
uggcgcgcagccugcuggugcu

SEQ ID NO: 57758 - RNA, 22 nt, Human
uggccgaugagcaugcgcugau

SEQ ID NO: 57759 - RNA, 23 nt, Human
uggccguccccugacucucuggc

SEQ ID NO: 57760 - RNA, 22 nt, Human
uggccaaauuggccugauguau

SEQ ID NO: 57761 - RNA, 21 nt, Human
uggccaaggaauagaagcucu

SEQ ID NO: 57762 - RNA, 22 nt, Human
ucuugccuuuucuagcuucuag

SEQ ID NO: 57763 - RNA, 22 nt, Human
uggcaucacagacaaggcagca

SEQ ID NO: 57764 - RNA, 18 nt, Human
uggcaaugccaaaggcuu

SEQ ID NO: 57765 - RNA, 22 nt, Human
ucuuccucuccuggggcauuug

SEQ ID NO: 57766 - RNA, 22 nt, Human
uggcagugggaagcuggaaguc

SEQ ID NO: 57767 - RNA, 19 nt, Human
ucuuccaucuauccuccuc

SEQ ID NO: 57768 - RNA, 22 nt, Human
ucuuccacuugaaccuucuguc

SEQ ID NO: 57769 - RNA, 22 nt, Human
uggcaagcuguuggcagauagc

SEQ ID NO: 57770 - RNA, 22 nt, Human
ucuucaaauacagucauauuga

SEQ ID NO: 57771 - RNA, 22 nt, Human
ucuucacugaagcuuugcaucu

SEQ ID NO: 57772 - RNA, 22 nt, Human
ucugugcuccuuccuugucauc

SEQ ID NO: 57773 - RNA, 22 nt, Human
uggagaaauaacauuuggauuc

SEQ ID NO: 57774 - RNA, 22 nt, Human
ucuguucagaagaggugaaagu

SEQ ID NO: 57775 - RNA, 22 nt, Human
uggauauuuuguaugugcguuu

SEQ ID NO: 57776 - RNA, 22 nt, Human
ucuggugcacucugauauuuga

SEQ ID NO: 57777 - RNA, 22 nt, Human
uggaagggguuacgcagcagga

SEQ ID NO: 57778 - RNA, 22 nt, Human
uggaaggugauucucugguuaa

SEQ ID NO: 57779 - RNA, 19 nt, Human
uggaagugauaguauagua

SEQ ID NO: 57780 - RNA, 22 nt, Human
uggaaguggcaggggagacgua

SEQ ID NO: 57781 - RNA, 22 nt, Human
uggaagcuggcugaucugacuu

SEQ ID NO: 57782 - RNA, 20 nt, Human
ucugcuugucuucagguucc

SEQ ID NO: 57783 - RNA, 22 nt, Human
ucugaucagaagacaaaugagg

SEQ ID NO: 57784 - RNA, 22 nt, Human
ucugauucucuuguugaccuag

SEQ ID NO: 57785 - RNA, 23 nt, Human
uggaagaaaaugguuuggcugug

SEQ ID NO: 57786 - RNA, 22 nt, Human
uggaaaacgcaguuuaauuuuu

SEQ ID NO: 57787 - RNA, 22 nt, Human
uggaaaagaugucuuccugaau

SEQ ID NO: 57788 - RNA, 22 nt, Human
ugcuuuuggcagcaguguuuau

SEQ ID NO: 57789 - RNA, 21 nt, Human
ugcuuuuguugucagcugcug

SEQ ID NO: 57790 - RNA, 22 nt, Human
ucugaaauuuuaguuauagaaa

SEQ ID NO: 57791 - RNA, 22 nt, Human
ugcuuuaccuuccauuuaagga

SEQ ID NO: 57792 - RNA, 20 nt, Human
ucucuuuuucuucuuuucuc

SEQ ID NO: 57793 - RNA, 22 nt, Human
ucucuucggagagaccuuugga

SEQ ID NO: 57794 - RNA, 22 nt, Human
ugcuugaggcuugucaucuaac

SEQ ID NO: 57795 - RNA, 22 nt, Human
ugcuugacucagcaucggcaau

SEQ ID NO: 57796 - RNA, 22 nt, Human
ucucucguuuuuugcagauaaa

SEQ ID NO: 57797 - RNA, 22 nt, Human
ugcuucuuugggggugaagaga

SEQ ID NO: 57798 - RNA, 22 nt, Human
ucucuccauguuuucuguccag

SEQ ID NO: 57799 - RNA, 22 nt, Human
ugcuucuuuaggauguaguuau

SEQ ID NO: 57800 - RNA, 22 nt, Human
ugcuucucucuaggaagacgcu

SEQ ID NO: 57801 - RNA, 22 nt, Human
ugcuucuuuccuuggugacuuc

SEQ ID NO: 57802 - RNA, 22 nt, Human
ugcugugcuggcggcagaggcc

SEQ ID NO: 57803 - RNA, 22 nt, Human
ucucccgcuuccugcuggcugc

SEQ ID NO: 57804 - RNA, 18 nt, Human
ucuccgaccccgcggucc

SEQ ID NO: 57805 - RNA, 22 nt, Human
ugcugguuucugaguaaccaca

SEQ ID NO: 57806 - RNA, 22 nt, Human
ugcugggagcugggccucgaca

SEQ ID NO: 57807 - RNA, 20 nt, Human
ugcugggccaucuugcaugc

SEQ ID NO: 57808 - RNA, 22 nt, Human
ugcuggagccauguuuucucua

SEQ ID NO: 57809 - RNA, 22 nt, Human
ucucaggcuuccuggugcugug

SEQ ID NO: 57810 - RNA, 22 nt, Human
ugcugcuguuuccuacaucuca

SEQ ID NO: 57811 - RNA, 22 nt, Human
ucucagaagaaacaucugcugg

SEQ ID NO: 57812 - RNA, 22 nt, Human
ugcugcuguuaucauuuuacca

SEQ ID NO: 57813 - RNA, 22 nt, Human
ugcugcucaagcugcagcaaaa

SEQ ID NO: 57814 - RNA, 22 nt, Human
ugcugcggauauacaggaucug

SEQ ID NO: 57815 - RNA, 22 nt, Human
ucucaaacuauauaugggguuc

SEQ ID NO: 57816 - RNA, 22 nt, Human
ucuauuauauuuacacgagagu

SEQ ID NO: 57817 - RNA, 22 nt, Human
ugcggagggagcagucggcugu

SEQ ID NO: 57818 - RNA, 22 nt, Human
ugcggaaggcagcgcagggugg

SEQ ID NO: 57819 - RNA, 22 nt, Human
ucgcuucugaguuggugacccc

SEQ ID NO: 57820 - RNA, 22 nt, Human
ucgcuugaacccaggaagugga

SEQ ID NO: 57821 - RNA, 22 nt, Human
ugcggcucaaagggaaggccuu

SEQ ID NO: 57822 - RNA, 22 nt, Human
ugcgccucugucacucagcauc

SEQ ID NO: 57823 - RNA, 22 nt, Human
ugcgccuccugcugccugcccu

SEQ ID NO: 57824 - RNA, 22 nt, Human
ugccuuuuguguuuggcuaauc

SEQ ID NO: 57825 - RNA, 22 nt, Human
ugccuuccuucuccccuccuuc

SEQ ID NO: 57826 - RNA, 22 nt, Human
ugccuuuggcuguucugugacc

SEQ ID NO: 57827 - RNA, 20 nt, Human
ugccuuccgccccgggcacc

SEQ ID NO: 57828 - RNA, 22 nt, Human
uccuuguucugauuuuucuggg

SEQ ID NO: 57829 - RNA, 22 nt, Human
ugccuggacgacaucacaguga

SEQ ID NO: 57830 - RNA, 22 nt, Human
ugccuaaaccauuccccuuccu

SEQ ID NO: 57831 - RNA, 22 nt, Human
ugccucucucugucauuaugcu

SEQ ID NO: 57832 - RNA, 22 nt, Human
uccuggcgugggcuggcugcag

SEQ ID NO: 57833 - RNA, 22 nt, Human
uccugcucucuccauuccuucc

SEQ ID NO: 57834 - RNA, 21 nt, Human
uccugccuuaguccagagcag

SEQ ID NO: 57835 - RNA, 22 nt, Human
uccugcuucaaucugcugcugg

SEQ ID NO: 57836 - RNA, 22 nt, Human
ugcccagcagggagcuaccugg

SEQ ID NO: 57837 - RNA, 22 nt, Human
uccuccuuuccccgcuggagcc

SEQ ID NO: 57838 - RNA, 22 nt, Human
uccugcaugcuagugagugcuu

SEQ ID NO: 57839 - RNA, 22 nt, Human
ugcccacuuugucuccaugcug

SEQ ID NO: 57840 - RNA, 22 nt, Human
uccucguccucauccgcgucau

SEQ ID NO: 57841 - RNA, 22 nt, Human
uccuccauguugugcacuugaa

SEQ ID NO: 57842 - RNA, 22 nt, Human
ugcaugguuauauacuacuagu

SEQ ID NO: 57843 - RNA, 22 nt, Human
ugcauuuuuaauuuggaaaaaa

SEQ ID NO: 57844 - RNA, 22 nt, Human
ugcagugcagcuggaauaucuu

SEQ ID NO: 57845 - RNA, 22 nt, Human
ugcaguugcguuugcauuccau

SEQ ID NO: 57846 - RNA, 22 nt, Human
ugcagguggcagcggggcacca

SEQ ID NO: 57847 - RNA, 22 nt, Human
uccgcguugguuagagagggcu

SEQ ID NO: 57848 - RNA, 22 nt, Human
uccggcgaccuccagauguucc

SEQ ID NO: 57849 - RNA, 22 nt, Human
uccgggagcccccggaggagga

SEQ ID NO: 57850 - RNA, 18 nt, Human
uccggaggucagaguaaa

SEQ ID NO: 57851 - RNA, 22 nt, Human
ugcaggagcaccagcucacccu

SEQ ID NO: 57852 - RNA, 22 nt, Human
ugcaggaacucgaaaacuauag

SEQ ID NO: 57853 - RNA, 22 nt, Human
uccgacacacgugcucgcagcg

SEQ ID NO: 57854 - RNA, 22 nt, Human
ugcaggagcccaggaauacuau

SEQ ID NO: 57855 - RNA, 22 nt, Human
ucccugcagggccauugugcag

SEQ ID NO: 57856 - RNA, 22 nt, Human
ucccguuucacuccuugccagc

SEQ ID NO: 57857 - RNA, 22 nt, Human
ugcacugccuuucuuggcauga

SEQ ID NO: 57858 - RNA, 22 nt, Human
uccccgcugcgcccgcugcugc

SEQ ID NO: 57859 - RNA, 22 nt, Human
ugcaauggauaucugaacgugg

SEQ ID NO: 57860 - RNA, 22 nt, Human
ugauugguauguauguuuguca

SEQ ID NO: 57861 - RNA, 22 nt, Human
ugauuucauaugacagcuuuuu

SEQ ID NO: 57862 - RNA, 22 nt, Human
ugauuugaaaccuuuggcaaga

SEQ ID NO: 57863 - RNA, 22 nt, Human
uccaggagucagacagauggug

SEQ ID NO: 57864 - RNA, 22 nt, Human
uccagcuucugccugcugcugc

SEQ ID NO: 57865 - RNA, 22 nt, Human
ugauugaauaauguuaugugaa

SEQ ID NO: 57866 - RNA, 22 nt, Human
ugaugccauaguaaaauuugcu

SEQ ID NO: 57867 - RNA, 19 nt, Human
uccaaaauacuuguuacug

SEQ ID NO: 57868 - RNA, 22 nt, Human
ugaucauguucuccaaaagcgu

SEQ ID NO: 57869 - RNA, 22 nt, Human
ugaucauugaacaucgaguuaa

SEQ ID NO: 57870 - RNA, 22 nt, Human
ugaucaacagggcuggaaagag

SEQ ID NO: 57871 - RNA, 22 nt, Human
ucaugggcaaacuuggggauca

SEQ ID NO: 57872 - RNA, 22 nt, Human
ucaucuuuauaaugcaaguuuu

SEQ ID NO: 57873 - RNA, 22 nt, Human
ucaugcagaguagaaagggcaa

SEQ ID NO: 57874 - RNA, 22 nt, Human
ucaucuauaaguagcaucuggg

SEQ ID NO: 57875 - RNA, 20 nt, Human
ucaucuuucaaauuugugac

SEQ ID NO: 57876 - RNA, 22 nt, Human
ucauccugucucuguucggaau

SEQ ID NO: 57877 - RNA, 22 nt, Human
ugaggcuuucacuuggcaaaga

SEQ ID NO: 57878 - RNA, 22 nt, Human
ugaggccaagccuccucugcca

SEQ ID NO: 57879 - RNA, 21 nt, Human
ugaggccugccagucucagaa

SEQ ID NO: 57880 - RNA, 19 nt, Human
ugaggauugagguccagua

SEQ ID NO: 57881 - RNA, 22 nt, Human
ucauaaaaucaguguccauugu

SEQ ID NO: 57882 - RNA, 22 nt, Human
ugagccauguucaugagguuca

SEQ ID NO: 57883 - RNA, 21 nt, Human
ugagcccaaagcuguauuggu

SEQ ID NO: 57884 - RNA, 22 nt, Human
ugagaagaggucuuuugggaug

SEQ ID NO: 57885 - RNA, 22 nt, Human
ucuuccagauacuuccugacuu

SEQ ID NO: 57886 - RNA, 22 nt, Human
ucuucaugaaauugauugcuua

SEQ ID NO: 57887 - RNA, 22 nt, Human
ucuuccaaacaaaaaucugugu

SEQ ID NO: 57888 - RNA, 22 nt, Human
ugagacagaccuuggaccaugu

SEQ ID NO: 57889 - RNA, 22 nt, Human
ugagaggaagggaaagaugauu

SEQ ID NO: 57890 - RNA, 19 nt, Human
ucuguugcuuuguguccuc

SEQ ID NO: 57891 - RNA, 22 nt, Human
ucuguuucaggggucuggaaug

SEQ ID NO: 57892 - RNA, 22 nt, Human
ucuuacuguccucuguuuuucu

SEQ ID NO: 57893 - RNA, 20 nt, Human
ucuucagcuccaagucuggc

SEQ ID NO: 57894 - RNA, 17 nt, Human
ucuguguccgcucaguc

SEQ ID NO: 57895 - RNA, 22 nt, Human
ucuguggcaaacacagugacca

SEQ ID NO: 57896 - RNA, 19 nt, Human
ucuguggccuucccugaug

SEQ ID NO: 57897 - RNA, 20 nt, Human
ucuguggcagguggcgcuug

SEQ ID NO: 57898 - RNA, 21 nt, Human
ucugugcuuuuuuggcuccua

SEQ ID NO: 57899 - RNA, 22 nt, Human
ucuguauuuuuuacacacaugc

SEQ ID NO: 57900 - RNA, 22 nt, Human
uauguucaauaccagguucuuu

SEQ ID NO: 57901 - RNA, 22 nt, Human
ucugggucuaucccaugccuuu

SEQ ID NO: 57902 - RNA, 22 nt, Human
ucugggagaguagauaaaggaa

SEQ ID NO: 57903 - RNA, 21 nt, Human
ucuggggacaagguccaggaa

SEQ ID NO: 57904 - RNA, 22 nt, Human
ucugggccaacccuuccauggg

SEQ ID NO: 57905 - RNA, 22 nt, Human
ucugggccacccgccuccaggg

SEQ ID NO: 57906 - RNA, 22 nt, Human
ucuggcuucaguaggguucacu

SEQ ID NO: 57907 - RNA, 21 nt, Human
ucuggccuauaaaguagucgc

SEQ ID NO: 57908 - RNA, 22 nt, Human
ucuggcaguugccgcuucaguc

SEQ ID NO: 57909 - RNA, 22 nt, Human
uaugugaaauggaauauagaaa

SEQ ID NO: 57910 - RNA, 22 nt, Human
ucugcuuaguuuucuugaacag

SEQ ID NO: 57911 - RNA, 22 nt, Human
uauguaacaccauuuacaaagu

SEQ ID NO: 57912 - RNA, 22 nt, Human
uauguacauauauguguauaua

SEQ ID NO: 57913 - RNA, 22 nt, Human
ucugcuggugucauuuuugcua

SEQ ID NO: 57914 - RNA, 22 nt, Human
ucugcguggcgugguucugugc

SEQ ID NO: 57915 - RNA, 22 nt, Human
uaugggcaagagauaggugguc

SEQ ID NO: 57916 - RNA, 22 nt, Human
ucugccuucaggagcagacucu

SEQ ID NO: 57917 - RNA, 22 nt, Human
ucugcccguucaaauccuuguu

SEQ ID NO: 57918 - RNA, 22 nt, Human
uaugaucuuaggauggaacuuc

SEQ ID NO: 57919 - RNA, 22 nt, Human
ucugagugacguccugacagga

SEQ ID NO: 57920 - RNA, 22 nt, Human
ucucuugcuauugcgaacaggu

SEQ ID NO: 57921 - RNA, 18 nt, Human
ucugaaggaaugauucca

SEQ ID NO: 57922 - RNA, 22 nt, Human
ucugaccccccuugccuccacu

SEQ ID NO: 57923 - RNA, 20 nt, Human
ucucucacccuugcugugca

SEQ ID NO: 57924 - RNA, 20 nt, Human
ucucuaacaugaaugcuauc

SEQ ID NO: 57925 - RNA, 22 nt, Human
ucucuggacggacauuuaaggu

SEQ ID NO: 57926 - RNA, 22 nt, Human
ucucugguggcuccaucaguag

SEQ ID NO: 57927 - RNA, 22 nt, Human
ucucgcuguuccugcuucaggu

SEQ ID NO: 57928 - RNA, 22 nt, Human
ucuccccucuggucugggcucu

SEQ ID NO: 57929 - RNA, 22 nt, Human
ucgauccaggaaggcugguuua

SEQ ID NO: 57930 - RNA, 22 nt, Human
ucgaggagagucgccagcugcu

SEQ ID NO: 57931 - RNA, 22 nt, Human
ucucaaagagcuacuggucuau

SEQ ID NO: 57932 - RNA, 21 nt, Human
ucucaagguaacauuuaagau

SEQ ID NO: 57933 - RNA, 23 nt, Human
ucucaccaggauaugacugucac

SEQ ID NO: 57934 - RNA, 22 nt, Human
uccuggccuuggggagagaagu

SEQ ID NO: 57935 - RNA, 22 nt, Human
uccuggccucugagucaagaac

SEQ ID NO: 57936 - RNA, 22 nt, Human
uccuggcuguuagagaggcaag

SEQ ID NO: 57937 - RNA, 22 nt, Human
uccucgccgucacgcagccucu

SEQ ID NO: 57938 - RNA, 22 nt, Human
uccguugaggcugccaggcgag

SEQ ID NO: 57939 - RNA, 22 nt, Human
uccuaaauuuguacuagcauuu

SEQ ID NO: 57940 - RNA, 22 nt, Human
uccucagcaagacgcuggcagc

SEQ ID NO: 57941 - RNA, 22 nt, Human
uccgaccuuuacuucuugucuc

SEQ ID NO: 57942 - RNA, 22 nt, Human
uccgggcagcuccuggagcugu

SEQ ID NO: 57943 - RNA, 22 nt, Human
ucccugcgugagaaagcacuua

SEQ ID NO: 57944 - RNA, 22 nt, Human
ucccugccuuauuuucauaugc

SEQ ID NO: 57945 - RNA, 22 nt, Human
ucccugccuccuggcagugcca

SEQ ID NO: 57946 - RNA, 22 nt, Human
ucccggcaccgggagccccugc

SEQ ID NO: 57947 - RNA, 22 nt, Human
ucccgcccugcguucucccaug

SEQ ID NO: 57948 - RNA, 22 nt, Human
ucccuacuccucuggucccucu

SEQ ID NO: 57949 - RNA, 22 nt, Human
uccccugccccccauccucugg

SEQ ID NO: 57950 - RNA, 22 nt, Human
uacuugucuuuauuuuaaugcu

SEQ ID NO: 57951 - RNA, 19 nt, Human
uccccuacuccuuucccuc

SEQ ID NO: 57952 - RNA, 22 nt, Human
uacuucccacuggggucuacca

SEQ ID NO: 57953 - RNA, 22 nt, Human
uccccaugaacuuguggcugcu

SEQ ID NO: 57954 - RNA, 22 nt, Human
uccaugauauauaugugcacau

SEQ ID NO: 57955 - RNA, 22 nt, Human
uccaggcagcugcuugaugaua

SEQ ID NO: 57956 - RNA, 22 nt, Human
uccaggacgccgacgugucggc

SEQ ID NO: 57957 - RNA, 22 nt, Human
uccaggaggacugagggggcug

SEQ ID NO: 57958 - RNA, 21 nt, Human
uacagcucaucaauuacugcu

SEQ ID NO: 57959 - RNA, 22 nt, Human
uccaaggacucuugucagcugu

SEQ ID NO: 57960 - RNA, 22 nt, Human
uccaagacagauaccuagaaga

SEQ ID NO: 57961 - RNA, 22 nt, Human
ucauuuguauucuacaaagcac

SEQ ID NO: 57962 - RNA, 20 nt, Human
ucauucagaaucaguaugca

SEQ ID NO: 57963 - RNA, 22 nt, Human
ucaucagccaaagaguccuuca

SEQ ID NO: 57964 - RNA, 22 nt, Human
uaaggaaaugcaaauuuaagaa

SEQ ID NO: 57965 - RNA, 22 nt, Human
uaaggagagaauuuagagguuu

SEQ ID NO: 57966 - RNA, 22 nt, Human
ucauggguauaauuuuagaugu

SEQ ID NO: 57967 - RNA, 22 nt, Human
ucauggucucccagcccccucu

SEQ ID NO: 57968 - RNA, 21 nt, Human
ucauaauaauuacaugggggg

SEQ ID NO: 57969 - RNA, 22 nt, Human
ucaucggcugucaucuucacgu

SEQ ID NO: 57970 - RNA, 22 nt, Human
uaaauuugugaauuagcuauca

SEQ ID NO: 57971 - RNA, 22 nt, Human
uaacauuuaguuuuaagauggu

SEQ ID NO: 57972 - RNA, 22 nt, Human
ucagucucuggggcuucuguuu

SEQ ID NO: 57973 - RNA, 22 nt, Human
uaacuguuuugaauauuguggu

SEQ ID NO: 57974 - RNA, 22 nt, Human
ucagugugacccuucuauuuuu

SEQ ID NO: 57975 - RNA, 22 nt, Human
uaaaugaaaugaagugaaagcu

SEQ ID NO: 57976 - RNA, 22 nt, Human
uaaaugaaaggguuuaauuuau

SEQ ID NO: 57977 - RNA, 22 nt, Human
ucaagcuggaaaugaagaaucu

SEQ ID NO: 57978 - RNA, 21 nt, Human
ucaagcggcagagcaguuauu

SEQ ID NO: 57979 - RNA, 22 nt, Human
ucaagagauauaugcugguuua

SEQ ID NO: 57980 - RNA, 22 nt, Human
ucaggaggucugcugcggggug

SEQ ID NO: 57981 - RNA, 22 nt, Human
ucagggaggagaggcaggggga

SEQ ID NO: 57982 - RNA, 22 nt, Human
guugguggaggcgagagaagaa

SEQ ID NO: 57983 - RNA, 22 nt, Human
guugggguuucaguggcaguca

SEQ ID NO: 57984 - RNA, 22 nt, Human
ucaaauaugggccagaggaaau

SEQ ID NO: 57985 - RNA, 22 nt, Human
ucaaaggcuugugguucuggga

SEQ ID NO: 57986 - RNA, 22 nt, Human
ucaaaaauaagauauucuggac

SEQ ID NO: 57987 - RNA, 22 nt, Human
guugcggaguguagcgaugcuu

SEQ ID NO: 57988 - RNA, 22 nt, Human
guuggaaauaucagucacguga

SEQ ID NO: 57989 - RNA, 22 nt, Human
guuggcgaaggaccuggaggag

SEQ ID NO: 57990 - RNA, 22 nt, Human
guugcuucuuggcuuuuccaac

SEQ ID NO: 57991 - RNA, 22 nt, Human
guucuggaggagagccuggugu

SEQ ID NO: 57992 - RNA, 22 nt, Human
guucuuuacuucgcaucugcua

SEQ ID NO: 57993 - RNA, 17 nt, Human
guucucaaacugacuga

SEQ ID NO: 57994 - RNA, 22 nt, Human
guuccugagcaguuccuggcca

SEQ ID NO: 57995 - RNA, 22 nt, Human
guuccugugcccuguucuuucc

SEQ ID NO: 57996 - RNA, 18 nt, Human
guucaagcauuuugcucu

SEQ ID NO: 57997 - RNA, 22 nt, Human
uauucauuuuuauuugugacug

SEQ ID NO: 57998 - RNA, 22 nt, Human
guguugaaaaguagcacugcuu

SEQ ID NO: 57999 - RNA, 22 nt, Human
guguugaugugucuguauucua

SEQ ID NO: 58000 - RNA, 22 nt, Human
guguugcaggaagauauagcug

SEQ ID NO: 58001 - RNA, 22 nt, Human
guguuuauguuuuugcuaggga

SEQ ID NO: 58002 - RNA, 20 nt, Human
uaugugcaguuugguuuauc

SEQ ID NO: 58003 - RNA, 22 nt, Human
uauguggcaggugggagaucag

SEQ ID NO: 58004 - RNA, 22 nt, Human
uaugugguuugucauuuaauau

SEQ ID NO: 58005 - RNA, 22 nt, Human
guguggcgacucagagcugccu

SEQ ID NO: 58006 - RNA, 22 nt, Human
uaugcuguauucuguauguuag

SEQ ID NO: 58007 - RNA, 22 nt, Human
uaucuucaauagcccagaugug

SEQ ID NO: 58008 - RNA, 22 nt, Human
guggugauuugggucuagcuuu

SEQ ID NO: 58009 - RNA, 22 nt, Human
guggugaacauuugcaucugcu

SEQ ID NO: 58010 - RNA, 22 nt, Human
guggguuggguuuuugaaggga

SEQ ID NO: 58011 - RNA, 22 nt, Human
uagucggcuaggagggccuucu

SEQ ID NO: 58012 - RNA, 22 nt, Human
uaguaugugccuguugucucug

SEQ ID NO: 58013 - RNA, 22 nt, Human
gugggggcagaagcgagugcag

SEQ ID NO: 58014 - RNA, 22 nt, Human
gugggaaacagccuugcuucua

SEQ ID NO: 58015 - RNA, 22 nt, Human
guggcuuuguuuccaaaugaaa

SEQ ID NO: 58016 - RNA, 18 nt, Human
guggccauugaccagcuu

SEQ ID NO: 58017 - RNA, 22 nt, Human
guggccugacagaucggaacag

SEQ ID NO: 58018 - RNA, 22 nt, Human
uaggucugaggcugcaucuugg

SEQ ID NO: 58019 - RNA, 22 nt, Human
guggcagguguacagcucagcu

SEQ ID NO: 58020 - RNA, 22 nt, Human
guggcauggggagcagcuagaa

SEQ ID NO: 58021 - RNA, 22 nt, Human
uaggggaagcauagguuuagaa

SEQ ID NO: 58022 - RNA, 22 nt, Human
uaggcaaguggaccagagguuu

SEQ ID NO: 58023 - RNA, 22 nt, Human
uaggauauuuuagaaugguaca

SEQ ID NO: 58024 - RNA, 22 nt, Human
uaggagcagauggcagcaggug

SEQ ID NO: 58025 - RNA, 22 nt, Human
guggaggguuugcaaugugcag

SEQ ID NO: 58026 - RNA, 22 nt, Human
guggaagggaaaccgcacuggc

SEQ ID NO: 58027 - RNA, 22 nt, Human
guggaaauuuuaggaucaucuu

SEQ ID NO: 58028 - RNA, 22 nt, Human
gugcuugcgcauaacuggggcc

SEQ ID NO: 58029 - RNA, 22 nt, Human
gugcuuccuguauugauuccau

SEQ ID NO: 58030 - RNA, 22 nt, Human
gugcucgagcugugcgcgcugc

SEQ ID NO: 58031 - RNA, 22 nt, Human
uaggaagagauuuucacauggc

SEQ ID NO: 58032 - RNA, 22 nt, Human
uagcuggaggggcaggaugcug

SEQ ID NO: 58033 - RNA, 22 nt, Human
uagcucuaaggagaaucccucu

SEQ ID NO: 58034 - RNA, 23 nt, Human
uagcggccaugacgggggucaca

SEQ ID NO: 58035 - RNA, 22 nt, Human
uagcguaugcugugugaugaau

SEQ ID NO: 58036 - RNA, 22 nt, Human
gugaaggggaagcagggagagg

SEQ ID NO: 58037 - RNA, 22 nt, Human
gugaaggcaugugugcugugcu

SEQ ID NO: 58038 - RNA, 23 nt, Human
gugagaccagagccuauucucag

SEQ ID NO: 58039 - RNA, 22 nt, Human
gugaaauuguacacucaguacc

SEQ ID NO: 58040 - RNA, 22 nt, Human
gugaaacuggaugugaaaacaa

SEQ ID NO: 58041 - RNA, 18 nt, Human
gucuguuccuuuaauguc

SEQ ID NO: 58042 - RNA, 22 nt, Human
gucuucugacacuguuaggagg

SEQ ID NO: 58043 - RNA, 22 nt, Human
gugaaaaauggccaucaggaca

SEQ ID NO: 58044 - RNA, 22 nt, Human
gucugguggaguuguauauacu

SEQ ID NO: 58045 - RNA, 22 nt, Human
gucuggugguggguguagggca

SEQ ID NO: 58046 - RNA, 22 nt, Human
gucgguacuaguacugguguug

SEQ ID NO: 58047 - RNA, 22 nt, Human
guccugauggccauuuuucacu

SEQ ID NO: 58048 - RNA, 22 nt, Human
guccuggugccaccugcgggau

SEQ ID NO: 58049 - RNA, 22 nt, Human
gucccucauaacuggcaggugu

SEQ ID NO: 58050 - RNA, 22 nt, Human
guccaguaguguuugcaugugg

SEQ ID NO: 58051 - RNA, 22 nt, Human
uaaggcuguuaggaggauuaaa

SEQ ID NO: 58052 - RNA, 20 nt, Human
gucaucucagggacugucug

SEQ ID NO: 58053 - RNA, 22 nt, Human
gguuugauauguuugugauucu

SEQ ID NO: 58054 - RNA, 22 nt, Human
uaaaggcaaacucuccaaggau

SEQ ID NO: 58055 - RNA, 22 nt, Human
gguuuuuggcucaauauuuugg

SEQ ID NO: 58056 - RNA, 22 nt, Human
uaaaaucaugacagauugacau

SEQ ID NO: 58057 - RNA, 22 nt, Human
uaaauaugcaugugguauucau

SEQ ID NO: 58058 - RNA, 22 nt, Human
ggugugaauagagccuggagca

SEQ ID NO: 58059 - RNA, 23 nt, Human
guuuuugcugcagcugaagaagg

SEQ ID NO: 58060 - RNA, 21 nt, Human
uaaaagaugacaagacagcuc

SEQ ID NO: 58061 - RNA, 22 nt, Human
ggugcuggggaaauuaggguag

SEQ ID NO: 58062 - RNA, 22 nt, Human
ggugacauuggagagacaggug

SEQ ID NO: 58063 - RNA, 22 nt, Human
guuuccaagucucucaacaccc

SEQ ID NO: 58064 - RNA, 22 nt, Human
ggucugcgauggcaagggucuu

SEQ ID NO: 58065 - RNA, 22 nt, Human
guuguuuuuguuaaaacaguga

SEQ ID NO: 58066 - RNA, 22 nt, Human
ggucuagcucggugcuggcgac

SEQ ID NO: 58067 - RNA, 19 nt, Human
guuguguuugguucuuuug

SEQ ID NO: 58068 - RNA, 22 nt, Human
guuguugcuauguuauuguuau

SEQ ID NO: 58069 - RNA, 22 nt, Human
guuguuuucagcccagcauuag

SEQ ID NO: 58070 - RNA, 22 nt, Human
gguccgcgcgcagaggcccugg

SEQ ID NO: 58071 - RNA, 22 nt, Human
guugggcugaagugugugcuua

SEQ ID NO: 58072 - RNA, 22 nt, Human
gugcuggcaaagagaacaucuu

SEQ ID NO: 58073 - RNA, 22 nt, Human
gugcugggaggcccaggaugga

SEQ ID NO: 58074 - RNA, 22 nt, Human
gugcuugaguaaaaauagucuu

SEQ ID NO: 58075 - RNA, 22 nt, Human
gugcugcaaggauggagaggca

SEQ ID NO: 58076 - RNA, 22 nt, Human
gugcugcaugagcaucacguag

SEQ ID NO: 58077 - RNA, 22 nt, Human
gggcaagaggguuugacaugag

SEQ ID NO: 58078 - RNA, 22 nt, Human
gggcaagaagcuggaagcauuc

SEQ ID NO: 58079 - RNA, 20 nt, Human
gugcggcucuaccacucggu

SEQ ID NO: 58080 - RNA, 22 nt, Human
gugccuggugcaggauaaucac

SEQ ID NO: 58081 - RNA, 22 nt, Human
gugccuggaaucuuuucuucac

SEQ ID NO: 58082 - RNA, 22 nt, Human
gugccuuuuucccaguucauug

SEQ ID NO: 58083 - RNA, 22 nt, Human
gugccugcucauucucaauauu

SEQ ID NO: 58084 - RNA, 22 nt, Human
gggagggaggagccccggccau

SEQ ID NO: 58085 - RNA, 22 nt, Human
gugccgcuggagcuggaauuga

SEQ ID NO: 58086 - RNA, 22 nt, Human
gugcagcugguggagucugggg

SEQ ID NO: 58087 - RNA, 22 nt, Human
gugauuucagguuuuucauacu

SEQ ID NO: 58088 - RNA, 22 nt, Human
gggacgggcuagcugccguggc

SEQ ID NO: 58089 - RNA, 22 nt, Human
gugaugugugaaggucugcagg

SEQ ID NO: 58090 - RNA, 22 nt, Human
gugauggggagagcgcagcuuu

SEQ ID NO: 58091 - RNA, 22 nt, Human
gugauggucgagcgcuuguugu

SEQ ID NO: 58092 - RNA, 22 nt, Human
gggaaguugguaagaggcuguu

SEQ ID NO: 58093 - RNA, 22 nt, Human
gugaugaaggccugcaccuggu

SEQ ID NO: 58094 - RNA, 22 nt, Human
gugaugaagguggagaaucaga

SEQ ID NO: 58095 - RNA, 19 nt, Human
gugaugaugccacuccaac

SEQ ID NO: 58096 - RNA, 17 nt, Human
gugagcugagucaggac

SEQ ID NO: 58097 - RNA, 22 nt, Human
gggaacgacuguuaguacuugg

SEQ ID NO: 58098 - RNA, 22 nt, Human
gugaguuuucgugacacuauuu

SEQ ID NO: 58099 - RNA, 22 nt, Human
gggaagaaccucugcuaccaau

SEQ ID NO: 58100 - RNA, 22 nt, Human
gugaucagaagaaccugccgaa

SEQ ID NO: 58101 - RNA, 22 nt, Human
gggaagagggagcuggaaugau

SEQ ID NO: 58102 - RNA, 22 nt, Human
gggaaaugugucuuggcauucu

SEQ ID NO: 58103 - RNA, 22 nt, Human
ggcuuguccuucugguugucuu

SEQ ID NO: 58104 - RNA, 19 nt, Human
ggcuuugcccuucgcuccg

SEQ ID NO: 58105 - RNA, 22 nt, Human
ggcuuuuguuauaaucaggccu

SEQ ID NO: 58106 - RNA, 22 nt, Human
gugaagcaagggucaccugugg

SEQ ID NO: 58107 - RNA, 22 nt, Human
ggcuucaaaacacaugucaaga

SEQ ID NO: 58108 - RNA, 22 nt, Human
ggcugugguggacgcgggaaac

SEQ ID NO: 58109 - RNA, 22 nt, Human
gugaaaauaguaaccuggcuag

SEQ ID NO: 58110 - RNA, 18 nt, Human
ggcugggcugugccccuu

SEQ ID NO: 58111 - RNA, 22 nt, Human
ggcuguggcagcuggaaguggu

SEQ ID NO: 58112 - RNA, 22 nt, Human
gucuucuauuuggcaugacaga

SEQ ID NO: 58113 - RNA, 22 nt, Human
ggcuggacuuucugcugggcuc

SEQ ID NO: 58114 - RNA, 22 nt, Human
gucugcuuuuaucacaugucau

SEQ ID NO: 58115 - RNA, 22 nt, Human
gucuggagccacugcugcugcu

SEQ ID NO: 58116 - RNA, 22 nt, Human
gucugccagauucugcuggauc

SEQ ID NO: 58117 - RNA, 22 nt, Human
ggcuggaacuucuucuggcauu

SEQ ID NO: 58118 - RNA, 22 nt, Human
gucuauucaucauucaucaaac

SEQ ID NO: 58119 - RNA, 22 nt, Human
ggcugcuggaguugggucucuc

SEQ ID NO: 58120 - RNA, 22 nt, Human
guccuucgcggcugaggccauu

SEQ ID NO: 58121 - RNA, 22 nt, Human
gucgagcuggaggagcgaaugg

SEQ ID NO: 58122 - RNA, 22 nt, Human
guccucgugucuuuuucucuaa

SEQ ID NO: 58123 - RNA, 22 nt, Human
ggcugcagggaacaggaugggu

SEQ ID NO: 58124 - RNA, 22 nt, Human
ggcugaugacgccugagucuga

SEQ ID NO: 58125 - RNA, 22 nt, Human
ggcucguaaaggccucacaggu

SEQ ID NO: 58126 - RNA, 22 nt, Human
ggcucuggcgagcuuuaguaca

SEQ ID NO: 58127 - RNA, 22 nt, Human
guccccuauaugaggaagccau

SEQ ID NO: 58128 - RNA, 22 nt, Human
guccaucuugcaaugagaccua

SEQ ID NO: 58129 - RNA, 19 nt, Human
guccaugguaaagaaggau

SEQ ID NO: 58130 - RNA, 22 nt, Human
guccagaguagucgaguauucu

SEQ ID NO: 58131 - RNA, 22 nt, Human
ggcucccgugggaugguggagc

SEQ ID NO: 58132 - RNA, 22 nt, Human
ggcgucuugcgggcgguagcgc

SEQ ID NO: 58133 - RNA, 22 nt, Human
ggcguccuccucgucugaggcg

SEQ ID NO: 58134 - RNA, 22 nt, Human
ggcggugcgaggaugcagggcu

SEQ ID NO: 58135 - RNA, 22 nt, Human
ggcggcugcuccuugcccucgg

SEQ ID NO: 58136 - RNA, 22 nt, Human
gucaucugagggacgagauuuc

SEQ ID NO: 58137 - RNA, 22 nt, Human
gucaguccugugccuuuccgga

SEQ ID NO: 58138 - RNA, 20 nt, Human
gucagaggacccuagagcga

SEQ ID NO: 58139 - RNA, 22 nt, Human
gucaaugcuuaguuugccugaa

SEQ ID NO: 58140 - RNA, 22 nt, Human
gucacgucgggacagacugggg

SEQ ID NO: 58141 - RNA, 22 nt, Human
ggcgcccucccuguccgucuuc

SEQ ID NO: 58142 - RNA, 22 nt, Human
ggcgcuccccgccugcgucgcg

SEQ ID NO: 58143 - RNA, 22 nt, Human
ggcgaugaggucuuagaaucua

SEQ ID NO: 58144 - RNA, 22 nt, Human
guauauuuaugagcauuagccu

SEQ ID NO: 58145 - RNA, 22 nt, Human
guaucaggugugagcauuuuaa

SEQ ID NO: 58146 - RNA, 22 nt, Human
ggcccgcgcugcuggcgcgcca

SEQ ID NO: 58147 - RNA, 22 nt, Human
gguuucuuuccucucugugccu

SEQ ID NO: 58148 - RNA, 22 nt, Human
gguguuccgguucugcucuggg

SEQ ID NO: 58149 - RNA, 22 nt, Human
gguuauuucugauuauaugaua

SEQ ID NO: 58150 - RNA, 22 nt, Human
ggccaaagagcacaaugaauag

SEQ ID NO: 58151 - RNA, 22 nt, Human
ggcauugauggggucuugggga

SEQ ID NO: 58152 - RNA, 22 nt, Human
ggugucguuucacaugacccag

SEQ ID NO: 58153 - RNA, 22 nt, Human
ggcauggugggggaggacuugg

SEQ ID NO: 58154 - RNA, 22 nt, Human
ggcaugcaaaugugggugaccu

SEQ ID NO: 58155 - RNA, 22 nt, Human
gguggccggcaccccacccucg

SEQ ID NO: 58156 - RNA, 22 nt, Human
ggugcuucgauagguguccaua

SEQ ID NO: 58157 - RNA, 22 nt, Human
ggcagcagaaccaacuguggcu

SEQ ID NO: 58158 - RNA, 22 nt, Human
ggcagaggaagcuggaaguggg

SEQ ID NO: 58159 - RNA, 22 nt, Human
ggcaaggaagaaagcagaaguu

SEQ ID NO: 58160 - RNA, 22 nt, Human
ggucaaauaugaguaauuuccu

SEQ ID NO: 58161 - RNA, 22 nt, Human
ggucauagagcuggaaauuggc

SEQ ID NO: 58162 - RNA, 22 nt, Human
ggucgagcagcacccguucggc

SEQ ID NO: 58163 - RNA, 22 nt, Human
ggaugcugcuccacaucccaca

SEQ ID NO: 58164 - RNA, 22 nt, Human
gguaaucuccucauugacguua

SEQ ID NO: 58165 - RNA, 22 nt, Human
ggaugcagcagagaccuggagu

SEQ ID NO: 58166 - RNA, 22 nt, Human
ggauggaugugaucugccuccu

SEQ ID NO: 58167 - RNA, 22 nt, Human
ggaugggcuuggggaggucuag

SEQ ID NO: 58168 - RNA, 22 nt, Human
ggguuuguuccuacuucuacuc

SEQ ID NO: 58169 - RNA, 22 nt, Human
ggguuuuggggaggaagugagc

SEQ ID NO: 58170 - RNA, 22 nt, Human
ggguuuugugauugccucugaa

SEQ ID NO: 58171 - RNA, 22 nt, Human
gguaacagaagagcacuuggca

SEQ ID NO: 58172 - RNA, 22 nt, Human
ggguucauuugccggguaguuu

SEQ ID NO: 58173 - RNA, 22 nt, Human
ggguggugagagaacuuugcag

SEQ ID NO: 58174 - RNA, 22 nt, Human
gggugcuucauaggugaugcug

SEQ ID NO: 58175 - RNA, 22 nt, Human
ggaggggaguuugccucugggg

SEQ ID NO: 58176 - RNA, 22 nt, Human
ggaggccgugcugugcugccag

SEQ ID NO: 58177 - RNA, 22 nt, Human
ggaggccccccaugcagcucca

SEQ ID NO: 58178 - RNA, 22 nt, Human
ggagcauggcuucuuggggcug

SEQ ID NO: 58179 - RNA, 22 nt, Human
ggagccaguuuagaccucaguu

SEQ ID NO: 58180 - RNA, 22 nt, Human
ggggcuggguuugcgcaggcuc

SEQ ID NO: 58181 - RNA, 22 nt, Human
ggagcaagagugagcaagcaga

SEQ ID NO: 58182 - RNA, 22 nt, Human
gggcuuuuccauuccaggguuc

SEQ ID NO: 58183 - RNA, 23 nt, Human
ggacgugaggcgcccuuuuuccc

SEQ ID NO: 58184 - RNA, 22 nt, Human
ggaaugcagugagcauuagaua

SEQ ID NO: 58185 - RNA, 22 nt, Human
ggaauuaagaggcuggacaggg

SEQ ID NO: 58186 - RNA, 22 nt, Human
gggcugagagcuggaaucugag

SEQ ID NO: 58187 - RNA, 21 nt, Human
ggaauagcuuaaagugagggg

SEQ ID NO: 58188 - RNA, 22 nt, Human
ggaagcucaauacuuuccucuu

SEQ ID NO: 58189 - RNA, 22 nt, Human
gggccuuggaggagaaggacuu

SEQ ID NO: 58190 - RNA, 21 nt, Human
gggccugggccagggccgggu

SEQ ID NO: 58191 - RNA, 22 nt, Human
ggaacaguacucggaggccaga

SEQ ID NO: 58192 - RNA, 22 nt, Human
gggcagagagcuggaacuccuu

SEQ ID NO: 58193 - RNA, 22 nt, Human
ggaaaaauggguggugauauga

SEQ ID NO: 58194 - RNA, 22 nt, Human
ggaaaagaauuguuaguuagug

SEQ ID NO: 58195 - RNA, 22 nt, Human
gggaugaaugccuggcuccccc

SEQ ID NO: 58196 - RNA, 22 nt, Human
gcuuuugcaaagcuggagaauu

SEQ ID NO: 58197 - RNA, 22 nt, Human
gggacugguuguguguggugug

SEQ ID NO: 58198 - RNA, 19 nt, Human
gggagaaaaucuuuauccu

SEQ ID NO: 58199 - RNA, 22 nt, Human
gcuuucacugcaauagaugaau

SEQ ID NO: 58200 - RNA, 22 nt, Human
gggacugcgagauucucaaggg

SEQ ID NO: 58201 - RNA, 22 nt, Human
gcuuggagaacguuuucuagaa

SEQ ID NO: 58202 - RNA, 22 nt, Human
gcuugggcugaaggccuggguc

SEQ ID NO: 58203 - RNA, 22 nt, Human
gcuuguauguguauauauacau

SEQ ID NO: 58204 - RNA, 22 nt, Human
gggacaggacuccuggggccug

SEQ ID NO: 58205 - RNA, 22 nt, Human
gcuugaggaacucagacuugag

SEQ ID NO: 58206 - RNA, 22 nt, Human
gcuugcaucaggggcuggggcc

SEQ ID NO: 58207 - RNA, 22 nt, Human
gcuugcugaacaggaaccuggc

SEQ ID NO: 58208 - RNA, 21 nt, Human
gggaagagaagagaaaggagg

SEQ ID NO: 58209 - RNA, 22 nt, Human
gggaagaagaaaagagguggga

SEQ ID NO: 58210 - RNA, 22 nt, Human
gggaagaacugauuucacacca

SEQ ID NO: 58211 - RNA, 22 nt, Human
gggaagccugggugauccuaaa

SEQ ID NO: 58212 - RNA, 22 nt, Human
gcuucugugagugcagaugcug

SEQ ID NO: 58213 - RNA, 22 nt, Human
gcuuccgacagagaucacauug

SEQ ID NO: 58214 - RNA, 22 nt, Human
gcuucccacagcuggacugggg

SEQ ID NO: 58215 - RNA, 22 nt, Human
gcuuccuccaucuggggcuugc

SEQ ID NO: 58216 - RNA, 22 nt, Human
gcuuacuguuccuguuggugcu

SEQ ID NO: 58217 - RNA, 22 nt, Human
gggaaauagagcuggaaccuug

SEQ ID NO: 58218 - RNA, 22 nt, Human
gggaaaauguuucugagacaaa

SEQ ID NO: 58219 - RNA, 23 nt, Human
gggaaaucaaaagauauuucuuc

SEQ ID NO: 58220 - RNA, 22 nt, Human
gggaaaucugcuuccuagggcu

SEQ ID NO: 58221 - RNA, 22 nt, Human
gggaacccaaauaggaaaauug

SEQ ID NO: 58222 - RNA, 22 nt, Human
ggcuuugggaggaugaggcggu

SEQ ID NO: 58223 - RNA, 22 nt, Human
ggcuuuuucccuaggguaagag

SEQ ID NO: 58224 - RNA, 22 nt, Human
gggaaaaaggaaccuuauuacu

SEQ ID NO: 58225 - RNA, 22 nt, Human
gcuguguucauccugcccaggu

SEQ ID NO: 58226 - RNA, 21 nt, Human
ggccagauucucccauagcug

SEQ ID NO: 58227 - RNA, 22 nt, Human
ggccacgggguuugcugaaacu

SEQ ID NO: 58228 - RNA, 22 nt, Human
ggccaagagaggauggagggau

SEQ ID NO: 58229 - RNA, 23 nt, Human
gcucuccaucacaugguguggca

SEQ ID NO: 58230 - RNA, 20 nt, Human
ggcauuuuuuaguugagcuu

SEQ ID NO: 58231 - RNA, 21 nt, Human
ggcauguagccagcaaaggua

SEQ ID NO: 58232 - RNA, 22 nt, Human
ggcauuccucucuguucaugga

SEQ ID NO: 58233 - RNA, 20 nt, Human
ggcaucugacaacuaguugc

SEQ ID NO: 58234 - RNA, 22 nt, Human
ggcaucuuuaaugaacaugaau

SEQ ID NO: 58235 - RNA, 22 nt, Human
gcugagcagcgaaggcacaugc

SEQ ID NO: 58236 - RNA, 22 nt, Human
gcugagcagaacaauuagaaau

SEQ ID NO: 58237 - RNA, 22 nt, Human
gcugagcaaugcacugccgcau

SEQ ID NO: 58238 - RNA, 23 nt, Human
gcucugauaccagcuacaucuag

SEQ ID NO: 58239 - RNA, 22 nt, Human
gcugacucugcuuuuagccucc

SEQ ID NO: 58240 - RNA, 22 nt, Human
gcuccggggguuccagaucauc

SEQ ID NO: 58241 - RNA, 22 nt, Human
gcuaguucugccuccccuagug

SEQ ID NO: 58242 - RNA, 22 nt, Human
ggcagguggcacugcugcuccc

SEQ ID NO: 58243 - RNA, 22 nt, Human
ggcagcccuggacccuggagaa

SEQ ID NO: 58244 - RNA, 21 nt, Human
ggcagccuggcaggggcacug

SEQ ID NO: 58245 - RNA, 22 nt, Human
gcgugcauggccguguguaugc

SEQ ID NO: 58246 - RNA, 22 nt, Human
gcguggccugcugaaggacuuc

SEQ ID NO: 58247 - RNA, 22 nt, Human
ggcagaaaacaauaaccauuuc

SEQ ID NO: 58248 - RNA, 22 nt, Human
ggcacuggguugcagagagaga

SEQ ID NO: 58249 - RNA, 22 nt, Human
ggcacaggcugguaccaguuca

SEQ ID NO: 58250 - RNA, 22 nt, Human
ggcacagcgacuaccaucgaaa

SEQ ID NO: 58251 - RNA, 19 nt, Human
ggauaagguuggagugauc

SEQ ID NO: 58252 - RNA, 22 nt, Human
ggcaauauuauaagggcauuua

SEQ ID NO: 58253 - RNA, 22 nt, Human
ggauaaaugaaggcauacagau

SEQ ID NO: 58254 - RNA, 22 nt, Human
ggaggguggaggagggaauuga

SEQ ID NO: 58255 - RNA, 22 nt, Human
ggaggcggaaguccaagcaggu

SEQ ID NO: 58256 - RNA, 22 nt, Human
ggaggccagagaagagccaggc

SEQ ID NO: 58257 - RNA, 22 nt, Human
ggaggaugaggguggugguguu

SEQ ID NO: 58258 - RNA, 22 nt, Human
ggaggaagagaccagggggcuu

SEQ ID NO: 58259 - RNA, 22 nt, Human
gcgcugagcuuuucuuauugaa

SEQ ID NO: 58260 - RNA, 22 nt, Human
gcggaucuccuugagugggcaa

SEQ ID NO: 58261 - RNA, 22 nt, Human
gcggacaauggaagaugucauu

SEQ ID NO: 58262 - RNA, 22 nt, Human
gccuuuugcaaugguguuggug

SEQ ID NO: 58263 - RNA, 22 nt, Human
gccuucauuggaaucuagcuuc

SEQ ID NO: 58264 - RNA, 22 nt, Human
ggacagggagcaaaaacguccc

SEQ ID NO: 58265 - RNA, 22 nt, Human
gccugggguuugcggggcugca

SEQ ID NO: 58266 - RNA, 22 nt, Human
gccugggcuuccgggacccggg

SEQ ID NO: 58267 - RNA, 22 nt, Human
ggaaugcuuggcaugagaaccu

SEQ ID NO: 58268 - RNA, 22 nt, Human
gccugggccgggcgcggccccc

SEQ ID NO: 58269 - RNA, 22 nt, Human
ggaaucuucagccaugccaaga

SEQ ID NO: 58270 - RNA, 22 nt, Human
ggaagaggaagaugaggcagca

SEQ ID NO: 58271 - RNA, 22 nt, Human
ggaagaagagggagcuguggga

SEQ ID NO: 58272 - RNA, 19 nt, Human
ggaacgcugggcuccccuc

SEQ ID NO: 58273 - RNA, 22 nt, Human
gccugcugggcucuuccugcug

SEQ ID NO: 58274 - RNA, 22 nt, Human
gccugccucugacuggggcuga

SEQ ID NO: 58275 - RNA, 17 nt, Human
ggaagaaaaggaucauc

SEQ ID NO: 58276 - RNA, 22 nt, Human
gccugagucaagauguggcacc

SEQ ID NO: 58277 - RNA, 22 nt, Human
gccugagauuggacauuauuua

SEQ ID NO: 58278 - RNA, 22 nt, Human
ggaaagagaaacaugaacuaga

SEQ ID NO: 58279 - RNA, 22 nt, Human
ggaaaggaagggaaggagaugc

SEQ ID NO: 58280 - RNA, 22 nt, Human
ggaaaggacuggagcccagcgc

SEQ ID NO: 58281 - RNA, 22 nt, Human
gccucucuggcaaagcggugau

SEQ ID NO: 58282 - RNA, 22 nt, Human
gccuccgccuuccugucucccc

SEQ ID NO: 58283 - RNA, 22 nt, Human
gccuccggagucgcagugucuu

SEQ ID NO: 58284 - RNA, 22 nt, Human
gccuagaagaaugagcgcaggg

SEQ ID NO: 58285 - RNA, 22 nt, Human
gccggguguuccugggaagaug

SEQ ID NO: 58286 - RNA, 22 nt, Human
gccggcccugcgcggggcggaa

SEQ ID NO: 58287 - RNA, 22 nt, Human
gccggagagccaacaccacgga

SEQ ID NO: 58288 - RNA, 22 nt, Human
ggaaaaucaaaccauuuacagu

SEQ ID NO: 58289 - RNA, 22 nt, Human
ggaaaagccauauuauaggcaa

SEQ ID NO: 58290 - RNA, 22 nt, Human
gcuuuugagaaaguguuuuccc

SEQ ID NO: 58291 - RNA, 22 nt, Human
gcuuuuuaauuugcuucccugg

SEQ ID NO: 58292 - RNA, 22 nt, Human
gcuuuggcuucuccuggcagga

SEQ ID NO: 58293 - RNA, 22 nt, Human
gcuuuguucauuuaguuuuuuu

SEQ ID NO: 58294 - RNA, 22 nt, Human
gcuuuguugauggugagucugu

SEQ ID NO: 58295 - RNA, 22 nt, Human
gcuuuucucccugcuuucuucc

SEQ ID NO: 58296 - RNA, 22 nt, Human
gcuuucauuauguuguguuuuu

SEQ ID NO: 58297 - RNA, 22 nt, Human
gcuuucccaaccuucuugguau

SEQ ID NO: 58298 - RNA, 22 nt, Human
gcuuucagggucacugucaaca

SEQ ID NO: 58299 - RNA, 18 nt, Human
gcuuggguggcuauguuu

SEQ ID NO: 58300 - RNA, 22 nt, Human
gcuuguuuagcauaggucacug

SEQ ID NO: 58301 - RNA, 20 nt, Human
gcuugcggacagguggcuca

SEQ ID NO: 58302 - RNA, 20 nt, Human
gcuugaauuugauggccaga

SEQ ID NO: 58303 - RNA, 22 nt, Human
gccgcguggcagucuuggugac

SEQ ID NO: 58304 - RNA, 22 nt, Human
gccgccgccgccuuuguugcgg

SEQ ID NO: 58305 - RNA, 22 nt, Human
gccgccgcucaccugggcgccg

SEQ ID NO: 58306 - RNA, 22 nt, Human
gccgcagauucugagacgugua

SEQ ID NO: 58307 - RNA, 21 nt, Human
gccgaugugacucuacguagu

SEQ ID NO: 58308 - RNA, 22 nt, Human
gcuuaggcgcuccuuuucacuc

SEQ ID NO: 58309 - RNA, 21 nt, Human
gcuucaauucauccaccucuc

SEQ ID NO: 58310 - RNA, 22 nt, Human
gcuucucacccuuacuaucucu

SEQ ID NO: 58311 - RNA, 22 nt, Human
gcuguugcaaucaaggccaugg

SEQ ID NO: 58312 - RNA, 22 nt, Human
gcuguugagucagacaaguuuu

SEQ ID NO: 58313 - RNA, 22 nt, Human
gcuguuucuuuggcaaacugau

SEQ ID NO: 58314 - RNA, 22 nt, Human
gcccuguuauagucugaggccu

SEQ ID NO: 58315 - RNA, 22 nt, Human
gcccugucagcucucauggaca

SEQ ID NO: 58316 - RNA, 22 nt, Human
gcccuguguguuugcacugauu

SEQ ID NO: 58317 - RNA, 22 nt, Human
gcccugaaggccuccaggacuc

SEQ ID NO: 58318 - RNA, 22 nt, Human
gcccugccauugaucggcccag

SEQ ID NO: 58319 - RNA, 22 nt, Human
gcccuggcauuucuauucaugu

SEQ ID NO: 58320 - RNA, 22 nt, Human
gcugucauggacaugucuguuu

SEQ ID NO: 58321 - RNA, 22 nt, Human
gcccguuuagcaaacgccuccu

SEQ ID NO: 58322 - RNA, 22 nt, Human
gcuggugugagauucucgaggg

SEQ ID NO: 58323 - RNA, 22 nt, Human
gccccgcgcgcguagcgccgcu

SEQ ID NO: 58324 - RNA, 22 nt, Human
gcccccgccuugcugggccagg

SEQ ID NO: 58325 - RNA, 22 nt, Human
gcccccauuccugcggccuuca

SEQ ID NO: 58326 - RNA, 22 nt, Human
gcccgaccgcgccggcccgcac

SEQ ID NO: 58327 - RNA, 22 nt, Human
gcauuggaaacugcuuuaugcu

SEQ ID NO: 58328 - RNA, 22 nt, Human
gcauuagacuaguacacggcag

SEQ ID NO: 58329 - RNA, 20 nt, Human
gcucuucuccgggucugccu

SEQ ID NO: 58330 - RNA, 22 nt, Human
gcaugcaggaagggcuugggga

SEQ ID NO: 58331 - RNA, 18 nt, Human
gcugaaauucuaaacaaa

SEQ ID NO: 58332 - RNA, 23 nt, Human
gcugaagcccacucccugggucu

SEQ ID NO: 58333 - RNA, 22 nt, Human
gcucggcuggcucaucucaugu

SEQ ID NO: 58334 - RNA, 22 nt, Human
gcaugcuguuuggaaacgauaa

SEQ ID NO: 58335 - RNA, 22 nt, Human
gcaugcgugcgugcgugcaugu

SEQ ID NO: 58336 - RNA, 23 nt, Human
gcucauguugcuucuguucuguc

SEQ ID NO: 58337 - RNA, 22 nt, Human
gcucaugggcccagagcagccc

SEQ ID NO: 58338 - RNA, 22 nt, Human
gcauccugacuauggugguggu

SEQ ID NO: 58339 - RNA, 22 nt, Human
gcucagccuuuuguucuauuca

SEQ ID NO: 58340 - RNA, 20 nt, Human
gcucaguggagaaaugcacc

SEQ ID NO: 58341 - RNA, 22 nt, Human
gcuagcugugcuuggaaguuug

SEQ ID NO: 58342 - RNA, 22 nt, Human
gcuagaaacuguuuaaucucuu

SEQ ID NO: 58343 - RNA, 22 nt, Human
gcagugccauguggaggaucuc

SEQ ID NO: 58344 - RNA, 22 nt, Human
gcagucauggguagaacucaag

SEQ ID NO: 58345 - RNA, 22 nt, Human
gcaguauuguguguggucaugg

SEQ ID NO: 58346 - RNA, 22 nt, Human
gcaguaaauugagagucauguu

SEQ ID NO: 58347 - RNA, 22 nt, Human
gcgguuguucugugugcaugga

SEQ ID NO: 58348 - RNA, 22 nt, Human
gcagggcucuggagucaggcug

SEQ ID NO: 58349 - RNA, 22 nt, Human
gcaggagggggccuggagccca

SEQ ID NO: 58350 - RNA, 22 nt, Human
gcgggcgcuguggccccggccu

SEQ ID NO: 58351 - RNA, 22 nt, Human
gcgggcuuggcuccagggccca

SEQ ID NO: 58352 - RNA, 22 nt, Human
gcagcuuuggagguggaacucu

SEQ ID NO: 58353 - RNA, 20 nt, Human
gcgcuucccuacgcucugcu

SEQ ID NO: 58354 - RNA, 21 nt, Human
gcagcucaggauauagacuug

SEQ ID NO: 58355 - RNA, 22 nt, Human
gcgcucuccugcagacagccuc

SEQ ID NO: 58356 - RNA, 22 nt, Human
gcgcgggugagucacgggcgga

SEQ ID NO: 58357 - RNA, 22 nt, Human
gcgcgcucugcgaggacacgcu

SEQ ID NO: 58358 - RNA, 21 nt, Human
gcgcgcucgugcucgacgcgc

SEQ ID NO: 58359 - RNA, 22 nt, Human
gcgcgccugccucccgcggugc

SEQ ID NO: 58360 - RNA, 22 nt, Human
gcgccgacccucccugccggac

SEQ ID NO: 58361 - RNA, 20 nt, Human
gcgcaguuccgggcgcgucu

SEQ ID NO: 58362 - RNA, 22 nt, Human
gcgcggcgcggguccucggccu

SEQ ID NO: 58363 - RNA, 22 nt, Human
gcagauuggguacauaaacagu

SEQ ID NO: 58364 - RNA, 22 nt, Human
gcagcaauaaaacugaaggugu

SEQ ID NO: 58365 - RNA, 20 nt, Human
gcagcagacagacaggggac

SEQ ID NO: 58366 - RNA, 22 nt, Human
gcagaugagagugugaucuggg

SEQ ID NO: 58367 - RNA, 22 nt, Human
gcagagcacccugcagugguau

SEQ ID NO: 58368 - RNA, 22 nt, Human
gcacucugggucaucugcugcc

SEQ ID NO: 58369 - RNA, 22 nt, Human
gcacccagggcaggaagugagg

SEQ ID NO: 58370 - RNA, 22 nt, Human
gcacuaccaguaauuaaaucug

SEQ ID NO: 58371 - RNA, 22 nt, Human
gcaccauagagaagagacacaa

SEQ ID NO: 58372 - RNA, 22 nt, Human
gcacaggcugcacgaccccagc

SEQ ID NO: 58373 - RNA, 22 nt, Human
gccugcacucaaacacucucuu

SEQ ID NO: 58374 - RNA, 22 nt, Human
gcaauagccuacaugcgucaga

SEQ ID NO: 58375 - RNA, 18 nt, Human
gccucuguugacagaguu

SEQ ID NO: 58376 - RNA, 22 nt, Human
gauuuugaaccuuauuuggaaa

SEQ ID NO: 58377 - RNA, 22 nt, Human
gcccuuuuaucaacuccuagaa

SEQ ID NO: 58378 - RNA, 22 nt, Human
gauuuugcuuuagugaaggaag

SEQ ID NO: 58379 - RNA, 22 nt, Human
gcaaggaagcagaguugcuauc

SEQ ID NO: 58380 - RNA, 22 nt, Human
gcaaaaacaguguagucuucug

SEQ ID NO: 58381 - RNA, 22 nt, Human
gauuaucaccaaauggccuccu

SEQ ID NO: 58382 - RNA, 22 nt, Human
gauucagagcugcaacaaagaa

SEQ ID NO: 58383 - RNA, 20 nt, Human
gcccuucccccuccgcgagc

SEQ ID NO: 58384 - RNA, 22 nt, Human
gcccuggagauggaaguucuga

SEQ ID NO: 58385 - RNA, 22 nt, Human
gauguuuugaaagaagaauaca

SEQ ID NO: 58386 - RNA, 22 nt, Human
gauggggaaaaaauggaucuuu

SEQ ID NO: 58387 - RNA, 22 nt, Human
gauggugcaauuaucgugcaug

SEQ ID NO: 58388 - RNA, 22 nt, Human
gccccaaccccuccuuggucua

SEQ ID NO: 58389 - RNA, 23 nt, Human
gccaucugcugggugccccggcc

SEQ ID NO: 58390 - RNA, 22 nt, Human
gaugccggggucguagccgugg

SEQ ID NO: 58391 - RNA, 22 nt, Human
gccaggcagcagcgaggauggu

SEQ ID NO: 58392 - RNA, 18 nt, Human
gaugaagaggaagaggag

SEQ ID NO: 58393 - RNA, 22 nt, Human
gaucugguuccaggacauugca

SEQ ID NO: 58394 - RNA, 22 nt, Human
gauccagauauuugggcuggua

SEQ ID NO: 58395 - RNA, 22 nt, Human
gauccucagacccuccucuggu

SEQ ID NO: 58396 - RNA, 20 nt, Human
gccaaggaggagaaacaggc

SEQ ID NO: 58397 - RNA, 23 nt, Human
gcaugcccauauguguauauaua

SEQ ID NO: 58398 - RNA, 23 nt, Human
gcaucgcaggucuaagauuagcu

SEQ ID NO: 58399 - RNA, 22 nt, Human
gaguggugagaauacaacggaa

SEQ ID NO: 58400 - RNA, 22 nt, Human
gaguggcaaagagaacaaagau

SEQ ID NO: 58401 - RNA, 22 nt, Human
gagucaggucaggcuuguagau

SEQ ID NO: 58402 - RNA, 22 nt, Human
gcagguggaagcagcagacuca

SEQ ID NO: 58403 - RNA, 22 nt, Human
gaguaaggaaguguuggccaca

SEQ ID NO: 58404 - RNA, 22 nt, Human
gcaggggguaaggggcagggcu

SEQ ID NO: 58405 - RNA, 22 nt, Human
gcaggucacagcugauuggcca

SEQ ID NO: 58406 - RNA, 22 nt, Human
gaugaagaaacucaaccaagaa

SEQ ID NO: 58407 - RNA, 21 nt, Human
gaucgcaaugugggaaucaug

SEQ ID NO: 58408 - RNA, 22 nt, Human
gaucuguccuggcaguuaacac

SEQ ID NO: 58409 - RNA, 22 nt, Human
aaagagccaacuaccgcaaauu

SEQ ID NO: 58410 - RNA, 22 nt, Human
aaagaagugucuuacucccucu

SEQ ID NO: 58411 - RNA, 22 nt, Human
aaagaauuucaagauucccaca

SEQ ID NO: 58412 - RNA, 22 nt, Human
aaacugcuuucucugccuuucc

SEQ ID NO: 58413 - RNA, 22 nt, Human
aaaagcauuauuagucugggug

SEQ ID NO: 58414 - RNA, 22 nt, Human
aaaaggaagaguuuucagagac

SEQ ID NO: 58415 - RNA, 22 nt, Human
aaaaggauauuuggugcaaagc

SEQ ID NO: 58416 - RNA, 22 nt, Human
aaaauauguugagauacugaaa

SEQ ID NO: 58417 - RNA, 22 nt, Human
aaaccagaguucauaguauuca

SEQ ID NO: 58418 - RNA, 21 nt, Human
aauuauuugcauuuuucuugu

SEQ ID NO: 58419 - RNA, 22 nt, Human
aaugcgcagaguggugugugca

SEQ ID NO: 58420 - RNA, 22 nt, Human
aaugcuaaagaagaaggaguag

SEQ ID NO: 58421 - RNA, 22 nt, Human
aauggagaaaagacaauguuga

SEQ ID NO: 58422 - RNA, 22 nt, Human
aauggcagauaauuuuccagau

SEQ ID NO: 58423 - RNA, 22 nt, Human
aaugguggaugucuguucugac

SEQ ID NO: 58424 - RNA, 22 nt, Human
aauggugaggagugcauugaga

SEQ ID NO: 58425 - RNA, 22 nt, Human
aaugacagccuauacugucugc

SEQ ID NO: 58426 - RNA, 22 nt, Human
aaugaaaaucugucaguucaag

SEQ ID NO: 58427 - RNA, 22 nt, Human
aaugcagaugugucuuuaauuu

SEQ ID NO: 58428 - RNA, 22 nt, Human
aaucgguugaacccaggaagug

SEQ ID NO: 58429 - RNA, 22 nt, Human
aauaacuuaaugacuguguaca

SEQ ID NO: 58430 - RNA, 22 nt, Human
aauagagacaguuuaacaauau

SEQ ID NO: 58431 - RNA, 22 nt, Human
aauauauaugggugcaugucug

SEQ ID NO: 58432 - RNA, 23 nt, Human
aaguggugacugugcuacugaga

SEQ ID NO: 58433 - RNA, 22 nt, Human
aaguggugagacccugcugaaa

SEQ ID NO: 58434 - RNA, 22 nt, Human
aaguggcaggggaaggguugga

SEQ ID NO: 58435 - RNA, 22 nt, Human
aaguagccuguuauguaguuca

SEQ ID NO: 58436 - RNA, 22 nt, Human
aaguguggguaagcauuucuug

SEQ ID NO: 58437 - RNA, 22 nt, Human
aaggucuuggcucuggccgcac

SEQ ID NO: 58438 - RNA, 22 nt, Human
aaggucucucgggcuuugcuga

SEQ ID NO: 58439 - RNA, 22 nt, Human
aagguuuuguuuucgguuuuuu

SEQ ID NO: 58440 - RNA, 22 nt, Human
aagguguaaguagcugguucau

SEQ ID NO: 58441 - RNA, 22 nt, Human
aaggggggcaccugcaugcccg

SEQ ID NO: 58442 - RNA, 22 nt, Human
aagggccuccuggggagccugg

SEQ ID NO: 58443 - RNA, 22 nt, Human
aagggaauagagcagcaaaaau

SEQ ID NO: 58444 - RNA, 22 nt, Human
aagggaaacagccaggcccugu

SEQ ID NO: 58445 - RNA, 22 nt, Human
aagggaaggaugggcauuuaca

SEQ ID NO: 58446 - RNA, 22 nt, Human
aagggaggguaggaagagggag

SEQ ID NO: 58447 - RNA, 22 nt, Human
aagggcuucucgccugugugca

SEQ ID NO: 58448 - RNA, 22 nt, Human
aaggcgccacagugauugcaaa

SEQ ID NO: 58449 - RNA, 22 nt, Human
aaggcgguuccgguucgcggcg

SEQ ID NO: 58450 - RNA, 22 nt, Human
aaggcgauuuaaagauguuagg

SEQ ID NO: 58451 - RNA, 22 nt, Human
aaggcggcggcggcggcugcgg

SEQ ID NO: 58452 - RNA, 22 nt, Human
aaggcuguuugagcacuggagc

SEQ ID NO: 58453 - RNA, 22 nt, Human
aaggcuuguugucacgcucuug

SEQ ID NO: 58454 - RNA, 22 nt, Human
aaggccacacuugcuggccagc

SEQ ID NO: 58455 - RNA, 22 nt, Human
aaggcacauauuuuagagucac

SEQ ID NO: 58456 - RNA, 22 nt, Human
aaggcacuugcccagagcugca

SEQ ID NO: 58457 - RNA, 22 nt, Human
aaggauguuuaaacuacuuucc

SEQ ID NO: 58458 - RNA, 22 nt, Human
aagcgcggccgccgcggucgcu

SEQ ID NO: 58459 - RNA, 22 nt, Human
aaggaucuuucuuuuuaccauu

SEQ ID NO: 58460 - RNA, 22 nt, Human
aagcauaucaaguuuuaugugc

SEQ ID NO: 58461 - RNA, 22 nt, Human
aagauucaguugguuuuggaaa

SEQ ID NO: 58462 - RNA, 22 nt, Human
aagauuugaaaguggugcauuu

SEQ ID NO: 58463 - RNA, 22 nt, Human
aagcauuuuagauaaagcauca

SEQ ID NO: 58464 - RNA, 22 nt, Human
aagccagccaguuccagcagcu

SEQ ID NO: 58465 - RNA, 22 nt, Human
aagccgagggaggugauggaga

SEQ ID NO: 58466 - RNA, 21 nt, Human
aagcagcugcagaauuucagu

SEQ ID NO: 58467 - RNA, 22 nt, Human
aagcagaaaaacugagcuccaa

SEQ ID NO: 58468 - RNA, 21 nt, Human
aagagcgccgggcagggcuga

SEQ ID NO: 58469 - RNA, 22 nt, Human
aagaggacagucaaauggccgg

SEQ ID NO: 58470 - RNA, 22 nt, Human
aagagcuuguuaugcugcucuu

SEQ ID NO: 58471 - RNA, 22 nt, Human
aagaaggcggaccagaagggag

SEQ ID NO: 58472 - RNA, 22 nt, Human
aagaagguugaaugacuacuuu

SEQ ID NO: 58473 - RNA, 22 nt, Human
aagaaaggcacaagaaagaaaa

SEQ ID NO: 58474 - RNA, 22 nt, Human
aacuuucagaauccuaugcauu

SEQ ID NO: 58475 - RNA, 21 nt, Human
aacuuucccaauccagauuug

SEQ ID NO: 58476 - RNA, 22 nt, Human
aacuucuggaaacuuccaugug

SEQ ID NO: 58477 - RNA, 19 nt, Human
aacucugccgaggcaagcc

SEQ ID NO: 58478 - RNA, 22 nt, Human
aacucugcaaugaaaucauguu

SEQ ID NO: 58479 - RNA, 22 nt, Human
aacgccgggacucgcagggagc

SEQ ID NO: 58480 - RNA, 22 nt, Human
aacgcugugcacuggguccagg

SEQ ID NO: 58481 - RNA, 22 nt, Human
aacccuguuguguacaugcaua

SEQ ID NO: 58482 - RNA, 22 nt, Human
aaccggauugauccuucuuuga

SEQ ID NO: 58483 - RNA, 22 nt, Human
aaccucgggcugcacuuggcac

SEQ ID NO: 58484 - RNA, 22 nt, Human
aaccaaguaaagagguuucauu

SEQ ID NO: 58485 - RNA, 22 nt, Human
aaccguguucgggaacacuugu

SEQ ID NO: 58486 - RNA, 22 nt, Human
aacaugggcaacuucuuuucag

SEQ ID NO: 58487 - RNA, 22 nt, Human
aaccaggcgagagagcggucag

SEQ ID NO: 58488 - RNA, 22 nt, Human
aaccagaagucaucagagcuga

SEQ ID NO: 58489 - RNA, 22 nt, Human
aacagguucaucuuggaagcag

SEQ ID NO: 58490 - RNA, 22 nt, Human
aaauucggggaguuuugaggau

SEQ ID NO: 58491 - RNA, 22 nt, Human
aaauucuuccaggaggaaauac

SEQ ID NO: 58492 - RNA, 20 nt, Human
aaauucgacuaaaaccagaa

SEQ ID NO: 58493 - RNA, 22 nt, Human
aaauggauaaucaagauaauca

SEQ ID NO: 58494 - RNA, 22 nt, Human
aaaugggagucacacagguuua

SEQ ID NO: 58495 - RNA, 22 nt, Human
agucccugauggacuggaugag

SEQ ID NO: 58496 - RNA, 22 nt, Human
agucggggagcgugaccagaga

SEQ ID NO: 58497 - RNA, 22 nt, Human
aguccagggcuuagucagcggg

SEQ ID NO: 58498 - RNA, 22 nt, Human
agucagcuuggaacuuuuuucc

SEQ ID NO: 58499 - RNA, 22 nt, Human
agucaagguggaccagaaaaau

SEQ ID NO: 58500 - RNA, 22 nt, Human
agucaggggaucuagacuugaa

SEQ ID NO: 58501 - RNA, 22 nt, Human
agucaaaaaaccuagaaacacc

SEQ ID NO: 58502 - RNA, 22 nt, Human
aguauugguaaguguagcaaau

SEQ ID NO: 58503 - RNA, 22 nt, Human
aguaaaggaaggaagggacagc

SEQ ID NO: 58504 - RNA, 22 nt, Human
agguggucuuguggaugccgca

SEQ ID NO: 58505 - RNA, 22 nt, Human
agguggucccaauggcugggca

SEQ ID NO: 58506 - RNA, 22 nt, Human
aggucuugguaggccagagucu

SEQ ID NO: 58507 - RNA, 22 nt, Human
aggugagaacguggaggggcgg

SEQ ID NO: 58508 - RNA, 22 nt, Human
aguaucugccagaaucucaguu

SEQ ID NO: 58509 - RNA, 23 nt, Human
aguaucuugguguggugcagaga

SEQ ID NO: 58510 - RNA, 22 nt, Human
aguaucuuccucaugaacacgu

SEQ ID NO: 58511 - RNA, 22 nt, Human
aggugcagcugguggagucugg

SEQ ID NO: 58512 - RNA, 22 nt, Human
aggguuuucauauauuauuagu

SEQ ID NO: 58513 - RNA, 22 nt, Human
agguagggaggguagaugcucu

SEQ ID NO: 58514 - RNA, 22 nt, Human
aggggcagaggaugauggaaga

SEQ ID NO: 58515 - RNA, 22 nt, Human
agggggaaaauguggauuaugg

SEQ ID NO: 58516 - RNA, 22 nt, Human
aggggaggcugcgggcugccgu

SEQ ID NO: 58517 - RNA, 22 nt, Human
agggcuugggggccuugaaggc

SEQ ID NO: 58518 - RNA, 22 nt, Human
aggggagaguuaaugugaaugu

SEQ ID NO: 58519 - RNA, 22 nt, Human
aggggaguuauuagacagggag

SEQ ID NO: 58520 - RNA, 22 nt, Human
agggcgugguggugcuggagca

SEQ ID NO: 58521 - RNA, 22 nt, Human
agggccggggagggcugugggg

SEQ ID NO: 58522 - RNA, 22 nt, Human
agggaccgugagcuccuugggg

SEQ ID NO: 58523 - RNA, 22 nt, Human
agggaaguucuagggagucugg

SEQ ID NO: 58524 - RNA, 22 nt, Human
agggagcugcucugcuuccgug

SEQ ID NO: 58525 - RNA, 22 nt, Human
agggaguagggagccaugggug

SEQ ID NO: 58526 - RNA, 22 nt, Human
aggcuucaaggacagcagccac

SEQ ID NO: 58527 - RNA, 21 nt, Human
aggcuuggaucuagacaggcc

SEQ ID NO: 58528 - RNA, 22 nt, Human
aggcuucauuacagugguucaa

SEQ ID NO: 58529 - RNA, 22 nt, Human
aggcugucucagccugcuugca

SEQ ID NO: 58530 - RNA, 19 nt, Human
aggcugccucacccucccu

SEQ ID NO: 58531 - RNA, 22 nt, Human
aggcugccuaugaaggcagaag

SEQ ID NO: 58532 - RNA, 23 nt, Human
aggcugccacucagggugaggcu

SEQ ID NO: 58533 - RNA, 22 nt, Human
aggccugcuccucuucucaucc

SEQ ID NO: 58534 - RNA, 22 nt, Human
aggccugcccuuggggagccuu

SEQ ID NO: 58535 - RNA, 22 nt, Human
aggccgcuggggcagcgcccga

SEQ ID NO: 58536 - RNA, 23 nt, Human
aggcugcagaagaauagggucau

SEQ ID NO: 58537 - RNA, 22 nt, Human
aggcugaagcacacucaugcag

SEQ ID NO: 58538 - RNA, 22 nt, Human
aggcguggcuucugcuggguug

SEQ ID NO: 58539 - RNA, 22 nt, Human
aggcgguuggcuuugucugggu

SEQ ID NO: 58540 - RNA, 22 nt, Human
aggcgagcgcggccggugcccc

SEQ ID NO: 58541 - RNA, 22 nt, Human
aggccgguggaggagguggagg

SEQ ID NO: 58542 - RNA, 22 nt, Human
aggccgagaugacagagccacu

SEQ ID NO: 58543 - RNA, 22 nt, Human
aggcccugcugaggccucccuc

SEQ ID NO: 58544 - RNA, 22 nt, Human
aggcccagcaccagcggucuuc

SEQ ID NO: 58545 - RNA, 22 nt, Human
aggagcccaaagcacuuggcug

SEQ ID NO: 58546 - RNA, 22 nt, Human
aggauagacuucagaaggcaua

SEQ ID NO: 58547 - RNA, 22 nt, Human
aggagcacugggcaugucaccc

SEQ ID NO: 58548 - RNA, 22 nt, Human
aggaagucucucaaaacuggaa

SEQ ID NO: 58549 - RNA, 22 nt, Human
aggaagccuggaguccugccca

SEQ ID NO: 58550 - RNA, 20 nt, Human
aggaaggagaaucugagcaa

SEQ ID NO: 58551 - RNA, 23 nt, Human
aggaagucugacacuacagcguu

SEQ ID NO: 58552 - RNA, 22 nt, Human
aggaaagacgcauuucuguagg

SEQ ID NO: 58553 - RNA, 22 nt, Human
aggaaaggcucugugguuccua

SEQ ID NO: 58554 - RNA, 22 nt, Human
agcuugaugaaagugggugcuc

SEQ ID NO: 58555 - RNA, 22 nt, Human
agcuuugcugcuggagaagggu

SEQ ID NO: 58556 - RNA, 22 nt, Human
agcuuccaaagaccaggauuga

SEQ ID NO: 58557 - RNA, 22 nt, Human
agcuucccaggagaucuccgcc

SEQ ID NO: 58558 - RNA, 19 nt, Human
agcuuauuuacugcaggac

SEQ ID NO: 58559 - RNA, 22 nt, Human
agcugugccuauucguggcaag

SEQ ID NO: 58560 - RNA, 22 nt, Human
agcugugaccaguuacgaaauu

SEQ ID NO: 58561 - RNA, 22 nt, Human
agcuggauuaaucacagugacu

SEQ ID NO: 58562 - RNA, 22 nt, Human
agcuggaaucucggcaaagcgu

SEQ ID NO: 58563 - RNA, 22 nt, Human
agcugcuuuacuggucggcugg

SEQ ID NO: 58564 - RNA, 22 nt, Human
agcugcugcaaguggugcuaac

SEQ ID NO: 58565 - RNA, 22 nt, Human
agcugcauguauauucuuaaca

SEQ ID NO: 58566 - RNA, 22 nt, Human
agcugcauucguaucauauugu

SEQ ID NO: 58567 - RNA, 22 nt, Human
agcuuggcaagcacuguuugag

SEQ ID NO: 58568 - RNA, 22 nt, Human
agcuuucuauauaugaguugcu

SEQ ID NO: 58569 - RNA, 22 nt, Human
agcuuucaagaaauugucacaa

SEQ ID NO: 58570 - RNA, 22 nt, Human
agcuugauggauugcugaggca

SEQ ID NO: 58571 - RNA, 22 nt, Human
agcuugcccuuguaccagccag

SEQ ID NO: 58572 - RNA, 20 nt, Human
agcuggcccccgguggccug

SEQ ID NO: 58573 - RNA, 22 nt, Human
agcugcuaagcugcauaacuua

SEQ ID NO: 58574 - RNA, 22 nt, Human
agcugugaccuucaagagcuac

SEQ ID NO: 58575 - RNA, 19 nt, Human
agcugcugauugguggagg

SEQ ID NO: 58576 - RNA, 22 nt, Human
agcugcuggcggauguuggacu

SEQ ID NO: 58577 - RNA, 22 nt, Human
agcucuucugacucuaggcuca

SEQ ID NO: 58578 - RNA, 22 nt, Human
agcucuuccuccauucuggcca

SEQ ID NO: 58579 - RNA, 22 nt, Human
agcucggcuguccugugccccu

SEQ ID NO: 58580 - RNA, 19 nt, Human
agcucaggcccaucguccc

SEQ ID NO: 58581 - RNA, 22 nt, Human
agcggugacauccuucugugcu

SEQ ID NO: 58582 - RNA, 22 nt, Human
agcggcucaggccccgugggcu

SEQ ID NO: 58583 - RNA, 22 nt, Human
agcgucaugugaccagcgcgcc

SEQ ID NO: 58584 - RNA, 22 nt, Human
agcgggucaugucggccgccca

SEQ ID NO: 58585 - RNA, 22 nt, Human
agcggccucgcugccugcucag

SEQ ID NO: 58586 - RNA, 22 nt, Human
agcggcaggacgucuucuucga

SEQ ID NO: 58587 - RNA, 22 nt, Human
agcggcgcgucuccgagcugga

SEQ ID NO: 58588 - RNA, 22 nt, Human
agcggaggaggcggagcaggga

SEQ ID NO: 58589 - RNA, 22 nt, Human
agcgagccugugcacuucuaac

SEQ ID NO: 58590 - RNA, 22 nt, Human
agcgcggccuuacacccagggg

SEQ ID NO: 58591 - RNA, 22 nt, Human
agcgcgcggggcugcggcaggg

SEQ ID NO: 58592 - RNA, 22 nt, Human
agcgcaguuaccgcgcggggcu

SEQ ID NO: 58593 - RNA, 22 nt, Human
agcgcccguugagucgcgcggu

SEQ ID NO: 58594 - RNA, 22 nt, Human
agcgacuugacagacauguccu

SEQ ID NO: 58595 - RNA, 22 nt, Human
agccuucccuuucaacaauuug

SEQ ID NO: 58596 - RNA, 22 nt, Human
agccuugcaugauuucauucau

SEQ ID NO: 58597 - RNA, 22 nt, Human
agcgaaaagaauggaguggagu

SEQ ID NO: 58598 - RNA, 22 nt, Human
agccgcgcuguuccugcugcug

SEQ ID NO: 58599 - RNA, 22 nt, Human
agccgauaaauuguuuucuugg

SEQ ID NO: 58600 - RNA, 22 nt, Human
agcccuuucuuguuuaacugca

SEQ ID NO: 58601 - RNA, 22 nt, Human
agccgcugaauuugaaacaagc

SEQ ID NO: 58602 - RNA, 22 nt, Human
agcauuuuaaaacuaguuacca

SEQ ID NO: 58603 - RNA, 22 nt, Human
agcauuucuacugugucagaaa

SEQ ID NO: 58604 - RNA, 21 nt, Human
agccagguuuccuuugaagag

SEQ ID NO: 58605 - RNA, 22 nt, Human
agcaugaauugccauuuauuaa

SEQ ID NO: 58606 - RNA, 22 nt, Human
agccacggcaaugauaggcugc

SEQ ID NO: 58607 - RNA, 19 nt, Human
agcaguggagccaugccug

SEQ ID NO: 58608 - RNA, 22 nt, Human
agcaguucucugucuagcuaga

SEQ ID NO: 58609 - RNA, 22 nt, Human
agcaguugcuuuguauauuaaa

SEQ ID NO: 58610 - RNA, 22 nt, Human
agcauucuguggucuucuaugg

SEQ ID NO: 58611 - RNA, 22 nt, Human
agcauuugcuguucuagaaagu

SEQ ID NO: 58612 - RNA, 21 nt, Human
agcaucugaggcaguuuccua

SEQ ID NO: 58613 - RNA, 22 nt, Human
agcaguuuauccucauaaugga

SEQ ID NO: 58614 - RNA, 21 nt, Human
agcagucugcggccggugcgg

SEQ ID NO: 58615 - RNA, 22 nt, Human
agcaggagagacuggcccaaaa

SEQ ID NO: 58616 - RNA, 22 nt, Human
agcagccgccgccgccgcgcac

SEQ ID NO: 58617 - RNA, 22 nt, Human
agagggcugugcuaaauuucag

SEQ ID NO: 58618 - RNA, 22 nt, Human
agaggcaugaacucccguagcc

SEQ ID NO: 58619 - RNA, 23 nt, Human
agaggccaacuucuugccccucc

SEQ ID NO: 58620 - RNA, 23 nt, Human
agagggaagagcuuagaugggga

SEQ ID NO: 58621 - RNA, 22 nt, Human
agagcagcuuuucggaaccacu

SEQ ID NO: 58622 - RNA, 22 nt, Human
agagcuuagaggaccuucgugc

SEQ ID NO: 58623 - RNA, 22 nt, Human
agagcuuuggaguaaguuuuga

SEQ ID NO: 58624 - RNA, 22 nt, Human
agagcagcaaucuuugaaauua

SEQ ID NO: 58625 - RNA, 22 nt, Human
agagcagaggcauggccguggg

SEQ ID NO: 58626 - RNA, 22 nt, Human
agagaaccauggcauccaggua

SEQ ID NO: 58627 - RNA, 19 nt, Human
agacugaagggcccgaguc

SEQ ID NO: 58628 - RNA, 22 nt, Human
agacugugagaagauggcugcg

SEQ ID NO: 58629 - RNA, 22 nt, Human
agagaacaggcagcuggugccg

SEQ ID NO: 58630 - RNA, 22 nt, Human
agacgcgcagaaggaagcggcc

SEQ ID NO: 58631 - RNA, 22 nt, Human
agacccugauucugcuggcggu

SEQ ID NO: 58632 - RNA, 20 nt, Human
agacauugaggagagagcau

SEQ ID NO: 58633 - RNA, 22 nt, Human
agacuggagucuccuuuggagc

SEQ ID NO: 58634 - RNA, 21 nt, Human
agaaugaagaagaggucuuug

SEQ ID NO: 58635 - RNA, 22 nt, Human
agaaggcagaaaagcuuuacaa

SEQ ID NO: 58636 - RNA, 22 nt, Human
agacagaaaaguugucaaucau

SEQ ID NO: 58637 - RNA, 22 nt, Human
agaagcaaagcaaacacauucu

SEQ ID NO: 58638 - RNA, 22 nt, Human
agaaauggccagacuugccccu

SEQ ID NO: 58639 - RNA, 21 nt, Human
agaagcggucgaaucgcagac

SEQ ID NO: 58640 - RNA, 22 nt, Human
agaacaagaaacccgaaaagug

SEQ ID NO: 58641 - RNA, 22 nt, Human
agaacaggaggaagccagcucc

SEQ ID NO: 58642 - RNA, 22 nt, Human
agaaaagagacaauguuuuugg

SEQ ID NO: 58643 - RNA, 22 nt, Human
acuuggcuaggguuuuuaucuu

SEQ ID NO: 58644 - RNA, 22 nt, Human
acuuugucuugaucaaaggugu

SEQ ID NO: 58645 - RNA, 22 nt, Human
acuuugugaauagaacuggaug

SEQ ID NO: 58646 - RNA, 22 nt, Human
acuuuuccuggguagcuccugg

SEQ ID NO: 58647 - RNA, 22 nt, Human
acugugauguaaagaaauaggc

SEQ ID NO: 58648 - RNA, 22 nt, Human
acuguugcuuguuuggaauguu

SEQ ID NO: 58649 - RNA, 22 nt, Human
acugugcaugaaccgaaacaaa

SEQ ID NO: 58650 - RNA, 22 nt, Human
acuguucacccagcacuagcag

SEQ ID NO: 58651 - RNA, 22 nt, Human
acuguugagggaagcagaugaa

SEQ ID NO: 58652 - RNA, 22 nt, Human
acugugacugugucuucugggc

SEQ ID NO: 58653 - RNA, 22 nt, Human
acuggugcucuggccaccgcug

SEQ ID NO: 58654 - RNA, 22 nt, Human
acuguccucgaaguaccugugc

SEQ ID NO: 58655 - RNA, 22 nt, Human
acugugaagagcauucuggcug

SEQ ID NO: 58656 - RNA, 21 nt, Human
acugggcuagccugacuucug

SEQ ID NO: 58657 - RNA, 22 nt, Human
acugguuucaaguuggacugaa

SEQ ID NO: 58658 - RNA, 22 nt, Human
acuggcgucugucuccccugcc

SEQ ID NO: 58659 - RNA, 22 nt, Human
acuggcaugauagaccauaaca

SEQ ID NO: 58660 - RNA, 19 nt, Human
acugggaugggcagugcca

SEQ ID NO: 58661 - RNA, 22 nt, Human
acugggcaaggauaugaugggu

SEQ ID NO: 58662 - RNA, 22 nt, Human
acuggagcccguggaggcgcag

SEQ ID NO: 58663 - RNA, 20 nt, Human
acugcaagagacagaugaaa

SEQ ID NO: 58664 - RNA, 22 nt, Human
acugccauauuaggagcuucag

SEQ ID NO: 58665 - RNA, 22 nt, Human
acggggagcgucggccucuccc

SEQ ID NO: 58666 - RNA, 22 nt, Human
acgguuuugugagguaguacuu

SEQ ID NO: 58667 - RNA, 22 nt, Human
acgucaucguugucaucgucau

SEQ ID NO: 58668 - RNA, 22 nt, Human
acggcggguuccgggccagccc

SEQ ID NO: 58669 - RNA, 22 nt, Human
acggccgaugacuccagcaugg

SEQ ID NO: 58670 - RNA, 22 nt, Human
accuugggcccagaccggcacg

SEQ ID NO: 58671 - RNA, 20 nt, Human
accuucuuugguagacggaa

SEQ ID NO: 58672 - RNA, 19 nt, Human
accuguucaaccucgugcu

SEQ ID NO: 58673 - RNA, 22 nt, Human
accugguuucuuacccaagaga

SEQ ID NO: 58674 - RNA, 22 nt, Human
acgcaacacugcuauuuuuuuc

SEQ ID NO: 58675 - RNA, 22 nt, Human
acgaaugacaugugauuugaaa

SEQ ID NO: 58676 - RNA, 22 nt, Human
accuucugaccucucggacuuc

SEQ ID NO: 58677 - RNA, 22 nt, Human
accuggauauuuucaguugcau

SEQ ID NO: 58678 - RNA, 22 nt, Human
accuggcccugggucuccugac

SEQ ID NO: 58679 - RNA, 22 nt, Human
accugaucugagaaguggaggg

SEQ ID NO: 58680 - RNA, 22 nt, Human
accgguucccaucuggagaguu

SEQ ID NO: 58681 - RNA, 22 nt, Human
accgggcagcucugccccugcc

SEQ ID NO: 58682 - RNA, 22 nt, Human
accgcuggcacuggggacgggg

SEQ ID NO: 58683 - RNA, 22 nt, Human
accugaccagguggcuucccaa

SEQ ID NO: 58684 - RNA, 22 nt, Human
accgagcaggguguuugcgcac

SEQ ID NO: 58685 - RNA, 22 nt, Human
acccuuucgagauuucugccuu

SEQ ID NO: 58686 - RNA, 22 nt, Human
acccugacggugggcagcuuga

SEQ ID NO: 58687 - RNA, 22 nt, Human
accgucagguuagaaugagcac

SEQ ID NO: 58688 - RNA, 23 nt, Human
accgccgcugccgccgcccccgc

SEQ ID NO: 58689 - RNA, 22 nt, Human
accgauguggaaaauuucauuu

SEQ ID NO: 58690 - RNA, 22 nt, Human
accgauuucaaauggugcuaga

SEQ ID NO: 58691 - RNA, 19 nt, Human
accauggguguguuaagaa

SEQ ID NO: 58692 - RNA, 22 nt, Human
accagcgcguuuucaguuucau

SEQ ID NO: 58693 - RNA, 22 nt, Human
accaggcagcaccaaagccggu

SEQ ID NO: 58694 - RNA, 22 nt, Human
accagguugagacuucggcuuu

SEQ ID NO: 58695 - RNA, 22 nt, Human
acccggccuacucagugcccag

SEQ ID NO: 58696 - RNA, 21 nt, Human
acccagaauggagccaagccu

SEQ ID NO: 58697 - RNA, 22 nt, Human
accaguucuauguagauaauga

SEQ ID NO: 58698 - RNA, 22 nt, Human
acauuuuguuuauggaaaagau

SEQ ID NO: 58699 - RNA, 22 nt, Human
accacguccugguggcuguugg

SEQ ID NO: 58700 - RNA, 22 nt, Human
accagccacacacauuagucac

SEQ ID NO: 58701 - RNA, 22 nt, Human
acaugguguggcacuaggggcu

SEQ ID NO: 58702 - RNA, 22 nt, Human
acauggguuaaagaagauggaa

SEQ ID NO: 58703 - RNA, 22 nt, Human
accaaucugguauauuccagaa

SEQ ID NO: 58704 - RNA, 22 nt, Human
acauuauuguguagugugggca

SEQ ID NO: 58705 - RNA, 22 nt, Human
acauugcagcuccuaccuuguc

SEQ ID NO: 58706 - RNA, 22 nt, Human
acaugggggugggacggcagag

SEQ ID NO: 58707 - RNA, 22 nt, Human
acaugggcaaucgcuuuauuca

SEQ ID NO: 58708 - RNA, 22 nt, Human
acauggaauuucagaagagcau

SEQ ID NO: 58709 - RNA, 22 nt, Human
acauuguuauuccucaggaguu

SEQ ID NO: 58710 - RNA, 22 nt, Human
acauuguuuuugugacuucuau

SEQ ID NO: 58711 - RNA, 22 nt, Human
acauguggaggaggcgagggua

SEQ ID NO: 58712 - RNA, 22 nt, Human
acaucuaugucugaggccuugg

SEQ ID NO: 58713 - RNA, 22 nt, Human
acauagcuuaaaugagaagaua

SEQ ID NO: 58714 - RNA, 22 nt, Human
acaguuuuccuugguauagaac

SEQ ID NO: 58715 - RNA, 22 nt, Human
acauggaccucagauccuggcc

SEQ ID NO: 58716 - RNA, 22 nt, Human
acauggggaaaaaggccugcuc

SEQ ID NO: 58717 - RNA, 22 nt, Human
acauggaaacacgcagccccaa

SEQ ID NO: 58718 - RNA, 22 nt, Human
aauucuuuguuccucugccaag

SEQ ID NO: 58719 - RNA, 22 nt, Human
aauugccaagaauuagugauac

SEQ ID NO: 58720 - RNA, 22 nt, Human
aauucgcugcauuccaucuagg

SEQ ID NO: 58721 - RNA, 22 nt, Human
gaagaaggaagaucaugcuuga

SEQ ID NO: 58722 - RNA, 22 nt, Human
gagcaggcuggcagggccaggg

SEQ ID NO: 58723 - RNA, 22 nt, Human
gagcagcacagaccaaacagaa

SEQ ID NO: 58724 - RNA, 22 nt, Human
gaacaugaguuuuaugguauuu

SEQ ID NO: 58725 - RNA, 22 nt, Human
gagcacuucagcauaaaucaca

SEQ ID NO: 58726 - RNA, 22 nt, Human
gaacaaggauucccaaagaaga

SEQ ID NO: 58727 - RNA, 22 nt, Human
gaacagauucaucuaguggcua

SEQ ID NO: 58728 - RNA, 22 nt, Human
gaacauauuuagcaccuaauau

SEQ ID NO: 58729 - RNA, 22 nt, Human
gagauuugaguuccuacugagu

SEQ ID NO: 58730 - RNA, 22 nt, Human
gagaguuggaggguauguuagu

SEQ ID NO: 58731 - RNA, 22 nt, Human
gagauggauuuuuuugccaguc

SEQ ID NO: 58732 - RNA, 22 nt, Human
gagauuucauuugugaggcuca

SEQ ID NO: 58733 - RNA, 22 nt, Human
gaacaaaagauagcccaaacau

SEQ ID NO: 58734 - RNA, 22 nt, Human
gaaaugggggcaugcguuacau

SEQ ID NO: 58735 - RNA, 22 nt, Human
gaaauuucuuuguuaucuuggu

SEQ ID NO: 58736 - RNA, 22 nt, Human
gaaagugaauguaacauguuau

SEQ ID NO: 58737 - RNA, 22 nt, Human
gagaaugagucagagcuggcug

SEQ ID NO: 58738 - RNA, 22 nt, Human
gagaauaauaauaggcauggug

SEQ ID NO: 58739 - RNA, 22 nt, Human
gaaaggagacugcacuggagcc

SEQ ID NO: 58740 - RNA, 22 nt, Human
gaaaaggaggggaggcagaugg

SEQ ID NO: 58741 - RNA, 22 nt, Human
gacuucaucagagcguacuguu

SEQ ID NO: 58742 - RNA, 22 nt, Human
gacggagugcgcuugcuguuca

SEQ ID NO: 58743 - RNA, 22 nt, Human
gacggggcagccagcugguggc

SEQ ID NO: 58744 - RNA, 20 nt, Human
gacgaacuagaacaguggua

SEQ ID NO: 58745 - RNA, 21 nt, Human
cuuuucuagucccagccccgc

SEQ ID NO: 58746 - RNA, 22 nt, Human
cuuuucauuucauggaauacaa

SEQ ID NO: 58747 - RNA, 22 nt, Human
cuuuucaaacaggacagguccu

SEQ ID NO: 58748 - RNA, 22 nt, Human
gacccggauguuguacucgagg

SEQ ID NO: 58749 - RNA, 22 nt, Human
gacccgacaaguaaucagguga

SEQ ID NO: 58750 - RNA, 22 nt, Human
gacauugaauugaauccagauu

SEQ ID NO: 58751 - RNA, 22 nt, Human
cuuguuuggccauaggugcugg

SEQ ID NO: 58752 - RNA, 22 nt, Human
cuuggugcgaagagucagggga

SEQ ID NO: 58753 - RNA, 22 nt, Human
gaaugccugggguucuucgauc

SEQ ID NO: 58754 - RNA, 22 nt, Human
cuugcugggagagcuuuagaga

SEQ ID NO: 58755 - RNA, 22 nt, Human
cuuggcacccaucuuuccaccu

SEQ ID NO: 58756 - RNA, 22 nt, Human
cuucuuucuuuucuucuucucu

SEQ ID NO: 58757 - RNA, 22 nt, Human
cuucuuuucuacuggccuagaa

SEQ ID NO: 58758 - RNA, 22 nt, Human
gaauaauuuugaucagaaggga

SEQ ID NO: 58759 - RNA, 22 nt, Human
gaaucucuuugucccugaguuu

SEQ ID NO: 58760 - RNA, 22 nt, Human
cuugccuuugaaagcauuucuc

SEQ ID NO: 58761 - RNA, 22 nt, Human
cuugcucugggaauaugaguuu

SEQ ID NO: 58762 - RNA, 22 nt, Human
gaagcuccaggaugccugcacu

SEQ ID NO: 58763 - RNA, 22 nt, Human
gaagcucaguugcuuagaucuc

SEQ ID NO: 58764 - RNA, 22 nt, Human
cuucaguuaguuucaugugagc

SEQ ID NO: 58765 - RNA, 22 nt, Human
gaagcuucucaacugguggaau

SEQ ID NO: 58766 - RNA, 22 nt, Human
gaaggaagcugucuggaugugu

SEQ ID NO: 58767 - RNA, 22 nt, Human
cuucuggaggcugcagaaaaga

SEQ ID NO: 58768 - RNA, 22 nt, Human
cuucuguggcugagaaggcagc

SEQ ID NO: 58769 - RNA, 22 nt, Human
cuucuucaucuuuuggaggaac

SEQ ID NO: 58770 - RNA, 22 nt, Human
gaagccaugauaaccagugugg

SEQ ID NO: 58771 - RNA, 22 nt, Human
cuucaacuucuguuuuaaggaa

SEQ ID NO: 58772 - RNA, 22 nt, Human
cuucacugcagucauggcucug

SEQ ID NO: 58773 - RNA, 22 nt, Human
gaagcagguucuucaggaugaa

SEQ ID NO: 58774 - RNA, 22 nt, Human
cuguuucucugccugcacacau

SEQ ID NO: 58775 - RNA, 20 nt, Human
cuguucucuugccacaugag

SEQ ID NO: 58776 - RNA, 22 nt, Human
gaaaugucaagauauguuugga

SEQ ID NO: 58777 - RNA, 22 nt, Human
cugugugcagggcacaauggaa

SEQ ID NO: 58778 - RNA, 22 nt, Human
gaaauaggcccuuacauggaaa

SEQ ID NO: 58779 - RNA, 22 nt, Human
cugugcuugcugugcuggggcc

SEQ ID NO: 58780 - RNA, 22 nt, Human
cuguggaaugcaguugcgagca

SEQ ID NO: 58781 - RNA, 22 nt, Human
gaaagcuuggaaacgacuuuau

SEQ ID NO: 58782 - RNA, 22 nt, Human
cuggcccugucagcacagaauc

SEQ ID NO: 58783 - RNA, 22 nt, Human
cuggccugugggcugucuccgg

SEQ ID NO: 58784 - RNA, 22 nt, Human
cuggccagccucccagguaccc

SEQ ID NO: 58785 - RNA, 21 nt, Human
cuuugccuccagcagccgcag

SEQ ID NO: 58786 - RNA, 21 nt, Human
cuuuggcaagggagaagucac

SEQ ID NO: 58787 - RNA, 22 nt, Human
cuuuguaaucaauaagucuuuu

SEQ ID NO: 58788 - RNA, 22 nt, Human
cuuucauuuuugggcaucugag

SEQ ID NO: 58789 - RNA, 22 nt, Human
cugcuuuggaucucucucugcc

SEQ ID NO: 58790 - RNA, 22 nt, Human
cuggaaaaauggauccugucuu

SEQ ID NO: 58791 - RNA, 22 nt, Human
cuggaaagauuuacacggggaa

SEQ ID NO: 58792 - RNA, 22 nt, Human
cugcuugguuuggagggcccac

SEQ ID NO: 58793 - RNA, 22 nt, Human
cugcuugaugaggaaaggauug

SEQ ID NO: 58794 - RNA, 22 nt, Human
cugcuguuuucugggcuucuua

SEQ ID NO: 58795 - RNA, 22 nt, Human
cugcuucacccugccugagaac

SEQ ID NO: 58796 - RNA, 22 nt, Human
cugcuguuuuccccaccaucuc

SEQ ID NO: 58797 - RNA, 22 nt, Human
cuugucuaguuccuggugaugu

SEQ ID NO: 58798 - RNA, 22 nt, Human
cuuggugagcuccuggcgcagc

SEQ ID NO: 58799 - RNA, 22 nt, Human
cugcugcuugauugcaggaagu

SEQ ID NO: 58800 - RNA, 22 nt, Human
cugcuguugagguuccaggcca

SEQ ID NO: 58801 - RNA, 22 nt, Human
cugcugccagcuuaauacucac

SEQ ID NO: 58802 - RNA, 22 nt, Human
cuuggcuccuucacagggagau

SEQ ID NO: 58803 - RNA, 22 nt, Human
cuuggcacauuuuguucuucug

SEQ ID NO: 58804 - RNA, 22 nt, Human
cuuggcauguucaucugcuugg

SEQ ID NO: 58805 - RNA, 22 nt, Human
cugcucuucccaucccuuaaau

SEQ ID NO: 58806 - RNA, 22 nt, Human
cugccggcugcugcagagaggu

SEQ ID NO: 58807 - RNA, 22 nt, Human
cuugcagagcccauggauguca

SEQ ID NO: 58808 - RNA, 22 nt, Human
cuugcagccuggagcucagccu

SEQ ID NO: 58809 - RNA, 22 nt, Human
cuugccaguguugcagaagcuc

SEQ ID NO: 58810 - RNA, 22 nt, Human
cuugccucucccucuagggggu

SEQ ID NO: 58811 - RNA, 22 nt, Human
cuucuuuccauguguuuugguu

SEQ ID NO: 58812 - RNA, 22 nt, Human
cuucuuuuggggaugaaaaugg

SEQ ID NO: 58813 - RNA, 22 nt, Human
cuucuuugacucacugguacgc

SEQ ID NO: 58814 - RNA, 22 nt, Human
cuucuguggaauagguuugaca

SEQ ID NO: 58815 - RNA, 22 nt, Human
cuucucuuugacaguugggugu

SEQ ID NO: 58816 - RNA, 22 nt, Human
cuucugaugugugcucuuaguu

SEQ ID NO: 58817 - RNA, 22 nt, Human
cuucucuugugauguuagcgga

SEQ ID NO: 58818 - RNA, 23 nt, Human
cuucggcgcucgcugggcggagg

SEQ ID NO: 58819 - RNA, 22 nt, Human
cuucuaauucuuauguaagcuu

SEQ ID NO: 58820 - RNA, 21 nt, Human
cuucgcuguuccagcucuugg

SEQ ID NO: 58821 - RNA, 22 nt, Human
cuucucuuccuucucauccuca

SEQ ID NO: 58822 - RNA, 22 nt, Human
cuucucuuggguguggugucuu

SEQ ID NO: 58823 - RNA, 22 nt, Human
cugccacuaccaugcuggauga

SEQ ID NO: 58824 - RNA, 22 nt, Human
cugcagauguagcugcuuuccu

SEQ ID NO: 58825 - RNA, 22 nt, Human
cuuccugcaacaccuguguugc

SEQ ID NO: 58826 - RNA, 22 nt, Human
cuucccuacuucagugcucccu

SEQ ID NO: 58827 - RNA, 22 nt, Human
cuucauccguaccacggccaca

SEQ ID NO: 58828 - RNA, 22 nt, Human
cugauguuuaucucaagaguuc

SEQ ID NO: 58829 - RNA, 22 nt, Human
cugauuucaaauggugcuagau

SEQ ID NO: 58830 - RNA, 22 nt, Human
cuucccuaagggacuggcauag

SEQ ID NO: 58831 - RNA, 22 nt, Human
cugagcuuuucucugcuucuua

SEQ ID NO: 58832 - RNA, 22 nt, Human
cugagaaauacccaagucuggu

SEQ ID NO: 58833 - RNA, 22 nt, Human
cugagcugcucccgcugcagcg

SEQ ID NO: 58834 - RNA, 22 nt, Human
cugaaggcuuugaauggaauga

SEQ ID NO: 58835 - RNA, 22 nt, Human
cugaccgugccgcgguacugcu

SEQ ID NO: 58836 - RNA, 22 nt, Human
cugugguuucuaugggccuuga

SEQ ID NO: 58837 - RNA, 22 nt, Human
cugugcuucgagggcuccccgc

SEQ ID NO: 58838 - RNA, 22 nt, Human
cuguggcuaggaagcuguggga

SEQ ID NO: 58839 - RNA, 22 nt, Human
cugugcauguucucuagcugau

SEQ ID NO: 58840 - RNA, 22 nt, Human
cucuucugugggugcuauguca

SEQ ID NO: 58841 - RNA, 20 nt, Human
cucuuuaugagaccacuguc

SEQ ID NO: 58842 - RNA, 20 nt, Human
cuggugccuucugcgauuua

SEQ ID NO: 58843 - RNA, 22 nt, Human
cucugauuuuucuaauacuuca

SEQ ID NO: 58844 - RNA, 22 nt, Human
cucugcccacaguccccgagga

SEQ ID NO: 58845 - RNA, 22 nt, Human
cugggacccagcccaagucuuu

SEQ ID NO: 58846 - RNA, 22 nt, Human
cuccuugguuccggcguuggag

SEQ ID NO: 58847 - RNA, 22 nt, Human
cuggcgauugcgagagucgccu

SEQ ID NO: 58848 - RNA, 22 nt, Human
cuggcuuucauggcgcaguuga

SEQ ID NO: 58849 - RNA, 22 nt, Human
cuccccauuuucaugggcaggu

SEQ ID NO: 58850 - RNA, 22 nt, Human
cuggccaggugggggguagugg

SEQ ID NO: 58851 - RNA, 22 nt, Human
cuggcagcucugagucccuucu

SEQ ID NO: 58852 - RNA, 22 nt, Human
cuggaugucugggaggcuuccc

SEQ ID NO: 58853 - RNA, 22 nt, Human
cuggaucgccccgaugugcccc

SEQ ID NO: 58854 - RNA, 20 nt, Human
cuggaguguagcaguggcug

SEQ ID NO: 58855 - RNA, 22 nt, Human
cuggaagcgucggaggaagggc

SEQ ID NO: 58856 - RNA, 22 nt, Human
cuggaaauggcagaguugcauu

SEQ ID NO: 58857 - RNA, 22 nt, Human
cuggagaacucugugcuucacu

SEQ ID NO: 58858 - RNA, 22 nt, Human
cuggagaagagguaguauguag

SEQ ID NO: 58859 - RNA, 22 nt, Human
cugaccugugagcuaugccggc

SEQ ID NO: 58860 - RNA, 22 nt, Human
cgguccugcucuuccucccguu

SEQ ID NO: 58861 - RNA, 22 nt, Human
cggugccccuagcgcgccgccc

SEQ ID NO: 58862 - RNA, 22 nt, Human
cggggucuggaguuguggugug

SEQ ID NO: 58863 - RNA, 22 nt, Human
cggggugugacggugcgggccu

SEQ ID NO: 58864 - RNA, 22 nt, Human
cgggucgagugcuguaguucga

SEQ ID NO: 58865 - RNA, 22 nt, Human
cugaauucuuguugucggagca

SEQ ID NO: 58866 - RNA, 22 nt, Human
cggggcuccgaagagcucgguu

SEQ ID NO: 58867 - RNA, 22 nt, Human
cggggcuggcguuagggaggca

SEQ ID NO: 58868 - RNA, 22 nt, Human
cugaaagcaaaguaauucuuaa

SEQ ID NO: 58869 - RNA, 22 nt, Human
cggggcaaggggggcuggugga

SEQ ID NO: 58870 - RNA, 22 nt, Human
cggcgcugguacaguggaagag

SEQ ID NO: 58871 - RNA, 22 nt, Human
cugaaacucaagauaggaggaa

SEQ ID NO: 58872 - RNA, 22 nt, Human
cugaaagacagccaggcaaagc

SEQ ID NO: 58873 - RNA, 22 nt, Human
cucuugugucaccauggauaaa

SEQ ID NO: 58874 - RNA, 22 nt, Human
cucuggacaucugcggugcuuc

SEQ ID NO: 58875 - RNA, 22 nt, Human
cucuggagggaggcugagcugg

SEQ ID NO: 58876 - RNA, 20 nt, Human
cucugggaggcuugucaccu

SEQ ID NO: 58877 - RNA, 18 nt, Human
cucuggacagcaggcauc

SEQ ID NO: 58878 - RNA, 22 nt, Human
cucuaagcuuugguguuucacu

SEQ ID NO: 58879 - RNA, 22 nt, Human
cucgccugacucggaugggcug

SEQ ID NO: 58880 - RNA, 22 nt, Human
cuccuuuuugggaccgugcagc

SEQ ID NO: 58881 - RNA, 22 nt, Human
cucccucacaaagcauucucuu

SEQ ID NO: 58882 - RNA, 22 nt, Human
cuccuuccuccgcccuuccucg

SEQ ID NO: 58883 - RNA, 22 nt, Human
cuccuggagcagcaggcgcagg

SEQ ID NO: 58884 - RNA, 22 nt, Human
cuccccacucaacucccagacc

SEQ ID NO: 58885 - RNA, 22 nt, Human
cuccagucccuccuugcccagc

SEQ ID NO: 58886 - RNA, 22 nt, Human
cggaagcacuagacacugacac

SEQ ID NO: 58887 - RNA, 22 nt, Human
cgcuucauugugggggccccca

SEQ ID NO: 58888 - RNA, 22 nt, Human
cgcuuugacuuuagaaggccaa

SEQ ID NO: 58889 - RNA, 21 nt, Human
cucauuccccgucccggcccc

SEQ ID NO: 58890 - RNA, 19 nt, Human
cgcugcucccgcuguggcu

SEQ ID NO: 58891 - RNA, 22 nt, Human
cucaggaaaauauugaagaagu

SEQ ID NO: 58892 - RNA, 22 nt, Human
cucagaugaugucuucagggaa

SEQ ID NO: 58893 - RNA, 22 nt, Human
cucacccaaacuauaucuuuaa

SEQ ID NO: 58894 - RNA, 22 nt, Human
cuauuuucccauaugguugaca

SEQ ID NO: 58895 - RNA, 22 nt, Human
cgccuggccccgcagcgcuugu

SEQ ID NO: 58896 - RNA, 22 nt, Human
cuaugaaucaauuucugcaguu

SEQ ID NO: 58897 - RNA, 23 nt, Human
cgagagccugcaggaccuucgga

SEQ ID NO: 58898 - RNA, 22 nt, Human
cgagaccaggcuuuuuuuagga

SEQ ID NO: 58899 - RNA, 22 nt, Human
cuacaaggucuuuaucugcuuu

SEQ ID NO: 58900 - RNA, 22 nt, Human
cgacaagagaaaugcuuuguuu

SEQ ID NO: 58901 - RNA, 19 nt, Human
cgacauggguaaugggaga

SEQ ID NO: 58902 - RNA, 22 nt, Human
cgacagauuauuuugugacugc

SEQ ID NO: 58903 - RNA, 22 nt, Human
cgaagcuuuuguuggcgugucg

SEQ ID NO: 58904 - RNA, 22 nt, Human
cguugguggguguguggucgga

SEQ ID NO: 58905 - RNA, 22 nt, Human
cuaaaaauguucuaguaguuca

SEQ ID NO: 58906 - RNA, 20 nt, Human
cuaaaacaggugucuaguga

SEQ ID NO: 58907 - RNA, 22 nt, Human
cgucauacagaugaacaaucuc

SEQ ID NO: 58908 - RNA, 22 nt, Human
cgugccugguggagagcgaggg

SEQ ID NO: 58909 - RNA, 22 nt, Human
cgguggcccauuguacgcagcu

SEQ ID NO: 58910 - RNA, 19 nt, Human
cggugcugauuggugcagu

SEQ ID NO: 58911 - RNA, 22 nt, Human
cgggucgcacaggagaaaggcg

SEQ ID NO: 58912 - RNA, 22 nt, Human
cggucggagagaaugaccugga

SEQ ID NO: 58913 - RNA, 22 nt, Human
cggucuauuguguaucauuuca

SEQ ID NO: 58914 - RNA, 18 nt, Human
ccuucaucucugcuucuu

SEQ ID NO: 58915 - RNA, 20 nt, Human
ccuguucacugcgcaguuuc

SEQ ID NO: 58916 - RNA, 22 nt, Human
cggggcucugcacaggccagga

SEQ ID NO: 58917 - RNA, 22 nt, Human
cggggcgggcgugggaggugga

SEQ ID NO: 58918 - RNA, 22 nt, Human
cggggcggcgagcgggccgggc

SEQ ID NO: 58919 - RNA, 22 nt, Human
cggggaggagccagcggaggau

SEQ ID NO: 58920 - RNA, 21 nt, Human
ccugucagcccaacuuuugga

SEQ ID NO: 58921 - RNA, 22 nt, Human
ccugggccuaaacaaacaagag

SEQ ID NO: 58922 - RNA, 22 nt, Human
ccugggcauaaaucacuccaag

SEQ ID NO: 58923 - RNA, 22 nt, Human
cggcugcagcggagcaggcugg

SEQ ID NO: 58924 - RNA, 22 nt, Human
cggcgccccgcgcgggcggcuc

SEQ ID NO: 58925 - RNA, 22 nt, Human
ccugggcauuuguuucacaggu

SEQ ID NO: 58926 - RNA, 22 nt, Human
cggcggcgaaccgaccugggug

SEQ ID NO: 58927 - RNA, 22 nt, Human
ccugccugggcucacuugccag

SEQ ID NO: 58928 - RNA, 22 nt, Human
cggccuuuggcuucuccugugu

SEQ ID NO: 58929 - RNA, 22 nt, Human
ccugcuggagucuaguuggucu

SEQ ID NO: 58930 - RNA, 22 nt, Human
ccugcugcugaugcuguuucac

SEQ ID NO: 58931 - RNA, 19 nt, Human
ccugcugaagugaugcagc

SEQ ID NO: 58932 - RNA, 22 nt, Human
ccugcucccccugcaagccuug

SEQ ID NO: 58933 - RNA, 22 nt, Human
ccugcucuaauucauucaugcu

SEQ ID NO: 58934 - RNA, 22 nt, Human
cggcccggccucgcggcgcaug

SEQ ID NO: 58935 - RNA, 22 nt, Human
cggccgcgggauggcgggcagc

SEQ ID NO: 58936 - RNA, 22 nt, Human
ccugccagccugccaucccaca

SEQ ID NO: 58937 - RNA, 22 nt, Human
cgcugcagcggcugagucccgc

SEQ ID NO: 58938 - RNA, 22 nt, Human
cgcucggcuuucccuccgccgg

SEQ ID NO: 58939 - RNA, 22 nt, Human
cgccugucugcauggccacugg

SEQ ID NO: 58940 - RNA, 22 nt, Human
cgcgggcuugggcaccugcgga

SEQ ID NO: 58941 - RNA, 22 nt, Human
cgccaguggcagcuggaacagg

SEQ ID NO: 58942 - RNA, 22 nt, Human
cgcauugcaauucaggggauaa

SEQ ID NO: 58943 - RNA, 22 nt, Human
cgcagcuucagggccaggaggg

SEQ ID NO: 58944 - RNA, 22 nt, Human
cgcacuggagcuggaacgaguc

SEQ ID NO: 58945 - RNA, 22 nt, Human
cgagcccaacccucccguccuc

SEQ ID NO: 58946 - RNA, 22 nt, Human
ccgccacggggcaugggaggca

SEQ ID NO: 58947 - RNA, 22 nt, Human
ccgccccaggcccugagccaag

SEQ ID NO: 58948 - RNA, 22 nt, Human
ccgcagggcccggcgggcucag

SEQ ID NO: 58949 - RNA, 22 nt, Human
ccgagguccugaagcaagggcc

SEQ ID NO: 58950 - RNA, 22 nt, Human
ccugcaguuuuuccaugauaca

SEQ ID NO: 58951 - RNA, 22 nt, Human
ccugcaugacuuugucagaccu

SEQ ID NO: 58952 - RNA, 22 nt, Human
cccuugagccuggaggagcucu

SEQ ID NO: 58953 - RNA, 21 nt, Human
cccuugccugcacuccucggc

SEQ ID NO: 58954 - RNA, 22 nt, Human
cccuucuguaucuucugaguuu

SEQ ID NO: 58955 - RNA, 22 nt, Human
cccuguccugcuaggcccuggu

SEQ ID NO: 58956 - RNA, 22 nt, Human
cccuggucucugacuugauccu

SEQ ID NO: 58957 - RNA, 22 nt, Human
ccugaggcccuggcugugcuga

SEQ ID NO: 58958 - RNA, 21 nt, Human
ccugagccuguuuauccagaa

SEQ ID NO: 58959 - RNA, 22 nt, Human
ccugagacucuccugugcagcc

SEQ ID NO: 58960 - RNA, 22 nt, Human
ccugacucugauuucgcugcau

SEQ ID NO: 58961 - RNA, 22 nt, Human
cccugggccccgaacugcugag

SEQ ID NO: 58962 - RNA, 22 nt, Human
ccugacagcgugucccuggccc

SEQ ID NO: 58963 - RNA, 22 nt, Human
ccugaaaugaguucugcucacu

SEQ ID NO: 58964 - RNA, 22 nt, Human
ccucucugcgaaugcugauagu

SEQ ID NO: 58965 - RNA, 22 nt, Human
cccuccgccagugcccgccccg

SEQ ID NO: 58966 - RNA, 22 nt, Human
cccgguugggguuccagggcgc

SEQ ID NO: 58967 - RNA, 22 nt, Human
ccucggacuugggugggcuccu

SEQ ID NO: 58968 - RNA, 22 nt, Human
ccucuccucugugcagacugcc

SEQ ID NO: 58969 - RNA, 19 nt, Human
ccuccgcauccucaucugu

SEQ ID NO: 58970 - RNA, 22 nt, Human
cccggcucggcuucuuccccac

SEQ ID NO: 58971 - RNA, 22 nt, Human
cccggagcagucgggcuccggg

SEQ ID NO: 58972 - RNA, 22 nt, Human
cccgccggccacaccggccgcc

SEQ ID NO: 58973 - RNA, 19 nt, Human
cccgauggagacuuagcag

SEQ ID NO: 58974 - RNA, 22 nt, Human
cccgaaaauuguuguacugcag

SEQ ID NO: 58975 - RNA, 22 nt, Human
ccucaucagaaagcagaaagca

SEQ ID NO: 58976 - RNA, 22 nt, Human
ccccuuucucccgcgucuggcc

SEQ ID NO: 58977 - RNA, 22 nt, Human
ccccccaaaacuacuggccugu

SEQ ID NO: 58978 - RNA, 22 nt, Human
cccccucuuccccucauugcuu

SEQ ID NO: 58979 - RNA, 22 nt, Human
ccccccaaauguuacagugacc

SEQ ID NO: 58980 - RNA, 22 nt, Human
ccgugcaguuucucacacacau

SEQ ID NO: 58981 - RNA, 22 nt, Human
ccguccgcuccuccagccgcug

SEQ ID NO: 58982 - RNA, 19 nt, Human
ccggucaugcauuccuuug

SEQ ID NO: 58983 - RNA, 22 nt, Human
cccaggcuggggcuccuccagc

SEQ ID NO: 58984 - RNA, 22 nt, Human
cccaggccguguaaucagcagc

SEQ ID NO: 58985 - RNA, 22 nt, Human
cccagccugaucucggccagcu

SEQ ID NO: 58986 - RNA, 22 nt, Human
cccagccgaaugcucccuuccc

SEQ ID NO: 58987 - RNA, 22 nt, Human
ccggauuugggagccaccaggg

SEQ ID NO: 58988 - RNA, 22 nt, Human
ccggcggaaacauggcggcgcc

SEQ ID NO: 58989 - RNA, 22 nt, Human
ccgcuggaagcgaguggugggc

SEQ ID NO: 58990 - RNA, 22 nt, Human
ccgcucuuugagacucucccga

SEQ ID NO: 58991 - RNA, 22 nt, Human
ccgcucgggugcagagggcaga

SEQ ID NO: 58992 - RNA, 22 nt, Human
ccgcgcccccggcugugccccc

SEQ ID NO: 58993 - RNA, 22 nt, Human
ccgcggcagaggcgggggcgcc

SEQ ID NO: 58994 - RNA, 22 nt, Human
ccgcggcugcgcggugccccuc

SEQ ID NO: 58995 - RNA, 22 nt, Human
ccgcggcuguaguggaggugga

SEQ ID NO: 58996 - RNA, 22 nt, Human
ccauuuuccuguauggacucga

SEQ ID NO: 58997 - RNA, 23 nt, Human
ccaugugcaggguucagcacuua

SEQ ID NO: 58998 - RNA, 22 nt, Human
ccgcaccgucugccauacacgc

SEQ ID NO: 58999 - RNA, 22 nt, Human
ccaugggugucuggagcacccu

SEQ ID NO: 59000 - RNA, 22 nt, Human
ccauggauacuaagguauguga

SEQ ID NO: 59001 - RNA, 22 nt, Human
ccauggaugcucagauguuagc

SEQ ID NO: 59002 - RNA, 22 nt, Human
ccaugauguugccuacacugcu

SEQ ID NO: 59003 - RNA, 22 nt, Human
ccauagucacuuguccucuuuu

SEQ ID NO: 59004 - RNA, 22 nt, Human
ccaucuuugcucuuuuauugca

SEQ ID NO: 59005 - RNA, 21 nt, Human
ccgacggcgcagaugccggcc

SEQ ID NO: 59006 - RNA, 22 nt, Human
ccgaaaaacagaaucuuggaac

SEQ ID NO: 59007 - RNA, 22 nt, Human
cccuuuuccugaggcccccugc

SEQ ID NO: 59008 - RNA, 22 nt, Human
cccuuuucuaauuuagccuguu

SEQ ID NO: 59009 - RNA, 22 nt, Human
cccuuuuuuauggaguuggcca

SEQ ID NO: 59010 - RNA, 22 nt, Human
ccagugcaguacaaaccuuagu

SEQ ID NO: 59011 - RNA, 22 nt, Human
cccuggcucaggcagcuuuguu

SEQ ID NO: 59012 - RNA, 20 nt, Human
cccuggcuggcaucuggacu

SEQ ID NO: 59013 - RNA, 17 nt, Human
cccugcauugauccuca

SEQ ID NO: 59014 - RNA, 22 nt, Human
cccugcuuccucuucuguuugu

SEQ ID NO: 59015 - RNA, 22 nt, Human
ccagucagccuaguucuucuuu

SEQ ID NO: 59016 - RNA, 19 nt, Human
cccucggcuucugguuacu

SEQ ID NO: 59017 - RNA, 22 nt, Human
cccugauaaaucagcaccucag

SEQ ID NO: 59018 - RNA, 22 nt, Human
ccaggggagagucugagucguu

SEQ ID NO: 59019 - RNA, 22 nt, Human
cccgggcucuggcagaggcggu

SEQ ID NO: 59020 - RNA, 22 nt, Human
ccagggcuggaccagugcuugg

SEQ ID NO: 59021 - RNA, 22 nt, Human
cccgggccgagucuuccagcga

SEQ ID NO: 59022 - RNA, 22 nt, Human
cccggcgccucguuuccuaguc

SEQ ID NO: 59023 - RNA, 22 nt, Human
cccgcuaaaucaguucugaguc

SEQ ID NO: 59024 - RNA, 22 nt, Human
ccaggaguccgugggucuugag

SEQ ID NO: 59025 - RNA, 22 nt, Human
ccagcuuuucagaaucugccug

SEQ ID NO: 59026 - RNA, 22 nt, Human
ccagcugcugcaccgugcaugg

SEQ ID NO: 59027 - RNA, 22 nt, Human
ccagcugggucccugcuggggc

SEQ ID NO: 59028 - RNA, 22 nt, Human
ccagcucgaggcaggggcugca

SEQ ID NO: 59029 - RNA, 23 nt, Human
ccccugcauggcaccacauuccc

SEQ ID NO: 59030 - RNA, 22 nt, Human
ccccauggaaaacccaccuagg

SEQ ID NO: 59031 - RNA, 22 nt, Human
ccagccugccaagcccagcccu

SEQ ID NO: 59032 - RNA, 22 nt, Human
ccccaggcagcccuccaggagc

SEQ ID NO: 59033 - RNA, 22 nt, Human
ccagcaucagcucuuggcuggc

SEQ ID NO: 59034 - RNA, 22 nt, Human
ccagccacagcuuccagcuccu

SEQ ID NO: 59035 - RNA, 22 nt, Human
cccaggucgucagcaguguggu

SEQ ID NO: 59036 - RNA, 22 nt, Human
cccagcuggcaaaggcguccuu

SEQ ID NO: 59037 - RNA, 22 nt, Human
cccagcugaacuugcauuccaa

SEQ ID NO: 59038 - RNA, 22 nt, Human
cccagccuuugcuuccugguuc

SEQ ID NO: 59039 - RNA, 22 nt, Human
ccagcagaagcucccgcugggu

SEQ ID NO: 59040 - RNA, 22 nt, Human
ccagaugggggcugugggaggg

SEQ ID NO: 59041 - RNA, 22 nt, Human
ccagauaaacauuccuuggccu

SEQ ID NO: 59042 - RNA, 22 nt, Human
caugucaagacugaagauccag

SEQ ID NO: 59043 - RNA, 22 nt, Human
caucaaaugcaagagcguucuu

SEQ ID NO: 59044 - RNA, 20 nt, Human
caucaacaccuugucagccu

SEQ ID NO: 59045 - RNA, 19 nt, Human
cauggcgguaaagaggcug

SEQ ID NO: 59046 - RNA, 22 nt, Human
cauggcggcgcucucccugccu

SEQ ID NO: 59047 - RNA, 22 nt, Human
caugcuggcacugaccagccua

SEQ ID NO: 59048 - RNA, 22 nt, Human
caugcgucugcauuggguggug

SEQ ID NO: 59049 - RNA, 22 nt, Human
caguuuuggaagaaacaaggaa

SEQ ID NO: 59050 - RNA, 22 nt, Human
caucuuuguuuuggauauaauc

SEQ ID NO: 59051 - RNA, 22 nt, Human
cagugcuggaggggugcuugca

SEQ ID NO: 59052 - RNA, 22 nt, Human
cagugcucauagcuguuccucc

SEQ ID NO: 59053 - RNA, 22 nt, Human
cauccagggguacccuggagcc

SEQ ID NO: 59054 - RNA, 22 nt, Human
cauccagcuccugggggccacc

SEQ ID NO: 59055 - RNA, 22 nt, Human
caucccaacaggugaucuggua

SEQ ID NO: 59056 - RNA, 22 nt, Human
cagguuucuggaugcagcccca

SEQ ID NO: 59057 - RNA, 22 nt, Human
cagguuguucugggcauggagg

SEQ ID NO: 59058 - RNA, 22 nt, Human
caggucagcacuuggaggugca

SEQ ID NO: 59059 - RNA, 22 nt, Human
cagguauuugaaggcaguggga

SEQ ID NO: 59060 - RNA, 22 nt, Human
caggguugaugaauugucugua

SEQ ID NO: 59061 - RNA, 22 nt, Human
cauaccuugguaagagugauca

SEQ ID NO: 59062 - RNA, 22 nt, Human
cagggugaagaugcgccuccug

SEQ ID NO: 59063 - RNA, 22 nt, Human
caggggaagccagcugccaugu

SEQ ID NO: 59064 - RNA, 22 nt, Human
cagggcagaguuaagaugcugg

SEQ ID NO: 59065 - RNA, 20 nt, Human
caggccuucaggauggcugg

SEQ ID NO: 59066 - RNA, 22 nt, Human
caggcgcugacgggaccgggcu

SEQ ID NO: 59067 - RNA, 22 nt, Human
caggccagcuggaggggcagcu

SEQ ID NO: 59068 - RNA, 22 nt, Human
caguauguuuauuagaacugca

SEQ ID NO: 59069 - RNA, 22 nt, Human
caggucauaacuaugcaugaac

SEQ ID NO: 59070 - RNA, 19 nt, Human
caggggcuuaugcgaccuc

SEQ ID NO: 59071 - RNA, 22 nt, Human
cagcuucaaaggcccugauggu

SEQ ID NO: 59072 - RNA, 22 nt, Human
cagggcuuuuuccuccucuuug

SEQ ID NO: 59073 - RNA, 22 nt, Human
cagggcaucucugaaucuucac

SEQ ID NO: 59074 - RNA, 22 nt, Human
cagggccaggccucaggggcgc

SEQ ID NO: 59075 - RNA, 22 nt, Human
caggcagggcugccuucugcuu

SEQ ID NO: 59076 - RNA, 22 nt, Human
cagggagguuggauuggggccu

SEQ ID NO: 59077 - RNA, 22 nt, Human
caggcaggagaaaaggcgcggg

SEQ ID NO: 59078 - RNA, 22 nt, Human
caggcagggagcuggaaaggau

SEQ ID NO: 59079 - RNA, 22 nt, Human
caggcagagagggcagugugga

SEQ ID NO: 59080 - RNA, 22 nt, Human
caggcacagcuaagacuggcca

SEQ ID NO: 59081 - RNA, 22 nt, Human
caggaagucugaauucugagag

SEQ ID NO: 59082 - RNA, 22 nt, Human
caggacacagacacuaaauaua

SEQ ID NO: 59083 - RNA, 22 nt, Human
cagcuccagcccaggcagcucc

SEQ ID NO: 59084 - RNA, 22 nt, Human
cagcucgaauaauggagaacug

SEQ ID NO: 59085 - RNA, 22 nt, Human
cagcucuggcuauugaggacca

SEQ ID NO: 59086 - RNA, 22 nt, Human
cagccgcucaugggcccggagc

SEQ ID NO: 59087 - RNA, 22 nt, Human
cagcuuguucugaccugugauu

SEQ ID NO: 59088 - RNA, 22 nt, Human
cagcuuuugcagacuucuugcc

SEQ ID NO: 59089 - RNA, 22 nt, Human
cagcccaggcucagauguuggg

SEQ ID NO: 59090 - RNA, 22 nt, Human
cagcuguggagauggggugcau

SEQ ID NO: 59091 - RNA, 22 nt, Human
cagcacuuccuccgugagcccc

SEQ ID NO: 59092 - RNA, 22 nt, Human
cagcagaggagguggcagcacc

SEQ ID NO: 59093 - RNA, 21 nt, Human
cagcagaaaugagaggagaaa

SEQ ID NO: 59094 - RNA, 22 nt, Human
cagauggaguuaguuucuaaca

SEQ ID NO: 59095 - RNA, 22 nt, Human
cagauggagaaagagugaaugg

SEQ ID NO: 59096 - RNA, 22 nt, Human
cagcugcgcagcgccgggccug

SEQ ID NO: 59097 - RNA, 22 nt, Human
cagaucacauccauccgucacc

SEQ ID NO: 59098 - RNA, 22 nt, Human
cagaggcugagcugcgggauga

SEQ ID NO: 59099 - RNA, 22 nt, Human
cagcaugguggagcugcucuuu

SEQ ID NO: 59100 - RNA, 18 nt, Human
cagcauuagcagcuucca

SEQ ID NO: 59101 - RNA, 22 nt, Human
cagacagaaggcuccuugaggu

SEQ ID NO: 59102 - RNA, 22 nt, Human
cagaaaacauuguguguauaag

SEQ ID NO: 59103 - RNA, 22 nt, Human
cagaucacucugggcggcggga

SEQ ID NO: 59104 - RNA, 22 nt, Human
cagagcugucauuugccaguga

SEQ ID NO: 59105 - RNA, 20 nt, Human
cagagccaggguuuuguuuu

SEQ ID NO: 59106 - RNA, 22 nt, Human
cacgggcgacgugaucuaggac

SEQ ID NO: 59107 - RNA, 22 nt, Human
cagagccagcuguccuuggcau

SEQ ID NO: 59108 - RNA, 18 nt, Human
cacgcaacuguaaaaccc

SEQ ID NO: 59109 - RNA, 22 nt, Human
caauugcuuccuucuguaagua

SEQ ID NO: 59110 - RNA, 22 nt, Human
caauuuggaaagcaugcccccc

SEQ ID NO: 59111 - RNA, 20 nt, Human
caccggguugcugguuucuu

SEQ ID NO: 59112 - RNA, 20 nt, Human
cacccgguccucagcgacuc

SEQ ID NO: 59113 - RNA, 22 nt, Human
caaucuucucuagaguauucua

SEQ ID NO: 59114 - RNA, 22 nt, Human
cacccgacugaggacgccgccc

SEQ ID NO: 59115 - RNA, 22 nt, Human
caccaucagacuucugggcagg

SEQ ID NO: 59116 - RNA, 22 nt, Human
caaggguguacagauaugagag

SEQ ID NO: 59117 - RNA, 22 nt, Human
caagguuucgaguucccaacca

SEQ ID NO: 59118 - RNA, 22 nt, Human
cacauuguuuggucagagcaua

SEQ ID NO: 59119 - RNA, 22 nt, Human
caagccacugggagcugcacac

SEQ ID NO: 59120 - RNA, 22 nt, Human
caagcgcgccgcuuccuuccgc

SEQ ID NO: 59121 - RNA, 22 nt, Human
caagcagauauuuuagucaaga

SEQ ID NO: 59122 - RNA, 22 nt, Human
caagaaaaaacaugaugagugu

SEQ ID NO: 59123 - RNA, 22 nt, Human
caagaaccuagcgaucagguaa

SEQ ID NO: 59124 - RNA, 22 nt, Human
caagaaguugacagccagguga

SEQ ID NO: 59125 - RNA, 20 nt, Human
caacacugcccauuguuugc

SEQ ID NO: 59126 - RNA, 22 nt, Human
cacaagacuaaguggcagagca

SEQ ID NO: 59127 - RNA, 22 nt, Human
cacaauuuccauugagcagcag

SEQ ID NO: 59128 - RNA, 22 nt, Human
caacaagcgcucagagcaaagc

SEQ ID NO: 59129 - RNA, 22 nt, Human
caaugaaaauuuaaguugcagc

SEQ ID NO: 59130 - RNA, 22 nt, Human
caaaucagaucagagacaggcu

SEQ ID NO: 59131 - RNA, 22 nt, Human
caaggggagcugguauggaugg

SEQ ID NO: 59132 - RNA, 22 nt, Human
caaggaagguugguugaaggua

SEQ ID NO: 59133 - RNA, 22 nt, Human
caaggucagacagccaggacag

SEQ ID NO: 59134 - RNA, 22 nt, Human
caagucucuagaaugcaauagu

SEQ ID NO: 59135 - RNA, 22 nt, Human
caagaugcaagaccagucaggc

SEQ ID NO: 59136 - RNA, 22 nt, Human
caaggaaaacagaugaucaaca

SEQ ID NO: 59137 - RNA, 22 nt, Human
caaggaaaugucagaaaggcaa

SEQ ID NO: 59138 - RNA, 22 nt, Human
caacuucuauucagucugcagu

SEQ ID NO: 59139 - RNA, 23 nt, Human
auuuuuccacacacagacucagu

SEQ ID NO: 59140 - RNA, 22 nt, Human
caaauacaaauacgggcagcuu

SEQ ID NO: 59141 - RNA, 22 nt, Human
caaaacccaagugcuauugcaa

SEQ ID NO: 59142 - RNA, 22 nt, Human
auuuugcuuuucuaguggguuu

SEQ ID NO: 59143 - RNA, 22 nt, Human
auuuuggguguuaacaaugaaa

SEQ ID NO: 59144 - RNA, 19 nt, Human
auuuugguucuuuccauuc

SEQ ID NO: 59145 - RNA, 22 nt, Human
caaagccuggggagaguaagga

SEQ ID NO: 59146 - RNA, 22 nt, Human
auuuggaaggcguuucucugua

SEQ ID NO: 59147 - RNA, 22 nt, Human
auuuuugguuauaaaauaguuu

SEQ ID NO: 59148 - RNA, 22 nt, Human
auuuuugguuucaccugcacgc

SEQ ID NO: 59149 - RNA, 22 nt, Human
auuuucgcaccucgcgaguugc

SEQ ID NO: 59150 - RNA, 22 nt, Human
auuuucuugucucuguuguagg

SEQ ID NO: 59151 - RNA, 22 nt, Human
auuuccacaaauuaagauugca

SEQ ID NO: 59152 - RNA, 22 nt, Human
auucuuuucucuaaaugaugaa

SEQ ID NO: 59153 - RNA, 22 nt, Human
auuuauuuucccucaaguaccu

SEQ ID NO: 59154 - RNA, 22 nt, Human
auuucagaaugaaaggaaaaau

SEQ ID NO: 59155 - RNA, 22 nt, Human
auuucagcagcccauguuugga

SEQ ID NO: 59156 - RNA, 17 nt, Human
auuguuuuuaauuugca

SEQ ID NO: 59157 - RNA, 19 nt, Human
auuuccuggcauauaucac

SEQ ID NO: 59158 - RNA, 22 nt, Human
auuuggaaacaugcugaccaug

SEQ ID NO: 59159 - RNA, 21 nt, Human
auuuggucaaugucugcguga

SEQ ID NO: 59160 - RNA, 22 nt, Human
auguuuucauuuagaagcuaau

SEQ ID NO: 59161 - RNA, 22 nt, Human
auguuuugaguuuuuuuacacc

SEQ ID NO: 59162 - RNA, 22 nt, Human
auguuccaugacuaugcaugaa

SEQ ID NO: 59163 - RNA, 22 nt, Human
auguuugugauugcugaaaaga

SEQ ID NO: 59164 - RNA, 22 nt, Human
auuagaaaugacaugugggaau

SEQ ID NO: 59165 - RNA, 23 nt, Human
auuauuucaggguuuugacuugc

SEQ ID NO: 59166 - RNA, 20 nt, Human
auuauuucuucugcccaaag

SEQ ID NO: 59167 - RNA, 22 nt, Human
auuauuugcuuaagcuggucuc

SEQ ID NO: 59168 - RNA, 22 nt, Human
auucaagagcccauguuuccug

SEQ ID NO: 59169 - RNA, 22 nt, Human
auucaagauaagggucugggag

SEQ ID NO: 59170 - RNA, 22 nt, Human
auucaguucuaaggucagugcc

SEQ ID NO: 59171 - RNA, 22 nt, Human
auucauucugaccucaagagaa

SEQ ID NO: 59172 - RNA, 22 nt, Human
auguggaaagcuugucuuagag

SEQ ID NO: 59173 - RNA, 22 nt, Human
augugaaauuugggcucuggga

SEQ ID NO: 59174 - RNA, 21 nt, Human
auguguucugauagugcuugc

SEQ ID NO: 59175 - RNA, 22 nt, Human
augugccugagggcuccuugug

SEQ ID NO: 59176 - RNA, 22 nt, Human
augugcacuggugugugcguuc

SEQ ID NO: 59177 - RNA, 22 nt, Human
auguccccagacugcugugcag

SEQ ID NO: 59178 - RNA, 22 nt, Human
augugaaagagguguucagugg

SEQ ID NO: 59179 - RNA, 22 nt, Human
augugaaccuggguccugggcc

SEQ ID NO: 59180 - RNA, 22 nt, Human
augguugggggaugucagcagg

SEQ ID NO: 59181 - RNA, 22 nt, Human
auggcuguguuguuccucugaa

SEQ ID NO: 59182 - RNA, 20 nt, Human
auggcgagucagcacaaaac

SEQ ID NO: 59183 - RNA, 22 nt, Human
auggccugaagcuaaccccccu

SEQ ID NO: 59184 - RNA, 22 nt, Human
auggccuguuuccucugaaaga

SEQ ID NO: 59185 - RNA, 22 nt, Human
augcugcuccuuuucaggcauu

SEQ ID NO: 59186 - RNA, 22 nt, Human
augcugugccuggaaagcggcu

SEQ ID NO: 59187 - RNA, 22 nt, Human
augcugccuaaagcuacuuaca

SEQ ID NO: 59188 - RNA, 18 nt, Human
augcugacacaaugugga

SEQ ID NO: 59189 - RNA, 22 nt, Human
augcucuuaauugcuagauaag

SEQ ID NO: 59190 - RNA, 22 nt, Human
augcucuggucucuucuuuccu

SEQ ID NO: 59191 - RNA, 22 nt, Human
augcggcugugggggaauggga

SEQ ID NO: 59192 - RNA, 21 nt, Human
augcgcgguggagugagcgaa

SEQ ID NO: 59193 - RNA, 22 nt, Human
augcuuuauuggagacagucau

SEQ ID NO: 59194 - RNA, 22 nt, Human
augcuugaaaguuauuucauuu

SEQ ID NO: 59195 - RNA, 22 nt, Human
augcuugcccauguuucugaag

SEQ ID NO: 59196 - RNA, 22 nt, Human
augccugcugucaggaacucuu

SEQ ID NO: 59197 - RNA, 22 nt, Human
augcugccuccucuucagccgc

SEQ ID NO: 59198 - RNA, 22 nt, Human
augcgcugugcacacucuuaac

SEQ ID NO: 59199 - RNA, 22 nt, Human
augcacuugacucuauuccaca

SEQ ID NO: 59200 - RNA, 22 nt, Human
augccgggguggcuccagcacc

SEQ ID NO: 59201 - RNA, 23 nt, Human
augcaacauugccaguaugggca

SEQ ID NO: 59202 - RNA, 22 nt, Human
augaugaugguuuaacuucagg

SEQ ID NO: 59203 - RNA, 22 nt, Human
augcaggcuaagaguaaagacg

SEQ ID NO: 59204 - RNA, 22 nt, Human
augcagcggucagaggaacuca

SEQ ID NO: 59205 - RNA, 22 nt, Human
augcagauguagauucugaaau

SEQ ID NO: 59206 - RNA, 22 nt, Human
augagcucuaaguacaugccca

SEQ ID NO: 59207 - RNA, 22 nt, Human
aucuucuuucaucagccccuca

SEQ ID NO: 59208 - RNA, 22 nt, Human
aucugggaaggggaaaaugcug

SEQ ID NO: 59209 - RNA, 20 nt, Human
aucugugaugagaacgguuu

SEQ ID NO: 59210 - RNA, 20 nt, Human
aucuuaucuaucuuuuguuc

SEQ ID NO: 59211 - RNA, 22 nt, Human
aucuucaaagcacaucguuugu

SEQ ID NO: 59212 - RNA, 22 nt, Human
aucuucaaggacgccaagaucc

SEQ ID NO: 59213 - RNA, 22 nt, Human
augaaaacgugugugugugugu

SEQ ID NO: 59214 - RNA, 22 nt, Human
augaaacuggagcgccuggagg

SEQ ID NO: 59215 - RNA, 23 nt, Human
augaaaugauacuuuauucacug

SEQ ID NO: 59216 - RNA, 22 nt, Human
aucugcugcuccuucuucuugc

SEQ ID NO: 59217 - RNA, 22 nt, Human
aucuagguuuggaagauagagu

SEQ ID NO: 59218 - RNA, 22 nt, Human
aucuauguaucucagaagcuag

SEQ ID NO: 59219 - RNA, 22 nt, Human
augaaacucuagcuuucagcac

SEQ ID NO: 59220 - RNA, 22 nt, Human
augaucaagaauuuuguauucc

SEQ ID NO: 59221 - RNA, 22 nt, Human
augaucacagugucagucauua

SEQ ID NO: 59222 - RNA, 22 nt, Human
augauggagaacaaagaaaauc

SEQ ID NO: 59223 - RNA, 22 nt, Human
augaagugcccugggggccaga

SEQ ID NO: 59224 - RNA, 22 nt, Human
augaaugccggucucgggggaa

SEQ ID NO: 59225 - RNA, 22 nt, Human
augaauuugaacaccagguugg

SEQ ID NO: 59226 - RNA, 22 nt, Human
augaccauccagaaguccagcu

SEQ ID NO: 59227 - RNA, 22 nt, Human
auccacuagagggugaacucug

SEQ ID NO: 59228 - RNA, 22 nt, Human
auccuccuggggcagucuuccc

SEQ ID NO: 59229 - RNA, 22 nt, Human
aucauuuuuauuagcugggguu

SEQ ID NO: 59230 - RNA, 22 nt, Human
auccuugacuguagugauauua

SEQ ID NO: 59231 - RNA, 22 nt, Human
auccuggcuuuccugauuuacu

SEQ ID NO: 59232 - RNA, 20 nt, Human
auccuggucuuuggaagcuu

SEQ ID NO: 59233 - RNA, 22 nt, Human
auccgugagcgagcgagcaccc

SEQ ID NO: 59234 - RNA, 22 nt, Human
auccucucugugacagggaacg

SEQ ID NO: 59235 - RNA, 20 nt, Human
aucaugugcacugcugacag

SEQ ID NO: 59236 - RNA, 23 nt, Human
aucauuucuuagugagucccugc

SEQ ID NO: 59237 - RNA, 22 nt, Human
auccaggggucugaauggauau

SEQ ID NO: 59238 - RNA, 22 nt, Human
aucaugcgguuaaggagugugu

SEQ ID NO: 59239 - RNA, 22 nt, Human
aucaucuaaaauuggcucagau

SEQ ID NO: 59240 - RNA, 22 nt, Human
aucaucccuuucucccagugaa

SEQ ID NO: 59241 - RNA, 22 nt, Human
aucauugcuaguaaggaucuug

SEQ ID NO: 59242 - RNA, 22 nt, Human
aucagugcacgcgaugggcaga

SEQ ID NO: 59243 - RNA, 17 nt, Human
aucagaggauaggacaa

SEQ ID NO: 59244 - RNA, 22 nt, Human
aucaugcugacacaguuuaucu

SEQ ID NO: 59245 - RNA, 22 nt, Human
aucauccuagaaggaagcuagg

SEQ ID NO: 59246 - RNA, 22 nt, Human
aucaaugggucaaagagaaggu

SEQ ID NO: 59247 - RNA, 21 nt, Human
aucagaggacaucucagggcc

SEQ ID NO: 59248 - RNA, 19 nt, Human
aucagcaguuuugccugga

SEQ ID NO: 59249 - RNA, 22 nt, Human
aucagaagaaauggaugugacu

SEQ ID NO: 59250 - RNA, 22 nt, Human
aucagagcuaguacuugcaggu

SEQ ID NO: 59251 - RNA, 22 nt, Human
aucaaaauguguagucuugauc

SEQ ID NO: 59252 - RNA, 20 nt, Human
aucaagugucuugccaggca

SEQ ID NO: 59253 - RNA, 22 nt, Human
auauguuaugccauuuucaagg

SEQ ID NO: 59254 - RNA, 22 nt, Human
auaggggagcagccagagaaga

SEQ ID NO: 59255 - RNA, 22 nt, Human
auaugagaggaggagcaucagu

SEQ ID NO: 59256 - RNA, 22 nt, Human
auaugcacauguacauguauau

SEQ ID NO: 59257 - RNA, 22 nt, Human
auauaugcaacaagaaagcaua

SEQ ID NO: 59258 - RNA, 22 nt, Human
auaucuuguuuuugauuucuug

SEQ ID NO: 59259 - RNA, 22 nt, Human
auauggugauuuuaugcaggaa

SEQ ID NO: 59260 - RNA, 22 nt, Human
auauuugcccccaugcccuggc

SEQ ID NO: 59261 - RNA, 22 nt, Human
auagacauuuauagagaaugac

SEQ ID NO: 59262 - RNA, 22 nt, Human
auagggaggcggagggagcugg

SEQ ID NO: 59263 - RNA, 22 nt, Human
agugaaauaugcccauugcugu

SEQ ID NO: 59264 - RNA, 22 nt, Human
uuuuugcccuaaagaagucauu

SEQ ID NO: 59265 - RNA, 22 nt, Human
uuuuugggaagaauucugauau

SEQ ID NO: 59266 - RNA, 22 nt, Human
uuuuuguauaugcuucgaggau

SEQ ID NO: 59267 - RNA, 22 nt, Human
uuuuuuccagcuucuagaggcc

SEQ ID NO: 59268 - RNA, 22 nt, Human
uuuuuucuucucuaucuuaaua

SEQ ID NO: 59269 - RNA, 22 nt, Human
uuuuuuuagaaagaucauaguu

SEQ ID NO: 59270 - RNA, 22 nt, Human
uuuucuucucauucugaccuca

SEQ ID NO: 59271 - RNA, 22 nt, Human
uuuucucuuugcuucucuaaaa

SEQ ID NO: 59272 - RNA, 22 nt, Human
uuuugaugaccauucuucuuuu

SEQ ID NO: 59273 - RNA, 22 nt, Human
uuuugccuauuguaucaucgua

SEQ ID NO: 59274 - RNA, 22 nt, Human
uuuucggggcgacuuagguucu

SEQ ID NO: 59275 - RNA, 22 nt, Human
uuuucuacaaaucuggacuuuu

SEQ ID NO: 59276 - RNA, 22 nt, Human
uuuucucacugagagccuugau

SEQ ID NO: 59277 - RNA, 22 nt, Human
uuuucucaguuuuuuucaaaag

SEQ ID NO: 59278 - RNA, 22 nt, Human
uuuuccaaaaguggagaggaau

SEQ ID NO: 59279 - RNA, 22 nt, Human
uuuuccuguccuugggucugca

SEQ ID NO: 59280 - RNA, 22 nt, Human
uuuuggaaaaaccaguauggaa

SEQ ID NO: 59281 - RNA, 22 nt, Human
uuuugucuguggaaagcugcua

SEQ ID NO: 59282 - RNA, 22 nt, Human
uuuuuaaaagaugauuuaauga

SEQ ID NO: 59283 - RNA, 22 nt, Human
uuuuuagcuguuauuguggaag

SEQ ID NO: 59284 - RNA, 22 nt, Human
uuuuucacacuccuuuccaguu

SEQ ID NO: 59285 - RNA, 22 nt, Human
uuuuaucuuacauggaaucucc

SEQ ID NO: 59286 - RNA, 22 nt, Human
uuuuaaaagguugcuguuauaa

SEQ ID NO: 59287 - RNA, 22 nt, Human
uuuuaauccucuugguaucuua

SEQ ID NO: 59288 - RNA, 22 nt, Human
uuuagacuacuaugcugccaga

SEQ ID NO: 59289 - RNA, 22 nt, Human
uuuguuaggguuucagcuagcc

SEQ ID NO: 59290 - RNA, 22 nt, Human
uuuguucaguuuguugugggug

SEQ ID NO: 59291 - RNA, 22 nt, Human
uuuguugucuucauaauacuuu

SEQ ID NO: 59292 - RNA, 22 nt, Human
uuuguuuccagccuuuugucuu

SEQ ID NO: 59293 - RNA, 22 nt, Human
uuuguuuuggugucaugcguga

SEQ ID NO: 59294 - RNA, 22 nt, Human
uuggggccggcgcggaggaggg

SEQ ID NO: 59295 - RNA, 22 nt, Human
uugggggccuccuguuccccca

SEQ ID NO: 59296 - RNA, 22 nt, Human
uugggucagcuuucagguagua

SEQ ID NO: 59297 - RNA, 22 nt, Human
uuggccaaggaccuuuuuggag

SEQ ID NO: 59298 - RNA, 22 nt, Human
uuggcauuccagaugcuuuucu

SEQ ID NO: 59299 - RNA, 22 nt, Human
uuggcagagaacagaaugauuu

SEQ ID NO: 59300 - RNA, 22 nt, Human
uuggcaaaagauuggguacuua

SEQ ID NO: 59301 - RNA, 22 nt, Human
uuggugaugcccaccuuuucau

SEQ ID NO: 59302 - RNA, 22 nt, Human
uuguagccaugucacaagcaca

SEQ ID NO: 59303 - RNA, 22 nt, Human
uuguauguuucugugcacauga

SEQ ID NO: 59304 - RNA, 22 nt, Human
uuuaaaacagcauuuaaaaggu

SEQ ID NO: 59305 - RNA, 22 nt, Human
uugcugccagcgcccugcaggg

SEQ ID NO: 59306 - RNA, 22 nt, Human
uugcucuuaccauuauguguga

SEQ ID NO: 59307 - RNA, 22 nt, Human
uugcggauguccacgucacacu

SEQ ID NO: 59308 - RNA, 22 nt, Human
uugcggaucuucauggccucag

SEQ ID NO: 59309 - RNA, 22 nt, Human
uugccgacuggccaaggaguaa

SEQ ID NO: 59310 - RNA, 22 nt, Human
uugcauauguccagccaugcau

SEQ ID NO: 59311 - RNA, 22 nt, Human
uugaguuuacauuguauuagcc

SEQ ID NO: 59312 - RNA, 22 nt, Human
uugcaagcccugaagggcugga

SEQ ID NO: 59313 - RNA, 22 nt, Human
uucuguguauggaagaaugucc

SEQ ID NO: 59314 - RNA, 22 nt, Human
uucuguucugcuuucuccaucc

SEQ ID NO: 59315 - RNA, 22 nt, Human
uucuucuuuccuauaauuaauu

SEQ ID NO: 59316 - RNA, 23 nt, Human
uucuuuccuuaucccauuuacuu

SEQ ID NO: 59317 - RNA, 21 nt, Human
uuuuucuccagaguuuccacu

SEQ ID NO: 59318 - RNA, 22 nt, Human
uuuuucuccucucucuuucauu

SEQ ID NO: 59319 - RNA, 22 nt, Human
uugaaaaaugcccagcagacaa

SEQ ID NO: 59320 - RNA, 22 nt, Human
uugaaagaacaauucugugaug

SEQ ID NO: 59321 - RNA, 22 nt, Human
uugaagaagucaaaagcugcag

SEQ ID NO: 59322 - RNA, 22 nt, Human
uuuuuucuggaguuugggguuu

SEQ ID NO: 59323 - RNA, 22 nt, Human
uuuuuugguuuggggauuauuu

SEQ ID NO: 59324 - RNA, 22 nt, Human
uucuggucucucugaccuagga

SEQ ID NO: 59325 - RNA, 22 nt, Human
uucuggccagggaagagggguc

SEQ ID NO: 59326 - RNA, 22 nt, Human
uucuggagacccagcaacaggg

SEQ ID NO: 59327 - RNA, 22 nt, Human
uucuggaguuugaagaucaggu

SEQ ID NO: 59328 - RNA, 21 nt, Human
uucugcuguucaccaccaccc

SEQ ID NO: 59329 - RNA, 23 nt, Human
uucugcuucccauagcacuuugu

SEQ ID NO: 59330 - RNA, 22 nt, Human
uucuggacuuccaaauggcuuc

SEQ ID NO: 59331 - RNA, 22 nt, Human
uucugaugccuggguugcuucu

SEQ ID NO: 59332 - RNA, 22 nt, Human
uucugcauaggcuauauuuguu

SEQ ID NO: 59333 - RNA, 22 nt, Human
uucugcccuugccagacaagua

SEQ ID NO: 59334 - RNA, 22 nt, Human
uuuucuacaaucacucuggaag

SEQ ID NO: 59335 - RNA, 22 nt, Human
uuuuacgucuuugcugccucgu

SEQ ID NO: 59336 - RNA, 22 nt, Human
uucguucagcgcuugcgcaugc

SEQ ID NO: 59337 - RNA, 22 nt, Human
uucguugaagcaacgacuuugg

SEQ ID NO: 59338 - RNA, 22 nt, Human
uucuccugacuggccauucagu

SEQ ID NO: 59339 - RNA, 22 nt, Human
uucccugggggggccgcuuucc

SEQ ID NO: 59340 - RNA, 22 nt, Human
uuccagucugggcucuucacug

SEQ ID NO: 59341 - RNA, 22 nt, Human
uuccaaaugacaaugggcugua

SEQ ID NO: 59342 - RNA, 22 nt, Human
uuccaaggagagcucgaccuca

SEQ ID NO: 59343 - RNA, 22 nt, Human
uuccaagcaccaugaaggccuc

SEQ ID NO: 59344 - RNA, 22 nt, Human
uuuguaguuguggaugcugaag

SEQ ID NO: 59345 - RNA, 22 nt, Human
uucauugcagaauuuggccuca

SEQ ID NO: 59346 - RNA, 22 nt, Human
uucauugcuacuuaaaauacca

SEQ ID NO: 59347 - RNA, 22 nt, Human
uuugggccugucugccugcuuu

SEQ ID NO: 59348 - RNA, 22 nt, Human
uuugggcuuuguuuuaagguau

SEQ ID NO: 59349 - RNA, 22 nt, Human
uucaggaucuaggaguauuuuu

SEQ ID NO: 59350 - RNA, 22 nt, Human
uuugcaggaaauguacugaaug

SEQ ID NO: 59351 - RNA, 17 nt, Human
uuucugcaugauuggac

SEQ ID NO: 59352 - RNA, 22 nt, Human
uuucugcuuucuaguugguguu

SEQ ID NO: 59353 - RNA, 22 nt, Human
uuucucuuuuugggguggggug

SEQ ID NO: 59354 - RNA, 23 nt, Human
uuucugaguuuuuuaaaagucca

SEQ ID NO: 59355 - RNA, 22 nt, Human
uuucucugggugaugagguggc

SEQ ID NO: 59356 - RNA, 22 nt, Human
uuucucuuguauuugaaucacu

SEQ ID NO: 59357 - RNA, 22 nt, Human
uuucucuuucaaucugcaguac

SEQ ID NO: 59358 - RNA, 22 nt, Human
uuucucuccucgaaauucuuau

SEQ ID NO: 59359 - RNA, 22 nt, Human
uuauuucaggcauuuguaaaug

SEQ ID NO: 59360 - RNA, 22 nt, Human
uuauuucauguaaaauuuaugu

SEQ ID NO: 59361 - RNA, 22 nt, Human
uuucugggggucgugcuggcug

SEQ ID NO: 59362 - RNA, 19 nt, Human
uuucuggguucaccucuug

SEQ ID NO: 59363 - RNA, 22 nt, Human
uuucugugguggguaguucaga

SEQ ID NO: 59364 - RNA, 22 nt, Human
uuucuuccaucuggcuuuauuu

SEQ ID NO: 59365 - RNA, 22 nt, Human
uuucuuccuucuugaucauuug

SEQ ID NO: 59366 - RNA, 22 nt, Human
uuucuuugggcccuggcagucu

SEQ ID NO: 59367 - RNA, 22 nt, Human
uuauuuuguagcucugaucuuu

SEQ ID NO: 59368 - RNA, 18 nt, Human
uuucuuuuauuccagguc

SEQ ID NO: 59369 - RNA, 22 nt, Human
uucaaaccuaucuaagaaauag

SEQ ID NO: 59370 - RNA, 22 nt, Human
uuugagaaugucaaucacaaga

SEQ ID NO: 59371 - RNA, 22 nt, Human
uuuaucaggccaucuuaugucu

SEQ ID NO: 59372 - RNA, 22 nt, Human
uuuaucucugcauagaagugau

SEQ ID NO: 59373 - RNA, 22 nt, Human
uuuauugcuaugucuugauugu

SEQ ID NO: 59374 - RNA, 22 nt, Human
uuuauuuuccaugucucuaggu

SEQ ID NO: 59375 - RNA, 22 nt, Human
uuucaagccucacugcguuuug

SEQ ID NO: 59376 - RNA, 22 nt, Human
uuucagaaauggcacugaaauc

SEQ ID NO: 59377 - RNA, 21 nt, Human
uuuccagaggcagccggacuc

SEQ ID NO: 59378 - RNA, 22 nt, Human
uuaugggcgaugcaaaccugau

SEQ ID NO: 59379 - RNA, 18 nt, Human
uuuccucauuugcagacu

SEQ ID NO: 59380 - RNA, 22 nt, Human
uuuccugacuucaccuuuuacc

SEQ ID NO: 59381 - RNA, 22 nt, Human
uuaugugcuuuuugagcucuaa

SEQ ID NO: 59382 - RNA, 22 nt, Human
uuuccuucccuccugggccuuc

SEQ ID NO: 59383 - RNA, 22 nt, Human
uuucgcuuguucggagugcuuu

SEQ ID NO: 59384 - RNA, 22 nt, Human
uuucuaaaauuacugcagucgg

SEQ ID NO: 59385 - RNA, 22 nt, Human
uuggugauugggaauggauggg

SEQ ID NO: 59386 - RNA, 22 nt, Human
uuggugauguagcagcaauugu

SEQ ID NO: 59387 - RNA, 22 nt, Human
uuggugaugaaagugcugcgcu

SEQ ID NO: 59388 - RNA, 22 nt, Human
uuggugaugcuaggaauguagu

SEQ ID NO: 59389 - RNA, 19 nt, Human
uguugcagcuugaucggua

SEQ ID NO: 59390 - RNA, 22 nt, Human
uguugcauguggcuguuugcca

SEQ ID NO: 59391 - RNA, 19 nt, Human
uuggugaagguucacugac

SEQ ID NO: 59392 - RNA, 22 nt, Human
uguugucaugcagucaguggua

SEQ ID NO: 59393 - RNA, 22 nt, Human
uguuuccuaagugucucugaag

SEQ ID NO: 59394 - RNA, 22 nt, Human
uguugaagcaccucugucuuuc

SEQ ID NO: 59395 - RNA, 22 nt, Human
uugggagagaaaccuaaugccu

SEQ ID NO: 59396 - RNA, 22 nt, Human
uguuccggucuaucgugucaau

SEQ ID NO: 59397 - RNA, 22 nt, Human
uguucccgaugacaggaccagg

SEQ ID NO: 59398 - RNA, 22 nt, Human
uuggcuucuugcuaggaagcug

SEQ ID NO: 59399 - RNA, 22 nt, Human
uuggcgcuauuauuaccacauu

SEQ ID NO: 59400 - RNA, 22 nt, Human
uuggccguuucacugggcaguu

SEQ ID NO: 59401 - RNA, 22 nt, Human
uuggaaauguagaaaagcagau

SEQ ID NO: 59402 - RNA, 17 nt, Human
uguguaaguugcauaga

SEQ ID NO: 59403 - RNA, 22 nt, Human
uguggugcagcgggaacagcuu

SEQ ID NO: 59404 - RNA, 22 nt, Human
uuggaggaagcucaugggggau

SEQ ID NO: 59405 - RNA, 22 nt, Human
uugcuugcggccuuugugccuu

SEQ ID NO: 59406 - RNA, 22 nt, Human
uuggaaaagaaauacucauaua

SEQ ID NO: 59407 - RNA, 22 nt, Human
uuggaaaugcauuuguuauuau

SEQ ID NO: 59408 - RNA, 22 nt, Human
uugcugugucauuuguuuaauc

SEQ ID NO: 59409 - RNA, 22 nt, Human
uguggccaccagagcugcuauu

SEQ ID NO: 59410 - RNA, 21 nt, Human
uugcuggagcaauguaaauca

SEQ ID NO: 59411 - RNA, 22 nt, Human
uugcuggaguagaaaacuuaac

SEQ ID NO: 59412 - RNA, 22 nt, Human
uugcugggauucauugaagggu

SEQ ID NO: 59413 - RNA, 22 nt, Human
uugcugguggcucugauuucau

SEQ ID NO: 59414 - RNA, 22 nt, Human
uguggcaauauggaauguguuu

SEQ ID NO: 59415 - RNA, 22 nt, Human
ugugcuggcuucugugagcuga

SEQ ID NO: 59416 - RNA, 22 nt, Human
ugugccuagauuccaugcacuc

SEQ ID NO: 59417 - RNA, 22 nt, Human
ugucugggauguuggcagccac

SEQ ID NO: 59418 - RNA, 22 nt, Human
ugugaaugacuguguucuuugc

SEQ ID NO: 59419 - RNA, 23 nt, Human
ugugaauggccuucuuuagaggu

SEQ ID NO: 59420 - RNA, 22 nt, Human
ugugaugagaugaacuguagac

SEQ ID NO: 59421 - RNA, 22 nt, Human
uugccucuaauuagcucuguga

SEQ ID NO: 59422 - RNA, 22 nt, Human
ugucauuggugaucugaugccu

SEQ ID NO: 59423 - RNA, 22 nt, Human
ugucauggacuggauuucugcu

SEQ ID NO: 59424 - RNA, 20 nt, Human
ugucccuggagagcugcaga

SEQ ID NO: 59425 - RNA, 22 nt, Human
ugucagacagggcugcagucag

SEQ ID NO: 59426 - RNA, 22 nt, Human
uugauggaggaaaaguuggaau

SEQ ID NO: 59427 - RNA, 22 nt, Human
ugucacguaaaaacuagauuuc

SEQ ID NO: 59428 - RNA, 22 nt, Human
uguaucuguguguauguguuua

SEQ ID NO: 59429 - RNA, 22 nt, Human
uugauaacuuagcugggcugcu

SEQ ID NO: 59430 - RNA, 22 nt, Human
ugguuuccugauggacacuugg

SEQ ID NO: 59431 - RNA, 22 nt, Human
uugaaaaaaucugaggaggacc

SEQ ID NO: 59432 - RNA, 22 nt, Human
ugguggcaauuuuuggggucaa

SEQ ID NO: 59433 - RNA, 18 nt, Human
uucugcggugacagauau

SEQ ID NO: 59434 - RNA, 22 nt, Human
uggugcagacaggagccccgcu

SEQ ID NO: 59435 - RNA, 22 nt, Human
ugggucaguagccuugcagaac

SEQ ID NO: 59436 - RNA, 22 nt, Human
uggggagcucagcaccaucagu

SEQ ID NO: 59437 - RNA, 22 nt, Human
ugggccgugagacgucucuggg

SEQ ID NO: 59438 - RNA, 22 nt, Human
ugggcuguuucuuaaggauaug

SEQ ID NO: 59439 - RNA, 22 nt, Human
ugggccaaaugucugcauaagu

SEQ ID NO: 59440 - RNA, 22 nt, Human
ugggcaguccagcuggaaacgg

SEQ ID NO: 59441 - RNA, 22 nt, Human
ugggauucucagaaacacagag

SEQ ID NO: 59442 - RNA, 22 nt, Human
ugggaugagcuauauagaaagu

SEQ ID NO: 59443 - RNA, 22 nt, Human
ugggaggcugugggaauggguc

SEQ ID NO: 59444 - RNA, 20 nt, Human
ugggauggaaucaccugcac

SEQ ID NO: 59445 - RNA, 22 nt, Human
uggcuuuugaaaaggugaugua

SEQ ID NO: 59446 - RNA, 22 nt, Human
uggcuucuggccaggcacagga

SEQ ID NO: 59447 - RNA, 22 nt, Human
uuccagguggcuuuccuggggg

SEQ ID NO: 59448 - RNA, 22 nt, Human
uuccagaacaauguggacguau

SEQ ID NO: 59449 - RNA, 22 nt, Human
uuccagauguuuaaguucugcu

SEQ ID NO: 59450 - RNA, 18 nt, Human
uggcuagaagagcucuca

SEQ ID NO: 59451 - RNA, 22 nt, Human
uggcggagacauggacuucaga

SEQ ID NO: 59452 - RNA, 22 nt, Human
uggcggcggggagguaggcaga

SEQ ID NO: 59453 - RNA, 22 nt, Human
uggcgcgcucgcucucgcugag

SEQ ID NO: 59454 - RNA, 22 nt, Human
uucaugucuuugauucugauaa

SEQ ID NO: 59455 - RNA, 20 nt, Human
uucaugcagugguugcugug

SEQ ID NO: 59456 - RNA, 22 nt, Human
uucaucuucaaaccccagugcc

SEQ ID NO: 59457 - RNA, 20 nt, Human
uggcccgcgcuccuccugcu

SEQ ID NO: 59458 - RNA, 22 nt, Human
uggccuucagcucuggggugca

SEQ ID NO: 59459 - RNA, 20 nt, Human
uggccgacccugaggaguug

SEQ ID NO: 59460 - RNA, 22 nt, Human
uggcccugaaucaaggccagca

SEQ ID NO: 59461 - RNA, 22 nt, Human
uucaguuuugcuuuuaaucaug

SEQ ID NO: 59462 - RNA, 22 nt, Human
uggccaugagaaucuuugcugu

SEQ ID NO: 59463 - RNA, 22 nt, Human
uucaggaaacaaauuugcaguu

SEQ ID NO: 59464 - RNA, 20 nt, Human
uggcaugaaauuuuccaagc

SEQ ID NO: 59465 - RNA, 18 nt, Human
uggcaugcuuugauacau

SEQ ID NO: 59466 - RNA, 22 nt, Human
uggcauuuuguagcuguguauc

SEQ ID NO: 59467 - RNA, 22 nt, Human
uggcaucucggugcugguucuu

SEQ ID NO: 59468 - RNA, 22 nt, Human
uggcaucuggugauauggacua

SEQ ID NO: 59469 - RNA, 22 nt, Human
uggcaguaaagcuggaaaagug

SEQ ID NO: 59470 - RNA, 22 nt, Human
uggcaguagagcuggaacuuga

SEQ ID NO: 59471 - RNA, 21 nt, Human
uggcaggcagcuggaagcuug

SEQ ID NO: 59472 - RNA, 22 nt, Human
uucagaagguaggaaugucccu

SEQ ID NO: 59473 - RNA, 22 nt, Human
uucagaauguacugauagaaca

SEQ ID NO: 59474 - RNA, 22 nt, Human
uggcagccugcgugaaggagcu

SEQ ID NO: 59475 - RNA, 22 nt, Human
uucagaaagugaaucuuguuau

SEQ ID NO: 59476 - RNA, 22 nt, Human
uggcagccucugguccuuaguu

SEQ ID NO: 59477 - RNA, 22 nt, Human
uggcacguuggauugggaguuc

SEQ ID NO: 59478 - RNA, 22 nt, Human
uggcacugaagcuggaaagccu

SEQ ID NO: 59479 - RNA, 22 nt, Human
uggcaaggccacaggugcaguu

SEQ ID NO: 59480 - RNA, 22 nt, Human
uucacccaaaucaagcuggccu

SEQ ID NO: 59481 - RNA, 22 nt, Human
uucacccuucucuggcuuucag

SEQ ID NO: 59482 - RNA, 22 nt, Human
uggaguuuuaaucuguacagaa

SEQ ID NO: 59483 - RNA, 22 nt, Human
uucaaugcaagggaggucugaa

SEQ ID NO: 59484 - RNA, 22 nt, Human
uggauauagcugaggugucuug

SEQ ID NO: 59485 - RNA, 20 nt, Human
uggaucgaccucacuuccau

SEQ ID NO: 59486 - RNA, 20 nt, Human
uggaugacuucaggcagccu

SEQ ID NO: 59487 - RNA, 22 nt, Human
uggaugagugaauggauaaauc

SEQ ID NO: 59488 - RNA, 22 nt, Human
uggaggaugacagagaugggcu

SEQ ID NO: 59489 - RNA, 22 nt, Human
uuauuccauagaagucaaggaa

SEQ ID NO: 59490 - RNA, 20 nt, Human
ugcuaucugcucucccuucu

SEQ ID NO: 59491 - RNA, 22 nt, Human
ugcgcgccgacggcuccgugac

SEQ ID NO: 59492 - RNA, 22 nt, Human
ugcgcgcaccugcauauauaug

SEQ ID NO: 59493 - RNA, 22 nt, Human
uguuccacgcguaguuccugcu

SEQ ID NO: 59494 - RNA, 23 nt, Human
uguuccugaugccucguccuguc

SEQ ID NO: 59495 - RNA, 22 nt, Human
uguuggaauaagugcuugaagg

SEQ ID NO: 59496 - RNA, 22 nt, Human
uguuccucuuagucuuaugugu

SEQ ID NO: 59497 - RNA, 22 nt, Human
ugcgccccgcgggccuucgggc

SEQ ID NO: 59498 - RNA, 22 nt, Human
uguguuuuucauuuuaaguccu

SEQ ID NO: 59499 - RNA, 17 nt, Human
ugccuucgucuucaguu

SEQ ID NO: 59500 - RNA, 22 nt, Human
uguguuucucugaggggucccu

SEQ ID NO: 59501 - RNA, 19 nt, Human
ugccuggcaccagcuccac

SEQ ID NO: 59502 - RNA, 22 nt, Human
uguggucuccucucugucuucc

SEQ ID NO: 59503 - RNA, 22 nt, Human
ugugggcugcuguuuccuugua

SEQ ID NO: 59504 - RNA, 22 nt, Human
ugugggcguggguuggggaggg

SEQ ID NO: 59505 - RNA, 22 nt, Human
ugcccaaucaauuguagcuauu

SEQ ID NO: 59506 - RNA, 22 nt, Human
ugcauucugaacguaaauguga

SEQ ID NO: 59507 - RNA, 22 nt, Human
ugcauuugcaauggguacacaa

SEQ ID NO: 59508 - RNA, 22 nt, Human
ugcauuuucuaccacacccacu

SEQ ID NO: 59509 - RNA, 22 nt, Human
ugcauuuugaaggaaaaaaaug

SEQ ID NO: 59510 - RNA, 22 nt, Human
ugcauugccauagcagggggau

SEQ ID NO: 59511 - RNA, 22 nt, Human
ugcauuccagcucccuucuggc

SEQ ID NO: 59512 - RNA, 22 nt, Human
ugcaucauuaagguacaguugg

SEQ ID NO: 59513 - RNA, 22 nt, Human
uguggcuuaggugagcauguga

SEQ ID NO: 59514 - RNA, 22 nt, Human
ugugcgcgugugcuuugugugu

SEQ ID NO: 59515 - RNA, 22 nt, Human
ugugccuuucacuaugucauuc

SEQ ID NO: 59516 - RNA, 22 nt, Human
ugcagaacacaguagacagaac

SEQ ID NO: 59517 - RNA, 22 nt, Human
ugucuucagguuccucaccacu

SEQ ID NO: 59518 - RNA, 16 nt, Human
ugcaccgggaacacug

SEQ ID NO: 59519 - RNA, 22 nt, Human
ugucugcauucgaguucaugga

SEQ ID NO: 59520 - RNA, 23 nt, Human
ugucugccuaucaugugaaggac

SEQ ID NO: 59521 - RNA, 20 nt, Human
ugucugguaagacgcccauc

SEQ ID NO: 59522 - RNA, 22 nt, Human
ugcaaauuuuuuuauuuuuccu

SEQ ID NO: 59523 - RNA, 22 nt, Human
ugucccuaucagucccaaguca

SEQ ID NO: 59524 - RNA, 19 nt, Human
ugcaagcuuuuucuuguua

SEQ ID NO: 59525 - RNA, 22 nt, Human
ugucaaguuguuaaguucuggg

SEQ ID NO: 59526 - RNA, 22 nt, Human
ugauuccugugcuuauuccagu

SEQ ID NO: 59527 - RNA, 18 nt, Human
ugauggcuaagagccggg

SEQ ID NO: 59528 - RNA, 22 nt, Human
ugauggaucuguuggcggguuu

SEQ ID NO: 59529 - RNA, 22 nt, Human
ugauggugagaugucccguguu

SEQ ID NO: 59530 - RNA, 22 nt, Human
ugaugaugccaaaauuuggcau

SEQ ID NO: 59531 - RNA, 22 nt, Human
ugaugaugauacauuucuucag

SEQ ID NO: 59532 - RNA, 22 nt, Human
uguaauuugguuagauuucuuu

SEQ ID NO: 59533 - RNA, 22 nt, Human
ugaugaugaagaaauauuauca

SEQ ID NO: 59534 - RNA, 22 nt, Human
ugaguugucacaacgucacaag

SEQ ID NO: 59535 - RNA, 22 nt, Human
ugagggauuucuggccuuaacu

SEQ ID NO: 59536 - RNA, 19 nt, Human
ugguggaggugcaccugac

SEQ ID NO: 59537 - RNA, 23 nt, Human
uggugcagcgcaggccggguggc

SEQ ID NO: 59538 - RNA, 22 nt, Human
ugagccauguucaugaguucau

SEQ ID NO: 59539 - RNA, 22 nt, Human
ugaggaagugguuguaugguuu

SEQ ID NO: 59540 - RNA, 22 nt, Human
ugggguuuuagagcaggcagag

SEQ ID NO: 59541 - RNA, 22 nt, Human
ugagccugaguguguauugaac

SEQ ID NO: 59542 - RNA, 17 nt, Human
ugacagcuaaggggcuu

SEQ ID NO: 59543 - RNA, 22 nt, Human
ugaauguguacacgauuguuug

SEQ ID NO: 59544 - RNA, 22 nt, Human
ugaauuucuuuuuaaaauauua

SEQ ID NO: 59545 - RNA, 22 nt, Human
uggggcuuucgcggagcgucgg

SEQ ID NO: 59546 - RNA, 22 nt, Human
uggggcgccuggcugaggcugc

SEQ ID NO: 59547 - RNA, 22 nt, Human
uggggcggaaggaggagaggug

SEQ ID NO: 59548 - RNA, 22 nt, Human
ugggggagggagaguugauggg

SEQ ID NO: 59549 - RNA, 22 nt, Human
uggggaauguaauucuuuggcu

SEQ ID NO: 59550 - RNA, 21 nt, Human
uggggaugcauugcagaggca

SEQ ID NO: 59551 - RNA, 23 nt, Human
ugggccucuccacccuuuucugu

SEQ ID NO: 59552 - RNA, 22 nt, Human
ugggcagggagcuggaaccaca

SEQ ID NO: 59553 - RNA, 22 nt, Human
ugggcacacugaaucugcuauu

SEQ ID NO: 59554 - RNA, 22 nt, Human
ugaaggccagggauuugcagcc

SEQ ID NO: 59555 - RNA, 22 nt, Human
ugggagccuuccacugggggaa

SEQ ID NO: 59556 - RNA, 22 nt, Human
ugaagacuucuuuuggucacca

SEQ ID NO: 59557 - RNA, 22 nt, Human
ugaagccacacuagcuuguccu

SEQ ID NO: 59558 - RNA, 22 nt, Human
ugaaccgcuucauggugccugu

SEQ ID NO: 59559 - RNA, 22 nt, Human
ugaaccgacaggggaagauugu

SEQ ID NO: 59560 - RNA, 22 nt, Human
ugaacuggauuugugagcuccu

SEQ ID NO: 59561 - RNA, 22 nt, Human
ugggaagcugagccucgaugug

SEQ ID NO: 59562 - RNA, 22 nt, Human
ugggaagaguuagagacagcug

SEQ ID NO: 59563 - RNA, 22 nt, Human
ugggaaaauugugauucuuucu

SEQ ID NO: 59564 - RNA, 22 nt, Human
uggcuguuggagcuggaagaug

SEQ ID NO: 59565 - RNA, 22 nt, Human
uggcugggagcuggaacugggc

SEQ ID NO: 59566 - RNA, 22 nt, Human
uggcugagcugcagcguggcuu

SEQ ID NO: 59567 - RNA, 22 nt, Human
ugaaagcuggcucugcagagug

SEQ ID NO: 59568 - RNA, 23 nt, Human
uggcucugagcuuccugguggcc

SEQ ID NO: 59569 - RNA, 22 nt, Human
ucuuugcugacacuuacacugu

SEQ ID NO: 59570 - RNA, 22 nt, Human
ucuuuucagccagcugguagga

SEQ ID NO: 59571 - RNA, 22 nt, Human
uggcggcuggacuggggggcca

SEQ ID NO: 59572 - RNA, 22 nt, Human
uggcuucagacuucugcuacgu

SEQ ID NO: 59573 - RNA, 22 nt, Human
uggcuugagcugggcccaccug

SEQ ID NO: 59574 - RNA, 22 nt, Human
uggcuuuucaccugcuccucug

SEQ ID NO: 59575 - RNA, 22 nt, Human
ugaaaugccucuuugguucuaa

SEQ ID NO: 59576 - RNA, 21 nt, Human
ugaacaccaggagaaaucggu

SEQ ID NO: 59577 - RNA, 22 nt, Human
ugaacagacuauucucccaugu

SEQ ID NO: 59578 - RNA, 19 nt, Human
ucuuucauuucuagcucug

SEQ ID NO: 59579 - RNA, 22 nt, Human
ucuuucucauccaaacuaguug

SEQ ID NO: 59580 - RNA, 22 nt, Human
ucuuucucuccagccuggaccu

SEQ ID NO: 59581 - RNA, 22 nt, Human
ucuuuaaauucuuaugagugaa

SEQ ID NO: 59582 - RNA, 22 nt, Human
ucuugggcaguccucuacuggu

SEQ ID NO: 59583 - RNA, 22 nt, Human
uggccauuuacucuguaagagu

SEQ ID NO: 59584 - RNA, 22 nt, Human
ucuucuuugugguugcccaagg

SEQ ID NO: 59585 - RNA, 22 nt, Human
uggcauuugagcuggaaggaug

SEQ ID NO: 59586 - RNA, 19 nt, Human
ucuugcaucuuccuacugu

SEQ ID NO: 59587 - RNA, 22 nt, Human
uggcaugugaauuguuacauug

SEQ ID NO: 59588 - RNA, 22 nt, Human
uggcagcauuuuuuccagaaca

SEQ ID NO: 59589 - RNA, 22 nt, Human
uggcacugcccugucucggugg

SEQ ID NO: 59590 - RNA, 22 nt, Human
uggcagaaugaagacuggggcc

SEQ ID NO: 59591 - RNA, 22 nt, Human
uggcacaggcagaaggugccgc

SEQ ID NO: 59592 - RNA, 22 nt, Human
ucuuauucuuuuaaacaacgca

SEQ ID NO: 59593 - RNA, 22 nt, Human
ucuuauugguaaugauggcauu

SEQ ID NO: 59594 - RNA, 22 nt, Human
ucuuauugugaugaugaagaac

SEQ ID NO: 59595 - RNA, 22 nt, Human
uggaugccuugggggaggagga

SEQ ID NO: 59596 - RNA, 22 nt, Human
uggaugccauuugauuaaggcu

SEQ ID NO: 59597 - RNA, 22 nt, Human
uggauaugaaacaaaacaagag

SEQ ID NO: 59598 - RNA, 21 nt, Human
uggaggcguaaucacuguuga

SEQ ID NO: 59599 - RNA, 19 nt, Human
uggaggcggguggcccaga

SEQ ID NO: 59600 - RNA, 20 nt, Human
uggagggaggaggggcccaa

SEQ ID NO: 59601 - RNA, 22 nt, Human
ucuguucucuuguucugacggu

SEQ ID NO: 59602 - RNA, 22 nt, Human
uggaggaggagaacuuggcacu

SEQ ID NO: 59603 - RNA, 22 nt, Human
uggaggauggaaggaaagcugg

SEQ ID NO: 59604 - RNA, 22 nt, Human
uggagagcaaugaggggcaggc

SEQ ID NO: 59605 - RNA, 21 nt, Human
uggagcagggaggauuugggg

SEQ ID NO: 59606 - RNA, 22 nt, Human
uggaaggaaauguguaucauaa

SEQ ID NO: 59607 - RNA, 22 nt, Human
uggaagcccagaaggaagcaga

SEQ ID NO: 59608 - RNA, 21 nt, Human
uggaagggaagucuugguugu

SEQ ID NO: 59609 - RNA, 22 nt, Human
uggacagguacuucacauuauu

SEQ ID NO: 59610 - RNA, 22 nt, Human
uggagagauagucauucuagag

SEQ ID NO: 59611 - RNA, 22 nt, Human
ucuggaggucucagggcgggaa

SEQ ID NO: 59612 - RNA, 22 nt, Human
ucuggcacuugccaguuucuau

SEQ ID NO: 59613 - RNA, 22 nt, Human
ucuggaaauggaaguaacuaug

SEQ ID NO: 59614 - RNA, 22 nt, Human
uggaacugguuugcuucagacu

SEQ ID NO: 59615 - RNA, 22 nt, Human
ucugcggccuagcgcccggcgc

SEQ ID NO: 59616 - RNA, 22 nt, Human
ucugcggccggaauucccuuca

SEQ ID NO: 59617 - RNA, 22 nt, Human
uggaaaugcuuagaggugaucu

SEQ ID NO: 59618 - RNA, 22 nt, Human
ucugcagggcccuuggcuccug

SEQ ID NO: 59619 - RNA, 22 nt, Human
uggaaaggcccauaaaaggaua

SEQ ID NO: 59620 - RNA, 22 nt, Human
uggaaaggaguucuguuuauuu

SEQ ID NO: 59621 - RNA, 22 nt, Human
ugcugccucccaucccucccga

SEQ ID NO: 59622 - RNA, 22 nt, Human
ugcugccgccgccaccgccgcc

SEQ ID NO: 59623 - RNA, 22 nt, Human
ucuacuccaucugccagggcuu

SEQ ID NO: 59624 - RNA, 22 nt, Human
uggaaagauuuaaaauaacgag

SEQ ID NO: 59625 - RNA, 22 nt, Human
ucguccaauaaccugccagcgc

SEQ ID NO: 59626 - RNA, 22 nt, Human
ucuaaaaauuagaaauuagguc

SEQ ID NO: 59627 - RNA, 22 nt, Human
ucgucaaaguaaugucauagca

SEQ ID NO: 59628 - RNA, 22 nt, Human
ugcucugguccucccucggcgc

SEQ ID NO: 59629 - RNA, 22 nt, Human
ugcucuuguauccaaaagugau

SEQ ID NO: 59630 - RNA, 22 nt, Human
ugcucuuucaggcauagaccuu

SEQ ID NO: 59631 - RNA, 22 nt, Human
ugcucgggcuccuuugagugag

SEQ ID NO: 59632 - RNA, 22 nt, Human
ucgggccacauccacacaucca

SEQ ID NO: 59633 - RNA, 22 nt, Human
ucgggcccggcucccgacgccc

SEQ ID NO: 59634 - RNA, 22 nt, Human
ucgggacccccgcccgggcccg

SEQ ID NO: 59635 - RNA, 22 nt, Human
ucggccuuuucuuauacccaca

SEQ ID NO: 59636 - RNA, 22 nt, Human
ugcuauuuuguuuucaguccau

SEQ ID NO: 59637 - RNA, 22 nt, Human
ugcuaucuagaaauacuggguu

SEQ ID NO: 59638 - RNA, 22 nt, Human
ugcuauucuuggagcugaugga

SEQ ID NO: 59639 - RNA, 22 nt, Human
ugcguugaggaccgcgagggcg

SEQ ID NO: 59640 - RNA, 19 nt, Human
ugcgggcugcggucagggc

SEQ ID NO: 59641 - RNA, 22 nt, Human
ugcggugcgcccgggcgagugc

SEQ ID NO: 59642 - RNA, 22 nt, Human
ugcggugcagcccugcccucuc

SEQ ID NO: 59643 - RNA, 22 nt, Human
ugcgccaggacacccguggcgg

SEQ ID NO: 59644 - RNA, 22 nt, Human
ucgcccagguuggagugcagug

SEQ ID NO: 59645 - RNA, 22 nt, Human
ucgagcgcucccugugcucucg

SEQ ID NO: 59646 - RNA, 22 nt, Human
ugccuguguauuuccggccugc

SEQ ID NO: 59647 - RNA, 22 nt, Human
uccuucuguuguuuauuuuaaa

SEQ ID NO: 59648 - RNA, 22 nt, Human
uccuucuuuucgccggaguuga

SEQ ID NO: 59649 - RNA, 22 nt, Human
ugccgcuuucuggcccucaguc

SEQ ID NO: 59650 - RNA, 22 nt, Human
ugccgggcugagcaagugcugc

SEQ ID NO: 59651 - RNA, 22 nt, Human
uccuuaggaccuagagguagua

SEQ ID NO: 59652 - RNA, 22 nt, Human
ugccgcaggaggggcgauuucu

SEQ ID NO: 59653 - RNA, 22 nt, Human
ugccgccgugggucccgacgcg

SEQ ID NO: 59654 - RNA, 23 nt, Human
ugccggaucuacuuuggguucuc

SEQ ID NO: 59655 - RNA, 22 nt, Human
ugcccugcagacccugcagugu

SEQ ID NO: 59656 - RNA, 22 nt, Human
ugcccuuucuccagugaccauu

SEQ ID NO: 59657 - RNA, 21 nt, Human
uccucucuaaguuccgccccg

SEQ ID NO: 59658 - RNA, 22 nt, Human
uccucuuguguguuccgguacc

SEQ ID NO: 59659 - RNA, 20 nt, Human
uccugaaauuacgugauuca

SEQ ID NO: 59660 - RNA, 22 nt, Human
ugccaucaugucagauuuggga

SEQ ID NO: 59661 - RNA, 22 nt, Human
ugccaugguuguacaguagcag

SEQ ID NO: 59662 - RNA, 22 nt, Human
ugccauuggucuuaaggcuagc

SEQ ID NO: 59663 - RNA, 22 nt, Human
ugccagauuaugucuccagggc

SEQ ID NO: 59664 - RNA, 22 nt, Human
ugcauugccucuauucauuaua

SEQ ID NO: 59665 - RNA, 22 nt, Human
ugcauucugggucgcagagugg

SEQ ID NO: 59666 - RNA, 22 nt, Human
ugccaaugauuccacaauggaa

SEQ ID NO: 59667 - RNA, 22 nt, Human
ugcauguuuuaagugaagcuga

SEQ ID NO: 59668 - RNA, 22 nt, Human
ugcauuauaacaauaaggcuua

SEQ ID NO: 59669 - RNA, 22 nt, Human
ugcaugaucucacuuacaggug

SEQ ID NO: 59670 - RNA, 22 nt, Human
ucccuuuuuaauugugucccug

SEQ ID NO: 59671 - RNA, 22 nt, Human
ucccuuuuagccccgcccuccu

SEQ ID NO: 59672 - RNA, 22 nt, Human
ucccuuucuucuugguccaccu

SEQ ID NO: 59673 - RNA, 22 nt, Human
ugcagcuucucugcaacaggag

SEQ ID NO: 59674 - RNA, 19 nt, Human
ugcagcuguaugagcuuaa

SEQ ID NO: 59675 - RNA, 22 nt, Human
ugcacgcgcccuucgauggccc

SEQ ID NO: 59676 - RNA, 22 nt, Human
ugcacgcacuugcucuccagcg

SEQ ID NO: 59677 - RNA, 22 nt, Human
ugcagagagccagcucucucgg

SEQ ID NO: 59678 - RNA, 22 nt, Human
ugcagaggagcuggaaggcugg

SEQ ID NO: 59679 - RNA, 22 nt, Human
ugcacauuucucacaauguaca

SEQ ID NO: 59680 - RNA, 22 nt, Human
ugcaaggcacccacucugcuuu

SEQ ID NO: 59681 - RNA, 21 nt, Human
ugcaacugaaaggaauauggu

SEQ ID NO: 59682 - RNA, 22 nt, Human
ugcaagauccagucuugagaag

SEQ ID NO: 59683 - RNA, 22 nt, Human
uccaugcgcgauggccuggcuu

SEQ ID NO: 59684 - RNA, 22 nt, Human
uccaugcaguagaggcgcuggg

SEQ ID NO: 59685 - RNA, 22 nt, Human
uccauggucgauggcugcuggg

SEQ ID NO: 59686 - RNA, 22 nt, Human
uccaucaccacagaggacagag

SEQ ID NO: 59687 - RNA, 22 nt, Human
ugcaaaaagagcgaggagcccu

SEQ ID NO: 59688 - RNA, 22 nt, Human
uccagugccagcuguuaaaguu

SEQ ID NO: 59689 - RNA, 22 nt, Human
uccagaaaucucuguugauugu

SEQ ID NO: 59690 - RNA, 22 nt, Human
uccacgcucuuucuacuuuuca

SEQ ID NO: 59691 - RNA, 22 nt, Human
uccaagcgcuucuggagcuccu

SEQ ID NO: 59692 - RNA, 22 nt, Human
ugauggaguauaauaaaaugac

SEQ ID NO: 59693 - RNA, 22 nt, Human
ugaugaucaugcagguugguuu

SEQ ID NO: 59694 - RNA, 22 nt, Human
ugaugaaguuggaaggaaaguu

SEQ ID NO: 59695 - RNA, 22 nt, Human
ucauuguguaguagagguggca

SEQ ID NO: 59696 - RNA, 22 nt, Human
ucauaggaguagcagugagagg

SEQ ID NO: 59697 - RNA, 22 nt, Human
ugaguuucuuacucaggagcug

SEQ ID NO: 59698 - RNA, 22 nt, Human
ugaggggaggggagaaaauggu

SEQ ID NO: 59699 - RNA, 22 nt, Human
ucaggcgcucuucguggcugcc

SEQ ID NO: 59700 - RNA, 22 nt, Human
ucagcucaggggauguggggga

SEQ ID NO: 59701 - RNA, 22 nt, Human
ugacgcauggccagcucugucu

SEQ ID NO: 59702 - RNA, 22 nt, Human
ugaccgucagcugucuuccauu

SEQ ID NO: 59703 - RNA, 22 nt, Human
ugaccuacauuuauagcuguca

SEQ ID NO: 59704 - RNA, 22 nt, Human
ucagauggucauucacuagggu

SEQ ID NO: 59705 - RNA, 22 nt, Human
ugacagugugcccggagguuag

SEQ ID NO: 59706 - RNA, 22 nt, Human
ucagaaggagagacagcgugga

SEQ ID NO: 59707 - RNA, 21 nt, Human
ucagaaucguuccagguagau

SEQ ID NO: 59708 - RNA, 20 nt, Human
ucagaaugugacccccaugg

SEQ ID NO: 59709 - RNA, 22 nt, Human
ucagagccagacacacagcaga

SEQ ID NO: 59710 - RNA, 18 nt, Human
ucagaggagauaccuaaa

SEQ ID NO: 59711 - RNA, 22 nt, Human
ucagagugagcuggggcugcuu

SEQ ID NO: 59712 - RNA, 22 nt, Human
ucacuuuacaucuguaaaagga

SEQ ID NO: 59713 - RNA, 22 nt, Human
ucacucgccuuuucguucgccg

SEQ ID NO: 59714 - RNA, 22 nt, Human
ucacugccuagggcuacugugc

SEQ ID NO: 59715 - RNA, 22 nt, Human
ugaaugcuacccugcuggcucu

SEQ ID NO: 59716 - RNA, 22 nt, Human
ugaaucugagccugcgcaaagu

SEQ ID NO: 59717 - RNA, 23 nt, Human
ucacaaggcuauguuauauguac

SEQ ID NO: 59718 - RNA, 22 nt, Human
ugaaucuuguuuacugauuccu

SEQ ID NO: 59719 - RNA, 22 nt, Human
ucaagggaccaagcauucauua

SEQ ID NO: 59720 - RNA, 22 nt, Human
ucaagcaaggaauccuuuugua

SEQ ID NO: 59721 - RNA, 22 nt, Human
ucaagaagauaaugucuagggu

SEQ ID NO: 59722 - RNA, 21 nt, Human
ucaaccagguguugaaggcac

SEQ ID NO: 59723 - RNA, 21 nt, Human
ugaagcccugugaggugcuua

SEQ ID NO: 59724 - RNA, 22 nt, Human
ugaagacaguuuuacucaugag

SEQ ID NO: 59725 - RNA, 22 nt, Human
ugaaccugagggcaaagggaca

SEQ ID NO: 59726 - RNA, 22 nt, Human
ugaaaggaauuuaaauguuguu

SEQ ID NO: 59727 - RNA, 23 nt, Human
uauuuuccccuguaauauguauu

SEQ ID NO: 59728 - RNA, 22 nt, Human
uauuuucucugccacacuucca

SEQ ID NO: 59729 - RNA, 22 nt, Human
uauuuguuucuaguggcagcaa

SEQ ID NO: 59730 - RNA, 22 nt, Human
ucuuuugaacauccaggauguc

SEQ ID NO: 59731 - RNA, 22 nt, Human
ucuuuugugauuuucugaagca

SEQ ID NO: 59732 - RNA, 22 nt, Human
ucuuuguuagucagaauugauc

SEQ ID NO: 59733 - RNA, 22 nt, Human
ucuuuccagaccagccccagcu

SEQ ID NO: 59734 - RNA, 22 nt, Human
ucuuucugaugggaagggucaa

SEQ ID NO: 59735 - RNA, 22 nt, Human
ucuuuaucugugagcagucucc

SEQ ID NO: 59736 - RNA, 22 nt, Human
ucuuggcaguucuugugcuuuu

SEQ ID NO: 59737 - RNA, 20 nt, Human
ucuugucuggcagccuggag

SEQ ID NO: 59738 - RNA, 22 nt, Human
ucuugcuguagcuguuucuucu

SEQ ID NO: 59739 - RNA, 22 nt, Human
ucuugccccugcuuuggaacaa

SEQ ID NO: 59740 - RNA, 22 nt, Human
ucuucuuuccuuuugugcauuu

SEQ ID NO: 59741 - RNA, 22 nt, Human
ucuugauggugauguuguguca

SEQ ID NO: 59742 - RNA, 22 nt, Human
ucuucccgggcaucucugcuca

SEQ ID NO: 59743 - RNA, 22 nt, Human
ucuuccuuacucuggauguuau

SEQ ID NO: 59744 - RNA, 22 nt, Human
ucuuccuuguaagggcuuuaga

SEQ ID NO: 59745 - RNA, 22 nt, Human
ucuuccauuccccuccuacgcc

SEQ ID NO: 59746 - RNA, 20 nt, Human
uaguggaccuugaaggccuc

SEQ ID NO: 59747 - RNA, 22 nt, Human
ucguggaugaagaauagaggcc

SEQ ID NO: 59748 - RNA, 22 nt, Human
ucgugaagaaauguggacuuca

SEQ ID NO: 59749 - RNA, 22 nt, Human
ucgggcgaauguuguuuuucuc

SEQ ID NO: 59750 - RNA, 21 nt, Human
ucgggcggcggcugaggcggc

SEQ ID NO: 59751 - RNA, 22 nt, Human
ucggcgaccugucauggaccaa

SEQ ID NO: 59752 - RNA, 22 nt, Human
ucggccggagggggcgggcgca

SEQ ID NO: 59753 - RNA, 22 nt, Human
ucgcuuuaauggucuucacagc

SEQ ID NO: 59754 - RNA, 22 nt, Human
uaggcuuuguuacuuucccuuu

SEQ ID NO: 59755 - RNA, 20 nt, Human
ucgcugcaagggaaauggag

SEQ ID NO: 59756 - RNA, 22 nt, Human
ucgcucgcuggcuccugcccgc

SEQ ID NO: 59757 - RNA, 22 nt, Human
ucgcuauuauuuuagguucuca

SEQ ID NO: 59758 - RNA, 22 nt, Human
ucgcgcgugccacgcgccgcgg

SEQ ID NO: 59759 - RNA, 22 nt, Human
ucgcggccgcuccacaugcaca

SEQ ID NO: 59760 - RNA, 22 nt, Human
ucgccuccucccagaucaacaa

SEQ ID NO: 59761 - RNA, 22 nt, Human
ucgccauguacaugaagggcgg

SEQ ID NO: 59762 - RNA, 22 nt, Human
ucgagcacaccagacuugcaga

SEQ ID NO: 59763 - RNA, 22 nt, Human
uccugcccuguccuugccucug

SEQ ID NO: 59764 - RNA, 21 nt, Human
uccugccuggccuucugacua

SEQ ID NO: 59765 - RNA, 22 nt, Human
uagcauaaaguuucuguguggu

SEQ ID NO: 59766 - RNA, 22 nt, Human
uccucuucucuagagccggaau

SEQ ID NO: 59767 - RNA, 22 nt, Human
uagcaaucugugaugugugugu

SEQ ID NO: 59768 - RNA, 22 nt, Human
uagacuggaagcuccuugaggc

SEQ ID NO: 59769 - RNA, 22 nt, Human
uccuacccccuucuccagcucc

SEQ ID NO: 59770 - RNA, 22 nt, Human
uagacauuuacuuugaaaaaau

SEQ ID NO: 59771 - RNA, 22 nt, Human
ucccagccugacagugcaucaa

SEQ ID NO: 59772 - RNA, 22 nt, Human
ucccagcaggcaccgcuucugc

SEQ ID NO: 59773 - RNA, 22 nt, Human
ucccagaaccuuuuagcuucac

SEQ ID NO: 59774 - RNA, 22 nt, Human
uacucgaaaucagagagaauaa

SEQ ID NO: 59775 - RNA, 22 nt, Human
uacucuggaguugagaugcgag

SEQ ID NO: 59776 - RNA, 22 nt, Human
uccauucccugacagccucuuu

SEQ ID NO: 59777 - RNA, 22 nt, Human
uccaggucgggggugggccggc

SEQ ID NO: 59778 - RNA, 20 nt, Human
uacccgcagcugggucuggc

SEQ ID NO: 59779 - RNA, 22 nt, Human
uccagcacacagguggcucuca

SEQ ID NO: 59780 - RNA, 22 nt, Human
uccacagggaugccugcggcuu

SEQ ID NO: 59781 - RNA, 19 nt, Human
uccaccgcgugcaccucua

SEQ ID NO: 59782 - RNA, 22 nt, Human
uaagggaagucuucaggagaca

SEQ ID NO: 59783 - RNA, 22 nt, Human
uaaguaauugugguuuuugcca

SEQ ID NO: 59784 - RNA, 22 nt, Human
ucaucuuucuuuauggaaauac

SEQ ID NO: 59785 - RNA, 22 nt, Human
ucaugacaacuugcacaguuuu

SEQ ID NO: 59786 - RNA, 22 nt, Human
ucauccugaagaaccugcuucc

SEQ ID NO: 59787 - RNA, 22 nt, Human
ucauccucguccucuggugccc

SEQ ID NO: 59788 - RNA, 22 nt, Human
ucauccgcaaccacuuuagccu

SEQ ID NO: 59789 - RNA, 21 nt, Human
ucauccagguccugcuucuuc

SEQ ID NO: 59790 - RNA, 22 nt, Human
ucaucauccuuuuuugaagagu

SEQ ID NO: 59791 - RNA, 22 nt, Human
uaagauauugagugguaauuug

SEQ ID NO: 59792 - RNA, 22 nt, Human
ucaucgauggggagcucuacaa

SEQ ID NO: 59793 - RNA, 22 nt, Human
uaaugcucauuuggcucugcaa

SEQ ID NO: 59794 - RNA, 22 nt, Human
uaauggagggucugagucuggg

SEQ ID NO: 59795 - RNA, 20 nt, Human
uacaaggauguucaucagag

SEQ ID NO: 59796 - RNA, 22 nt, Human
ucagcucacaauguugagaaag

SEQ ID NO: 59797 - RNA, 22 nt, Human
uaaaaugcucagauaaauauau

SEQ ID NO: 59798 - RNA, 22 nt, Human
ucagcaaugggauucaggcuuu

SEQ ID NO: 59799 - RNA, 23 nt, Human
ucagccgcuggcgaguccacugg

SEQ ID NO: 59800 - RNA, 22 nt, Human
ucagccuugguuuugguguugg

SEQ ID NO: 59801 - RNA, 22 nt, Human
ucagcgucuccaaaagagcccg

SEQ ID NO: 59802 - RNA, 22 nt, Human
uaaaaaccuuguauuuaacucu

SEQ ID NO: 59803 - RNA, 22 nt, Human
ucagaaugaaauuucuuucaga

SEQ ID NO: 59804 - RNA, 22 nt, Human
guuugggauucuagacaaaaau

SEQ ID NO: 59805 - RNA, 22 nt, Human
guuuugaugugauuucucaugu

SEQ ID NO: 59806 - RNA, 22 nt, Human
guuuuucuagaaaucuccuccu

SEQ ID NO: 59807 - RNA, 22 nt, Human
guuuuguagucuggagacuguc

SEQ ID NO: 59808 - RNA, 22 nt, Human
ucagacucaguuuugucuccug

SEQ ID NO: 59809 - RNA, 22 nt, Human
ucagagaaguaggcuaauggug

SEQ ID NO: 59810 - RNA, 19 nt, Human
ucacggucaaccagagccu

SEQ ID NO: 59811 - RNA, 22 nt, Human
ucacuggaaaacaaauguuuua

SEQ ID NO: 59812 - RNA, 22 nt, Human
ucacuggauucauguuucuuua

SEQ ID NO: 59813 - RNA, 22 nt, Human
ucagaaacuaaauguggauuug

SEQ ID NO: 59814 - RNA, 22 nt, Human
ucaccugccuggguggucaccu

SEQ ID NO: 59815 - RNA, 22 nt, Human
ucaccgucucaguacggaggga

SEQ ID NO: 59816 - RNA, 22 nt, Human
ucacccagacugucugacucuu

SEQ ID NO: 59817 - RNA, 22 nt, Human
guuuauucuuuuauuugugaga

SEQ ID NO: 59818 - RNA, 22 nt, Human
ucacaggagucaaggaauagua

SEQ ID NO: 59819 - RNA, 22 nt, Human
ucaaggaagggguaggaauaau

SEQ ID NO: 59820 - RNA, 21 nt, Human
ucaaguccuggcuuugcucuu

SEQ ID NO: 59821 - RNA, 22 nt, Human
guuccgcggccucgcgcugagc

SEQ ID NO: 59822 - RNA, 22 nt, Human
guuccgcugcaaggccaggaaa

SEQ ID NO: 59823 - RNA, 22 nt, Human
guuauuuugucuuguucaugaa

SEQ ID NO: 59824 - RNA, 22 nt, Human
guguguggacgucugagcccag

SEQ ID NO: 59825 - RNA, 22 nt, Human
uauggcuucucagucaugaaaa

SEQ ID NO: 59826 - RNA, 22 nt, Human
uauuucaguuaagaugagguca

SEQ ID NO: 59827 - RNA, 22 nt, Human
guugagacguguauuggaaucu

SEQ ID NO: 59828 - RNA, 22 nt, Human
uauauguagcucaaaaauuccc

SEQ ID NO: 59829 - RNA, 22 nt, Human
uaguuagagggaagcgacucgg

SEQ ID NO: 59830 - RNA, 22 nt, Human
gugcgaaagaagcgacuccagu

SEQ ID NO: 59831 - RNA, 22 nt, Human
gugccgggcugcggcaaggugu

SEQ ID NO: 59832 - RNA, 20 nt, Human
uagcacagacuuuugcuuac

SEQ ID NO: 59833 - RNA, 22 nt, Human
gugccgaugaggccuggcauuc

SEQ ID NO: 59834 - RNA, 22 nt, Human
gugcagcugggcgcugaccuuc

SEQ ID NO: 59835 - RNA, 22 nt, Human
gugauuucaaauauagagugag

SEQ ID NO: 59836 - RNA, 19 nt, Human
uagagcagcuucagauucc

SEQ ID NO: 59837 - RNA, 22 nt, Human
uagagcucaagaagcaaaagcu

SEQ ID NO: 59838 - RNA, 22 nt, Human
uacugccauuauccugcugaaa

SEQ ID NO: 59839 - RNA, 22 nt, Human
uacugaaagagugguggacucu

SEQ ID NO: 59840 - RNA, 19 nt, Human
uacccggauagccagguag

SEQ ID NO: 59841 - RNA, 22 nt, Human
uacagcgaaaauuuagcuugau

SEQ ID NO: 59842 - RNA, 22 nt, Human
uacaagcucuuguagggggaaa

SEQ ID NO: 59843 - RNA, 22 nt, Human
uacaauguucgcauucucucug

SEQ ID NO: 59844 - RNA, 22 nt, Human
gucugcacgugccagggagggg

SEQ ID NO: 59845 - RNA, 21 nt, Human
uaaggaagagcauuuuagguc

SEQ ID NO: 59846 - RNA, 22 nt, Human
gucacuuugcuugcgaugcucc

SEQ ID NO: 59847 - RNA, 22 nt, Human
gucaagaugcuacauaauggga

SEQ ID NO: 59848 - RNA, 23 nt, Human
uaagccacgugacccuuuauuug

SEQ ID NO: 59849 - RNA, 22 nt, Human
guaucaggacuaaauuauggau

SEQ ID NO: 59850 - RNA, 22 nt, Human
uaacgcaucuggaaacaggaca

SEQ ID NO: 59851 - RNA, 22 nt, Human
uaacauuagcuuugcucaugca

SEQ ID NO: 59852 - RNA, 22 nt, Human
uaaccaggaaaaagauaugcau

SEQ ID NO: 59853 - RNA, 22 nt, Human
gguugcggaccagcugggcugc

SEQ ID NO: 59854 - RNA, 22 nt, Human
gguuccagacaguuauaugggc

SEQ ID NO: 59855 - RNA, 22 nt, Human
gguucuggaaaagaaagcaaag

SEQ ID NO: 59856 - RNA, 22 nt, Human
guuuugugugugugcccacacg

SEQ ID NO: 59857 - RNA, 22 nt, Human
guuuuucuuugauuuagaacca

SEQ ID NO: 59858 - RNA, 22 nt, Human
uaaaggaccuguacuagguuua

SEQ ID NO: 59859 - RNA, 22 nt, Human
gguggcuucuguuugcaagagg

SEQ ID NO: 59860 - RNA, 22 nt, Human
ggugcuuuucacaagcauggga

SEQ ID NO: 59861 - RNA, 22 nt, Human
guuuucuuguuaauuuugaacg

SEQ ID NO: 59862 - RNA, 22 nt, Human
guuuugaagagaagcaagucug

SEQ ID NO: 59863 - RNA, 22 nt, Human
ggugggaauccaggccuucauc

SEQ ID NO: 59864 - RNA, 22 nt, Human
guuuuauguuuuauagacacaa

SEQ ID NO: 59865 - RNA, 22 nt, Human
ggucaucacugagagcagaucc

SEQ ID NO: 59866 - RNA, 21 nt, Human
guugcuccuucuuuuucuugc

SEQ ID NO: 59867 - RNA, 22 nt, Human
guucuucagcccucagguccua

SEQ ID NO: 59868 - RNA, 22 nt, Human
guugaacagucacccugggagu

SEQ ID NO: 59869 - RNA, 23 nt, Human
guugccuuugcaucuucauccau

SEQ ID NO: 59870 - RNA, 22 nt, Human
gggugguggagguuugacagac

SEQ ID NO: 59871 - RNA, 22 nt, Human
ggguggcaagucuuucugcaac

SEQ ID NO: 59872 - RNA, 22 nt, Human
guucucuuaauccuaguuggua

SEQ ID NO: 59873 - RNA, 20 nt, Human
gggucuggcaucucucucug

SEQ ID NO: 59874 - RNA, 22 nt, Human
gggucggcacucuggcagcacc

SEQ ID NO: 59875 - RNA, 22 nt, Human
gggggcugugugcccgcucccc

SEQ ID NO: 59876 - RNA, 22 nt, Human
ggggcuuggguaagaaugcaaa

SEQ ID NO: 59877 - RNA, 22 nt, Human
ggggcuuggguagagcagaaac

SEQ ID NO: 59878 - RNA, 22 nt, Human
ggggcugggaggccggcgcgca

SEQ ID NO: 59879 - RNA, 21 nt, Human
gggguuuuguucuuauaaugu

SEQ ID NO: 59880 - RNA, 22 nt, Human
guucaaggagcagcuugcuaca

SEQ ID NO: 59881 - RNA, 22 nt, Human
ggggcggggagcaugagcuggg

SEQ ID NO: 59882 - RNA, 17 nt, Human
ggggcguguauuugaug

SEQ ID NO: 59883 - RNA, 22 nt, Human
guuagaauggacaaagcugaaa

SEQ ID NO: 59884 - RNA, 22 nt, Human
guuaaaugcagauucugacuca

SEQ ID NO: 59885 - RNA, 22 nt, Human
ggggcgaguguggaccgcagcc

SEQ ID NO: 59886 - RNA, 22 nt, Human
ggggccgggccggcagacuggg

SEQ ID NO: 59887 - RNA, 22 nt, Human
ggggcaucguugauugcauggu

SEQ ID NO: 59888 - RNA, 22 nt, Human
guguuuugagaggaugguuuua

SEQ ID NO: 59889 - RNA, 22 nt, Human
ggggauuucccaaugcgaagca

SEQ ID NO: 59890 - RNA, 22 nt, Human
guguucucagcacccacuucau

SEQ ID NO: 59891 - RNA, 22 nt, Human
guguugacacagccaucuuguc

SEQ ID NO: 59892 - RNA, 22 nt, Human
guguucccauccacaccaagcc

SEQ ID NO: 59893 - RNA, 20 nt, Human
gggcuuugagcucagggcuu

SEQ ID NO: 59894 - RNA, 18 nt, Human
gggcuuugggguucuauc

SEQ ID NO: 59895 - RNA, 22 nt, Human
gggcuuuuccaacacucuggag

SEQ ID NO: 59896 - RNA, 22 nt, Human
gggcuuguuaacuuggcuucca

SEQ ID NO: 59897 - RNA, 22 nt, Human
gugugucucaguugcuccgaag

SEQ ID NO: 59898 - RNA, 22 nt, Human
gggcuggcaguuuucugaguuc

SEQ ID NO: 59899 - RNA, 22 nt, Human
guguccaaagguaggaggaggg

SEQ ID NO: 59900 - RNA, 22 nt, Human
guguauuucuagaagaaaugaa

SEQ ID NO: 59901 - RNA, 22 nt, Human
gggcggcguccucagucgggug

SEQ ID NO: 59902 - RNA, 22 nt, Human
gugguggggaguuggauggaag

SEQ ID NO: 59903 - RNA, 22 nt, Human
gggcggccugcucuguggggag

SEQ ID NO: 59904 - RNA, 22 nt, Human
gggcggggggagcuggaaugaa

SEQ ID NO: 59905 - RNA, 22 nt, Human
gggcgcuguguuaggugcugua

SEQ ID NO: 59906 - RNA, 22 nt, Human
gggcgagcgucucagccgggcg

SEQ ID NO: 59907 - RNA, 22 nt, Human
gggccugcgcuggggggagccg

SEQ ID NO: 59908 - RNA, 22 nt, Human
guggguauauauaugugugcug

SEQ ID NO: 59909 - RNA, 22 nt, Human
gugggccaguuccucacaggua

SEQ ID NO: 59910 - RNA, 22 nt, Human
gugggggauggcgugugggucu

SEQ ID NO: 59911 - RNA, 22 nt, Human
guggggcgggucccccgccugg

SEQ ID NO: 59912 - RNA, 22 nt, Human
guggcuggguggaacugagucu

SEQ ID NO: 59913 - RNA, 22 nt, Human
guggcuugguauuaaggugcca

SEQ ID NO: 59914 - RNA, 22 nt, Human
guggcgucgaugauggugucau

SEQ ID NO: 59915 - RNA, 20 nt, Human
guggcagugguggcagcagu

SEQ ID NO: 59916 - RNA, 22 nt, Human
guggcagagccuugcggcuuug

SEQ ID NO: 59917 - RNA, 22 nt, Human
guggauggagcuggaagccauu

SEQ ID NO: 59918 - RNA, 22 nt, Human
guggauuguaccacgaaaagug

SEQ ID NO: 59919 - RNA, 22 nt, Human
guggcaaguuuucugacaagga

SEQ ID NO: 59920 - RNA, 19 nt, Human
gggccucacccacaccucc

SEQ ID NO: 59921 - RNA, 22 nt, Human
gggccucccggagcugcuccca

SEQ ID NO: 59922 - RNA, 22 nt, Human
gggccgcagccucuccggccug

SEQ ID NO: 59923 - RNA, 22 nt, Human
gggcccggguaggggaagagag

SEQ ID NO: 59924 - RNA, 22 nt, Human
gggccaaggggagcuggaaggg

SEQ ID NO: 59925 - RNA, 22 nt, Human
guggaggaagaucuuugaugau

SEQ ID NO: 59926 - RNA, 22 nt, Human
gggccaggaugugguucauuuu

SEQ ID NO: 59927 - RNA, 22 nt, Human
guggagauauuugugauagggg

SEQ ID NO: 59928 - RNA, 22 nt, Human
gggcaugugauggacgugugcc

SEQ ID NO: 59929 - RNA, 22 nt, Human
gggcaggcuggguggugguccc

SEQ ID NO: 59930 - RNA, 22 nt, Human
gggcagagggcgagcugggaga

SEQ ID NO: 59931 - RNA, 22 nt, Human
ggccuugauuccggucauugaa

SEQ ID NO: 59932 - RNA, 22 nt, Human
gugcuuugcuaggaccgauugu

SEQ ID NO: 59933 - RNA, 22 nt, Human
guggaaauaugggcaacaaaga

SEQ ID NO: 59934 - RNA, 22 nt, Human
guggaagauauuucugguccag

SEQ ID NO: 59935 - RNA, 22 nt, Human
ggccuccaucuuaucuuacucu

SEQ ID NO: 59936 - RNA, 22 nt, Human
ggccucucuccuuggcuugcag

SEQ ID NO: 59937 - RNA, 22 nt, Human
ggccgggugggaggcagcggag

SEQ ID NO: 59938 - RNA, 22 nt, Human
ggccgccgcuuagcugagcccc

SEQ ID NO: 59939 - RNA, 22 nt, Human
ggccgggcaugcgagcugagcg

SEQ ID NO: 59940 - RNA, 22 nt, Human
guagguggaggcaacacagcca

SEQ ID NO: 59941 - RNA, 22 nt, Human
ggcccuggggcaggagcagagg

SEQ ID NO: 59942 - RNA, 22 nt, Human
ggccgccacuuuccagugcugc

SEQ ID NO: 59943 - RNA, 22 nt, Human
ggcccugcuuccccaguguaca

SEQ ID NO: 59944 - RNA, 22 nt, Human
gguugccuuugcaguuggauca

SEQ ID NO: 59945 - RNA, 22 nt, Human
ggccagcuuugagcugcaggaa

SEQ ID NO: 59946 - RNA, 22 nt, Human
ggccagcgugggggaguagcgg

SEQ ID NO: 59947 - RNA, 22 nt, Human
guaaacugaauuggauacugug

SEQ ID NO: 59948 - RNA, 22 nt, Human
guaacuuuuuccucauuggcua

SEQ ID NO: 59949 - RNA, 22 nt, Human
gguggucaggagcgcccguugg

SEQ ID NO: 59950 - RNA, 22 nt, Human
ggcaguguggauccuggagaag

SEQ ID NO: 59951 - RNA, 22 nt, Human
ggugguucagugguuagggcca

SEQ ID NO: 59952 - RNA, 22 nt, Human
ggcagugguaggagcccaggag

SEQ ID NO: 59953 - RNA, 22 nt, Human
ggcagucuuucccuugagcucu

SEQ ID NO: 59954 - RNA, 22 nt, Human
ggcagucaucacuuauucauca

SEQ ID NO: 59955 - RNA, 18 nt, Human
ggcagggcucagcugcuc

SEQ ID NO: 59956 - RNA, 22 nt, Human
ggcagcgcuuggcugcucgaca

SEQ ID NO: 59957 - RNA, 22 nt, Human
ggcagcagaacuggcccuguau

SEQ ID NO: 59958 - RNA, 22 nt, Human
ggugcaaagauggcaguugcaa

SEQ ID NO: 59959 - RNA, 19 nt, Human
ggucugcggggugaccgug

SEQ ID NO: 59960 - RNA, 22 nt, Human
ggugaucucuggcucugcuugu

SEQ ID NO: 59961 - RNA, 22 nt, Human
ggugcaauaaaguuguagaacc

SEQ ID NO: 59962 - RNA, 22 nt, Human
ggugcagucuggggcacauuau

SEQ ID NO: 59963 - RNA, 22 nt, Human
ggucuucauucuaccagacuuu

SEQ ID NO: 59964 - RNA, 22 nt, Human
ggucuuccuugggggacuugaa

SEQ ID NO: 59965 - RNA, 22 nt, Human
ggucugauaccugcagguuguc

SEQ ID NO: 59966 - RNA, 22 nt, Human
ggucgucuguccugucgccgcu

SEQ ID NO: 59967 - RNA, 22 nt, Human
ggucgguuggagagaucaugaa

SEQ ID NO: 59968 - RNA, 22 nt, Human
ggcaagcacugggugucuuagc

SEQ ID NO: 59969 - RNA, 22 nt, Human
ggcaagauccagcacaaacaca

SEQ ID NO: 59970 - RNA, 22 nt, Human
ggcaaagaguacaucguccugg

SEQ ID NO: 59971 - RNA, 22 nt, Human
ggguguuuuuggugacagggag

SEQ ID NO: 59972 - RNA, 22 nt, Human
ggaguucacagcaauggaacag

SEQ ID NO: 59973 - RNA, 22 nt, Human
ggguggugauacugcuucugcc

SEQ ID NO: 59974 - RNA, 22 nt, Human
gggucuggagauccgggugaag

SEQ ID NO: 59975 - RNA, 20 nt, Human
ggagagggaaaggcuguacu

SEQ ID NO: 59976 - RNA, 22 nt, Human
ggggccaugauggacgagguga

SEQ ID NO: 59977 - RNA, 22 nt, Human
ggggccuuugaguugggucccu

SEQ ID NO: 59978 - RNA, 22 nt, Human
ggggcggcgugggcgcggugau

SEQ ID NO: 59979 - RNA, 22 nt, Human
ggggacggcuggccggggcccc

SEQ ID NO: 59980 - RNA, 22 nt, Human
ggggaauaaacacuuugucacu

SEQ ID NO: 59981 - RNA, 22 nt, Human
ggggaagagagaagaaugaucu

SEQ ID NO: 59982 - RNA, 22 nt, Human
ggacuuucuccugcacaaagug

SEQ ID NO: 59983 - RNA, 22 nt, Human
ggaccagagcuaaugcgcgccc

SEQ ID NO: 59984 - RNA, 22 nt, Human
gggcugcuccgcccgcugcgcc

SEQ ID NO: 59985 - RNA, 22 nt, Human
gggcuggggcucuggggcuagg

SEQ ID NO: 59986 - RNA, 22 nt, Human
gggcuguggggccugcagaagg

SEQ ID NO: 59987 - RNA, 22 nt, Human
gggcugaugcuuauacauacug

SEQ ID NO: 59988 - RNA, 22 nt, Human
ggacauggccguaguccccacg

SEQ ID NO: 59989 - RNA, 22 nt, Human
ggacauggaaagugugugauuu

SEQ ID NO: 59990 - RNA, 22 nt, Human
ggacagacagcauggaaccaua

SEQ ID NO: 59991 - RNA, 22 nt, Human
gggcucaaccauagcacaaaga

SEQ ID NO: 59992 - RNA, 22 nt, Human
gggcucuuaauuuuuuucucua

SEQ ID NO: 59993 - RNA, 22 nt, Human
gggcggugccugucuccgaagc

SEQ ID NO: 59994 - RNA, 22 nt, Human
gggcgcuuucugggucagggcu

SEQ ID NO: 59995 - RNA, 22 nt, Human
gggcgcgcggagccucgccggg

SEQ ID NO: 59996 - RNA, 22 nt, Human
gggcgcgccaggagcugcgcgg

SEQ ID NO: 59997 - RNA, 22 nt, Human
gggcgccgggagugagagugag

SEQ ID NO: 59998 - RNA, 22 nt, Human
gggcgcaagcaugugucugggu

SEQ ID NO: 59999 - RNA, 18 nt, Human
ggaaggugcuggagugca

SEQ ID NO: 60000 - RNA, 22 nt, Human
gggcaguuucaugugguucaac

SEQ ID NO: 60001 - RNA, 22 nt, Human
gggcaggggcagugguggcauu

SEQ ID NO: 60002 - RNA, 22 nt, Human
gggcaagagaggaagagauggc

SEQ ID NO: 60003 - RNA, 22 nt, Human
ggaaaaugcugaagcaucugaa

SEQ ID NO: 60004 - RNA, 22 nt, Human
gggagggggauucuggcgagaa

SEQ ID NO: 60005 - RNA, 22 nt, Human
gcuuuugaauacuacaggaguu

SEQ ID NO: 60006 - RNA, 22 nt, Human
gcuuuuaaauuaucugacaaug

SEQ ID NO: 60007 - RNA, 23 nt, Human
gcuuugaaaaugcuuucuuccag

SEQ ID NO: 60008 - RNA, 22 nt, Human
gcuguggagaagcugccuaugg

SEQ ID NO: 60009 - RNA, 22 nt, Human
gcuguggcuccaauggugagcc

SEQ ID NO: 60010 - RNA, 22 nt, Human
gcuguggacacagcucucuuca

SEQ ID NO: 60011 - RNA, 22 nt, Human
gcuguggaaaaugggucuccaa

SEQ ID NO: 60012 - RNA, 22 nt, Human
ggcuucucuuggccaugguccc

SEQ ID NO: 60013 - RNA, 20 nt, Human
gcugugccaugacccucgag

SEQ ID NO: 60014 - RNA, 22 nt, Human
ggcugugggguccuguggugug

SEQ ID NO: 60015 - RNA, 18 nt, Human
gcuguccgguagcuggug

SEQ ID NO: 60016 - RNA, 22 nt, Human
ggcugguggcgggcagcacaga

SEQ ID NO: 60017 - RNA, 22 nt, Human
ggcuggagcaggcugcacagug

SEQ ID NO: 60018 - RNA, 22 nt, Human
gcugguuucucucauugucagu

SEQ ID NO: 60019 - RNA, 22 nt, Human
gcugggucucucccugguccug

SEQ ID NO: 60020 - RNA, 22 nt, Human
gcugguggcagagcuccgcggc

SEQ ID NO: 60021 - RNA, 22 nt, Human
gcugggagaggcagcuuucgga

SEQ ID NO: 60022 - RNA, 21 nt, Human
gcuggcugucucuuacacggu

SEQ ID NO: 60023 - RNA, 22 nt, Human
gcuggcggguuggggaggcgga

SEQ ID NO: 60024 - RNA, 22 nt, Human
gcuggcgauggccgagucuccg

SEQ ID NO: 60025 - RNA, 22 nt, Human
ggcugcugcccaccccugcaug

SEQ ID NO: 60026 - RNA, 22 nt, Human
ggcugcagugcaacucuuucua

SEQ ID NO: 60027 - RNA, 17 nt, Human
ggcugccaggcaacaua

SEQ ID NO: 60028 - RNA, 21 nt, Human
ggcugcucgugaugaacuuca

SEQ ID NO: 60029 - RNA, 22 nt, Human
ggcugaggccucuggggaggga

SEQ ID NO: 60030 - RNA, 22 nt, Human
ggcugcaagacguuauuagcgu

SEQ ID NO: 60031 - RNA, 22 nt, Human
ggcucuccacuauggaugagaa

SEQ ID NO: 60032 - RNA, 22 nt, Human
gcuggaugucugugccaggcac

SEQ ID NO: 60033 - RNA, 22 nt, Human
gcugcuucgcugcacacccgag

SEQ ID NO: 60034 - RNA, 22 nt, Human
gcuggaaauaacuuguguagaa

SEQ ID NO: 60035 - RNA, 22 nt, Human
ggcucacuguaccugccgccgc

SEQ ID NO: 60036 - RNA, 22 nt, Human
ggcgggucuagggcccuggagu

SEQ ID NO: 60037 - RNA, 22 nt, Human
ggcggcccaggugcuccaggcg

SEQ ID NO: 60038 - RNA, 22 nt, Human
ggcggcaagggaauggagaaga

SEQ ID NO: 60039 - RNA, 22 nt, Human
ggcggaggucacgcacccgcca

SEQ ID NO: 60040 - RNA, 22 nt, Human
ggcgccuuguggaaugagagcu

SEQ ID NO: 60041 - RNA, 22 nt, Human
ggcgccugguauucuuccucuc

SEQ ID NO: 60042 - RNA, 22 nt, Human
ggcgccauuuuugccuucggag

SEQ ID NO: 60043 - RNA, 22 nt, Human
gcugcuggcuuccugcuguuuu

SEQ ID NO: 60044 - RNA, 22 nt, Human
ggcgauuggccgggaggaggca

SEQ ID NO: 60045 - RNA, 22 nt, Human
gcugcgcugggacgccaccaac

SEQ ID NO: 60046 - RNA, 22 nt, Human
gcugcgccgggagccggggccg

SEQ ID NO: 60047 - RNA, 22 nt, Human
ggcgaggcgggccgcggggucu

SEQ ID NO: 60048 - RNA, 22 nt, Human
ggccuugggauguggcugcagc

SEQ ID NO: 60049 - RNA, 22 nt, Human
ggccuucuuuucaugucuuucg

SEQ ID NO: 60050 - RNA, 22 nt, Human
ggccuugguggcuuugcugaug

SEQ ID NO: 60051 - RNA, 23 nt, Human
ggccuuuuuaaccgcgagcgaca

SEQ ID NO: 60052 - RNA, 22 nt, Human
ggccuggccuccugcuuuucca

SEQ ID NO: 60053 - RNA, 22 nt, Human
ggccuggcacauaguaggcagu

SEQ ID NO: 60054 - RNA, 22 nt, Human
ggccugcuaccagcugugaccu

SEQ ID NO: 60055 - RNA, 22 nt, Human
ggccgcuuucuggggagugagg

SEQ ID NO: 60056 - RNA, 22 nt, Human
gcugccgcugcggggcgcgggc

SEQ ID NO: 60057 - RNA, 22 nt, Human
gcugcccucccagggcaagcuu

SEQ ID NO: 60058 - RNA, 22 nt, Human
gcugauucuucugcuuuuucuc

SEQ ID NO: 60059 - RNA, 22 nt, Human
gcugcaggaggugguagggucu

SEQ ID NO: 60060 - RNA, 22 nt, Human
gcucuugcuuuuucuagaaaga

SEQ ID NO: 60061 - RNA, 22 nt, Human
gcuacauuagcuucaauggcua

SEQ ID NO: 60062 - RNA, 22 nt, Human
gcuauuggcuaauuguugcaac

SEQ ID NO: 60063 - RNA, 22 nt, Human
gcgguuauggcagagauuacag

SEQ ID NO: 60064 - RNA, 22 nt, Human
gcgguguuuuaacacucccucg

SEQ ID NO: 60065 - RNA, 22 nt, Human
gcgggugagauucgagagaugg

SEQ ID NO: 60066 - RNA, 22 nt, Human
ggcaggaaguaaggaugcuaca

SEQ ID NO: 60067 - RNA, 22 nt, Human
gcggggcucuacuuggccugga

SEQ ID NO: 60068 - RNA, 20 nt, Human
ggcagcaaccauaugcuaca

SEQ ID NO: 60069 - RNA, 22 nt, Human
ggcagaggagcuggaaacaugg

SEQ ID NO: 60070 - RNA, 23 nt, Human
gcgggcggagccgggaggcgggg

SEQ ID NO: 60071 - RNA, 22 nt, Human
gcggcuggcuguccaaacuggg

SEQ ID NO: 60072 - RNA, 19 nt, Human
gcggcggugccggcuggga

SEQ ID NO: 60073 - RNA, 22 nt, Human
gcggcggcggaggcgggggcag

SEQ ID NO: 60074 - RNA, 22 nt, Human
ggauuucuucucauaacugaga

SEQ ID NO: 60075 - RNA, 22 nt, Human
ggaugauacuuggagaaauauu

SEQ ID NO: 60076 - RNA, 22 nt, Human
ggagcaucuaccauuucuagau

SEQ ID NO: 60077 - RNA, 22 nt, Human
gcgccuugccuguccucuaacc

SEQ ID NO: 60078 - RNA, 22 nt, Human
gcgcacaaccccguggcgguga

SEQ ID NO: 60079 - RNA, 22 nt, Human
ggacuggugaagccuucggaga

SEQ ID NO: 60080 - RNA, 21 nt, Human
ggacccucagauggcagugag

SEQ ID NO: 60081 - RNA, 22 nt, Human
ggacagagcaacccuacgcagc

SEQ ID NO: 60082 - RNA, 22 nt, Human
gccuucccuccucugcucucag

SEQ ID NO: 60083 - RNA, 22 nt, Human
gccuugagcucaugucccagcu

SEQ ID NO: 60084 - RNA, 22 nt, Human
gccuggaaugcaaugugacgaa

SEQ ID NO: 60085 - RNA, 22 nt, Human
gccugcuugaaagcacuuucug

SEQ ID NO: 60086 - RNA, 22 nt, Human
ggaauacggguuuauuuagucu

SEQ ID NO: 60087 - RNA, 22 nt, Human
gccuggccaaucgccgucuagg

SEQ ID NO: 60088 - RNA, 21 nt, Human
gccugcuguucacccugccac

SEQ ID NO: 60089 - RNA, 22 nt, Human
ggaauaauauuacagauacagu

SEQ ID NO: 60090 - RNA, 22 nt, Human
ggaaguggauucagggcugcua

SEQ ID NO: 60091 - RNA, 22 nt, Human
ggaaguuugagcaucuguuucc

SEQ ID NO: 60092 - RNA, 22 nt, Human
ggaagcuguugugagugcagca

SEQ ID NO: 60093 - RNA, 22 nt, Human
ggaagcugucugcccggcgcuc

SEQ ID NO: 60094 - RNA, 22 nt, Human
ggaagccugggcgcaggcaggg

SEQ ID NO: 60095 - RNA, 22 nt, Human
gcccauggagaccucaggcugg

SEQ ID NO: 60096 - RNA, 22 nt, Human
ggaagauagaaguucaaaaguu

SEQ ID NO: 60097 - RNA, 22 nt, Human
gcccagcuuuuugaggcaggca

SEQ ID NO: 60098 - RNA, 22 nt, Human
gcuggucuggcaauccucaugg

SEQ ID NO: 60099 - RNA, 22 nt, Human
gccauguucuugaaucuggguc

SEQ ID NO: 60100 - RNA, 22 nt, Human
gccaugguggggccucccugac

SEQ ID NO: 60101 - RNA, 22 nt, Human
gcuggccugcgagggcaggcug

SEQ ID NO: 60102 - RNA, 22 nt, Human
gcuggauaaggaucaguuucuu

SEQ ID NO: 60103 - RNA, 22 nt, Human
gccaucugcuuagauugcuggg

SEQ ID NO: 60104 - RNA, 22 nt, Human
gccaucuucggcagccgccugg

SEQ ID NO: 60105 - RNA, 22 nt, Human
gcuggaagggccagcuuucagg

SEQ ID NO: 60106 - RNA, 22 nt, Human
gccagggcucgagcaggccagc

SEQ ID NO: 60107 - RNA, 22 nt, Human
gccagucgucuuuauuacagcu

SEQ ID NO: 60108 - RNA, 22 nt, Human
gccaguuuguuuacugaugguu

SEQ ID NO: 60109 - RNA, 22 nt, Human
gccauauucaugcaggugcuaa

SEQ ID NO: 60110 - RNA, 22 nt, Human
gcugcuggcggagcuggcgcug

SEQ ID NO: 60111 - RNA, 22 nt, Human
gcugcuacagagcuggaggggg

SEQ ID NO: 60112 - RNA, 22 nt, Human
gccaggcggcccaggagauggc

SEQ ID NO: 60113 - RNA, 22 nt, Human
gccagccggugaguggaagcgg

SEQ ID NO: 60114 - RNA, 22 nt, Human
gccagcuuagaucccccagccc

SEQ ID NO: 60115 - RNA, 16 nt, Human
gccagauugaacuuug

SEQ ID NO: 60116 - RNA, 21 nt, Human
gccacugcugcucauucucug

SEQ ID NO: 60117 - RNA, 22 nt, Human
gcugcgcgcagccggcgccgag

SEQ ID NO: 60118 - RNA, 23 nt, Human
gcugccguuucccaucgugguga

SEQ ID NO: 60119 - RNA, 22 nt, Human
gcugcccauugcucucccacuc

SEQ ID NO: 60120 - RNA, 22 nt, Human
gccaaucaggaggcuguacauc

SEQ ID NO: 60121 - RNA, 22 nt, Human
gcugcacgguccuggcaccacg

SEQ ID NO: 60122 - RNA, 23 nt, Human
gcugagcaccagccauaucuuuu

SEQ ID NO: 60123 - RNA, 22 nt, Human
gcucuggcuacuguggcuaccg

SEQ ID NO: 60124 - RNA, 22 nt, Human
gcucuggcugccuuaguuuugu

SEQ ID NO: 60125 - RNA, 22 nt, Human
gcucugaacugucaugaauugg

SEQ ID NO: 60126 - RNA, 22 nt, Human
gcucucuggccugggaggagga

SEQ ID NO: 60127 - RNA, 19 nt, Human
gcuccugcagcuagagugc

SEQ ID NO: 60128 - RNA, 21 nt, Human
gcucccgaagugcucggcguu

SEQ ID NO: 60129 - RNA, 22 nt, Human
gcaucuguuagagugugcaugc

SEQ ID NO: 60130 - RNA, 22 nt, Human
gcaugaauggaacccccugagu

SEQ ID NO: 60131 - RNA, 22 nt, Human
gcucaagaccaagggagcgggg

SEQ ID NO: 60132 - RNA, 22 nt, Human
gcaguuugugauguggcaguca

SEQ ID NO: 60133 - RNA, 22 nt, Human
gcaguugguccagccucggcug

SEQ ID NO: 60134 - RNA, 19 nt, Human
gcaguuccucuuaagagaa

SEQ ID NO: 60135 - RNA, 22 nt, Human
gcguggaugauuuugagucggu

SEQ ID NO: 60136 - RNA, 22 nt, Human
gcgugcauguguguaugcgugu

SEQ ID NO: 60137 - RNA, 22 nt, Human
gcgucucugggcugacccaggu

SEQ ID NO: 60138 - RNA, 22 nt, Human
gcgguggcuacuaaaguucgaa

SEQ ID NO: 60139 - RNA, 22 nt, Human
gcggguggaggagggacgggca

SEQ ID NO: 60140 - RNA, 22 nt, Human
gcggggggcucgggcagcucgg

SEQ ID NO: 60141 - RNA, 22 nt, Human
gcgggccggcaggggaggaguu

SEQ ID NO: 60142 - RNA, 22 nt, Human
gcggcgucccagcuccgacggc

SEQ ID NO: 60143 - RNA, 22 nt, Human
gcggccucuuugcugccucagg

SEQ ID NO: 60144 - RNA, 22 nt, Human
gcggcccggguccccagcagca

SEQ ID NO: 60145 - RNA, 22 nt, Human
gcggcaguccuuccaguacagg

SEQ ID NO: 60146 - RNA, 22 nt, Human
gcagccugaguuuagcucgucg

SEQ ID NO: 60147 - RNA, 22 nt, Human
gcagccuccggccuggcccccu

SEQ ID NO: 60148 - RNA, 22 nt, Human
gcagccagggaccuuugacuau

SEQ ID NO: 60149 - RNA, 22 nt, Human
gcggagaggcagagacuccgcg

SEQ ID NO: 60150 - RNA, 23 nt, Human
gcacuguuugaggagcacugugc

SEQ ID NO: 60151 - RNA, 22 nt, Human
gccugaaaugaaccagaggacu

SEQ ID NO: 60152 - RNA, 22 nt, Human
gcacacaagagauuguuauugc

SEQ ID NO: 60153 - RNA, 22 nt, Human
gcaaaugacuuagucacuccag

SEQ ID NO: 60154 - RNA, 22 nt, Human
gccguuccuacucucucugugu

SEQ ID NO: 60155 - RNA, 21 nt, Human
gccgugcgccuccaggcgcgc

SEQ ID NO: 60156 - RNA, 22 nt, Human
gauuucuucauuuaaaaauauu

SEQ ID NO: 60157 - RNA, 20 nt, Human
gccggggcauaggggccguc

SEQ ID NO: 60158 - RNA, 22 nt, Human
gccgggagugcagcgggcgcgc

SEQ ID NO: 60159 - RNA, 22 nt, Human
gccgggagaggcggcgcagggg

SEQ ID NO: 60160 - RNA, 22 nt, Human
gccggcugggggcggagggcag

SEQ ID NO: 60161 - RNA, 22 nt, Human
gauugcugccagcguguccgug

SEQ ID NO: 60162 - RNA, 22 nt, Human
gccgcgggucugggucuggcuc

SEQ ID NO: 60163 - RNA, 18 nt, Human
gccgccuugcucgugaac

SEQ ID NO: 60164 - RNA, 22 nt, Human
gauucuaucauucuguauauua

SEQ ID NO: 60165 - RNA, 22 nt, Human
gccgcaacggacccugggaguc

SEQ ID NO: 60166 - RNA, 22 nt, Human
gcccugaagagguagagaauuu

SEQ ID NO: 60167 - RNA, 22 nt, Human
gcccgccaacuugccagcggug

SEQ ID NO: 60168 - RNA, 22 nt, Human
gcccagccucagggcaucagcu

SEQ ID NO: 60169 - RNA, 22 nt, Human
gccauguuuugguaaauaccau

SEQ ID NO: 60170 - RNA, 22 nt, Human
gauggcaaugcuagaaauuuag

SEQ ID NO: 60171 - RNA, 22 nt, Human
gauggcauucacaaacuuaacu

SEQ ID NO: 60172 - RNA, 22 nt, Human
gccauggugagccaccuggugg

SEQ ID NO: 60173 - RNA, 22 nt, Human
gaugauugaauaaauaugguca

SEQ ID NO: 60174 - RNA, 22 nt, Human
gaugccuccaggaaagaggacg

SEQ ID NO: 60175 - RNA, 22 nt, Human
gaugaaguaguccacuggaagg

SEQ ID NO: 60176 - RNA, 22 nt, Human
gaugauuccuuuguucauugug

SEQ ID NO: 60177 - RNA, 23 nt, Human
gcauuugcaggaaacuggaaaag

SEQ ID NO: 60178 - RNA, 22 nt, Human
gauagaaagagaaucagaacuu

SEQ ID NO: 60179 - RNA, 22 nt, Human
gcauuccagaguugcuggaaaa

SEQ ID NO: 60180 - RNA, 22 nt, Human
gcauugcuauuucuguuagugu

SEQ ID NO: 60181 - RNA, 20 nt, Human
gcauggcuggcugcugucug

SEQ ID NO: 60182 - RNA, 22 nt, Human
gcaggccuccccugcuggagcu

SEQ ID NO: 60183 - RNA, 22 nt, Human
gcaggccgauuuguuagaaguc

SEQ ID NO: 60184 - RNA, 22 nt, Human
gaggugggaggcgggccugcau

SEQ ID NO: 60185 - RNA, 22 nt, Human
gagguuauucuucuaucaguau

SEQ ID NO: 60186 - RNA, 22 nt, Human
gcaggcagauccagaagcacua

SEQ ID NO: 60187 - RNA, 22 nt, Human
gcaggaagauugcagaaggcug

SEQ ID NO: 60188 - RNA, 22 nt, Human
gcaggaaugguacauaccuguu

SEQ ID NO: 60189 - RNA, 22 nt, Human
gcagcucagcacgcacagguaa

SEQ ID NO: 60190 - RNA, 22 nt, Human
gcagcguguggcuaauggcucu

SEQ ID NO: 60191 - RNA, 22 nt, Human
gaggugaacccaggugcuucac

SEQ ID NO: 60192 - RNA, 22 nt, Human
gaggguuucagugggacggguu

SEQ ID NO: 60193 - RNA, 22 nt, Human
gcagcccucuuggucacuaggc

SEQ ID NO: 60194 - RNA, 22 nt, Human
gcagccauuugcaucuaauuaa

SEQ ID NO: 60195 - RNA, 22 nt, Human
gcagccauggcuggccgggcau

SEQ ID NO: 60196 - RNA, 22 nt, Human
gcagcauuaccaagacauggca

SEQ ID NO: 60197 - RNA, 22 nt, Human
gagggugguggcggccggcacc

SEQ ID NO: 60198 - RNA, 22 nt, Human
gcagcaaucuucacagugucau

SEQ ID NO: 60199 - RNA, 22 nt, Human
gcagauaguaggagcuaaucuu

SEQ ID NO: 60200 - RNA, 22 nt, Human
gaggggcaagaaguuggccucu

SEQ ID NO: 60201 - RNA, 22 nt, Human
gaggggaaggauuucuucagaa

SEQ ID NO: 60202 - RNA, 22 nt, Human
gaggggaauguuccugagcugg

SEQ ID NO: 60203 - RNA, 22 nt, Human
gcagaggcugccgugggcagga

SEQ ID NO: 60204 - RNA, 22 nt, Human
gaggggaacaggcauucuuaag

SEQ ID NO: 60205 - RNA, 22 nt, Human
gcagaggcaaagucuggaugac

SEQ ID NO: 60206 - RNA, 22 nt, Human
gagggcugccacguugggcgag

SEQ ID NO: 60207 - RNA, 22 nt, Human
gagggauuuuagugcagcaacu

SEQ ID NO: 60208 - RNA, 22 nt, Human
gaggcuugccacuguccauggc

SEQ ID NO: 60209 - RNA, 22 nt, Human
gaggcggcgacgcgggcccggg

SEQ ID NO: 60210 - RNA, 22 nt, Human
gaggcuaugucuacgcucagcg

SEQ ID NO: 60211 - RNA, 22 nt, Human
gaggcgcgcugcgagggcgcgg

SEQ ID NO: 60212 - RNA, 22 nt, Human
gaggcggugguggcgagaguca

SEQ ID NO: 60213 - RNA, 22 nt, Human
gcacggucagggugggggagug

SEQ ID NO: 60214 - RNA, 22 nt, Human
gcaccgagaaggaagcaugccu

SEQ ID NO: 60215 - RNA, 22 nt, Human
gaggaucuuuagcgggacugcu

SEQ ID NO: 60216 - RNA, 22 nt, Human
gcacagucaacacuuauucacc

SEQ ID NO: 60217 - RNA, 22 nt, Human
gcacauauuuagaucuugaugu

SEQ ID NO: 60218 - RNA, 22 nt, Human
gaggaugacaaagaaggcagac

SEQ ID NO: 60219 - RNA, 22 nt, Human
gaggcagaggaaacagcucauu

SEQ ID NO: 60220 - RNA, 19 nt, Human
gcacacccugcaccaccau

SEQ ID NO: 60221 - RNA, 22 nt, Human
gcacacaaaaauauguguugaa

SEQ ID NO: 60222 - RNA, 22 nt, Human
gcacagaguguaaaaguuucau

SEQ ID NO: 60223 - RNA, 22 nt, Human
gcacagauaaucugccuuacca

SEQ ID NO: 60224 - RNA, 22 nt, Human
gcacaaguccuccgacagcacg

SEQ ID NO: 60225 - RNA, 22 nt, Human
gaggaggagacggaggccuggg

SEQ ID NO: 60226 - RNA, 22 nt, Human
gcacaaaagguacuucauguag

SEQ ID NO: 60227 - RNA, 22 nt, Human
gaggaggagaagcggcggcgga

SEQ ID NO: 60228 - RNA, 22 nt, Human
gaggaggacauuggaaagaacu

SEQ ID NO: 60229 - RNA, 22 nt, Human
gaggagcggugcaugugggggc

SEQ ID NO: 60230 - RNA, 22 nt, Human
gcaagagaagaaagaauaguuu

SEQ ID NO: 60231 - RNA, 22 nt, Human
gagcuuuguuccgugguggcac

SEQ ID NO: 60232 - RNA, 22 nt, Human
gagcuggagaaacacauaagaa

SEQ ID NO: 60233 - RNA, 22 nt, Human
gagcggcucaguggccauguga

SEQ ID NO: 60234 - RNA, 22 nt, Human
gagcggcggugagaaguguggg

SEQ ID NO: 60235 - RNA, 22 nt, Human
gagcgugaggcagcuuucuaag

SEQ ID NO: 60236 - RNA, 22 nt, Human
gagcguuucccugggggucugc

SEQ ID NO: 60237 - RNA, 22 nt, Human
gauuuucauuauagcuaguuuc

SEQ ID NO: 60238 - RNA, 22 nt, Human
gagcgcgcaaucucuccagcug

SEQ ID NO: 60239 - RNA, 22 nt, Human
gagcgacucuuuuaguccagag

SEQ ID NO: 60240 - RNA, 22 nt, Human
gauugcauaugcauucugauac

SEQ ID NO: 60241 - RNA, 22 nt, Human
gagcccuguagcaagucauguc

SEQ ID NO: 60242 - RNA, 19 nt, Human
gagcaugacuggccuugca

SEQ ID NO: 60243 - RNA, 22 nt, Human
gauuaagugaauuggagaaaag

SEQ ID NO: 60244 - RNA, 22 nt, Human
gagcaggucuuugguaaugcuu

SEQ ID NO: 60245 - RNA, 22 nt, Human
gagcagcugagcuggaaugaga

SEQ ID NO: 60246 - RNA, 22 nt, Human
gauuaaaggucuugauuauaag

SEQ ID NO: 60247 - RNA, 22 nt, Human
gagcagccugaggauucugcuc

SEQ ID NO: 60248 - RNA, 22 nt, Human
gagcagcucgagaaggaagcag

SEQ ID NO: 60249 - RNA, 22 nt, Human
gaugucauguuggcagacaguu

SEQ ID NO: 60250 - RNA, 22 nt, Human
gagcagacugcacaguucuugc

SEQ ID NO: 60251 - RNA, 22 nt, Human
gagcacugagcuggaauuggag

SEQ ID NO: 60252 - RNA, 22 nt, Human
gauggugauggcccuaagcuga

SEQ ID NO: 60253 - RNA, 22 nt, Human
gaugguggaggaaucgcugaag

SEQ ID NO: 60254 - RNA, 22 nt, Human
gagauuuccauauuuuguaaca

SEQ ID NO: 60255 - RNA, 22 nt, Human
gagauuguggcagcagcuguuu

SEQ ID NO: 60256 - RNA, 22 nt, Human
gaugcauccuuucugucuucuc

SEQ ID NO: 60257 - RNA, 22 nt, Human
gaugcucuugauuggaccaggg

SEQ ID NO: 60258 - RNA, 23 nt, Human
gaugauggcaacuacauccggug

SEQ ID NO: 60259 - RNA, 22 nt, Human
gagccauggaggaugugcagca

SEQ ID NO: 60260 - RNA, 22 nt, Chlamydia trachomatis
auguagagguaugggcugaagu

SEQ ID NO: 60261 - RNA, 22 nt, Chlamydia trachomatis
uagcggaucgugauugguuaga

SEQ ID NO: 60262 - RNA, 22 nt, Chlamydia trachomatis
agaauuccuuaaagauggugua

SEQ ID NO: 60263 - RNA, 22 nt, Chlamydia trachomatis
ggacaaagagcuacagaugcug

SEQ ID NO: 60264 - RNA, 21 nt, Chlamydia trachomatis
cucguugcguucaagaucaag

SEQ ID NO: 60265 - RNA, 22 nt, Chlamydia trachomatis
uuuuggguuguguacgaagcuu

SEQ ID NO: 60266 - RNA, 22 nt, Chlamydia trachomatis
auugauuuuggcuucaacugua

SEQ ID NO: 60267 - RNA, 22 nt, Chlamydia trachomatis
gguauugacuauauuuguaccg

SEQ ID NO: 60268 - RNA, 22 nt, Chlamydia trachomatis
agagguuuuucacacucuuucu

SEQ ID NO: 60269 - RNA, 19 nt, Chlamydia trachomatis
aaguuguuugacauuuucu

SEQ ID NO: 60270 - RNA, 22 nt, Chlamydia trachomatis
ugaaacuuuugguacaaaggcu

SEQ ID NO: 60271 - RNA, 22 nt, Chlamydia trachomatis
gagauguugugcaaaaaugugu

SEQ ID NO: 60272 - RNA, 22 nt, Chlamydia trachomatis
aggaguuauuuagcucucucaa

SEQ ID NO: 60273 - RNA, 22 nt, Chlamydia trachomatis
ucacuggacuuguuuaucauau

SEQ ID NO: 60274 - RNA, 22 nt, Chlamydia trachomatis
acaaaagggguguuugacaauc

SEQ ID NO: 60275 - RNA, 22 nt, Chlamydia trachomatis
uaacaagaggcuuuuugggagu

SEQ ID NO: 60276 - RNA, 22 nt, Chlamydia trachomatis
acuucuggguauuccuucgaga

SEQ ID NO: 60277 - RNA, 22 nt, Chlamydia trachomatis
ggaaucuuggagaugacguugu

SEQ ID NO: 60278 - RNA, 22 nt, Chlamydia trachomatis
uugcuugauuuuguaagagcuc

SEQ ID NO: 60279 - RNA, 23 nt, Chlamydia trachomatis
gcagcauuuccauugaaagauuu

SEQ ID NO: 60280 - RNA, 22 nt, Chlamydia trachomatis
guauuuuucaaucgcuuguucu

SEQ ID NO: 60281 - RNA, 22 nt, Chlamydia trachomatis
uuuaaagacagaucuaauccgc

SEQ ID NO: 60282 - RNA, 22 nt, Chlamydia trachomatis
uucuuugaucacugcguccaca

SEQ ID NO: 60283 - RNA, 22 nt, Chlamydia trachomatis
ggaacuggugaaggacuguuug

SEQ ID NO: 60284 - RNA, 22 nt, Chlamydia trachomatis
aucggcuaauguuucucuuucu

SEQ ID NO: 60285 - RNA, 22 nt, Chlamydia trachomatis
aggcucuucggaugggaaaacu

SEQ ID NO: 60286 - RNA, 22 nt, Chlamydia trachomatis
uuggggaaagguuaucuugaaa

SEQ ID NO: 60287 - RNA, 22 nt, Chlamydia trachomatis
uuugcuagcuaaacgaguuacu

SEQ ID NO: 60288 - RNA, 22 nt, Chlamydia trachomatis
guagggaauucuggaaguggcu

SEQ ID NO: 60289 - RNA, 22 nt, Chlamydia trachomatis
uuggggaacucgguggacucgu

SEQ ID NO: 60290 - RNA, 22 nt, Chlamydia trachomatis
aaggagaucuuaacagauaaga

SEQ ID NO: 60291 - RNA, 22 nt, Chlamydia trachomatis
uucugcauuuacuagagcugcu

SEQ ID NO: 60292 - RNA, 22 nt, Chlamydia trachomatis
acgaaaagcaaguaucugcuua

SEQ ID NO: 60293 - RNA, 22 nt, Chlamydia trachomatis
uuccuaaagcguaugacccuaa

SEQ ID NO: 60294 - RNA, 20 nt, Chlamydia trachomatis
caaagcugcagauguuuuug

SEQ ID NO: 60295 - RNA, 22 nt, Chlamydia trachomatis
auggaaauguguucuggaguuu

SEQ ID NO: 60296 - RNA, 22 nt, Chlamydia trachomatis
cguggucucugugguaagagag

SEQ ID NO: 60297 - RNA, 23 nt, Chlamydia trachomatis
aagccuuuauuaaagacccugaa

SEQ ID NO: 60298 - RNA, 21 nt, Chlamydia trachomatis
aaugauuucccaguauuuggg

SEQ ID NO: 60299 - RNA, 22 nt, Chlamydia trachomatis
uagaagaagcuggaggccucgu

SEQ ID NO: 60300 - RNA, 22 nt, Chlamydia trachomatis
cuuguuccuccacauuuuguau

SEQ ID NO: 60301 - RNA, 22 nt, Chlamydia trachomatis
ucgauuacaacuagcuccccau

SEQ ID NO: 60302 - RNA, 22 nt, Chlamydia trachomatis
aaaaugcugacgccuugauuca

SEQ ID NO: 60303 - RNA, 22 nt, Chlamydia trachomatis
auguuucuuauuugcccaguca

SEQ ID NO: 60304 - RNA, 22 nt, Chlamydia trachomatis
agucgggaggauugaaaagaga

SEQ ID NO: 60305 - RNA, 22 nt, Chlamydia trachomatis
agcucgucugcuaggccuaaag

SEQ ID NO: 60306 - RNA, 22 nt, Chlamydia trachomatis
agggcuuugugagaguuugcuu

SEQ ID NO: 60307 - RNA, 22 nt, Chlamydia trachomatis
uaccgccuaccucaacuuauag

SEQ ID NO: 60308 - RNA, 22 nt, Chlamydia trachomatis
aaacgggagcccaauuaaaaca

SEQ ID NO: 60309 - RNA, 18 nt, Chlamydia trachomatis
gcuuaugcggcuuauugg

SEQ ID NO: 60310 - RNA, 22 nt, Chlamydia trachomatis
gcaucuguagcauauccagucc

SEQ ID NO: 60311 - RNA, 22 nt, Chlamydia trachomatis
uacauaaguuaggauuagaggu

SEQ ID NO: 60312 - RNA, 22 nt, Chlamydia trachomatis
gguugucuuccuuugcuuauac

SEQ ID NO: 60313 - RNA, 22 nt, Chlamydia trachomatis
agggauagugauuucugcauaa

SEQ ID NO: 60314 - RNA, 23 nt, Chlamydia trachomatis
accuucguuugcuagagagccuc

SEQ ID NO: 60315 - RNA, 22 nt, Chlamydia trachomatis
auccacaacccagagaauuccu

SEQ ID NO: 60316 - RNA, 22 nt, Chlamydia trachomatis
uggaugugcguggauaguuucg

SEQ ID NO: 60317 - RNA, 22 nt, Chlamydia trachomatis
uuauccauagagagacuucucg

SEQ ID NO: 60318 - RNA, 22 nt, Chlamydia trachomatis
ggcuucuugagaucggaugggc

SEQ ID NO: 60319 - RNA, 22 nt, Chlamydia trachomatis
ggaaagcgagaaaguugcuagc

SEQ ID NO: 60320 - RNA, 22 nt, Chlamydia trachomatis
guuuuugacggagcauaauagc

SEQ ID NO: 60321 - RNA, 22 nt, Chlamydia trachomatis
aaaaucaacguagaucgucgga

SEQ ID NO: 60322 - RNA, 22 nt, Chlamydia trachomatis
ucuaaugagcugaccaaguuuc

SEQ ID NO: 60323 - RNA, 22 nt, Chlamydia trachomatis
uguuccuuagagaagagcuugg

SEQ ID NO: 60324 - RNA, 22 nt, Chlamydia trachomatis
agaagauaaugauuagggggac

SEQ ID NO: 60325 - RNA, 23 nt, Chlamydia trachomatis
agaaauacaacaaagcacgauuc

SEQ ID NO: 60326 - RNA, 22 nt, Chlamydia trachomatis
agauucguggagaaguagacuu

SEQ ID NO: 60327 - RNA, 22 nt, Chlamydia trachomatis
uuucggaucucuugcacagcug

SEQ ID NO: 60328 - RNA, 22 nt, Chlamydia trachomatis
gaacuguauagcuuuuccuguc

SEQ ID NO: 60329 - RNA, 22 nt, Chlamydia trachomatis
auggaaagaaguauuaucuuua

SEQ ID NO: 60330 - RNA, 22 nt, Chlamydia trachomatis
uucuucauuaggagguucaugu

SEQ ID NO: 60331 - RNA, 22 nt, Chlamydia trachomatis
gcuuuagagggucuuauucacg

SEQ ID NO: 60332 - RNA, 22 nt, Chlamydia trachomatis
uagaaauuauggaagagcggua

SEQ ID NO: 60333 - RNA, 22 nt, Chlamydia trachomatis
cagcaucuguagcucuuugucc

SEQ ID NO: 60334 - RNA, 22 nt, Chlamydia trachomatis
ucguuguucgcauauuggaaga

SEQ ID NO: 60335 - RNA, 22 nt, Chlamydia trachomatis
uguucaguaccccagcaguaga

SEQ ID NO: 60336 - RNA, 22 nt, Chlamydia trachomatis
uuuguuugaaggacguacgcuu

SEQ ID NO: 60337 - RNA, 22 nt, Chlamydia trachomatis
gauguggugcuuguuucuuauu

SEQ ID NO: 60338 - RNA, 22 nt, Chlamydia trachomatis
gaaacguugaauauaggggaga

SEQ ID NO: 60339 - RNA, 22 nt, Chlamydia trachomatis
cucauugcaaaugaaucuauag

SEQ ID NO: 60340 - RNA, 22 nt, Chlamydia trachomatis
ggguggcaauucucagguauuu

SEQ ID NO: 60341 - RNA, 22 nt, Chlamydia trachomatis
agaaagagaaacauuagccgau

SEQ ID NO: 60342 - RNA, 20 nt, Chlamydia trachomatis
ggagaguuuugaagcuuugc

SEQ ID NO: 60343 - RNA, 22 nt, Chlamydia trachomatis
uaaugacuauacagcugcagcu

SEQ ID NO: 60344 - RNA, 22 nt, Chlamydia trachomatis
uauuucguuggugggagcguuc

SEQ ID NO: 60345 - RNA, 22 nt, Chlamydia trachomatis
gauauucuaaaguuuuguggua

SEQ ID NO: 60346 - RNA, 22 nt, Chlamydia trachomatis
auccggauauuguuguuguugu

SEQ ID NO: 60347 - RNA, 22 nt, Chlamydia trachomatis
aguuuguucguauaggcucuua

SEQ ID NO: 60348 - RNA, 22 nt, Chlamydia trachomatis
agucuuguaucauagaggauag

SEQ ID NO: 60349 - RNA, 22 nt, Chlamydia trachomatis
uuguaagguuugcauguaggcu

SEQ ID NO: 60350 - RNA, 15 nt, Chlamydia trachomatis
auagcaacucguugg

SEQ ID NO: 60351 - RNA, 23 nt, Chlamydia trachomatis
uuacuucuuugauaagcucuuca

SEQ ID NO: 60352 - RNA, 22 nt, Chlamydia trachomatis
uaaugcagauuuuucagaagaa

SEQ ID NO: 60353 - RNA, 22 nt, Chlamydia trachomatis
gaucucucuugaaaugaaggug

SEQ ID NO: 60354 - RNA, 22 nt, Chlamydia trachomatis
cugcaguuuuauccagaauuug

SEQ ID NO: 60355 - RNA, 22 nt, Chlamydia trachomatis
cccaagcaacuuggaauucauu

SEQ ID NO: 60356 - RNA, 22 nt, Chlamydia trachomatis
cucuuuuuguucuuaaggacca

SEQ ID NO: 60357 - RNA, 22 nt, Chlamydia trachomatis
uuaucgguaguaacguugucuu

SEQ ID NO: 60358 - RNA, 22 nt, Chlamydia trachomatis
gcuaaaaaccagcagguagacu

SEQ ID NO: 60359 - RNA, 22 nt, Chlamydia trachomatis
ugaaagaaaugggaaccguucc

SEQ ID NO: 60360 - RNA, 22 nt, Chlamydia trachomatis
uguuuauaguucccguucaaaa

SEQ ID NO: 60361 - RNA, 22 nt, Chlamydia trachomatis
augauucucguaauccuugugg

SEQ ID NO: 60362 - RNA, 22 nt, Chlamydia trachomatis
ucggcuucuauucuuucgagau

SEQ ID NO: 60363 - RNA, 22 nt, Chlamydia trachomatis
ugagcuuucugaaguaucugga

SEQ ID NO: 60364 - RNA, 22 nt, Chlamydia trachomatis
aagcuauugaugacgcugguau

SEQ ID NO: 60365 - RNA, 22 nt, Chlamydia trachomatis
agagcuuuuggauccuguuuau

SEQ ID NO: 60366 - RNA, 22 nt, Chlamydia trachomatis
auaauuguagacauuucgagcu

SEQ ID NO: 60367 - RNA, 22 nt, Chlamydia trachomatis
gaauguuagacucucuuccugu

SEQ ID NO: 60368 - RNA, 22 nt, Chlamydia trachomatis
ucuaugcagguguagaaaaagg

SEQ ID NO: 60369 - RNA, 22 nt, Chlamydia trachomatis
uucagcgacuugaucggcagga

SEQ ID NO: 60370 - RNA, 22 nt, Chlamydia trachomatis
auuuugcggcuaaaaacuccag

SEQ ID NO: 60371 - RNA, 22 nt, Chlamydia trachomatis
acaacgaauaaucuugcaaucc

SEQ ID NO: 60372 - RNA, 22 nt, Chlamydia trachomatis
auggcgaguuuucuuccguagc

SEQ ID NO: 60373 - RNA, 22 nt, Chlamydia trachomatis
gucaggcuguguuaucuacaac

SEQ ID NO: 60374 - RNA, 22 nt, Chlamydia trachomatis
aauugcuuuuucuuagaaguga

SEQ ID NO: 60375 - RNA, 22 nt, Chlamydia trachomatis
uuuaguugaaggucaggcagau

SEQ ID NO: 60376 - RNA, 22 nt, Chlamydia trachomatis
aaagguuuuuaagguauuagau

SEQ ID NO: 60377 - RNA, 22 nt, Chlamydia trachomatis
aaaguuuuguguuuccaaagcu

SEQ ID NO: 60378 - RNA, 22 nt, Chlamydia trachomatis
ugucugucaccauggugaugag

SEQ ID NO: 60379 - RNA, 18 nt, Chlamydia trachomatis
aaguuuugggaagaagcu

SEQ ID NO: 60380 - RNA, 22 nt, Chlamydia trachomatis
aucaagaaggcugguuccuuuc

SEQ ID NO: 60381 - RNA, 22 nt, Chlamydia trachomatis
aagacuucgagacuucccagaa

SEQ ID NO: 60382 - RNA, 22 nt, Chlamydia trachomatis
aggcuugguaugcgauuguucu

SEQ ID NO: 60383 - RNA, 22 nt, Chlamydia trachomatis
ucaggaggccaaauucaacgug

SEQ ID NO: 60384 - RNA, 22 nt, Chlamydia trachomatis
uuguuguguuccuaggcaaaga

SEQ ID NO: 60385 - RNA, 22 nt, Chlamydia trachomatis
ggcaaugauuucuugaacaguc

SEQ ID NO: 60386 - RNA, 19 nt, Chlamydia trachomatis
ugcagggauagcaacucuu

SEQ ID NO: 60387 - RNA, 22 nt, Chlamydia trachomatis
ucuugggaggcggagcggcucu

SEQ ID NO: 60388 - RNA, 22 nt, Chlamydia trachomatis
uauuucuauuucggauaacggu

SEQ ID NO: 60389 - RNA, 22 nt, Chlamydia trachomatis
aagcagcaucauuuugucgagg

SEQ ID NO: 60390 - RNA, 22 nt, Chlamydia trachomatis
gugaauuguauccgcaguccga

SEQ ID NO: 60391 - RNA, 22 nt, Chlamydia trachomatis
uugaaaaagagucuagagagca

SEQ ID NO: 60392 - RNA, 22 nt, Chlamydia trachomatis
uuucguucaagacaugaugcgu

SEQ ID NO: 60393 - RNA, 22 nt, Chlamydia trachomatis
aagcuucguacacaagaaaauc

SEQ ID NO: 60394 - RNA, 22 nt, Chlamydia trachomatis
cagcuaaaucaucagcuccuug

SEQ ID NO: 60395 - RNA, 22 nt, Chlamydia trachomatis
aggaugcucgcagccugcauua

SEQ ID NO: 60396 - RNA, 22 nt, Chlamydia trachomatis
cugauucuuugucuuuaauacg

SEQ ID NO: 60397 - RNA, 22 nt, Chlamydia trachomatis
uccaaucuuggaaaaaaggauc

SEQ ID NO: 60398 - RNA, 22 nt, Chlamydia trachomatis
uaagggaagcgacuccguccaa

SEQ ID NO: 60399 - RNA, 23 nt, Chlamydia trachomatis
ucucuucaguugaugccgcuuuc

SEQ ID NO: 60400 - RNA, 22 nt, Chlamydia trachomatis
uuuuaccuuaagucguugacuc

SEQ ID NO: 60401 - RNA, 22 nt, Chlamydia trachomatis
aaaagaccugagaacgcucuuu

SEQ ID NO: 60402 - RNA, 22 nt, Chlamydia trachomatis
uauguuugcagucgcucugccu

SEQ ID NO: 60403 - RNA, 22 nt, Chlamydia trachomatis
gcagcgauuguagcauguugag

SEQ ID NO: 60404 - RNA, 22 nt, Chlamydia trachomatis
uuggcaagaugucuauagcagu

SEQ ID NO: 60405 - RNA, 22 nt, Chlamydia trachomatis
uuuauugagagaaugguggauu

SEQ ID NO: 60406 - RNA, 22 nt, Chlamydia trachomatis
ggcacccuguguacaguuagga

SEQ ID NO: 60407 - RNA, 22 nt, Chlamydia trachomatis
uaaagcgaguaagaaggauuug

SEQ ID NO: 60408 - RNA, 21 nt, Chlamydia trachomatis
agaagcuuuaggagcuagcau

SEQ ID NO: 60409 - RNA, 22 nt, Chlamydia trachomatis
uugaucaauaagguagcuaaaa

SEQ ID NO: 60410 - RNA, 22 nt, Chlamydia trachomatis
uguaucuucgguugucaaugaa

SEQ ID NO: 60411 - RNA, 22 nt, Chlamydia trachomatis
agagaagcauauucauaagcuc

SEQ ID NO: 60412 - RNA, 22 nt, Chlamydia trachomatis
uggaaguaucgaggaucucugg

SEQ ID NO: 60413 - RNA, 22 nt, Chlamydia trachomatis
gggaaaguauuucgagcgaaag

SEQ ID NO: 60414 - RNA, 22 nt, Chlamydia trachomatis
uguuuuucuagacaagcuuuau

SEQ ID NO: 60415 - RNA, 22 nt, Chlamydia trachomatis
aauagcggcuuauuauggcugu

SEQ ID NO: 60416 - RNA, 22 nt, Chlamydia trachomatis
aaaucguuucuucgaaaacugu

SEQ ID NO: 60417 - RNA, 22 nt, Chlamydia trachomatis
agugcuuucuacuauugcuuua

SEQ ID NO: 60418 - RNA, 22 nt, Chlamydia trachomatis
gguuuuuagccucuggagagcu

SEQ ID NO: 60419 - RNA, 22 nt, Chlamydia trachomatis
cuauuuuccauuuugcagaucu

SEQ ID NO: 60420 - RNA, 22 nt, Chlamydia trachomatis
acaaacuggucauucuuuuggg

SEQ ID NO: 60421 - RNA, 22 nt, Chlamydia trachomatis
cugaucggacaaggugauaugu

SEQ ID NO: 60422 - RNA, 22 nt, Chlamydia trachomatis
uacuuacuuuaguauugaccuu

SEQ ID NO: 60423 - RNA, 22 nt, Chlamydia trachomatis
uugagauucucagagcggaaga

SEQ ID NO: 60424 - RNA, 22 nt, Chlamydia trachomatis
cugcuguugagaauguauucag

SEQ ID NO: 60425 - RNA, 22 nt, Chlamydia trachomatis
aacaaaguuuucugggaagaga

SEQ ID NO: 60426 - RNA, 22 nt, Chlamydia trachomatis
uuuuuauguaagaugaaccuug

SEQ ID NO: 60427 - RNA, 22 nt, Chlamydia trachomatis
aaguauuagugacuaccauuac

SEQ ID NO: 60428 - RNA, 22 nt, Chlamydia trachomatis
ggaagagguggaaauuucuaag

SEQ ID NO: 60429 - RNA, 22 nt, Chlamydia trachomatis
aggaaacaguuucauuuuggga

SEQ ID NO: 60430 - RNA, 22 nt, Chlamydia trachomatis
ccuaagaacgggggaccucgua

SEQ ID NO: 60431 - RNA, 22 nt, Chlamydia trachomatis
uucagaagggaccagcccuugu

SEQ ID NO: 60432 - RNA, 22 nt, Chlamydia trachomatis
cuguagcugcagcggcaaaguu

SEQ ID NO: 60433 - RNA, 22 nt, Chlamydia trachomatis
agggcuuucuguuuguuuagcu

SEQ ID NO: 60434 - RNA, 22 nt, Chlamydia trachomatis
agagugcauccgguugcauggu

SEQ ID NO: 60435 - RNA, 22 nt, Chlamydia trachomatis
uuuugauuuccuucaaauggga

SEQ ID NO: 60436 - RNA, 22 nt, Chlamydia trachomatis
uuucuauccauuaaugcaggag

SEQ ID NO: 60437 - RNA, 22 nt, Chlamydia trachomatis
guuuucauugugaugugauuau

SEQ ID NO: 60438 - RNA, 22 nt, Chlamydia trachomatis
gaagagauuguccuauuuccau

SEQ ID NO: 60439 - RNA, 22 nt, Chlamydia trachomatis
aucgggcuaguaaagugugugu

SEQ ID NO: 60440 - RNA, 22 nt, Chlamydia trachomatis
ugcagaucaacucguugcauuu

SEQ ID NO: 60441 - RNA, 22 nt, Chlamydia trachomatis
uauggggaugguuucuuagaaa

SEQ ID NO: 60442 - RNA, 22 nt, Chlamydia trachomatis
cuagaggcuguuuuagauaucu

SEQ ID NO: 60443 - RNA, 22 nt, Chlamydia trachomatis
cauagaaugauuucugcuugga

SEQ ID NO: 60444 - RNA, 22 nt, Chlamydia trachomatis
cgaguuucugcaaaagacugug

SEQ ID NO: 60445 - RNA, 22 nt, Chlamydia trachomatis
agaaagucgauuccguaaauuu

SEQ ID NO: 60446 - RNA, 22 nt, Chlamydia trachomatis
aacuuuuaauagcagauagucg

SEQ ID NO: 60447 - RNA, 23 nt, Chlamydia trachomatis
gaugugugugcagcagcuacugc

SEQ ID NO: 60448 - RNA, 19 nt, Chlamydia trachomatis
uuccaauaaggguuucuca

SEQ ID NO: 60449 - RNA, 22 nt, Chlamydia trachomatis
uugcuauguugaugccuaagcu

SEQ ID NO: 60450 - RNA, 22 nt, Chlamydia trachomatis
auuugggagcuuuggagagcau

SEQ ID NO: 60451 - RNA, 22 nt, Chlamydia trachomatis
uugggaggagacgacuucgaug

SEQ ID NO: 60452 - RNA, 21 nt, Chlamydia trachomatis
aggaguugucauggcucaaag

SEQ ID NO: 60453 - RNA, 22 nt, Chlamydia trachomatis
uguuaucauaggugccagagca

SEQ ID NO: 60454 - RNA, 22 nt, Chlamydia trachomatis
gguuugggcguguuugaaaaga

SEQ ID NO: 60455 - RNA, 23 nt, Chlamydia trachomatis
agauccuaaacaauuucuuccua

SEQ ID NO: 60456 - RNA, 22 nt, Chlamydia trachomatis
uuuugauugauagcgacauuca

SEQ ID NO: 60457 - RNA, 17 nt, Chlamydia trachomatis
aacauuugcucaauagg

SEQ ID NO: 60458 - RNA, 22 nt, Chlamydia trachomatis
ccgcaaucuccugaagagauug

SEQ ID NO: 60459 - RNA, 22 nt, Chlamydia trachomatis
aggauagcaagaauucuuuggu

SEQ ID NO: 60460 - RNA, 22 nt, Chlamydia trachomatis
uuugcuaguugauacugaaaua

SEQ ID NO: 60461 - RNA, 22 nt, Chlamydia trachomatis
aggaacgaggaauaagcgcucu

SEQ ID NO: 60462 - RNA, 22 nt, Chlamydia trachomatis
uaacucuuuuuuauaagaaggg

SEQ ID NO: 60463 - RNA, 22 nt, Chlamydia trachomatis
agaguuugcgucaagauuucuu

SEQ ID NO: 60464 - RNA, 21 nt, Chlamydia trachomatis
gcagcgaucacauugcuuucc

SEQ ID NO: 60465 - RNA, 22 nt, Chlamydia trachomatis
uuguccaaugucgaggcuuuaa

SEQ ID NO: 60466 - RNA, 22 nt, Chlamydia trachomatis
gaucuuguucaaagcuccguuu

SEQ ID NO: 60467 - RNA, 22 nt, Chlamydia trachomatis
aagaugcucucaaaaguuacga

SEQ ID NO: 60468 - RNA, 19 nt, Chlamydia trachomatis
gccuuuucgugcaaucucu

SEQ ID NO: 60469 - RNA, 23 nt, Chlamydia trachomatis
uaugcggucuuucaguagccgag

SEQ ID NO: 60470 - RNA, 22 nt, Chlamydia trachomatis
ucgauagaacgcauaauccaga

SEQ ID NO: 60471 - RNA, 22 nt, Chlamydia trachomatis
acuuuucuaugacagaagaucu

SEQ ID NO: 60472 - RNA, 22 nt, Chlamydia trachomatis
uuguuugucuuuaucaugauac

SEQ ID NO: 60473 - RNA, 19 nt, Chlamydia trachomatis
agauguuuuugugccagca

SEQ ID NO: 60474 - RNA, 22 nt, Chlamydia trachomatis
cuacaauacgacagaagaauuu

SEQ ID NO: 60475 - RNA, 22 nt, Chlamydia trachomatis
ucgaaugauaugauagcgagaa

SEQ ID NO: 60476 - RNA, 22 nt, Chlamydia trachomatis
uauucccaaaaauugacagcca

SEQ ID NO: 60477 - RNA, 22 nt, Chlamydia trachomatis
uuucuagagauauuggcgcacc

SEQ ID NO: 60478 - RNA, 22 nt, Chlamydia trachomatis
gcgaauuccccugauguaagga

SEQ ID NO: 60479 - RNA, 22 nt, Chlamydia trachomatis
aagauucuguauccaagaguga

SEQ ID NO: 60480 - RNA, 22 nt, Chlamydia trachomatis
uggcugauuaugagaaguauua

SEQ ID NO: 60481 - RNA, 22 nt, Chlamydia trachomatis
aucgguuaucuggacugcugug

SEQ ID NO: 60482 - RNA, 22 nt, Chlamydia trachomatis
uguuguaagguucgcguuuccg

SEQ ID NO: 60483 - RNA, 21 nt, Chlamydia trachomatis
ccagaacaaugugaaagcuuu

SEQ ID NO: 60484 - RNA, 22 nt, Chlamydia trachomatis
uauacuuucucuauacagcauu

SEQ ID NO: 60485 - RNA, 22 nt, Chlamydia trachomatis
uuguagagaaagggauuuguag

SEQ ID NO: 60486 - RNA, 22 nt, Chlamydia trachomatis
auggaaguauugcguuuaucug

SEQ ID NO: 60487 - RNA, 22 nt, Chlamydia trachomatis
ugguaguacuauugcagauauu

SEQ ID NO: 60488 - RNA, 22 nt, Chlamydia trachomatis
gcuucccuuaaauauucauaug

SEQ ID NO: 60489 - RNA, 22 nt, Chlamydia trachomatis
guucuuuucuaugaaucgggua

SEQ ID NO: 60490 - RNA, 22 nt, Chlamydia trachomatis
uugguuccuucuuuaggggagc

SEQ ID NO: 60491 - RNA, 22 nt, Chlamydia trachomatis
aggggcuuugucaugacucgga

SEQ ID NO: 60492 - RNA, 22 nt, Chlamydia trachomatis
aauauaucuauuugcccucuau

SEQ ID NO: 60493 - RNA, 22 nt, Chlamydia trachomatis
gccaauggucccuauguugaua

SEQ ID NO: 60494 - RNA, 22 nt, Chlamydia trachomatis
ggaaaugaauucuuauucggua

SEQ ID NO: 60495 - RNA, 22 nt, Chlamydia trachomatis
uuugccuaguggggaaucuugg

SEQ ID NO: 60496 - RNA, 22 nt, Chlamydia trachomatis
augcgcuacuucaaaucgauug

SEQ ID NO: 60497 - RNA, 22 nt, Chlamydia trachomatis
uucugcgccuuuuacagggugu

SEQ ID NO: 60498 - RNA, 22 nt, Chlamydia trachomatis
aaacuuuucggaauucuuuggu

SEQ ID NO: 60499 - RNA, 23 nt, Chlamydia trachomatis
uggaaggucaugagauccguauu

SEQ ID NO: 60500 - RNA, 22 nt, Chlamydia trachomatis
aucaauugcaugaagaauuugc

SEQ ID NO: 60501 - RNA, 22 nt, Chlamydia trachomatis
agccaagcgaaugaguucgaca

SEQ ID NO: 60502 - RNA, 22 nt, Chlamydia trachomatis
gauucuuuugcaaugaggaaga

SEQ ID NO: 60503 - RNA, 22 nt, Chlamydia trachomatis
auuuucuauuggcguuugaggu

SEQ ID NO: 60504 - RNA, 22 nt, Chlamydia trachomatis
acuguucaagaaaucauugccg

SEQ ID NO: 60505 - RNA, 22 nt, Chlamydia trachomatis
aucguaaagaugguucuacacu

SEQ ID NO: 60506 - RNA, 20 nt, Chlamydia trachomatis
augucuuugaugcaagcucu

SEQ ID NO: 60507 - RNA, 22 nt, Chlamydia trachomatis
uacuucuauggggauagaaacc

SEQ ID NO: 60508 - RNA, 22 nt, Chlamydia trachomatis
uuggauaugauccuuuguuugu

SEQ ID NO: 60509 - RNA, 22 nt, Chlamydia trachomatis
agagagcggucucuauugguaa

SEQ ID NO: 60510 - RNA, 22 nt, Chlamydia trachomatis
auacggauaucuugcuggcugg

SEQ ID NO: 60511 - RNA, 22 nt, Chlamydia trachomatis
uacagcuuuuugagucauuguu

SEQ ID NO: 60512 - RNA, 22 nt, Chlamydia trachomatis
cagaaauauaagguagcuuggc

SEQ ID NO: 60513 - RNA, 22 nt, Chlamydia trachomatis
aaucuuaucuaugaauggcgag

SEQ ID NO: 60514 - RNA, 22 nt, Chlamydia trachomatis
auccuuuuugaacuuucggagc

SEQ ID NO: 60515 - RNA, 22 nt, Chlamydia trachomatis
uuuggucuuggagucuucacag

SEQ ID NO: 60516 - RNA, 22 nt, Chlamydia trachomatis
guaguuguaugaaaauccguga

SEQ ID NO: 60517 - RNA, 22 nt, Chlamydia trachomatis
uucuuagauaaggcauuugugu

SEQ ID NO: 60518 - RNA, 22 nt, Chlamydia trachomatis
uaaucaagagaggaagagguuu

SEQ ID NO: 60519 - RNA, 22 nt, Chlamydia trachomatis
uuacuaccuaugugaaugacua

SEQ ID NO: 60520 - RNA, 20 nt, Chlamydia trachomatis
aaaugguuuagcugaagcug

SEQ ID NO: 60521 - RNA, 22 nt, Chlamydia trachomatis
acaagcuuagcucacuggaaau

SEQ ID NO: 60522 - RNA, 22 nt, Chlamydia trachomatis
gagcuaucauuuccaaaaucuu

SEQ ID NO: 60523 - RNA, 22 nt, Chlamydia trachomatis
ucuuuagauacacaguauucaa

SEQ ID NO: 60524 - RNA, 22 nt, Chlamydia trachomatis
acuacggaguuucuaucccuga

SEQ ID NO: 60525 - RNA, 22 nt, Chlamydia trachomatis
agauccuaaaaaagucccuaug

SEQ ID NO: 60526 - RNA, 22 nt, Chlamydia trachomatis
uugugguuuuuauauuaugcca

SEQ ID NO: 60527 - RNA, 22 nt, Chlamydia trachomatis
ugauuugguaaacaagugugcu

SEQ ID NO: 60528 - RNA, 22 nt, Chlamydia trachomatis
aagggaaacucaccuuaguagu

SEQ ID NO: 60529 - RNA, 22 nt, Chlamydia trachomatis
ggcuucucguuaaggcuuuacg

SEQ ID NO: 60530 - RNA, 22 nt, Chlamydia trachomatis
auagggaaucauaagaauuucc

SEQ ID NO: 60531 - RNA, 22 nt, Chlamydia trachomatis
auuugcagcauggauuuaaggc

SEQ ID NO: 60532 - RNA, 22 nt, Chlamydia trachomatis
auagucuuagcguuuauauccu

SEQ ID NO: 60533 - RNA, 22 nt, Chlamydia trachomatis
auccacaggaugcaacuccuca

SEQ ID NO: 60534 - RNA, 22 nt, Chlamydia trachomatis
uagcuaugucaaauucuuuugg

SEQ ID NO: 60535 - RNA, 22 nt, Chlamydia trachomatis
ucuugaggauguucuguuuuua

SEQ ID NO: 60536 - RNA, 22 nt, Chlamydia trachomatis
uagaagccacuguacgcuuccu

SEQ ID NO: 60537 - RNA, 22 nt, Chlamydia trachomatis
aaaacgcagagucggcaucgga

SEQ ID NO: 60538 - RNA, 22 nt, Chlamydia trachomatis
gggaauccucucccuuuuucua

SEQ ID NO: 60539 - RNA, 22 nt, Chlamydia trachomatis
auggagguguuagccuaucauu

SEQ ID NO: 60540 - RNA, 22 nt, Chlamydia trachomatis
gagaucuccuagcgaagcauaa

SEQ ID NO: 60541 - RNA, 22 nt, Chlamydia trachomatis
cgucuuuugaaugaucugcuua

SEQ ID NO: 60542 - RNA, 22 nt, Chlamydia trachomatis
caggagaauuaacgguucucgu

SEQ ID NO: 60543 - RNA, 22 nt, Chlamydia trachomatis
uuaaagcuuuuuuccauagaac

SEQ ID NO: 60544 - RNA, 22 nt, Chlamydia trachomatis
ucgagacucaaaugacaauucc

SEQ ID NO: 60545 - RNA, 22 nt, Chlamydia trachomatis
uugauuaucccgaagauauaac

SEQ ID NO: 60546 - RNA, 22 nt, Chlamydia trachomatis
gugggauuggaaagaguaaucc

SEQ ID NO: 60547 - RNA, 22 nt, Chlamydia trachomatis
agacucugauauuguggaaugg

SEQ ID NO: 60548 - RNA, 22 nt, Chlamydia trachomatis
ucugcauacugugugaugucuc

SEQ ID NO: 60549 - RNA, 22 nt, Chlamydia trachomatis
aagagaaagcucuucuuuuagu

SEQ ID NO: 60550 - RNA, 22 nt, Chlamydia trachomatis
gaagagagaaucacaaaucgau

SEQ ID NO: 60551 - RNA, 20 nt, Chlamydia trachomatis
uaucgcuauuaguaucagaa

SEQ ID NO: 60552 - RNA, 22 nt, Chlamydia trachomatis
aaagcaagcccuuucucuacag

SEQ ID NO: 60553 - RNA, 22 nt, Chlamydia trachomatis
uuucaugguaacuucuucucua

SEQ ID NO: 60554 - RNA, 22 nt, Chlamydia trachomatis
ucuugugggacagggauguugg

SEQ ID NO: 60555 - RNA, 22 nt, Chlamydia trachomatis
auucgacagagcugucaagagu

SEQ ID NO: 60556 - RNA, 22 nt, Chlamydia trachomatis
aaggauuucugaaggacagagg

SEQ ID NO: 60557 - RNA, 22 nt, Chlamydia trachomatis
agccguugcuaaaacuguuuug

SEQ ID NO: 60558 - RNA, 22 nt, Chlamydia trachomatis
aacaacaagauguuagcauaga

SEQ ID NO: 60559 - RNA, 20 nt, Chlamydia trachomatis
aaccucuguuuucuuuagcu

SEQ ID NO: 60560 - RNA, 22 nt, Chlamydia trachomatis
ucuauuucuuggaauagagcaa

SEQ ID NO: 60561 - RNA, 22 nt, Chlamydia trachomatis
aagcuauagauucagcgcaguu

SEQ ID NO: 60562 - RNA, 19 nt, Chlamydia trachomatis
uaucccuaccccaggagug

SEQ ID NO: 60563 - RNA, 20 nt, Chlamydia trachomatis
uuuuuuguaacaaaggagca

SEQ ID NO: 60564 - RNA, 22 nt, Chlamydia trachomatis
cauauuugaaacaagaguccaa

SEQ ID NO: 60565 - RNA, 22 nt, Chlamydia trachomatis
gucuuuggaaucaaagcuuuag

SEQ ID NO: 60566 - RNA, 22 nt, Chlamydia trachomatis
uguugcuaagauuagguggauu

SEQ ID NO: 60567 - RNA, 22 nt, Chlamydia trachomatis
cuuccugugacuugguaaagua

SEQ ID NO: 60568 - RNA, 22 nt, Chlamydia trachomatis
ugagaggaaaaguggugcauuc

SEQ ID NO: 60569 - RNA, 22 nt, Chlamydia trachomatis
guuccuugugauuuugcuacug

SEQ ID NO: 60570 - RNA, 21 nt, Chlamydia trachomatis
gggaaaggugggcugagcuga

SEQ ID NO: 60571 - RNA, 22 nt, Chlamydia trachomatis
uuuggggauauauacuguaacu

SEQ ID NO: 60572 - RNA, 21 nt, Chlamydia trachomatis
cuucugaaaagguucugccac

SEQ ID NO: 60573 - RNA, 22 nt, Chlamydia trachomatis
cuacuuugugcgauaaagucuu

SEQ ID NO: 60574 - RNA, 22 nt, Chlamydia trachomatis
ucugcuaucucucuuugaguga

SEQ ID NO: 60575 - RNA, 22 nt, Chlamydia trachomatis
auacucuuauagcuuaucgauu

SEQ ID NO: 60576 - RNA, 22 nt, Chlamydia trachomatis
aacucuuuauucauaacaaaac

SEQ ID NO: 60577 - RNA, 22 nt, Chlamydia trachomatis
ucuguucuacuuguucagccuu

SEQ ID NO: 60578 - RNA, 22 nt, Chlamydia trachomatis
aaaauccuuuuaugaugugagu

SEQ ID NO: 60579 - RNA, 22 nt, Chlamydia trachomatis
ugcugccauaaagauuucuuau

SEQ ID NO: 60580 - RNA, 22 nt, Chlamydia trachomatis
agcucuuuaaugucuuugauuu

SEQ ID NO: 60581 - RNA, 23 nt, Chlamydia trachomatis
auuuuucauccagugguucuauc

SEQ ID NO: 60582 - RNA, 21 nt, Chlamydia trachomatis
aaacucuuuaucgaccucuac

SEQ ID NO: 60583 - RNA, 18 nt, Chlamydia trachomatis
uccuuucuuucugcaagu

SEQ ID NO: 60584 - RNA, 22 nt, Chlamydia trachomatis
agggagccuauguuuuuagcgu

SEQ ID NO: 60585 - RNA, 22 nt, Chlamydia trachomatis
ucuucuguuagcuacgcucugu

SEQ ID NO: 60586 - RNA, 22 nt, Chlamydia trachomatis
auuuccacaauucuucuacaaa

SEQ ID NO: 60587 - RNA, 22 nt, Chlamydia trachomatis
agaguuucugcauuacucgaga

SEQ ID NO: 60588 - RNA, 22 nt, Chlamydia trachomatis
gggacguuacacuaugacccca

SEQ ID NO: 60589 - RNA, 22 nt, Chlamydia trachomatis
auagaagaauucgaugugguug

SEQ ID NO: 60590 - RNA, 22 nt, Chlamydia trachomatis
aggauuuuguauuggaacaaua

SEQ ID NO: 60591 - RNA, 22 nt, Chlamydia trachomatis
acgguaucguaaagcuuauguu

SEQ ID NO: 60592 - RNA, 22 nt, Chlamydia trachomatis
uagagaucugaaagagccucgu

SEQ ID NO: 60593 - RNA, 22 nt, Chlamydia trachomatis
uucguugcuuaaaaaguauccu

SEQ ID NO: 60594 - RNA, 22 nt, Chlamydia trachomatis
aucuucauacuuucaucgaaaa

SEQ ID NO: 60595 - RNA, 22 nt, Chlamydia trachomatis
ucuuagguuuagauuucuuagc

SEQ ID NO: 60596 - RNA, 22 nt, Chlamydia trachomatis
agagaaugucaaaagauacuuu

SEQ ID NO: 60597 - RNA, 22 nt, Chlamydia trachomatis
ccgaguuccccaagaggcauac

SEQ ID NO: 60598 - RNA, 22 nt, Chlamydia trachomatis
agcuacaggaaccgggauugcu

SEQ ID NO: 60599 - RNA, 22 nt, Chlamydia trachomatis
ucaggaauauuuggcauaggua

SEQ ID NO: 60600 - RNA, 22 nt, Chlamydia trachomatis
uuguuugcuugugaauaagaaa

SEQ ID NO: 60601 - RNA, 22 nt, Chlamydia trachomatis
gacugcuauagacaucuugcca

SEQ ID NO: 60602 - RNA, 22 nt, Chlamydia trachomatis
gugcuaaaugcuucaaaagaac

SEQ ID NO: 60603 - RNA, 22 nt, Chlamydia trachomatis
cgauuaugagauucuuuuugug

SEQ ID NO: 60604 - RNA, 22 nt, Chlamydia trachomatis
cgauuucuucugaagauuaugg

SEQ ID NO: 60605 - RNA, 22 nt, Chlamydia trachomatis
gcguaucagugaauugauucug

SEQ ID NO: 60606 - RNA, 22 nt, Chlamydia trachomatis
gaucuguauauuggaggugcag

SEQ ID NO: 60607 - RNA, 22 nt, Chlamydia trachomatis
ucguaugccucccuuuguuuuu

SEQ ID NO: 60608 - RNA, 22 nt, Chlamydia trachomatis
uuucuauucucaacagacgaua

SEQ ID NO: 60609 - RNA, 22 nt, Chlamydia trachomatis
gugauuguguuuucuuaugcau

SEQ ID NO: 60610 - RNA, 22 nt, Chlamydia trachomatis
uuggauguagacuuugaaaagc

SEQ ID NO: 60611 - RNA, 22 nt, Chlamydia trachomatis
ggauauugauaccgcuauacau

SEQ ID NO: 60612 - RNA, 22 nt, Chlamydia trachomatis
uucagaaacauaaggcgcuuca

SEQ ID NO: 60613 - RNA, 22 nt, Chlamydia trachomatis
cauggaaaggaauucguuucac

SEQ ID NO: 60614 - RNA, 18 nt, Chlamydia trachomatis
uauaagagggcauaucau

SEQ ID NO: 60615 - RNA, 22 nt, Chlamydia trachomatis
gaaguuucugugaucgaagcaa

SEQ ID NO: 60616 - RNA, 22 nt, Chlamydia trachomatis
gagugguugaaaggaguuccuu

SEQ ID NO: 60617 - RNA, 22 nt, Chlamydia trachomatis
gaugauuacguaggcaagguuu

SEQ ID NO: 60618 - RNA, 22 nt, Chlamydia trachomatis
cugcuauugagguaagcuauuu

SEQ ID NO: 60619 - RNA, 22 nt, Chlamydia trachomatis
aaucccuugggauagucugcga

SEQ ID NO: 60620 - RNA, 22 nt, Chlamydia trachomatis
aaauaguuaacucuguagcgua

SEQ ID NO: 60621 - RNA, 22 nt, Chlamydia trachomatis
cuaugccuuacggaacucguua

SEQ ID NO: 60622 - RNA, 22 nt, Chlamydia trachomatis
cucaacaugcuacaaucgcugc

SEQ ID NO: 60623 - RNA, 22 nt, Chlamydia trachomatis
uuuuaucgauaaaagaaacuuc

SEQ ID NO: 60624 - RNA, 22 nt, Chlamydia trachomatis
agaucauuggcccuaaacaggg

SEQ ID NO: 60625 - RNA, 22 nt, Chlamydia trachomatis
uucgaauauagucaaagauacu

SEQ ID NO: 60626 - RNA, 22 nt, Chlamydia trachomatis
caaagcaguuauuaugauaacg

SEQ ID NO: 60627 - RNA, 22 nt, Chlamydia trachomatis
auugugauuacuccaucuaagc

SEQ ID NO: 60628 - RNA, 22 nt, Chlamydia trachomatis
aguguauuggggaugacauugc

SEQ ID NO: 60629 - RNA, 23 nt, Chlamydia trachomatis
uaucaauagggagcaaaccucua

SEQ ID NO: 60630 - RNA, 22 nt, Chlamydia trachomatis
aauaaacucgccacacuaguca

SEQ ID NO: 60631 - RNA, 22 nt, Chlamydia trachomatis
agcuuuucagagcuuuguaaau

SEQ ID NO: 60632 - RNA, 22 nt, Chlamydia trachomatis
uuuuugaaguucucucaaccaa

SEQ ID NO: 60633 - RNA, 22 nt, Chlamydia trachomatis
uugcuccuuuguuacaaaaaac

SEQ ID NO: 60634 - RNA, 22 nt, Chlamydia trachomatis
cuguguauguuuaagggaagac

SEQ ID NO: 60635 - RNA, 19 nt, Chlamydia trachomatis
aggggaagagaguuagcug

SEQ ID NO: 60636 - RNA, 21 nt, Chlamydia trachomatis
uggaagaaauagauagcuucu

SEQ ID NO: 60637 - RNA, 23 nt, Chlamydia trachomatis
auucugaauuggcuacuuguuac

SEQ ID NO: 60638 - RNA, 22 nt, Chlamydia trachomatis
cuauccuuguaguuggcggugu

SEQ ID NO: 60639 - RNA, 22 nt, Chlamydia trachomatis
ucuuuugaagcagaggaaucuu

SEQ ID NO: 60640 - RNA, 22 nt, Chlamydia trachomatis
auuaggagaagcuguugguauu

SEQ ID NO: 60641 - RNA, 22 nt, Chlamydia trachomatis
aggauauucagacguaccuaug

SEQ ID NO: 60642 - RNA, 22 nt, Chlamydia trachomatis
uuuuuuacucaugguuuagucc

SEQ ID NO: 60643 - RNA, 22 nt, Chlamydia trachomatis
ucauuaucaauagcuuuggccg

SEQ ID NO: 60644 - RNA, 22 nt, Chlamydia trachomatis
uccugaagguagagaacugcaa

SEQ ID NO: 60645 - RNA, 22 nt, Chlamydia trachomatis
uaucugcaaaagugaagguaga

SEQ ID NO: 60646 - RNA, 22 nt, Chlamydia trachomatis
ggagauuacgaaaaggugcuuu

SEQ ID NO: 60647 - RNA, 21 nt, Chlamydia trachomatis
agaaaguugggaagcuaauuc

SEQ ID NO: 60648 - RNA, 22 nt, Chlamydia trachomatis
auucgagagggaauuuuaaaug

SEQ ID NO: 60649 - RNA, 22 nt, Chlamydia trachomatis
aaaaauauagcgaguagagccg

SEQ ID NO: 60650 - RNA, 22 nt, Chlamydia trachomatis
caacuccuuugaguuugucugc

SEQ ID NO: 60651 - RNA, 23 nt, Chlamydia trachomatis
aaaauacggucacaaugaaagug

SEQ ID NO: 60652 - RNA, 22 nt, Chlamydia trachomatis
acgcuagacguaaggcuuuaga

SEQ ID NO: 60653 - RNA, 22 nt, Chlamydia trachomatis
uucaugcuuugacggaguuuuu

SEQ ID NO: 60654 - RNA, 22 nt, Chlamydia trachomatis
uccauuccagauggagguaugu

SEQ ID NO: 60655 - RNA, 22 nt, Chlamydia trachomatis
cugucuguaggagaauuaucac

SEQ ID NO: 60656 - RNA, 22 nt, Chlamydia trachomatis
gcucucucuacaaauggauuuu

SEQ ID NO: 60657 - RNA, 22 nt, Chlamydia trachomatis
guauauuuauauugcccuucuu

SEQ ID NO: 60658 - RNA, 22 nt, Chlamydia trachomatis
aagucuaguuuauauguauggg

SEQ ID NO: 60659 - RNA, 22 nt, Chlamydia trachomatis
aagcuuaaagcugaagaaguau

SEQ ID NO: 60660 - RNA, 20 nt, Chlamydia trachomatis
gguaguugaaggucuagaau

SEQ ID NO: 60661 - RNA, 22 nt, Chlamydia trachomatis
gggauuauagaaguuuuuauaa

SEQ ID NO: 60662 - RNA, 22 nt, Chlamydia trachomatis
ugcuuugaauaauccagauauu

SEQ ID NO: 60663 - RNA, 22 nt, Chlamydia trachomatis
aacgguuuuaugaaguauugga

SEQ ID NO: 60664 - RNA, 22 nt, Chlamydia trachomatis
auggggguccacgcucuuauca

SEQ ID NO: 60665 - RNA, 22 nt, Chlamydia trachomatis
uucuaagaacccucuaccagag

SEQ ID NO: 60666 - RNA, 22 nt, Chlamydia trachomatis
gucgaggauuaggcggaggauc

SEQ ID NO: 60667 - RNA, 22 nt, Chlamydia trachomatis
uuggguuaguagaaaugacucg

SEQ ID NO: 60668 - RNA, 22 nt, Chlamydia trachomatis
gacuagaggagagacuucaaua

SEQ ID NO: 60669 - RNA, 22 nt, Chlamydia trachomatis
aaaauccuuuuaugaugugagu

SEQ ID NO: 60670 - RNA, 22 nt, Chlamydia trachomatis
aaaguuuuguguuuccaaagcu

SEQ ID NO: 60671 - RNA, 22 nt, Chlamydia trachomatis
aagggaaacucaccuuaguagu

SEQ ID NO: 60672 - RNA, 22 nt, Chlamydia trachomatis
aaguagaggcuaccuauggaga

SEQ ID NO: 60673 - RNA, 22 nt, Chlamydia trachomatis
aaggauuucugaaggacagagg

SEQ ID NO: 60674 - RNA, 22 nt, Chlamydia trachomatis
aacaacaagauguuagcauaga

SEQ ID NO: 60675 - RNA, 22 nt, Chlamydia trachomatis
aauugcuuuuucuuagaaguga

SEQ ID NO: 60676 - RNA, 22 nt, Chlamydia trachomatis
caccaugcgaucaucuuuugaa

SEQ ID NO: 60677 - RNA, 22 nt, Chlamydia trachomatis
cagcaucuguagcucuuugucc

SEQ ID NO: 60678 - RNA, 22 nt, Chlamydia trachomatis
cagccucagccuauucuguuuc

SEQ ID NO: 60679 - RNA, 22 nt, Chlamydia trachomatis
auggaaauguguucuggaguuu

SEQ ID NO: 60680 - RNA, 22 nt, Chlamydia trachomatis
auggggguccacgcucuuauca

SEQ ID NO: 60681 - RNA, 22 nt, Chlamydia trachomatis
auucaccauucucuucauugug

SEQ ID NO: 60682 - RNA, 20 nt, Chlamydia trachomatis
augucuuugaugcaagcucu

SEQ ID NO: 60683 - RNA, 23 nt, Chlamydia trachomatis
auucugaauuggcuacuuguuac

SEQ ID NO: 60684 - RNA, 22 nt, Chlamydia trachomatis
auuuucuauuggcguuugaggu

SEQ ID NO: 60685 - RNA, 23 nt, Chlamydia trachomatis
auuuuucauccagugguucuauc

SEQ ID NO: 60686 - RNA, 20 nt, Chlamydia trachomatis
caaagcugcagauguuuuug

SEQ ID NO: 60687 - RNA, 22 nt, Chlamydia trachomatis
auacauuuuaugcuagccuggc

SEQ ID NO: 60688 - RNA, 22 nt, Chlamydia trachomatis
auccacaacccagagaauuccu

SEQ ID NO: 60689 - RNA, 22 nt, Chlamydia trachomatis
aguccaagguacuagguccuca

SEQ ID NO: 60690 - RNA, 22 nt, Chlamydia trachomatis
aguguauuggggaugacauugc

SEQ ID NO: 60691 - RNA, 23 nt, Chlamydia trachomatis
agaaauacaacaaagcacgauuc

SEQ ID NO: 60692 - RNA, 22 nt, Chlamydia trachomatis
ugagucacuaaugcagaccuua

SEQ ID NO: 60693 - RNA, 22 nt, Chlamydia trachomatis
uccagcaacggcuugggaaguu

SEQ ID NO: 60694 - RNA, 22 nt, Chlamydia trachomatis
ucuaugcagguguagaaaaagg

SEQ ID NO: 60695 - RNA, 22 nt, Chlamydia trachomatis
ucucccaauagauugauauuau

SEQ ID NO: 60696 - RNA, 22 nt, Chlamydia trachomatis
gugggauuggaaagaguaaucc

SEQ ID NO: 60697 - RNA, 22 nt, Chlamydia trachomatis
gugauuucuccuugcauauuuu

SEQ ID NO: 60698 - RNA, 22 nt, Chlamydia trachomatis
ucaggaauauuuggcauaggua

SEQ ID NO: 60699 - RNA, 22 nt, Chlamydia trachomatis
gccaugccugagguauucaugg

SEQ ID NO: 60700 - RNA, 21 nt, Chlamydia trachomatis
gaagagccuaaaauagcgcgc

SEQ ID NO: 60701 - RNA, 22 nt, Chlamydia trachomatis
gaaguuucugugaucgaagcaa

SEQ ID NO: 60702 - RNA, 22 nt, Chlamydia trachomatis
cuauuuuccauuuugcagaucu

SEQ ID NO: 60703 - RNA, 22 nt, Chlamydia trachomatis
cucaacaugcuacaaucgcugc

SEQ ID NO: 60704 - RNA, 22 nt, Chlamydia trachomatis
cucuguguaguaucaguauucc

SEQ ID NO: 60705 - RNA, 22 nt, Chlamydia trachomatis
cugauucuuugucuuuaauacg

SEQ ID NO: 60706 - RNA, 22 nt, Chlamydia trachomatis
cuuccugugacuugguaaagua

SEQ ID NO: 60707 - RNA, 22 nt, Chlamydia trachomatis
cgucuuuugaaugaucugcuua

SEQ ID NO: 60708 - RNA, 22 nt, Chlamydia trachomatis
cgauuucuucugaagauuaugg

SEQ ID NO: 60709 - RNA, 22 nt, Chlamydia trachomatis
ugugucuaaagaucggcuuaca

SEQ ID NO: 60710 - RNA, 22 nt, Chlamydia trachomatis
uguuguaagguucgcguuuccg

SEQ ID NO: 60711 - RNA, 22 nt, Chlamydia trachomatis
aaaaauauagcgaguagagccg

SEQ ID NO: 60712 - RNA, 17 nt, Chlamydia trachomatis
aacauuugcucaauagg

SEQ ID NO: 60713 - RNA, 22 nt, Chlamydia trachomatis
aagauucuguauccaagaguga

SEQ ID NO: 60714 - RNA, 22 nt, Chlamydia trachomatis
aauaaacucgccacacuaguca

SEQ ID NO: 60715 - RNA, 23 nt, Chlamydia trachomatis
aggauaggaaaugagagcuagca

SEQ ID NO: 60716 - RNA, 22 nt, Chlamydia trachomatis
aggauuuuguauuggaacaaua

SEQ ID NO: 60717 - RNA, 17 nt, Chlamydia trachomatis
agcugggcgaucugaag

SEQ ID NO: 60718 - RNA, 22 nt, Chlamydia trachomatis
agccccaacugauccagagccu

SEQ ID NO: 60719 - RNA, 22 nt, Chlamydia trachomatis
accaugcccuaaauugaaaaua

SEQ ID NO: 60720 - RNA, 22 nt, Chlamydia trachomatis
agagagcggucucuauugguaa

SEQ ID NO: 60721 - RNA, 22 nt, Chlamydia trachomatis
agaguuucugcauuacucgaga

SEQ ID NO: 60722 - RNA, 22 nt, Chlamydia trachomatis
uugauuaucccgaagauauaac

SEQ ID NO: 60723 - RNA, 22 nt, Chlamydia trachomatis
uugagauucucagagcggaaga

SEQ ID NO: 60724 - RNA, 22 nt, Chlamydia trachomatis
uugggaggagacgacuucgaug

SEQ ID NO: 60725 - RNA, 22 nt, Chlamydia trachomatis
uugugguuuuuauauuaugcca

SEQ ID NO: 60726 - RNA, 22 nt, Chlamydia trachomatis
uuuaaagacagaucuaauccgc

SEQ ID NO: 60727 - RNA, 22 nt, Chlamydia trachomatis
uuuauaacaaaggaacuuauga

SEQ ID NO: 60728 - RNA, 22 nt, Chlamydia trachomatis
uuuauugagagaaugguggauu

SEQ ID NO: 60729 - RNA, 22 nt, Chlamydia trachomatis
uucugcauuuacuagagcugcu

SEQ ID NO: 60730 - RNA, 22 nt, Chlamydia trachomatis
uuucuagagauauuggcgcacc

SEQ ID NO: 60731 - RNA, 22 nt, Chlamydia trachomatis
uuucuauucucaacagacgaua

SEQ ID NO: 60732 - RNA, 22 nt, Chlamydia trachomatis
uuuuaucgauaaaagaaacuuc

SEQ ID NO: 60733 - RNA, 22 nt, Chlamydia trachomatis
uuuuggguuguguacgaagcuu

SEQ ID NO: 60734 - RNA, 22 nt, Chlamydia trachomatis
uuuuuauguaagaugaaccuug

SEQ ID NO: 60735 - RNA, 22 nt, Chlamydia trachomatis
uggaaguaucgaggaucucugg

SEQ ID NO: 60736 - RNA, 18 nt, Chlamydia trachomatis
uccuuucuuucugcaagu

SEQ ID NO: 60737 - RNA, 22 nt, Chlamydia trachomatis
ugaaagaaaugggaaccguucc

SEQ ID NO: 60738 - RNA, 22 nt, Chlamydia trachomatis
gcuuuagagggucuuauucacg

SEQ ID NO: 60739 - RNA, 22 nt, Chlamydia trachomatis
guauauuuauauugcccuucuu

SEQ ID NO: 60740 - RNA, 22 nt, Chlamydia trachomatis
guauuuuucaaucgcuuguucu

SEQ ID NO: 60741 - RNA, 22 nt, Chlamydia trachomatis
gucaggcuguguuaucuacaac

SEQ ID NO: 60742 - RNA, 22 nt, Chlamydia trachomatis
uacagcuuuuugagucauuguu

SEQ ID NO: 60743 - RNA, 22 nt, Chlamydia trachomatis
uacaccauuacgaggaagcugu

SEQ ID NO: 60744 - RNA, 22 nt, Chlamydia trachomatis
uagaagaagcuggaggccucgu

SEQ ID NO: 60745 - RNA, 22 nt, Chlamydia trachomatis
gauucucugguauuaacugguu

SEQ ID NO: 60746 - RNA, 22 nt, Chlamydia trachomatis
gcacagaccguaauggccuuug

SEQ ID NO: 60747 - RNA, 22 nt, Chlamydia trachomatis
cgcguccugaauuccuuuuguu

SEQ ID NO: 60748 - RNA, 17 nt, Chlamydia trachomatis
ccgacgagacucccuuc

SEQ ID NO: 60749 - RNA, 22 nt, Human
aaaaaauugcuggcagagcugu

SEQ ID NO: 60750 - RNA, 22 nt, Human
aaaaaggagaaagagagggaga

SEQ ID NO: 60751 - RNA, 22 nt, Human
aaaaaaacuaauuuuaaaugug

SEQ ID NO: 60752 - RNA, 20 nt, Human
aaaaacaguaaugcugaaga

SEQ ID NO: 60753 - RNA, 22 nt, Human
aaaaacuuaccccagggcaagg

SEQ ID NO: 60754 - RNA, 22 nt, Human
aaaaaguaccacuuggacacuu

SEQ ID NO: 60755 - RNA, 22 nt, Human
aaaacauuuuacugccaucuca

SEQ ID NO: 60756 - RNA, 22 nt, Human
aaaacuuucagggauacagaaa

SEQ ID NO: 60757 - RNA, 22 nt, Human
aaaagaaugaugggagcugggu

SEQ ID NO: 60758 - RNA, 22 nt, Human
aaaagacaaggaucuggaguga

SEQ ID NO: 60759 - RNA, 20 nt, Human
aaaaauguguuuauggagau

SEQ ID NO: 60760 - RNA, 18 nt, Human
aaacauggcuuaaaggcu

SEQ ID NO: 60761 - RNA, 22 nt, Human
aaacccaggguuuugucuuccc

SEQ ID NO: 60762 - RNA, 21 nt, Human
aaacaugcagccugccaauuc

SEQ ID NO: 60763 - RNA, 22 nt, Human
aaacccuagcguuguuuauuga

SEQ ID NO: 60764 - RNA, 22 nt, Human
aaacauguagugcaugaggauc

SEQ ID NO: 60765 - RNA, 22 nt, Human
aaaccagaguucauaguauuca

SEQ ID NO: 60766 - RNA, 22 nt, Human
aaaauauguugagauacugaaa

SEQ ID NO: 60767 - RNA, 22 nt, Human
aaaauacuaggaaaauaaauca

SEQ ID NO: 60768 - RNA, 22 nt, Human
aaacaauaauaauuaggaagga

SEQ ID NO: 60769 - RNA, 22 nt, Human
aaaauauucuauaucaaagaua

SEQ ID NO: 60770 - RNA, 22 nt, Human
aaaauaauauuauaccacugcu

SEQ ID NO: 60771 - RNA, 22 nt, Human
aaaaggaagaguuuucagagac

SEQ ID NO: 60772 - RNA, 22 nt, Human
aaaaguuguaauauuuccuuua

SEQ ID NO: 60773 - RNA, 22 nt, Human
aaaauaaccuucauuugcauug

SEQ ID NO: 60774 - RNA, 22 nt, Human
aaaaggaacaauaugguauuuu

SEQ ID NO: 60775 - RNA, 22 nt, Human
aaacugcuuucucugccuuucc

SEQ ID NO: 60776 - RNA, 22 nt, Human
aaacuuuaggcacauggaucua

SEQ ID NO: 60777 - RNA, 22 nt, Human
aaacucuaagacuaaaauugaa

SEQ ID NO: 60778 - RNA, 20 nt, Human
aaacucuuuucuuacauuuu

SEQ ID NO: 60779 - RNA, 22 nt, Human
aaacugacugaugugaucuuau

SEQ ID NO: 60780 - RNA, 20 nt, Human
aaacucucugaucuuacagu

SEQ ID NO: 60781 - RNA, 22 nt, Human
aaacuagaacagagagagaagc

SEQ ID NO: 60782 - RNA, 22 nt, Human
aaacucaucaguuuagaaaccu

SEQ ID NO: 60783 - RNA, 21 nt, Human
aaagaaguuaguucagugguu

SEQ ID NO: 60784 - RNA, 22 nt, Human
aaagagcugccaagguuacagu

SEQ ID NO: 60785 - RNA, 22 nt, Human
aaacuuuugaaggaggaaaaag

SEQ ID NO: 60786 - RNA, 22 nt, Human
aaagacaauaauucucucuagc

SEQ ID NO: 60787 - RNA, 22 nt, Human
aaagacagccuguuggcuuucu

SEQ ID NO: 60788 - RNA, 22 nt, Human
aaagacuaaccaguugucaaaa

SEQ ID NO: 60789 - RNA, 22 nt, Human
aaagacucaauuguucccuaau

SEQ ID NO: 60790 - RNA, 22 nt, Human
aaagagacaacaacaacuucua

SEQ ID NO: 60791 - RNA, 22 nt, Human
aaaugggagucacacagguuua

SEQ ID NO: 60792 - RNA, 22 nt, Human
aaagaugaaguucagcgaagaa

SEQ ID NO: 60793 - RNA, 22 nt, Human
aaagaucaguuaacgccaucaa

SEQ ID NO: 60794 - RNA, 20 nt, Human
aaagauacuuuuuguaaugg

SEQ ID NO: 60795 - RNA, 23 nt, Human
aaagacuagaagccguggcugca

SEQ ID NO: 60796 - RNA, 23 nt, Human
aaagaggugaauccaggacaagc

SEQ ID NO: 60797 - RNA, 22 nt, Human
aaagaccuucacuuucuggcug

SEQ ID NO: 60798 - RNA, 22 nt, Human
aaauguguagaggggagagccg

SEQ ID NO: 60799 - RNA, 20 nt, Human
aaauucgacuaaaaccagaa

SEQ ID NO: 60800 - RNA, 22 nt, Human
aaauucuuccaggaggaaauac

SEQ ID NO: 60801 - RNA, 22 nt, Human
aaauggauaaucaagauaauca

SEQ ID NO: 60802 - RNA, 22 nt, Human
aaaugucugagacuucugaacu

SEQ ID NO: 60803 - RNA, 22 nt, Human
aaauguuugguggauaaaagga

SEQ ID NO: 60804 - RNA, 22 nt, Human
aaauguuucauucuauuuuuag

SEQ ID NO: 60805 - RNA, 22 nt, Human
aaauuuuguugaaaaauauuuu

SEQ ID NO: 60806 - RNA, 22 nt, Human
aaauuugggagaaaugggucau

SEQ ID NO: 60807 - RNA, 21 nt, Human
aaauuucauauggccaaccua

SEQ ID NO: 60808 - RNA, 22 nt, Human
aacaaaacauuuuacgaauaua

SEQ ID NO: 60809 - RNA, 21 nt, Human
aacaaaagggaagaacagcug

SEQ ID NO: 60810 - RNA, 22 nt, Human
aacagguucaucuuggaagcag

SEQ ID NO: 60811 - RNA, 21 nt, Human
aacagguuuccuaccacuugc

SEQ ID NO: 60812 - RNA, 22 nt, Human
aacagaaaucauuuagggcucu

SEQ ID NO: 60813 - RNA, 22 nt, Human
aacacugaaaugucuuaagauu

SEQ ID NO: 60814 - RNA, 22 nt, Human
aacagagauucuucccuucuuu

SEQ ID NO: 60815 - RNA, 22 nt, Human
aacagaauaucaaaagauuaug

SEQ ID NO: 60816 - RNA, 22 nt, Human
aacccaagacaagcacuggcca

SEQ ID NO: 60817 - RNA, 22 nt, Human
aacaguaugugagauuuacaca

SEQ ID NO: 60818 - RNA, 20 nt, Human
aaccuauuguaauauucuaa

SEQ ID NO: 60819 - RNA, 22 nt, Human
aacauuguuuaaguuaaauugu

SEQ ID NO: 60820 - RNA, 22 nt, Human
aacauuuccggccuuuuguucu

SEQ ID NO: 60821 - RNA, 22 nt, Human
aaccaaaguugguauuuaauaa

SEQ ID NO: 60822 - RNA, 22 nt, Human
aaccucuuuaaaagggauauug

SEQ ID NO: 60823 - RNA, 22 nt, Human
aaccucuuugugaaugucauga

SEQ ID NO: 60824 - RNA, 22 nt, Human
aaccugaggguagacaaguuca

SEQ ID NO: 60825 - RNA, 22 nt, Human
aacccuaguugauagcuugggu

SEQ ID NO: 60826 - RNA, 22 nt, Human
aacgcugugcacuggguccagg

SEQ ID NO: 60827 - RNA, 22 nt, Human
aacgcagagaguaaugcugaac

SEQ ID NO: 60828 - RNA, 22 nt, Human
aacgaugauaaauuguucucug

SEQ ID NO: 60829 - RNA, 22 nt, Human
aacccacuaugauuguccucau

SEQ ID NO: 60830 - RNA, 22 nt, Human
aacgauuugaguuaguuuuuag

SEQ ID NO: 60831 - RNA, 22 nt, Human
aaccuuucucccugcacacugg

SEQ ID NO: 60832 - RNA, 21 nt, Human
aacuauuaauaccauuagcaa

SEQ ID NO: 60833 - RNA, 22 nt, Human
aacucccucaacuuccuucucu

SEQ ID NO: 60834 - RNA, 22 nt, Human
aaccuuauuguguaucaccaua

SEQ ID NO: 60835 - RNA, 22 nt, Human
aacgugcuuuacaaaugaccuu

SEQ ID NO: 60836 - RNA, 23 nt, Human
aacucuggcuagcauagaauaga

SEQ ID NO: 60837 - RNA, 22 nt, Human
aacugagugcuacauugugauu

SEQ ID NO: 60838 - RNA, 23 nt, Human
aacugcaagguugcugggaagua

SEQ ID NO: 60839 - RNA, 22 nt, Human
aacuucuggaaacuuccaugug

SEQ ID NO: 60840 - RNA, 22 nt, Human
aacuugaagacaccccacauuc

SEQ ID NO: 60841 - RNA, 22 nt, Human
aagaaaagcaucuuuguaguag

SEQ ID NO: 60842 - RNA, 22 nt, Human
aacuuaaacaagcucccaaguu

SEQ ID NO: 60843 - RNA, 22 nt, Human
aacugguaauuuaguauuacug

SEQ ID NO: 60844 - RNA, 21 nt, Human
aacuuucccaauccagauuug

SEQ ID NO: 60845 - RNA, 22 nt, Human
aacuuucugaaaagcuugauca

SEQ ID NO: 60846 - RNA, 22 nt, Human
aacuuucuuugcaucuaaguuu

SEQ ID NO: 60847 - RNA, 20 nt, Human
aacuuugagugcaugacuuu

SEQ ID NO: 60848 - RNA, 22 nt, Human
aacuuucagaauccuaugcauu

SEQ ID NO: 60849 - RNA, 22 nt, Human
aacuuuuaugaaggaaaucaua

SEQ ID NO: 60850 - RNA, 22 nt, Human
aacuuuuucuuaggggaaagca

SEQ ID NO: 60851 - RNA, 22 nt, Human
aagaacaacugcuuuaaaagca

SEQ ID NO: 60852 - RNA, 19 nt, Human
aagaacaguucuaauuuca

SEQ ID NO: 60853 - RNA, 22 nt, Human
aacuuauacccagggcagaaau

SEQ ID NO: 60854 - RNA, 22 nt, Human
aagaaguccuugaggcgcaccc

SEQ ID NO: 60855 - RNA, 22 nt, Human
aagaagcuacugucacuaucag

SEQ ID NO: 60856 - RNA, 22 nt, Human
aagaaggaaggcaagagauggg

SEQ ID NO: 60857 - RNA, 22 nt, Human
aagaacaugggugugggcauuc

SEQ ID NO: 60858 - RNA, 22 nt, Human
aagaagagaauauauuuacguc

SEQ ID NO: 60859 - RNA, 22 nt, Human
aagagaaaugcuuuaacuuuau

SEQ ID NO: 60860 - RNA, 22 nt, Human
aagagaggaaagggugugaggu

SEQ ID NO: 60861 - RNA, 22 nt, Human
aagagaggcccaaguggcuggc

SEQ ID NO: 60862 - RNA, 22 nt, Human
aagaaaagaaacauggguaugc

SEQ ID NO: 60863 - RNA, 22 nt, Human
aagagcuuguuaugcugcucuu

SEQ ID NO: 60864 - RNA, 22 nt, Human
aagaggaggacgguucccagaa

SEQ ID NO: 60865 - RNA, 22 nt, Human
aagaggacagucaaauggccgg

SEQ ID NO: 60866 - RNA, 22 nt, Human
aagagggguggucugugaggau

SEQ ID NO: 60867 - RNA, 22 nt, Human
aagaguggagcuggaaaguggg

SEQ ID NO: 60868 - RNA, 22 nt, Human
aagauuuaccacuuuauucaag

SEQ ID NO: 60869 - RNA, 22 nt, Human
aagaggaauaauaaaaauugca

SEQ ID NO: 60870 - RNA, 22 nt, Human
aagaggaggcuggaauccuaaa

SEQ ID NO: 60871 - RNA, 22 nt, Human
aagaggauuuuaguuugccaga

SEQ ID NO: 60872 - RNA, 22 nt, Human
aagcagaaaaacugagcuccaa

SEQ ID NO: 60873 - RNA, 22 nt, Human
aagauguuguagauuagugaga

SEQ ID NO: 60874 - RNA, 22 nt, Human
aagcacagggacucaggaccgg

SEQ ID NO: 60875 - RNA, 22 nt, Human
aagaggcagcuugguaggcauc

SEQ ID NO: 60876 - RNA, 21 nt, Human
aagcagcugcagaauuucagu

SEQ ID NO: 60877 - RNA, 22 nt, Human
aagcagaacuguuuuguuuucu

SEQ ID NO: 60878 - RNA, 22 nt, Human
aagcccucagagccucuuugac

SEQ ID NO: 60879 - RNA, 22 nt, Human
aagcauuuuagauaaagcauca

SEQ ID NO: 60880 - RNA, 22 nt, Human
aagauuugaaaguggugcauuu

SEQ ID NO: 60881 - RNA, 22 nt, Human
aagcaaaagguuacacuucugg

SEQ ID NO: 60882 - RNA, 22 nt, Human
aagauucaguugguuuuggaaa

SEQ ID NO: 60883 - RNA, 22 nt, Human
aagcaaaaucgcaucuggggcc

SEQ ID NO: 60884 - RNA, 22 nt, Human
aagcauaucaaguuuuaugugc

SEQ ID NO: 60885 - RNA, 22 nt, Human
aagcaggaaaugaaaugcuugc

SEQ ID NO: 60886 - RNA, 22 nt, Human
aagccuguugacagcugucagu

SEQ ID NO: 60887 - RNA, 22 nt, Human
aagccucaugccagauccaggu

SEQ ID NO: 60888 - RNA, 20 nt, Human
aaggaggcuuaaaguuagaa

SEQ ID NO: 60889 - RNA, 22 nt, Human
aaggauguuuaaacuacuuucc

SEQ ID NO: 60890 - RNA, 22 nt, Human
aaggauuuccaggccugcgccu

SEQ ID NO: 60891 - RNA, 22 nt, Human
aaggcagagggaaaacgggaau

SEQ ID NO: 60892 - RNA, 22 nt, Human
aaggccuaggaguugacauggg

SEQ ID NO: 60893 - RNA, 22 nt, Human
aaggcuguuugagcacuggagc

SEQ ID NO: 60894 - RNA, 19 nt, Human
aaggcuuucugagugaaaa

SEQ ID NO: 60895 - RNA, 22 nt, Human
aaggcuuugugcugaguugucg

SEQ ID NO: 60896 - RNA, 22 nt, Human
aaggcgauuuaaagauguuagg

SEQ ID NO: 60897 - RNA, 22 nt, Human
aagggcuucucgccugugugca

SEQ ID NO: 60898 - RNA, 23 nt, Human
aagggcgauuaacauucgcucga

SEQ ID NO: 60899 - RNA, 22 nt, Human
aagggaggguaggaagagggag

SEQ ID NO: 60900 - RNA, 22 nt, Human
aagggagaguauccagaaacag

SEQ ID NO: 60901 - RNA, 22 nt, Human
aagggaaggaugggcauuuaca

SEQ ID NO: 60902 - RNA, 22 nt, Human
aagggaaguuugacacuuuuua

SEQ ID NO: 60903 - RNA, 22 nt, Human
aagggaaacagccaggcccugu

SEQ ID NO: 60904 - RNA, 22 nt, Human
aagggaaaagcugaaugagaug

SEQ ID NO: 60905 - RNA, 22 nt, Human
aagggaauagagcagcaaaaau

SEQ ID NO: 60906 - RNA, 22 nt, Human
aagggggacaagcauuggcuua

SEQ ID NO: 60907 - RNA, 22 nt, Human
aagguaaugcaucaggcaggga

SEQ ID NO: 60908 - RNA, 21 nt, Human
aaguaaauuuuuacuuaggcc

SEQ ID NO: 60909 - RNA, 22 nt, Human
aaguaauuugugaaggcauguu

SEQ ID NO: 60910 - RNA, 22 nt, Human
aaggucuucgaaccuuauguua

SEQ ID NO: 60911 - RNA, 22 nt, Human
aagguuuuguaugaaaucucug

SEQ ID NO: 60912 - RNA, 22 nt, Human
aagguuuuguuuucgguuuuuu

SEQ ID NO: 60913 - RNA, 22 nt, Human
aagugugugugcgcaugugcau

SEQ ID NO: 60914 - RNA, 22 nt, Human
aaguucuuauguucugaugugc

SEQ ID NO: 60915 - RNA, 22 nt, Human
aaguagaaaaccgcacuggacu

SEQ ID NO: 60916 - RNA, 22 nt, Human
aaguauuccccaaguauucugg

SEQ ID NO: 60917 - RNA, 22 nt, Human
aagucauuaucucuucuaaucu

SEQ ID NO: 60918 - RNA, 22 nt, Human
aaguccaaaacauuucucugcu

SEQ ID NO: 60919 - RNA, 23 nt, Human
aaguggugacugugcuacugaga

SEQ ID NO: 60920 - RNA, 22 nt, Human
aauaucuagccuuuagcagcuu

SEQ ID NO: 60921 - RNA, 22 nt, Human
aauauagagcagaucuggcucu

SEQ ID NO: 60922 - RNA, 22 nt, Human
aauaugaugccaaauugcuaca

SEQ ID NO: 60923 - RNA, 22 nt, Human
aauagcuuuuuguuugguguau

SEQ ID NO: 60924 - RNA, 22 nt, Human
aauaggaaggaaauguuuaccu

SEQ ID NO: 60925 - RNA, 22 nt, Human
aauaagagaauaaaaucuguua

SEQ ID NO: 60926 - RNA, 23 nt, Human
aaguugucauguaaaaugggcua

SEQ ID NO: 60927 - RNA, 16 nt, Human
aaguuuuaucuucuca

SEQ ID NO: 60928 - RNA, 22 nt, Human
aaguugacuguuuuacuuaugu

SEQ ID NO: 60929 - RNA, 22 nt, Human
aauacagauggcaugugaagau

SEQ ID NO: 60930 - RNA, 22 nt, Human
aauaauuuuuuugugauuaugu

SEQ ID NO: 60931 - RNA, 22 nt, Human
aaucucuugggaagagugagug

SEQ ID NO: 60932 - RNA, 22 nt, Human
aaucaaauuucuugugguuguu

SEQ ID NO: 60933 - RNA, 22 nt, Human
aaucaauuauccauuuguuagu

SEQ ID NO: 60934 - RNA, 23 nt, Human
aaucacuggauuugagcaugagg

SEQ ID NO: 60935 - RNA, 22 nt, Human
aaucugaccguggagaucucca

SEQ ID NO: 60936 - RNA, 22 nt, Human
aaucuuguucaacauuaucugu

SEQ ID NO: 60937 - RNA, 22 nt, Human
aaucugugugugagaaauggca

SEQ ID NO: 60938 - RNA, 22 nt, Human
aaucugugaggaauaaugaguu

SEQ ID NO: 60939 - RNA, 22 nt, Human
aaucuguugucaggaauccaca

SEQ ID NO: 60940 - RNA, 22 nt, Human
aaucuugggacagggacacuau

SEQ ID NO: 60941 - RNA, 22 nt, Human
aaucuuuuugaaggaggagaga

SEQ ID NO: 60942 - RNA, 22 nt, Human
aaugaacuuucaguucagagag

SEQ ID NO: 60943 - RNA, 22 nt, Human
aaugaauaaauuuuaaagacag

SEQ ID NO: 60944 - RNA, 22 nt, Human
aaugcagaugugucuuuaauuu

SEQ ID NO: 60945 - RNA, 22 nt, Human
aaugaguuuguucuauuauuug

SEQ ID NO: 60946 - RNA, 22 nt, Human
aaugauuuucugcaaacaguga

SEQ ID NO: 60947 - RNA, 22 nt, Human
aaugcauacguguuuguggcaa

SEQ ID NO: 60948 - RNA, 23 nt, Human
aaugaguugggcagcauacaggc

SEQ ID NO: 60949 - RNA, 22 nt, Human
aaugagaauguaagugaagaga

SEQ ID NO: 60950 - RNA, 22 nt, Human
aaugagauaagaaaaccuuugc

SEQ ID NO: 60951 - RNA, 22 nt, Human
aaugagacgagagaacccauuu

SEQ ID NO: 60952 - RNA, 22 nt, Human
aaugaguucaucugaauucugg

SEQ ID NO: 60953 - RNA, 22 nt, Human
aaugaaaaucugucaguucaag

SEQ ID NO: 60954 - RNA, 22 nt, Human
aaugguggaugucuguucugac

SEQ ID NO: 60955 - RNA, 22 nt, Human
aaugguaauauuucauaguugu

SEQ ID NO: 60956 - RNA, 22 nt, Human
aaugguagaguauuuuaauccu

SEQ ID NO: 60957 - RNA, 22 nt, Human
aaugggauuaagaaagaucuug

SEQ ID NO: 60958 - RNA, 22 nt, Human
aauggcuagcauguaaaauauc

SEQ ID NO: 60959 - RNA, 22 nt, Human
aaugggauaggucuucaggaau

SEQ ID NO: 60960 - RNA, 22 nt, Human
aauggagugguucuugcccucu

SEQ ID NO: 60961 - RNA, 22 nt, Human
aauguaaauaauuguaaaauuu

SEQ ID NO: 60962 - RNA, 22 nt, Human
aauggagaaaagacaauguuga

SEQ ID NO: 60963 - RNA, 22 nt, Human
aaugcgcagaguggugugugca

SEQ ID NO: 60964 - RNA, 22 nt, Human
aaugcugaaugcauguuuccau

SEQ ID NO: 60965 - RNA, 22 nt, Human
aauggaaaggagccugacuaua

SEQ ID NO: 60966 - RNA, 22 nt, Human
aauuauugucuuuuuuaaaagc

SEQ ID NO: 60967 - RNA, 22 nt, Human
aauucaggacaaauguuuucaa

SEQ ID NO: 60968 - RNA, 22 nt, Human
aauucaacagucaguuaucuca

SEQ ID NO: 60969 - RNA, 22 nt, Human
aauuaaggccuuuaaaugucuu

SEQ ID NO: 60970 - RNA, 22 nt, Human
aauuagaagcuguuagcaaaau

SEQ ID NO: 60971 - RNA, 22 nt, Human
aauuacuuuaggaaaacuccuc

SEQ ID NO: 60972 - RNA, 22 nt, Human
aauuauucucucaacugagaug

SEQ ID NO: 60973 - RNA, 22 nt, Human
aauuauucuugccuagguuuaa

SEQ ID NO: 60974 - RNA, 23 nt, Human
aauguugaggguggguuuuuaac

SEQ ID NO: 60975 - RNA, 22 nt, Human
aauguuguaaauauucuuugag

SEQ ID NO: 60976 - RNA, 22 nt, Human
aauguauuuuuaggcagaauau

SEQ ID NO: 60977 - RNA, 22 nt, Human
aauguucucuaaucuuucucuu

SEQ ID NO: 60978 - RNA, 22 nt, Human
aauguuugaacuuugcauauuu

SEQ ID NO: 60979 - RNA, 22 nt, Human
aauucgcugcauuccaucuagg

SEQ ID NO: 60980 - RNA, 22 nt, Human
aauucuaaugaguucuuaucua

SEQ ID NO: 60981 - RNA, 22 nt, Human
aauugccaagaauuagugauac

SEQ ID NO: 60982 - RNA, 22 nt, Human
acaugaggaacucaggagucac

SEQ ID NO: 60983 - RNA, 22 nt, Human
aauugcauucauuuguauauuu

SEQ ID NO: 60984 - RNA, 22 nt, Human
acauggaccucagauccuggcc

SEQ ID NO: 60985 - RNA, 21 nt, Human
acauguacacauguaugcaca

SEQ ID NO: 60986 - RNA, 22 nt, Human
acauaaaccccccuuccccagg

SEQ ID NO: 60987 - RNA, 22 nt, Human
acauggaauuucagaagagcau

SEQ ID NO: 60988 - RNA, 22 nt, Human
acauggacugguccauuaugac

SEQ ID NO: 60989 - RNA, 22 nt, Human
acauguuuacaaaccucaagcc

SEQ ID NO: 60990 - RNA, 22 nt, Human
acauuagaugacucuuucuuuc

SEQ ID NO: 60991 - RNA, 22 nt, Human
acauuauuguguagugugggca

SEQ ID NO: 60992 - RNA, 22 nt, Human
acauucucuuuuagaaagcugu

SEQ ID NO: 60993 - RNA, 22 nt, Human
acauugguauuaguguggcuga

SEQ ID NO: 60994 - RNA, 22 nt, Human
acauugcagcuccuaccuuguc

SEQ ID NO: 60995 - RNA, 22 nt, Human
acaugcacagcaagggugagag

SEQ ID NO: 60996 - RNA, 22 nt, Human
acauuguuauuccucaggaguu

SEQ ID NO: 60997 - RNA, 22 nt, Human
acauuuugggagaaaguuguua

SEQ ID NO: 60998 - RNA, 22 nt, Human
acauuuuaccaucuguggauga

SEQ ID NO: 60999 - RNA, 23 nt, Human
acauuacacgcaguaauugcccc

SEQ ID NO: 61000 - RNA, 22 nt, Human
accaauguucaaccuugacugc

SEQ ID NO: 61001 - RNA, 22 nt, Human
acauguggaggaggcgagggua

SEQ ID NO: 61002 - RNA, 22 nt, Human
accaauguuuuauagaaaugcc

SEQ ID NO: 61003 - RNA, 22 nt, Human
accagcgcguuuucaguuucau

SEQ ID NO: 61004 - RNA, 22 nt, Human
acauuguuuuugugacuucuau

SEQ ID NO: 61005 - RNA, 22 nt, Human
acauuuguuucucuagaguagg

SEQ ID NO: 61006 - RNA, 22 nt, Human
acauuuuaaaaacaguaccugg

SEQ ID NO: 61007 - RNA, 22 nt, Human
acauuucuccuacuuguuauuu

SEQ ID NO: 61008 - RNA, 17 nt, Human
accaggggcagcacugc

SEQ ID NO: 61009 - RNA, 22 nt, Human
acauuuuguuuauggaaaagau

SEQ ID NO: 61010 - RNA, 20 nt, Human
acccaaagcucagcgugucc

SEQ ID NO: 61011 - RNA, 22 nt, Human
acauuuuuggguugaugucuga

SEQ ID NO: 61012 - RNA, 22 nt, Human
accaacuuuccaaagugccugg

SEQ ID NO: 61013 - RNA, 22 nt, Human
acccccuuucuugaccucaugu

SEQ ID NO: 61014 - RNA, 22 nt, Human
acccagauauccaggccucugc

SEQ ID NO: 61015 - RNA, 22 nt, Human
accauaugaaguugcccauauu

SEQ ID NO: 61016 - RNA, 22 nt, Human
acccuucugugaccugccuguc

SEQ ID NO: 61017 - RNA, 22 nt, Human
accauuuaucagaagagacacc

SEQ ID NO: 61018 - RNA, 22 nt, Human
accccuauugcuugugauuaug

SEQ ID NO: 61019 - RNA, 22 nt, Human
acccaucauuagucuuucagga

SEQ ID NO: 61020 - RNA, 22 nt, Human
accuauuuauacaacugcacca

SEQ ID NO: 61021 - RNA, 22 nt, Human
acccuuucgagauuucugccuu

SEQ ID NO: 61022 - RNA, 22 nt, Human
accucaguucaagggaguuuca

SEQ ID NO: 61023 - RNA, 22 nt, Human
accucuuucuauggauuuuuug

SEQ ID NO: 61024 - RNA, 22 nt, Human
accugauuuuauggauuuugag

SEQ ID NO: 61025 - RNA, 22 nt, Human
accugagauuuuuacucaguaa

SEQ ID NO: 61026 - RNA, 22 nt, Human
accucuuuuugaauauagcauu

SEQ ID NO: 61027 - RNA, 22 nt, Human
accuccuaccuaacuuuugcuu

SEQ ID NO: 61028 - RNA, 22 nt, Human
accuuggauauucuuacucggu

SEQ ID NO: 61029 - RNA, 19 nt, Human
accuguucaaccucgugcu

SEQ ID NO: 61030 - RNA, 22 nt, Human
accuggaccugccaccuaugag

SEQ ID NO: 61031 - RNA, 22 nt, Human
accuucguuuaguacucauuuu

SEQ ID NO: 61032 - RNA, 20 nt, Human
accuucuuugguagacggaa

SEQ ID NO: 61033 - RNA, 22 nt, Human
accuuagugauuuaaaaucaga

SEQ ID NO: 61034 - RNA, 20 nt, Human
acgaacauauugcaggguuu

SEQ ID NO: 61035 - RNA, 22 nt, Human
acgaggauuuccuuagaugaaa

SEQ ID NO: 61036 - RNA, 22 nt, Human
acuaaacauaucacugcuuuac

SEQ ID NO: 61037 - RNA, 22 nt, Human
acuaagcugugugguucacuca

SEQ ID NO: 61038 - RNA, 22 nt, Human
acugaggaagccugucaucauc

SEQ ID NO: 61039 - RNA, 22 nt, Human
acugcacuccagcccgagcaac

SEQ ID NO: 61040 - RNA, 22 nt, Human
acugauuuuauauauuaccccg

SEQ ID NO: 61041 - RNA, 22 nt, Human
acuggggauugguucuucaaca

SEQ ID NO: 61042 - RNA, 19 nt, Human
acugggaugggcagugcca

SEQ ID NO: 61043 - RNA, 22 nt, Human
acuggcuuggaaauggguauuu

SEQ ID NO: 61044 - RNA, 22 nt, Human
acuggugcucuggccaccgcug

SEQ ID NO: 61045 - RNA, 22 nt, Human
acugucaggauugagucucugg

SEQ ID NO: 61046 - RNA, 22 nt, Human
acugucauuaaugaauguaaua

SEQ ID NO: 61047 - RNA, 15 nt, Human
acugggaaggaguau

SEQ ID NO: 61048 - RNA, 22 nt, Human
acugugcaugaaccgaaacaaa

SEQ ID NO: 61049 - RNA, 22 nt, Human
acuguugugaauaaugaaaugc

SEQ ID NO: 61050 - RNA, 22 nt, Human
acugucuuguuguaugugagcu

SEQ ID NO: 61051 - RNA, 22 nt, Human
acugugauguaaagaaauaggc

SEQ ID NO: 61052 - RNA, 22 nt, Human
acuuuuccuggguagcuccugg

SEQ ID NO: 61053 - RNA, 22 nt, Human
acuuuuuugccaucccuccagc

SEQ ID NO: 61054 - RNA, 22 nt, Human
acuuuuaauaguagauuuuuaa

SEQ ID NO: 61055 - RNA, 22 nt, Human
acuugggaaaugaaaauacaga

SEQ ID NO: 61056 - RNA, 22 nt, Human
acuuuauacuagugauaguuug

SEQ ID NO: 61057 - RNA, 20 nt, Human
acuuucacaugaacauuuaa

SEQ ID NO: 61058 - RNA, 22 nt, Human
agaaaagagacaauguuuuugg

SEQ ID NO: 61059 - RNA, 22 nt, Human
acuuuugaguuacauaccugaa

SEQ ID NO: 61060 - RNA, 22 nt, Human
agaaaagaggcuuucuaagcau

SEQ ID NO: 61061 - RNA, 22 nt, Human
agaacaggaggaagccagcucc

SEQ ID NO: 61062 - RNA, 22 nt, Human
acuuuuaaggggccuugauuua

SEQ ID NO: 61063 - RNA, 22 nt, Human
acuuugucuugaucaaaggugu

SEQ ID NO: 61064 - RNA, 22 nt, Human
agaagcaauuggaaaguacagg

SEQ ID NO: 61065 - RNA, 22 nt, Human
agaagcagaaggaagcagggcc

SEQ ID NO: 61066 - RNA, 22 nt, Human
agaagaucccugugguuacgac

SEQ ID NO: 61067 - RNA, 19 nt, Human
agaaacaacauucuggaga

SEQ ID NO: 61068 - RNA, 22 nt, Human
agaaagcacccugcacuuucug

SEQ ID NO: 61069 - RNA, 20 nt, Human
agaaaggaguaaagaagaga

SEQ ID NO: 61070 - RNA, 22 nt, Human
agaaggcagaaaagcuuuacaa

SEQ ID NO: 61071 - RNA, 22 nt, Human
agaaccauccugguuccagcuu

SEQ ID NO: 61072 - RNA, 22 nt, Human
agaauccucuagggauggcagg

SEQ ID NO: 61073 - RNA, 22 nt, Human
agaaccaauacuacagcaagua

SEQ ID NO: 61074 - RNA, 20 nt, Human
agaaggagagaugaggcaaa

SEQ ID NO: 61075 - RNA, 22 nt, Human
agaacaagaaacccgaaaagug

SEQ ID NO: 61076 - RNA, 22 nt, Human
agaaugucaagucaagaacaau

SEQ ID NO: 61077 - RNA, 22 nt, Human
acuuggucguggugcagcaugg

SEQ ID NO: 61078 - RNA, 22 nt, Human
agacagaacauaauuaguacug

SEQ ID NO: 61079 - RNA, 22 nt, Human
agacauauuggcuugcuuuaau

SEQ ID NO: 61080 - RNA, 22 nt, Human
agacuggagucuccuuuggagc

SEQ ID NO: 61081 - RNA, 22 nt, Human
agacauuuggugugaagggagg

SEQ ID NO: 61082 - RNA, 22 nt, Human
agacccuugcagucugguuguc

SEQ ID NO: 61083 - RNA, 22 nt, Human
agacugugagaagauggcugcg

SEQ ID NO: 61084 - RNA, 22 nt, Human
agacuucucuuggcuauauuau

SEQ ID NO: 61085 - RNA, 22 nt, Human
agacuugguaacuagugaagaa

SEQ ID NO: 61086 - RNA, 22 nt, Human
agacuaauaucccauuucugac

SEQ ID NO: 61087 - RNA, 22 nt, Human
agacuuugaaugaugacagcgu

SEQ ID NO: 61088 - RNA, 22 nt, Human
agagaacaggcagcuggugccg

SEQ ID NO: 61089 - RNA, 22 nt, Human
agacuagccaaaggacuuuaua

SEQ ID NO: 61090 - RNA, 21 nt, Human
agacuucuacuaucuuaugac

SEQ ID NO: 61091 - RNA, 22 nt, Human
agacuguuccgucagacucagu

SEQ ID NO: 61092 - RNA, 22 nt, Human
agacuguuuucccaucucuugg

SEQ ID NO: 61093 - RNA, 22 nt, Human
agagaauuugggaauauaaauc

SEQ ID NO: 61094 - RNA, 21 nt, Human
agagaccuaagcugagauucc

SEQ ID NO: 61095 - RNA, 22 nt, Human
agagaccugaaugaguugaaca

SEQ ID NO: 61096 - RNA, 22 nt, Human
agagacuguaaugagagguaca

SEQ ID NO: 61097 - RNA, 22 nt, Human
agacucuaguggaggugcuagg

SEQ ID NO: 61098 - RNA, 22 nt, Human
agagaagaauccccugguggag

SEQ ID NO: 61099 - RNA, 16 nt, Human
agagagaugguggugg

SEQ ID NO: 61100 - RNA, 22 nt, Human
agagacauagcacaguuuuucg

SEQ ID NO: 61101 - RNA, 22 nt, Human
agagacugauggaucaccaaau

SEQ ID NO: 61102 - RNA, 22 nt, Human
agagacaagggaccucuggaga

SEQ ID NO: 61103 - RNA, 22 nt, Human
agagcagcaaucuuugaaauua

SEQ ID NO: 61104 - RNA, 22 nt, Human
agagcauagggcauuaggaagg

SEQ ID NO: 61105 - RNA, 22 nt, Human
agagccauuuaaauaguuguca

SEQ ID NO: 61106 - RNA, 22 nt, Human
agagccuaguauggacucuuag

SEQ ID NO: 61107 - RNA, 22 nt, Human
agagauggugaugaggaaaaau

SEQ ID NO: 61108 - RNA, 22 nt, Human
agagauuuacaacuugggcuuu

SEQ ID NO: 61109 - RNA, 22 nt, Human
agagaacauuuucaggguuuca

SEQ ID NO: 61110 - RNA, 22 nt, Human
agagauuagagaagaugauaaa

SEQ ID NO: 61111 - RNA, 20 nt, Human
agagaacaguuuggucacag

SEQ ID NO: 61112 - RNA, 22 nt, Human
agagaaauguacuagucuaacu

SEQ ID NO: 61113 - RNA, 22 nt, Human
agagaaacauuaauugaugagg

SEQ ID NO: 61114 - RNA, 22 nt, Human
agacuuuggcagggccaguggu

SEQ ID NO: 61115 - RNA, 22 nt, Human
agagaguacuuucaucagggaa

SEQ ID NO: 61116 - RNA, 22 nt, Human
agagaguagaagggacaguauu

SEQ ID NO: 61117 - RNA, 22 nt, Human
agacuucucuaacuugaggacc

SEQ ID NO: 61118 - RNA, 22 nt, Human
agagcuuuggaguaaguuuuga

SEQ ID NO: 61119 - RNA, 21 nt, Human
agaggacuuuuuugauguuuu

SEQ ID NO: 61120 - RNA, 22 nt, Human
agaggaguagcugagcucugca

SEQ ID NO: 61121 - RNA, 22 nt, Human
agaggcacccaguuaagcugca

SEQ ID NO: 61122 - RNA, 22 nt, Human
agagauugagcucagaagaccu

SEQ ID NO: 61123 - RNA, 22 nt, Human
agagcuccaggguuuuguagug

SEQ ID NO: 61124 - RNA, 22 nt, Human
agagcagcuuuucggaaccacu

SEQ ID NO: 61125 - RNA, 22 nt, Human
agaggaauuauugaguuagauu

SEQ ID NO: 61126 - RNA, 22 nt, Human
agaggagaauguaaauuuguca

SEQ ID NO: 61127 - RNA, 22 nt, Human
agagggagagauuggcaaucag

SEQ ID NO: 61128 - RNA, 22 nt, Human
agagggagccugcacagcuuuc

SEQ ID NO: 61129 - RNA, 22 nt, Human
agaggggaaggaugugauguga

SEQ ID NO: 61130 - RNA, 22 nt, Human
agagggagcuccaagaucaagg

SEQ ID NO: 61131 - RNA, 22 nt, Human
agaggugcuuaugcucaugguu

SEQ ID NO: 61132 - RNA, 22 nt, Human
agaguaauguggaguuugugcu

SEQ ID NO: 61133 - RNA, 22 nt, Human
agaguguaauuaguauuuauau

SEQ ID NO: 61134 - RNA, 22 nt, Human
agaguuaguggccucagcaggg

SEQ ID NO: 61135 - RNA, 22 nt, Human
agauaaucacaaucuagacuuu

SEQ ID NO: 61136 - RNA, 22 nt, Human
agcagcaggcugggaugagucu

SEQ ID NO: 61137 - RNA, 22 nt, Human
agauaggcuuagccaagcuuuc

SEQ ID NO: 61138 - RNA, 22 nt, Human
agauagaaggauugugacacau

SEQ ID NO: 61139 - RNA, 22 nt, Human
agauacaaaagauaagauuuag

SEQ ID NO: 61140 - RNA, 22 nt, Human
agauacuaagccucaagagacg

SEQ ID NO: 61141 - RNA, 22 nt, Human
agcaggucagugguaaucaaaa

SEQ ID NO: 61142 - RNA, 18 nt, Human
agcaguugucucucucca

SEQ ID NO: 61143 - RNA, 22 nt, Human
agcaguucucugucuagcuaga

SEQ ID NO: 61144 - RNA, 22 nt, Human
agcaggaggguuuuguagaguc

SEQ ID NO: 61145 - RNA, 22 nt, Human
agcagcugagccccagcuguga

SEQ ID NO: 61146 - RNA, 21 nt, Human
agcaucugaggcaguuuccua

SEQ ID NO: 61147 - RNA, 22 nt, Human
agcaucuaucuucaaugugugu

SEQ ID NO: 61148 - RNA, 22 nt, Human
agcaggaggagagccuggcggu

SEQ ID NO: 61149 - RNA, 22 nt, Human
agcauuuuaaaacuaguuacca

SEQ ID NO: 61150 - RNA, 22 nt, Human
agcauucuguggucuucuaugg

SEQ ID NO: 61151 - RNA, 22 nt, Human
agcagguucaagggcaaagcug

SEQ ID NO: 61152 - RNA, 22 nt, Human
agcagucagaucguggggaaaa

SEQ ID NO: 61153 - RNA, 22 nt, Human
agcaguugcuuuguauauuaaa

SEQ ID NO: 61154 - RNA, 19 nt, Human
agcagugaaaucuggugag

SEQ ID NO: 61155 - RNA, 22 nt, Human
agcaugaauugccauuuauuaa

SEQ ID NO: 61156 - RNA, 19 nt, Human
agcaucuccacagaaaaag

SEQ ID NO: 61157 - RNA, 22 nt, Human
agcaguuagauccugguuagcg

SEQ ID NO: 61158 - RNA, 22 nt, Human
agcaguuuauccucauaaugga

SEQ ID NO: 61159 - RNA, 22 nt, Human
agcauuucuacugugucagaaa

SEQ ID NO: 61160 - RNA, 22 nt, Human
agcauucccuuugcagugucau

SEQ ID NO: 61161 - RNA, 22 nt, Human
agcaugucuaacucuucagggu

SEQ ID NO: 61162 - RNA, 22 nt, Human
agcccuauacuuagauuuauuc

SEQ ID NO: 61163 - RNA, 22 nt, Human
agccccuucuuuggggagcuga

SEQ ID NO: 61164 - RNA, 22 nt, Human
agccuucccuuucaacaauuug

SEQ ID NO: 61165 - RNA, 22 nt, Human
agccuuucugcgcacucuuccg

SEQ ID NO: 61166 - RNA, 22 nt, Human
agcgagccugugcacuucuaac

SEQ ID NO: 61167 - RNA, 22 nt, Human
agcggaggaggcggagcaggga

SEQ ID NO: 61168 - RNA, 19 nt, Human
agcggagguuguauauugu

SEQ ID NO: 61169 - RNA, 22 nt, Human
agcggugacauccuucugugcu

SEQ ID NO: 61170 - RNA, 22 nt, Human
agcuaaaaugagguuuuuggau

SEQ ID NO: 61171 - RNA, 22 nt, Human
agcguucuguuccaugcuaaca

SEQ ID NO: 61172 - RNA, 19 nt, Human
agcucaggcccaucguccc

SEQ ID NO: 61173 - RNA, 22 nt, Human
agcguaugaauauuugaagaga

SEQ ID NO: 61174 - RNA, 22 nt, Human
agcuaaauauuuuuccugacac

SEQ ID NO: 61175 - RNA, 22 nt, Human
agcucucaccauagugcuuaaa

SEQ ID NO: 61176 - RNA, 22 nt, Human
agcucuguugcggucacaggag

SEQ ID NO: 61177 - RNA, 22 nt, Human
agcucugugcaggcagaggcau

SEQ ID NO: 61178 - RNA, 22 nt, Human
agcucuucugacucuaggcuca

SEQ ID NO: 61179 - RNA, 22 nt, Human
agcuagugcaguucucaaaugg

SEQ ID NO: 61180 - RNA, 22 nt, Human
agcucuccuacucucuuucuag

SEQ ID NO: 61181 - RNA, 22 nt, Human
agcucuuuggacuuuguuuuau

SEQ ID NO: 61182 - RNA, 22 nt, Human
agcucuuccuccauucuggcca

SEQ ID NO: 61183 - RNA, 22 nt, Human
agcugcugcaaguggugcuaac

SEQ ID NO: 61184 - RNA, 22 nt, Human
agcugcauguauauucuuaaca

SEQ ID NO: 61185 - RNA, 22 nt, Human
agcugcauucguaucauauugu

SEQ ID NO: 61186 - RNA, 22 nt, Human
agcugugaccuucaagagcuac

SEQ ID NO: 61187 - RNA, 22 nt, Human
agcugugaccaguuacgaaauu

SEQ ID NO: 61188 - RNA, 22 nt, Human
agcuugcccuuguaccagccag

SEQ ID NO: 61189 - RNA, 22 nt, Human
agcuugaaccuaaaacaauaau

SEQ ID NO: 61190 - RNA, 19 nt, Human
agcuuauuuacugcaggac

SEQ ID NO: 61191 - RNA, 22 nt, Human
agcuucuucugccuugucccug

SEQ ID NO: 61192 - RNA, 22 nt, Human
agcuuucaagaaauugucacaa

SEQ ID NO: 61193 - RNA, 22 nt, Human
agcuuucuauauaugaguugcu

SEQ ID NO: 61194 - RNA, 22 nt, Human
agcuuugcccaaugaguuaugu

SEQ ID NO: 61195 - RNA, 20 nt, Human
agcuuucaccaguacuucca

SEQ ID NO: 61196 - RNA, 22 nt, Human
agcugcuaagcugcauaacuua

SEQ ID NO: 61197 - RNA, 19 nt, Human
agcugcugauugguggagg

SEQ ID NO: 61198 - RNA, 22 nt, Human
agcugcuuuacuggucggcugg

SEQ ID NO: 61199 - RNA, 22 nt, Human
agcuggauuaaucacagugacu

SEQ ID NO: 61200 - RNA, 22 nt, Human
aggaaaguugagcugucuguag

SEQ ID NO: 61201 - RNA, 22 nt, Human
aggaaaguugcuuguagugcug

SEQ ID NO: 61202 - RNA, 22 nt, Human
aggaaauaagggcacuucagau

SEQ ID NO: 61203 - RNA, 22 nt, Human
agcugugccuauucguggcaag

SEQ ID NO: 61204 - RNA, 20 nt, Human
agcugucccugacacuagga

SEQ ID NO: 61205 - RNA, 22 nt, Human
agcuuugucccaagugcucugg

SEQ ID NO: 61206 - RNA, 22 nt, Human
aggaaaaagaagaaaagaauca

SEQ ID NO: 61207 - RNA, 22 nt, Human
aggaaaaugaaggaagugggaa

SEQ ID NO: 61208 - RNA, 22 nt, Human
aggaagagcuggaccagaggac

SEQ ID NO: 61209 - RNA, 22 nt, Human
aggaaagacgcauuucuguagg

SEQ ID NO: 61210 - RNA, 22 nt, Human
aggaaaauggaccagaguuguu

SEQ ID NO: 61211 - RNA, 19 nt, Human
aggaaggggauaaguaaca

SEQ ID NO: 61212 - RNA, 22 nt, Human
aggacagagggaccagagccca

SEQ ID NO: 61213 - RNA, 20 nt, Human
aggaagauccuuucuuuuaa

SEQ ID NO: 61214 - RNA, 20 nt, Human
aggaaggagaaucugagcaa

SEQ ID NO: 61215 - RNA, 23 nt, Human
aggaagucugacacuacagcguu

SEQ ID NO: 61216 - RNA, 22 nt, Human
aggauagacuucagaaggcaua

SEQ ID NO: 61217 - RNA, 22 nt, Human
aggauaaaugggucauuaggca

SEQ ID NO: 61218 - RNA, 22 nt, Human
aggagacaguuuggacguguag

SEQ ID NO: 61219 - RNA, 22 nt, Human
aggauaaaggucauuauuccca

SEQ ID NO: 61220 - RNA, 22 nt, Human
aggacguaacccaggacagccu

SEQ ID NO: 61221 - RNA, 22 nt, Human
aggacuguauacucuaggugaa

SEQ ID NO: 61222 - RNA, 22 nt, Human
aggagaaagaccagccugccga

SEQ ID NO: 61223 - RNA, 22 nt, Human
aggacauuugcuuuuuuucuuu

SEQ ID NO: 61224 - RNA, 22 nt, Human
aggagcauuuugguggguuuug

SEQ ID NO: 61225 - RNA, 19 nt, Human
aggagacuacuucuugcug

SEQ ID NO: 61226 - RNA, 22 nt, Human
aggagagaacaagaguauccug

SEQ ID NO: 61227 - RNA, 16 nt, Human
aggagcagaaagcagu

SEQ ID NO: 61228 - RNA, 22 nt, Human
aggauggauagcaaggaagccg

SEQ ID NO: 61229 - RNA, 22 nt, Human
aggauggaaguaacuggauaau

SEQ ID NO: 61230 - RNA, 22 nt, Human
aggaugagugaagagguaaauu

SEQ ID NO: 61231 - RNA, 22 nt, Human
aggcccagcaccagcggucuuc

SEQ ID NO: 61232 - RNA, 22 nt, Human
aggaggaggacucgccaggcca

SEQ ID NO: 61233 - RNA, 22 nt, Human
aggagggcggggcuaaaaggga

SEQ ID NO: 61234 - RNA, 17 nt, Human
aggagcuagaaaggaga

SEQ ID NO: 61235 - RNA, 22 nt, Human
aggagguagggugugaaacagc

SEQ ID NO: 61236 - RNA, 22 nt, Human
aggcucucccacauucauuaca

SEQ ID NO: 61237 - RNA, 22 nt, Human
aggcucagcaucugauucauau

SEQ ID NO: 61238 - RNA, 22 nt, Human
aggcugaagcacacucaugcag

SEQ ID NO: 61239 - RNA, 22 nt, Human
agggaagaggaccagagucucu

SEQ ID NO: 61240 - RNA, 22 nt, Human
aggcugucucaccucaggaggg

SEQ ID NO: 61241 - RNA, 22 nt, Human
aggcuguagaucuagacaugua

SEQ ID NO: 61242 - RNA, 22 nt, Human
aggcuucauuacagugguucaa

SEQ ID NO: 61243 - RNA, 22 nt, Human
aggcuuaacuacaauuuuugcc

SEQ ID NO: 61244 - RNA, 21 nt, Human
aggcuuggaucuagacaggcc

SEQ ID NO: 61245 - RNA, 22 nt, Human
agggaggcccagcagacuggcg

SEQ ID NO: 61246 - RNA, 19 nt, Human
agggagagucccaagagaa

SEQ ID NO: 61247 - RNA, 22 nt, Human
agggaaguucuagggagucugg

SEQ ID NO: 61248 - RNA, 22 nt, Human
agggagcagcuagagggggucc

SEQ ID NO: 61249 - RNA, 22 nt, Human
agggaagagaaacaaagauuca

SEQ ID NO: 61250 - RNA, 22 nt, Human
agggaagccggagcgacggggg

SEQ ID NO: 61251 - RNA, 22 nt, Human
agggaggagggacagaaagagg

SEQ ID NO: 61252 - RNA, 20 nt, Human
agggauuugguugguauugu

SEQ ID NO: 61253 - RNA, 22 nt, Human
agggcuucugcugcagagaccu

SEQ ID NO: 61254 - RNA, 22 nt, Human
agggcucuuucauuguuaagaa

SEQ ID NO: 61255 - RNA, 22 nt, Human
aggggagaagcacuccuugccu

SEQ ID NO: 61256 - RNA, 22 nt, Human
aggggagaguuaaugugaaugu

SEQ ID NO: 61257 - RNA, 22 nt, Human
aggggaguuauuagacagggag

SEQ ID NO: 61258 - RNA, 22 nt, Human
aggguuugugaagacuuggcca

SEQ ID NO: 61259 - RNA, 22 nt, Human
aggguuuucauauauuauuagu

SEQ ID NO: 61260 - RNA, 22 nt, Human
agguaguacuuuuuagagugca

SEQ ID NO: 61261 - RNA, 22 nt, Human
agguaguagagaacucugcucu

SEQ ID NO: 61262 - RNA, 22 nt, Human
agguaguggaaccaaggcauca

SEQ ID NO: 61263 - RNA, 22 nt, Human
agguaagaagugagcaaguuua

SEQ ID NO: 61264 - RNA, 22 nt, Human
aggguuacuuauuuuggauagu

SEQ ID NO: 61265 - RNA, 22 nt, Human
aggguuaggaaggagaagagag

SEQ ID NO: 61266 - RNA, 22 nt, Human
aggguuugaauccucuuucuua

SEQ ID NO: 61267 - RNA, 22 nt, Human
aggguuaugcuccuucaucuug

SEQ ID NO: 61268 - RNA, 22 nt, Human
agguaugucccccgagugcagc

SEQ ID NO: 61269 - RNA, 22 nt, Human
agguagaaggaccagaauuuau

SEQ ID NO: 61270 - RNA, 22 nt, Human
agguagggaggguagaugcucu

SEQ ID NO: 61271 - RNA, 22 nt, Human
agguauuuuaugucgugugaug

SEQ ID NO: 61272 - RNA, 22 nt, Human
aguauucaguuagugagcuaag

SEQ ID NO: 61273 - RNA, 23 nt, Human
aguaucuugguguggugcagaga

SEQ ID NO: 61274 - RNA, 22 nt, Human
aguauccauccugcuguuucua

SEQ ID NO: 61275 - RNA, 22 nt, Human
aguaucuauaucaaaaauggcu

SEQ ID NO: 61276 - RNA, 22 nt, Human
aguaugcuggcaccuuugagug

SEQ ID NO: 61277 - RNA, 22 nt, Human
aguaacuuaagcaauuguguau

SEQ ID NO: 61278 - RNA, 22 nt, Human
aguaagaaagaaugauaggccu

SEQ ID NO: 61279 - RNA, 22 nt, Human
aguaagaacugugggugggguu

SEQ ID NO: 61280 - RNA, 22 nt, Human
aguauaagugaugcuaucuucu

SEQ ID NO: 61281 - RNA, 19 nt, Human
aguauauaucuuuaccuca

SEQ ID NO: 61282 - RNA, 22 nt, Human
aguagacuuuuuauuuguuuug

SEQ ID NO: 61283 - RNA, 22 nt, Human
aguaggagugacaagcagguca

SEQ ID NO: 61284 - RNA, 21 nt, Human
aguagucgauucaggagaagu

SEQ ID NO: 61285 - RNA, 22 nt, Human
aggugcuugcauacugcuugac

SEQ ID NO: 61286 - RNA, 22 nt, Human
aggugguauuuaaaauuauuug

SEQ ID NO: 61287 - RNA, 19 nt, Human
aguaaagugguggcauuuu

SEQ ID NO: 61288 - RNA, 22 nt, Human
agguuuuagagagccaggaugu

SEQ ID NO: 61289 - RNA, 22 nt, Human
aggugugcacccggucgcuucc

SEQ ID NO: 61290 - RNA, 22 nt, Human
agguuagaauauuuuuucaaga

SEQ ID NO: 61291 - RNA, 22 nt, Human
agguuagcuguaugucuguaaa

SEQ ID NO: 61292 - RNA, 22 nt, Human
agguuguugagaucaucuggcu

SEQ ID NO: 61293 - RNA, 22 nt, Human
aguauuuuaaaauacauuaucc

SEQ ID NO: 61294 - RNA, 22 nt, Human
aguauuuaguauucuauauuag

SEQ ID NO: 61295 - RNA, 22 nt, Human
aguauggaauuuuuaaugacag

SEQ ID NO: 61296 - RNA, 22 nt, Human
aguauuuucuuuaguuuguuag

SEQ ID NO: 61297 - RNA, 22 nt, Human
agucaaaaaaccuagaaacacc

SEQ ID NO: 61298 - RNA, 22 nt, Human
agucacuguuuaaucuagcuaa

SEQ ID NO: 61299 - RNA, 22 nt, Human
agucagaaggugucagaucuug

SEQ ID NO: 61300 - RNA, 22 nt, Human
aguauaucugcuucuggguccc

SEQ ID NO: 61301 - RNA, 22 nt, Human
agucaccuacagcucaugcuuc

SEQ ID NO: 61302 - RNA, 22 nt, Human
agucacacagccugacaaugga

SEQ ID NO: 61303 - RNA, 22 nt, Human
agucacuguucugucaugucaa

SEQ ID NO: 61304 - RNA, 22 nt, Human
agucaguaugacuuauaguucu

SEQ ID NO: 61305 - RNA, 22 nt, Human
aguccauccagaaaacaaagcu

SEQ ID NO: 61306 - RNA, 22 nt, Human
agucauuguguucaguaaaauc

SEQ ID NO: 61307 - RNA, 22 nt, Human
agucauuugaggcaugauuaug

SEQ ID NO: 61308 - RNA, 18 nt, Human
agucauguuuuagucacu

SEQ ID NO: 61309 - RNA, 22 nt, Human
agucuagcagagauaaagacgu

SEQ ID NO: 61310 - RNA, 22 nt, Human
agucuauguuuuuguucuuauu

SEQ ID NO: 61311 - RNA, 22 nt, Human
agucucuagagucugucccucu

SEQ ID NO: 61312 - RNA, 22 nt, Human
agucuagcuguguuuugagcug

SEQ ID NO: 61313 - RNA, 22 nt, Human
agucucccauaggcuaaguauu

SEQ ID NO: 61314 - RNA, 19 nt, Human
agugaacuccauaucaggu

SEQ ID NO: 61315 - RNA, 21 nt, Human
agugaagagugggcuugauca

SEQ ID NO: 61316 - RNA, 22 nt, Human
agucugugguccucuguaucuc

SEQ ID NO: 61317 - RNA, 22 nt, Human
agugaaaacugaaucaccuucc

SEQ ID NO: 61318 - RNA, 22 nt, Human
agugaaagaaaacuguuagaac

SEQ ID NO: 61319 - RNA, 21 nt, Human
agugaguagagcacugaguca

SEQ ID NO: 61320 - RNA, 22 nt, Human
auacuuccuuaauuuggggaaa

SEQ ID NO: 61321 - RNA, 22 nt, Human
auagaaauagacaaugcaaaga

SEQ ID NO: 61322 - RNA, 22 nt, Human
auagaauggcaccagcaucuac

SEQ ID NO: 61323 - RNA, 18 nt, Human
auagacaggaaaaaugga

SEQ ID NO: 61324 - RNA, 22 nt, Human
auagagaggaacagcaagaacu

SEQ ID NO: 61325 - RNA, 22 nt, Human
auacaugacucacacauucugc

SEQ ID NO: 61326 - RNA, 22 nt, Human
auaccaaugacaggaguuaggg

SEQ ID NO: 61327 - RNA, 22 nt, Human
auagaguucucuuuggaggagu

SEQ ID NO: 61328 - RNA, 22 nt, Human
auagaugacaguuaggaagcug

SEQ ID NO: 61329 - RNA, 22 nt, Human
auaguaaauguuaacagcaaca

SEQ ID NO: 61330 - RNA, 22 nt, Human
auaggagcaagauuauagcagg

SEQ ID NO: 61331 - RNA, 22 nt, Human
auaggaguauaaggcaguaacu

SEQ ID NO: 61332 - RNA, 22 nt, Human
auagcaguauuaugagauaacu

SEQ ID NO: 61333 - RNA, 19 nt, Human
auagcagaagucauuuuca

SEQ ID NO: 61334 - RNA, 22 nt, Human
auagcacuuaauaugaaacagu

SEQ ID NO: 61335 - RNA, 22 nt, Human
auaccuauagcagacugagacu

SEQ ID NO: 61336 - RNA, 22 nt, Human
auacuagccugggcaucuccua

SEQ ID NO: 61337 - RNA, 23 nt, Human
auacuuuuuuucuacguuaucuc

SEQ ID NO: 61338 - RNA, 22 nt, Human
auagagcuggggaagaagcugg

SEQ ID NO: 61339 - RNA, 20 nt, Human
auagaguggugugucacauu

SEQ ID NO: 61340 - RNA, 22 nt, Human
auagacacagcuaugauuugag

SEQ ID NO: 61341 - RNA, 22 nt, Human
auagaagguaaugccccaaggg

SEQ ID NO: 61342 - RNA, 22 nt, Human
auaguccuucuuuaacuuagau

SEQ ID NO: 61343 - RNA, 23 nt, Human
auagucuuaaaccagacuucacc

SEQ ID NO: 61344 - RNA, 22 nt, Human
auaguuuuagauacugagaaaa

SEQ ID NO: 61345 - RNA, 22 nt, Human
auauaaugcaguaggugauuaa

SEQ ID NO: 61346 - RNA, 22 nt, Human
auagaguguguguuauguguga

SEQ ID NO: 61347 - RNA, 22 nt, Human
auauuuguacagcuugugaguu

SEQ ID NO: 61348 - RNA, 22 nt, Human
auauuuguuuggcagaguucag

SEQ ID NO: 61349 - RNA, 22 nt, Human
auauuucuacaggcugauuuua

SEQ ID NO: 61350 - RNA, 22 nt, Human
auaugcacauguacauguauau

SEQ ID NO: 61351 - RNA, 22 nt, Human
auaugaagaaugaucugaagua

SEQ ID NO: 61352 - RNA, 22 nt, Human
auaucuuguuuuugauuucuug

SEQ ID NO: 61353 - RNA, 21 nt, Human
auauggauauuauuuuguguc

SEQ ID NO: 61354 - RNA, 22 nt, Human
auauggugauuuuaugcaggaa

SEQ ID NO: 61355 - RNA, 22 nt, Human
auauguaguuucagaaguggaa

SEQ ID NO: 61356 - RNA, 22 nt, Human
auauaguuggguuucauucuac

SEQ ID NO: 61357 - RNA, 22 nt, Human
auauaggcugaaaaauagaauu

SEQ ID NO: 61358 - RNA, 22 nt, Human
auauauguauauaugugugugu

SEQ ID NO: 61359 - RNA, 22 nt, Human
auaucuaggcugaauguaaaau

SEQ ID NO: 61360 - RNA, 22 nt, Human
auauguuuuaguagaaucccaa

SEQ ID NO: 61361 - RNA, 22 nt, Human
auauucaaugaggucauauaag

SEQ ID NO: 61362 - RNA, 21 nt, Human
auauugguaucuuuuuaaauc

SEQ ID NO: 61363 - RNA, 22 nt, Human
auauccugguucuaucaaaagg

SEQ ID NO: 61364 - RNA, 22 nt, Human
auagcuauuauuauuucuguua

SEQ ID NO: 61365 - RNA, 22 nt, Human
auagaugaggaaauucaggugc

SEQ ID NO: 61366 - RNA, 22 nt, Human
auagauuuuaucagauuuuauc

SEQ ID NO: 61367 - RNA, 22 nt, Human
auagauugcucauauauuacuu

SEQ ID NO: 61368 - RNA, 22 nt, Human
auagcaacucugcuuccuugcc

SEQ ID NO: 61369 - RNA, 22 nt, Human
auaugcagaaaauaaaggaauu

SEQ ID NO: 61370 - RNA, 22 nt, Human
auaugagaggaggagcaucagu

SEQ ID NO: 61371 - RNA, 22 nt, Human
auaucugaugacgugacuaugu

SEQ ID NO: 61372 - RNA, 22 nt, Human
auaggaguuauggaaugagccc

SEQ ID NO: 61373 - RNA, 22 nt, Human
auauuauuaaaauagauggaua

SEQ ID NO: 61374 - RNA, 22 nt, Human
auauugagagagugagguguag

SEQ ID NO: 61375 - RNA, 22 nt, Human
auauugcuuuauucuugaauau

SEQ ID NO: 61376 - RNA, 22 nt, Human
auauuguagcaucacugucuug

SEQ ID NO: 61377 - RNA, 22 nt, Human
aucaagacaaaggaaaggcuaa

SEQ ID NO: 61378 - RNA, 22 nt, Human
auauuuuugcagaauuuuucgu

SEQ ID NO: 61379 - RNA, 22 nt, Human
aucaaaauguguagucuugauc

SEQ ID NO: 61380 - RNA, 21 nt, Human
aucagaaucucuagauuugga

SEQ ID NO: 61381 - RNA, 22 nt, Human
aucagaagaaauggaugugacu

SEQ ID NO: 61382 - RNA, 22 nt, Human
aucaauaaccauagugguuaca

SEQ ID NO: 61383 - RNA, 22 nt, Human
auauuugucuguuuuaguggca

SEQ ID NO: 61384 - RNA, 21 nt, Human
auauuguugggguuuucuuuu

SEQ ID NO: 61385 - RNA, 22 nt, Human
auauuuguuagcugcuuuggag

SEQ ID NO: 61386 - RNA, 22 nt, Human
aucaaaauuuucagauacuaca

SEQ ID NO: 61387 - RNA, 22 nt, Human
aucacugcaggcauauaggggu

SEQ ID NO: 61388 - RNA, 22 nt, Human
aucaaugggucaaagagaaggu

SEQ ID NO: 61389 - RNA, 22 nt, Human
aucacaaauggaaucaccuccc

SEQ ID NO: 61390 - RNA, 22 nt, Human
aucauccuagaaggaagcuagg

SEQ ID NO: 61391 - RNA, 20 nt, Human
aucaagugucuugccaggca

SEQ ID NO: 61392 - RNA, 22 nt, Human
aucacacaccuguuaaauugug

SEQ ID NO: 61393 - RNA, 22 nt, Human
aucacauggauuuuaucuuuug

SEQ ID NO: 61394 - RNA, 17 nt, Human
aucagaggauaggacaa

SEQ ID NO: 61395 - RNA, 19 nt, Human
aucagcaguuuugccugga

SEQ ID NO: 61396 - RNA, 22 nt, Human
aucauuaacagugcagggguag

SEQ ID NO: 61397 - RNA, 20 nt, Human
aucaggagucgcggggagag

SEQ ID NO: 61398 - RNA, 22 nt, Human
aucaucuaaaauuggcucagau

SEQ ID NO: 61399 - RNA, 22 nt, Human
aucaugcugacacaguuuaucu

SEQ ID NO: 61400 - RNA, 22 nt, Human
auccucugcucaugagaaaugu

SEQ ID NO: 61401 - RNA, 22 nt, Human
auccucaaggaauuaaauaggg

SEQ ID NO: 61402 - RNA, 19 nt, Human
auccucucuagaaguggga

SEQ ID NO: 61403 - RNA, 22 nt, Human
aucauguuauguacaaauauga

SEQ ID NO: 61404 - RNA, 22 nt, Human
auccuucaaaaggaauagcagg

SEQ ID NO: 61405 - RNA, 18 nt, Human
auccuuugaucaucuguc

SEQ ID NO: 61406 - RNA, 23 nt, Human
auccacauucuaguccuuuaugc

SEQ ID NO: 61407 - RNA, 22 nt, Human
aucccacaccccuacaacauau

SEQ ID NO: 61408 - RNA, 22 nt, Human
auccagaaguauuuuggguacu

SEQ ID NO: 61409 - RNA, 22 nt, Human
auccaggggucugaauggauau

SEQ ID NO: 61410 - RNA, 22 nt, Human
auccucucugugacagggaacg

SEQ ID NO: 61411 - RNA, 22 nt, Human
auccucucuuaugaacaacugu

SEQ ID NO: 61412 - RNA, 22 nt, Human
auccuagacuccuaugccccaa

SEQ ID NO: 61413 - RNA, 22 nt, Human
auccuccuuugcccugagauca

SEQ ID NO: 61414 - RNA, 22 nt, Human
auccugauggaaacugguauga

SEQ ID NO: 61415 - RNA, 22 nt, Human
aucuaaucugccuuccuaaucu

SEQ ID NO: 61416 - RNA, 22 nt, Human
auccuccuggggcagucuuccc

SEQ ID NO: 61417 - RNA, 22 nt, Human
aucggggaaugaccuuuucauu

SEQ ID NO: 61418 - RNA, 22 nt, Human
augaccauccagaaguccagcu

SEQ ID NO: 61419 - RNA, 22 nt, Human
augauuaagguacgucauuucu

SEQ ID NO: 61420 - RNA, 22 nt, Human
augacagcuaaggaauguguag

SEQ ID NO: 61421 - RNA, 22 nt, Human
augaauuaucugguguuggaaa

SEQ ID NO: 61422 - RNA, 22 nt, Human
augauggagaacaaagaaaauc

SEQ ID NO: 61423 - RNA, 22 nt, Human
augaucaagaauuuuguauucc

SEQ ID NO: 61424 - RNA, 22 nt, Human
augagaaauaauuguguacuga

SEQ ID NO: 61425 - RNA, 22 nt, Human
augagaguuagccugcauaguu

SEQ ID NO: 61426 - RNA, 22 nt, Human
augagcuaagcagaaagcacac

SEQ ID NO: 61427 - RNA, 22 nt, Human
augcacuccucagcuguucugg

SEQ ID NO: 61428 - RNA, 22 nt, Human
augcacuugacucuauuccaca

SEQ ID NO: 61429 - RNA, 22 nt, Human
augaaacucuagcuuucagcac

SEQ ID NO: 61430 - RNA, 22 nt, Human
aucuauguaucucagaagcuag

SEQ ID NO: 61431 - RNA, 22 nt, Human
aucuggaacuucucugcauuga

SEQ ID NO: 61432 - RNA, 23 nt, Human
augaaaugauacuuuauucacug

SEQ ID NO: 61433 - RNA, 22 nt, Human
aucuucaaagcacaucguuugu

SEQ ID NO: 61434 - RNA, 20 nt, Human
aucuuaucuaucuuuuguuc

SEQ ID NO: 61435 - RNA, 22 nt, Human
aucuuaguuauuuggagaaacc

SEQ ID NO: 61436 - RNA, 22 nt, Human
aucugucagaccuuggucacag

SEQ ID NO: 61437 - RNA, 22 nt, Human
aucuucuuucaucagccccuca

SEQ ID NO: 61438 - RNA, 22 nt, Human
aucuugaaacauauaugcauuu

SEQ ID NO: 61439 - RNA, 22 nt, Human
augaggaacagcaagaauauuu

SEQ ID NO: 61440 - RNA, 22 nt, Human
augcagauguagauucugaaau

SEQ ID NO: 61441 - RNA, 22 nt, Human
augccccucucucucccaauca

SEQ ID NO: 61442 - RNA, 22 nt, Human
augcacuaugaugagcuagucu

SEQ ID NO: 61443 - RNA, 22 nt, Human
augcagaaucucuuuccugagg

SEQ ID NO: 61444 - RNA, 22 nt, Human
augcagagacugugggaaagca

SEQ ID NO: 61445 - RNA, 22 nt, Human
augcagcggucagaggaacuca

SEQ ID NO: 61446 - RNA, 22 nt, Human
augcuaaucaaacuuucugcag

SEQ ID NO: 61447 - RNA, 22 nt, Human
augcuagaaaauuucauauuau

SEQ ID NO: 61448 - RNA, 22 nt, Human
augcucuggucucuucuuuccu

SEQ ID NO: 61449 - RNA, 22 nt, Human
augcucuuaauugcuagauaag

SEQ ID NO: 61450 - RNA, 22 nt, Human
augcauaucuccuaucuccuca

SEQ ID NO: 61451 - RNA, 22 nt, Human
augcuucuguugcuuaggaggu

SEQ ID NO: 61452 - RNA, 22 nt, Human
augcugcuuguccauuuauuug

SEQ ID NO: 61453 - RNA, 22 nt, Human
augcauaugugugcaagugugu

SEQ ID NO: 61454 - RNA, 22 nt, Human
augcuuuauuggagacagucau

SEQ ID NO: 61455 - RNA, 22 nt, Human
augccugggcuuuaggguucuc

SEQ ID NO: 61456 - RNA, 22 nt, Human
augcuacauuuugguuuauaaa

SEQ ID NO: 61457 - RNA, 22 nt, Human
augcugacaacaaagaaggaag

SEQ ID NO: 61458 - RNA, 22 nt, Human
augcugccuaaagcuacuuaca

SEQ ID NO: 61459 - RNA, 22 nt, Human
augcugugccuggaaagcggcu

SEQ ID NO: 61460 - RNA, 22 nt, Human
augcuugcccauguuucugaag

SEQ ID NO: 61461 - RNA, 22 nt, Human
auggccuuucucaguggugcuu

SEQ ID NO: 61462 - RNA, 22 nt, Human
auggcucugcugggcaaagcaa

SEQ ID NO: 61463 - RNA, 22 nt, Human
augcuuucucuucuauuucuca

SEQ ID NO: 61464 - RNA, 18 nt, Human
auggcuccagugucuucc

SEQ ID NO: 61465 - RNA, 22 nt, Human
auggcuucugucuuggaaauuu

SEQ ID NO: 61466 - RNA, 22 nt, Human
auggcuguguuguuccucugaa

SEQ ID NO: 61467 - RNA, 22 nt, Human
augguuagcuauuuuucucuca

SEQ ID NO: 61468 - RNA, 22 nt, Human
augguugccugagauaagacug

SEQ ID NO: 61469 - RNA, 22 nt, Human
auguauuuauguauguguuaua

SEQ ID NO: 61470 - RNA, 22 nt, Human
augugaaccuggguccugggcc

SEQ ID NO: 61471 - RNA, 22 nt, Human
augugaaagagguguucagugg

SEQ ID NO: 61472 - RNA, 22 nt, Human
augugaaauuugggcucuggga

SEQ ID NO: 61473 - RNA, 22 nt, Human
augguuuuguccucuuugguuc

SEQ ID NO: 61474 - RNA, 22 nt, Human
auggugaaaugauuugauguca

SEQ ID NO: 61475 - RNA, 22 nt, Human
auguaugagagauucuuuuauu

SEQ ID NO: 61476 - RNA, 22 nt, Human
augguugugaaagagcaaagac

SEQ ID NO: 61477 - RNA, 22 nt, Human
augguuuugugaaaaugcuuug

SEQ ID NO: 61478 - RNA, 22 nt, Human
auguguguaugugugcauguau

SEQ ID NO: 61479 - RNA, 22 nt, Human
auguguuuccaacagagaggga

SEQ ID NO: 61480 - RNA, 22 nt, Human
auguguuuugaccccugcuaaa

SEQ ID NO: 61481 - RNA, 22 nt, Human
auguuagcaucuggcacuaugg

SEQ ID NO: 61482 - RNA, 19 nt, Human
auguucugaauuacuguaa

SEQ ID NO: 61483 - RNA, 22 nt, Human
auguuccuuaaugugcuuguag

SEQ ID NO: 61484 - RNA, 22 nt, Human
auuccauccuggcuuuuuccug

SEQ ID NO: 61485 - RNA, 17 nt, Human
auucaugaacauguccu

SEQ ID NO: 61486 - RNA, 22 nt, Human
auucauuuuuacaucaccaaua

SEQ ID NO: 61487 - RNA, 22 nt, Human
auucaggacucuuccuugaaga

SEQ ID NO: 61488 - RNA, 22 nt, Human
auucaagauagaaggauuuuca

SEQ ID NO: 61489 - RNA, 20 nt, Human
auuauuucuucugcccaaag

SEQ ID NO: 61490 - RNA, 23 nt, Human
auuauuucaggguuuugacuugc

SEQ ID NO: 61491 - RNA, 22 nt, Human
auuaugugagggacuuaaucau

SEQ ID NO: 61492 - RNA, 22 nt, Human
auuauucuuugggaaaguugaa

SEQ ID NO: 61493 - RNA, 21 nt, Human
auucaaagaagaggaaggccc

SEQ ID NO: 61494 - RNA, 22 nt, Human
auuaaaaaugagaguagggauu

SEQ ID NO: 61495 - RNA, 22 nt, Human
auuaaagcuaguugagauuuaa

SEQ ID NO: 61496 - RNA, 22 nt, Human
auuaaauagcagaagaaagaug

SEQ ID NO: 61497 - RNA, 22 nt, Human
auuagaagagcuuuuuacucuu

SEQ ID NO: 61498 - RNA, 22 nt, Human
auuacugaggcaaaguaguuuu

SEQ ID NO: 61499 - RNA, 20 nt, Human
auuaauuuuuagggcucacc

SEQ ID NO: 61500 - RNA, 22 nt, Human
auuacagaagauaugcucaaca

SEQ ID NO: 61501 - RNA, 22 nt, Human
auguuccuuuaaaauauagauu

SEQ ID NO: 61502 - RNA, 22 nt, Human
auuaagucugacuggauuguau

SEQ ID NO: 61503 - RNA, 19 nt, Human
auguuuccauuucuggaua

SEQ ID NO: 61504 - RNA, 22 nt, Human
auguuccaugacuaugcaugaa

SEQ ID NO: 61505 - RNA, 18 nt, Human
auguuccugcaguuauuu

SEQ ID NO: 61506 - RNA, 22 nt, Human
auguucucagguuguauuuauu

SEQ ID NO: 61507 - RNA, 22 nt, Human
auguuuuauacacauguaucac

SEQ ID NO: 61508 - RNA, 22 nt, Human
auuauacauuaggagauugauu

SEQ ID NO: 61509 - RNA, 22 nt, Human
auuagcaccccuggauguggga

SEQ ID NO: 61510 - RNA, 22 nt, Human
auuauaauucauuaggcuuagu

SEQ ID NO: 61511 - RNA, 22 nt, Human
auuaaaaaaagauaaugaguua

SEQ ID NO: 61512 - RNA, 22 nt, Human
auuaucuauccgccaacaguaa

SEQ ID NO: 61513 - RNA, 23 nt, Human
auuaugaagaagacucgccuguu

SEQ ID NO: 61514 - RNA, 22 nt, Human
auuaugaauuguguuacgaaga

SEQ ID NO: 61515 - RNA, 22 nt, Human
auuuccugugaacuuuucugau

SEQ ID NO: 61516 - RNA, 17 nt, Human
auuuccgaguuucuuuc

SEQ ID NO: 61517 - RNA, 22 nt, Human
auuucaguuugcaguuucucuc

SEQ ID NO: 61518 - RNA, 22 nt, Human
auuucauccauuaagaguacuc

SEQ ID NO: 61519 - RNA, 22 nt, Human
auuucauuuuagaaauaagugu

SEQ ID NO: 61520 - RNA, 22 nt, Human
auuucagaaugaaaggaaaaau

SEQ ID NO: 61521 - RNA, 22 nt, Human
auuucagaguagaucguuauuu

SEQ ID NO: 61522 - RNA, 22 nt, Human
auuuauuuucccucaaguaccu

SEQ ID NO: 61523 - RNA, 22 nt, Human
auuucacucuuaauugcuuccu

SEQ ID NO: 61524 - RNA, 22 nt, Human
auuuauuugaagagccauugca

SEQ ID NO: 61525 - RNA, 22 nt, Human
auucuuuucucuaaaugaugaa

SEQ ID NO: 61526 - RNA, 17 nt, Human
auuguuuuuaauuugca

SEQ ID NO: 61527 - RNA, 22 nt, Human
auuuaaaaacugguacaacagg

SEQ ID NO: 61528 - RNA, 22 nt, Human
auugacuucccaucaggugagu

SEQ ID NO: 61529 - RNA, 22 nt, Human
auugacuuucccuucuccucau

SEQ ID NO: 61530 - RNA, 22 nt, Human
auuuagacaacaagccuucucc

SEQ ID NO: 61531 - RNA, 22 nt, Human
auuuauccuugggguagagcca

SEQ ID NO: 61532 - RNA, 22 nt, Human
auuacagauuauaaauuugagc

SEQ ID NO: 61533 - RNA, 22 nt, Human
auuagaaaugacaugugggaau

SEQ ID NO: 61534 - RNA, 22 nt, Human
auuagguaguauaaucuuuguu

SEQ ID NO: 61535 - RNA, 22 nt, Human
auuagugguguauuuggcacua

SEQ ID NO: 61536 - RNA, 22 nt, Human
auuaguagcacacagagaucag

SEQ ID NO: 61537 - RNA, 22 nt, Human
auuauaguuuugcccuuaagaa

SEQ ID NO: 61538 - RNA, 22 nt, Human
auuguuacuggguuaauuugga

SEQ ID NO: 61539 - RNA, 22 nt, Human
auuugaaaaucuaugaugugca

SEQ ID NO: 61540 - RNA, 22 nt, Human
auuuuagagaaacaaacguagg

SEQ ID NO: 61541 - RNA, 18 nt, Human
auuuguggggguuauaga

SEQ ID NO: 61542 - RNA, 22 nt, Human
auuugcaucagugagcgaugug

SEQ ID NO: 61543 - RNA, 22 nt, Human
auuuccagcagcauauuugucu

SEQ ID NO: 61544 - RNA, 22 nt, Human
auuuucuugucucuguuguagg

SEQ ID NO: 61545 - RNA, 22 nt, Human
auuuucgcaccucgcgaguugc

SEQ ID NO: 61546 - RNA, 22 nt, Human
auuuuugugucacaucuaggaa

SEQ ID NO: 61547 - RNA, 22 nt, Human
auuuggaaggcguuucucugua

SEQ ID NO: 61548 - RNA, 22 nt, Human
auuuggaaacaugcugaccaug

SEQ ID NO: 61549 - RNA, 22 nt, Human
auuuggggacagagugggggua

SEQ ID NO: 61550 - RNA, 22 nt, Human
auuuuucucucaugugcaacua

SEQ ID NO: 61551 - RNA, 22 nt, Human
auuuuucuuucacauuuucuua

SEQ ID NO: 61552 - RNA, 21 nt, Human
auuuguggugcaauuguggua

SEQ ID NO: 61553 - RNA, 22 nt, Human
caaagaugccaaaaggaagaca

SEQ ID NO: 61554 - RNA, 22 nt, Human
caaagagaugcaccauauuucu

SEQ ID NO: 61555 - RNA, 19 nt, Human
auuuugguucuuuccauuc

SEQ ID NO: 61556 - RNA, 22 nt, Human
auuuugcuuuucuaguggguuu

SEQ ID NO: 61557 - RNA, 22 nt, Human
caaaacccaagugcuauugcaa

SEQ ID NO: 61558 - RNA, 22 nt, Human
auuuugcaguuuauugccaauc

SEQ ID NO: 61559 - RNA, 22 nt, Human
auuuuuuuuccugucucuuuca

SEQ ID NO: 61560 - RNA, 21 nt, Human
auuuuucagaaggaugugaua

SEQ ID NO: 61561 - RNA, 22 nt, Human
auuuuucacauuuugggggaca

SEQ ID NO: 61562 - RNA, 22 nt, Human
caacuucuauucagucugcagu

SEQ ID NO: 61563 - RNA, 22 nt, Human
caaccucuaucggucaggaagc

SEQ ID NO: 61564 - RNA, 22 nt, Human
caacacaucaguucagucuuga

SEQ ID NO: 61565 - RNA, 22 nt, Human
caaagcuucaucuguuguuuug

SEQ ID NO: 61566 - RNA, 22 nt, Human
caaggaaaugucagaaaggcaa

SEQ ID NO: 61567 - RNA, 22 nt, Human
caaggaaaacagaugaucaaca

SEQ ID NO: 61568 - RNA, 22 nt, Human
caagagguaugagccgggauga

SEQ ID NO: 61569 - RNA, 22 nt, Human
caaagaagagauuuacagagcu

SEQ ID NO: 61570 - RNA, 22 nt, Human
caagaaaaaacaugaugagugu

SEQ ID NO: 61571 - RNA, 22 nt, Human
caagagcuuuagaaaugcucau

SEQ ID NO: 61572 - RNA, 22 nt, Human
caagguuucgaguucccaacca

SEQ ID NO: 61573 - RNA, 22 nt, Human
caauaccucuuggugauugggc

SEQ ID NO: 61574 - RNA, 22 nt, Human
caaaggauguguagugcaacca

SEQ ID NO: 61575 - RNA, 22 nt, Human
caauagcuauguaaccugaaga

SEQ ID NO: 61576 - RNA, 22 nt, Human
caaugcacauggacaucaggcu

SEQ ID NO: 61577 - RNA, 20 nt, Human
caauguuggcaguauagagc

SEQ ID NO: 61578 - RNA, 22 nt, Human
caaaucagaucagagacaggcu

SEQ ID NO: 61579 - RNA, 22 nt, Human
caaaucuguuaauuucaaguug

SEQ ID NO: 61580 - RNA, 22 nt, Human
caaauguuugguggcauuuugu

SEQ ID NO: 61581 - RNA, 22 nt, Human
caacaagcgcucagagcaaagc

SEQ ID NO: 61582 - RNA, 22 nt, Human
caauugcuuccuucuguaagua

SEQ ID NO: 61583 - RNA, 22 nt, Human
cacaacaaaaaauaaguaugag

SEQ ID NO: 61584 - RNA, 22 nt, Human
cacaagacuaaguggcagagca

SEQ ID NO: 61585 - RNA, 22 nt, Human
cacacacacacacacucucaca

SEQ ID NO: 61586 - RNA, 20 nt, Human
caacacugcccauuguuugc

SEQ ID NO: 61587 - RNA, 22 nt, Human
caacauuucaaggucuuuagga

SEQ ID NO: 61588 - RNA, 22 nt, Human
cacaaggagaaauagauauuga

SEQ ID NO: 61589 - RNA, 22 nt, Human
caagaaguugacagccagguga

SEQ ID NO: 61590 - RNA, 22 nt, Human
caagaaccuagcgaucagguaa

SEQ ID NO: 61591 - RNA, 22 nt, Human
caagagcucccagaccugggca

SEQ ID NO: 61592 - RNA, 20 nt, Human
cacagcugacgaguauccaa

SEQ ID NO: 61593 - RNA, 22 nt, Human
cacagcagcaucauuuaucugg

SEQ ID NO: 61594 - RNA, 22 nt, Human
cacagcaggcagaacgugggca

SEQ ID NO: 61595 - RNA, 18 nt, Human
cacagcauccaaguuaug

SEQ ID NO: 61596 - RNA, 22 nt, Human
caacuucugcuuucuuccuugc

SEQ ID NO: 61597 - RNA, 22 nt, Human
caagaugcaagaccagucaggc

SEQ ID NO: 61598 - RNA, 22 nt, Human
cacauuaagcccaagcauagaa

SEQ ID NO: 61599 - RNA, 22 nt, Human
cacaguuuuaucuuauacugau

SEQ ID NO: 61600 - RNA, 22 nt, Human
caagauauguccuguuacuaag

SEQ ID NO: 61601 - RNA, 22 nt, Human
cacauuucagcacucagggcau

SEQ ID NO: 61602 - RNA, 22 nt, Human
cacauuuuccagaagaaucaga

SEQ ID NO: 61603 - RNA, 22 nt, Human
caaggcuaagcuuuggcuuucu

SEQ ID NO: 61604 - RNA, 22 nt, Human
caccacauguccgaaauucagc

SEQ ID NO: 61605 - RNA, 22 nt, Human
caccaucugaauauucuccaag

SEQ ID NO: 61606 - RNA, 22 nt, Human
caaguaugagaaagcuauuacc

SEQ ID NO: 61607 - RNA, 22 nt, Human
caaguauuuauugaggcccugu

SEQ ID NO: 61608 - RNA, 22 nt, Human
caagucucuagaaugcaauagu

SEQ ID NO: 61609 - RNA, 22 nt, Human
caaucuucucuagaguauucua

SEQ ID NO: 61610 - RNA, 22 nt, Human
caauccccaggucccagaacag

SEQ ID NO: 61611 - RNA, 22 nt, Human
caccuuccgcccacugaccgcc

SEQ ID NO: 61612 - RNA, 22 nt, Human
caaugaaaauuuaaguugcagc

SEQ ID NO: 61613 - RNA, 22 nt, Human
cagagcucacaaacugaaaacc

SEQ ID NO: 61614 - RNA, 22 nt, Human
cagagcugagucuucaagguug

SEQ ID NO: 61615 - RNA, 22 nt, Human
cacucaaacugaaauccuuuuu

SEQ ID NO: 61616 - RNA, 22 nt, Human
cagaucacauccauccgucacc

SEQ ID NO: 61617 - RNA, 20 nt, Human
cagaucuuauguuuuucugu

SEQ ID NO: 61618 - RNA, 22 nt, Human
cagauggagaaagagugaaugg

SEQ ID NO: 61619 - RNA, 22 nt, Human
cagauggaguuaguuucuaaca

SEQ ID NO: 61620 - RNA, 22 nt, Human
cacuuuuucccccuggugucau

SEQ ID NO: 61621 - RNA, 22 nt, Human
cagaaaaaaaugcagacuagca

SEQ ID NO: 61622 - RNA, 22 nt, Human
cagaggcugagcugcgggauga

SEQ ID NO: 61623 - RNA, 22 nt, Human
cagagggagcuaaccagcagcc

SEQ ID NO: 61624 - RNA, 22 nt, Human
cagaaagaaguggggauagagg

SEQ ID NO: 61625 - RNA, 19 nt, Human
cagagacuguaacacuuuu

SEQ ID NO: 61626 - RNA, 22 nt, Human
cagagacuuuugcuccgauucu

SEQ ID NO: 61627 - RNA, 22 nt, Human
cagagaagaggucuugaccccu

SEQ ID NO: 61628 - RNA, 20 nt, Human
cagagacaagagggaaggga

SEQ ID NO: 61629 - RNA, 22 nt, Human
cagaggaugucuacaccuugag

SEQ ID NO: 61630 - RNA, 22 nt, Human
cagagguagaaguagauguuug

SEQ ID NO: 61631 - RNA, 22 nt, Human
cagaguaaugugauuuccaugu

SEQ ID NO: 61632 - RNA, 22 nt, Human
cagauacaacagcaggaaugaa

SEQ ID NO: 61633 - RNA, 22 nt, Human
cagcuccaucuugcuuauacca

SEQ ID NO: 61634 - RNA, 22 nt, Human
cagcucugcugggaggaugcag

SEQ ID NO: 61635 - RNA, 22 nt, Human
cagcugcgcagcgccgggccug

SEQ ID NO: 61636 - RNA, 22 nt, Human
cagauguuugaaugcuuaccac

SEQ ID NO: 61637 - RNA, 22 nt, Human
cagaucacucugggcggcggga

SEQ ID NO: 61638 - RNA, 22 nt, Human
cagauuuagcacugauaggacu

SEQ ID NO: 61639 - RNA, 21 nt, Human
cagcagaaaugagaggagaaa

SEQ ID NO: 61640 - RNA, 21 nt, Human
cagcagaugccagggucucug

SEQ ID NO: 61641 - RNA, 20 nt, Human
cagcagucagcucuccaaug

SEQ ID NO: 61642 - RNA, 22 nt, Human
cagcuguacgugaucuacaugg

SEQ ID NO: 61643 - RNA, 22 nt, Human
cagcuuauggcuucuccaguag

SEQ ID NO: 61644 - RNA, 22 nt, Human
cagcccaggcucagauguuggg

SEQ ID NO: 61645 - RNA, 22 nt, Human
cagcuucuccauucuucuggcu

SEQ ID NO: 61646 - RNA, 22 nt, Human
cagccuuuucuuaaaaugcaag

SEQ ID NO: 61647 - RNA, 22 nt, Human
cagcuccagcccaggcagcucc

SEQ ID NO: 61648 - RNA, 22 nt, Human
cagcuauuguucuguauaauga

SEQ ID NO: 61649 - RNA, 22 nt, Human
caggacacagacacuaaauaua

SEQ ID NO: 61650 - RNA, 22 nt, Human
caggaagucugaauucugagag

SEQ ID NO: 61651 - RNA, 22 nt, Human
cagcuuuugcagacuucuugcc

SEQ ID NO: 61652 - RNA, 22 nt, Human
cagguauuugaaggcaguggga

SEQ ID NO: 61653 - RNA, 22 nt, Human
caguauguuuauuagaacugca

SEQ ID NO: 61654 - RNA, 21 nt, Human
caggccaaaagguucaacauu

SEQ ID NO: 61655 - RNA, 22 nt, Human
caggcagggcugccuucugcuu

SEQ ID NO: 61656 - RNA, 22 nt, Human
caguagcuuuuugcagacaaga

SEQ ID NO: 61657 - RNA, 22 nt, Human
cagggaaguauuacauguuucc

SEQ ID NO: 61658 - RNA, 22 nt, Human
cagggagcggggagaucucggg

SEQ ID NO: 61659 - RNA, 22 nt, Human
cagggcaucucugaaucuucac

SEQ ID NO: 61660 - RNA, 22 nt, Human
caggggaagccagcugccaugu

SEQ ID NO: 61661 - RNA, 22 nt, Human
cagacagaguuguuucuucucc

SEQ ID NO: 61662 - RNA, 22 nt, Human
caggguaagagagagugacauu

SEQ ID NO: 61663 - RNA, 22 nt, Human
caguuuuucaaaauuacaugau

SEQ ID NO: 61664 - RNA, 22 nt, Human
cauacauguuagcaguagccuu

SEQ ID NO: 61665 - RNA, 22 nt, Human
caggucagcacuuggaggugca

SEQ ID NO: 61666 - RNA, 22 nt, Human
cagguugaagagguuaacgaua

SEQ ID NO: 61667 - RNA, 22 nt, Human
cagguugucuaauuccaagggg

SEQ ID NO: 61668 - RNA, 22 nt, Human
caucaaaugcaagagcguucuu

SEQ ID NO: 61669 - RNA, 21 nt, Human
caguagcgcgacaugguuagc

SEQ ID NO: 61670 - RNA, 22 nt, Human
cauccagagcugccugaccccg

SEQ ID NO: 61671 - RNA, 22 nt, Human
cagugcucauagcuguuccucc

SEQ ID NO: 61672 - RNA, 22 nt, Human
caucuccaagucuguaagcagu

SEQ ID NO: 61673 - RNA, 22 nt, Human
caugagaguaaccuagagaaga

SEQ ID NO: 61674 - RNA, 22 nt, Human
caucucagguuuguucugagac

SEQ ID NO: 61675 - RNA, 22 nt, Human
cagucaaauuugaaaacuuuga

SEQ ID NO: 61676 - RNA, 22 nt, Human
cagucucuggugaguugacagu

SEQ ID NO: 61677 - RNA, 22 nt, Human
caugauucccacauugcgauca

SEQ ID NO: 61678 - RNA, 20 nt, Human
caugaguccgugaguggccc

SEQ ID NO: 61679 - RNA, 22 nt, Human
caguuuuggaagaaacaaggaa

SEQ ID NO: 61680 - RNA, 22 nt, Human
caugcagcagaauaaugacuau

SEQ ID NO: 61681 - RNA, 22 nt, Human
caguguugcuaaugaauucauu

SEQ ID NO: 61682 - RNA, 22 nt, Human
caguugcagagugauguguuug

SEQ ID NO: 61683 - RNA, 22 nt, Human
caguuuccagacauuauugaua

SEQ ID NO: 61684 - RNA, 22 nt, Human
caugccucuguuuuaguuguug

SEQ ID NO: 61685 - RNA, 22 nt, Human
caguucuguaccaggagaagcu

SEQ ID NO: 61686 - RNA, 22 nt, Human
cauagcuagcaccuucuuuucu

SEQ ID NO: 61687 - RNA, 22 nt, Human
cauaccuugguaagagugauca

SEQ ID NO: 61688 - RNA, 22 nt, Human
cauagacauugauagguuauau

SEQ ID NO: 61689 - RNA, 22 nt, Human
cauguaaguucacagucgaugu

SEQ ID NO: 61690 - RNA, 20 nt, Human
caucaacaccuugucagccu

SEQ ID NO: 61691 - RNA, 23 nt, Human
cauauucagaaacaccuaguggu

SEQ ID NO: 61692 - RNA, 23 nt, Human
cauguacacacagcuguacagug

SEQ ID NO: 61693 - RNA, 22 nt, Human
ccagaggcuuaugcagcugcug

SEQ ID NO: 61694 - RNA, 22 nt, Human
ccagcaaguaagucagugucag

SEQ ID NO: 61695 - RNA, 22 nt, Human
ccagcaggagacuagcaacaua

SEQ ID NO: 61696 - RNA, 20 nt, Human
ccccagcauccuuuucaucu

SEQ ID NO: 61697 - RNA, 23 nt, Human
ccccugcauggcaccacauuccc

SEQ ID NO: 61698 - RNA, 22 nt, Human
ccagcuuuucagaaucugccug

SEQ ID NO: 61699 - RNA, 17 nt, Human
ccagcugcucccucaga

SEQ ID NO: 61700 - RNA, 23 nt, Human
ccagcugugccuggcccaggagc

SEQ ID NO: 61701 - RNA, 22 nt, Human
ccaggaguccgugggucuugag

SEQ ID NO: 61702 - RNA, 19 nt, Human
cccgauggagacuuagcag

SEQ ID NO: 61703 - RNA, 22 nt, Human
cccuccaaauuauaguauuguc

SEQ ID NO: 61704 - RNA, 17 nt, Human
cccugcacccuacucuc

SEQ ID NO: 61705 - RNA, 22 nt, Human
ccaguuguggagaauuguuuga

SEQ ID NO: 61706 - RNA, 22 nt, Human
cccuuugucaguagucuuagug

SEQ ID NO: 61707 - RNA, 22 nt, Human
ccauaaaguaggaaacacuaca

SEQ ID NO: 61708 - RNA, 22 nt, Human
cccuugagccuggaggagcucu

SEQ ID NO: 61709 - RNA, 21 nt, Human
ccaucuugaaccaugcccacu

SEQ ID NO: 61710 - RNA, 22 nt, Human
ccauggauacuaagguauguga

SEQ ID NO: 61711 - RNA, 22 nt, Human
ccgagcagggcgcccugcccca

SEQ ID NO: 61712 - RNA, 21 nt, Human
ccgaggagugcggggagcccc

SEQ ID NO: 61713 - RNA, 22 nt, Human
ccgaggaguagggugucuacgg

SEQ ID NO: 61714 - RNA, 22 nt, Human
ccauuuuccuguauggacucga

SEQ ID NO: 61715 - RNA, 22 nt, Human
cccagaagaguauguguuugcu

SEQ ID NO: 61716 - RNA, 22 nt, Human
ccggaggaaauugcauugguug

SEQ ID NO: 61717 - RNA, 19 nt, Human
ccggucaugcauuccuuug

SEQ ID NO: 61718 - RNA, 22 nt, Human
cccccucuggcuccagucugac

SEQ ID NO: 61719 - RNA, 22 nt, Human
ccccaaauuugugcuuucauag

SEQ ID NO: 61720 - RNA, 22 nt, Human
ccccacaugaauacaguguagu

SEQ ID NO: 61721 - RNA, 22 nt, Human
cccauuaguuguuaaucaucaa

SEQ ID NO: 61722 - RNA, 18 nt, Human
ccccucuuccagacagag

SEQ ID NO: 61723 - RNA, 22 nt, Human
ccucagcuguuucucucaucag

SEQ ID NO: 61724 - RNA, 22 nt, Human
ccuauauaaaugacauauagga

SEQ ID NO: 61725 - RNA, 22 nt, Human
cccgaaaauuguuguacugcag

SEQ ID NO: 61726 - RNA, 22 nt, Human
ccuccacgaggggucuucucuu

SEQ ID NO: 61727 - RNA, 22 nt, Human
ccucauagccuuuccuacuuua

SEQ ID NO: 61728 - RNA, 18 nt, Human
ccuccccuguggaggucc

SEQ ID NO: 61729 - RNA, 19 nt, Human
ccuccgcauccucaucugu

SEQ ID NO: 61730 - RNA, 22 nt, Human
ccuccugggccuugcucuguga

SEQ ID NO: 61731 - RNA, 22 nt, Human
ccucuccuugcuccccuuccuu

SEQ ID NO: 61732 - RNA, 22 nt, Human
ccugaauuuaucugaauggugg

SEQ ID NO: 61733 - RNA, 22 nt, Human
ccugacuugguuuaggagaugg

SEQ ID NO: 61734 - RNA, 22 nt, Human
cccugcuuccucuucuguuugu

SEQ ID NO: 61735 - RNA, 22 nt, Human
cccuuuuccugaggcccccugc

SEQ ID NO: 61736 - RNA, 22 nt, Human
cccuuuuuuauggaguuggcca

SEQ ID NO: 61737 - RNA, 22 nt, Human
cccuuuuuugccauuccuuccu

SEQ ID NO: 61738 - RNA, 22 nt, Human
cccuuuucuaauuuagccuguu

SEQ ID NO: 61739 - RNA, 22 nt, Human
ccugcugagccuggugggcagc

SEQ ID NO: 61740 - RNA, 22 nt, Human
ccucacaaagaaugucuagaca

SEQ ID NO: 61741 - RNA, 22 nt, Human
cgacaagagaaaugcuuuguuu

SEQ ID NO: 61742 - RNA, 22 nt, Human
ccucacuucuuucucuucacuu

SEQ ID NO: 61743 - RNA, 22 nt, Human
cgcauugcaauucaggggauaa

SEQ ID NO: 61744 - RNA, 22 nt, Human
cgccaguggcagcuggaacagg

SEQ ID NO: 61745 - RNA, 22 nt, Human
cgacuacuaacuacuguagaaa

SEQ ID NO: 61746 - RNA, 22 nt, Human
ccucaucagaaagcagaaagca

SEQ ID NO: 61747 - RNA, 22 nt, Human
ccugaagaugguugauccccuu

SEQ ID NO: 61748 - RNA, 20 nt, Human
ccucuuuaguugauggguuu

SEQ ID NO: 61749 - RNA, 22 nt, Human
ccucuuugcccucuuuccuucc

SEQ ID NO: 61750 - RNA, 22 nt, Human
ccucuuuugaaccaguucuuca

SEQ ID NO: 61751 - RNA, 22 nt, Human
ccugaaaugaguucugcucacu

SEQ ID NO: 61752 - RNA, 22 nt, Human
ccugccagccugccaucccaca

SEQ ID NO: 61753 - RNA, 22 nt, Human
ccugcucuaauucauucaugcu

SEQ ID NO: 61754 - RNA, 19 nt, Human
ccugcugaagugaugcagc

SEQ ID NO: 61755 - RNA, 22 nt, Human
cggccuuuggcuucuccugugu

SEQ ID NO: 61756 - RNA, 22 nt, Human
cggcuacccaugucauauucgu

SEQ ID NO: 61757 - RNA, 22 nt, Human
ccugugcuucacucaacaagcc

SEQ ID NO: 61758 - RNA, 22 nt, Human
ccuuagaaaaucauggaauauu

SEQ ID NO: 61759 - RNA, 19 nt, Human
cgguaugaauguacuaugg

SEQ ID NO: 61760 - RNA, 22 nt, Human
ccuucccagacggcucagcugu

SEQ ID NO: 61761 - RNA, 19 nt, Human
cggugaagagaguuuagau

SEQ ID NO: 61762 - RNA, 22 nt, Human
cgguuuuuaaaagucucuucua

SEQ ID NO: 61763 - RNA, 22 nt, Human
ccuuuuaagggagacuagagau

SEQ ID NO: 61764 - RNA, 22 nt, Human
ccuuuuagagaagugcauccag

SEQ ID NO: 61765 - RNA, 20 nt, Human
cuaaaacaggugucuaguga

SEQ ID NO: 61766 - RNA, 22 nt, Human
cuaaaaauguucuaguaguuca

SEQ ID NO: 61767 - RNA, 22 nt, Human
ccuuuggaugucauucuuggca

SEQ ID NO: 61768 - RNA, 22 nt, Human
ccuuuuguuucccuuuauguuc

SEQ ID NO: 61769 - RNA, 22 nt, Human
cgaagcuuuuguuggcgugucg

SEQ ID NO: 61770 - RNA, 22 nt, Human
cuaagaaggaggaaaagugcca

SEQ ID NO: 61771 - RNA, 23 nt, Human
cuaagcuugaguauagcuuagga

SEQ ID NO: 61772 - RNA, 22 nt, Human
cuaauaauuuacugagugcuac

SEQ ID NO: 61773 - RNA, 21 nt, Human
cuauaaaaaugguucuuugcg

SEQ ID NO: 61774 - RNA, 22 nt, Human
cuaguuuucacaaaggaagggc

SEQ ID NO: 61775 - RNA, 22 nt, Human
cuaugaaucaauuucugcaguu

SEQ ID NO: 61776 - RNA, 22 nt, Human
cuauaauuguacuuguuuuuua

SEQ ID NO: 61777 - RNA, 22 nt, Human
cuauacuuagaacuccauuuuc

SEQ ID NO: 61778 - RNA, 22 nt, Human
cuauaucuguggauaguguaug

SEQ ID NO: 61779 - RNA, 22 nt, Human
cgccuggccccgcagcgcuugu

SEQ ID NO: 61780 - RNA, 22 nt, Human
cuaugguaguggcacaggagga

SEQ ID NO: 61781 - RNA, 22 nt, Human
cuauguuucagauauauauaua

SEQ ID NO: 61782 - RNA, 22 nt, Human
cgccugucugcauggccacugg

SEQ ID NO: 61783 - RNA, 22 nt, Human
cuauugguaucacacugauuuc

SEQ ID NO: 61784 - RNA, 22 nt, Human
cgcucugccugcccuaacuucc

SEQ ID NO: 61785 - RNA, 22 nt, Human
cucauguucuaagcuuucuuca

SEQ ID NO: 61786 - RNA, 22 nt, Human
cgcuuuccaggcacauccucuu

SEQ ID NO: 61787 - RNA, 22 nt, Human
cucccccugccucuccucccug

SEQ ID NO: 61788 - RNA, 22 nt, Human
cuccccucccuuuaacccccuu

SEQ ID NO: 61789 - RNA, 22 nt, Human
cuccccuuauuccucaacauga

SEQ ID NO: 61790 - RNA, 22 nt, Human
cuccuugagaaugaacaaagga

SEQ ID NO: 61791 - RNA, 21 nt, Human
cuccuguaaaucaccuccgca

SEQ ID NO: 61792 - RNA, 22 nt, Human
cuccuuuuuauaucuuucucug

SEQ ID NO: 61793 - RNA, 22 nt, Human
cucuaagcuuugguguuucacu

SEQ ID NO: 61794 - RNA, 22 nt, Human
cucggcccuggucuuacgggac

SEQ ID NO: 61795 - RNA, 22 nt, Human
cuccuuugagcaaaucuuugau

SEQ ID NO: 61796 - RNA, 22 nt, Human
cucucuccuuagcugcagacca

SEQ ID NO: 61797 - RNA, 22 nt, Human
cucugcuuguaucacauuugcu

SEQ ID NO: 61798 - RNA, 22 nt, Human
cucuccaguuauagcugauuug

SEQ ID NO: 61799 - RNA, 22 nt, Human
cucuccagucauauucucaguc

SEQ ID NO: 61800 - RNA, 22 nt, Human
cucuggagggaggcugagcugg

SEQ ID NO: 61801 - RNA, 22 nt, Human
cucucuaacuagagacaggagu

SEQ ID NO: 61802 - RNA, 22 nt, Human
cucuuauaaagaugucucuguu

SEQ ID NO: 61803 - RNA, 22 nt, Human
cucuucauguuggugcagaagc

SEQ ID NO: 61804 - RNA, 22 nt, Human
cucuucauuauucacgcccugu

SEQ ID NO: 61805 - RNA, 22 nt, Human
cucuugugucaccauggauaaa

SEQ ID NO: 61806 - RNA, 22 nt, Human
cucuugacagcuuuaguaucau

SEQ ID NO: 61807 - RNA, 20 nt, Human
cucuuuaugagaccacuguc

SEQ ID NO: 61808 - RNA, 22 nt, Human
cucuuucauucuguccuuguuu

SEQ ID NO: 61809 - RNA, 20 nt, Human
cucuuucugcuuuaugccuc

SEQ ID NO: 61810 - RNA, 22 nt, Human
cucuuuuuccuaugaaaucuau

SEQ ID NO: 61811 - RNA, 19 nt, Human
cugaaacacagagagggcu

SEQ ID NO: 61812 - RNA, 22 nt, Human
cgggacaauagcagugcugaug

SEQ ID NO: 61813 - RNA, 22 nt, Human
cugaaagcaaaguaauucuuaa

SEQ ID NO: 61814 - RNA, 20 nt, Human
cugaaaggaaagaaauuuuu

SEQ ID NO: 61815 - RNA, 22 nt, Human
cugaacuaagcccaaagacacu

SEQ ID NO: 61816 - RNA, 22 nt, Human
cugaaagacgaggggaagucgg

SEQ ID NO: 61817 - RNA, 22 nt, Human
cugaaucugccuccgaggguuu

SEQ ID NO: 61818 - RNA, 22 nt, Human
cugaccgugccgcgguacugcu

SEQ ID NO: 61819 - RNA, 22 nt, Human
cugacagaucuggaucugaacu

SEQ ID NO: 61820 - RNA, 22 nt, Human
cugaaggacacgugaggagcca

SEQ ID NO: 61821 - RNA, 22 nt, Human
cugaagcugggcacuuccuuuu

SEQ ID NO: 61822 - RNA, 19 nt, Human
cggugcugauuggugcagu

SEQ ID NO: 61823 - RNA, 22 nt, Human
cggucuauuguguaucauuuca

SEQ ID NO: 61824 - RNA, 22 nt, Human
cugagaaauacccaagucuggu

SEQ ID NO: 61825 - RNA, 22 nt, Human
cuggagaucaguuggacaacag

SEQ ID NO: 61826 - RNA, 23 nt, Human
cuggacauucgcaaaguucaucu

SEQ ID NO: 61827 - RNA, 22 nt, Human
cuggagcuucaggguucucggg

SEQ ID NO: 61828 - RNA, 22 nt, Human
cuggaucgccccgaugugcccc

SEQ ID NO: 61829 - RNA, 22 nt, Human
cuggauagaggaugguaggcac

SEQ ID NO: 61830 - RNA, 22 nt, Human
cucccaauaauaacaagcaggu

SEQ ID NO: 61831 - RNA, 22 nt, Human
cucccucacaaagcauucucuu

SEQ ID NO: 61832 - RNA, 22 nt, Human
cuccugauuucuaggccuuauc

SEQ ID NO: 61833 - RNA, 22 nt, Human
cuccucccagcccaggcgccac

SEQ ID NO: 61834 - RNA, 22 nt, Human
cugggaaggaagggaaaaacag

SEQ ID NO: 61835 - RNA, 19 nt, Human
cugggacaaugaaagcauc

SEQ ID NO: 61836 - RNA, 22 nt, Human
cuccuuuacaauugugggaaaa

SEQ ID NO: 61837 - RNA, 22 nt, Human
cuccugcuuuuucuucuuccga

SEQ ID NO: 61838 - RNA, 22 nt, Human
cuccuuuuccuacucauacuau

SEQ ID NO: 61839 - RNA, 22 nt, Human
cuccuuuuugggaccgugcagc

SEQ ID NO: 61840 - RNA, 22 nt, Human
cuccuuuuuuuaaagauggauu

SEQ ID NO: 61841 - RNA, 22 nt, Human
cucuaaauguggucugcagaua

SEQ ID NO: 61842 - RNA, 22 nt, Human
cucuauucuaauggauucuggg

SEQ ID NO: 61843 - RNA, 22 nt, Human
cucuauuuuuucaucuuucagg

SEQ ID NO: 61844 - RNA, 22 nt, Human
cucugaguuuacaguauguuuu

SEQ ID NO: 61845 - RNA, 22 nt, Human
cucugauuuuucuaauacuuca

SEQ ID NO: 61846 - RNA, 22 nt, Human
cucucugcugucuuucgggaaa

SEQ ID NO: 61847 - RNA, 22 nt, Human
cucucuccuuuuugauauuuag

SEQ ID NO: 61848 - RNA, 22 nt, Human
cuguacuuguuuuaggaugaug

SEQ ID NO: 61849 - RNA, 22 nt, Human
cucuucugugggugcuauguca

SEQ ID NO: 61850 - RNA, 19 nt, Human
cucuucauuggaggguuga

SEQ ID NO: 61851 - RNA, 22 nt, Human
cucuguauauugagugcuuacu

SEQ ID NO: 61852 - RNA, 22 nt, Human
cugugguuucuaugggccuuga

SEQ ID NO: 61853 - RNA, 22 nt, Human
cucuuuucaaaccuguuuaugg

SEQ ID NO: 61854 - RNA, 22 nt, Human
cugacacagccauuguccuugu

SEQ ID NO: 61855 - RNA, 22 nt, Human
cugaaucaaaugacuuagccau

SEQ ID NO: 61856 - RNA, 22 nt, Human
cugugucucccaaggaggguca

SEQ ID NO: 61857 - RNA, 22 nt, Human
cuucacuccuggagugaguuuc

SEQ ID NO: 61858 - RNA, 22 nt, Human
cugauaauaaccauuuuaaaau

SEQ ID NO: 61859 - RNA, 22 nt, Human
cuucauuacagcaaccauuuga

SEQ ID NO: 61860 - RNA, 22 nt, Human
cuucauuucaggcugaagaaua

SEQ ID NO: 61861 - RNA, 22 nt, Human
cugauguuuaucucaagaguuc

SEQ ID NO: 61862 - RNA, 20 nt, Human
cugauguucgugcuuccugg

SEQ ID NO: 61863 - RNA, 21 nt, Human
cugauguaccucaagccuagu

SEQ ID NO: 61864 - RNA, 22 nt, Human
cuucaggaccugaagcccaucu

SEQ ID NO: 61865 - RNA, 22 nt, Human
cuucaguuaguuucaugugagc

SEQ ID NO: 61866 - RNA, 22 nt, Human
cuuccguuacugacaaaauguu

SEQ ID NO: 61867 - RNA, 22 nt, Human
cuuccuaaucuuggguuauuuu

SEQ ID NO: 61868 - RNA, 22 nt, Human
cugcagauguagcugcuuuccu

SEQ ID NO: 61869 - RNA, 22 nt, Human
cugcagagaccuaggucagguu

SEQ ID NO: 61870 - RNA, 22 nt, Human
cugcaguaacuauuuucaauaa

SEQ ID NO: 61871 - RNA, 22 nt, Human
cugccacuaccaugcuggauga

SEQ ID NO: 61872 - RNA, 22 nt, Human
cugcaguguccgcuugcucagc

SEQ ID NO: 61873 - RNA, 22 nt, Human
cuucucuuggguguggugucuu

SEQ ID NO: 61874 - RNA, 22 nt, Human
cuucuaauucuuauguaagcuu

SEQ ID NO: 61875 - RNA, 22 nt, Human
cuucucuugugauguuagcgga

SEQ ID NO: 61876 - RNA, 22 nt, Human
cuucuggaggcucuagaggaga

SEQ ID NO: 61877 - RNA, 22 nt, Human
cuucugaugugugcucuuaguu

SEQ ID NO: 61878 - RNA, 22 nt, Human
cuucucuuugacaguugggugu

SEQ ID NO: 61879 - RNA, 22 nt, Human
cuucuuagugauuuaacaugua

SEQ ID NO: 61880 - RNA, 22 nt, Human
cuucuucaucuuuuggaggaac

SEQ ID NO: 61881 - RNA, 22 nt, Human
cuucuuuucuacuggccuagaa

SEQ ID NO: 61882 - RNA, 22 nt, Human
cuucuuuuggggaugaaaaugg

SEQ ID NO: 61883 - RNA, 22 nt, Human
cuucuuuccauguguuuugguu

SEQ ID NO: 61884 - RNA, 22 nt, Human
cuucuuucuuuucuucuucucu

SEQ ID NO: 61885 - RNA, 22 nt, Human
cuucuugucagugauuucuucc

SEQ ID NO: 61886 - RNA, 22 nt, Human
cuugcagagcccauggauguca

SEQ ID NO: 61887 - RNA, 22 nt, Human
cuugcucugggaauaugaguuu

SEQ ID NO: 61888 - RNA, 22 nt, Human
cugcgguucuguuuaguggcga

SEQ ID NO: 61889 - RNA, 22 nt, Human
cuuggcauguucaucugcuugg

SEQ ID NO: 61890 - RNA, 22 nt, Human
cugcucuucccaucccuuaaau

SEQ ID NO: 61891 - RNA, 22 nt, Human
cuuggcacauuuuguucuucug

SEQ ID NO: 61892 - RNA, 22 nt, Human
cuuggcacccaucuuuccaccu

SEQ ID NO: 61893 - RNA, 22 nt, Human
cuugcugggagagcuuuagaga

SEQ ID NO: 61894 - RNA, 21 nt, Human
cuuggagacucuuggccacau

SEQ ID NO: 61895 - RNA, 22 nt, Human
cuuggagauacagaggacauuu

SEQ ID NO: 61896 - RNA, 22 nt, Human
cuuggugagcuccuggcgcagc

SEQ ID NO: 61897 - RNA, 22 nt, Human
cuugguuugaaacauacucuac

SEQ ID NO: 61898 - RNA, 22 nt, Human
cugcuucacccugccugagaac

SEQ ID NO: 61899 - RNA, 22 nt, Human
cuuguuaaaagugacccuaaug

SEQ ID NO: 61900 - RNA, 22 nt, Human
cuggaaaaauggauccugucuu

SEQ ID NO: 61901 - RNA, 22 nt, Human
cuggaaauggcagaguugcauu

SEQ ID NO: 61902 - RNA, 22 nt, Human
cuggagaacucugugcuucacu

SEQ ID NO: 61903 - RNA, 22 nt, Human
cuggaauugcuugagcuaggaa

SEQ ID NO: 61904 - RNA, 22 nt, Human
cuuuaaaaauguauuuuugugg

SEQ ID NO: 61905 - RNA, 22 nt, Human
cuuuaguaaaacguauuuagga

SEQ ID NO: 61906 - RNA, 22 nt, Human
cuggagaacagagcuguuuaga

SEQ ID NO: 61907 - RNA, 22 nt, Human
cuggagaagagguaguauguag

SEQ ID NO: 61908 - RNA, 22 nt, Human
cuuuccaugucuucuuucucca

SEQ ID NO: 61909 - RNA, 22 nt, Human
cuuucucucaaacacacauaca

SEQ ID NO: 61910 - RNA, 22 nt, Human
cuuucugauguaaggaacuagg

SEQ ID NO: 61911 - RNA, 22 nt, Human
cuuucuuucaaguucugcuuua

SEQ ID NO: 61912 - RNA, 22 nt, Human
cuuugauuucucugguccaauc

SEQ ID NO: 61913 - RNA, 22 nt, Human
cuuucuuuuugguuucccccca

SEQ ID NO: 61914 - RNA, 22 nt, Human
cuuuuaaucuaauuuuuauauu

SEQ ID NO: 61915 - RNA, 21 nt, Human
cuuuggcaagggagaagucac

SEQ ID NO: 61916 - RNA, 22 nt, Human
cuuuggauuuuuugcuuuugua

SEQ ID NO: 61917 - RNA, 22 nt, Human
cuuuggggcugaggaggagguu

SEQ ID NO: 61918 - RNA, 21 nt, Human
cuuugccuccagcagccgcag

SEQ ID NO: 61919 - RNA, 22 nt, Human
cuggauuaaacaguuugauacu

SEQ ID NO: 61920 - RNA, 22 nt, Human
cuggcccugucagcacagaauc

SEQ ID NO: 61921 - RNA, 22 nt, Human
gaaagcuuggaaacgacuuuau

SEQ ID NO: 61922 - RNA, 22 nt, Human
cuguggaaugcaguugcgagca

SEQ ID NO: 61923 - RNA, 22 nt, Human
cuguggaguccuggggaaugga

SEQ ID NO: 61924 - RNA, 22 nt, Human
gaaauaggcccuuacauggaaa

SEQ ID NO: 61925 - RNA, 22 nt, Human
cugugcauaugucuugaggucu

SEQ ID NO: 61926 - RNA, 22 nt, Human
gaaagugaauguaacauguuau

SEQ ID NO: 61927 - RNA, 22 nt, Human
cuguucuccacuccugacuucu

SEQ ID NO: 61928 - RNA, 22 nt, Human
cuguuccuccaccucaacaaac

SEQ ID NO: 61929 - RNA, 22 nt, Human
gaacaaaagauagcccaaacau

SEQ ID NO: 61930 - RNA, 22 nt, Human
gaacaugaguuuuaugguauuu

SEQ ID NO: 61931 - RNA, 20 nt, Human
cuguuugcuaucaugagcug

SEQ ID NO: 61932 - RNA, 22 nt, Human
cuguuuggaugccauggucaag

SEQ ID NO: 61933 - RNA, 22 nt, Human
cuguuuggcuuccacugcuucu

SEQ ID NO: 61934 - RNA, 22 nt, Human
gaagcagguucuucaggaugaa

SEQ ID NO: 61935 - RNA, 20 nt, Human
cuuaugcaaaauguuaggga

SEQ ID NO: 61936 - RNA, 22 nt, Human
cuuaagacaggcucaaagauua

SEQ ID NO: 61937 - RNA, 22 nt, Human
cuuacauuuguuuaguguuucc

SEQ ID NO: 61938 - RNA, 23 nt, Human
cuuauauaaucauuagaaaccau

SEQ ID NO: 61939 - RNA, 22 nt, Human
cuucaacuucuguuuuaaggaa

SEQ ID NO: 61940 - RNA, 22 nt, Human
cuucacaaaauauuucauuaua

SEQ ID NO: 61941 - RNA, 22 nt, Human
cuuauuugcccauguuucuuua

SEQ ID NO: 61942 - RNA, 20 nt, Human
cuuauuuuggagaacuuuuc

SEQ ID NO: 61943 - RNA, 22 nt, Human
cuucagcgucgucaguguugcu

SEQ ID NO: 61944 - RNA, 22 nt, Human
cuucuguggcugagaaggcagc

SEQ ID NO: 61945 - RNA, 22 nt, Human
cuucuuaaaguugucacagcug

SEQ ID NO: 61946 - RNA, 22 nt, Human
cuucuggaggcugcagaaaaga

SEQ ID NO: 61947 - RNA, 22 nt, Human
gaaggaagcugucuggaugugu

SEQ ID NO: 61948 - RNA, 22 nt, Human
gaaggauaauuuugcuggaugu

SEQ ID NO: 61949 - RNA, 22 nt, Human
cuuccauucugauggcuaauua

SEQ ID NO: 61950 - RNA, 22 nt, Human
cuucccuaagggacuggcauag

SEQ ID NO: 61951 - RNA, 22 nt, Human
gaagcuucucaacugguggaau

SEQ ID NO: 61952 - RNA, 22 nt, Human
gaaggaaaagacgugcuaagua

SEQ ID NO: 61953 - RNA, 22 nt, Human
cuucacuaccuacacugccgcu

SEQ ID NO: 61954 - RNA, 22 nt, Human
cuucauaagauuguugugagga

SEQ ID NO: 61955 - RNA, 22 nt, Human
cuucauccguaccacggccaca

SEQ ID NO: 61956 - RNA, 22 nt, Human
gaagcuccaggaugccugcacu

SEQ ID NO: 61957 - RNA, 22 nt, Human
gaagcuucgaaagagugauuuc

SEQ ID NO: 61958 - RNA, 20 nt, Human
gaaucuggucaaaugucuau

SEQ ID NO: 61959 - RNA, 22 nt, Human
gaauauuuaucucagcugcaga

SEQ ID NO: 61960 - RNA, 22 nt, Human
gaauaauuuugaucagaaggga

SEQ ID NO: 61961 - RNA, 21 nt, Human
gaaguagcucugagaaaagug

SEQ ID NO: 61962 - RNA, 22 nt, Human
gaaguaaugugauugcucaggg

SEQ ID NO: 61963 - RNA, 22 nt, Human
cuucuuugacucacugguacgc

SEQ ID NO: 61964 - RNA, 22 nt, Human
cuucuucuagaagauggggaag

SEQ ID NO: 61965 - RNA, 22 nt, Human
cuuggcaaaguggcaaaauuag

SEQ ID NO: 61966 - RNA, 22 nt, Human
cuugcuuuaucugguuucucau

SEQ ID NO: 61967 - RNA, 22 nt, Human
gaauggaugcuggucaguuugg

SEQ ID NO: 61968 - RNA, 22 nt, Human
cuuguuuggccauaggugcugg

SEQ ID NO: 61969 - RNA, 19 nt, Human
gaauugcacgagcagaggc

SEQ ID NO: 61970 - RNA, 22 nt, Human
cuuguuaacaauugguaucuuu

SEQ ID NO: 61971 - RNA, 22 nt, Human
gacauugaauugaauccagauu

SEQ ID NO: 61972 - RNA, 22 nt, Human
cuuuacauuaauuucuacugau

SEQ ID NO: 61973 - RNA, 20 nt, Human
gacaugagggagcaaagagc

SEQ ID NO: 61974 - RNA, 22 nt, Human
cuuuuaccuuaauuucgacaca

SEQ ID NO: 61975 - RNA, 22 nt, Human
gacugacagugguacuguaauu

SEQ ID NO: 61976 - RNA, 22 nt, Human
cuuuuucuugugguuaauaucu

SEQ ID NO: 61977 - RNA, 21 nt, Human
gacuacaauauguaaucuaau

SEQ ID NO: 61978 - RNA, 22 nt, Human
gacuucaucagagcguacuguu

SEQ ID NO: 61979 - RNA, 23 nt, Human
gacuucacacucucaaccacugc

SEQ ID NO: 61980 - RNA, 22 nt, Human
gacuucuuaaagaggugaggaa

SEQ ID NO: 61981 - RNA, 22 nt, Human
gaaaaagucuuaaaguaaggca

SEQ ID NO: 61982 - RNA, 22 nt, Human
gacuguuggcagauguuugagu

SEQ ID NO: 61983 - RNA, 22 nt, Human
gaaaaagagaaggaguucagua

SEQ ID NO: 61984 - RNA, 20 nt, Human
gagaauuccagguuucugug

SEQ ID NO: 61985 - RNA, 22 nt, Human
gaaacguuguggaaaauccucu

SEQ ID NO: 61986 - RNA, 22 nt, Human
gaaagagaugucguuugucuuc

SEQ ID NO: 61987 - RNA, 22 nt, Human
gagaagugaauaacgaagcagg

SEQ ID NO: 61988 - RNA, 22 nt, Human
gagaagguggaccugaaggagc

SEQ ID NO: 61989 - RNA, 22 nt, Human
gagaaguagcgucuucccgggg

SEQ ID NO: 61990 - RNA, 22 nt, Human
gagaaguaggaauaucaggagu

SEQ ID NO: 61991 - RNA, 22 nt, Human
gagagcaaaccuguguuuggag

SEQ ID NO: 61992 - RNA, 22 nt, Human
gagagcugucagcguagcaccg

SEQ ID NO: 61993 - RNA, 22 nt, Human
gagaggaagugccugcucccag

SEQ ID NO: 61994 - RNA, 18 nt, Human
gagaggcauuuagcugau

SEQ ID NO: 61995 - RNA, 22 nt, Human
gagaggugaagcuaauuaauuu

SEQ ID NO: 61996 - RNA, 22 nt, Human
gaaauuucuuuguuaucuuggu

SEQ ID NO: 61997 - RNA, 22 nt, Human
gagagucuuaaguuacagaacu

SEQ ID NO: 61998 - RNA, 22 nt, Human
gaaaugaaacacacaugcagcu

SEQ ID NO: 61999 - RNA, 22 nt, Human
gaaauagagacaguaagugucu

SEQ ID NO: 62000 - RNA, 22 nt, Human
gaaaucuggugauuuucuguug

SEQ ID NO: 62001 - RNA, 22 nt, Human
gagauggauuuuuuugccaguc

SEQ ID NO: 62002 - RNA, 22 nt, Human
gagaugugguucaaggguguuu

SEQ ID NO: 62003 - RNA, 22 nt, Human
gagaguuggaggguauguuagu

SEQ ID NO: 62004 - RNA, 22 nt, Human
gagaucuguguuugcugaagcu

SEQ ID NO: 62005 - RNA, 22 nt, Human
gagauuugaguuccuacugagu

SEQ ID NO: 62006 - RNA, 22 nt, Human
gagcacauguggagagucuggg

SEQ ID NO: 62007 - RNA, 22 nt, Human
gaacauuucugcagaugucuga

SEQ ID NO: 62008 - RNA, 22 nt, Human
gaacugaauguguaauguuggc

SEQ ID NO: 62009 - RNA, 19 nt, Human
gaacuaaggggagcucugg

SEQ ID NO: 62010 - RNA, 22 nt, Human
gaacucuugguggucauuagau

SEQ ID NO: 62011 - RNA, 22 nt, Human
gaagaaggaagaucaugcuuga

SEQ ID NO: 62012 - RNA, 22 nt, Human
gaagaggaagaggagccagagc

SEQ ID NO: 62013 - RNA, 22 nt, Human
gagaccuuaagagaugucagcu

SEQ ID NO: 62014 - RNA, 22 nt, Human
gagacugugucugucaagcuag

SEQ ID NO: 62015 - RNA, 22 nt, Human
gagagagacugggaaaucauca

SEQ ID NO: 62016 - RNA, 22 nt, Human
gagacucagccccugcucucaa

SEQ ID NO: 62017 - RNA, 22 nt, Human
gagacugcguggcucugacaca

SEQ ID NO: 62018 - RNA, 22 nt, Human
gaugauuccuuuguucauugug

SEQ ID NO: 62019 - RNA, 22 nt, Human
gaugauuuuguaacuggggaca

SEQ ID NO: 62020 - RNA, 22 nt, Human
gaugcucuugauuggaccaggg

SEQ ID NO: 62021 - RNA, 22 nt, Human
gaugcuaauuaaugaagaggag

SEQ ID NO: 62022 - RNA, 22 nt, Human
gaugccuccaggaaagaggacg

SEQ ID NO: 62023 - RNA, 22 nt, Human
gauggcauucacaaacuuaacu

SEQ ID NO: 62024 - RNA, 22 nt, Human
gaugauaacagcauuucaacug

SEQ ID NO: 62025 - RNA, 22 nt, Human
gagagaggggaagagaagcucu

SEQ ID NO: 62026 - RNA, 22 nt, Human
gagagaguaucugcugguucac

SEQ ID NO: 62027 - RNA, 22 nt, Human
gagagauacauucccaaccuga

SEQ ID NO: 62028 - RNA, 22 nt, Human
gaugguaucugcuggcuuucag

SEQ ID NO: 62029 - RNA, 22 nt, Human
gaugguggaggaaucgcugaag

SEQ ID NO: 62030 - RNA, 22 nt, Human
gauggguugaguucauggagcc

SEQ ID NO: 62031 - RNA, 22 nt, Human
gauggggaaaaaauggaucuuu

SEQ ID NO: 62032 - RNA, 22 nt, Human
gagcagacugcacaguucuugc

SEQ ID NO: 62033 - RNA, 22 nt, Human
gauguaucugagcugcuuaggu

SEQ ID NO: 62034 - RNA, 22 nt, Human
gagcagcucgagaaggaagcag

SEQ ID NO: 62035 - RNA, 22 nt, Human
gauguuaauauguuucaccaaa

SEQ ID NO: 62036 - RNA, 22 nt, Human
gauuaaaggucuugauuauaag

SEQ ID NO: 62037 - RNA, 22 nt, Human
gagcagcugagcuggaaugaga

SEQ ID NO: 62038 - RNA, 22 nt, Human
gagcaggucuuugguaaugcuu

SEQ ID NO: 62039 - RNA, 22 nt, Human
gagcaugacgcaacaccaagug

SEQ ID NO: 62040 - RNA, 22 nt, Human
gauuccugcuauucacagggcu

SEQ ID NO: 62041 - RNA, 22 nt, Human
gauugauguaggugauaaaucu

SEQ ID NO: 62042 - RNA, 22 nt, Human
gauugcauaugcauucugauac

SEQ ID NO: 62043 - RNA, 22 nt, Human
gauugauuuaauaugagaggau

SEQ ID NO: 62044 - RNA, 22 nt, Human
gauuccuuucgccugccgagcu

SEQ ID NO: 62045 - RNA, 22 nt, Human
gauugggagugugacauuguau

SEQ ID NO: 62046 - RNA, 22 nt, Human
gauuguagacauauuagacugc

SEQ ID NO: 62047 - RNA, 22 nt, Human
gagcgacucuuuuaguccagag

SEQ ID NO: 62048 - RNA, 22 nt, Human
gagccuuucuggagggcacuug

SEQ ID NO: 62049 - RNA, 22 nt, Human
gauuuuaaaagauguauaaggu

SEQ ID NO: 62050 - RNA, 22 nt, Human
gauuugucuauauucaaauaug

SEQ ID NO: 62051 - RNA, 21 nt, Human
gauuuuagggcagccaaacac

SEQ ID NO: 62052 - RNA, 22 nt, Human
gagcggcucaguggccauguga

SEQ ID NO: 62053 - RNA, 22 nt, Human
gauuuugcuuuagugaaggaag

SEQ ID NO: 62054 - RNA, 22 nt, Human
gagcuggacauacaggaaacca

SEQ ID NO: 62055 - RNA, 18 nt, Human
gagcucuucccuuuucuc

SEQ ID NO: 62056 - RNA, 22 nt, Human
gauuuuuaaaaguaguuuugaa

SEQ ID NO: 62057 - RNA, 22 nt, Human
gcaaagaauugauucauuuugc

SEQ ID NO: 62058 - RNA, 22 nt, Human
gcaagagaagaaagaauaguuu

SEQ ID NO: 62059 - RNA, 22 nt, Human
gaggaagucuuaucuggaugca

SEQ ID NO: 62060 - RNA, 22 nt, Human
gaggaaagcugguuuaaaguau

SEQ ID NO: 62061 - RNA, 22 nt, Human
gagcuuuagcugagaccugcuu

SEQ ID NO: 62062 - RNA, 22 nt, Human
gaggagcaggcaggaucugguc

SEQ ID NO: 62063 - RNA, 22 nt, Human
gaggagagaaauguuuucugug

SEQ ID NO: 62064 - RNA, 22 nt, Human
gaggagcugggucagggagaca

SEQ ID NO: 62065 - RNA, 22 nt, Human
gaggaggagaagcggcggcgga

SEQ ID NO: 62066 - RNA, 22 nt, Human
gaggagcuucagaggaaucuua

SEQ ID NO: 62067 - RNA, 22 nt, Human
gaggaggucaccuggugagcaa

SEQ ID NO: 62068 - RNA, 22 nt, Human
gaggauaaugaaucugaaucau

SEQ ID NO: 62069 - RNA, 22 nt, Human
gcacauauuuagaucuugaugu

SEQ ID NO: 62070 - RNA, 22 nt, Human
gaggcuaugucuacgcucagcg

SEQ ID NO: 62071 - RNA, 22 nt, Human
gcacucuguggagacaagauag

SEQ ID NO: 62072 - RNA, 22 nt, Human
gagggaaaggggccaugauugg

SEQ ID NO: 62073 - RNA, 21 nt, Human
gcagaacuaggacuugaacau

SEQ ID NO: 62074 - RNA, 22 nt, Human
gcagaaguauuguacgguggga

SEQ ID NO: 62075 - RNA, 22 nt, Human
gagggauuuuagugcagcaacu

SEQ ID NO: 62076 - RNA, 22 nt, Human
gcagagcacccugcagugguau

SEQ ID NO: 62077 - RNA, 22 nt, Human
gaggggaacaggcauucuuaag

SEQ ID NO: 62078 - RNA, 22 nt, Human
gcagagcugucuaagucacuuc

SEQ ID NO: 62079 - RNA, 22 nt, Human
gaggggaaggagcgaaggcggg

SEQ ID NO: 62080 - RNA, 22 nt, Human
gcagauaguaggagcuaaucuu

SEQ ID NO: 62081 - RNA, 22 nt, Human
gagggguuguuaacaaagaaua

SEQ ID NO: 62082 - RNA, 22 nt, Human
gcagccaugcacgucauuauga

SEQ ID NO: 62083 - RNA, 22 nt, Human
gaggucuugagugacuuagcag

SEQ ID NO: 62084 - RNA, 22 nt, Human
gaggucggaagugaggguaacu

SEQ ID NO: 62085 - RNA, 22 nt, Human
gcagcguguggcuaauggcucu

SEQ ID NO: 62086 - RNA, 22 nt, Human
gcagcgcugagaugauuuguug

SEQ ID NO: 62087 - RNA, 22 nt, Human
gcagccucugcaguucaggagg

SEQ ID NO: 62088 - RNA, 21 nt, Human
gcagcucaggauauagacuug

SEQ ID NO: 62089 - RNA, 22 nt, Human
gcaggaaugguacauaccuguu

SEQ ID NO: 62090 - RNA, 22 nt, Human
gagguuauucuucuaucaguau

SEQ ID NO: 62091 - RNA, 22 nt, Human
gauaaugcuuuggucagacaug

SEQ ID NO: 62092 - RNA, 22 nt, Human
gcaugcuguuuggaaacgauaa

SEQ ID NO: 62093 - RNA, 22 nt, Human
gcauugcuauuucuguuagugu

SEQ ID NO: 62094 - RNA, 22 nt, Human
gauagcacacuuguugcuucug

SEQ ID NO: 62095 - RNA, 22 nt, Human
gauaggaggaugggaccuguga

SEQ ID NO: 62096 - RNA, 22 nt, Human
gauauauuucaaauucuuuugc

SEQ ID NO: 62097 - RNA, 22 nt, Human
gauacuuuguggaauccuggau

SEQ ID NO: 62098 - RNA, 22 nt, Human
gauacugugggcacucauaaua

SEQ ID NO: 62099 - RNA, 22 nt, Human
gcauguagucaguguugagaac

SEQ ID NO: 62100 - RNA, 22 nt, Human
gcauuucuguuuuuuuaaauga

SEQ ID NO: 62101 - RNA, 23 nt, Human
gaugauggcaacuacauccggug

SEQ ID NO: 62102 - RNA, 22 nt, Human
gaugauugaauaaauaugguca

SEQ ID NO: 62103 - RNA, 22 nt, Human
gauggauuuuuuauuaaaucag

SEQ ID NO: 62104 - RNA, 22 nt, Human
gcccagaagguagcgaguaguc

SEQ ID NO: 62105 - RNA, 22 nt, Human
gauucuaucauucuguauauua

SEQ ID NO: 62106 - RNA, 22 nt, Human
gauucugaaauuaacagacugg

SEQ ID NO: 62107 - RNA, 22 nt, Human
gauugcugccagcguguccgug

SEQ ID NO: 62108 - RNA, 22 nt, Human
gauugcaucaauauuuagagua

SEQ ID NO: 62109 - RNA, 22 nt, Human
gccggagagccaacaccacgga

SEQ ID NO: 62110 - RNA, 22 nt, Human
gauuucuucauuuaaaaauauu

SEQ ID NO: 62111 - RNA, 22 nt, Human
gauuucauaaaacgagaaacuc

SEQ ID NO: 62112 - RNA, 22 nt, Human
gauuggucacacaauaguauau

SEQ ID NO: 62113 - RNA, 22 nt, Human
gccucaaaaguguuguagaggg

SEQ ID NO: 62114 - RNA, 20 nt, Human
gccuccuccaaguuucauca

SEQ ID NO: 62115 - RNA, 22 nt, Human
gccuccuccaucauugcuucau

SEQ ID NO: 62116 - RNA, 22 nt, Human
gccuagaagaaugagcgcaggg

SEQ ID NO: 62117 - RNA, 22 nt, Human
gauuuucauuauagcuaguuuc

SEQ ID NO: 62118 - RNA, 22 nt, Human
gcacagcuaugagcugaauugu

SEQ ID NO: 62119 - RNA, 22 nt, Human
gcacagaguguaaaaguuucau

SEQ ID NO: 62120 - RNA, 22 nt, Human
gcggagcuaaagauuggcuccu

SEQ ID NO: 62121 - RNA, 22 nt, Human
gccuuuuaaggcagagggagau

SEQ ID NO: 62122 - RNA, 22 nt, Human
gcagccauuugcaucuaauuaa

SEQ ID NO: 62123 - RNA, 22 nt, Human
gcgguggcuacuaaaguucgaa

SEQ ID NO: 62124 - RNA, 22 nt, Human
gcgguuguucugugugcaugga

SEQ ID NO: 62125 - RNA, 22 nt, Human
gcaggacugauggagcauaugu

SEQ ID NO: 62126 - RNA, 21 nt, Human
gcaggggugugugagcugggg

SEQ ID NO: 62127 - RNA, 22 nt, Human
gcaguuaccuauuuuguagaaa

SEQ ID NO: 62128 - RNA, 22 nt, Human
gcuacaaaaccagggcaaagga

SEQ ID NO: 62129 - RNA, 22 nt, Human
gcuacaaauaaaaugggugacu

SEQ ID NO: 62130 - RNA, 22 nt, Human
gcauaaaggacuauaaggauca

SEQ ID NO: 62131 - RNA, 22 nt, Human
gcucaacucaacgucauuugaa

SEQ ID NO: 62132 - RNA, 22 nt, Human
gcaucuguuguguuaauuuaca

SEQ ID NO: 62133 - RNA, 22 nt, Human
gcucgauugucaguguuaggga

SEQ ID NO: 62134 - RNA, 19 nt, Human
gcuccugcagcuagagugc

SEQ ID NO: 62135 - RNA, 22 nt, Human
gcucaaggucacacagggguga

SEQ ID NO: 62136 - RNA, 22 nt, Human
gcuccccaggcccuccacucuc

SEQ ID NO: 62137 - RNA, 22 nt, Human
gcucugcuccaucuguuuccuc

SEQ ID NO: 62138 - RNA, 22 nt, Human
gcucugaacugucaugaauugg

SEQ ID NO: 62139 - RNA, 22 nt, Human
gcucuggcuacuguggcuaccg

SEQ ID NO: 62140 - RNA, 22 nt, Human
gcugagcagaacaauuagaaau

SEQ ID NO: 62141 - RNA, 22 nt, Human
gcugauucuucugcuuuuucuc

SEQ ID NO: 62142 - RNA, 22 nt, Human
gcauuuuaauuggggcaguuag

SEQ ID NO: 62143 - RNA, 22 nt, Human
gcugcagggagcuggaaggcuc

SEQ ID NO: 62144 - RNA, 22 nt, Human
gcugcaggaggugguagggucu

SEQ ID NO: 62145 - RNA, 22 nt, Human
gcugcucaaaaaaacacuagcu

SEQ ID NO: 62146 - RNA, 22 nt, Human
gcuggaaauaacuuguguagaa

SEQ ID NO: 62147 - RNA, 22 nt, Human
gcuggaagggccagcuuucagg

SEQ ID NO: 62148 - RNA, 22 nt, Human
gcuggauuuaggguucccuccu

SEQ ID NO: 62149 - RNA, 21 nt, Human
gcuggcugucucuuacacggu

SEQ ID NO: 62150 - RNA, 22 nt, Human
gcuggucuggcaauccucaugg

SEQ ID NO: 62151 - RNA, 22 nt, Human
ggaagcucaauacuuuccucuu

SEQ ID NO: 62152 - RNA, 22 nt, Human
ggaagcugucugcccggcgcuc

SEQ ID NO: 62153 - RNA, 22 nt, Human
ggaagcuguugugagugcagca

SEQ ID NO: 62154 - RNA, 22 nt, Human
gcugggagaggcagcuuucgga

SEQ ID NO: 62155 - RNA, 22 nt, Human
gcugggagucgcgucuguggcc

SEQ ID NO: 62156 - RNA, 22 nt, Human
ggaaguuugagcaucuguuucc

SEQ ID NO: 62157 - RNA, 22 nt, Human
ggaagguauuucuccuugagug

SEQ ID NO: 62158 - RNA, 22 nt, Human
ggaagucuacucuuccgaaaac

SEQ ID NO: 62159 - RNA, 22 nt, Human
ggaaggggagcuggaaagggua

SEQ ID NO: 62160 - RNA, 22 nt, Human
ggaaggugagugcugugugauu

SEQ ID NO: 62161 - RNA, 18 nt, Human
ggaaggugcuggagugca

SEQ ID NO: 62162 - RNA, 22 nt, Human
ggaauaaaaggagguggcgaga

SEQ ID NO: 62163 - RNA, 21 nt, Human
ggaauagcuuaaagugagggg

SEQ ID NO: 62164 - RNA, 22 nt, Human
ggaccucagccaucccucggag

SEQ ID NO: 62165 - RNA, 22 nt, Human
ggagaucucauugauacugaua

SEQ ID NO: 62166 - RNA, 22 nt, Human
ggagaucugggcuguuucuggc

SEQ ID NO: 62167 - RNA, 22 nt, Human
ggagcagaggaaagaguagcau

SEQ ID NO: 62168 - RNA, 18 nt, Human
ggagaagaacagaugugg

SEQ ID NO: 62169 - RNA, 22 nt, Human
ggagauaugugaaaaagacagc

SEQ ID NO: 62170 - RNA, 22 nt, Human
ggagcauggcuucuuggggcug

SEQ ID NO: 62171 - RNA, 22 nt, Human
ggagccucuaaacaguuaucaa

SEQ ID NO: 62172 - RNA, 22 nt, Human
ggauccuucagcacugaggugu

SEQ ID NO: 62173 - RNA, 22 nt, Human
ggaugaguuguauauaggauuc

SEQ ID NO: 62174 - RNA, 22 nt, Human
ggauuucuucucauaacugaga

SEQ ID NO: 62175 - RNA, 22 nt, Human
ggcaagcacugggugucuuagc

SEQ ID NO: 62176 - RNA, 22 nt, Human
ggcagaggagcuggaaacaugg

SEQ ID NO: 62177 - RNA, 22 nt, Human
ggcagaggaagcuggaaguggg

SEQ ID NO: 62178 - RNA, 21 nt, Human
ggcagagaagcuggaaguugg

SEQ ID NO: 62179 - RNA, 22 nt, Human
ggcaggaaguaaggaugcuaca

SEQ ID NO: 62180 - RNA, 22 nt, Human
gcuaagcuuugagucuggacag

SEQ ID NO: 62181 - RNA, 22 nt, Human
gcuauuggcuaauuguugcaac

SEQ ID NO: 62182 - RNA, 22 nt, Human
gcuacaggggucaguccuuugc

SEQ ID NO: 62183 - RNA, 22 nt, Human
gcuauuuagaaaggcuuggaga

SEQ ID NO: 62184 - RNA, 22 nt, Human
ggcaggauggagcagggcuaaa

SEQ ID NO: 62185 - RNA, 22 nt, Human
gcucaugggcccagagcagccc

SEQ ID NO: 62186 - RNA, 22 nt, Human
ggcagggaauucagagggaagg

SEQ ID NO: 62187 - RNA, 20 nt, Human
gcucaguggagaaaugcacc

SEQ ID NO: 62188 - RNA, 22 nt, Human
gcucuugcuuuuucuagaaaga

SEQ ID NO: 62189 - RNA, 22 nt, Human
gcucuucuaaguuuacccuucc

SEQ ID NO: 62190 - RNA, 23 nt, Human
gcugcagugaauguuguuguugu

SEQ ID NO: 62191 - RNA, 23 nt, Human
gcugccguuucccaucgugguga

SEQ ID NO: 62192 - RNA, 22 nt, Human
ggcccucucuacauguuagacg

SEQ ID NO: 62193 - RNA, 22 nt, Human
ggccugcuaccagcugugaccu

SEQ ID NO: 62194 - RNA, 23 nt, Human
ggccuuuuuaaccgcgagcgaca

SEQ ID NO: 62195 - RNA, 22 nt, Human
ggccuucuuuucaugucuuucg

SEQ ID NO: 62196 - RNA, 22 nt, Human
gcugcuggcuuccugcuguuuu

SEQ ID NO: 62197 - RNA, 22 nt, Human
ggcgcuccccgccugcgucgcg

SEQ ID NO: 62198 - RNA, 22 nt, Human
ggcucguaaaggccucacaggu

SEQ ID NO: 62199 - RNA, 22 nt, Human
gcugcuuagaaccauauuuaaa

SEQ ID NO: 62200 - RNA, 22 nt, Human
gcuggauaaggaucaguuucuu

SEQ ID NO: 62201 - RNA, 22 nt, Human
ggcugcaagacguuauuagcgu

SEQ ID NO: 62202 - RNA, 22 nt, Human
ggcugaugacgccugagucuga

SEQ ID NO: 62203 - RNA, 22 nt, Human
ggcugcuugggcuguuucuuuu

SEQ ID NO: 62204 - RNA, 22 nt, Human
ggcugcuugauagauaugagua

SEQ ID NO: 62205 - RNA, 22 nt, Human
gcuggugugagauucucgaggg

SEQ ID NO: 62206 - RNA, 19 nt, Human
gcugggauaggauguauuu

SEQ ID NO: 62207 - RNA, 22 nt, Human
gcuggguaguucuuguuuggga

SEQ ID NO: 62208 - RNA, 22 nt, Human
gcugguuucucucauugucagu

SEQ ID NO: 62209 - RNA, 22 nt, Human
ggcugguggcgggcagcacaga

SEQ ID NO: 62210 - RNA, 22 nt, Human
gcuguauaucuuuugaagugau

SEQ ID NO: 62211 - RNA, 22 nt, Human
gcugugacaagaggcugcuucu

SEQ ID NO: 62212 - RNA, 21 nt, Human
gcuguagauucacaaagaggu

SEQ ID NO: 62213 - RNA, 22 nt, Human
gcugucaggaacaugccuuggu

SEQ ID NO: 62214 - RNA, 22 nt, Human
gcuguaacuuuuucauuuucaa

SEQ ID NO: 62215 - RNA, 22 nt, Human
ggcugugggguccuguggugug

SEQ ID NO: 62216 - RNA, 22 nt, Human
ggcuucucuuggccaugguccc

SEQ ID NO: 62217 - RNA, 22 nt, Human
ggcuucaaaacacaugucaaga

SEQ ID NO: 62218 - RNA, 22 nt, Human
gcuguggacacagcucucuuca

SEQ ID NO: 62219 - RNA, 22 nt, Human
gcuguggcuccaauggugagcc

SEQ ID NO: 62220 - RNA, 22 nt, Human
gcuuuguugauggugagucugu

SEQ ID NO: 62221 - RNA, 22 nt, Human
gcuuuucaaguuacaauuagcu

SEQ ID NO: 62222 - RNA, 22 nt, Human
gcuuuugaauacuacaggaguu

SEQ ID NO: 62223 - RNA, 22 nt, Human
gggagcuggagcuggaagacuc

SEQ ID NO: 62224 - RNA, 22 nt, Human
gggcaagaggguuugacaugag

SEQ ID NO: 62225 - RNA, 22 nt, Human
ggaagugagcucauuacuuuag

SEQ ID NO: 62226 - RNA, 23 nt, Human
ggaauuucagaugugaaauaaaa

SEQ ID NO: 62227 - RNA, 22 nt, Human
ggacaauuguacucgauuucaa

SEQ ID NO: 62228 - RNA, 18 nt, Human
ggacaguuguagaggacu

SEQ ID NO: 62229 - RNA, 23 nt, Human
ggacaugucucuggguauuuuga

SEQ ID NO: 62230 - RNA, 22 nt, Human
ggacuuucuccugcacaaagug

SEQ ID NO: 62231 - RNA, 22 nt, Human
ggagaaacuaguuagauccaau

SEQ ID NO: 62232 - RNA, 22 nt, Human
ggggaagagagaagaaugaucu

SEQ ID NO: 62233 - RNA, 22 nt, Human
ggggaauaaacacuuugucacu

SEQ ID NO: 62234 - RNA, 22 nt, Human
ggggagaugauaagugcauuug

SEQ ID NO: 62235 - RNA, 22 nt, Human
ggagacagugacuuagagacug

SEQ ID NO: 62236 - RNA, 22 nt, Human
ggagagcuagugagcuggaggu

SEQ ID NO: 62237 - RNA, 22 nt, Human
ggagaugaaugugguaaaacug

SEQ ID NO: 62238 - RNA, 20 nt, Human
gggucuggcaucucucucug

SEQ ID NO: 62239 - RNA, 22 nt, Human
ggagggcuggacguacuagggc

SEQ ID NO: 62240 - RNA, 22 nt, Human
ggauaaaugaaggcauacagau

SEQ ID NO: 62241 - RNA, 22 nt, Human
gggucauugcgugacgcgagca

SEQ ID NO: 62242 - RNA, 22 nt, Human
gggucucucuucuuucugugaa

SEQ ID NO: 62243 - RNA, 22 nt, Human
gguagagagugaggaggggcuc

SEQ ID NO: 62244 - RNA, 20 nt, Human
ggauugaacuauuucucagc

SEQ ID NO: 62245 - RNA, 22 nt, Human
ggggcuccuguggcuauaugua

SEQ ID NO: 62246 - RNA, 22 nt, Human
ggauuugaugagacuaucuacu

SEQ ID NO: 62247 - RNA, 22 nt, Human
ggcaagauccagcacaaacaca

SEQ ID NO: 62248 - RNA, 22 nt, Human
ggcagggagagcaugcugauaa

SEQ ID NO: 62249 - RNA, 22 nt, Human
ggugcuggggaaauuaggguag

SEQ ID NO: 62250 - RNA, 22 nt, Human
ggugcugcugcugaacccagcu

SEQ ID NO: 62251 - RNA, 22 nt, Human
guaaggcaggagucuuaaaccu

SEQ ID NO: 62252 - RNA, 22 nt, Human
guaauucugugugaaucuauua

SEQ ID NO: 62253 - RNA, 22 nt, Human
guaccuguacauaacuacauau

SEQ ID NO: 62254 - RNA, 22 nt, Human
guacuacagguuugguaguggg

SEQ ID NO: 62255 - RNA, 22 nt, Human
guacauauccuuuacguuuugu

SEQ ID NO: 62256 - RNA, 22 nt, Human
gguuccagacaguuauaugggc

SEQ ID NO: 62257 - RNA, 22 nt, Human
gguguagggaaacuugacuaau

SEQ ID NO: 62258 - RNA, 22 nt, Human
ggugucaucugggcuggagaua

SEQ ID NO: 62259 - RNA, 22 nt, Human
guaggaguguucgggaacuggg

SEQ ID NO: 62260 - RNA, 22 nt, Human
guaggggccagaaagacuuaga

SEQ ID NO: 62261 - RNA, 22 nt, Human
guaguauuuucugaggacuggu

SEQ ID NO: 62262 - RNA, 22 nt, Human
guagucuuaggaaugauuuugu

SEQ ID NO: 62263 - RNA, 22 nt, Human
guagaaaauagauugucucuug

SEQ ID NO: 62264 - RNA, 22 nt, Human
guagagcagaaacauggagaaa

SEQ ID NO: 62265 - RNA, 22 nt, Human
guagagagugucuuccagaaau

SEQ ID NO: 62266 - RNA, 22 nt, Human
guagauaauuuuggaaagcugg

SEQ ID NO: 62267 - RNA, 22 nt, Human
guauaaagaugccauacuuacu

SEQ ID NO: 62268 - RNA, 22 nt, Human
guaguggaauuuagaguauaau

SEQ ID NO: 62269 - RNA, 22 nt, Human
guaguucuuucucaauguucaa

SEQ ID NO: 62270 - RNA, 22 nt, Human
guaguuuucaugguuagaaaua

SEQ ID NO: 62271 - RNA, 22 nt, Human
guaguuuuugagcuguaaucuu

SEQ ID NO: 62272 - RNA, 22 nt, Human
ggccugcucuggcuguggucag

SEQ ID NO: 62273 - RNA, 22 nt, Human
guggaagauauuucugguccag

SEQ ID NO: 62274 - RNA, 22 nt, Human
guggaaauaugggcaacaaaga

SEQ ID NO: 62275 - RNA, 22 nt, Human
guggaaauuuuaggaucaucuu

SEQ ID NO: 62276 - RNA, 22 nt, Human
guggacagacauaauccuaauu

SEQ ID NO: 62277 - RNA, 22 nt, Human
guggagaugagauauaccccuu

SEQ ID NO: 62278 - RNA, 22 nt, Human
guggagauauuugugauagggg

SEQ ID NO: 62279 - RNA, 22 nt, Human
guggagaucuggugcccccugg

SEQ ID NO: 62280 - RNA, 22 nt, Human
guggacuagaguaggaguugca

SEQ ID NO: 62281 - RNA, 22 nt, Human
guggagaaagcuggaaucugag

SEQ ID NO: 62282 - RNA, 22 nt, Human
guggauuucaggcuccccucag

SEQ ID NO: 62283 - RNA, 22 nt, Human
guggauuguaccacgaaaagug

SEQ ID NO: 62284 - RNA, 22 nt, Human
guggcagagccuugcggcuuug

SEQ ID NO: 62285 - RNA, 22 nt, Human
guggcagagagcaagugucuga

SEQ ID NO: 62286 - RNA, 22 nt, Human
gugggaguggagcucagcaugu

SEQ ID NO: 62287 - RNA, 22 nt, Human
guggcuuuguuuccaaaugaaa

SEQ ID NO: 62288 - RNA, 22 nt, Human
gugggagaaugggaggaguaau

SEQ ID NO: 62289 - RNA, 22 nt, Human
gugggauaaccugagauaacau

SEQ ID NO: 62290 - RNA, 22 nt, Human
guggugauuugggucuagcuuu

SEQ ID NO: 62291 - RNA, 20 nt, Human
gggcucugcauccaucagcc

SEQ ID NO: 62292 - RNA, 22 nt, Human
gugguuuagccuucauuaaccu

SEQ ID NO: 62293 - RNA, 22 nt, Human
gugucccaaagauuagaaauca

SEQ ID NO: 62294 - RNA, 22 nt, Human
gugucacuuucaggagcucuaa

SEQ ID NO: 62295 - RNA, 19 nt, Human
gggcucucugaauuuuuuu

SEQ ID NO: 62296 - RNA, 22 nt, Human
gugugaguggcuaagugugccu

SEQ ID NO: 62297 - RNA, 22 nt, Human
gggcucuuaauuuuuuucucua

SEQ ID NO: 62298 - RNA, 22 nt, Human
gggcuuuuccaacacucuggag

SEQ ID NO: 62299 - RNA, 22 nt, Human
guguuagagucuugugcucauu

SEQ ID NO: 62300 - RNA, 22 nt, Human
guguucuucacuguuagaaggu

SEQ ID NO: 62301 - RNA, 22 nt, Human
guguucuuuguagaggaucuug

SEQ ID NO: 62302 - RNA, 22 nt, Human
ggggaaauauuucugaccugug

SEQ ID NO: 62303 - RNA, 22 nt, Human
ggggaagaaauagaacauuuug

SEQ ID NO: 62304 - RNA, 22 nt, Human
gggcuuuuccauuccaggguuc

SEQ ID NO: 62305 - RNA, 22 nt, Human
guguugaugugucuguauucua

SEQ ID NO: 62306 - RNA, 22 nt, Human
ggggacuugguuuuaaugagcu

SEQ ID NO: 62307 - RNA, 22 nt, Human
ggggaauuaaaugagaagccuu

SEQ ID NO: 62308 - RNA, 22 nt, Human
ggggauuucccaaugcgaagca

SEQ ID NO: 62309 - RNA, 22 nt, Human
guuaaaugcagauucugacuca

SEQ ID NO: 62310 - RNA, 22 nt, Human
guuacagagcugcuaugugugc

SEQ ID NO: 62311 - RNA, 22 nt, Human
guuagaauggacaaagcugaaa

SEQ ID NO: 62312 - RNA, 22 nt, Human
ggggcggggagcaugagcuggg

SEQ ID NO: 62313 - RNA, 22 nt, Human
ggguauuugacaaacugacacu

SEQ ID NO: 62314 - RNA, 22 nt, Human
guuaucauccucagaggcaguu

SEQ ID NO: 62315 - RNA, 23 nt, Human
guuauugcuggugcuggccagcc

SEQ ID NO: 62316 - RNA, 22 nt, Human
guuauuguuauugcguugucga

SEQ ID NO: 62317 - RNA, 22 nt, Human
guuauuuugucuuguucaugaa

SEQ ID NO: 62318 - RNA, 22 nt, Human
ggggcguugccacggggacggg

SEQ ID NO: 62319 - RNA, 23 nt, Human
gggggagcuggacuccuagaucc

SEQ ID NO: 62320 - RNA, 17 nt, Human
guucucaaacugacuga

SEQ ID NO: 62321 - RNA, 22 nt, Human
guucccuugccuuuaguuugau

SEQ ID NO: 62322 - RNA, 22 nt, Human
guucagauucuuucucuuucac

SEQ ID NO: 62323 - RNA, 22 nt, Human
guucuguauauauccuagcaaa

SEQ ID NO: 62324 - RNA, 22 nt, Human
guucuguuguugaucuuuggag

SEQ ID NO: 62325 - RNA, 22 nt, Human
ggguggcaagucuuucugcaac

SEQ ID NO: 62326 - RNA, 22 nt, Human
gggugcuucauaggugaugcug

SEQ ID NO: 62327 - RNA, 22 nt, Human
ggguggaaugugagugugugug

SEQ ID NO: 62328 - RNA, 22 nt, Human
guucucauugugaugcuuaguu

SEQ ID NO: 62329 - RNA, 22 nt, Human
guucuucagauuccauuucagu

SEQ ID NO: 62330 - RNA, 22 nt, Human
guucuuagguacucauauuuaa

SEQ ID NO: 62331 - RNA, 22 nt, Human
guugauauggaaacucuagguu

SEQ ID NO: 62332 - RNA, 22 nt, Human
guugagaggccuggcucuuuuc

SEQ ID NO: 62333 - RNA, 22 nt, Human
gguaauguucugaugaauuugu

SEQ ID NO: 62334 - RNA, 22 nt, Human
gguaaucuccucauugacguua

SEQ ID NO: 62335 - RNA, 22 nt, Human
gguagauacaaaaagauugugg

SEQ ID NO: 62336 - RNA, 22 nt, Human
guucuucucuuguaauggaauc

SEQ ID NO: 62337 - RNA, 22 nt, Human
ggguucauuugccggguaguuu

SEQ ID NO: 62338 - RNA, 22 nt, Human
gguggagacucagauuuguugc

SEQ ID NO: 62339 - RNA, 22 nt, Human
gguauccaaauaaagcagguaa

SEQ ID NO: 62340 - RNA, 22 nt, Human
guuuuguagucuggagacuguc

SEQ ID NO: 62341 - RNA, 22 nt, Human
guuuuguucaugaacauugggu

SEQ ID NO: 62342 - RNA, 22 nt, Human
guuuugaagagaagcaagucug

SEQ ID NO: 62343 - RNA, 22 nt, Human
guuuugauggaguguguuaaau

SEQ ID NO: 62344 - RNA, 22 nt, Human
guuuucuuguuaauuuugaacg

SEQ ID NO: 62345 - RNA, 22 nt, Human
guuuuauguuuuauagacacaa

SEQ ID NO: 62346 - RNA, 22 nt, Human
guuuucuccugcuauacagugc

SEQ ID NO: 62347 - RNA, 22 nt, Human
uaaagcauguuucaguaagguu

SEQ ID NO: 62348 - RNA, 22 nt, Human
uaaaugagcaccucuaguuuug

SEQ ID NO: 62349 - RNA, 22 nt, Human
uaaaugauaguauugaagguag

SEQ ID NO: 62350 - RNA, 22 nt, Human
uaaauguacugaggcaacagga

SEQ ID NO: 62351 - RNA, 22 nt, Human
uaaauguugcuugugcugcuca

SEQ ID NO: 62352 - RNA, 22 nt, Human
guaaauaucucacgaaugauuc

SEQ ID NO: 62353 - RNA, 22 nt, Human
uaaagacaauuucgagcuguag

SEQ ID NO: 62354 - RNA, 22 nt, Human
guuuuuaguuuaaguuuuugca

SEQ ID NO: 62355 - RNA, 22 nt, Human
guuuuuacuuccaaugcuauga

SEQ ID NO: 62356 - RNA, 22 nt, Human
gguugaagcuacuuucuggaug

SEQ ID NO: 62357 - RNA, 22 nt, Human
gguuauuucugauuauaugaua

SEQ ID NO: 62358 - RNA, 22 nt, Human
gguugccuuugcaguuggauca

SEQ ID NO: 62359 - RNA, 22 nt, Human
guaggaaaugaauaagguaccu

SEQ ID NO: 62360 - RNA, 22 nt, Human
uaaauuugugaauuagcuauca

SEQ ID NO: 62361 - RNA, 23 nt, Human
uaacacaguccuggucuuuggcc

SEQ ID NO: 62362 - RNA, 22 nt, Human
guaaugcuuuuauuucggggaa

SEQ ID NO: 62363 - RNA, 22 nt, Human
guaguuuuucuugcaagaguag

SEQ ID NO: 62364 - RNA, 22 nt, Human
uaagaaacauuuuuaugacagu

SEQ ID NO: 62365 - RNA, 21 nt, Human
guaucuuucuuuuaaaauauc

SEQ ID NO: 62366 - RNA, 22 nt, Human
guaugaguggauagauguaucu

SEQ ID NO: 62367 - RNA, 22 nt, Human
uaagagauuuauugaggacuuc

SEQ ID NO: 62368 - RNA, 22 nt, Human
guagucauugggucugugguca

SEQ ID NO: 62369 - RNA, 22 nt, Human
guauuaugaaugccgaggcggc

SEQ ID NO: 62370 - RNA, 22 nt, Human
guauuugcaaucacaaacaaaa

SEQ ID NO: 62371 - RNA, 22 nt, Human
gucaaugcuuaguuugccugaa

SEQ ID NO: 62372 - RNA, 22 nt, Human
gucaagaugcuacauaauggga

SEQ ID NO: 62373 - RNA, 22 nt, Human
uaaggaaaugcaaauuuaagaa

SEQ ID NO: 62374 - RNA, 22 nt, Human
uaagcuauuccugaagaagguu

SEQ ID NO: 62375 - RNA, 22 nt, Human
gucacuguuucacuguucauua

SEQ ID NO: 62376 - RNA, 22 nt, Human
gucugcagcacugugcacgguc

SEQ ID NO: 62377 - RNA, 20 nt, Human
uacaauauucccacuuugcu

SEQ ID NO: 62378 - RNA, 22 nt, Human
gucuccugcccacccugguccc

SEQ ID NO: 62379 - RNA, 22 nt, Human
gucugaaauaucuuuugucuug

SEQ ID NO: 62380 - RNA, 22 nt, Human
uacaaauuguuuugccacaaag

SEQ ID NO: 62381 - RNA, 22 nt, Human
uacaaaugaucaucucuuugaa

SEQ ID NO: 62382 - RNA, 22 nt, Human
uacaguauuuuuuaagaaaaaa

SEQ ID NO: 62383 - RNA, 22 nt, Human
uacauaauagcaaggugcuguc

SEQ ID NO: 62384 - RNA, 20 nt, Human
uaccaucauuggcaaaccuc

SEQ ID NO: 62385 - RNA, 22 nt, Human
uacucucuuccauacaaucugu

SEQ ID NO: 62386 - RNA, 22 nt, Human
uacucgaaaucagagagaauaa

SEQ ID NO: 62387 - RNA, 22 nt, Human
uacugaagaugccaucacaagc

SEQ ID NO: 62388 - RNA, 22 nt, Human
uacugaauuacugcugguaaau

SEQ ID NO: 62389 - RNA, 22 nt, Human
uacuuaauuuuaaaagcuagau

SEQ ID NO: 62390 - RNA, 22 nt, Human
uacuuacacugaagcaaagaua

SEQ ID NO: 62391 - RNA, 22 nt, Human
uagagcucaagaagcaaaagcu

SEQ ID NO: 62392 - RNA, 19 nt, Human
uagagcagcuucagauucc

SEQ ID NO: 62393 - RNA, 22 nt, Human
uagagauagccaaguccuucaa

SEQ ID NO: 62394 - RNA, 19 nt, Human
uagaggagaauggcaaaga

SEQ ID NO: 62395 - RNA, 22 nt, Human
gugauuucaaauauagagugag

SEQ ID NO: 62396 - RNA, 22 nt, Human
gugauuucagguuuuucauacu

SEQ ID NO: 62397 - RNA, 22 nt, Human
gugauucaucuggggccuuauu

SEQ ID NO: 62398 - RNA, 22 nt, Human
uagaggauucuaaaggaagcug

SEQ ID NO: 62399 - RNA, 22 nt, Human
uagagaaauauuuguagugcug

SEQ ID NO: 62400 - RNA, 22 nt, Human
uagacugugagcuccuugaggg

SEQ ID NO: 62401 - RNA, 22 nt, Human
uagacauuuacuuugaaaaaau

SEQ ID NO: 62402 - RNA, 22 nt, Human
gugauaguucuuacuccaaagu

SEQ ID NO: 62403 - RNA, 22 nt, Human
gugcagcugggcgcugaccuuc

SEQ ID NO: 62404 - RNA, 22 nt, Human
uagaguaagugugugcugagcu

SEQ ID NO: 62405 - RNA, 19 nt, Human
uagauuagagcauaggguu

SEQ ID NO: 62406 - RNA, 22 nt, Human
gugcauauguguguauacaaac

SEQ ID NO: 62407 - RNA, 22 nt, Human
uagaugaacagaaagccacugu

SEQ ID NO: 62408 - RNA, 22 nt, Human
uagaugcugagcuuaagagaau

SEQ ID NO: 62409 - RNA, 20 nt, Human
uagcacagacuuuugcuuac

SEQ ID NO: 62410 - RNA, 22 nt, Human
gugccuaaugacccauuuaucc

SEQ ID NO: 62411 - RNA, 22 nt, Human
gugccucuaguuuucuccuaaa

SEQ ID NO: 62412 - RNA, 22 nt, Human
uagcaggagagaaguuuuaagu

SEQ ID NO: 62413 - RNA, 22 nt, Human
uagcagcacuauuuguuguagu

SEQ ID NO: 62414 - RNA, 22 nt, Human
uagcauaaaguuucuguguggu

SEQ ID NO: 62415 - RNA, 22 nt, Human
uaguuagagggaagcgacucgg

SEQ ID NO: 62416 - RNA, 22 nt, Human
uaguugaauuuaucaguagcau

SEQ ID NO: 62417 - RNA, 22 nt, Human
uaguuuucaagugaguuggaag

SEQ ID NO: 62418 - RNA, 22 nt, Human
uaguuuucuuuuguguuauucu

SEQ ID NO: 62419 - RNA, 22 nt, Human
uagcauuuauugggcuagcaaa

SEQ ID NO: 62420 - RNA, 22 nt, Human
uagcauuucacugaucuucacu

SEQ ID NO: 62421 - RNA, 22 nt, Human
uaguuacuuuugcucuucauua

SEQ ID NO: 62422 - RNA, 22 nt, Human
uauagcaagagaaccauuacca

SEQ ID NO: 62423 - RNA, 22 nt, Human
uauagcccaaucuggaugcagu

SEQ ID NO: 62424 - RNA, 22 nt, Human
uauaagaaacaaggcaaauuuu

SEQ ID NO: 62425 - RNA, 22 nt, Human
uauauguagcucaaaaauuccc

SEQ ID NO: 62426 - RNA, 22 nt, Human
uauaugcagauuuucaucaucg

SEQ ID NO: 62427 - RNA, 19 nt, Human
uaucccccauagcagugcg

SEQ ID NO: 62428 - RNA, 22 nt, Human
uaucuccauucuagccccuugu

SEQ ID NO: 62429 - RNA, 22 nt, Human
uaucugcuggagguaauuacuc

SEQ ID NO: 62430 - RNA, 22 nt, Human
uaucuguauuguagaacuguug

SEQ ID NO: 62431 - RNA, 22 nt, Human
uaucuuagaagaaaugggucca

SEQ ID NO: 62432 - RNA, 22 nt, Human
gugucauuggcuucccaagucc

SEQ ID NO: 62433 - RNA, 22 nt, Human
guguccaaagguaggaggaggg

SEQ ID NO: 62434 - RNA, 19 nt, Human
uaugacaaguacuaguucu

SEQ ID NO: 62435 - RNA, 22 nt, Human
uaugacccccugcacaugugac

SEQ ID NO: 62436 - RNA, 22 nt, Human
uaugagguuaucuaugucguau

SEQ ID NO: 62437 - RNA, 22 nt, Human
uaugaucuuaggauggaacuuc

SEQ ID NO: 62438 - RNA, 22 nt, Human
uaugcagauaguuugccauuca

SEQ ID NO: 62439 - RNA, 22 nt, Human
gugugucucaguugcuccgaag

SEQ ID NO: 62440 - RNA, 22 nt, Human
guugauaauuaauagcuuuuga

SEQ ID NO: 62441 - RNA, 22 nt, Human
guugauuuaaccucaccuuuga

SEQ ID NO: 62442 - RNA, 22 nt, Human
uauuuugaggugaaagaguuug

SEQ ID NO: 62443 - RNA, 22 nt, Human
uauuuuggaugcauugagaugc

SEQ ID NO: 62444 - RNA, 22 nt, Human
guugagaaucucuagcuuagga

SEQ ID NO: 62445 - RNA, 22 nt, Human
uauuugauggaacucuugcuuu

SEQ ID NO: 62446 - RNA, 18 nt, Human
uauuugugugugugugug

SEQ ID NO: 62447 - RNA, 22 nt, Human
uauuuguuucuaguggcagcaa

SEQ ID NO: 62448 - RNA, 22 nt, Human
uauuucaguuaagaugagguca

SEQ ID NO: 62449 - RNA, 20 nt, Human
uauuucaaugugccaaguuu

SEQ ID NO: 62450 - RNA, 22 nt, Human
uauuuaggcagaaagugauauu

SEQ ID NO: 62451 - RNA, 18 nt, Human
uauuuacuguguguuacc

SEQ ID NO: 62452 - RNA, 22 nt, Human
guucuacaugacacucaacauu

SEQ ID NO: 62453 - RNA, 22 nt, Human
uauugaucuuugaaaccuuggu

SEQ ID NO: 62454 - RNA, 22 nt, Human
guuccuauauagccuuaaggau

SEQ ID NO: 62455 - RNA, 22 nt, Human
guuccucugaaggauuuucaga

SEQ ID NO: 62456 - RNA, 22 nt, Human
uauuguauuagcucuuggagau

SEQ ID NO: 62457 - RNA, 22 nt, Human
uauuguuuuaagguguauuaau

SEQ ID NO: 62458 - RNA, 22 nt, Human
uauggcuucucagucaugaaaa

SEQ ID NO: 62459 - RNA, 22 nt, Human
uaugggaaggauuugucuuuca

SEQ ID NO: 62460 - RNA, 22 nt, Human
uaugguuagugcuguagauuau

SEQ ID NO: 62461 - RNA, 22 nt, Human
guguguggacgucugagcccag

SEQ ID NO: 62462 - RNA, 22 nt, Human
uaugguuucuccugcagauuug

SEQ ID NO: 62463 - RNA, 23 nt, Human
guuaccgaccugauucggcagcc

SEQ ID NO: 62464 - RNA, 18 nt, Human
uaugugucuguuacaacu

SEQ ID NO: 62465 - RNA, 22 nt, Human
uauuaauugugguuauuguauu

SEQ ID NO: 62466 - RNA, 21 nt, Human
uauucgcauuucugucuuuac

SEQ ID NO: 62467 - RNA, 22 nt, Human
uauucuucaacuuuucuccucu

SEQ ID NO: 62468 - RNA, 22 nt, Human
ucaaggaagggguaggaauaau

SEQ ID NO: 62469 - RNA, 22 nt, Human
guuguuuucagcccagcauuag

SEQ ID NO: 62470 - RNA, 22 nt, Human
guugauuuaggguuuugguuuu

SEQ ID NO: 62471 - RNA, 22 nt, Human
guugcaaaugggaagaugguua

SEQ ID NO: 62472 - RNA, 22 nt, Human
guugucuggcucugaccauucu

SEQ ID NO: 62473 - RNA, 22 nt, Human
ucacagauguuauccugaggau

SEQ ID NO: 62474 - RNA, 21 nt, Human
ucacagggucacucuuaccac

SEQ ID NO: 62475 - RNA, 22 nt, Human
ucacaguucaacuaguucagau

SEQ ID NO: 62476 - RNA, 22 nt, Human
ucaauuggcuacaaauaaugua

SEQ ID NO: 62477 - RNA, 22 nt, Human
guuuauuucuuaucaucacuau

SEQ ID NO: 62478 - RNA, 22 nt, Human
guuuggguggcuagagaaagaa

SEQ ID NO: 62479 - RNA, 22 nt, Human
ucacuucuaugaucugucucuu

SEQ ID NO: 62480 - RNA, 22 nt, Human
ucacuggaaaacaaauguuuua

SEQ ID NO: 62481 - RNA, 22 nt, Human
ucacuguugccacggugauaau

SEQ ID NO: 62482 - RNA, 22 nt, Human
ucacuguuucaccgucugaagg

SEQ ID NO: 62483 - RNA, 22 nt, Human
ucacuaugcccagaauacaguu

SEQ ID NO: 62484 - RNA, 22 nt, Human
ucacucgccuuuucguucgccg

SEQ ID NO: 62485 - RNA, 22 nt, Human
ucaccuguucaacagcaauaau

SEQ ID NO: 62486 - RNA, 22 nt, Human
ucaccuguuggauguauacugu

SEQ ID NO: 62487 - RNA, 22 nt, Human
ucacucuuuaucuuuuaugucu

SEQ ID NO: 62488 - RNA, 23 nt, Human
ucacugccaagaaaaguuacaga

SEQ ID NO: 62489 - RNA, 22 nt, Human
ucagagaaguaggcuaauggug

SEQ ID NO: 62490 - RNA, 22 nt, Human
ucagauaauccaauagagagga

SEQ ID NO: 62491 - RNA, 22 nt, Human
guuuuucuuugauuuagaacca

SEQ ID NO: 62492 - RNA, 22 nt, Human
guuuuucuagaaaucuccuccu

SEQ ID NO: 62493 - RNA, 22 nt, Human
guuuugaugugauuucucaugu

SEQ ID NO: 62494 - RNA, 22 nt, Human
guuuguguauauguguauuuuu

SEQ ID NO: 62495 - RNA, 22 nt, Human
guuuuaaucuccuuauuccuaa

SEQ ID NO: 62496 - RNA, 22 nt, Human
guuuuagugauaagaacaccaa

SEQ ID NO: 62497 - RNA, 22 nt, Human
guuuuaucuauguaauuauaaa

SEQ ID NO: 62498 - RNA, 22 nt, Human
ucagaacuaacuuugcugaacc

SEQ ID NO: 62499 - RNA, 22 nt, Human
ucagaaggagagacagcgugga

SEQ ID NO: 62500 - RNA, 22 nt, Human
guuuucuaaaacacauauaagu

SEQ ID NO: 62501 - RNA, 22 nt, Human
uaaaaauuagauauguauuuag

SEQ ID NO: 62502 - RNA, 22 nt, Human
uaaaacuaugcaaccuacuacc

SEQ ID NO: 62503 - RNA, 22 nt, Human
uaaaaugcucagauaaauauau

SEQ ID NO: 62504 - RNA, 22 nt, Human
uaaacgaagcuucaugcuugaa

SEQ ID NO: 62505 - RNA, 22 nt, Human
uaaagaagaaaaggcuucaggc

SEQ ID NO: 62506 - RNA, 21 nt, Human
ucaggaagagccaguucaugc

SEQ ID NO: 62507 - RNA, 22 nt, Human
ucagcucucucuuggugaucuc

SEQ ID NO: 62508 - RNA, 20 nt, Human
uacaaggauguucaucagag

SEQ ID NO: 62509 - RNA, 22 nt, Human
uaauggagggucugagucuggg

SEQ ID NO: 62510 - RNA, 22 nt, Human
uaauuauuaauuuuagguugcu

SEQ ID NO: 62511 - RNA, 22 nt, Human
uaauuccacacucccgcaagcg

SEQ ID NO: 62512 - RNA, 22 nt, Human
uaauucuucaauccaguguuca

SEQ ID NO: 62513 - RNA, 22 nt, Human
uacaaauugccugacggcaggu

SEQ ID NO: 62514 - RNA, 22 nt, Human
uaaugaugaacacuuggaagaa

SEQ ID NO: 62515 - RNA, 22 nt, Human
uaauccaaaccaggaauucccu

SEQ ID NO: 62516 - RNA, 23 nt, Human
ucauugcucaagauaaugguuga

SEQ ID NO: 62517 - RNA, 22 nt, Human
uaauagauagggagaguugcug

SEQ ID NO: 62518 - RNA, 22 nt, Human
uaauaaaaauuuaauucacauu

SEQ ID NO: 62519 - RNA, 22 nt, Human
uaagauauugagugguaauuug

SEQ ID NO: 62520 - RNA, 22 nt, Human
uaagauuuuuacaaauagagug

SEQ ID NO: 62521 - RNA, 22 nt, Human
uaagagcagacacaaccugaga

SEQ ID NO: 62522 - RNA, 22 nt, Human
uaaagaggagaauuaagucagc

SEQ ID NO: 62523 - RNA, 23 nt, Human
uaaagauaguuuaaaggugaguu

SEQ ID NO: 62524 - RNA, 22 nt, Human
ucaggacacuuaauaggaacag

SEQ ID NO: 62525 - RNA, 22 nt, Human
uaacuuuuuauccuguuaaaug

SEQ ID NO: 62526 - RNA, 22 nt, Human
uaagaaaggggaaguuccucuu

SEQ ID NO: 62527 - RNA, 22 nt, Human
ucauccucguccucuggugccc

SEQ ID NO: 62528 - RNA, 22 nt, Human
uaagcacuuuauaugcuuuauc

SEQ ID NO: 62529 - RNA, 22 nt, Human
uaagcguuugggaguuaugaac

SEQ ID NO: 62530 - RNA, 22 nt, Human
ucaucuuucuuuauggaaauac

SEQ ID NO: 62531 - RNA, 22 nt, Human
uaaguaauugugguuuuugcca

SEQ ID NO: 62532 - RNA, 22 nt, Human
uaagggaagucuucaggagaca

SEQ ID NO: 62533 - RNA, 22 nt, Human
uaaggcuuuggucaccauggag

SEQ ID NO: 62534 - RNA, 22 nt, Human
ucaucccuuccugcacuauuag

SEQ ID NO: 62535 - RNA, 22 nt, Human
uccacagggaugccugcggcuu

SEQ ID NO: 62536 - RNA, 22 nt, Human
uacagauaaaaaugcuguucuu

SEQ ID NO: 62537 - RNA, 22 nt, Human
uacaccuuaagccgcggcuccc

SEQ ID NO: 62538 - RNA, 22 nt, Human
uacagucauaagguuucucucc

SEQ ID NO: 62539 - RNA, 22 nt, Human
uacauagaauauauaaaugucg

SEQ ID NO: 62540 - RNA, 22 nt, Human
uccagaaagccguugacuuauu

SEQ ID NO: 62541 - RNA, 20 nt, Human
uaccagggguuugggacagc

SEQ ID NO: 62542 - RNA, 22 nt, Human
uccacuaucugagcuuaguugc

SEQ ID NO: 62543 - RNA, 22 nt, Human
uccagguucaguucaucaucua

SEQ ID NO: 62544 - RNA, 22 nt, Human
uccauacuggccucuuucccag

SEQ ID NO: 62545 - RNA, 22 nt, Human
uacuauuuugacaugaaauuga

SEQ ID NO: 62546 - RNA, 22 nt, Human
uccagguuuggcuuuauaacuu

SEQ ID NO: 62547 - RNA, 22 nt, Human
uacucuggaguugagaugcgag

SEQ ID NO: 62548 - RNA, 22 nt, Human
uacugaaagagugguggacucu

SEQ ID NO: 62549 - RNA, 22 nt, Human
uccauugucaauaguauugauu

SEQ ID NO: 62550 - RNA, 22 nt, Human
ucccaaaacuugaagcaagccu

SEQ ID NO: 62551 - RNA, 22 nt, Human
uacuuaaaacacauuuagcauu

SEQ ID NO: 62552 - RNA, 23 nt, Human
ucccaacuuugaaauauuccaca

SEQ ID NO: 62553 - RNA, 22 nt, Human
uacuucaguuacaugaagguau

SEQ ID NO: 62554 - RNA, 22 nt, Human
uagaaugggaggggaaucaucc

SEQ ID NO: 62555 - RNA, 19 nt, Human
uagacagauuuguguuacu

SEQ ID NO: 62556 - RNA, 17 nt, Human
uccuacaggugugcuga

SEQ ID NO: 62557 - RNA, 22 nt, Human
uagaagagcuuccaccuggggc

SEQ ID NO: 62558 - RNA, 22 nt, Human
uagaagaugccuuaaaguugaa

SEQ ID NO: 62559 - RNA, 22 nt, Human
uagaaguuaaaggaauacagaa

SEQ ID NO: 62560 - RNA, 22 nt, Human
uccucaaauccuagccucaucg

SEQ ID NO: 62561 - RNA, 22 nt, Human
uccucacaugcaaaaugguauu

SEQ ID NO: 62562 - RNA, 22 nt, Human
uccucugagguccucucggcca

SEQ ID NO: 62563 - RNA, 22 nt, Human
uagagaaauuacagcuuucuuu

SEQ ID NO: 62564 - RNA, 22 nt, Human
uagagagaaaccaggguuuggg

SEQ ID NO: 62565 - RNA, 22 nt, Human
uagauuuaaaaagggugggaug

SEQ ID NO: 62566 - RNA, 22 nt, Human
uccugagaagcacuuaauacac

SEQ ID NO: 62567 - RNA, 22 nt, Human
uagcaggaggcaguuccucgcu

SEQ ID NO: 62568 - RNA, 22 nt, Human
uagcauuuagaacaccuugaga

SEQ ID NO: 62569 - RNA, 22 nt, Human
uagcgggucacccugcugugaa

SEQ ID NO: 62570 - RNA, 22 nt, Human
uagccucuggaauccuuucucu

SEQ ID NO: 62571 - RNA, 22 nt, Human
uccuuuggaaacuggaugucuu

SEQ ID NO: 62572 - RNA, 22 nt, Human
uagcguaugcugugugaugaau

SEQ ID NO: 62573 - RNA, 22 nt, Human
uagcuucccagcuaaccauguc

SEQ ID NO: 62574 - RNA, 22 nt, Human
uccuuggagaaucuuguuuuac

SEQ ID NO: 62575 - RNA, 22 nt, Human
uccuuguuggaauauccuuacc

SEQ ID NO: 62576 - RNA, 22 nt, Human
uccuuguucugauuuuucuggg

SEQ ID NO: 62577 - RNA, 22 nt, Human
ucgagcacaccagacuugcaga

SEQ ID NO: 62578 - RNA, 22 nt, Human
ucgagauguuuguuguggugau

SEQ ID NO: 62579 - RNA, 22 nt, Human
uccuuuuuagguuauuguacau

SEQ ID NO: 62580 - RNA, 22 nt, Human
ucgccauguacaugaagggcgg

SEQ ID NO: 62581 - RNA, 22 nt, Human
uaggcaaguggaccagagguuu

SEQ ID NO: 62582 - RNA, 22 nt, Human
ucgaugcuggcgcagguuucac

SEQ ID NO: 62583 - RNA, 22 nt, Human
uaggcuuuguuacuuucccuuu

SEQ ID NO: 62584 - RNA, 22 nt, Human
uaggcaauauuagacuuugucu

SEQ ID NO: 62585 - RNA, 22 nt, Human
ucgcuguguccuuuucacuuau

SEQ ID NO: 62586 - RNA, 22 nt, Human
ucguauucagugcaagucaacg

SEQ ID NO: 62587 - RNA, 22 nt, Human
uaggucugaggcugcaucuugg

SEQ ID NO: 62588 - RNA, 22 nt, Human
uaggucuuggagguggggcugg

SEQ ID NO: 62589 - RNA, 22 nt, Human
uagguggaaccauaugaaauuu

SEQ ID NO: 62590 - RNA, 22 nt, Human
uagguuuugugucagaguagaa

SEQ ID NO: 62591 - RNA, 22 nt, Human
uaguagcuguuguuuuuuaaac

SEQ ID NO: 62592 - RNA, 22 nt, Human
uaguauuuguaauuaucaaagc

SEQ ID NO: 62593 - RNA, 22 nt, Human
ucguuucuuuuucuucccugga

SEQ ID NO: 62594 - RNA, 22 nt, Human
ucuaaggacauuggcuuuggag

SEQ ID NO: 62595 - RNA, 22 nt, Human
ucuaauagauuuggaguggaaa

SEQ ID NO: 62596 - RNA, 22 nt, Human
uagugauuuaagaaaggugacu

SEQ ID NO: 62597 - RNA, 22 nt, Human
uagugcuuaaaacagaauuuuc

SEQ ID NO: 62598 - RNA, 22 nt, Human
ucuaccuucagaaugugggguu

SEQ ID NO: 62599 - RNA, 22 nt, Human
ucuuccauuccccuccuacgcc

SEQ ID NO: 62600 - RNA, 21 nt, Human
ucuagaugggaugaaaggugc

SEQ ID NO: 62601 - RNA, 22 nt, Human
ucuagcccucauggcugaaggc

SEQ ID NO: 62602 - RNA, 22 nt, Human
ucuuccucuccuggggcauuug

SEQ ID NO: 62603 - RNA, 22 nt, Human
uauugucuuuuucuuccaccug

SEQ ID NO: 62604 - RNA, 22 nt, Human
ucuucuuugugguugcccaagg

SEQ ID NO: 62605 - RNA, 22 nt, Human
ucuucuuauuuuaugaucgcuu

SEQ ID NO: 62606 - RNA, 22 nt, Human
ucuugccuuuucuagcuucuag

SEQ ID NO: 62607 - RNA, 19 nt, Human
ucuugcaucuuccuacugu

SEQ ID NO: 62608 - RNA, 22 nt, Human
ucuugcuguagcuguuucuucu

SEQ ID NO: 62609 - RNA, 22 nt, Human
ucuugcuggagucaaggcuaca

SEQ ID NO: 62610 - RNA, 22 nt, Human
ucuucuuacauuaaguugaaac

SEQ ID NO: 62611 - RNA, 22 nt, Human
uauucuucagcauaaaaauucu

SEQ ID NO: 62612 - RNA, 22 nt, Human
uauugauuuuguugcuaccugg

SEQ ID NO: 62613 - RNA, 22 nt, Human
uauuggcucagucagaaguuuu

SEQ ID NO: 62614 - RNA, 22 nt, Human
uauugguagauggagagagaca

SEQ ID NO: 62615 - RNA, 22 nt, Human
ucuuguuaaagguuaaagguga

SEQ ID NO: 62616 - RNA, 22 nt, Human
ucuuggcaguucuugugcuuuu

SEQ ID NO: 62617 - RNA, 22 nt, Human
ucuuuaaauucuuaugagugaa

SEQ ID NO: 62618 - RNA, 22 nt, Human
ucuuuaaggggccuuuguguca

SEQ ID NO: 62619 - RNA, 22 nt, Human
ucuuuaagugugugccuccagg

SEQ ID NO: 62620 - RNA, 22 nt, Human
ucuuuccagaccagccccagcu

SEQ ID NO: 62621 - RNA, 22 nt, Human
ucuuucucuccagccuggaccu

SEQ ID NO: 62622 - RNA, 22 nt, Human
ucuuuguuagucagaauugauc

SEQ ID NO: 62623 - RNA, 19 nt, Human
ucuuugcuuuucuaagagg

SEQ ID NO: 62624 - RNA, 22 nt, Human
uauuuaugcaucacuuuuuucc

SEQ ID NO: 62625 - RNA, 22 nt, Human
ucuuugcagaauuuaacuuugc

SEQ ID NO: 62626 - RNA, 22 nt, Human
uauuuacuuugaggaaguuguu

SEQ ID NO: 62627 - RNA, 22 nt, Human
uauugugaaggccaugugcuaa

SEQ ID NO: 62628 - RNA, 22 nt, Human
uauuuaaagucagcaacuuuuc

SEQ ID NO: 62629 - RNA, 22 nt, Human
uauuuacgcaaacaauugugca

SEQ ID NO: 62630 - RNA, 22 nt, Human
ucuuuugugauuuucugaagca

SEQ ID NO: 62631 - RNA, 22 nt, Human
ucuuuugaacauccaggauguc

SEQ ID NO: 62632 - RNA, 22 nt, Human
ucuuuuaucuguuguguaacaa

SEQ ID NO: 62633 - RNA, 22 nt, Human
uauuucaucugaacuucccaac

SEQ ID NO: 62634 - RNA, 22 nt, Human
uauuuccugcguuucugugagc

SEQ ID NO: 62635 - RNA, 22 nt, Human
uauuucuagggcaugaaaauaa

SEQ ID NO: 62636 - RNA, 22 nt, Human
uauuuguuuuuaaugcugggug

SEQ ID NO: 62637 - RNA, 22 nt, Human
ucuuuuuaugucaaaaucgaug

SEQ ID NO: 62638 - RNA, 22 nt, Human
uauuuguauugucuuaucacuu

SEQ ID NO: 62639 - RNA, 22 nt, Human
uauuuuggcuccugagcucuga

SEQ ID NO: 62640 - RNA, 23 nt, Human
uauuuuccccuguaauauguauu

SEQ ID NO: 62641 - RNA, 22 nt, Human
ugaaaugccucuuugguucuaa

SEQ ID NO: 62642 - RNA, 22 nt, Human
ugaaauguggagaugguaagua

SEQ ID NO: 62643 - RNA, 22 nt, Human
ugaaauugaguaccucuuuaua

SEQ ID NO: 62644 - RNA, 22 nt, Human
ugaaaaaugcuuuaaugcaugu

SEQ ID NO: 62645 - RNA, 22 nt, Human
uauuuuuaccuaauuuaugaga

SEQ ID NO: 62646 - RNA, 22 nt, Human
uauuuuuacuguuugaugauuc

SEQ ID NO: 62647 - RNA, 22 nt, Human
ugaagacaguuuuacucaugag

SEQ ID NO: 62648 - RNA, 22 nt, Human
uauuuuucacagauuggugcuu

SEQ ID NO: 62649 - RNA, 22 nt, Human
uauuuuuuuaacauuuauugua

SEQ ID NO: 62650 - RNA, 22 nt, Human
ucaaaaauaagauauucuggac

SEQ ID NO: 62651 - RNA, 22 nt, Human
ucaaaucuuuuuuccuucccug

SEQ ID NO: 62652 - RNA, 22 nt, Human
ugaagccaugcuaaauguuaca

SEQ ID NO: 62653 - RNA, 22 nt, Human
ucaagaagauaaugucuagggu

SEQ ID NO: 62654 - RNA, 22 nt, Human
ucaacagaagugauagcuauua

SEQ ID NO: 62655 - RNA, 22 nt, Human
ucaagagauauaugcugguuua

SEQ ID NO: 62656 - RNA, 22 nt, Human
ugaaggccagggauuugcagcc

SEQ ID NO: 62657 - RNA, 22 nt, Human
ugaaggagucgaggugggugag

SEQ ID NO: 62658 - RNA, 22 nt, Human
ugaagcuaguauuaacucagau

SEQ ID NO: 62659 - RNA, 22 nt, Human
ucaagggaccaagcauucauua

SEQ ID NO: 62660 - RNA, 22 nt, Human
ugaaucuuguuuacugauuccu

SEQ ID NO: 62661 - RNA, 22 nt, Human
ugaauagucaaagcacaagagg

SEQ ID NO: 62662 - RNA, 22 nt, Human
ugaaugaacugaugaacuuaac

SEQ ID NO: 62663 - RNA, 22 nt, Human
ugaaugaagcacuguaauucuc

SEQ ID NO: 62664 - RNA, 22 nt, Human
ugaaucaaugaauugcacuuca

SEQ ID NO: 62665 - RNA, 22 nt, Human
ucaagucaauagguuaguaggu

SEQ ID NO: 62666 - RNA, 22 nt, Human
ucacaagaagaaauuaaacugu

SEQ ID NO: 62667 - RNA, 22 nt, Human
ugaauguggucaggaaauuguu

SEQ ID NO: 62668 - RNA, 22 nt, Human
ugaauggugcccuagagggaug

SEQ ID NO: 62669 - RNA, 22 nt, Human
ugaauuauaugguauugaacau

SEQ ID NO: 62670 - RNA, 22 nt, Human
ucacaggagucaaggaauagua

SEQ ID NO: 62671 - RNA, 22 nt, Human
ucacugaauuucaagcuagugg

SEQ ID NO: 62672 - RNA, 22 nt, Human
ucacuggauucauguuucuuua

SEQ ID NO: 62673 - RNA, 22 nt, Human
ucacuagcaucugaauauuguu

SEQ ID NO: 62674 - RNA, 22 nt, Human
ucaccuuuugaauugcuguugu

SEQ ID NO: 62675 - RNA, 22 nt, Human
ucacuucugcuccuuggaugcc

SEQ ID NO: 62676 - RNA, 22 nt, Human
ucacuuccuugcagcuguagaa

SEQ ID NO: 62677 - RNA, 22 nt, Human
ugacagaggagcuggaaugauu

SEQ ID NO: 62678 - RNA, 22 nt, Human
ucagaacucuagucucagccug

SEQ ID NO: 62679 - RNA, 22 nt, Human
ugaauuuuggcaauuuucugug

SEQ ID NO: 62680 - RNA, 18 nt, Human
ucagaggagauaccuaaa

SEQ ID NO: 62681 - RNA, 22 nt, Human
ucagagacaucagguuguagca

SEQ ID NO: 62682 - RNA, 21 nt, Human
ucagaaucguuccagguagau

SEQ ID NO: 62683 - RNA, 22 nt, Human
ucagaagguacugaagacaugg

SEQ ID NO: 62684 - RNA, 22 nt, Human
ugacaucagacugugagaagag

SEQ ID NO: 62685 - RNA, 22 nt, Human
ucagcaaugggauucaggcuuu

SEQ ID NO: 62686 - RNA, 22 nt, Human
ucagauagcaagggauaccugu

SEQ ID NO: 62687 - RNA, 19 nt, Human
ucagcagauuuugcaaaca

SEQ ID NO: 62688 - RNA, 22 nt, Human
ucagcaggugcuuuguuuacuc

SEQ ID NO: 62689 - RNA, 22 nt, Human
ucaggcaggaucccagggaagg

SEQ ID NO: 62690 - RNA, 19 nt, Human
ugacuggguucuaggcagg

SEQ ID NO: 62691 - RNA, 22 nt, Human
ugacucugaugcaguguguuua

SEQ ID NO: 62692 - RNA, 19 nt, Human
ugaguacuaaugagauuga

SEQ ID NO: 62693 - RNA, 20 nt, Human
ugagucagcugcaugggugg

SEQ ID NO: 62694 - RNA, 20 nt, Human
ugagaaacaagggcuggucu

SEQ ID NO: 62695 - RNA, 22 nt, Human
ugacuuuucuccucugaaguuu

SEQ ID NO: 62696 - RNA, 22 nt, Human
ugaguuucuuacucaggagcug

SEQ ID NO: 62697 - RNA, 22 nt, Human
ugaguuuuggaagauguuacag

SEQ ID NO: 62698 - RNA, 22 nt, Human
ugaguugucacaacgucacaag

SEQ ID NO: 62699 - RNA, 22 nt, Human
ugagugugugcugcuuacauuc

SEQ ID NO: 62700 - RNA, 22 nt, Human
ugaguuagcucuauucuuuugg

SEQ ID NO: 62701 - RNA, 22 nt, Human
ucauucucucguauucgcgaau

SEQ ID NO: 62702 - RNA, 22 nt, Human
ucauuguuuacugucuuuuuuc

SEQ ID NO: 62703 - RNA, 22 nt, Human
ucauuauuuugauguauuuccu

SEQ ID NO: 62704 - RNA, 22 nt, Human
ucauuggagcauaugaugguua

SEQ ID NO: 62705 - RNA, 22 nt, Human
ucauuagcuaucagaguggaac

SEQ ID NO: 62706 - RNA, 22 nt, Human
ugaugaaguuggaaggaaaguu

SEQ ID NO: 62707 - RNA, 17 nt, Human
ucauuucaguaaaucca

SEQ ID NO: 62708 - RNA, 22 nt, Human
ugauggaguauaauaaaaugac

SEQ ID NO: 62709 - RNA, 22 nt, Human
ugaugcuagaacuuccaagaua

SEQ ID NO: 62710 - RNA, 22 nt, Human
uccaaauucccaugacagaagu

SEQ ID NO: 62711 - RNA, 22 nt, Human
uccaacuuaauugggaagauua

SEQ ID NO: 62712 - RNA, 22 nt, Human
uccagaaaucucuguugauugu

SEQ ID NO: 62713 - RNA, 22 nt, Human
uccagguaaggguaaguaggcu

SEQ ID NO: 62714 - RNA, 22 nt, Human
ugcaaauucuuuacucugugau

SEQ ID NO: 62715 - RNA, 22 nt, Human
uccaugauauauaugugcacau

SEQ ID NO: 62716 - RNA, 22 nt, Human
ugcaaauuuuuuuauuuuuccu

SEQ ID NO: 62717 - RNA, 22 nt, Human
uccauguauugcuaacaaauag

SEQ ID NO: 62718 - RNA, 22 nt, Human
ugcaaggcacccacucugcuuu

SEQ ID NO: 62719 - RNA, 19 nt, Human
ugcaagcuuuuucuuguua

SEQ ID NO: 62720 - RNA, 22 nt, Human
ugcacauuucucacaauguaca

SEQ ID NO: 62721 - RNA, 22 nt, Human
uccauucccugacagccucuuu

SEQ ID NO: 62722 - RNA, 21 nt, Human
uccauucuuggugguucugca

SEQ ID NO: 62723 - RNA, 22 nt, Human
ugcagaacacaguagacagaac

SEQ ID NO: 62724 - RNA, 22 nt, Human
ugcacgcacuugcucuccagcg

SEQ ID NO: 62725 - RNA, 22 nt, Human
ucccagaaauccaggcuuaaau

SEQ ID NO: 62726 - RNA, 22 nt, Human
ucccagaaccuuuuagcuucac

SEQ ID NO: 62727 - RNA, 20 nt, Human
ugcagcucccccgcaguuuc

SEQ ID NO: 62728 - RNA, 22 nt, Human
ugcagcagaauauggcugcagg

SEQ ID NO: 62729 - RNA, 22 nt, Human
ucccagaacggguucuucccag

SEQ ID NO: 62730 - RNA, 23 nt, Human
ucccuuuguucuugcuaggaugu

SEQ ID NO: 62731 - RNA, 22 nt, Human
ucccuuuuagccccgcccuccu

SEQ ID NO: 62732 - RNA, 22 nt, Human
ucccuuuucauccuaucccagc

SEQ ID NO: 62733 - RNA, 22 nt, Human
ucccuugacuucucuuuuucca

SEQ ID NO: 62734 - RNA, 22 nt, Human
ucccuuuuuccugaucugugaa

SEQ ID NO: 62735 - RNA, 22 nt, Human
ugcaugacaauugccgucaagu

SEQ ID NO: 62736 - RNA, 22 nt, Human
uccuaagaaacagacugaaaag

SEQ ID NO: 62737 - RNA, 22 nt, Human
ugcauuauaacaauaaggcuua

SEQ ID NO: 62738 - RNA, 22 nt, Human
ugccaauuaccuauuucugaga

SEQ ID NO: 62739 - RNA, 22 nt, Human
ugccagucggcacuuuaucugg

SEQ ID NO: 62740 - RNA, 22 nt, Human
ugccauauuuugaggauguaca

SEQ ID NO: 62741 - RNA, 22 nt, Human
ugccaugguuguacaguagcag

SEQ ID NO: 62742 - RNA, 22 nt, Human
uccucuuguguguuccgguacc

SEQ ID NO: 62743 - RNA, 22 nt, Human
uccucuucaaaauagcucugaa

SEQ ID NO: 62744 - RNA, 21 nt, Human
uccucucuaaguuccgccccg

SEQ ID NO: 62745 - RNA, 22 nt, Human
uccucuucucuagagccggaau

SEQ ID NO: 62746 - RNA, 22 nt, Human
uccugggcuugcucuuuccauu

SEQ ID NO: 62747 - RNA, 22 nt, Human
uccugguaaagaguaucagauu

SEQ ID NO: 62748 - RNA, 21 nt, Human
uccugcagggcagcagagugg

SEQ ID NO: 62749 - RNA, 22 nt, Human
ugccgcaggaggggcgauuucu

SEQ ID NO: 62750 - RNA, 22 nt, Human
uccuuacuccuggagauucuga

SEQ ID NO: 62751 - RNA, 22 nt, Human
uccuucucagggagacuugaua

SEQ ID NO: 62752 - RNA, 22 nt, Human
uccuucuguuguuuauuuuaaa

SEQ ID NO: 62753 - RNA, 22 nt, Human
ucgaaugccaacaccgaaguuu

SEQ ID NO: 62754 - RNA, 22 nt, Human
uccuuuucuuugaggaaggugu

SEQ ID NO: 62755 - RNA, 22 nt, Human
ucgaaacuucucauuuaucugu

SEQ ID NO: 62756 - RNA, 22 nt, Human
ucgaggagagucgccagcugcu

SEQ ID NO: 62757 - RNA, 21 nt, Human
ugcguaugucuuguauuacuc

SEQ ID NO: 62758 - RNA, 23 nt, Human
ugcuaaaggcagaauauucaccu

SEQ ID NO: 62759 - RNA, 22 nt, Human
ugcguuuaguuucaagacacgu

SEQ ID NO: 62760 - RNA, 22 nt, Human
ugcuauucuuggagcugaugga

SEQ ID NO: 62761 - RNA, 22 nt, Human
ugcuauuaagagaaagugaaca

SEQ ID NO: 62762 - RNA, 22 nt, Human
ugcuaucuagaaauacuggguu

SEQ ID NO: 62763 - RNA, 22 nt, Human
ugcuauccagacacauaugauc

SEQ ID NO: 62764 - RNA, 20 nt, Human
ugcuccaggaacacuggccg

SEQ ID NO: 62765 - RNA, 22 nt, Human
ugcuccugaacacagcccuaug

SEQ ID NO: 62766 - RNA, 22 nt, Human
ucggcuccucccuggaaagggg

SEQ ID NO: 62767 - RNA, 22 nt, Human
ugcugacuauacauuuagcauu

SEQ ID NO: 62768 - RNA, 22 nt, Human
ucguauaguugcugcagauggu

SEQ ID NO: 62769 - RNA, 22 nt, Human
ucuaaaaauuagaaauuagguc

SEQ ID NO: 62770 - RNA, 22 nt, Human
ucuaaagcuccuuccacuaaaa

SEQ ID NO: 62771 - RNA, 22 nt, Human
ucuaaaugaccuccuugcccag

SEQ ID NO: 62772 - RNA, 22 nt, Human
ucguguuggaacugcuuuguaa

SEQ ID NO: 62773 - RNA, 22 nt, Human
ucuaaugcuuccucucauccca

SEQ ID NO: 62774 - RNA, 22 nt, Human
ugcugcacuuauggcucugagg

SEQ ID NO: 62775 - RNA, 22 nt, Human
ucuaacuaagcuuuaaaagguc

SEQ ID NO: 62776 - RNA, 22 nt, Human
ucuaagcuugaucacuugcuuu

SEQ ID NO: 62777 - RNA, 22 nt, Human
ucuaaucuacaaaaggaaauuc

SEQ ID NO: 62778 - RNA, 22 nt, Human
ucuaaucuuugaaaucaggguc

SEQ ID NO: 62779 - RNA, 20 nt, Human
ucuaaugaagugagcuuagc

SEQ ID NO: 62780 - RNA, 22 nt, Human
uggaaagauuuaaaauaacgag

SEQ ID NO: 62781 - RNA, 22 nt, Human
ucuacuccaucugccagggcuu

SEQ ID NO: 62782 - RNA, 22 nt, Human
ucuacugagugcugagauuuug

SEQ ID NO: 62783 - RNA, 22 nt, Human
ucuaaucacccgccgccccccg

SEQ ID NO: 62784 - RNA, 22 nt, Human
ucuacgugggaguucaggauuc

SEQ ID NO: 62785 - RNA, 19 nt, Human
ugcugcaggaauucucaag

SEQ ID NO: 62786 - RNA, 22 nt, Human
ugcugccucugaauggagcagu

SEQ ID NO: 62787 - RNA, 22 nt, Human
uggaaaggaguucuguuuauuu

SEQ ID NO: 62788 - RNA, 22 nt, Human
uggaaaggcccauaaaaggaua

SEQ ID NO: 62789 - RNA, 22 nt, Human
uggaaauagauguaggaaauug

SEQ ID NO: 62790 - RNA, 22 nt, Human
ucugcccaggaggucccauggg

SEQ ID NO: 62791 - RNA, 22 nt, Human
uggaagaaaacuuggaaggcau

SEQ ID NO: 62792 - RNA, 22 nt, Human
ucuggaaauggaaguaacuaug

SEQ ID NO: 62793 - RNA, 22 nt, Human
ucugguuuggguugcuauggcu

SEQ ID NO: 62794 - RNA, 22 nt, Human
uggaauuaucugaagugauuug

SEQ ID NO: 62795 - RNA, 21 nt, Human
uggaauuggaaaccauucuau

SEQ ID NO: 62796 - RNA, 22 nt, Human
ucugggccaacccuuccauggg

SEQ ID NO: 62797 - RNA, 22 nt, Human
uggaaggaaauguguaucauaa

SEQ ID NO: 62798 - RNA, 22 nt, Human
ucuggguaacugaggcuaauau

SEQ ID NO: 62799 - RNA, 21 nt, Human
uggagcagggaggauuugggg

SEQ ID NO: 62800 - RNA, 22 nt, Human
uggagcaagaagggaggcagaa

SEQ ID NO: 62801 - RNA, 22 nt, Human
uggagagcaggugaaggaaaga

SEQ ID NO: 62802 - RNA, 22 nt, Human
uggagccugauggauaggaacg

SEQ ID NO: 62803 - RNA, 22 nt, Human
uggaggauaacacaagaaguga

SEQ ID NO: 62804 - RNA, 22 nt, Human
uggaggaggagaacuuggcacu

SEQ ID NO: 62805 - RNA, 22 nt, Human
uggaggagaacugauuuggcuu

SEQ ID NO: 62806 - RNA, 22 nt, Human
ucugugugugcauguguguaua

SEQ ID NO: 62807 - RNA, 22 nt, Human
uggaguguuggucccacugagg

SEQ ID NO: 62808 - RNA, 22 nt, Human
uggagguagcugacuccagccc

SEQ ID NO: 62809 - RNA, 22 nt, Human
uggagggaagcaaacacuagau

SEQ ID NO: 62810 - RNA, 22 nt, Human
uggauaugaaacaaaacaagag

SEQ ID NO: 62811 - RNA, 22 nt, Human
uggauauagcugaggugucuug

SEQ ID NO: 62812 - RNA, 22 nt, Human
uggauuagugcugaaaugaugg

SEQ ID NO: 62813 - RNA, 22 nt, Human
ucuuauugguaaugauggcauu

SEQ ID NO: 62814 - RNA, 18 nt, Human
uggcaaugccaaaggcuu

SEQ ID NO: 62815 - RNA, 22 nt, Human
ucuuaaucauucuucacuuccu

SEQ ID NO: 62816 - RNA, 22 nt, Human
ucuuagacagagaagacuauug

SEQ ID NO: 62817 - RNA, 22 nt, Human
uggcacaggcagaaggugccgc

SEQ ID NO: 62818 - RNA, 22 nt, Human
uggcacaguuaaaguuguagaa

SEQ ID NO: 62819 - RNA, 22 nt, Human
uggcagaaugaagacuggggcc

SEQ ID NO: 62820 - RNA, 22 nt, Human
ucuuaaguuccaggugugcuca

SEQ ID NO: 62821 - RNA, 22 nt, Human
ucuucuuuccuuuugugcauuu

SEQ ID NO: 62822 - RNA, 20 nt, Human
uggcaugcucucuuuuuagg

SEQ ID NO: 62823 - RNA, 22 nt, Human
ucuugcuguggcagaucuggag

SEQ ID NO: 62824 - RNA, 22 nt, Human
ucuuggggagacuaguguuugg

SEQ ID NO: 62825 - RNA, 22 nt, Human
ucuuggucccugagcucuuuca

SEQ ID NO: 62826 - RNA, 22 nt, Human
ucuugugagcugagauaaagcc

SEQ ID NO: 62827 - RNA, 22 nt, Human
ucuuucucauccaaacuaguug

SEQ ID NO: 62828 - RNA, 23 nt, Human
ucuuuccuuucauacagucagcu

SEQ ID NO: 62829 - RNA, 19 nt, Human
ucuuucauuucuagcucug

SEQ ID NO: 62830 - RNA, 22 nt, Human
ucuuuauuucccuaacuugcua

SEQ ID NO: 62831 - RNA, 22 nt, Human
ugaaauuuuuuggagauaauuu

SEQ ID NO: 62832 - RNA, 22 nt, Human
uggcuuuucaccugcuccucug

SEQ ID NO: 62833 - RNA, 22 nt, Human
uggcuucuggccaggcacagga

SEQ ID NO: 62834 - RNA, 22 nt, Human
uggcuugacaucaauacuuauu

SEQ ID NO: 62835 - RNA, 22 nt, Human
ucuuuucagccagcugguagga

SEQ ID NO: 62836 - RNA, 17 nt, Human
ucuuuuacuuucucucc

SEQ ID NO: 62837 - RNA, 22 nt, Human
ucuuugcugacacuuacacugu

SEQ ID NO: 62838 - RNA, 22 nt, Human
ucuuugcauggacauguguuuu

SEQ ID NO: 62839 - RNA, 22 nt, Human
ugaaagcuggcucugcagagug

SEQ ID NO: 62840 - RNA, 22 nt, Human
uggcucuucucaagcauuggcu

SEQ ID NO: 62841 - RNA, 22 nt, Human
uggcuguuggagcuggaagaug

SEQ ID NO: 62842 - RNA, 22 nt, Human
ugggaaaauugugauucuuucu

SEQ ID NO: 62843 - RNA, 22 nt, Human
uggcuuuuuauuccuaugugau

SEQ ID NO: 62844 - RNA, 22 nt, Human
uggcuuuuuucuccccuuggau

SEQ ID NO: 62845 - RNA, 22 nt, Human
ugaacagugugagggugugacc

SEQ ID NO: 62846 - RNA, 22 nt, Human
ugggaaacucuaaacuugagua

SEQ ID NO: 62847 - RNA, 22 nt, Human
ugggaagcugagccucgaugug

SEQ ID NO: 62848 - RNA, 22 nt, Human
ugaacuguccuuguugucuaga

SEQ ID NO: 62849 - RNA, 22 nt, Human
ugaacauuuuugcuugcagcuu

SEQ ID NO: 62850 - RNA, 22 nt, Human
ugaaccuaacauuucuggcagu

SEQ ID NO: 62851 - RNA, 22 nt, Human
ugaagaauuccauggcuuccau

SEQ ID NO: 62852 - RNA, 22 nt, Human
ugggagccuuccacugggggaa

SEQ ID NO: 62853 - RNA, 22 nt, Human
ugggagagaagcugaggcaggg

SEQ ID NO: 62854 - RNA, 22 nt, Human
ugggacaugaugcauuugaaag

SEQ ID NO: 62855 - RNA, 18 nt, Human
ugggacucugacuugguu

SEQ ID NO: 62856 - RNA, 22 nt, Human
ugaaggaggugaauccaugcau

SEQ ID NO: 62857 - RNA, 22 nt, Human
ugggcaaaugcuuuuuagucaa

SEQ ID NO: 62858 - RNA, 22 nt, Human
ugggaggcugugggaauggguc

SEQ ID NO: 62859 - RNA, 22 nt, Human
ugaaggggaaagucuugcuaua

SEQ ID NO: 62860 - RNA, 21 nt, Human
ugaagggugagauauaaguga

SEQ ID NO: 62861 - RNA, 22 nt, Human
ugaagguggcuugcagcuaguc

SEQ ID NO: 62862 - RNA, 23 nt, Human
ugaagugaaauuucacaagggac

SEQ ID NO: 62863 - RNA, 22 nt, Human
ugaaguuuagaaaaagugccuu

SEQ ID NO: 62864 - RNA, 22 nt, Human
ugaauaaauaaacuuuuacuac

SEQ ID NO: 62865 - RNA, 22 nt, Human
ugaauagcaccuugaguaauga

SEQ ID NO: 62866 - RNA, 21 nt, Human
uggggaugcauugcagaggca

SEQ ID NO: 62867 - RNA, 22 nt, Human
uggggaguaggaggggaacaga

SEQ ID NO: 62868 - RNA, 22 nt, Human
ugaaucagaccuucauugggua

SEQ ID NO: 62869 - RNA, 22 nt, Human
ugggggagggagaguugauggg

SEQ ID NO: 62870 - RNA, 22 nt, Human
ugaaugcuacccugcuggcucu

SEQ ID NO: 62871 - RNA, 22 nt, Human
uggggcuuggcucacagaagcu

SEQ ID NO: 62872 - RNA, 22 nt, Human
ugaauuucuuuuuaaaauauua

SEQ ID NO: 62873 - RNA, 22 nt, Human
ugaauucaaacuuuuuaacaag

SEQ ID NO: 62874 - RNA, 22 nt, Human
ugaauuuguaggaauucuccau

SEQ ID NO: 62875 - RNA, 22 nt, Human
ugaauuuuaacauucugcugga

SEQ ID NO: 62876 - RNA, 22 nt, Human
ugaauguguacacgauuguuug

SEQ ID NO: 62877 - RNA, 22 nt, Human
uggucuuuccuucauuguccag

SEQ ID NO: 62878 - RNA, 22 nt, Human
uggggucuggcauaugguagau

SEQ ID NO: 62879 - RNA, 22 nt, Human
ugagcuauuucaccauauagau

SEQ ID NO: 62880 - RNA, 21 nt, Human
ugaggccugccagucucagaa

SEQ ID NO: 62881 - RNA, 22 nt, Human
ugaggcaguucuuacuuguauu

SEQ ID NO: 62882 - RNA, 22 nt, Human
ugaggggaggggagaaaauggu

SEQ ID NO: 62883 - RNA, 22 nt, Human
ugaggggucuccuaccaugaug

SEQ ID NO: 62884 - RNA, 23 nt, Human
ugaggucuuggaaguucuguuug

SEQ ID NO: 62885 - RNA, 17 nt, Human
ugguucuuuuccugacc

SEQ ID NO: 62886 - RNA, 22 nt, Human
ugguugagguugacucuauaua

SEQ ID NO: 62887 - RNA, 22 nt, Human
ugguugugcucuguuugaaagu

SEQ ID NO: 62888 - RNA, 22 nt, Human
ugaguguuguaaccauaugauu

SEQ ID NO: 62889 - RNA, 22 nt, Human
ugaguucugacugagcaugggg

SEQ ID NO: 62890 - RNA, 22 nt, Human
ugaguuuaggccaggauauggu

SEQ ID NO: 62891 - RNA, 22 nt, Human
ugaucauguucuccaaaagcgu

SEQ ID NO: 62892 - RNA, 22 nt, Human
uguaaacuuuugcauacugcuu

SEQ ID NO: 62893 - RNA, 22 nt, Human
uguaagaagaaaaccguaugga

SEQ ID NO: 62894 - RNA, 22 nt, Human
uguaaagguuuuagagcagaga

SEQ ID NO: 62895 - RNA, 22 nt, Human
uguaauuugguuagauuucuuu

SEQ ID NO: 62896 - RNA, 22 nt, Human
ugaugaugauacauuucuucag

SEQ ID NO: 62897 - RNA, 22 nt, Human
ugaugaugccaaaauuuggcau

SEQ ID NO: 62898 - RNA, 22 nt, Human
uguagcucaaggaauuguucuc

SEQ ID NO: 62899 - RNA, 22 nt, Human
uguaguguuuagucuagugucg

SEQ ID NO: 62900 - RNA, 22 nt, Human
uguaguuuuaggagggguaaau

SEQ ID NO: 62901 - RNA, 23 nt, Human
uguauacacccugugcaucuggg

SEQ ID NO: 62902 - RNA, 22 nt, Human
ugauguaggacauuauuauuuc

SEQ ID NO: 62903 - RNA, 22 nt, Human
ugauguggaucuauaacuguaa

SEQ ID NO: 62904 - RNA, 22 nt, Human
ugauuagauacuucagaugaca

SEQ ID NO: 62905 - RNA, 22 nt, Human
ugauuagccguccuuuuauuaa

SEQ ID NO: 62906 - RNA, 22 nt, Human
uguaucuguguguauguguuua

SEQ ID NO: 62907 - RNA, 22 nt, Human
ugauucaguacuuucucuaacu

SEQ ID NO: 62908 - RNA, 22 nt, Human
ugauucacgcuucucuuuaaac

SEQ ID NO: 62909 - RNA, 22 nt, Human
uguauuugaagaaagagcuucu

SEQ ID NO: 62910 - RNA, 22 nt, Human
uguauuuuuucccugaaauaaa

SEQ ID NO: 62911 - RNA, 22 nt, Human
ugcaaaaguuuuauacacagau

SEQ ID NO: 62912 - RNA, 22 nt, Human
ugauucuuugaccaaaaaauug

SEQ ID NO: 62913 - RNA, 22 nt, Human
ugauugauaaugaagacaguca

SEQ ID NO: 62914 - RNA, 22 nt, Human
ugauugcucgacacucugcuug

SEQ ID NO: 62915 - RNA, 22 nt, Human
ugcaagauccagucuugagaag

SEQ ID NO: 62916 - RNA, 22 nt, Human
ugcaagagcccaaacuauauac

SEQ ID NO: 62917 - RNA, 23 nt, Human
ugcaaaauuugcagaguucgaug

SEQ ID NO: 62918 - RNA, 22 nt, Human
ugucuguauuugaggacauugu

SEQ ID NO: 62919 - RNA, 22 nt, Human
ugucccuggacuccaggagcca

SEQ ID NO: 62920 - RNA, 22 nt, Human
ugucuuaugcugcauagacuau

SEQ ID NO: 62921 - RNA, 22 nt, Human
ugugcaguauugaaauauaugu

SEQ ID NO: 62922 - RNA, 22 nt, Human
ugugccuuucacuaugucauuc

SEQ ID NO: 62923 - RNA, 22 nt, Human
ugugcagaaggagguucuccgg

SEQ ID NO: 62924 - RNA, 22 nt, Human
ugcaggagaaaguacggagcgu

SEQ ID NO: 62925 - RNA, 22 nt, Human
ugcauuaguaaagagaggaggg

SEQ ID NO: 62926 - RNA, 22 nt, Human
ugugggaucauggaucagggcc

SEQ ID NO: 62927 - RNA, 22 nt, Human
ugcauuccagcucccuucuggc

SEQ ID NO: 62928 - RNA, 22 nt, Human
ugcauucugggucgcagagugg

SEQ ID NO: 62929 - RNA, 22 nt, Human
ugcauugccucuauucauuaua

SEQ ID NO: 62930 - RNA, 22 nt, Human
ugcauuuugaaggaaaaaaaug

SEQ ID NO: 62931 - RNA, 22 nt, Human
ugcauucugaacguaaauguga

SEQ ID NO: 62932 - RNA, 22 nt, Human
ugcauuguuuauggaauaaaau

SEQ ID NO: 62933 - RNA, 22 nt, Human
ugccaaugauuccacaauggaa

SEQ ID NO: 62934 - RNA, 22 nt, Human
ugccaacaggcuugccugaugu

SEQ ID NO: 62935 - RNA, 22 nt, Human
ugcauuuuuaauuuggaaaaaa

SEQ ID NO: 62936 - RNA, 22 nt, Human
ugugguagagcuuaaaugaggu

SEQ ID NO: 62937 - RNA, 22 nt, Human
ugugguuggggucagauaggga

SEQ ID NO: 62938 - RNA, 22 nt, Human
ugugguuuguaagcaaagcaaa

SEQ ID NO: 62939 - RNA, 22 nt, Human
ugccuaguuuaaaucauuuucu

SEQ ID NO: 62940 - RNA, 22 nt, Human
uguguauaugugugugugugug

SEQ ID NO: 62941 - RNA, 22 nt, Human
ugccugaagccugccccugggu

SEQ ID NO: 62942 - RNA, 22 nt, Human
uguguuagguuuugggauggcu

SEQ ID NO: 62943 - RNA, 22 nt, Human
uguguuucggauagcagauucu

SEQ ID NO: 62944 - RNA, 22 nt, Human
uguguuuaaacuauaugccugc

SEQ ID NO: 62945 - RNA, 22 nt, Human
uguguuguuuggggauguccau

SEQ ID NO: 62946 - RNA, 22 nt, Human
uguguuucucugaggggucccu

SEQ ID NO: 62947 - RNA, 22 nt, Human
ugccuuuuguguuuggcuaauc

SEQ ID NO: 62948 - RNA, 22 nt, Human
ugccuuccuucuccccuccuuc

SEQ ID NO: 62949 - RNA, 22 nt, Human
ugccuuuggcuguucugugacc

SEQ ID NO: 62950 - RNA, 22 nt, Human
uguuccaacuacugaauuggca

SEQ ID NO: 62951 - RNA, 23 nt, Human
uguuaucacauguuccuuuaaau

SEQ ID NO: 62952 - RNA, 22 nt, Human
uguuggaauaagugcuugaagg

SEQ ID NO: 62953 - RNA, 22 nt, Human
uguugaugaccacaauuuaugc

SEQ ID NO: 62954 - RNA, 22 nt, Human
uguucuuacuaaguaccugaaa

SEQ ID NO: 62955 - RNA, 20 nt, Human
uguuccgugguguccuuuuc

SEQ ID NO: 62956 - RNA, 19 nt, Human
uguucuacuugcuaguauu

SEQ ID NO: 62957 - RNA, 22 nt, Human
uguucugaggaggguuucaagg

SEQ ID NO: 62958 - RNA, 22 nt, Human
uguucuuaacuuuuguguauau

SEQ ID NO: 62959 - RNA, 22 nt, Human
uguucuucaaacucaguuccac

SEQ ID NO: 62960 - RNA, 22 nt, Human
uguugaaacagcuauugacuuu

SEQ ID NO: 62961 - RNA, 22 nt, Human
ugcuaguuuuugauacuuuugc

SEQ ID NO: 62962 - RNA, 22 nt, Human
ugcuauuuuguuuucaguccau

SEQ ID NO: 62963 - RNA, 22 nt, Human
ugcucagaagacuuacugguua

SEQ ID NO: 62964 - RNA, 22 nt, Human
uuaugugcuuuuugagcucuaa

SEQ ID NO: 62965 - RNA, 22 nt, Human
uuauguugauaggaaucugauu

SEQ ID NO: 62966 - RNA, 22 nt, Human
uuauuccauagaagucaaggaa

SEQ ID NO: 62967 - RNA, 22 nt, Human
uuauuaauacaugcaccugcau

SEQ ID NO: 62968 - RNA, 22 nt, Human
uuauuggcagcuccugcacaug

SEQ ID NO: 62969 - RNA, 22 nt, Human
uggagcugguucuggggaagcu

SEQ ID NO: 62970 - RNA, 22 nt, Human
uuauuguagcacuuuggcagug

SEQ ID NO: 62971 - RNA, 22 nt, Human
uuauuuaaaauguagguuggga

SEQ ID NO: 62972 - RNA, 22 nt, Human
uggaggauggaaggaaagcugg

SEQ ID NO: 62973 - RNA, 22 nt, Human
uggaggaggaugcauuuguugu

SEQ ID NO: 62974 - RNA, 22 nt, Human
uuauuuaagaucuuaauauaua

SEQ ID NO: 62975 - RNA, 22 nt, Human
uuauuugcccauguuuagcaga

SEQ ID NO: 62976 - RNA, 22 nt, Human
uuauuuucgugugugugugugu

SEQ ID NO: 62977 - RNA, 22 nt, Human
uggaugagugaauggauaaauc

SEQ ID NO: 62978 - RNA, 22 nt, Human
uucacauucauuucuuauguuu

SEQ ID NO: 62979 - RNA, 22 nt, Human
uucaauuacaucagaaucuaaa

SEQ ID NO: 62980 - RNA, 22 nt, Human
uucacaauuuuaaaaaguggaa

SEQ ID NO: 62981 - RNA, 20 nt, Human
uucacagaggacucagguca

SEQ ID NO: 62982 - RNA, 22 nt, Human
uggaucuugaugcuccaagagu

SEQ ID NO: 62983 - RNA, 21 nt, Human
uggauauugaguaguuucuga

SEQ ID NO: 62984 - RNA, 22 nt, Human
uggauauuuuguaugugcguuu

SEQ ID NO: 62985 - RNA, 22 nt, Human
uggaguuuuaaucuguacagaa

SEQ ID NO: 62986 - RNA, 22 nt, Human
uucaacacaaguugugcaguaa

SEQ ID NO: 62987 - RNA, 22 nt, Human
uggaguuuauuugaauucuugg

SEQ ID NO: 62988 - RNA, 22 nt, Human
uucaaacaguguagaauauaug

SEQ ID NO: 62989 - RNA, 22 nt, Human
uucaaaaugcagaauaguuugg

SEQ ID NO: 62990 - RNA, 20 nt, Human
uggagggaggaggggcccaa

SEQ ID NO: 62991 - RNA, 22 nt, Human
uggaguagaagggcuccuggaa

SEQ ID NO: 62992 - RNA, 22 nt, Human
uuauuuuuguaacacuguauag

SEQ ID NO: 62993 - RNA, 22 nt, Human
uuauuuuuguuuguuaagccua

SEQ ID NO: 62994 - RNA, 22 nt, Human
uggcaaaaccugcaauuacuuu

SEQ ID NO: 62995 - RNA, 15 nt, Human
uggauuugccacaua

SEQ ID NO: 62996 - RNA, 22 nt, Human
uggauuguauugauugguuggc

SEQ ID NO: 62997 - RNA, 22 nt, Human
uggaugcuccaaguagaccuua

SEQ ID NO: 62998 - RNA, 22 nt, Human
uggcacugcccugucucggugg

SEQ ID NO: 62999 - RNA, 22 nt, Human
uucagaaagugaaucuuguuau

SEQ ID NO: 63000 - RNA, 22 nt, Human
uucacugacaguauugaggagg

SEQ ID NO: 63001 - RNA, 22 nt, Human
uucacuuuuuccugguccauuu

SEQ ID NO: 63002 - RNA, 22 nt, Human
uucacuuuuucucugcuugaga

SEQ ID NO: 63003 - RNA, 21 nt, Human
uggcaggcagcuggaagcuug

SEQ ID NO: 63004 - RNA, 22 nt, Human
uucagcaagugucucuacuguc

SEQ ID NO: 63005 - RNA, 22 nt, Human
uggcaucuggugauauggacua

SEQ ID NO: 63006 - RNA, 23 nt, Human
uucagcucuccugaagcaucugu

SEQ ID NO: 63007 - RNA, 22 nt, Human
uucagcacuggacagcgagucu

SEQ ID NO: 63008 - RNA, 18 nt, Human
uggcaugcuuugauacau

SEQ ID NO: 63009 - RNA, 20 nt, Human
uggcaugaaauuuuccaagc

SEQ ID NO: 63010 - RNA, 22 nt, Human
uucagcugcuugccugaaguca

SEQ ID NO: 63011 - RNA, 20 nt, Human
uucaggaccuuccaguccau

SEQ ID NO: 63012 - RNA, 22 nt, Human
uucaggaucuaggaguauuuuu

SEQ ID NO: 63013 - RNA, 22 nt, Human
uucaggugguuuaagaauugga

SEQ ID NO: 63014 - RNA, 22 nt, Human
uggccagucuuagcugugccug

SEQ ID NO: 63015 - RNA, 22 nt, Human
uucaguaugcugaaugauuuuu

SEQ ID NO: 63016 - RNA, 22 nt, Human
uucagguacuaagugcugauuc

SEQ ID NO: 63017 - RNA, 22 nt, Human
uucagguuuuaugguaaugcuu

SEQ ID NO: 63018 - RNA, 22 nt, Human
uucauauuguggucuugcauuc

SEQ ID NO: 63019 - RNA, 22 nt, Human
uucaucauuuuccauuccucuu

SEQ ID NO: 63020 - RNA, 22 nt, Human
uucaucuucaaaccccagugcc

SEQ ID NO: 63021 - RNA, 22 nt, Human
uucaugcgcuuuucaggagugu

SEQ ID NO: 63022 - RNA, 22 nt, Human
uucauuauuaauaauagcagcu

SEQ ID NO: 63023 - RNA, 22 nt, Human
uucauuagcacauuuccuuggu

SEQ ID NO: 63024 - RNA, 22 nt, Human
uucauuagcguaggauguguac

SEQ ID NO: 63025 - RNA, 22 nt, Human
uggcgcgcagccugcuggugcu

SEQ ID NO: 63026 - RNA, 18 nt, Human
uggcuagaagagcucuca

SEQ ID NO: 63027 - RNA, 22 nt, Human
uggcuacauuuauacucucauu

SEQ ID NO: 63028 - RNA, 22 nt, Human
uuccagcaaagguaguguguua

SEQ ID NO: 63029 - RNA, 22 nt, Human
uuccaggacuggguguuugaag

SEQ ID NO: 63030 - RNA, 22 nt, Human
uggcuucugguuuauccuuaua

SEQ ID NO: 63031 - RNA, 22 nt, Human
uuccauuccauaucagguacag

SEQ ID NO: 63032 - RNA, 22 nt, Human
uuccccaugugaugcuauugcu

SEQ ID NO: 63033 - RNA, 22 nt, Human
uuccccuucuaauacucaauuu

SEQ ID NO: 63034 - RNA, 22 nt, Human
uggcuuuugaaaaggugaugua

SEQ ID NO: 63035 - RNA, 22 nt, Human
ugggaugagcuauauagaaagu

SEQ ID NO: 63036 - RNA, 22 nt, Human
ugggauauagaauuggcagagu

SEQ ID NO: 63037 - RNA, 22 nt, Human
ugggauggacuuuagagaaucg

SEQ ID NO: 63038 - RNA, 22 nt, Human
uggggaauguaauucuuuggcu

SEQ ID NO: 63039 - RNA, 22 nt, Human
uggggacucacugacuaucuug

SEQ ID NO: 63040 - RNA, 22 nt, Human
ugggccucuguuuccucaucug

SEQ ID NO: 63041 - RNA, 22 nt, Human
uucuagaagggccuaggcauaa

SEQ ID NO: 63042 - RNA, 18 nt, Human
uucuagaggucucaucca

SEQ ID NO: 63043 - RNA, 18 nt, Human
uucucucuggauaguagu

SEQ ID NO: 63044 - RNA, 22 nt, Human
uucucuggggacugucucuauu

SEQ ID NO: 63045 - RNA, 22 nt, Human
uucucuugccuucucuuuuauc

SEQ ID NO: 63046 - RNA, 22 nt, Human
uucuaagaaauggaaaacgauu

SEQ ID NO: 63047 - RNA, 22 nt, Human
ugggggaggaggagacagacug

SEQ ID NO: 63048 - RNA, 22 nt, Human
ugggggaugacuugcucuuuca

SEQ ID NO: 63049 - RNA, 22 nt, Human
uucuacauugugaaguucuuua

SEQ ID NO: 63050 - RNA, 22 nt, Human
uucucucacucuuagaucccgc

SEQ ID NO: 63051 - RNA, 22 nt, Human
uucugaguguugucaccaugug

SEQ ID NO: 63052 - RNA, 22 nt, Human
uucugaugccuggguugcuucu

SEQ ID NO: 63053 - RNA, 20 nt, Human
uucugcagcagguguugaag

SEQ ID NO: 63054 - RNA, 22 nt, Human
uucugaaggcaggggcuaucuu

SEQ ID NO: 63055 - RNA, 22 nt, Human
ugguggcaauuuuuggggucaa

SEQ ID NO: 63056 - RNA, 22 nt, Human
uucuuacuaaguagaguacuca

SEQ ID NO: 63057 - RNA, 22 nt, Human
uucuuagauuuuauuucuucug

SEQ ID NO: 63058 - RNA, 20 nt, Human
ugguguacauuuccauaguu

SEQ ID NO: 63059 - RNA, 22 nt, Human
uucuugucuuuguuauguagga

SEQ ID NO: 63060 - RNA, 22 nt, Human
ugguggcuuuucguagguucac

SEQ ID NO: 63061 - RNA, 22 nt, Human
uugaaaaaaucugaggaggacc

SEQ ID NO: 63062 - RNA, 22 nt, Human
uguaaagaaagacgcagaguua

SEQ ID NO: 63063 - RNA, 22 nt, Human
uucuuugcccauguuuccuaag

SEQ ID NO: 63064 - RNA, 22 nt, Human
uucuuucgaacaagagaaguuc

SEQ ID NO: 63065 - RNA, 22 nt, Human
uugaagaagucaaaagcugcag

SEQ ID NO: 63066 - RNA, 22 nt, Human
uguagcaauauaucagugcaca

SEQ ID NO: 63067 - RNA, 22 nt, Human
uugaaagaacaauucugugaug

SEQ ID NO: 63068 - RNA, 22 nt, Human
uugaaaaguuuguuacucacau

SEQ ID NO: 63069 - RNA, 22 nt, Human
uguacagauaucaggagugagg

SEQ ID NO: 63070 - RNA, 22 nt, Human
uugauaacuuagcugggcugcu

SEQ ID NO: 63071 - RNA, 19 nt, Human
uguauuuauauuucugugc

SEQ ID NO: 63072 - RNA, 22 nt, Human
uguauuuauuuuucaacuacca

SEQ ID NO: 63073 - RNA, 22 nt, Human
uguauauguguguagcauguua

SEQ ID NO: 63074 - RNA, 22 nt, Human
uugagcagccauuagcuggggu

SEQ ID NO: 63075 - RNA, 22 nt, Human
uguauugugggugucagagugc

SEQ ID NO: 63076 - RNA, 23 nt, Human
ugucacugcggaguggccugcag

SEQ ID NO: 63077 - RNA, 21 nt, Human
ugucagaaagccugugacuuu

SEQ ID NO: 63078 - RNA, 22 nt, Human
uugauggaggaaaaguuggaau

SEQ ID NO: 63079 - RNA, 22 nt, Human
uugauuaauugaugaaccucuc

SEQ ID NO: 63080 - RNA, 22 nt, Human
ugucauauagaauguucuauga

SEQ ID NO: 63081 - RNA, 22 nt, Human
uugauuugcagaagguguagag

SEQ ID NO: 63082 - RNA, 22 nt, Human
ugucaucuuggugcugugagag

SEQ ID NO: 63083 - RNA, 22 nt, Human
ugucauuggugaucugaugccu

SEQ ID NO: 63084 - RNA, 22 nt, Human
ugugauugucuucugaaaguca

SEQ ID NO: 63085 - RNA, 22 nt, Human
ugugauugcauugcagauuacu

SEQ ID NO: 63086 - RNA, 22 nt, Human
ugugauaaaggcccgcagaucc

SEQ ID NO: 63087 - RNA, 22 nt, Human
ugugacaugauggcgucaugua

SEQ ID NO: 63088 - RNA, 22 nt, Human
ugucugggauguuggcagccac

SEQ ID NO: 63089 - RNA, 22 nt, Human
ugucugcauucgaguucaugga

SEQ ID NO: 63090 - RNA, 22 nt, Human
ugucuuugaccuuaagaaguuu

SEQ ID NO: 63091 - RNA, 17 nt, Human
ugucuuuuuccuccucc

SEQ ID NO: 63092 - RNA, 19 nt, Human
ugugaagaccucagugcgg

SEQ ID NO: 63093 - RNA, 22 nt, Human
ugucuaaggaaaaagucuauuu

SEQ ID NO: 63094 - RNA, 22 nt, Human
uugcagagaacuaaagggagua

SEQ ID NO: 63095 - RNA, 22 nt, Human
uugcagaauucuucccacucag

SEQ ID NO: 63096 - RNA, 22 nt, Human
ugugcagaaaacacuuaagaac

SEQ ID NO: 63097 - RNA, 22 nt, Human
uugcucuuaccauuauguguga

SEQ ID NO: 63098 - RNA, 22 nt, Human
uugcucaugucaccaaagcaca

SEQ ID NO: 63099 - RNA, 18 nt, Human
uugcucucucugggggca

SEQ ID NO: 63100 - RNA, 22 nt, Human
ugugcuugucuguuuugauugu

SEQ ID NO: 63101 - RNA, 22 nt, Human
uugcugagcugaaccagccacc

SEQ ID NO: 63102 - RNA, 22 nt, Human
ugugcuauuuuugcauaugugu

SEQ ID NO: 63103 - RNA, 22 nt, Human
uguggcaauauggaauguguuu

SEQ ID NO: 63104 - RNA, 22 nt, Human
uguggauauauuuuaaaaggaa

SEQ ID NO: 63105 - RNA, 22 nt, Human
uugcugaggcuggggagaggug

SEQ ID NO: 63106 - RNA, 22 nt, Human
uugcugggauucauugaagggu

SEQ ID NO: 63107 - RNA, 22 nt, Human
uugcuggaguagaaaacuuaac

SEQ ID NO: 63108 - RNA, 22 nt, Human
uugcugcgcugaccuccaguga

SEQ ID NO: 63109 - RNA, 22 nt, Human
uugcugugucauuuguuuaauc

SEQ ID NO: 63110 - RNA, 22 nt, Human
ugugggaucguaaauuugggac

SEQ ID NO: 63111 - RNA, 22 nt, Human
uugcugguggcucugauuucau

SEQ ID NO: 63112 - RNA, 22 nt, Human
uuggaaaugcauuuguuauuau

SEQ ID NO: 63113 - RNA, 22 nt, Human
uuggaaaagaaauacucauaua

SEQ ID NO: 63114 - RNA, 22 nt, Human
uugcuugcggccuuugugccuu

SEQ ID NO: 63115 - RNA, 22 nt, Human
uugcuuugcuucuuuaugguca

SEQ ID NO: 63116 - RNA, 22 nt, Human
uuggaggcagagucuugcugag

SEQ ID NO: 63117 - RNA, 22 nt, Human
uuggaggccacagucaucuuua

SEQ ID NO: 63118 - RNA, 22 nt, Human
uuggaggucucugugguggugg

SEQ ID NO: 63119 - RNA, 22 nt, Human
uuggaguucuucaugcucugua

SEQ ID NO: 63120 - RNA, 22 nt, Human
uuggauagaauuuaaauugucu

SEQ ID NO: 63121 - RNA, 22 nt, Human
uuggaaauguagaaaagcagau

SEQ ID NO: 63122 - RNA, 20 nt, Human
uuggagaucacguguccagg

SEQ ID NO: 63123 - RNA, 19 nt, Human
uuggagcaucccaaaggcu

SEQ ID NO: 63124 - RNA, 22 nt, Human
uguguguauauauggaauauug

SEQ ID NO: 63125 - RNA, 22 nt, Human
uguuaaaaagucccuguuuugu

SEQ ID NO: 63126 - RNA, 22 nt, Human
uguuaacugccaggacagaucg

SEQ ID NO: 63127 - RNA, 22 nt, Human
uuggcuucuugcuaggaagcug

SEQ ID NO: 63128 - RNA, 22 nt, Human
uguuacugaaugucucugcuuu

SEQ ID NO: 63129 - RNA, 22 nt, Human
uuggcuuuucaguuuuaaguua

SEQ ID NO: 63130 - RNA, 22 nt, Human
uugggagaggcagcagagucau

SEQ ID NO: 63131 - RNA, 22 nt, Human
uguuccucuuagucuuaugugu

SEQ ID NO: 63132 - RNA, 22 nt, Human
uugggaguaauacugaagagag

SEQ ID NO: 63133 - RNA, 22 nt, Human
uugggauucugucagugugugu

SEQ ID NO: 63134 - RNA, 22 nt, Human
uuggggaaaaagaccuaaugac

SEQ ID NO: 63135 - RNA, 22 nt, Human
uguugaagcaccucugucuuuc

SEQ ID NO: 63136 - RNA, 22 nt, Human
uguugauuaauuuucccaaaca

SEQ ID NO: 63137 - RNA, 22 nt, Human
uguuuccuaagugucucugaag

SEQ ID NO: 63138 - RNA, 22 nt, Human
uuguagaucagauggccaguag

SEQ ID NO: 63139 - RNA, 22 nt, Human
uugguugaaauguguucaugcu

SEQ ID NO: 63140 - RNA, 22 nt, Human
uuguacuuaaauaugcaaauag

SEQ ID NO: 63141 - RNA, 22 nt, Human
uguugagaacaucucggggaca

SEQ ID NO: 63142 - RNA, 22 nt, Human
uguuggaaucuucuagucuucc

SEQ ID NO: 63143 - RNA, 22 nt, Human
uguugccaucuaaaauguuacu

SEQ ID NO: 63144 - RNA, 21 nt, Human
uguugcuugucugagacuaug

SEQ ID NO: 63145 - RNA, 22 nt, Human
uuggugaugcuaggaauguagu

SEQ ID NO: 63146 - RNA, 22 nt, Human
uuggugaugaaagugcugcgcu

SEQ ID NO: 63147 - RNA, 22 nt, Human
uuggugauguagcagcaauugu

SEQ ID NO: 63148 - RNA, 22 nt, Human
uugguguaauacaagcaauuug

SEQ ID NO: 63149 - RNA, 22 nt, Human
uuucuaaaauuacugcagucgg

SEQ ID NO: 63150 - RNA, 22 nt, Human
uuucgggauuucaaagagcaaa

SEQ ID NO: 63151 - RNA, 22 nt, Human
uuuccuuacuuauaaaaugggg

SEQ ID NO: 63152 - RNA, 22 nt, Human
uuuccuuuguuuugguauaugu

SEQ ID NO: 63153 - RNA, 22 nt, Human
uuauuguuuggguauaauuuga

SEQ ID NO: 63154 - RNA, 22 nt, Human
uuucuacauuuguaaccagauu

SEQ ID NO: 63155 - RNA, 22 nt, Human
uuucuaguagcuacagcaccau

SEQ ID NO: 63156 - RNA, 22 nt, Human
uuuccuuaauuguaaaauggag

SEQ ID NO: 63157 - RNA, 22 nt, Human
uuuccuguuuugguuuggagag

SEQ ID NO: 63158 - RNA, 22 nt, Human
uuauucuuagccucgguauuuc

SEQ ID NO: 63159 - RNA, 22 nt, Human
uuaugguuuaauauccagcaca

SEQ ID NO: 63160 - RNA, 22 nt, Human
uuaugugcuacacauaauuugu

SEQ ID NO: 63161 - RNA, 22 nt, Human
uuaugcaaaggggccucuuccu

SEQ ID NO: 63162 - RNA, 22 nt, Human
uuaucugcccauuguagaauug

SEQ ID NO: 63163 - RNA, 22 nt, Human
uuaucugugcuuuacugacaga

SEQ ID NO: 63164 - RNA, 22 nt, Human
uuaucuuuuaaaaacacuugug

SEQ ID NO: 63165 - RNA, 21 nt, Human
uuuccagaggcagccggacuc

SEQ ID NO: 63166 - RNA, 22 nt, Human
uuaucagggaguuguguguucu

SEQ ID NO: 63167 - RNA, 21 nt, Human
uuucauuaguacaucaauuug

SEQ ID NO: 63168 - RNA, 22 nt, Human
uuuccagacaugguuuuucaaa

SEQ ID NO: 63169 - RNA, 22 nt, Human
uuucagacugcccauguuugcc

SEQ ID NO: 63170 - RNA, 22 nt, Human
uuucauagaggcagcggcggau

SEQ ID NO: 63171 - RNA, 21 nt, Human
uuucauaggguuaaaggguua

SEQ ID NO: 63172 - RNA, 22 nt, Human
uuauaggugauuaauuuuaacc

SEQ ID NO: 63173 - RNA, 22 nt, Human
uuauaguggcuuggggaaaaaa

SEQ ID NO: 63174 - RNA, 22 nt, Human
uuauauuuuauuuaauuaaaua

SEQ ID NO: 63175 - RNA, 22 nt, Human
uuucaagccucacugcguuuug

SEQ ID NO: 63176 - RNA, 22 nt, Human
uuuauuuuccaugucucuaggu

SEQ ID NO: 63177 - RNA, 22 nt, Human
uuuauuugggauuucucaucug

SEQ ID NO: 63178 - RNA, 19 nt, Human
uuucacaaagagagcguga

SEQ ID NO: 63179 - RNA, 22 nt, Human
uuucacagcgucuuucucuugc

SEQ ID NO: 63180 - RNA, 22 nt, Human
uuucacugaguaggagagcacu

SEQ ID NO: 63181 - RNA, 22 nt, Human
uuuauugaccugaguaucagca

SEQ ID NO: 63182 - RNA, 22 nt, Human
uuuauuuagguaaacaugaguu

SEQ ID NO: 63183 - RNA, 19 nt, Human
uuuauuugagacaugccuu

SEQ ID NO: 63184 - RNA, 22 nt, Human
uuaggagugccaucuuguggac

SEQ ID NO: 63185 - RNA, 22 nt, Human
uuuaucaggccaucuuaugucu

SEQ ID NO: 63186 - RNA, 22 nt, Human
uuuaucaucuucugaauuugga

SEQ ID NO: 63187 - RNA, 22 nt, Human
uuuauaauuguuauguuaccca

SEQ ID NO: 63188 - RNA, 22 nt, Human
uuagcagacagauggagagaga

SEQ ID NO: 63189 - RNA, 22 nt, Human
uuagccuccaguuuucucauuu

SEQ ID NO: 63190 - RNA, 22 nt, Human
uuagcgcucucuccauucuuaa

SEQ ID NO: 63191 - RNA, 22 nt, Human
uuagagagaggagagagagaga

SEQ ID NO: 63192 - RNA, 22 nt, Human
uuagagagguuggagugguaga

SEQ ID NO: 63193 - RNA, 22 nt, Human
uuagagauuuuauguuaaugua

SEQ ID NO: 63194 - RNA, 22 nt, Human
uuaccugcagagacguggaggc

SEQ ID NO: 63195 - RNA, 22 nt, Human
uuuacuguuuacagcuaaugca

SEQ ID NO: 63196 - RNA, 22 nt, Human
uuacccuugaauuugugacaaa

SEQ ID NO: 63197 - RNA, 22 nt, Human
uuguaugcugggaagcgggagg

SEQ ID NO: 63198 - RNA, 22 nt, Human
uguuuguaugauggcacaucca

SEQ ID NO: 63199 - RNA, 22 nt, Human
uguuugaggugacucuggaaug

SEQ ID NO: 63200 - RNA, 23 nt, Human
uguuugggcuaucuuuuguucuc

SEQ ID NO: 63201 - RNA, 22 nt, Human
uuguauaaagauggcuagaucc

SEQ ID NO: 63202 - RNA, 22 nt, Human
uguuucguugguggagagcuac

SEQ ID NO: 63203 - RNA, 21 nt, Human
uguuugcuuuuggagcaacug

SEQ ID NO: 63204 - RNA, 19 nt, Human
uuuacuuaggccacagaau

SEQ ID NO: 63205 - RNA, 20 nt, Human
uuacucaaccaggcuucuac

SEQ ID NO: 63206 - RNA, 22 nt, Human
uuacuguaggugggugaauuug

SEQ ID NO: 63207 - RNA, 22 nt, Human
uuagaauggaaucauuugcauu

SEQ ID NO: 63208 - RNA, 22 nt, Human
uuagacagagcuccuugagggc

SEQ ID NO: 63209 - RNA, 22 nt, Human
uuagagaauagacuuuacccug

SEQ ID NO: 63210 - RNA, 22 nt, Human
uuguaggguauagcaggagaac

SEQ ID NO: 63211 - RNA, 22 nt, Human
uuuagcaguuuauuuaaggggg

SEQ ID NO: 63212 - RNA, 22 nt, Human
uuuagcauggacacugagggcu

SEQ ID NO: 63213 - RNA, 19 nt, Human
uuuagcuacugugguauua

SEQ ID NO: 63214 - RNA, 22 nt, Human
uuuagcugugugugucgcucca

SEQ ID NO: 63215 - RNA, 22 nt, Human
uuuaggaagaucugaaggaaga

SEQ ID NO: 63216 - RNA, 22 nt, Human
uuuagguccguguugcaguugg

SEQ ID NO: 63217 - RNA, 22 nt, Human
uuugaugagaaaugacuuaagu

SEQ ID NO: 63218 - RNA, 22 nt, Human
uucaaaccuaucuaagaaauag

SEQ ID NO: 63219 - RNA, 18 nt, Human
uuucuuuuauuccagguc

SEQ ID NO: 63220 - RNA, 22 nt, Human
uuauuuuguagcucugaucuuu

SEQ ID NO: 63221 - RNA, 22 nt, Human
uuauuuuuaggaauguagaggu

SEQ ID NO: 63222 - RNA, 22 nt, Human
uuugaagaaacagucuuaagag

SEQ ID NO: 63223 - RNA, 22 nt, Human
uuucuuugcugguuggcucucc

SEQ ID NO: 63224 - RNA, 22 nt, Human
uuauuugguuuuggcuuuagcu

SEQ ID NO: 63225 - RNA, 22 nt, Human
uuauuuuauaaagagaagacuu

SEQ ID NO: 63226 - RNA, 22 nt, Human
uuucuuccuucuugaucauuug

SEQ ID NO: 63227 - RNA, 22 nt, Human
uuucuugugauuuugaugaacu

SEQ ID NO: 63228 - RNA, 22 nt, Human
uuucugggggucgugcuggcug

SEQ ID NO: 63229 - RNA, 22 nt, Human
uuucuggaaacuguaaagagga

SEQ ID NO: 63230 - RNA, 22 nt, Human
uuucuggacuaaagggagagau

SEQ ID NO: 63231 - RNA, 22 nt, Human
uuucuuaaaagcuuuuaaaguu

SEQ ID NO: 63232 - RNA, 22 nt, Human
uuauuucauguaaaauuuaugu

SEQ ID NO: 63233 - RNA, 22 nt, Human
uuauuucuucucgaagcuuggg

SEQ ID NO: 63234 - RNA, 22 nt, Human
uuauuucaggcauuuguaaaug

SEQ ID NO: 63235 - RNA, 22 nt, Human
uuauuuaaguauuuauugaagu

SEQ ID NO: 63236 - RNA, 20 nt, Human
uuucucccacaaugacccuc

SEQ ID NO: 63237 - RNA, 22 nt, Human
uuucucuuguauuugaaucacu

SEQ ID NO: 63238 - RNA, 22 nt, Human
uuucugaugaaguagaaagacc

SEQ ID NO: 63239 - RNA, 22 nt, Human
uuucugcauuuguauuggaaaa

SEQ ID NO: 63240 - RNA, 22 nt, Human
uuugcaggaaauguacugaaug

SEQ ID NO: 63241 - RNA, 22 nt, Human
uuugcaaaguccauugaaguua

SEQ ID NO: 63242 - RNA, 23 nt, Human
uuugcaaauuggacacaaccaca

SEQ ID NO: 63243 - RNA, 22 nt, Human
uuugauuuuguuuauagugccg

SEQ ID NO: 63244 - RNA, 22 nt, Human
uucagaugcuugauuauggcaa

SEQ ID NO: 63245 - RNA, 22 nt, Human
uucagguuuuuaaguucugccu

SEQ ID NO: 63246 - RNA, 22 nt, Human
uuugggcuuuguuuuaagguau

SEQ ID NO: 63247 - RNA, 22 nt, Human
uuuggggcucauuugcuuuugu

SEQ ID NO: 63248 - RNA, 22 nt, Human
uuuggguauuaguuuagcuaga

SEQ ID NO: 63249 - RNA, 22 nt, Human
uuuggguuuuuccuuagggacu

SEQ ID NO: 63250 - RNA, 22 nt, Human
uuuggucuggaaucuucagggu

SEQ ID NO: 63251 - RNA, 22 nt, Human
uuugggaaguaauuaauugcag

SEQ ID NO: 63252 - RNA, 22 nt, Human
uucauugcuacuuaaaauacca

SEQ ID NO: 63253 - RNA, 22 nt, Human
uucauuuccauuuuauagauaa

SEQ ID NO: 63254 - RNA, 22 nt, Human
uuuguaaguuuguucuccuggg

SEQ ID NO: 63255 - RNA, 22 nt, Human
uucauugauuuccuuggaauaa

SEQ ID NO: 63256 - RNA, 22 nt, Human
uuugguguuuucaggaauauac

SEQ ID NO: 63257 - RNA, 22 nt, Human
uuuggugauuuuuaaucccccu

SEQ ID NO: 63258 - RNA, 22 nt, Human
uuuguauuucaaggcacucuca

SEQ ID NO: 63259 - RNA, 22 nt, Human
uuugucaggaauugaaaaguuu

SEQ ID NO: 63260 - RNA, 22 nt, Human
uuuguauuguuuauuucauuuu

SEQ ID NO: 63261 - RNA, 22 nt, Human
uuccaugccuaagagccugaag

SEQ ID NO: 63262 - RNA, 17 nt, Human
uuugugauggcagaugc

SEQ ID NO: 63263 - RNA, 22 nt, Human
uuuguggaaaagagcccaggag

SEQ ID NO: 63264 - RNA, 22 nt, Human
uuuguggugagcagggaacguc

SEQ ID NO: 63265 - RNA, 22 nt, Human
uuugugguuuugagagaguugc

SEQ ID NO: 63266 - RNA, 22 nt, Human
uuuguuaugguuggaagcagga

SEQ ID NO: 63267 - RNA, 22 nt, Human
uucuccucuuugucacugcuuu

SEQ ID NO: 63268 - RNA, 22 nt, Human
uucuccugcccuuggacuucca

SEQ ID NO: 63269 - RNA, 22 nt, Human
uucuccaccugcuccucccacc

SEQ ID NO: 63270 - RNA, 22 nt, Human
uucucuauuugcugcaccucuc

SEQ ID NO: 63271 - RNA, 22 nt, Human
uucucucaguuaaacuuuguga

SEQ ID NO: 63272 - RNA, 22 nt, Human
uucucagagaaagcuccucaug

SEQ ID NO: 63273 - RNA, 22 nt, Human
uucuccucagcaaggcagcuuu

SEQ ID NO: 63274 - RNA, 22 nt, Human
uucuagauagucugauauuccu

SEQ ID NO: 63275 - RNA, 22 nt, Human
uucuagccauagaaauuagauu

SEQ ID NO: 63276 - RNA, 22 nt, Human
uucuaggagucugguuccugcc

SEQ ID NO: 63277 - RNA, 22 nt, Human
uucuagcucauggugacagauc

SEQ ID NO: 63278 - RNA, 22 nt, Human
uucuaguuacagaagccuugcu

SEQ ID NO: 63279 - RNA, 22 nt, Human
uuuuauuuguauguugaaugua

SEQ ID NO: 63280 - RNA, 22 nt, Human
uucguucagcgcuugcgcaugc

SEQ ID NO: 63281 - RNA, 20 nt, Human
uucguuucaguguuggauca

SEQ ID NO: 63282 - RNA, 18 nt, Human
uucuaaauucuguuuuua

SEQ ID NO: 63283 - RNA, 22 nt, Human
uuccuaauugccaugaaguuau

SEQ ID NO: 63284 - RNA, 22 nt, Human
uucccuuggcuuugauuguguu

SEQ ID NO: 63285 - RNA, 22 nt, Human
uuuguucuucucaugcacacaa

SEQ ID NO: 63286 - RNA, 22 nt, Human
uuuguugaauggcaggauuuua

SEQ ID NO: 63287 - RNA, 22 nt, Human
uucccugugcaguauguuccaa

SEQ ID NO: 63288 - RNA, 17 nt, Human
uucugcucaggaacaga

SEQ ID NO: 63289 - RNA, 18 nt, Human
uucugcggugacagauau

SEQ ID NO: 63290 - RNA, 22 nt, Human
uucucuuguaaaauuccuuuuu

SEQ ID NO: 63291 - RNA, 22 nt, Human
uucugaaacauugcuauuuucc

SEQ ID NO: 63292 - RNA, 22 nt, Human
uucugaaccauugagcacugcc

SEQ ID NO: 63293 - RNA, 22 nt, Human
uucucugcgcuccggcccaguu

SEQ ID NO: 63294 - RNA, 22 nt, Human
uucuggacuuccaaauggcuuc

SEQ ID NO: 63295 - RNA, 22 nt, Human
uucugcuuuaaagcucauguuu

SEQ ID NO: 63296 - RNA, 23 nt, Human
uucugcuucccauagcacuuugu

SEQ ID NO: 63297 - RNA, 22 nt, Human
uucuggagacccagcaacaggg

SEQ ID NO: 63298 - RNA, 22 nt, Human
uucuguacuagaucuuaucagu

SEQ ID NO: 63299 - RNA, 22 nt, Human
uuuuggagaaaugggacuuaau

SEQ ID NO: 63300 - RNA, 20 nt, Human
uucuguggcccguuuaagug

SEQ ID NO: 63301 - RNA, 19 nt, Human
uugaauguuugauagucuc

SEQ ID NO: 63302 - RNA, 22 nt, Human
uuuuuuguuccuugguuuuugu

SEQ ID NO: 63303 - RNA, 22 nt, Human
uuuuuuuaaguuuugauuuuag

SEQ ID NO: 63304 - RNA, 22 nt, Human
uugacucuuucauuuauuauuu

SEQ ID NO: 63305 - RNA, 22 nt, Human
uuuuuuuguagguguaugaaaa

SEQ ID NO: 63306 - RNA, 22 nt, Human
uuuuuuuuacuccggacagcuc

SEQ ID NO: 63307 - RNA, 20 nt, Human
uugaggagauauugaauacu

SEQ ID NO: 63308 - RNA, 22 nt, Human
uuuuuucuggaguuugggguuu

SEQ ID NO: 63309 - RNA, 22 nt, Human
uuuuuucuucucuaucuuaaua

SEQ ID NO: 63310 - RNA, 22 nt, Human
uugaaggugggaggauuuauau

SEQ ID NO: 63311 - RNA, 22 nt, Human
uugaacguguaggaagcugguu

SEQ ID NO: 63312 - RNA, 22 nt, Human
uugaaaauuaauagguguacaa

SEQ ID NO: 63313 - RNA, 22 nt, Human
uuuuucugacugcuaacaaaaa

SEQ ID NO: 63314 - RNA, 22 nt, Human
uuuuuguuauuuagguguagag

SEQ ID NO: 63315 - RNA, 22 nt, Human
uuuuucuccucucucuuucauu

SEQ ID NO: 63316 - RNA, 21 nt, Human
uuuuucuccagaguuuccacu

SEQ ID NO: 63317 - RNA, 19 nt, Human
uucuuuccccaccccuacc

SEQ ID NO: 63318 - RNA, 23 nt, Human
uucuuuccuuaucccauuuacuu

SEQ ID NO: 63319 - RNA, 22 nt, Human
uucuucuuuccuauaauuaauu

SEQ ID NO: 63320 - RNA, 22 nt, Human
uuuuuaccugguguccagcuuc

SEQ ID NO: 63321 - RNA, 22 nt, Human
uuuuuagcuguuauuguggaag

SEQ ID NO: 63322 - RNA, 22 nt, Human
uuuugggugcaaauuguuuguu

SEQ ID NO: 63323 - RNA, 22 nt, Human
uucuguucuuuguccccuuggu

SEQ ID NO: 63324 - RNA, 22 nt, Human
uuuuguagauuggaaaaucugg

SEQ ID NO: 63325 - RNA, 22 nt, Human
uuuuguagauagggaaacagag

SEQ ID NO: 63326 - RNA, 22 nt, Human
uucuuaggauuauuuaaaauuc

SEQ ID NO: 63327 - RNA, 22 nt, Human
uucuuauuuuucguaaauccug

SEQ ID NO: 63328 - RNA, 22 nt, Human
uuuuguuacugauuauuaaaau

SEQ ID NO: 63329 - RNA, 22 nt, Human
uuuuguuuacauuaaauuuuga

SEQ ID NO: 63330 - RNA, 21 nt, Human
uuuuguguugcgcacuuugag

SEQ ID NO: 63331 - RNA, 20 nt, Human
uugcaaagugaauagcaauu

SEQ ID NO: 63332 - RNA, 22 nt, Human
uugcagcuguugcaaagucucu

SEQ ID NO: 63333 - RNA, 22 nt, Human
uugcaugauuuaagaauaucug

SEQ ID NO: 63334 - RNA, 20 nt, Human
uugcaugcagccggaugcug

SEQ ID NO: 63335 - RNA, 22 nt, Human
uugcaugugugaaaugcacaga

SEQ ID NO: 63336 - RNA, 22 nt, Human
uugccuacaaacgaaucuaucu

SEQ ID NO: 63337 - RNA, 22 nt, Human
uugccucuaauuagcucuguga

SEQ ID NO: 63338 - RNA, 22 nt, Human
uugcguaucuacauugccugua

SEQ ID NO: 63339 - RNA, 22 nt, Human
uugcucaccugagaagaauaga

SEQ ID NO: 63340 - RNA, 20 nt, Human
uugcucucuuguguugaugu

SEQ ID NO: 63341 - RNA, 21 nt, Human
uugcuggagcaauguaaauca

SEQ ID NO: 63342 - RNA, 22 nt, Human
uugcuuaggccaaauggcgcau

SEQ ID NO: 63343 - RNA, 22 nt, Human
uugcuugaacccaggaagugga

SEQ ID NO: 63344 - RNA, 22 nt, Human
uugcuuucuuuguagguuuucc

SEQ ID NO: 63345 - RNA, 22 nt, Human
uuggagaaagcugcaggcucug

SEQ ID NO: 63346 - RNA, 22 nt, Human
uuggagagggugggcuuugaag

SEQ ID NO: 63347 - RNA, 22 nt, Human
uuggaagagagauggggagaga

SEQ ID NO: 63348 - RNA, 22 nt, Human
uuggaaguggcaaaggcuaaag

SEQ ID NO: 63349 - RNA, 23 nt, Human
uugcuugagcccaggaaguggag

SEQ ID NO: 63350 - RNA, 23 nt, Human
uugcuuuugccccaaaagaguua

SEQ ID NO: 63351 - RNA, 22 nt, Human
uuggaagacagccgucuuuauu

SEQ ID NO: 63352 - RNA, 22 nt, Human
uuuaaaacagcauuuaaaaggu

SEQ ID NO: 63353 - RNA, 22 nt, Human
uuuaaaacaguacguuuucuua

SEQ ID NO: 63354 - RNA, 22 nt, Human
uuguuuuaaaaagaauaacuac

SEQ ID NO: 63355 - RNA, 22 nt, Human
uuguuuucuugaugaaauuauu

SEQ ID NO: 63356 - RNA, 21 nt, Human
uugugaaaguccaggaacaac

SEQ ID NO: 63357 - RNA, 22 nt, Human
uuguuugcacuuuagagacugu

SEQ ID NO: 63358 - RNA, 22 nt, Human
uuguuuggcaaaugugugugug

SEQ ID NO: 63359 - RNA, 22 nt, Human
uuguuugguugacugauuuacc

SEQ ID NO: 63360 - RNA, 22 nt, Human
uuguuuguaaggcucuuagaau

SEQ ID NO: 63361 - RNA, 20 nt, Human
uuuaacuggccuucuggcuc

SEQ ID NO: 63362 - RNA, 22 nt, Human
uuuaagguacagcuagcagcau

SEQ ID NO: 63363 - RNA, 22 nt, Human
uuuaaugaugucuaugccuguu

SEQ ID NO: 63364 - RNA, 22 nt, Human
uuguccacuaagaaagugcccu

SEQ ID NO: 63365 - RNA, 22 nt, Human
uugucucuacagagaguaguag

SEQ ID NO: 63366 - RNA, 22 nt, Human
uugucuuggcauaccguuauau

SEQ ID NO: 63367 - RNA, 22 nt, Human
uugucuuucguauggaacacua

SEQ ID NO: 63368 - RNA, 20 nt, Human
uuguacuuaugugagaagga

SEQ ID NO: 63369 - RNA, 22 nt, Human
uugguaaccaaucaaaugugag

SEQ ID NO: 63370 - RNA, 22 nt, Human
uugguauucaguuggauuugga

SEQ ID NO: 63371 - RNA, 22 nt, Human
uuuuaaaacaugucaaaaugug

SEQ ID NO: 63372 - RNA, 22 nt, Human
uuuguuugcuaguauuuuguuu

SEQ ID NO: 63373 - RNA, 22 nt, Human
uuuguuugcugagugaauucaa

SEQ ID NO: 63374 - RNA, 22 nt, Human
uuuguuuccagccuuuugucuu

SEQ ID NO: 63375 - RNA, 17 nt, Human
uuuguuucauacuucau

SEQ ID NO: 63376 - RNA, 22 nt, Human
uuuguuuauuuacuuugggccu

SEQ ID NO: 63377 - RNA, 22 nt, Human
uuuguucaccuagcaaacuuuu

SEQ ID NO: 63378 - RNA, 22 nt, Human
uuuguucuagauaacugguaau

SEQ ID NO: 63379 - RNA, 22 nt, Human
uuuagaugcuguauguuauuuc

SEQ ID NO: 63380 - RNA, 22 nt, Human
uuuguguuuugaggucuugcaa

SEQ ID NO: 63381 - RNA, 22 nt, Human
uuuagaaugaaugcaagagaau

SEQ ID NO: 63382 - RNA, 22 nt, Human
uuuagagauaaaugcucuccca

SEQ ID NO: 63383 - RNA, 22 nt, Human
uuuaaugucuuggaaaaagacu

SEQ ID NO: 63384 - RNA, 22 nt, Human
uuuacucagucugagcaggugu

SEQ ID NO: 63385 - RNA, 22 nt, Human
uuuacuuuugguaaggucauuu

SEQ ID NO: 63386 - RNA, 22 nt, Human
uuuuaauccucuugguaucuua

SEQ ID NO: 63387 - RNA, 22 nt, Human
uuuuaauucaacauuugcuuuu

SEQ ID NO: 63388 - RNA, 23 nt, Human
uuuuaauaguaugacaugagcug

SEQ ID NO: 63389 - RNA, 23 nt, Human
uuuuacaagagugcauuugucuc

SEQ ID NO: 63390 - RNA, 22 nt, Human
uuuuaacuuuggguucucuuua

SEQ ID NO: 63391 - RNA, 22 nt, Human
uuuuacauuuuauucguuuauu

SEQ ID NO: 63392 - RNA, 22 nt, Human
uuuuaaaguaauugaagcuugu

SEQ ID NO: 63393 - RNA, 22 nt, Human
uuuuaaguauuuucuuuuuuua

SEQ ID NO: 63394 - RNA, 22 nt, Human
uuuuagagacagcauggagaaa

SEQ ID NO: 63395 - RNA, 22 nt, Human
uuuuaggauuugaguugcugga

SEQ ID NO: 63396 - RNA, 22 nt, Human
uuuuaguaauacuuuggccuuu

SEQ ID NO: 63397 - RNA, 22 nt, Human
uuuuauaaaaccuguuugaccu

SEQ ID NO: 63398 - RNA, 22 nt, Human
uuuuauaauacccuugacuaau

SEQ ID NO: 63399 - RNA, 22 nt, Human
uuuuucacacuccuuuccaguu

SEQ ID NO: 63400 - RNA, 22 nt, Human
uuuuuauguaaaauauuaaaag

SEQ ID NO: 63401 - RNA, 22 nt, Human
uuuuuagggauuaguguuugag

SEQ ID NO: 63402 - RNA, 22 nt, Human
uuuuuauaagagcagcagaguu

SEQ ID NO: 63403 - RNA, 22 nt, Human
uuuuuaaaagaugauuuaauga

SEQ ID NO: 63404 - RNA, 22 nt, Human
uuuuuaaaauuaggacggcacg

SEQ ID NO: 63405 - RNA, 22 nt, Human
uuuuuaauuuuaagcuauuugu

SEQ ID NO: 63406 - RNA, 22 nt, Human
uuuugucagggcaggaggaaga

SEQ ID NO: 63407 - RNA, 22 nt, Human
uuuuguggacugauccgaggac

SEQ ID NO: 63408 - RNA, 18 nt, Human
uuuuguguuuauucugca

SEQ ID NO: 63409 - RNA, 22 nt, Human
uuuuggaaaaaccaguauggaa

SEQ ID NO: 63410 - RNA, 22 nt, Human
uuuugcuucuaguauauuuuuu

SEQ ID NO: 63411 - RNA, 22 nt, Human
uuuuggauugcuaacucagggu

SEQ ID NO: 63412 - RNA, 22 nt, Human
uuuugguauggcuugauagagu

SEQ ID NO: 63413 - RNA, 22 nt, Human
uuuuccuuaacagagggagaaa

SEQ ID NO: 63414 - RNA, 22 nt, Human
uuuuccuuagaaauacauugau

SEQ ID NO: 63415 - RNA, 22 nt, Human
uuuuccuuccugucucuuuauu

SEQ ID NO: 63416 - RNA, 22 nt, Human
uuuuccaaaaguggagaggaau

SEQ ID NO: 63417 - RNA, 22 nt, Human
uuuucauuguuaguuucuccuu

SEQ ID NO: 63418 - RNA, 22 nt, Human
uuuucucacugagagccuugau

SEQ ID NO: 63419 - RNA, 22 nt, Human
uuuucuacaaaucuggacuuuu

SEQ ID NO: 63420 - RNA, 22 nt, Human
uuuuccuugagucggggcacag

SEQ ID NO: 63421 - RNA, 22 nt, Human
uuuucggagaauguuaaugugu

SEQ ID NO: 63422 - RNA, 22 nt, Human
uuuugccuauuguaucaucgua

SEQ ID NO: 63423 - RNA, 22 nt, Human
uuuugcuagaaaucaccaauac

SEQ ID NO: 63424 - RNA, 22 nt, Human
uuuugaugaccauucuucuuuu

SEQ ID NO: 63425 - RNA, 22 nt, Human
uuuugauacaaguuguaaaaaa

SEQ ID NO: 63426 - RNA, 22 nt, Human
uuuucucuuugcuucucuaaaa

SEQ ID NO: 63427 - RNA, 22 nt, Human
uuuucucucacuucacauauuu

SEQ ID NO: 63428 - RNA, 22 nt, Human
uuuucuguuuaugaaauugugu

SEQ ID NO: 63429 - RNA, 22 nt, Human
uuuucuugagucacuccaguga

SEQ ID NO: 63430 - RNA, 22 nt, Human
uuuucugauccuucuaacuuga

SEQ ID NO: 63431 - RNA, 22 nt, Human
uuuucuucggugcuggguugau

SEQ ID NO: 63432 - RNA, 22 nt, Human
uuuuuuuagaaagaucauaguu

SEQ ID NO: 63433 - RNA, 18 nt, Human
uuuuuuguucuguuuugu

SEQ ID NO: 63434 - RNA, 22 nt, Human
uuuuuugguuuggggauuauuu

SEQ ID NO: 63435 - RNA, 22 nt, Human
uuuuuugucuugaagaaauggu

SEQ ID NO: 63436 - RNA, 22 nt, Human
uuuuuuguggcuggaagaaaaa

SEQ ID NO: 63437 - RNA, 22 nt, Human
uuuuuuccuguuugucuuuggg

SEQ ID NO: 63438 - RNA, 22 nt, Human
uuuuugggccaaauauauuuac

SEQ ID NO: 63439 - RNA, 22 nt, Human
uuuuuguauaugcuucgaggau

SEQ ID NO: 63440 - RNA, 22 nt, Human
uuuuugggaagaauucugauau

SEQ ID NO: 63441 - RNA, 22 nt, Human
uuuuugcuuuuuugucaucuaa

SEQ ID NO: 63442 - RNA, 21 nt, Human
uuuuuggagggguggggagga

SEQ ID NO: 63443 - RNA, 22 nt, Human
uuuuucuccauuccaggugccu

SEQ ID NO: 63444 - RNA, 19 nt, Human
uuuuucccccucuccucag

SEQ ID NO: 63445 - RNA, 22 nt, Human
uuuuugaauaagugcaucauca

SEQ ID NO: 63446 - RNA, 22 nt, Human
aaaaauuucuggugaaaugccu

SEQ ID NO: 63447 - RNA, 22 nt, Human
aaaaccugcaagaugaaaucag

SEQ ID NO: 63448 - RNA, 22 nt, Human
aaaagggucugacacugcuuga

SEQ ID NO: 63449 - RNA, 22 nt, Human
aaaagguauuuagcgauugcau

SEQ ID NO: 63450 - RNA, 22 nt, Human
aaaaggucacuguaaaaugacg

SEQ ID NO: 63451 - RNA, 22 nt, Human
aaaaggauauuuggugcaaagc

SEQ ID NO: 63452 - RNA, 22 nt, Human
aaaagauguaaacauauauuaa

SEQ ID NO: 63453 - RNA, 22 nt, Human
aaaagcgaagagaacugaaguu

SEQ ID NO: 63454 - RNA, 22 nt, Human
aaaagcucucuucuucggcuuu

SEQ ID NO: 63455 - RNA, 22 nt, Human
aaacaaauccaauaauaaaauu

SEQ ID NO: 63456 - RNA, 22 nt, Human
aaaaguauaagugucuccugau

SEQ ID NO: 63457 - RNA, 22 nt, Human
aaaauauuuaucuagcucuuaa

SEQ ID NO: 63458 - RNA, 22 nt, Human
aaaaucucagaaaaguuuaggu

SEQ ID NO: 63459 - RNA, 22 nt, Human
aaaauuuccuuggaccauuuuu

SEQ ID NO: 63460 - RNA, 22 nt, Human
aaacaagagcuuacauggcugc

SEQ ID NO: 63461 - RNA, 22 nt, Human
aaacgcauucuuacaugcuucc

SEQ ID NO: 63462 - RNA, 22 nt, Human
aaacgcaauuucuugcauguca

SEQ ID NO: 63463 - RNA, 22 nt, Human
aaacagguuugaacuucuuaac

SEQ ID NO: 63464 - RNA, 22 nt, Human
aaaaugggaaaauuuuagauua

SEQ ID NO: 63465 - RNA, 22 nt, Human
aaagcaaauaguugcuuaauau

SEQ ID NO: 63466 - RNA, 22 nt, Human
aaagaauuucaagauucccaca

SEQ ID NO: 63467 - RNA, 22 nt, Human
aaagaugucauacacauuaaga

SEQ ID NO: 63468 - RNA, 22 nt, Human
aaagagggaaggaaggagugaa

SEQ ID NO: 63469 - RNA, 22 nt, Human
aaagagugugcauguaccugug

SEQ ID NO: 63470 - RNA, 22 nt, Human
aaagaggacgugcuauuuuuua

SEQ ID NO: 63471 - RNA, 22 nt, Human
aaagaguuguauucuuuuugag

SEQ ID NO: 63472 - RNA, 23 nt, Human
aaacuacauuuauaguuuuucuc

SEQ ID NO: 63473 - RNA, 22 nt, Human
aaacuuuaucaaguacucuuca

SEQ ID NO: 63474 - RNA, 22 nt, Human
aaagaacguuucugggaaucag

SEQ ID NO: 63475 - RNA, 21 nt, Human
aaagaagagcucagagguaga

SEQ ID NO: 63476 - RNA, 22 nt, Human
aaagaagugucuuacucccucu

SEQ ID NO: 63477 - RNA, 22 nt, Human
aaagaguuaagagucuuaagcu

SEQ ID NO: 63478 - RNA, 22 nt, Human
aaagccagggacagugugcaug

SEQ ID NO: 63479 - RNA, 22 nt, Human
aaagcauuuguuucuccuggaa

SEQ ID NO: 63480 - RNA, 22 nt, Human
aaagccaagucugauuuuguug

SEQ ID NO: 63481 - RNA, 17 nt, Human
aaagccgaucagauguu

SEQ ID NO: 63482 - RNA, 22 nt, Human
aaagcagguugcaauuacagug

SEQ ID NO: 63483 - RNA, 22 nt, Human
aaagcccuccaggguauacauu

SEQ ID NO: 63484 - RNA, 22 nt, Human
aaagcauucuaaccgaucgacg

SEQ ID NO: 63485 - RNA, 22 nt, Human
aaagccaagguccauguacuuu

SEQ ID NO: 63486 - RNA, 22 nt, Human
aaagggcugaaguagucucugu

SEQ ID NO: 63487 - RNA, 22 nt, Human
aaaggcaugugcaacuacaaau

SEQ ID NO: 63488 - RNA, 22 nt, Human
aaagguggugguuagggaauau

SEQ ID NO: 63489 - RNA, 22 nt, Human
aaaguaaagccuauuuaauaau

SEQ ID NO: 63490 - RNA, 22 nt, Human
aacaaagaaaagcuugagguuu

SEQ ID NO: 63491 - RNA, 22 nt, Human
aacagggcaguuccuuauagug

SEQ ID NO: 63492 - RNA, 22 nt, Human
aacagggcgugaauaaugaaga

SEQ ID NO: 63493 - RNA, 22 nt, Human
aacaggcuaaauuguccauuuc

SEQ ID NO: 63494 - RNA, 22 nt, Human
aacaaguagaauagguuuuuuu

SEQ ID NO: 63495 - RNA, 22 nt, Human
aacacguuuauccuaagaacuc

SEQ ID NO: 63496 - RNA, 22 nt, Human
aacaugggcaacuucuuuucag

SEQ ID NO: 63497 - RNA, 22 nt, Human
aacauuguggacaagggcaggu

SEQ ID NO: 63498 - RNA, 20 nt, Human
aacagcucucgacuuaucuu

SEQ ID NO: 63499 - RNA, 22 nt, Human
aacaaccuaguaguaucuuuca

SEQ ID NO: 63500 - RNA, 22 nt, Human
aacaaagaacuuucuuccuuug

SEQ ID NO: 63501 - RNA, 19 nt, Human
aacaaaauaguucuaguua

SEQ ID NO: 63502 - RNA, 22 nt, Human
aaauuaaaguuuuauuuagagc

SEQ ID NO: 63503 - RNA, 22 nt, Human
aaauguauuagccuaugugaga

SEQ ID NO: 63504 - RNA, 22 nt, Human
aaauuuauaacuuaaagugaau

SEQ ID NO: 63505 - RNA, 17 nt, Human
aaaugguccuagggauu

SEQ ID NO: 63506 - RNA, 22 nt, Human
aaaugguguucuuuagaugaaa

SEQ ID NO: 63507 - RNA, 22 nt, Human
aaauuaggcccugauuuuaugu

SEQ ID NO: 63508 - RNA, 22 nt, Human
aaaugcucgccagguuuuauua

SEQ ID NO: 63509 - RNA, 22 nt, Human
aaauggaaguuuguucucagcc

SEQ ID NO: 63510 - RNA, 22 nt, Human
aaaugcuuuaauugaguucaug

SEQ ID NO: 63511 - RNA, 22 nt, Human
aaaucaaaagugguuauuuuau

SEQ ID NO: 63512 - RNA, 22 nt, Human
aaaucaagucagcugaauucca

SEQ ID NO: 63513 - RNA, 22 nt, Human
aaauauugaauuugaggaugua

SEQ ID NO: 63514 - RNA, 22 nt, Human
aaaucuuccugaaauuuguuca

SEQ ID NO: 63515 - RNA, 22 nt, Human
aaaucuuucacauauuuuuuau

SEQ ID NO: 63516 - RNA, 22 nt, Human
aaauauagugacacuuauaguc

SEQ ID NO: 63517 - RNA, 22 nt, Human
aaauauauauaauauauauauu

SEQ ID NO: 63518 - RNA, 22 nt, Human
aaagcugaaacgaaaugacaac

SEQ ID NO: 63519 - RNA, 22 nt, Human
aaaggaaacuaugaaucucugg

SEQ ID NO: 63520 - RNA, 22 nt, Human
aaagggaugauuucugaagaua

SEQ ID NO: 63521 - RNA, 21 nt, Human
aaagugguaaggauuauuuug

SEQ ID NO: 63522 - RNA, 22 nt, Human
aaaguguuuaacaaauugcuuu

SEQ ID NO: 63523 - RNA, 22 nt, Human
aaaggugccucuuacaaggcuu

SEQ ID NO: 63524 - RNA, 23 nt, Human
aaaguacuuaaucugcaaaccac

SEQ ID NO: 63525 - RNA, 22 nt, Human
aaaguagaauaauaaacccuug

SEQ ID NO: 63526 - RNA, 22 nt, Human
aaaguugcauccuaugaccuca

SEQ ID NO: 63527 - RNA, 22 nt, Human
aaaguuuguacugggaguuacu

SEQ ID NO: 63528 - RNA, 22 nt, Human
aaauaggaguagugauguauua

SEQ ID NO: 63529 - RNA, 22 nt, Human
aaauaggucaaucagacuauga

SEQ ID NO: 63530 - RNA, 22 nt, Human
aaauagucagaaaucaacgugc

SEQ ID NO: 63531 - RNA, 22 nt, Human
aaauagauuugacuacuuggug

SEQ ID NO: 63532 - RNA, 21 nt, Human
aaauccagugaucuccucuaa

SEQ ID NO: 63533 - RNA, 22 nt, Human
aaauccaucaaaucuucuagaa

SEQ ID NO: 63534 - RNA, 22 nt, Human
aaaucgcuugaacccaggaagu

SEQ ID NO: 63535 - RNA, 22 nt, Human
aaaguagaugagaauuuuguug

SEQ ID NO: 63536 - RNA, 22 nt, Human
aaaggggugguauuucuuuugg

SEQ ID NO: 63537 - RNA, 22 nt, Human
aaauauuaaugaugaagguagu

SEQ ID NO: 63538 - RNA, 22 nt, Human
aaauauuugaaugguguaagau

SEQ ID NO: 63539 - RNA, 22 nt, Human
aagaaagaucugaaagaagcga

SEQ ID NO: 63540 - RNA, 22 nt, Human
aagaaaccauauuaguuccugg

SEQ ID NO: 63541 - RNA, 22 nt, Human
aagaaaagguaaccgcuuaucu

SEQ ID NO: 63542 - RNA, 22 nt, Human
aagacagugacagucacaauug

SEQ ID NO: 63543 - RNA, 22 nt, Human
aagaaaggagauauucuuuuag

SEQ ID NO: 63544 - RNA, 22 nt, Human
aagaaaggcacaagaaagaaaa

SEQ ID NO: 63545 - RNA, 22 nt, Human
aagaaauacagaaauggcagua

SEQ ID NO: 63546 - RNA, 22 nt, Human
aagaaauagauagaggaauacu

SEQ ID NO: 63547 - RNA, 22 nt, Human
aagaacuagauagugguguaaa

SEQ ID NO: 63548 - RNA, 22 nt, Human
aagagaaaaaucuuaaucuagu

SEQ ID NO: 63549 - RNA, 22 nt, Human
aagacccuaccccuggagagga

SEQ ID NO: 63550 - RNA, 22 nt, Human
aagagaaacauauggccagauu

SEQ ID NO: 63551 - RNA, 22 nt, Human
aagagaaagggaaaaugguaaa

SEQ ID NO: 63552 - RNA, 22 nt, Human
aagaaggcggaccagaagggag

SEQ ID NO: 63553 - RNA, 22 nt, Human
aagaagguugaaugacuacuuu

SEQ ID NO: 63554 - RNA, 22 nt, Human
aagaaugaaaugaaagaacuaa

SEQ ID NO: 63555 - RNA, 23 nt, Human
aagaaugcuucugaagagcugcc

SEQ ID NO: 63556 - RNA, 22 nt, Human
aagacacuuucuaaauagaagu

SEQ ID NO: 63557 - RNA, 22 nt, Human
aagacagaaaagcagagagagg

SEQ ID NO: 63558 - RNA, 22 nt, Human
aagaggcuacagcccugugucu

SEQ ID NO: 63559 - RNA, 22 nt, Human
aagagugaguagcuugguuggu

SEQ ID NO: 63560 - RNA, 22 nt, Human
aagagugugagguugugcuuuu

SEQ ID NO: 63561 - RNA, 22 nt, Human
aagaugcaagcauuuugaacug

SEQ ID NO: 63562 - RNA, 22 nt, Human
aagaugcuucaugagaguuggg

SEQ ID NO: 63563 - RNA, 22 nt, Human
aagaugaucagagggcaagagg

SEQ ID NO: 63564 - RNA, 22 nt, Human
aagaugaguuacaaaggaguaa

SEQ ID NO: 63565 - RNA, 22 nt, Human
aagauagaaugauguuggcuca

SEQ ID NO: 63566 - RNA, 22 nt, Human
aagaguuaggagugggcuuuga

SEQ ID NO: 63567 - RNA, 23 nt, Human
aagcaacagacuucaucagauau

SEQ ID NO: 63568 - RNA, 22 nt, Human
aagcaaaugguauugguauuau

SEQ ID NO: 63569 - RNA, 22 nt, Human
aagauauauaacccuuucacuu

SEQ ID NO: 63570 - RNA, 22 nt, Human
aagauauauaaggaaguucagu

SEQ ID NO: 63571 - RNA, 22 nt, Human
aagcaacccagugcuuguauag

SEQ ID NO: 63572 - RNA, 22 nt, Human
aagcagcauaugacagcaucca

SEQ ID NO: 63573 - RNA, 22 nt, Human
aagcaaguucuaaaguaauucu

SEQ ID NO: 63574 - RNA, 22 nt, Human
aagcaaagucaucuagaguagu

SEQ ID NO: 63575 - RNA, 22 nt, Human
aagcucagcugguggugauugc

SEQ ID NO: 63576 - RNA, 22 nt, Human
aaggaaaaccugacugaagaac

SEQ ID NO: 63577 - RNA, 20 nt, Human
aagcuguguucaagauggga

SEQ ID NO: 63578 - RNA, 18 nt, Human
aagcugcauuauuuuggc

SEQ ID NO: 63579 - RNA, 22 nt, Human
aagcuguuagggagugguaggu

SEQ ID NO: 63580 - RNA, 22 nt, Human
aaacauaugccuucuuuuguaa

SEQ ID NO: 63581 - RNA, 22 nt, Human
aagcuguuauuucacagguuca

SEQ ID NO: 63582 - RNA, 22 nt, Human
aaggaaaaaauggcuugugaua

SEQ ID NO: 63583 - RNA, 22 nt, Human
aagccugguuauuugaggaugu

SEQ ID NO: 63584 - RNA, 22 nt, Human
aagcucuuuccacuaaaccacu

SEQ ID NO: 63585 - RNA, 22 nt, Human
aaggaguacagggagggucccu

SEQ ID NO: 63586 - RNA, 22 nt, Human
aaggagcuuucauuacagccuu

SEQ ID NO: 63587 - RNA, 22 nt, Human
aaggaguggugaagucagaugu

SEQ ID NO: 63588 - RNA, 22 nt, Human
aaggaggugauucaccuuuugg

SEQ ID NO: 63589 - RNA, 22 nt, Human
aaggaucuuucuuuuuaccauu

SEQ ID NO: 63590 - RNA, 22 nt, Human
aaggacaaaacagcuguucuaa

SEQ ID NO: 63591 - RNA, 22 nt, Human
aaggagaggagucauugggaua

SEQ ID NO: 63592 - RNA, 18 nt, Human
aaggaggaaugaauagca

SEQ ID NO: 63593 - RNA, 22 nt, Human
aaggaggaugaauugucugcaa

SEQ ID NO: 63594 - RNA, 22 nt, Human
aagcuuugaauauuagaccuug

SEQ ID NO: 63595 - RNA, 22 nt, Human
aagcucugggacugaggcuccu

SEQ ID NO: 63596 - RNA, 22 nt, Human
aagcugcagacccccugucuca

SEQ ID NO: 63597 - RNA, 22 nt, Human
aagcucuauaggagauacagua

SEQ ID NO: 63598 - RNA, 22 nt, Human
aaggaaaguuaagguaaacucu

SEQ ID NO: 63599 - RNA, 22 nt, Human
aaggaacuucagggcgaaugga

SEQ ID NO: 63600 - RNA, 22 nt, Human
aagcuuugggcagaagaggauu

SEQ ID NO: 63601 - RNA, 22 nt, Human
aaggcuuguugucacgcucuug

SEQ ID NO: 63602 - RNA, 22 nt, Human
aaggacaccaaacuaauuggga

SEQ ID NO: 63603 - RNA, 22 nt, Human
aagggagagggagaagguggga

SEQ ID NO: 63604 - RNA, 22 nt, Human
aagggccuccuggggagccugg

SEQ ID NO: 63605 - RNA, 22 nt, Human
aagguauaucuuuaaaagugaa

SEQ ID NO: 63606 - RNA, 22 nt, Human
aaggggauuuaagguaagaaga

SEQ ID NO: 63607 - RNA, 22 nt, Human
aaggggaggccugcgcuuucgg

SEQ ID NO: 63608 - RNA, 22 nt, Human
aaggggaauaguaggaccuggg

SEQ ID NO: 63609 - RNA, 22 nt, Human
aaggucuuggcucuggccgcac

SEQ ID NO: 63610 - RNA, 22 nt, Human
aaggucucucgggcuuugcuga

SEQ ID NO: 63611 - RNA, 22 nt, Human
aaggugcugaggguccuggcuu

SEQ ID NO: 63612 - RNA, 22 nt, Human
aaggugggacugagaggggaca

SEQ ID NO: 63613 - RNA, 22 nt, Human
aagguggugaucaucuugaagg

SEQ ID NO: 63614 - RNA, 20 nt, Human
aaguagguuucaguugcugu

SEQ ID NO: 63615 - RNA, 18 nt, Human
aaguaguuugagauuguu

SEQ ID NO: 63616 - RNA, 22 nt, Human
aagugagaugggagucagagga

SEQ ID NO: 63617 - RNA, 22 nt, Human
aagugauauaaaucgagaggga

SEQ ID NO: 63618 - RNA, 22 nt, Human
aagugauuuagagagcucuuag

SEQ ID NO: 63619 - RNA, 20 nt, Human
aagucuauuuagaguugcuu

SEQ ID NO: 63620 - RNA, 22 nt, Human
aagucuguucuacagcaccaga

SEQ ID NO: 63621 - RNA, 22 nt, Human
aagucuuugagaucggacauag

SEQ ID NO: 63622 - RNA, 22 nt, Human
aagugaaaaaagucaguacuga

SEQ ID NO: 63623 - RNA, 21 nt, Human
aaguuucucccuaauuguugc

SEQ ID NO: 63624 - RNA, 21 nt, Human
aaguuuuggcuguacaguugu

SEQ ID NO: 63625 - RNA, 22 nt, Human
aauaaagcuugaaagcagggaa

SEQ ID NO: 63626 - RNA, 20 nt, Human
aauaaauauaacccauaauu

SEQ ID NO: 63627 - RNA, 22 nt, Human
aauaagaguuaagaaguauauu

SEQ ID NO: 63628 - RNA, 22 nt, Human
aauaauacaauuggugucaugu

SEQ ID NO: 63629 - RNA, 22 nt, Human
aagugcuggccuacucaaucga

SEQ ID NO: 63630 - RNA, 20 nt, Human
aagugcuguuagcugccuga

SEQ ID NO: 63631 - RNA, 23 nt, Human
aagugcucaguggacagcauugc

SEQ ID NO: 63632 - RNA, 22 nt, Human
aagugauuuuccuacuugcuaa

SEQ ID NO: 63633 - RNA, 22 nt, Human
aaguugaaugucuugcugaaug

SEQ ID NO: 63634 - RNA, 22 nt, Human
aaguucuugguuaauuagggaa

SEQ ID NO: 63635 - RNA, 20 nt, Human
aaguugaaguuacuucaugg

SEQ ID NO: 63636 - RNA, 22 nt, Human
aaguuuaagguagugaugauga

SEQ ID NO: 63637 - RNA, 22 nt, Human
aauacaaucagauuaugguagu

SEQ ID NO: 63638 - RNA, 22 nt, Human
aauagcaauuacccuucaacuc

SEQ ID NO: 63639 - RNA, 22 nt, Human
aauaucuugaguuauaaauuca

SEQ ID NO: 63640 - RNA, 22 nt, Human
aauauuuaaauagaauuacauc

SEQ ID NO: 63641 - RNA, 22 nt, Human
aauauuuaccuaccugucaucu

SEQ ID NO: 63642 - RNA, 22 nt, Human
aauauuuugggacugaggaauu

SEQ ID NO: 63643 - RNA, 22 nt, Human
aaucaaagccugcaaguugacu

SEQ ID NO: 63644 - RNA, 22 nt, Human
aauccucguagugguuagaaag

SEQ ID NO: 63645 - RNA, 22 nt, Human
aaucgguugaacccaggaagug

SEQ ID NO: 63646 - RNA, 22 nt, Human
aaucuacaaugaaaaaauguuu

SEQ ID NO: 63647 - RNA, 22 nt, Human
aaugcuaaagaagaaggaguag

SEQ ID NO: 63648 - RNA, 22 nt, Human
aaugcuuuuugcgaaaugugca

SEQ ID NO: 63649 - RNA, 22 nt, Human
aaucaugguacaaguaagcacg

SEQ ID NO: 63650 - RNA, 22 nt, Human
aaucauguguaaugggcagacc

SEQ ID NO: 63651 - RNA, 22 nt, Human
aaucaagcugcuguuuguucua

SEQ ID NO: 63652 - RNA, 22 nt, Human
aaucaucuguuguucccuugga

SEQ ID NO: 63653 - RNA, 22 nt, Human
aaugcugugauuuauuaaguau

SEQ ID NO: 63654 - RNA, 22 nt, Human
aauggaaaaauccacagggaac

SEQ ID NO: 63655 - RNA, 22 nt, Human
aauggaaaaagaacuguuuaaa

SEQ ID NO: 63656 - RNA, 22 nt, Human
aauggauaacaccgguucuguc

SEQ ID NO: 63657 - RNA, 22 nt, Human
aauggaugauuaaauggaugaa

SEQ ID NO: 63658 - RNA, 22 nt, Human
aauggcaagccacaugcuuuuc

SEQ ID NO: 63659 - RNA, 22 nt, Human
aauggcaauagugcauuaugua

SEQ ID NO: 63660 - RNA, 22 nt, Human
aauguuuuucaaguguggagca

SEQ ID NO: 63661 - RNA, 22 nt, Human
aaugugugggagaacagucuuu

SEQ ID NO: 63662 - RNA, 22 nt, Human
aauguuaguauuuaagagcuug

SEQ ID NO: 63663 - RNA, 22 nt, Human
aauuaaauguuugguuugagcu

SEQ ID NO: 63664 - RNA, 22 nt, Human
aauuauguugaaauaugagaac

SEQ ID NO: 63665 - RNA, 22 nt, Human
aauuauuaagcuuucuccagug

SEQ ID NO: 63666 - RNA, 22 nt, Human
aauuauuaucauuaucuuccug

SEQ ID NO: 63667 - RNA, 22 nt, Human
aauuauuauguggaagacgacg

SEQ ID NO: 63668 - RNA, 22 nt, Human
aauuauucaugucugggcagcc

SEQ ID NO: 63669 - RNA, 22 nt, Human
aauguucauauggguagcagau

SEQ ID NO: 63670 - RNA, 22 nt, Human
aauuguuagaaaugacuguuuu

SEQ ID NO: 63671 - RNA, 22 nt, Human
aauuggagaguugugaaaggau

SEQ ID NO: 63672 - RNA, 22 nt, Human
aauugguuugaauaaauaaaga

SEQ ID NO: 63673 - RNA, 22 nt, Human
aauugugagaguuagagagcau

SEQ ID NO: 63674 - RNA, 20 nt, Human
aauuuagaguuuuaccaagg

SEQ ID NO: 63675 - RNA, 22 nt, Human
aauuucaucugagacugggagc

SEQ ID NO: 63676 - RNA, 22 nt, Human
aauugcuuucacaaguguuaua

SEQ ID NO: 63677 - RNA, 22 nt, Human
aauugauauuagauuugucuca

SEQ ID NO: 63678 - RNA, 21 nt, Human
aauuauuugcauuuuucuugu

SEQ ID NO: 63679 - RNA, 22 nt, Human
aauucuguugguuagaguugga

SEQ ID NO: 63680 - RNA, 22 nt, Human
aauucuuuguuccucugccaag

SEQ ID NO: 63681 - RNA, 21 nt, Human
acaaaaccuaacuuggcugcu

SEQ ID NO: 63682 - RNA, 22 nt, Human
acaaaaauauuguagaagugcu

SEQ ID NO: 63683 - RNA, 22 nt, Human
aauuuuauuagacaggcauaau

SEQ ID NO: 63684 - RNA, 22 nt, Human
aauuuuagcuaaagauccaugg

SEQ ID NO: 63685 - RNA, 22 nt, Human
aauuucuccuuuucaguuagau

SEQ ID NO: 63686 - RNA, 22 nt, Human
aauuucuuuagagguacugauc

SEQ ID NO: 63687 - RNA, 22 nt, Human
aauuucuuucagcugcuuuaag

SEQ ID NO: 63688 - RNA, 22 nt, Human
aauuugcuccaaugucaguucu

SEQ ID NO: 63689 - RNA, 18 nt, Human
acaaaaauagugcuuugg

SEQ ID NO: 63690 - RNA, 22 nt, Human
acaaacugggauaggauccugu

SEQ ID NO: 63691 - RNA, 22 nt, Human
acaaauuuaaauguugucuguu

SEQ ID NO: 63692 - RNA, 22 nt, Human
acaacagaacuccugggauuuu

SEQ ID NO: 63693 - RNA, 22 nt, Human
acaaccaugucaguucaaacca

SEQ ID NO: 63694 - RNA, 22 nt, Human
acaagaaaggucugggaacaau

SEQ ID NO: 63695 - RNA, 22 nt, Human
acaaggaagaaaacauuacuuu

SEQ ID NO: 63696 - RNA, 22 nt, Human
acaaucauuuuuccccuucagu

SEQ ID NO: 63697 - RNA, 21 nt, Human
acaaugaguuugaggcaucag

SEQ ID NO: 63698 - RNA, 22 nt, Human
acaauaauguuuuuagguuauu

SEQ ID NO: 63699 - RNA, 22 nt, Human
acaaguuucauuguuuagaacc

SEQ ID NO: 63700 - RNA, 22 nt, Human
acaaucuuauuaguaguauaga

SEQ ID NO: 63701 - RNA, 22 nt, Human
acacaacuuuauuaauuuauac

SEQ ID NO: 63702 - RNA, 22 nt, Human
acaaucagcacugaguuuaucu

SEQ ID NO: 63703 - RNA, 22 nt, Human
acacaagaaugugcacucagcc

SEQ ID NO: 63704 - RNA, 22 nt, Human
acacacaugccuuuccuaagua

SEQ ID NO: 63705 - RNA, 21 nt, Human
acacagcuggagcaucccggu

SEQ ID NO: 63706 - RNA, 22 nt, Human
acacccuugcagacgguuccuu

SEQ ID NO: 63707 - RNA, 22 nt, Human
acacuuacugcauuuuucuaua

SEQ ID NO: 63708 - RNA, 22 nt, Human
acacucagaaaggcagagguuc

SEQ ID NO: 63709 - RNA, 22 nt, Human
acagacuugaccuuggagaggc

SEQ ID NO: 63710 - RNA, 22 nt, Human
acagacuuuuagacuuaugagu

SEQ ID NO: 63711 - RNA, 20 nt, Human
acagagauccucucuuuauc

SEQ ID NO: 63712 - RNA, 22 nt, Human
acacuuuugcgagagcaugcag

SEQ ID NO: 63713 - RNA, 22 nt, Human
acagaugccagcuacaccaccg

SEQ ID NO: 63714 - RNA, 22 nt, Human
acagacaucaucaacaucuucc

SEQ ID NO: 63715 - RNA, 22 nt, Human
acagacuuaguauccugcugcu

SEQ ID NO: 63716 - RNA, 22 nt, Human
acagaucuauauuauauauaca

SEQ ID NO: 63717 - RNA, 22 nt, Human
acagagcucccagccaucuccu

SEQ ID NO: 63718 - RNA, 22 nt, Human
acagcagguuauuguuauggca

SEQ ID NO: 63719 - RNA, 22 nt, Human
acagaucugcacagugaacaau

SEQ ID NO: 63720 - RNA, 22 nt, Human
acagcucaggcccaucaacccc

SEQ ID NO: 63721 - RNA, 22 nt, Human
acagccacuaugacagauuuag

SEQ ID NO: 63722 - RNA, 22 nt, Human
acagccaacgucuuucuuacuu

SEQ ID NO: 63723 - RNA, 22 nt, Human
acagcauagaggaaauguggaa

SEQ ID NO: 63724 - RNA, 22 nt, Human
acagcaauccuggcagaggguu

SEQ ID NO: 63725 - RNA, 22 nt, Human
acagcuggaggucugugagcac

SEQ ID NO: 63726 - RNA, 22 nt, Human
acaggaaaugaaaugguaucua

SEQ ID NO: 63727 - RNA, 19 nt, Human
acaggaaggaaaauuucaa

SEQ ID NO: 63728 - RNA, 22 nt, Human
acagguauuaugaagccuauuu

SEQ ID NO: 63729 - RNA, 22 nt, Human
acaggauuuucagggaagguga

SEQ ID NO: 63730 - RNA, 22 nt, Human
acaggcugcccgcuccccaccu

SEQ ID NO: 63731 - RNA, 22 nt, Human
acaggccuggguucaaauuugg

SEQ ID NO: 63732 - RNA, 22 nt, Human
acaggaaugaagaugagagagu

SEQ ID NO: 63733 - RNA, 22 nt, Human
acaggacaaaaaucuggauggc

SEQ ID NO: 63734 - RNA, 22 nt, Human
acagguuucuccccugguuauu

SEQ ID NO: 63735 - RNA, 22 nt, Human
acauauaugugcauacaacuau

SEQ ID NO: 63736 - RNA, 22 nt, Human
acagucucucaagcauauccug

SEQ ID NO: 63737 - RNA, 22 nt, Human
acaguguuacuugauaguguau

SEQ ID NO: 63738 - RNA, 22 nt, Human
acaguuuuccuugguauagaac

SEQ ID NO: 63739 - RNA, 22 nt, Human
acaucuucuauggagguucgga

SEQ ID NO: 63740 - RNA, 21 nt, Human
acaguaugaucaaaugugcca

SEQ ID NO: 63741 - RNA, 22 nt, Human
acgcacuuuaugcuuuuaacaa

SEQ ID NO: 63742 - RNA, 22 nt, Human
acgccugccuguacuugugggg

SEQ ID NO: 63743 - RNA, 22 nt, Human
acgguguuucucguucaggguu

SEQ ID NO: 63744 - RNA, 22 nt, Human
acguaaacagcaaagacaugau

SEQ ID NO: 63745 - RNA, 22 nt, Human
acuauggaguucagaucuugag

SEQ ID NO: 63746 - RNA, 22 nt, Human
acucacuguuuugaaauugaac

SEQ ID NO: 63747 - RNA, 22 nt, Human
acucagcaccuagaaagugugc

SEQ ID NO: 63748 - RNA, 22 nt, Human
acuaucaacagcaucagggugu

SEQ ID NO: 63749 - RNA, 22 nt, Human
acuauuguccgauuucuuuacu

SEQ ID NO: 63750 - RNA, 22 nt, Human
acuaauuuacagaaauuucuua

SEQ ID NO: 63751 - RNA, 20 nt, Human
acuagaaagucacugggggg

SEQ ID NO: 63752 - RNA, 22 nt, Human
acuauacaguauguacgugcac

SEQ ID NO: 63753 - RNA, 22 nt, Human
acuaucuauugucuucuucaug

SEQ ID NO: 63754 - RNA, 22 nt, Human
acucaugugacuaaaacauuaa

SEQ ID NO: 63755 - RNA, 22 nt, Human
acuccuauuugguagauggaag

SEQ ID NO: 63756 - RNA, 22 nt, Human
acucaucauuuuacggagcagc

SEQ ID NO: 63757 - RNA, 22 nt, Human
acucaguuuugaucguucuuau

SEQ ID NO: 63758 - RNA, 21 nt, Human
acucaucuuuuuggagaccag

SEQ ID NO: 63759 - RNA, 22 nt, Human
acuccuucauauuuuaauugaa

SEQ ID NO: 63760 - RNA, 22 nt, Human
acucucaauuaucuggacugaa

SEQ ID NO: 63761 - RNA, 22 nt, Human
acucugaaaggcuacaaaugcu

SEQ ID NO: 63762 - RNA, 22 nt, Human
acucugagaugugucuugauuc

SEQ ID NO: 63763 - RNA, 22 nt, Human
acucugaggauuucaguuuuac

SEQ ID NO: 63764 - RNA, 22 nt, Human
acucugagguuuuccaaguaca

SEQ ID NO: 63765 - RNA, 22 nt, Human
acucugcaguaaggaauuguuu

SEQ ID NO: 63766 - RNA, 22 nt, Human
acugaaaguugaugagucacug

SEQ ID NO: 63767 - RNA, 22 nt, Human
acucuugacuaaugcuaauguc

SEQ ID NO: 63768 - RNA, 22 nt, Human
acucuuauuuugaaguaauaau

SEQ ID NO: 63769 - RNA, 22 nt, Human
acugaaggcuggaccaugcauc

SEQ ID NO: 63770 - RNA, 22 nt, Human
acugacuacauguccugucauu

SEQ ID NO: 63771 - RNA, 18 nt, Human
acucuuccuuauguucuu

SEQ ID NO: 63772 - RNA, 22 nt, Human
acugaugacaaugugaguguuc

SEQ ID NO: 63773 - RNA, 22 nt, Human
acugaucuguguaauauguuac

SEQ ID NO: 63774 - RNA, 22 nt, Human
acugauuccaagcuuguggagg

SEQ ID NO: 63775 - RNA, 22 nt, Human
acugcagauccucugagaaacc

SEQ ID NO: 63776 - RNA, 22 nt, Human
acugcauuaucaccaagaugua

SEQ ID NO: 63777 - RNA, 22 nt, Human
acugcauuucauaaauuacaau

SEQ ID NO: 63778 - RNA, 22 nt, Human
acugcuguugugauggguauuu

SEQ ID NO: 63779 - RNA, 22 nt, Human
acugcucugugguuggaagccu

SEQ ID NO: 63780 - RNA, 22 nt, Human
acuucuuuugcaugauucuuua

SEQ ID NO: 63781 - RNA, 22 nt, Human
acuucugcccuggcgagggcgu

SEQ ID NO: 63782 - RNA, 22 nt, Human
acuugaagcaugaaaauaagcc

SEQ ID NO: 63783 - RNA, 22 nt, Human
acuucucuuuucauuaauuuug

SEQ ID NO: 63784 - RNA, 21 nt, Human
acuuccacaucacugaguaga

SEQ ID NO: 63785 - RNA, 22 nt, Human
acuuccuuuuuuggggauagca

SEQ ID NO: 63786 - RNA, 22 nt, Human
acuggauucucuuacacagaug

SEQ ID NO: 63787 - RNA, 22 nt, Human
acugcugauuauugaaguagag

SEQ ID NO: 63788 - RNA, 19 nt, Human
acuugcuuucauuuaagau

SEQ ID NO: 63789 - RNA, 22 nt, Human
acuuggcuaggguuuuuaucuu

SEQ ID NO: 63790 - RNA, 22 nt, Human
acuguucacccagcacuagcag

SEQ ID NO: 63791 - RNA, 22 nt, Human
acuuacuuucuauucuuguagg

SEQ ID NO: 63792 - RNA, 22 nt, Human
acuuagaacagccuaugggaag

SEQ ID NO: 63793 - RNA, 19 nt, Human
agaaauagccuuccuuguc

SEQ ID NO: 63794 - RNA, 22 nt, Human
agaaauuguaauaaaucugguc

SEQ ID NO: 63795 - RNA, 22 nt, Human
agaaauggccagacuugccccu

SEQ ID NO: 63796 - RNA, 22 nt, Human
agaaacacaaguaaagcuccca

SEQ ID NO: 63797 - RNA, 22 nt, Human
agaaacaagcccuagaaguccu

SEQ ID NO: 63798 - RNA, 22 nt, Human
agaaaaggaagcuuagacugua

SEQ ID NO: 63799 - RNA, 22 nt, Human
acuuuaaaucuguugcuuagcu

SEQ ID NO: 63800 - RNA, 22 nt, Human
acuuugccuucuuacuguguug

SEQ ID NO: 63801 - RNA, 22 nt, Human
acuuugaauuagaauuuugcug

SEQ ID NO: 63802 - RNA, 23 nt, Human
acuuugaggagaagaaugucagu

SEQ ID NO: 63803 - RNA, 22 nt, Human
acuuuaaauaucauuugguagg

SEQ ID NO: 63804 - RNA, 22 nt, Human
acuuguuuacaagcaguucuga

SEQ ID NO: 63805 - RNA, 22 nt, Human
acuucauuugaaaugguugaau

SEQ ID NO: 63806 - RNA, 22 nt, Human
acuuccuuccagcaaauggcau

SEQ ID NO: 63807 - RNA, 22 nt, Human
agaaauggggugaagcaaaugg

SEQ ID NO: 63808 - RNA, 22 nt, Human
agaacauaucuguuuucuaacu

SEQ ID NO: 63809 - RNA, 22 nt, Human
agaaaauagguaguagacgggc

SEQ ID NO: 63810 - RNA, 22 nt, Human
agaagaagacccuaaggaaagg

SEQ ID NO: 63811 - RNA, 22 nt, Human
agaagauucagcaguagggugg

SEQ ID NO: 63812 - RNA, 22 nt, Human
agaagaaugguuugaaagauuu

SEQ ID NO: 63813 - RNA, 22 nt, Human
agaagguggaguagaacaagcu

SEQ ID NO: 63814 - RNA, 22 nt, Human
agaagcaaagcaaacacauucu

SEQ ID NO: 63815 - RNA, 22 nt, Human
agaauacaauuguucaguaaua

SEQ ID NO: 63816 - RNA, 22 nt, Human
agaagcauaagggcuuugccag

SEQ ID NO: 63817 - RNA, 22 nt, Human
agaauauaguaaauauuuucua

SEQ ID NO: 63818 - RNA, 22 nt, Human
agaaggcaucugcucgcuucca

SEQ ID NO: 63819 - RNA, 16 nt, Human
agaaggcuaguaacag

SEQ ID NO: 63820 - RNA, 22 nt, Human
agaagggaagcaggagaggcau

SEQ ID NO: 63821 - RNA, 22 nt, Human
agaaucugcauuuuaacaagau

SEQ ID NO: 63822 - RNA, 21 nt, Human
agaaugaagaagaggucuuug

SEQ ID NO: 63823 - RNA, 22 nt, Human
agaauguaagaaugcaaagauu

SEQ ID NO: 63824 - RNA, 22 nt, Human
agaauccugagggaaauuuggc

SEQ ID NO: 63825 - RNA, 22 nt, Human
agaaucucuagaaaugggucuc

SEQ ID NO: 63826 - RNA, 22 nt, Human
agaagguagaugcaucaggagg

SEQ ID NO: 63827 - RNA, 19 nt, Human
agaauuggaaccaugaacc

SEQ ID NO: 63828 - RNA, 22 nt, Human
agaaguagacaguuggauauaa

SEQ ID NO: 63829 - RNA, 22 nt, Human
agaaguguacuuagagaacaua

SEQ ID NO: 63830 - RNA, 22 nt, Human
agaaguuuguuauguaaacaaa

SEQ ID NO: 63831 - RNA, 22 nt, Human
agaauaagucuaauauauuggu

SEQ ID NO: 63832 - RNA, 22 nt, Human
agaauacuaauaagggauuugc

SEQ ID NO: 63833 - RNA, 22 nt, Human
agacaagagcugaggacauauu

SEQ ID NO: 63834 - RNA, 22 nt, Human
agacaaucaacuguugaugccu

SEQ ID NO: 63835 - RNA, 22 nt, Human
agagcagauggagcuggaagag

SEQ ID NO: 63836 - RNA, 22 nt, Human
agagcagaggcauggccguggg

SEQ ID NO: 63837 - RNA, 19 nt, Human
agagauuuucuguuuuagu

SEQ ID NO: 63838 - RNA, 22 nt, Human
agacagaaaaguugucaaucau

SEQ ID NO: 63839 - RNA, 22 nt, Human
agacgcgcagaaggaagcggcc

SEQ ID NO: 63840 - RNA, 22 nt, Human
agacgggacagacuuuugagug

SEQ ID NO: 63841 - RNA, 22 nt, Human
agacuauuuugugauaacuaau

SEQ ID NO: 63842 - RNA, 22 nt, Human
agagccaugcuugugcauauau

SEQ ID NO: 63843 - RNA, 23 nt, Human
agagccuaauaucuaaucuuugu

SEQ ID NO: 63844 - RNA, 22 nt, Human
agagcugggacuuggacucaau

SEQ ID NO: 63845 - RNA, 22 nt, Human
agagcuauuucuuaaaagcugu

SEQ ID NO: 63846 - RNA, 22 nt, Human
agagcucguggcucauugagga

SEQ ID NO: 63847 - RNA, 22 nt, Human
agagcuagaaggaagcauuucu

SEQ ID NO: 63848 - RNA, 22 nt, Human
agagggcugugcuaaauuucag

SEQ ID NO: 63849 - RNA, 22 nt, Human
agaggcaugaacucccguagcc

SEQ ID NO: 63850 - RNA, 22 nt, Human
agagggagagaccuccgugccu

SEQ ID NO: 63851 - RNA, 22 nt, Human
agaguucuauccagacucaugu

SEQ ID NO: 63852 - RNA, 22 nt, Human
agaguuaaugcaggccaagccu

SEQ ID NO: 63853 - RNA, 22 nt, Human
agaguguagugaaaagagauua

SEQ ID NO: 63854 - RNA, 21 nt, Human
agagugugugcaucauauuug

SEQ ID NO: 63855 - RNA, 22 nt, Human
agaguacagaagcauuucagau

SEQ ID NO: 63856 - RNA, 22 nt, Human
agaguagucuuuacucuuccaa

SEQ ID NO: 63857 - RNA, 22 nt, Human
agaucugucaccauccuggagc

SEQ ID NO: 63858 - RNA, 22 nt, Human
agaucauuaaccaccuguucug

SEQ ID NO: 63859 - RNA, 22 nt, Human
agaugacuaacauaguauugcu

SEQ ID NO: 63860 - RNA, 22 nt, Human
agauauuauuuucuauuuauca

SEQ ID NO: 63861 - RNA, 21 nt, Human
agaguugaaggcaguaaagag

SEQ ID NO: 63862 - RNA, 21 nt, Human
agaguuuucuccauuucaggc

SEQ ID NO: 63863 - RNA, 22 nt, Human
agauaaacaacucuuagcuguu

SEQ ID NO: 63864 - RNA, 22 nt, Human
agauaacauguugcagauucug

SEQ ID NO: 63865 - RNA, 22 nt, Human
agauaagaacauuaguaagccg

SEQ ID NO: 63866 - RNA, 23 nt, Human
agaugaugaauaaagagugagga

SEQ ID NO: 63867 - RNA, 22 nt, Human
agauagccagauauaaauaguc

SEQ ID NO: 63868 - RNA, 22 nt, Human
agauaucuuguuggcauaaaug

SEQ ID NO: 63869 - RNA, 22 nt, Human
agauauguuaggcuuguucccu

SEQ ID NO: 63870 - RNA, 22 nt, Human
agauggaggaaagcaguuagaa

SEQ ID NO: 63871 - RNA, 21 nt, Human
agaugcaguuugcaggugggu

SEQ ID NO: 63872 - RNA, 22 nt, Human
agauauucugccuaacagguuu

SEQ ID NO: 63873 - RNA, 22 nt, Human
agauggaguccugaagccagaa

SEQ ID NO: 63874 - RNA, 22 nt, Human
agaugucauguguugcuccaag

SEQ ID NO: 63875 - RNA, 22 nt, Human
agaugguucagaauuauaaaga

SEQ ID NO: 63876 - RNA, 22 nt, Human
agauccuagaugugaauagcua

SEQ ID NO: 63877 - RNA, 22 nt, Human
agaugaugugugucuucagcua

SEQ ID NO: 63878 - RNA, 22 nt, Human
agaugacuuuguccugagcuga

SEQ ID NO: 63879 - RNA, 22 nt, Human
agaugaguaaauggagucuucc

SEQ ID NO: 63880 - RNA, 22 nt, Human
agauguugucucuuacguuuga

SEQ ID NO: 63881 - RNA, 22 nt, Human
agauugaugugaccauuggaag

SEQ ID NO: 63882 - RNA, 22 nt, Human
agauuucaauggauauugcaag

SEQ ID NO: 63883 - RNA, 22 nt, Human
agauucgucuuuaauucaccau

SEQ ID NO: 63884 - RNA, 22 nt, Human
agauggcugggagcucuguuug

SEQ ID NO: 63885 - RNA, 22 nt, Human
agauggggccugaggacacugu

SEQ ID NO: 63886 - RNA, 19 nt, Human
agauggcaaaaugcaaaga

SEQ ID NO: 63887 - RNA, 22 nt, Human
agcaagggucucucauggcuug

SEQ ID NO: 63888 - RNA, 21 nt, Human
agauguucaguguccuaaccc

SEQ ID NO: 63889 - RNA, 22 nt, Human
agauuauuuaagacaggaacca

SEQ ID NO: 63890 - RNA, 22 nt, Human
agauugaacgagcuggcaugga

SEQ ID NO: 63891 - RNA, 22 nt, Human
agauuguaugaggacuccauga

SEQ ID NO: 63892 - RNA, 22 nt, Human
agcaaagccucuuugaaaaaaa

SEQ ID NO: 63893 - RNA, 22 nt, Human
agcaaaguacugagcucaaagg

SEQ ID NO: 63894 - RNA, 22 nt, Human
agauguuaauaaccuuagggca

SEQ ID NO: 63895 - RNA, 22 nt, Human
agcaauucugaaauuacuugac

SEQ ID NO: 63896 - RNA, 22 nt, Human
agauucucccuccuggcgcugu

SEQ ID NO: 63897 - RNA, 22 nt, Human
agcaauguuggccuauauaccu

SEQ ID NO: 63898 - RNA, 20 nt, Human
agcacaggcagucauucagu

SEQ ID NO: 63899 - RNA, 22 nt, Human
agcaaaacuaaagacacagaca

SEQ ID NO: 63900 - RNA, 22 nt, Human
agauuuucuuuuccaucuuugu

SEQ ID NO: 63901 - RNA, 22 nt, Human
agcaaaauuccaaaaugcuaau

SEQ ID NO: 63902 - RNA, 22 nt, Human
agauuuguauagaugugguuga

SEQ ID NO: 63903 - RNA, 22 nt, Human
agauuuuacggaguauuagggu

SEQ ID NO: 63904 - RNA, 22 nt, Human
agcagauaaagguugcauuucu

SEQ ID NO: 63905 - RNA, 22 nt, Human
agcagagggucaguuuuuuagu

SEQ ID NO: 63906 - RNA, 22 nt, Human
agcacuagcugcuugucucaag

SEQ ID NO: 63907 - RNA, 22 nt, Human
agcaaauaauugucuuugaggg

SEQ ID NO: 63908 - RNA, 22 nt, Human
agcaacauggaguuugugcgca

SEQ ID NO: 63909 - RNA, 22 nt, Human
agcagcaggugaccucgaugcc

SEQ ID NO: 63910 - RNA, 19 nt, Human
agcagccaucgaccaugga

SEQ ID NO: 63911 - RNA, 22 nt, Human
agcaggaaggcuagaagcagga

SEQ ID NO: 63912 - RNA, 22 nt, Human
agcaggagaaagaguaugggcu

SEQ ID NO: 63913 - RNA, 22 nt, Human
agcagggagacagugcagcauu

SEQ ID NO: 63914 - RNA, 22 nt, Human
agcaggauggaguaacgugaaa

SEQ ID NO: 63915 - RNA, 22 nt, Human
agcacucacuagaguuagaacc

SEQ ID NO: 63916 - RNA, 22 nt, Human
agcacuuuagaauuuagaguug

SEQ ID NO: 63917 - RNA, 22 nt, Human
agcagagaacauucauucaugu

SEQ ID NO: 63918 - RNA, 22 nt, Human
agcagauuguacagugcauuag

SEQ ID NO: 63919 - RNA, 22 nt, Human
agcauauaugcaugagugugca

SEQ ID NO: 63920 - RNA, 18 nt, Human
agcccucuguuacuggaa

SEQ ID NO: 63921 - RNA, 22 nt, Human
agccaucuggugucaaugauuc

SEQ ID NO: 63922 - RNA, 22 nt, Human
agccauggagaacagacuugaa

SEQ ID NO: 63923 - RNA, 22 nt, Human
agcagggagaccaucucuuccu

SEQ ID NO: 63924 - RNA, 22 nt, Human
agcaggggcaggguuuugugcu

SEQ ID NO: 63925 - RNA, 22 nt, Human
agccagauuuuuugagaggcga

SEQ ID NO: 63926 - RNA, 22 nt, Human
agccucuagcuccccaaagcca

SEQ ID NO: 63927 - RNA, 22 nt, Human
agcgaaaagaauggaguggagu

SEQ ID NO: 63928 - RNA, 22 nt, Human
agccuacauuugacuauagucu

SEQ ID NO: 63929 - RNA, 22 nt, Human
agcgacuugacagacauguccu

SEQ ID NO: 63930 - RNA, 22 nt, Human
agccuauucaucugaucuugaa

SEQ ID NO: 63931 - RNA, 22 nt, Human
agccucucugaugugacagcua

SEQ ID NO: 63932 - RNA, 22 nt, Human
agccugaaccaauauagcagcc

SEQ ID NO: 63933 - RNA, 22 nt, Human
agcgcucauuuuccuccugcuc

SEQ ID NO: 63934 - RNA, 22 nt, Human
aggaauugucgucauguauaau

SEQ ID NO: 63935 - RNA, 22 nt, Human
aggaaauaggaccagacaaagc

SEQ ID NO: 63936 - RNA, 22 nt, Human
aggaauuucacugcguuuuuua

SEQ ID NO: 63937 - RNA, 22 nt, Human
aggaauuugggguuacaugaug

SEQ ID NO: 63938 - RNA, 22 nt, Human
aggaauuuuaauaugcuugucu

SEQ ID NO: 63939 - RNA, 22 nt, Human
aggacaaaggaccagaucugga

SEQ ID NO: 63940 - RNA, 22 nt, Human
aggaagaagggacagaauuuug

SEQ ID NO: 63941 - RNA, 22 nt, Human
aggaacaguuucaaagagugaa

SEQ ID NO: 63942 - RNA, 20 nt, Human
aggaacuggaagggaggaaa

SEQ ID NO: 63943 - RNA, 22 nt, Human
aggaacaacagccuuuauaucc

SEQ ID NO: 63944 - RNA, 22 nt, Human
aggaaauaguuuagucccaaaa

SEQ ID NO: 63945 - RNA, 22 nt, Human
aggacacuuccugaguggacaa

SEQ ID NO: 63946 - RNA, 22 nt, Human
aggaggcaaaugagagggcuca

SEQ ID NO: 63947 - RNA, 22 nt, Human
aggagcccggucgucaugguaa

SEQ ID NO: 63948 - RNA, 22 nt, Human
aggauauguccuuuuuuucccc

SEQ ID NO: 63949 - RNA, 22 nt, Human
aggaguuugaaaacuuaacuaa

SEQ ID NO: 63950 - RNA, 22 nt, Human
aggauugucuccugugaugugc

SEQ ID NO: 63951 - RNA, 22 nt, Human
aggauucuccuguuucccaccc

SEQ ID NO: 63952 - RNA, 23 nt, Human
aggcaagaacggguuguucaccc

SEQ ID NO: 63953 - RNA, 20 nt, Human
aggauuauguacauggaugc

SEQ ID NO: 63954 - RNA, 22 nt, Human
aggauuagucaccauuauuauu

SEQ ID NO: 63955 - RNA, 22 nt, Human
aggauugaaaaaacacauauau

SEQ ID NO: 63956 - RNA, 22 nt, Human
aggauuuaauugcauuuuucuc

SEQ ID NO: 63957 - RNA, 22 nt, Human
aggauuuauuccagaaaugcaa

SEQ ID NO: 63958 - RNA, 22 nt, Human
aggcaacagacaggcuugguuc

SEQ ID NO: 63959 - RNA, 19 nt, Human
aggcagccccaacuugcau

SEQ ID NO: 63960 - RNA, 22 nt, Human
aggauugauggcauguuuacug

SEQ ID NO: 63961 - RNA, 22 nt, Human
aggcaagauuaggaccagaaga

SEQ ID NO: 63962 - RNA, 22 nt, Human
aggcagaugggagcuggaaguu

SEQ ID NO: 63963 - RNA, 22 nt, Human
aggcaauagagggugaggagga

SEQ ID NO: 63964 - RNA, 22 nt, Human
aggcagagaggucuuccuggaa

SEQ ID NO: 63965 - RNA, 22 nt, Human
aggcagagauggcugcagggcc

SEQ ID NO: 63966 - RNA, 23 nt, Human
aggcagcaugcaacaggccauuu

SEQ ID NO: 63967 - RNA, 22 nt, Human
aggcaggauuugcgaugugguu

SEQ ID NO: 63968 - RNA, 21 nt, Human
aggcauuuucuuggagauucu

SEQ ID NO: 63969 - RNA, 22 nt, Human
aggcauuuaaagauguaagacu

SEQ ID NO: 63970 - RNA, 22 nt, Human
aggcauuuucuuguuauuuuua

SEQ ID NO: 63971 - RNA, 22 nt, Human
aggcauuuaucaggaaauguuc

SEQ ID NO: 63972 - RNA, 21 nt, Human
aggccaaguuggauuucuuca

SEQ ID NO: 63973 - RNA, 22 nt, Human
aggcuuuugcucuggcuccucu

SEQ ID NO: 63974 - RNA, 22 nt, Human
aggcugucucagccugcuugca

SEQ ID NO: 63975 - RNA, 22 nt, Human
agggaaauaggagaagaaagga

SEQ ID NO: 63976 - RNA, 19 nt, Human
agggaggcaagagaaaugu

SEQ ID NO: 63977 - RNA, 22 nt, Human
agggaaauuaaugugagcaaug

SEQ ID NO: 63978 - RNA, 22 nt, Human
agggaguuccgaucugugcacc

SEQ ID NO: 63979 - RNA, 22 nt, Human
agggaugugcagggcuugccau

SEQ ID NO: 63980 - RNA, 22 nt, Human
agggcuugggggccuugaaggc

SEQ ID NO: 63981 - RNA, 20 nt, Human
agggguucuguuaugaaaua

SEQ ID NO: 63982 - RNA, 22 nt, Human
agggguacuagaggauugagau

SEQ ID NO: 63983 - RNA, 22 nt, Human
aggucugcccaggaugcugcuu

SEQ ID NO: 63984 - RNA, 22 nt, Human
aggugauaugggcuucucugag

SEQ ID NO: 63985 - RNA, 22 nt, Human
aggucuugcggaagauauggcu

SEQ ID NO: 63986 - RNA, 22 nt, Human
aggucuuuaguggcagagucua

SEQ ID NO: 63987 - RNA, 22 nt, Human
agguccugucuuaucucuguaa

SEQ ID NO: 63988 - RNA, 22 nt, Human
aggugauauuauguauuucuau

SEQ ID NO: 63989 - RNA, 21 nt, Human
aggugguuccaauaaguaggu

SEQ ID NO: 63990 - RNA, 22 nt, Human
agguuaugcacugcacaacccu

SEQ ID NO: 63991 - RNA, 22 nt, Human
agguucaucaauaacucagaga

SEQ ID NO: 63992 - RNA, 18 nt, Human
agguuguguaaaaagaag

SEQ ID NO: 63993 - RNA, 18 nt, Human
agguugcaucugugcaga

SEQ ID NO: 63994 - RNA, 22 nt, Human
agguuuaggaaaacugagaguc

SEQ ID NO: 63995 - RNA, 22 nt, Human
agguuuuugucauuuucuggua

SEQ ID NO: 63996 - RNA, 21 nt, Human
aguaccugugugccugugugu

SEQ ID NO: 63997 - RNA, 22 nt, Human
aguaaucgugaucgagagauca

SEQ ID NO: 63998 - RNA, 22 nt, Human
aguaacagguguacagacuauc

SEQ ID NO: 63999 - RNA, 20 nt, Human
agugauuuguuaguacauug

SEQ ID NO: 64000 - RNA, 20 nt, Human
agugaguuaucagcuacagu

SEQ ID NO: 64001 - RNA, 22 nt, Human
agugacuguccuacuuuguaga

SEQ ID NO: 64002 - RNA, 22 nt, Human
agugaaauaugcccauugcugu

SEQ ID NO: 64003 - RNA, 20 nt, Human
agucuuaucugcauuuagaa

SEQ ID NO: 64004 - RNA, 22 nt, Human
aguacuuugacuagaggcagcu

SEQ ID NO: 64005 - RNA, 22 nt, Human
aguacacuguucagaauuuuag

SEQ ID NO: 64006 - RNA, 22 nt, Human
aguagaauuacagguuuucucu

SEQ ID NO: 64007 - RNA, 22 nt, Human
aguagagacgggguuuuaguag

SEQ ID NO: 64008 - RNA, 22 nt, Human
aguagcaguuccauuugaugug

SEQ ID NO: 64009 - RNA, 22 nt, Human
aguaggaauucaaagagacaaa

SEQ ID NO: 64010 - RNA, 22 nt, Human
aguagucacuucacccauccca

SEQ ID NO: 64011 - RNA, 22 nt, Human
agugaugcuuuggagaagaucc

SEQ ID NO: 64012 - RNA, 22 nt, Human
agugauguaauggugaauguga

SEQ ID NO: 64013 - RNA, 22 nt, Human
agugaucugcugcagugcucug

SEQ ID NO: 64014 - RNA, 21 nt, Human
aguggcacuguuucuucccua

SEQ ID NO: 64015 - RNA, 22 nt, Human
aguggagguuacagcuguacau

SEQ ID NO: 64016 - RNA, 22 nt, Human
aguggcuagaucaugagugagc

SEQ ID NO: 64017 - RNA, 22 nt, Human
agugccauggcugcuagauggc

SEQ ID NO: 64018 - RNA, 22 nt, Human
agugcuuuauguuguugugcaa

SEQ ID NO: 64019 - RNA, 22 nt, Human
aguggguaaggacaggugucug

SEQ ID NO: 64020 - RNA, 22 nt, Human
aguggcuucucuggggucaaga

SEQ ID NO: 64021 - RNA, 22 nt, Human
aguggcugugaaauacauggga

SEQ ID NO: 64022 - RNA, 22 nt, Human
aguggggaaauaucaauauuug

SEQ ID NO: 64023 - RNA, 19 nt, Human
agugggauggcuuuuuccc

SEQ ID NO: 64024 - RNA, 22 nt, Human
aguggggcccaagaaucugcau

SEQ ID NO: 64025 - RNA, 22 nt, Human
agugucuuuagucgcugagcaa

SEQ ID NO: 64026 - RNA, 22 nt, Human
aguguguauauaugugugugug

SEQ ID NO: 64027 - RNA, 22 nt, Human
aguguuaggaauuaauguaggg

SEQ ID NO: 64028 - RNA, 22 nt, Human
aguguuuuaagaaaguaauuuu

SEQ ID NO: 64029 - RNA, 22 nt, Human
aguuaaagggggcuacagugug

SEQ ID NO: 64030 - RNA, 22 nt, Human
agugugaguuacaaagugugaa

SEQ ID NO: 64031 - RNA, 20 nt, Human
aguguugaacuacacuuccc

SEQ ID NO: 64032 - RNA, 22 nt, Human
aguguuuuaugugccaguuuaa

SEQ ID NO: 64033 - RNA, 22 nt, Human
aguguuugggagagggugugag

SEQ ID NO: 64034 - RNA, 22 nt, Human
aguuacuauuacuuauuauuau

SEQ ID NO: 64035 - RNA, 23 nt, Human
aguuaucuaaugaaguucuucca

SEQ ID NO: 64036 - RNA, 22 nt, Human
aguuauggguauguauuauaau

SEQ ID NO: 64037 - RNA, 22 nt, Human
aguuaucuauaaaucccugagg

SEQ ID NO: 64038 - RNA, 22 nt, Human
aguuaacuugugguuuggcugu

SEQ ID NO: 64039 - RNA, 22 nt, Human
aguuaggaaauaaguugaguuu

SEQ ID NO: 64040 - RNA, 22 nt, Human
aguuauuaagaaaauuuugcca

SEQ ID NO: 64041 - RNA, 22 nt, Human
aguucaauuguuuuguaaaagu

SEQ ID NO: 64042 - RNA, 22 nt, Human
aguucaugugguuuaacuuaau

SEQ ID NO: 64043 - RNA, 22 nt, Human
aguucauaucuacuuuuccauc

SEQ ID NO: 64044 - RNA, 22 nt, Human
aguucauccucauuuacaagga

SEQ ID NO: 64045 - RNA, 22 nt, Human
aguuaugcaagcaaguaccacu

SEQ ID NO: 64046 - RNA, 20 nt, Human
aguucagguuauuuuccucc

SEQ ID NO: 64047 - RNA, 22 nt, Human
aguucaugcuuagaucucauuu

SEQ ID NO: 64048 - RNA, 22 nt, Human
aguucauucuagcugggagcag

SEQ ID NO: 64049 - RNA, 22 nt, Human
aguuauuuuucacuauuaggcu

SEQ ID NO: 64050 - RNA, 22 nt, Human
aguucucaagguuaggaaaagu

SEQ ID NO: 64051 - RNA, 22 nt, Human
aguucugggaggugcacgucca

SEQ ID NO: 64052 - RNA, 22 nt, Human
aguucuguucccccaguuacau

SEQ ID NO: 64053 - RNA, 22 nt, Human
aguugcuaauacaaaaaguccc

SEQ ID NO: 64054 - RNA, 22 nt, Human
aguugcuucccuauucuuagca

SEQ ID NO: 64055 - RNA, 22 nt, Human
aguucuuugcucccugcuuuuu

SEQ ID NO: 64056 - RNA, 22 nt, Human
aguucuggcccugaaacaggga

SEQ ID NO: 64057 - RNA, 22 nt, Human
aguucggauuguaauagauaau

SEQ ID NO: 64058 - RNA, 22 nt, Human
aguucugacucugaaucuggga

SEQ ID NO: 64059 - RNA, 22 nt, Human
aguugguauuuacugcaguugg

SEQ ID NO: 64060 - RNA, 22 nt, Human
aguugguucgucucgccuugag

SEQ ID NO: 64061 - RNA, 22 nt, Human
aguugugagaaugaacacugaa

SEQ ID NO: 64062 - RNA, 22 nt, Human
aguuguucucagcagaagaacu

SEQ ID NO: 64063 - RNA, 22 nt, Human
aguuguuuuucuuagauuuuag

SEQ ID NO: 64064 - RNA, 22 nt, Human
auaaaaaguggcugcuauugga

SEQ ID NO: 64065 - RNA, 22 nt, Human
aguuuucugccucuggaugcgu

SEQ ID NO: 64066 - RNA, 22 nt, Human
aguuuuguuuguuuguuuguua

SEQ ID NO: 64067 - RNA, 22 nt, Human
aguuuccacuggagacacugug

SEQ ID NO: 64068 - RNA, 22 nt, Human
aguuucccucacaggucugcau

SEQ ID NO: 64069 - RNA, 22 nt, Human
aguuuuugagaauucuucugaa

SEQ ID NO: 64070 - RNA, 22 nt, Human
aguuuuuaacgccauguuugaa

SEQ ID NO: 64071 - RNA, 22 nt, Human
aguuugauuugucuaucuucau

SEQ ID NO: 64072 - RNA, 22 nt, Human
aguuucuugaagacugauguuu

SEQ ID NO: 64073 - RNA, 22 nt, Human
aguuuguagguuaggaucagca

SEQ ID NO: 64074 - RNA, 22 nt, Human
aguuuggauccugcuaaaccag

SEQ ID NO: 64075 - RNA, 22 nt, Human
aguuuggaggagaaagugcggg

SEQ ID NO: 64076 - RNA, 22 nt, Human
aguuuaaauuguucuaucagaa

SEQ ID NO: 64077 - RNA, 21 nt, Human
auacaguucagcuuuuacuau

SEQ ID NO: 64078 - RNA, 22 nt, Human
auacauauaugcacauuaauau

SEQ ID NO: 64079 - RNA, 22 nt, Human
auacaucuuaacgcgcucuugg

SEQ ID NO: 64080 - RNA, 22 nt, Human
auaaucuuuccagucaguuucc

SEQ ID NO: 64081 - RNA, 22 nt, Human
auaccaaugaaucccugagaau

SEQ ID NO: 64082 - RNA, 22 nt, Human
auaauugaauaagagcugcagg

SEQ ID NO: 64083 - RNA, 22 nt, Human
auacaaaaaguggugaguguau

SEQ ID NO: 64084 - RNA, 22 nt, Human
auaaauucuaugauggauuggg

SEQ ID NO: 64085 - RNA, 22 nt, Human
auaaauuugacagcucuucaug

SEQ ID NO: 64086 - RNA, 22 nt, Human
auaaccaaaaauaguuuaguac

SEQ ID NO: 64087 - RNA, 22 nt, Human
auaaaucaagggcaguauuucc

SEQ ID NO: 64088 - RNA, 22 nt, Human
auacagccuaguuugaguccca

SEQ ID NO: 64089 - RNA, 22 nt, Human
aguuuuugccucgaauucugcg

SEQ ID NO: 64090 - RNA, 22 nt, Human
auaaaaauguuuuuguguggua

SEQ ID NO: 64091 - RNA, 18 nt, Human
aguuuuuuuggcaaaagg

SEQ ID NO: 64092 - RNA, 22 nt, Human
auaaaguaaugcauauaaugug

SEQ ID NO: 64093 - RNA, 22 nt, Human
auaaaacagaucaggagaauga

SEQ ID NO: 64094 - RNA, 22 nt, Human
auaaaaucugaagcaagaauaa

SEQ ID NO: 64095 - RNA, 22 nt, Human
auaaagggccuuauuuuagcaa

SEQ ID NO: 64096 - RNA, 22 nt, Human
auaaggaaagugagugcuuaaa

SEQ ID NO: 64097 - RNA, 22 nt, Human
auaagguuuucuuuuguucccu

SEQ ID NO: 64098 - RNA, 22 nt, Human
auaaucuuugaguagaguugag

SEQ ID NO: 64099 - RNA, 22 nt, Human
auaacgaaagcaauuauuuuca

SEQ ID NO: 64100 - RNA, 22 nt, Human
auaagcuucucugcaguucagu

SEQ ID NO: 64101 - RNA, 22 nt, Human
aucugcauguggcagguggauu

SEQ ID NO: 64102 - RNA, 22 nt, Human
aucucccaaauuagccucuuga

SEQ ID NO: 64103 - RNA, 22 nt, Human
aucucuguaaaccauaaauuga

SEQ ID NO: 64104 - RNA, 22 nt, Human
aucugacaaccuauugacuuga

SEQ ID NO: 64105 - RNA, 22 nt, Human
aucgcagaguggaaauugauga

SEQ ID NO: 64106 - RNA, 18 nt, Human
auccuucggccuagugga

SEQ ID NO: 64107 - RNA, 22 nt, Human
auccuugacuguagugauauua

SEQ ID NO: 64108 - RNA, 22 nt, Human
aucugugguacaugacggcugc

SEQ ID NO: 64109 - RNA, 22 nt, Human
aucugugauuuuggcaagauuu

SEQ ID NO: 64110 - RNA, 22 nt, Human
aucugcugcuccuucuucuugc

SEQ ID NO: 64111 - RNA, 22 nt, Human
aucugggaaggggaaaaugcug

SEQ ID NO: 64112 - RNA, 22 nt, Human
auccugugggguauugcugcau

SEQ ID NO: 64113 - RNA, 22 nt, Human
auacuuccugcuucccugaucu

SEQ ID NO: 64114 - RNA, 22 nt, Human
auacuagguggauauacaaaga

SEQ ID NO: 64115 - RNA, 22 nt, Human
auacugagauguuaauagggug

SEQ ID NO: 64116 - RNA, 22 nt, Human
auacuucaccuaacccaguuuc

SEQ ID NO: 64117 - RNA, 22 nt, Human
auacuacaucacagccaagaag

SEQ ID NO: 64118 - RNA, 22 nt, Human
aucuuagagagucguguuuugu

SEQ ID NO: 64119 - RNA, 21 nt, Human
aucugugucauuagguggcag

SEQ ID NO: 64120 - RNA, 22 nt, Human
aucggucuccuauaauucaaac

SEQ ID NO: 64121 - RNA, 22 nt, Human
aucuaaaacuacgaauacuacc

SEQ ID NO: 64122 - RNA, 22 nt, Human
aucguuaugauagagaaagaga

SEQ ID NO: 64123 - RNA, 22 nt, Human
aucuacuaagugccaagcacag

SEQ ID NO: 64124 - RNA, 22 nt, Human
aucuagguuuggaagauagagu

SEQ ID NO: 64125 - RNA, 22 nt, Human
aucuucaaggacgccaagaucc

SEQ ID NO: 64126 - RNA, 22 nt, Human
aucuucuauguguaggcauuuu

SEQ ID NO: 64127 - RNA, 22 nt, Human
aucuccagcagugcuuuugagc

SEQ ID NO: 64128 - RNA, 21 nt, Human
aucucaguccugggaaugauu

SEQ ID NO: 64129 - RNA, 22 nt, Human
aucucaagcucugagggaggcc

SEQ ID NO: 64130 - RNA, 22 nt, Human
aucuucucucucaucaggauca

SEQ ID NO: 64131 - RNA, 22 nt, Human
aucuuugccuuuaugccucuag

SEQ ID NO: 64132 - RNA, 22 nt, Human
aucuuguuagaaggcaguaggu

SEQ ID NO: 64133 - RNA, 22 nt, Human
aucuuggauccuuugccagcuu

SEQ ID NO: 64134 - RNA, 22 nt, Human
aucuguuccccuaugcucucua

SEQ ID NO: 64135 - RNA, 22 nt, Human
aucuguucuucaaaauauuaca

SEQ ID NO: 64136 - RNA, 22 nt, Human
augaagguggacagauuuuuuu

SEQ ID NO: 64137 - RNA, 22 nt, Human
augaaaacggaccagagcuauu

SEQ ID NO: 64138 - RNA, 22 nt, Human
augaggccuaauacccauuccu

SEQ ID NO: 64139 - RNA, 19 nt, Human
aucuuucagcagcuccccu

SEQ ID NO: 64140 - RNA, 22 nt, Human
aucuuugauuuuggcuuuuagg

SEQ ID NO: 64141 - RNA, 22 nt, Human
augaaaacgugugugugugugu

SEQ ID NO: 64142 - RNA, 22 nt, Human
aucuuuguaaguaaucaaagcu

SEQ ID NO: 64143 - RNA, 22 nt, Human
aucuuuuuucacaauuuauuuu

SEQ ID NO: 64144 - RNA, 19 nt, Human
augaaauagcauuuucuga

SEQ ID NO: 64145 - RNA, 22 nt, Human
augaaacuggagcgccuggagg

SEQ ID NO: 64146 - RNA, 22 nt, Human
augauaucuuguuuuucaugca

SEQ ID NO: 64147 - RNA, 22 nt, Human
augcaaaaucuuauuuuuucua

SEQ ID NO: 64148 - RNA, 23 nt, Human
augcaacauugccaguaugggca

SEQ ID NO: 64149 - RNA, 22 nt, Human
augaggagucaaggagucggag

SEQ ID NO: 64150 - RNA, 19 nt, Human
augcaauguuaucaauaac

SEQ ID NO: 64151 - RNA, 22 nt, Human
augcacaagguagauuauuauu

SEQ ID NO: 64152 - RNA, 22 nt, Human
augcaguuagguaauagucuca

SEQ ID NO: 64153 - RNA, 18 nt, Human
augauaauguuugcauca

SEQ ID NO: 64154 - RNA, 22 nt, Human
augcccagaacccccuggaugg

SEQ ID NO: 64155 - RNA, 22 nt, Human
augauucuaccaaugccaucuu

SEQ ID NO: 64156 - RNA, 22 nt, Human
augauuuguuaacagacuuaau

SEQ ID NO: 64157 - RNA, 22 nt, Human
augcaugaucccgguaugugaa

SEQ ID NO: 64158 - RNA, 22 nt, Human
augccaccucuucugauuccag

SEQ ID NO: 64159 - RNA, 22 nt, Human
auggaauuuaaauuuugguguc

SEQ ID NO: 64160 - RNA, 22 nt, Human
auggaaggggagguagggagga

SEQ ID NO: 64161 - RNA, 22 nt, Human
auggacguuuguguauuaugua

SEQ ID NO: 64162 - RNA, 22 nt, Human
auggaggaugugcagcaugggc

SEQ ID NO: 64163 - RNA, 22 nt, Human
auggagguuugucugguuuugu

SEQ ID NO: 64164 - RNA, 22 nt, Human
auggaacauuaaucuucaaaug

SEQ ID NO: 64165 - RNA, 22 nt, Human
auggaagagacaaugcuaucug

SEQ ID NO: 64166 - RNA, 22 nt, Human
augggagugacagggccacugg

SEQ ID NO: 64167 - RNA, 22 nt, Human
auggcaucuucgguuggacugc

SEQ ID NO: 64168 - RNA, 22 nt, Human
auggggaucugcaguguugauc

SEQ ID NO: 64169 - RNA, 22 nt, Human
auggggaauugaccguggaucu

SEQ ID NO: 64170 - RNA, 22 nt, Human
auggacagcucuuaugugggca

SEQ ID NO: 64171 - RNA, 22 nt, Human
auggagcagagcugaugggccu

SEQ ID NO: 64172 - RNA, 22 nt, Human
auggaggagcagaggguuucca

SEQ ID NO: 64173 - RNA, 19 nt, Human
augguauugcuggguuuuu

SEQ ID NO: 64174 - RNA, 22 nt, Human
augguguaagacuguauuucuu

SEQ ID NO: 64175 - RNA, 22 nt, Human
augggcuuuacccucagagcuu

SEQ ID NO: 64176 - RNA, 22 nt, Human
augguaaguuuuuaaaaagcgu

SEQ ID NO: 64177 - RNA, 22 nt, Human
auggugaugaugaugaugauaa

SEQ ID NO: 64178 - RNA, 22 nt, Human
augguguaggugaagagaacau

SEQ ID NO: 64179 - RNA, 22 nt, Human
augguuagauggaugagaugug

SEQ ID NO: 64180 - RNA, 22 nt, Human
auguggaaagcuugucuuagag

SEQ ID NO: 64181 - RNA, 22 nt, Human
auguugcugauccuguggcugu

SEQ ID NO: 64182 - RNA, 20 nt, Human
augugcuaauauuaauaugu

SEQ ID NO: 64183 - RNA, 21 nt, Human
auguguucugauagugcuugc

SEQ ID NO: 64184 - RNA, 23 nt, Human
auguagcugcucccgaugcccuc

SEQ ID NO: 64185 - RNA, 22 nt, Human
auguauauauacauguauugua

SEQ ID NO: 64186 - RNA, 22 nt, Human
auguuuuuugaaaauguauuuu

SEQ ID NO: 64187 - RNA, 22 nt, Human
auguuuucuugucuggagaagu

SEQ ID NO: 64188 - RNA, 22 nt, Human
auguuuugaguuuuuuuacacc

SEQ ID NO: 64189 - RNA, 22 nt, Human
auuaaacuaaauuaugaauugg

SEQ ID NO: 64190 - RNA, 22 nt, Human
auguuugugauugcugaaaaga

SEQ ID NO: 64191 - RNA, 22 nt, Human
auguuuaauuugaaauuuuauu

SEQ ID NO: 64192 - RNA, 22 nt, Human
auguuuuaaaaaacaggcuacc

SEQ ID NO: 64193 - RNA, 22 nt, Human
auguuuucauuuagaagcuaau

SEQ ID NO: 64194 - RNA, 22 nt, Human
auucauucugaccucaagagaa

SEQ ID NO: 64195 - RNA, 22 nt, Human
auucaucuguacuucaauaucu

SEQ ID NO: 64196 - RNA, 19 nt, Human
auucaagugcuuagagauc

SEQ ID NO: 64197 - RNA, 20 nt, Human
auucuguguaaauguccugu

SEQ ID NO: 64198 - RNA, 22 nt, Human
auucuuacaaagcagagucugu

SEQ ID NO: 64199 - RNA, 22 nt, Human
auucuuauaaaaaguguugacu

SEQ ID NO: 64200 - RNA, 17 nt, Human
auucuuauacucuguga

SEQ ID NO: 64201 - RNA, 22 nt, Human
auucaagauaagggucugggag

SEQ ID NO: 64202 - RNA, 22 nt, Human
auuauuugcuuaagcuggucuc

SEQ ID NO: 64203 - RNA, 22 nt, Human
auuauugcaagcagugaaggga

SEQ ID NO: 64204 - RNA, 22 nt, Human
auucaagagcccauguuuccug

SEQ ID NO: 64205 - RNA, 22 nt, Human
auucugagaucucuucuaggcc

SEQ ID NO: 64206 - RNA, 21 nt, Human
auucugaguugucagucuuca

SEQ ID NO: 64207 - RNA, 22 nt, Human
auucugcaauaaucaguccuua

SEQ ID NO: 64208 - RNA, 22 nt, Human
auucugcugccuaguuuaugaa

SEQ ID NO: 64209 - RNA, 22 nt, Human
auucuguaggcuuuuguuaaaa

SEQ ID NO: 64210 - RNA, 22 nt, Human
auucuccucaaaacaucugcug

SEQ ID NO: 64211 - RNA, 22 nt, Human
auucucauguuaccaaauucua

SEQ ID NO: 64212 - RNA, 22 nt, Human
auuaucugacugaguagucugu

SEQ ID NO: 64213 - RNA, 22 nt, Human
auuauggacuuucuuguuuggg

SEQ ID NO: 64214 - RNA, 22 nt, Human
auucgaucacugccgaggaccu

SEQ ID NO: 64215 - RNA, 22 nt, Human
auucgcggcuugaucugcuugc

SEQ ID NO: 64216 - RNA, 22 nt, Human
auucuaauaagcguuuugucgc

SEQ ID NO: 64217 - RNA, 22 nt, Human
auucuacgcuccgucucuauca

SEQ ID NO: 64218 - RNA, 22 nt, Human
auuccuguggcuggguaaagua

SEQ ID NO: 64219 - RNA, 22 nt, Human
auguugaguggaugaacaaaca

SEQ ID NO: 64220 - RNA, 22 nt, Human
auguuguugaacucuuugcaug

SEQ ID NO: 64221 - RNA, 22 nt, Human
auguuguuuauggguuaucaag

SEQ ID NO: 64222 - RNA, 22 nt, Human
auuaacaggcucuguucuaguu

SEQ ID NO: 64223 - RNA, 22 nt, Human
auucuaugaaugacuguuagau

SEQ ID NO: 64224 - RNA, 22 nt, Human
auucuagaguuucaauccaagg

SEQ ID NO: 64225 - RNA, 17 nt, Human
auucuaguuggcuuuuu

SEQ ID NO: 64226 - RNA, 20 nt, Human
auucucaccaugugacaugg

SEQ ID NO: 64227 - RNA, 22 nt, Human
auucucauguuuuaaaaaaguu

SEQ ID NO: 64228 - RNA, 22 nt, Human
auugaaauuugcuuccucacug

SEQ ID NO: 64229 - RNA, 22 nt, Human
auugaaguguacguuugaucua

SEQ ID NO: 64230 - RNA, 22 nt, Human
auugacagagguguaguugaga

SEQ ID NO: 64231 - RNA, 22 nt, Human
auucucuauugguaaauuugac

SEQ ID NO: 64232 - RNA, 22 nt, Human
auucuacucuccuacaggucua

SEQ ID NO: 64233 - RNA, 22 nt, Human
auugaaauuaauuucugcuuuc

SEQ ID NO: 64234 - RNA, 22 nt, Human
auucuuuauuuucuguacuugc

SEQ ID NO: 64235 - RNA, 22 nt, Human
auucccuuugacgaucccuagg

SEQ ID NO: 64236 - RNA, 22 nt, Human
auugauuuugugcuuuccuacg

SEQ ID NO: 64237 - RNA, 22 nt, Human
auugaugaaaauaguuauuuua

SEQ ID NO: 64238 - RNA, 22 nt, Human
auugccauaauagagccaugua

SEQ ID NO: 64239 - RNA, 22 nt, Human
auugcauucaugcuccccuuag

SEQ ID NO: 64240 - RNA, 21 nt, Human
auuggcagaucucuggauugu

SEQ ID NO: 64241 - RNA, 22 nt, Human
auucuucauguugaagcuguca

SEQ ID NO: 64242 - RNA, 22 nt, Human
auuggagacauuaagucuaaga

SEQ ID NO: 64243 - RNA, 16 nt, Human
auucuuccaccauuac

SEQ ID NO: 64244 - RNA, 22 nt, Human
auucucuguacagaagguaccg

SEQ ID NO: 64245 - RNA, 22 nt, Human
auucugaagcagaaaaggcaga

SEQ ID NO: 64246 - RNA, 21 nt, Human
auucugauguuucuauuguuu

SEQ ID NO: 64247 - RNA, 22 nt, Human
auucugcauuucuaaccagguc

SEQ ID NO: 64248 - RNA, 22 nt, Human
auucuguugguuuaauagucaa

SEQ ID NO: 64249 - RNA, 22 nt, Human
auucuguuuaauacacgaaagg

SEQ ID NO: 64250 - RNA, 22 nt, Human
auucuguuuuaccauuuucuuu

SEQ ID NO: 64251 - RNA, 22 nt, Human
auucuugauauagauaguuaau

SEQ ID NO: 64252 - RNA, 22 nt, Human
auuguuuugugaaacauaguga

SEQ ID NO: 64253 - RNA, 22 nt, Human
auugaagcauggagaugaggca

SEQ ID NO: 64254 - RNA, 22 nt, Human
auugaauuagauguuguagucc

SEQ ID NO: 64255 - RNA, 19 nt, Human
auucuucucuuccugcugu

SEQ ID NO: 64256 - RNA, 20 nt, Human
auucuuguuccauuucccag

SEQ ID NO: 64257 - RNA, 22 nt, Human
auucuuuagaguccuucaaaua

SEQ ID NO: 64258 - RNA, 18 nt, Human
auugagcaugacagaccu

SEQ ID NO: 64259 - RNA, 22 nt, Human
auugagaugcuuaaaucuucac

SEQ ID NO: 64260 - RNA, 22 nt, Human
auugagaaaauucgagcaaguu

SEQ ID NO: 64261 - RNA, 22 nt, Human
auugagcuguugaagucccaca

SEQ ID NO: 64262 - RNA, 22 nt, Human
auugaugccugaaaaauaugua

SEQ ID NO: 64263 - RNA, 19 nt, Human
auugcaguguaaaacuauu

SEQ ID NO: 64264 - RNA, 23 nt, Human
auugccuguagaucuucacuuuc

SEQ ID NO: 64265 - RNA, 22 nt, Human
auuucccugcagugcuuaggaa

SEQ ID NO: 64266 - RNA, 22 nt, Human
auuuaucugcucuucgcguuga

SEQ ID NO: 64267 - RNA, 22 nt, Human
auuuaggacagugucugaauug

SEQ ID NO: 64268 - RNA, 22 nt, Human
auuuagagaaguagcaaggucc

SEQ ID NO: 64269 - RNA, 22 nt, Human
auuugcuuguucaccaguacuu

SEQ ID NO: 64270 - RNA, 22 nt, Human
auuugcauguuuauuucuuaga

SEQ ID NO: 64271 - RNA, 23 nt, Human
auuugcugaucguagaugacuag

SEQ ID NO: 64272 - RNA, 22 nt, Human
auuugccaguuacucacaccac

SEQ ID NO: 64273 - RNA, 22 nt, Human
auuugaaguauaaguaauugcu

SEQ ID NO: 64274 - RNA, 22 nt, Human
auuguucuagaauuuuuuuucc

SEQ ID NO: 64275 - RNA, 22 nt, Human
auuguuuccccggaauuauuca

SEQ ID NO: 64276 - RNA, 22 nt, Human
auuggaagacgcuggaggcacu

SEQ ID NO: 64277 - RNA, 22 nt, Human
auugguuucuuguggguuaucc

SEQ ID NO: 64278 - RNA, 19 nt, Human
auugguuugcucgggaaug

SEQ ID NO: 64279 - RNA, 22 nt, Human
auuguauugcguuugcgaaugu

SEQ ID NO: 64280 - RNA, 22 nt, Human
caaaacauucagagagcucacu

SEQ ID NO: 64281 - RNA, 22 nt, Human
caaaaauacuugccuguaucug

SEQ ID NO: 64282 - RNA, 22 nt, Human
caaaaaauccauagaaagaggu

SEQ ID NO: 64283 - RNA, 22 nt, Human
auuuuuucaugugugguugaga

SEQ ID NO: 64284 - RNA, 22 nt, Human
auuuuuaucuaaaauccacuuu

SEQ ID NO: 64285 - RNA, 19 nt, Human
caagagcaaagucuuauga

SEQ ID NO: 64286 - RNA, 22 nt, Human
auuuuuuuggucauaugagaua

SEQ ID NO: 64287 - RNA, 22 nt, Human
auuuuugguuucaccugcacgc

SEQ ID NO: 64288 - RNA, 22 nt, Human
auuuuugugcuuuauuggggua

SEQ ID NO: 64289 - RNA, 22 nt, Human
caaauggggaauagaugauggg

SEQ ID NO: 64290 - RNA, 22 nt, Human
caaauuuuuauuuaccaucugc

SEQ ID NO: 64291 - RNA, 22 nt, Human
auuuuugguuauaaaauaguuu

SEQ ID NO: 64292 - RNA, 22 nt, Human
caaaugaugcauggcuagugag

SEQ ID NO: 64293 - RNA, 22 nt, Human
caaaguaggcuaagaccuucca

SEQ ID NO: 64294 - RNA, 22 nt, Human
auuuuuauuugccuaugauaua

SEQ ID NO: 64295 - RNA, 22 nt, Human
caaaggaauuacauguuucgga

SEQ ID NO: 64296 - RNA, 22 nt, Human
caaaggagcccuuugccggguu

SEQ ID NO: 64297 - RNA, 22 nt, Human
auuuuuagagugaaagaauuaa

SEQ ID NO: 64298 - RNA, 22 nt, Human
auuuuuagucuugcugcaauca

SEQ ID NO: 64299 - RNA, 22 nt, Human
caaaauuguugaugcugcuuug

SEQ ID NO: 64300 - RNA, 22 nt, Human
auuuuguugaaacccuuguugu

SEQ ID NO: 64301 - RNA, 22 nt, Human
auuuuggguguuaacaaugaaa

SEQ ID NO: 64302 - RNA, 22 nt, Human
auuuucuucauuuugauuguau

SEQ ID NO: 64303 - RNA, 22 nt, Human
auuuucauauggguuauuugua

SEQ ID NO: 64304 - RNA, 22 nt, Human
auuuuauuuugggaucuuuuua

SEQ ID NO: 64305 - RNA, 22 nt, Human
auuucuguaauucugaggagug

SEQ ID NO: 64306 - RNA, 23 nt, Human
auuuccuaaaagauaaucauuac

SEQ ID NO: 64307 - RNA, 22 nt, Human
auuuuuuuaggcugucagccgc

SEQ ID NO: 64308 - RNA, 22 nt, Human
auuuuacuaugauaguugagaa

SEQ ID NO: 64309 - RNA, 23 nt, Human
auuuuuccacacacagacucagu

SEQ ID NO: 64310 - RNA, 22 nt, Human
caaugccaggaaccugggggaa

SEQ ID NO: 64311 - RNA, 22 nt, Human
caaagaaccuucgagacagggc

SEQ ID NO: 64312 - RNA, 22 nt, Human
caagcagauauuuuagucaaga

SEQ ID NO: 64313 - RNA, 22 nt, Human
caaaagcaaagaucuuugauug

SEQ ID NO: 64314 - RNA, 22 nt, Human
caauguuuuuccuuccuuaaua

SEQ ID NO: 64315 - RNA, 23 nt, Human
cacucgcaggcccagcucucagg

SEQ ID NO: 64316 - RNA, 22 nt, Human
cacucuucucucauuuuccuuu

SEQ ID NO: 64317 - RNA, 22 nt, Human
cacacagguaagccucuuucaa

SEQ ID NO: 64318 - RNA, 22 nt, Human
cacugcugaggcccguguuacu

SEQ ID NO: 64319 - RNA, 22 nt, Human
cacagaggaugcccaagcgauc

SEQ ID NO: 64320 - RNA, 22 nt, Human
cacagaauuaagggagaaauau

SEQ ID NO: 64321 - RNA, 22 nt, Human
cacacguuucuacugcugccaa

SEQ ID NO: 64322 - RNA, 22 nt, Human
cacugguugccucuuucuguuc

SEQ ID NO: 64323 - RNA, 21 nt, Human
cacuguauagcaggagaaaac

SEQ ID NO: 64324 - RNA, 22 nt, Human
cacagucugagcccagccuugu

SEQ ID NO: 64325 - RNA, 22 nt, Human
cacuugauugucagaaaaaugg

SEQ ID NO: 64326 - RNA, 22 nt, Human
cagaaaguauguucuaguaguu

SEQ ID NO: 64327 - RNA, 22 nt, Human
cagaaaacauuguguguauaag

SEQ ID NO: 64328 - RNA, 22 nt, Human
cagaaacacuguauuuagggaa

SEQ ID NO: 64329 - RNA, 22 nt, Human
cagacagagcucacaagucuuu

SEQ ID NO: 64330 - RNA, 22 nt, Human
cagacaaauccuuaugagacug

SEQ ID NO: 64331 - RNA, 22 nt, Human
cagaaagugauuugcuauucca

SEQ ID NO: 64332 - RNA, 22 nt, Human
cagaaauuggcagagaagaccu

SEQ ID NO: 64333 - RNA, 23 nt, Human
cagagaaaauagaauaugcugug

SEQ ID NO: 64334 - RNA, 22 nt, Human
cagacugugagcuccuugaggg

SEQ ID NO: 64335 - RNA, 21 nt, Human
cagagcuuuggagacggagga

SEQ ID NO: 64336 - RNA, 22 nt, Human
cacuguugaagauacuuccucu

SEQ ID NO: 64337 - RNA, 22 nt, Human
cacuuauuuuuccuuugugauu

SEQ ID NO: 64338 - RNA, 22 nt, Human
cagcagaggagguggcagcacc

SEQ ID NO: 64339 - RNA, 22 nt, Human
cagcauugagcacagaaggaaa

SEQ ID NO: 64340 - RNA, 22 nt, Human
cagcauucuacuuugugaacug

SEQ ID NO: 64341 - RNA, 22 nt, Human
cagaaguugcuugagagagagc

SEQ ID NO: 64342 - RNA, 22 nt, Human
cagagaggagcacaaagugaag

SEQ ID NO: 64343 - RNA, 22 nt, Human
cagaggagcgaguuggacgcca

SEQ ID NO: 64344 - RNA, 22 nt, Human
cagagaugaggcuggcgugguu

SEQ ID NO: 64345 - RNA, 22 nt, Human
cagagcugucauuugccaguga

SEQ ID NO: 64346 - RNA, 22 nt, Human
cagcuacuaccuguagacaaag

SEQ ID NO: 64347 - RNA, 22 nt, Human
cagaggauggaaaugagaacaa

SEQ ID NO: 64348 - RNA, 22 nt, Human
caggaaaauaauggugauggga

SEQ ID NO: 64349 - RNA, 22 nt, Human
caggaacagcaccaggagcuag

SEQ ID NO: 64350 - RNA, 22 nt, Human
cagcccuggccucuucgcuuuc

SEQ ID NO: 64351 - RNA, 22 nt, Human
caggagaaauucacauuaguga

SEQ ID NO: 64352 - RNA, 22 nt, Human
caggauauguucaagguuuucu

SEQ ID NO: 64353 - RNA, 19 nt, Human
caggauuguuuaaagcuuu

SEQ ID NO: 64354 - RNA, 22 nt, Human
caggaggaggccgggaggaagc

SEQ ID NO: 64355 - RNA, 22 nt, Human
cagcuauggaauuggcccagau

SEQ ID NO: 64356 - RNA, 22 nt, Human
cagggacugcaggaggacaggu

SEQ ID NO: 64357 - RNA, 22 nt, Human
caggguuuuauuuggcuuuaaa

SEQ ID NO: 64358 - RNA, 22 nt, Human
cagcuguauuucucugguuaga

SEQ ID NO: 64359 - RNA, 22 nt, Human
cagcuugcccugauguggaaga

SEQ ID NO: 64360 - RNA, 22 nt, Human
cagcuuguucugaccugugauu

SEQ ID NO: 64361 - RNA, 22 nt, Human
caggaagagaacugcucagccu

SEQ ID NO: 64362 - RNA, 22 nt, Human
cagguguugcaguugaagacug

SEQ ID NO: 64363 - RNA, 22 nt, Human
caggacuuccucuaugguggcg

SEQ ID NO: 64364 - RNA, 22 nt, Human
caggagagucucugucuguacu

SEQ ID NO: 64365 - RNA, 22 nt, Human
cagguuguucugggcauggagg

SEQ ID NO: 64366 - RNA, 22 nt, Human
caggaggaaaguuccacucaac

SEQ ID NO: 64367 - RNA, 22 nt, Human
caggauuuaauaagauaguguu

SEQ ID NO: 64368 - RNA, 22 nt, Human
cagucugcuggcuuuuucagca

SEQ ID NO: 64369 - RNA, 22 nt, Human
caguggacacuuccucuacaau

SEQ ID NO: 64370 - RNA, 22 nt, Human
caguggagaccugccugcugga

SEQ ID NO: 64371 - RNA, 22 nt, Human
caguugcuauugagagaacaca

SEQ ID NO: 64372 - RNA, 22 nt, Human
caguucacggcugguaugaauu

SEQ ID NO: 64373 - RNA, 22 nt, Human
cauaucuccagguucugcugga

SEQ ID NO: 64374 - RNA, 22 nt, Human
caggugggauuuugcugcuuga

SEQ ID NO: 64375 - RNA, 22 nt, Human
cagguaguuagaaugaccagga

SEQ ID NO: 64376 - RNA, 22 nt, Human
cauaggaaauugcuguuaugga

SEQ ID NO: 64377 - RNA, 22 nt, Human
cauaggcucuucagagaacuga

SEQ ID NO: 64378 - RNA, 22 nt, Human
cauauacauauacaugcauaca

SEQ ID NO: 64379 - RNA, 22 nt, Human
cagguggauggcgagcccugca

SEQ ID NO: 64380 - RNA, 22 nt, Human
cauaaauuuuaccuuguaagug

SEQ ID NO: 64381 - RNA, 22 nt, Human
cauaagaauauuuaguggcagc

SEQ ID NO: 64382 - RNA, 22 nt, Human
cauaaucaagggguugugaugu

SEQ ID NO: 64383 - RNA, 22 nt, Human
caugugcaucagccaauuggag

SEQ ID NO: 64384 - RNA, 22 nt, Human
cauauuaugcauguuguucuuu

SEQ ID NO: 64385 - RNA, 22 nt, Human
cauuauucaggcuuuggaauuu

SEQ ID NO: 64386 - RNA, 21 nt, Human
caucaagaucaauggagggcu

SEQ ID NO: 64387 - RNA, 22 nt, Human
caucaauagguauuugagagac

SEQ ID NO: 64388 - RNA, 22 nt, Human
cauuccuucucagguacuggca

SEQ ID NO: 64389 - RNA, 22 nt, Human
caucauuuggcuuuagggccug

SEQ ID NO: 64390 - RNA, 22 nt, Human
cauuccuaccauaucugcucuu

SEQ ID NO: 64391 - RNA, 20 nt, Human
cauuccaugcaucuuggucc

SEQ ID NO: 64392 - RNA, 22 nt, Human
cauuccaaguauauacaugaua

SEQ ID NO: 64393 - RNA, 22 nt, Human
caucacggagcaugagaagaca

SEQ ID NO: 64394 - RNA, 22 nt, Human
cauugcuguuaauugucucuag

SEQ ID NO: 64395 - RNA, 22 nt, Human
cauuggaugagggccucaucga

SEQ ID NO: 64396 - RNA, 22 nt, Human
caucugcagccucugcauuccc

SEQ ID NO: 64397 - RNA, 22 nt, Human
cauccuauuacugaggcucccc

SEQ ID NO: 64398 - RNA, 22 nt, Human
caucuaaaauaagccuuauaau

SEQ ID NO: 64399 - RNA, 22 nt, Human
caucuuuguuuuggauauaauc

SEQ ID NO: 64400 - RNA, 18 nt, Human
cauuguacaaugcuuuau

SEQ ID NO: 64401 - RNA, 22 nt, Human
caugauaacacuucuguuuaau

SEQ ID NO: 64402 - RNA, 22 nt, Human
caugaacucucggguuuggaau

SEQ ID NO: 64403 - RNA, 22 nt, Human
caugaauaauucuuuuucuugg

SEQ ID NO: 64404 - RNA, 22 nt, Human
cauuugcuuaucacucuucuuu

SEQ ID NO: 64405 - RNA, 22 nt, Human
cauuuugguaauguucguuugc

SEQ ID NO: 64406 - RNA, 22 nt, Human
ccaaagaauuuggaaaaucuga

SEQ ID NO: 64407 - RNA, 19 nt, Human
ccaacaguacugaagcacu

SEQ ID NO: 64408 - RNA, 22 nt, Human
ccaaagaagcaaugagaauagu

SEQ ID NO: 64409 - RNA, 22 nt, Human
ccaaaauauuagugcuuaagua

SEQ ID NO: 64410 - RNA, 22 nt, Human
cauuuuuccucaggcaauuuga

SEQ ID NO: 64411 - RNA, 22 nt, Human
caugcagauugccaggcucccu

SEQ ID NO: 64412 - RNA, 22 nt, Human
cauuuugguccucauguguagc

SEQ ID NO: 64413 - RNA, 22 nt, Human
ccaaccaguuucuuggcuuuag

SEQ ID NO: 64414 - RNA, 22 nt, Human
cauggcacuuuugugucuaaau

SEQ ID NO: 64415 - RNA, 22 nt, Human
caugggaaauauaagaauuuuc

SEQ ID NO: 64416 - RNA, 21 nt, Human
caugguaaguacaaagaugac

SEQ ID NO: 64417 - RNA, 22 nt, Human
cauguauguuaguggcugcuuu

SEQ ID NO: 64418 - RNA, 19 nt, Human
ccacacacuggucucuggg

SEQ ID NO: 64419 - RNA, 22 nt, Human
cauuccaagaaguaguucugca

SEQ ID NO: 64420 - RNA, 22 nt, Human
cauuacaagaaauagcauaaug

SEQ ID NO: 64421 - RNA, 22 nt, Human
cauuaccuggggagaggauacc

SEQ ID NO: 64422 - RNA, 22 nt, Human
cauugcaaccccaaaaagaaca

SEQ ID NO: 64423 - RNA, 20 nt, Human
ccagaagagaagaaaaggaa

SEQ ID NO: 64424 - RNA, 19 nt, Human
ccagaagggcaagcaaagg

SEQ ID NO: 64425 - RNA, 22 nt, Human
cauugcugugggcauuugcugc

SEQ ID NO: 64426 - RNA, 22 nt, Human
cauugcugccaaggugagcugg

SEQ ID NO: 64427 - RNA, 22 nt, Human
ccagagcaccgaaacgagcuuu

SEQ ID NO: 64428 - RNA, 22 nt, Human
cauuuagagaagauuacaagga

SEQ ID NO: 64429 - RNA, 22 nt, Human
ccagagaugcagugggugcagu

SEQ ID NO: 64430 - RNA, 22 nt, Human
cauuucaaacaguuacagcugc

SEQ ID NO: 64431 - RNA, 22 nt, Human
cauuuucugcaagucugcucaa

SEQ ID NO: 64432 - RNA, 22 nt, Human
cauuucuugugagccgcauccu

SEQ ID NO: 64433 - RNA, 23 nt, Human
cauuugauccucacaauaaaugg

SEQ ID NO: 64434 - RNA, 22 nt, Human
cauuuuuuuuccccuccuggua

SEQ ID NO: 64435 - RNA, 22 nt, Human
ccagggaagaaagaugaagugc

SEQ ID NO: 64436 - RNA, 22 nt, Human
ccaagagcuucccauagcuucu

SEQ ID NO: 64437 - RNA, 22 nt, Human
ccaaccaguuaucuccuaaggu

SEQ ID NO: 64438 - RNA, 22 nt, Human
ccaagcguguuuaggaaaugcu

SEQ ID NO: 64439 - RNA, 22 nt, Human
ccagucagccuaguucuucuuu

SEQ ID NO: 64440 - RNA, 22 nt, Human
ccaaggcuguggggcugugcag

SEQ ID NO: 64441 - RNA, 21 nt, Human
ccacaauucuaguuacauaug

SEQ ID NO: 64442 - RNA, 22 nt, Human
ccaucuuugcucuuuuauugca

SEQ ID NO: 64443 - RNA, 22 nt, Human
ccacuacauugagugcuuucuc

SEQ ID NO: 64444 - RNA, 20 nt, Human
ccacuucucugcucugccca

SEQ ID NO: 64445 - RNA, 22 nt, Human
cccagaaugauucagcgacagu

SEQ ID NO: 64446 - RNA, 22 nt, Human
ccagacuggggauuuugccagg

SEQ ID NO: 64447 - RNA, 22 nt, Human
ccgcggauggggagucaccacc

SEQ ID NO: 64448 - RNA, 20 nt, Human
ccugggcuccaggagccccg

SEQ ID NO: 64449 - RNA, 22 nt, Human
ccugugcaugccaggguacacc

SEQ ID NO: 64450 - RNA, 22 nt, Human
ccuuaauaguguucuaauguuu

SEQ ID NO: 64451 - RNA, 20 nt, Human
ccuguucacugcgcaguuuc

SEQ ID NO: 64452 - RNA, 22 nt, Human
ccuucucuucuuggaaggaacu

SEQ ID NO: 64453 - RNA, 18 nt, Human
ccuucaucucugcuucuu

SEQ ID NO: 64454 - RNA, 22 nt, Human
ccuuggaucugcauaucagcua

SEQ ID NO: 64455 - RNA, 22 nt, Human
ccuugguuuagcaauuuuucuu

SEQ ID NO: 64456 - RNA, 23 nt, Human
ccuuguguaucuccagccacucc

SEQ ID NO: 64457 - RNA, 17 nt, Human
ccuuucugaucaucuga

SEQ ID NO: 64458 - RNA, 22 nt, Human
ccuuuccuggaaaugguaaguu

SEQ ID NO: 64459 - RNA, 21 nt, Human
ccuuuggagacugcagcaaug

SEQ ID NO: 64460 - RNA, 22 nt, Human
ccuuuuaucgcgaagaacucca

SEQ ID NO: 64461 - RNA, 20 nt, Human
ccuuuuguugcuguuuggau

SEQ ID NO: 64462 - RNA, 22 nt, Human
ccuauauuacaggcuugcucua

SEQ ID NO: 64463 - RNA, 22 nt, Human
ccuauuuucaaaauuguuuauc

SEQ ID NO: 64464 - RNA, 22 nt, Human
ccuagcauagcuuuugccuccc

SEQ ID NO: 64465 - RNA, 22 nt, Human
ccuaggauuaaaauaauaauua

SEQ ID NO: 64466 - RNA, 22 nt, Human
cgaacggcagagagcccguccc

SEQ ID NO: 64467 - RNA, 22 nt, Human
ccuuuuuagaugugcgaauguu

SEQ ID NO: 64468 - RNA, 22 nt, Human
ccuaacaugguuauuguuaauu

SEQ ID NO: 64469 - RNA, 22 nt, Human
cgaaggaaucacuuaacacuuu

SEQ ID NO: 64470 - RNA, 22 nt, Human
ccucccuucccggcauggcucu

SEQ ID NO: 64471 - RNA, 22 nt, Human
ccuccuuuccuguuuuccugag

SEQ ID NO: 64472 - RNA, 22 nt, Human
cgagugauuauucuggcugaga

SEQ ID NO: 64473 - RNA, 22 nt, Human
ccugaggcccuggcugugcuga

SEQ ID NO: 64474 - RNA, 22 nt, Human
cgcuuugguaauagggcagccu

SEQ ID NO: 64475 - RNA, 22 nt, Human
cggagagacaagucugcuuugg

SEQ ID NO: 64476 - RNA, 22 nt, Human
cgggagcagcucuggggcuggg

SEQ ID NO: 64477 - RNA, 22 nt, Human
ccuugcgaggaugcugugagcu

SEQ ID NO: 64478 - RNA, 22 nt, Human
ccuucugcuggucaucccagug

SEQ ID NO: 64479 - RNA, 22 nt, Human
ccuucuuaaacaucauuuuggc

SEQ ID NO: 64480 - RNA, 22 nt, Human
ccuuugcugggccucuccaucu

SEQ ID NO: 64481 - RNA, 22 nt, Human
ccuuucucuuggauaccgauug

SEQ ID NO: 64482 - RNA, 22 nt, Human
cgaaaaagaagugcaccauguu

SEQ ID NO: 64483 - RNA, 22 nt, Human
cgugugcguauguguuuguaug

SEQ ID NO: 64484 - RNA, 22 nt, Human
cuaaacuucauauguugcuuua

SEQ ID NO: 64485 - RNA, 16 nt, Human
cuaaaaugucuacuug

SEQ ID NO: 64486 - RNA, 22 nt, Human
cuaaauguuuuaucuuccuggc

SEQ ID NO: 64487 - RNA, 22 nt, Human
cuacugaagcaugcuuauaugu

SEQ ID NO: 64488 - RNA, 22 nt, Human
cuagaucuggcaggcacaaggu

SEQ ID NO: 64489 - RNA, 22 nt, Human
cuagaaaguaugcuuuuauaau

SEQ ID NO: 64490 - RNA, 22 nt, Human
cuagagaaaaagcuuagguacg

SEQ ID NO: 64491 - RNA, 22 nt, Human
cgaguaauuggaaauuugcuau

SEQ ID NO: 64492 - RNA, 22 nt, Human
cgauuccugauaagugaauaag

SEQ ID NO: 64493 - RNA, 22 nt, Human
cuacuucucccuagaucagaaa

SEQ ID NO: 64494 - RNA, 22 nt, Human
cuacuucuguggcucuaagaga

SEQ ID NO: 64495 - RNA, 22 nt, Human
cuaggaugcuguaauggugucu

SEQ ID NO: 64496 - RNA, 22 nt, Human
cuaggcuuucugugugacuaga

SEQ ID NO: 64497 - RNA, 22 nt, Human
cuaguuuuaagcuccuugaggu

SEQ ID NO: 64498 - RNA, 22 nt, Human
cuaguauuaagugugaguaaaa

SEQ ID NO: 64499 - RNA, 22 nt, Human
cucaguauugacgaaagagauu

SEQ ID NO: 64500 - RNA, 22 nt, Human
cucaauuuuuauugcuuuuuug

SEQ ID NO: 64501 - RNA, 22 nt, Human
cucaugaauggcucuuugugcu

SEQ ID NO: 64502 - RNA, 22 nt, Human
cucauugacagagcagcucuac

SEQ ID NO: 64503 - RNA, 22 nt, Human
cuccaggacugaggacagagcu

SEQ ID NO: 64504 - RNA, 22 nt, Human
cucccucauaugguugcuuauc

SEQ ID NO: 64505 - RNA, 22 nt, Human
cuccacagccccuccaguggca

SEQ ID NO: 64506 - RNA, 22 nt, Human
cuccucguccucuucauccucu

SEQ ID NO: 64507 - RNA, 22 nt, Human
cuccuauugaucaguacuauuu

SEQ ID NO: 64508 - RNA, 22 nt, Human
cuccuagagcacaaaaggccau

SEQ ID NO: 64509 - RNA, 22 nt, Human
cggccuuugcccgucauucugg

SEQ ID NO: 64510 - RNA, 22 nt, Human
cucucuuuuuuucccuuguuaa

SEQ ID NO: 64511 - RNA, 22 nt, Human
cggagggcccucaggacugggu

SEQ ID NO: 64512 - RNA, 22 nt, Human
cucucuguuaugcuuucaugaa

SEQ ID NO: 64513 - RNA, 22 nt, Human
cucugcuagaaggucaaucucu

SEQ ID NO: 64514 - RNA, 22 nt, Human
cucugcuuagacaggcuuuaag

SEQ ID NO: 64515 - RNA, 22 nt, Human
cugagcuauauauuaugcauag

SEQ ID NO: 64516 - RNA, 22 nt, Human
cugaggaguaguucuggaggac

SEQ ID NO: 64517 - RNA, 23 nt, Human
cugagggcuggucugaagucugc

SEQ ID NO: 64518 - RNA, 22 nt, Human
cugaguuuuucaaaucugaauu

SEQ ID NO: 64519 - RNA, 22 nt, Human
cugaucuuaaguaacauuauuu

SEQ ID NO: 64520 - RNA, 22 nt, Human
cugauagagcauuagugugaga

SEQ ID NO: 64521 - RNA, 20 nt, Human
cugauagauucuuccccaga

SEQ ID NO: 64522 - RNA, 22 nt, Human
cgugaagaaguaauagguggug

SEQ ID NO: 64523 - RNA, 22 nt, Human
cgugucauggcggcgcaggugg

SEQ ID NO: 64524 - RNA, 17 nt, Human
cguuccagaacaaauga

SEQ ID NO: 64525 - RNA, 22 nt, Human
cugcacuggguacauagaaaca

SEQ ID NO: 64526 - RNA, 22 nt, Human
cugauuucaaauggugcuagau

SEQ ID NO: 64527 - RNA, 22 nt, Human
cugauuguagccacugugauga

SEQ ID NO: 64528 - RNA, 22 nt, Human
cuaaaacuuuuccaaauuaugu

SEQ ID NO: 64529 - RNA, 22 nt, Human
cuaaacacuauucuggaaauag

SEQ ID NO: 64530 - RNA, 22 nt, Human
cuaaaccaauauauuuucuucc

SEQ ID NO: 64531 - RNA, 22 nt, Human
cuaaagacagcaagacaucauc

SEQ ID NO: 64532 - RNA, 22 nt, Human
cuaaauucuauauccuugcuuc

SEQ ID NO: 64533 - RNA, 22 nt, Human
cugcagauaaguguuuugaaaa

SEQ ID NO: 64534 - RNA, 22 nt, Human
cuaacuuugucuugguaauugc

SEQ ID NO: 64535 - RNA, 22 nt, Human
cuacacgauaaauuuuaguggu

SEQ ID NO: 64536 - RNA, 22 nt, Human
cugccaguaucuuuggggcugu

SEQ ID NO: 64537 - RNA, 22 nt, Human
cuacaaggucuuuaucugcuuu

SEQ ID NO: 64538 - RNA, 22 nt, Human
cuaccccaggccccucgaugcc

SEQ ID NO: 64539 - RNA, 19 nt, Human
cuacaguguuuuucuuucc

SEQ ID NO: 64540 - RNA, 22 nt, Human
cuacauaaauuuaucacagacu

SEQ ID NO: 64541 - RNA, 18 nt, Human
cuacauucauaggaaagg

SEQ ID NO: 64542 - RNA, 22 nt, Human
cugccucucaugccugcuugcu

SEQ ID NO: 64543 - RNA, 22 nt, Human
cuacuuucuucuucagaauugu

SEQ ID NO: 64544 - RNA, 22 nt, Human
cuagaaguuuggguccauuaag

SEQ ID NO: 64545 - RNA, 22 nt, Human
cugcgcagaucugcuguucucu

SEQ ID NO: 64546 - RNA, 22 nt, Human
cugcggcaccaaccccuucaug

SEQ ID NO: 64547 - RNA, 22 nt, Human
cuagaggaacaguuucagguuu

SEQ ID NO: 64548 - RNA, 22 nt, Human
cuagaucuuuaaaaaucuggaa

SEQ ID NO: 64549 - RNA, 22 nt, Human
cuacuguaguuaaaguuuugua

SEQ ID NO: 64550 - RNA, 22 nt, Human
cuagcaggacucagcagauauu

SEQ ID NO: 64551 - RNA, 22 nt, Human
cuagguggcagcacuccgaggu

SEQ ID NO: 64552 - RNA, 22 nt, Human
cuagcagaagcuccuugagggu

SEQ ID NO: 64553 - RNA, 20 nt, Human
cugcuccauggcaucuuuag

SEQ ID NO: 64554 - RNA, 22 nt, Human
cugcugccagcuuaauacucac

SEQ ID NO: 64555 - RNA, 21 nt, Human
cugcugaaggaaccccaugga

SEQ ID NO: 64556 - RNA, 22 nt, Human
cuaguucugccauucaguguca

SEQ ID NO: 64557 - RNA, 22 nt, Human
cugcuauaacacuaacaucuaa

SEQ ID NO: 64558 - RNA, 22 nt, Human
cugcugucuuuauuucacugcu

SEQ ID NO: 64559 - RNA, 22 nt, Human
cugcugugcagacagacucucu

SEQ ID NO: 64560 - RNA, 22 nt, Human
cuauguuuugcuagugaugggu

SEQ ID NO: 64561 - RNA, 22 nt, Human
cugcuguugagguuccaggcca

SEQ ID NO: 64562 - RNA, 22 nt, Human
cugcuguuuuccccaccaucuc

SEQ ID NO: 64563 - RNA, 22 nt, Human
cugcuguuuucugggcuucuua

SEQ ID NO: 64564 - RNA, 22 nt, Human
cuauuauuauugucguuuuaca

SEQ ID NO: 64565 - RNA, 22 nt, Human
cugcuugaugaggaaaggauug

SEQ ID NO: 64566 - RNA, 22 nt, Human
cucaagacacccuggccucuac

SEQ ID NO: 64567 - RNA, 22 nt, Human
cuauuuucccauaugguugaca

SEQ ID NO: 64568 - RNA, 22 nt, Human
cucaaaauccauaaaaucaggu

SEQ ID NO: 64569 - RNA, 22 nt, Human
cucacccaaacuauaucuuuaa

SEQ ID NO: 64570 - RNA, 22 nt, Human
cugcuuuggaucucucucugcc

SEQ ID NO: 64571 - RNA, 22 nt, Human
cugcuuguguugcucagaguca

SEQ ID NO: 64572 - RNA, 22 nt, Human
cucaagagaaaucggaaucaga

SEQ ID NO: 64573 - RNA, 22 nt, Human
cucagaagaacaaaggcucuac

SEQ ID NO: 64574 - RNA, 22 nt, Human
cucagaugaugucuucagggaa

SEQ ID NO: 64575 - RNA, 22 nt, Human
cucaggaaaauauugaagaagu

SEQ ID NO: 64576 - RNA, 22 nt, Human
cucaucuucuuccuucuuuucc

SEQ ID NO: 64577 - RNA, 22 nt, Human
cucaugagucugucagagucau

SEQ ID NO: 64578 - RNA, 20 nt, Human
cucauugcuuucauuuucuu

SEQ ID NO: 64579 - RNA, 22 nt, Human
cuccaaaucugauugcuaccuu

SEQ ID NO: 64580 - RNA, 22 nt, Human
cuccagauuugggggauauacu

SEQ ID NO: 64581 - RNA, 22 nt, Human
cuccaacugccacuguacugga

SEQ ID NO: 64582 - RNA, 22 nt, Human
cugggagaugacucagagcagg

SEQ ID NO: 64583 - RNA, 22 nt, Human
cucccuucaggggaggacuagg

SEQ ID NO: 64584 - RNA, 22 nt, Human
cuggucuugguauucgcagaag

SEQ ID NO: 64585 - RNA, 22 nt, Human
cugggaguugacgaggcuugua

SEQ ID NO: 64586 - RNA, 22 nt, Human
cugguuuauuucauaguuuguu

SEQ ID NO: 64587 - RNA, 22 nt, Human
cugguuuuccaauguuuugacu

SEQ ID NO: 64588 - RNA, 22 nt, Human
cucuuucauucuuagguugccg

SEQ ID NO: 64589 - RNA, 22 nt, Human
cucuuuuuuugucuuaagaacc

SEQ ID NO: 64590 - RNA, 22 nt, Human
cucuuuguauucuagaagcucu

SEQ ID NO: 64591 - RNA, 22 nt, Human
cuguucagugcauauguauuga

SEQ ID NO: 64592 - RNA, 22 nt, Human
cugaagaaagaaaauggccauc

SEQ ID NO: 64593 - RNA, 22 nt, Human
cugaaagacagccaggcaaagc

SEQ ID NO: 64594 - RNA, 22 nt, Human
cuguuguguuauuugcagugca

SEQ ID NO: 64595 - RNA, 22 nt, Human
cuguuucucugccugcacacau

SEQ ID NO: 64596 - RNA, 22 nt, Human
cuguuucuuugcugucagagag

SEQ ID NO: 64597 - RNA, 22 nt, Human
cuguuguauuuauuucccuuuc

SEQ ID NO: 64598 - RNA, 22 nt, Human
cuuacaauuuucuuggacuuuu

SEQ ID NO: 64599 - RNA, 22 nt, Human
cuguuuuugccugugacaaaaa

SEQ ID NO: 64600 - RNA, 22 nt, Human
cuuauuagaaagaaaagacaug

SEQ ID NO: 64601 - RNA, 22 nt, Human
cuuauucuucuggacuuggagu

SEQ ID NO: 64602 - RNA, 22 nt, Human
cugauggagagugugauuuggg

SEQ ID NO: 64603 - RNA, 22 nt, Human
cugauccuauauugguaugagg

SEQ ID NO: 64604 - RNA, 22 nt, Human
cugaugcucuggauguagucaa

SEQ ID NO: 64605 - RNA, 22 nt, Human
cuuugcaaagagagaaaguggg

SEQ ID NO: 64606 - RNA, 22 nt, Human
cuggagcucugggcaucucagg

SEQ ID NO: 64607 - RNA, 22 nt, Human
cuggagucagcaaggacgaggc

SEQ ID NO: 64608 - RNA, 22 nt, Human
cuggaugagcuucgugcgcacg

SEQ ID NO: 64609 - RNA, 22 nt, Human
cuggauagaccccuuauugcau

SEQ ID NO: 64610 - RNA, 22 nt, Human
cuuuuccuccaggaagccaagc

SEQ ID NO: 64611 - RNA, 19 nt, Human
cuuuuagagggagaggacu

SEQ ID NO: 64612 - RNA, 22 nt, Human
cuuuucuuuucuucucuuccca

SEQ ID NO: 64613 - RNA, 22 nt, Human
cuggcuuucauggcgcaguuga

SEQ ID NO: 64614 - RNA, 22 nt, Human
cuuuuugcccuugggcuuccug

SEQ ID NO: 64615 - RNA, 22 nt, Human
cuuuuucaugggugaugagugg

SEQ ID NO: 64616 - RNA, 22 nt, Human
cuuuuggcaucagccucaggaa

SEQ ID NO: 64617 - RNA, 22 nt, Human
cuuuuuaaaguaaauggcuaga

SEQ ID NO: 64618 - RNA, 22 nt, Human
cugggacacguugugcuuuaac

SEQ ID NO: 64619 - RNA, 22 nt, Human
gaaaaaccacaauugguauuuu

SEQ ID NO: 64620 - RNA, 22 nt, Human
gaaaaacucagugggggucuuu

SEQ ID NO: 64621 - RNA, 22 nt, Human
cugggcuuucaggcccuaaggc

SEQ ID NO: 64622 - RNA, 22 nt, Human
gaaaagaaggcaggagcccaag

SEQ ID NO: 64623 - RNA, 22 nt, Human
gaaaagaaaggaugguaugugu

SEQ ID NO: 64624 - RNA, 22 nt, Human
gaaaacccuguauguagcguuu

SEQ ID NO: 64625 - RNA, 22 nt, Human
gaaaagcucuuuagaagagguu

SEQ ID NO: 64626 - RNA, 22 nt, Human
gaaaaggaggggaggcagaugg

SEQ ID NO: 64627 - RNA, 22 nt, Human
cugguuacuucagaucaguagu

SEQ ID NO: 64628 - RNA, 22 nt, Human
gaaaaucaggauggaugugagg

SEQ ID NO: 64629 - RNA, 22 nt, Human
gaaaaucaugaaaguguguugu

SEQ ID NO: 64630 - RNA, 22 nt, Human
gaaaauaguucaucacaaugau

SEQ ID NO: 64631 - RNA, 22 nt, Human
cuguaaguggugaaauuaguuu

SEQ ID NO: 64632 - RNA, 22 nt, Human
cuguauggaggaggugcuagcc

SEQ ID NO: 64633 - RNA, 22 nt, Human
gaaaaugcacacauacacaccc

SEQ ID NO: 64634 - RNA, 21 nt, Human
gaaaaucuaaugugacaaugc

SEQ ID NO: 64635 - RNA, 22 nt, Human
cugucucugauaagcucgaggg

SEQ ID NO: 64636 - RNA, 22 nt, Human
cugucacuguuuuaaccaacaa

SEQ ID NO: 64637 - RNA, 22 nt, Human
cugugaaugguggccacgcguu

SEQ ID NO: 64638 - RNA, 22 nt, Human
gaaagaggcugucagggaaugg

SEQ ID NO: 64639 - RNA, 22 nt, Human
gaaacauuuguugaguacuugc

SEQ ID NO: 64640 - RNA, 22 nt, Human
gaaaccauggcaaccagguccu

SEQ ID NO: 64641 - RNA, 22 nt, Human
gaacaguuucccuguagaaaau

SEQ ID NO: 64642 - RNA, 20 nt, Human
gaacauaaauaacucuuuac

SEQ ID NO: 64643 - RNA, 22 nt, Human
gaacaaggauucccaaagaaga

SEQ ID NO: 64644 - RNA, 22 nt, Human
gaaaugggggcaugcguuacau

SEQ ID NO: 64645 - RNA, 22 nt, Human
cugugguuuuauuuauuugaag

SEQ ID NO: 64646 - RNA, 22 nt, Human
gaaccauuuaauggagaugcuc

SEQ ID NO: 64647 - RNA, 22 nt, Human
cuguuaauugugaauuuuacau

SEQ ID NO: 64648 - RNA, 22 nt, Human
gaacuugagugugcuauuucuu

SEQ ID NO: 64649 - RNA, 22 nt, Human
gaacuuaauauacaaucaguuc

SEQ ID NO: 64650 - RNA, 22 nt, Human
cuguuguucacuuugcugguga

SEQ ID NO: 64651 - RNA, 22 nt, Human
gaagaagagauaauggggagca

SEQ ID NO: 64652 - RNA, 22 nt, Human
gaacuuuaauuagcuuuugucu

SEQ ID NO: 64653 - RNA, 22 nt, Human
gaagaugacaucggaucugucu

SEQ ID NO: 64654 - RNA, 22 nt, Human
gaagaugcugcuuguucacggg

SEQ ID NO: 64655 - RNA, 22 nt, Human
gaagauuauuacucauugcagg

SEQ ID NO: 64656 - RNA, 22 nt, Human
gaagcaagagggaucaggaucu

SEQ ID NO: 64657 - RNA, 21 nt, Human
cuucgcuguuccagcucuugg

SEQ ID NO: 64658 - RNA, 22 nt, Human
gaaggcuguggcuggucucagu

SEQ ID NO: 64659 - RNA, 22 nt, Human
gaagggccaggggcaggcugga

SEQ ID NO: 64660 - RNA, 22 nt, Human
gaagguuuacugaagauuuaaa

SEQ ID NO: 64661 - RNA, 22 nt, Human
cuucucugcugccugccucuuu

SEQ ID NO: 64662 - RNA, 22 nt, Human
cuucucuuccuucucauccuca

SEQ ID NO: 64663 - RNA, 22 nt, Human
gaagguuuuguuugcaaaucau

SEQ ID NO: 64664 - RNA, 22 nt, Human
gaagucugacucuuuguaagcu

SEQ ID NO: 64665 - RNA, 22 nt, Human
gaagucuuuucuuccacccaaa

SEQ ID NO: 64666 - RNA, 22 nt, Human
cuugagcugaguuugcagcucu

SEQ ID NO: 64667 - RNA, 22 nt, Human
gaauuccaggugagagaaggua

SEQ ID NO: 64668 - RNA, 22 nt, Human
gaauguuugagugccaugugac

SEQ ID NO: 64669 - RNA, 22 nt, Human
gaaugguuagugaacaaauuug

SEQ ID NO: 64670 - RNA, 22 nt, Human
gaauguuaaugcacuucuagcu

SEQ ID NO: 64671 - RNA, 18 nt, Human
cuuuagcugucaucuuug

SEQ ID NO: 64672 - RNA, 22 nt, Human
gacaagaagaacggagguuuca

SEQ ID NO: 64673 - RNA, 22 nt, Human
cuuuauguuggggugucuuagu

SEQ ID NO: 64674 - RNA, 22 nt, Human
cuuucauuuuugggcaucugag

SEQ ID NO: 64675 - RNA, 22 nt, Human
cuuuccugaaaucucuucugca

SEQ ID NO: 64676 - RNA, 22 nt, Human
cuuucuccagagugaagauccu

SEQ ID NO: 64677 - RNA, 18 nt, Human
cuuucugcccccauuagc

SEQ ID NO: 64678 - RNA, 22 nt, Human
gacaggaauuaucuaaaguaga

SEQ ID NO: 64679 - RNA, 22 nt, Human
gacagggacacagccagugagg

SEQ ID NO: 64680 - RNA, 22 nt, Human
gacagguagacaugaauauuaa

SEQ ID NO: 64681 - RNA, 22 nt, Human
cuuugugcagcagaaaugugug

SEQ ID NO: 64682 - RNA, 22 nt, Human
cuuuguaaucaauaagucuuuu

SEQ ID NO: 64683 - RNA, 23 nt, Human
gaccucuuccuccagccucugaa

SEQ ID NO: 64684 - RNA, 22 nt, Human
gagaaaaauuucuuugcugcac

SEQ ID NO: 64685 - RNA, 22 nt, Human
cuuuuugccuugaagugaccuc

SEQ ID NO: 64686 - RNA, 22 nt, Human
cuuuuuuucuccauauuucugg

SEQ ID NO: 64687 - RNA, 22 nt, Human
cuuuugcaauagugacacugau

SEQ ID NO: 64688 - RNA, 22 nt, Human
cuuuuucuuaucuuuuucuaug

SEQ ID NO: 64689 - RNA, 22 nt, Human
gacuuaaaugcuccccucaggg

SEQ ID NO: 64690 - RNA, 22 nt, Human
gagaaagauuguccuucagggg

SEQ ID NO: 64691 - RNA, 22 nt, Human
gagaaagggagaaaaagaucuu

SEQ ID NO: 64692 - RNA, 22 nt, Human
gagaacaaggaagagucggcag

SEQ ID NO: 64693 - RNA, 22 nt, Human
gagacuguaagcuccuugagga

SEQ ID NO: 64694 - RNA, 22 nt, Human
gagagaaggaagugaauuuccc

SEQ ID NO: 64695 - RNA, 22 nt, Human
gaaaaauggguuguuugaagau

SEQ ID NO: 64696 - RNA, 22 nt, Human
gagaacuauagaaaccuggucu

SEQ ID NO: 64697 - RNA, 22 nt, Human
gaagauucugacccugacucag

SEQ ID NO: 64698 - RNA, 22 nt, Human
gaaaaguuuaaccuuguacauu

SEQ ID NO: 64699 - RNA, 22 nt, Human
gaagccaacacgugggagggag

SEQ ID NO: 64700 - RNA, 22 nt, Human
gaagcucaguugcuuagaucuc

SEQ ID NO: 64701 - RNA, 22 nt, Human
gaagcgugcagguccguauacu

SEQ ID NO: 64702 - RNA, 22 nt, Human
gaggaaaauggaguguaauuaa

SEQ ID NO: 64703 - RNA, 22 nt, Human
gaaggagaggauugugaggcug

SEQ ID NO: 64704 - RNA, 22 nt, Human
gaaggcaguaaauggcuguuuu

SEQ ID NO: 64705 - RNA, 22 nt, Human
gaaggcagucuggggagcagcc

SEQ ID NO: 64706 - RNA, 22 nt, Human
gaggagaaacagccgugauagu

SEQ ID NO: 64707 - RNA, 22 nt, Human
gaggagagcuggccagguuucu

SEQ ID NO: 64708 - RNA, 22 nt, Human
gaaggggacuccauggaaugau

SEQ ID NO: 64709 - RNA, 22 nt, Human
gaaggggccuggggcaaggcua

SEQ ID NO: 64710 - RNA, 22 nt, Human
gaaggugcugaaacagaaauuu

SEQ ID NO: 64711 - RNA, 22 nt, Human
gaggaggagacggaggccuggg

SEQ ID NO: 64712 - RNA, 22 nt, Human
gaaguaaaacaguaacuuuguu

SEQ ID NO: 64713 - RNA, 22 nt, Human
gaggaggacauuggaaagaacu

SEQ ID NO: 64714 - RNA, 22 nt, Human
gaauccccugucggaacagugg

SEQ ID NO: 64715 - RNA, 22 nt, Human
gaaucucuuugucccugaguuu

SEQ ID NO: 64716 - RNA, 22 nt, Human
gaggcagaggaaacagcucauu

SEQ ID NO: 64717 - RNA, 22 nt, Human
gaauagauuagaaagaguaugu

SEQ ID NO: 64718 - RNA, 22 nt, Human
gaaguucuuagucucauuugca

SEQ ID NO: 64719 - RNA, 22 nt, Human
gaauaagaauccacuucuggca

SEQ ID NO: 64720 - RNA, 22 nt, Human
gaggaugacaaagaaggcagac

SEQ ID NO: 64721 - RNA, 22 nt, Human
gaaguauuucugaguugcccag

SEQ ID NO: 64722 - RNA, 22 nt, Human
gaagucaggaaggagauugaag

SEQ ID NO: 64723 - RNA, 22 nt, Human
gaggauuugagggucacuccac

SEQ ID NO: 64724 - RNA, 22 nt, Human
gaggcauaaguagaagagauug

SEQ ID NO: 64725 - RNA, 22 nt, Human
gaggcugguucccuugaucuuu

SEQ ID NO: 64726 - RNA, 22 nt, Human
gaauggaacauagcaacaucuu

SEQ ID NO: 64727 - RNA, 22 nt, Human
gaauggagaacccuggacacug

SEQ ID NO: 64728 - RNA, 22 nt, Human
gaaugccugggguucuucgauc

SEQ ID NO: 64729 - RNA, 22 nt, Human
gaggggaaggauuucuucagaa

SEQ ID NO: 64730 - RNA, 22 nt, Human
gaggggaagaacaauuuaauuu

SEQ ID NO: 64731 - RNA, 22 nt, Human
gaaugguuauaugauguuuaaa

SEQ ID NO: 64732 - RNA, 22 nt, Human
gagggcucaacuacuacuaggc

SEQ ID NO: 64733 - RNA, 22 nt, Human
gagggaaauauggguuugguua

SEQ ID NO: 64734 - RNA, 22 nt, Human
gaggggaaggguguucaauggg

SEQ ID NO: 64735 - RNA, 22 nt, Human
gaggggaauguuccugagcugg

SEQ ID NO: 64736 - RNA, 22 nt, Human
gaauucuaguucuguaucucug

SEQ ID NO: 64737 - RNA, 20 nt, Human
gaauucugaagauaauuugg

SEQ ID NO: 64738 - RNA, 18 nt, Human
gacaaaaguacagacaga

SEQ ID NO: 64739 - RNA, 22 nt, Human
gacaacuucaguaaaguagauu

SEQ ID NO: 64740 - RNA, 22 nt, Human
gaggggcugggguugacuccaa

SEQ ID NO: 64741 - RNA, 22 nt, Human
gacagcguaucaauugaacaua

SEQ ID NO: 64742 - RNA, 22 nt, Human
gacaggcagagaggaagagaga

SEQ ID NO: 64743 - RNA, 22 nt, Human
gacagcaggaugugaggggaug

SEQ ID NO: 64744 - RNA, 22 nt, Human
gaggugauuccucccauguaau

SEQ ID NO: 64745 - RNA, 22 nt, Human
gaguaaaagaugaggcaguaga

SEQ ID NO: 64746 - RNA, 19 nt, Human
gaguaaaacuagagagaaa

SEQ ID NO: 64747 - RNA, 22 nt, Human
gaggugggaggcgggccugcau

SEQ ID NO: 64748 - RNA, 22 nt, Human
gagguagaggaaaagauuauca

SEQ ID NO: 64749 - RNA, 22 nt, Human
gacaccuucuacugacuaugga

SEQ ID NO: 64750 - RNA, 22 nt, Human
gacaagaugacaucauggcuuc

SEQ ID NO: 64751 - RNA, 22 nt, Human
gaggguaagcugggacuccucg

SEQ ID NO: 64752 - RNA, 22 nt, Human
gaggguaaauucagaguaggag

SEQ ID NO: 64753 - RNA, 22 nt, Human
gacaauuucucaauauagaaac

SEQ ID NO: 64754 - RNA, 22 nt, Human
gaccaggagauuugagcuaggc

SEQ ID NO: 64755 - RNA, 22 nt, Human
gaguacagaagauaaaggcaca

SEQ ID NO: 64756 - RNA, 22 nt, Human
gacauuuauuggauuuuacgag

SEQ ID NO: 64757 - RNA, 22 nt, Human
gacccugaggauucccugcuga

SEQ ID NO: 64758 - RNA, 22 nt, Human
gacccucucagacuuccaggca

SEQ ID NO: 64759 - RNA, 22 nt, Human
gaguauuagaagaguaguuauu

SEQ ID NO: 64760 - RNA, 22 nt, Human
gaguagcaguucauccacaagc

SEQ ID NO: 64761 - RNA, 22 nt, Human
gagugggugaaugugcucauaa

SEQ ID NO: 64762 - RNA, 22 nt, Human
gaguucaaagaucuaggaagag

SEQ ID NO: 64763 - RNA, 22 nt, Human
gacuggaaucucugcuuguuaa

SEQ ID NO: 64764 - RNA, 22 nt, Human
gacuacauuugguauugacgag

SEQ ID NO: 64765 - RNA, 19 nt, Human
gacuccugagaugugaaac

SEQ ID NO: 64766 - RNA, 22 nt, Human
gacuccugccucucuacuucug

SEQ ID NO: 64767 - RNA, 22 nt, Human
gacucuucucucccaaaugccc

SEQ ID NO: 64768 - RNA, 22 nt, Human
gaguguuugcuguauaauugga

SEQ ID NO: 64769 - RNA, 22 nt, Human
gaguuauuuuuccuguuuuuua

SEQ ID NO: 64770 - RNA, 22 nt, Human
gacuucaagaugaaucuuuggg

SEQ ID NO: 64771 - RNA, 20 nt, Human
gacuucaauuucuaucuuuu

SEQ ID NO: 64772 - RNA, 22 nt, Human
gauacaugucacaaguugugca

SEQ ID NO: 64773 - RNA, 22 nt, Human
gagaaauagauucaugguagau

SEQ ID NO: 64774 - RNA, 22 nt, Human
gagaaaacauacuuaguguccu

SEQ ID NO: 64775 - RNA, 22 nt, Human
gauauuaguuuuggaaggaggg

SEQ ID NO: 64776 - RNA, 22 nt, Human
gauauucauaggcagguauuua

SEQ ID NO: 64777 - RNA, 16 nt, Human
gacuuucuacgacucu

SEQ ID NO: 64778 - RNA, 22 nt, Human
gauagaaagagaaucagaacuu

SEQ ID NO: 64779 - RNA, 20 nt, Human
gauagcacaaagagaauggg

SEQ ID NO: 64780 - RNA, 22 nt, Human
gauagguacuguaagguccucu

SEQ ID NO: 64781 - RNA, 22 nt, Human
gauauggaaacuugauguugug

SEQ ID NO: 64782 - RNA, 22 nt, Human
gauccucagacccuccucuggu

SEQ ID NO: 64783 - RNA, 22 nt, Human
gagaacuguguauucuuuuuca

SEQ ID NO: 64784 - RNA, 22 nt, Human
gagaaggagcagaaaaucuccu

SEQ ID NO: 64785 - RNA, 22 nt, Human
gagaagugggggucugggauga

SEQ ID NO: 64786 - RNA, 22 nt, Human
gagaacagauaugaugacuuca

SEQ ID NO: 64787 - RNA, 19 nt, Human
gauauugagcugagaauuc

SEQ ID NO: 64788 - RNA, 22 nt, Human
gauauuuugugaaaaaacaacu

SEQ ID NO: 64789 - RNA, 22 nt, Human
gaucacuuugauuagauguccu

SEQ ID NO: 64790 - RNA, 22 nt, Human
gaucauuuucauuaauguugca

SEQ ID NO: 64791 - RNA, 22 nt, Human
gauccagauauuugggcuggua

SEQ ID NO: 64792 - RNA, 22 nt, Human
gaucuguccuggcaguuaacac

SEQ ID NO: 64793 - RNA, 22 nt, Human
gagaagucaggaguggagaaca

SEQ ID NO: 64794 - RNA, 22 nt, Human
gaucuuacucacuucagcuggc

SEQ ID NO: 64795 - RNA, 18 nt, Human
gaugaagaggaagaggag

SEQ ID NO: 64796 - RNA, 22 nt, Human
gaugaaguaguccacuggaagg

SEQ ID NO: 64797 - RNA, 22 nt, Human
gagaauuauacaugagcuauuu

SEQ ID NO: 64798 - RNA, 22 nt, Human
gcagguggaagcagcagacuca

SEQ ID NO: 64799 - RNA, 22 nt, Human
gaguaugugaggaaguaaagaa

SEQ ID NO: 64800 - RNA, 22 nt, Human
gcaguaaauugagagucauguu

SEQ ID NO: 64801 - RNA, 22 nt, Human
gagucaucucuagaaugaugau

SEQ ID NO: 64802 - RNA, 22 nt, Human
gcaguuugugauguggcaguca

SEQ ID NO: 64803 - RNA, 22 nt, Human
gaguauuacuaaaauucgccua

SEQ ID NO: 64804 - RNA, 22 nt, Human
gaguauuuaccacuaaaugguu

SEQ ID NO: 64805 - RNA, 22 nt, Human
gaguuaaauagcuuaggauuca

SEQ ID NO: 64806 - RNA, 22 nt, Human
gcauccaaggagcagaagugau

SEQ ID NO: 64807 - RNA, 22 nt, Human
gcaucacacgcacauacacaca

SEQ ID NO: 64808 - RNA, 22 nt, Human
gagucuuuuaagaugucuuacu

SEQ ID NO: 64809 - RNA, 22 nt, Human
gccaaccagucgguccaggaag

SEQ ID NO: 64810 - RNA, 21 nt, Human
gaucgcaaugugggaaucaug

SEQ ID NO: 64811 - RNA, 22 nt, Human
gaugaagaaacucaaccaagaa

SEQ ID NO: 64812 - RNA, 22 nt, Human
gccauauucaugcaggugcuaa

SEQ ID NO: 64813 - RNA, 22 nt, Human
gccauaggggcuuacauaguua

SEQ ID NO: 64814 - RNA, 22 nt, Human
gccaucuucggcagccgccugg

SEQ ID NO: 64815 - RNA, 22 nt, Human
gaugggaggaugaauuggaccu

SEQ ID NO: 64816 - RNA, 22 nt, Human
gauguuuugaaagaagaauaca

SEQ ID NO: 64817 - RNA, 22 nt, Human
gcccugucagcucucauggaca

SEQ ID NO: 64818 - RNA, 22 nt, Human
gauucagagcugcaacaaagaa

SEQ ID NO: 64819 - RNA, 22 nt, Human
gauuaucaccaaauggccuccu

SEQ ID NO: 64820 - RNA, 22 nt, Human
gauuaagaaagauagaugugga

SEQ ID NO: 64821 - RNA, 22 nt, Human
gcaaaaacaguguagucuucug

SEQ ID NO: 64822 - RNA, 22 nt, Human
gccucucagcuagaaggcaggu

SEQ ID NO: 64823 - RNA, 22 nt, Human
gcccuuuuaucaacuccuagaa

SEQ ID NO: 64824 - RNA, 22 nt, Human
gccucucuggcaaagcggugau

SEQ ID NO: 64825 - RNA, 22 nt, Human
gcaauagccuacaugcgucaga

SEQ ID NO: 64826 - RNA, 19 nt, Human
gcaaguuaucugucuccau

SEQ ID NO: 64827 - RNA, 22 nt, Human
gcacaaaagguacuucauguag

SEQ ID NO: 64828 - RNA, 22 nt, Human
gccugcagccagggaguucucu

SEQ ID NO: 64829 - RNA, 18 nt, Human
gccugccagccgagggac

SEQ ID NO: 64830 - RNA, 22 nt, Human
gccugcugggcucuuccugcug

SEQ ID NO: 64831 - RNA, 21 nt, Human
gcagaaagugauuugcuauuc

SEQ ID NO: 64832 - RNA, 22 nt, Human
gcagacuaacuuuugucagccu

SEQ ID NO: 64833 - RNA, 22 nt, Human
gcagagaaugucagauuuuguu

SEQ ID NO: 64834 - RNA, 22 nt, Human
gcagaggcaaagucuggaugac

SEQ ID NO: 64835 - RNA, 22 nt, Human
gcagaguauaaguguggagcug

SEQ ID NO: 64836 - RNA, 21 nt, Human
gcagaguauagauuaggagcc

SEQ ID NO: 64837 - RNA, 22 nt, Human
gcagaugagagugugaucuggg

SEQ ID NO: 64838 - RNA, 22 nt, Human
gcagcauuaccaagacauggca

SEQ ID NO: 64839 - RNA, 23 nt, Human
gcagccaacccacgugagagaag

SEQ ID NO: 64840 - RNA, 22 nt, Human
gcagauuggguacauaaacagu

SEQ ID NO: 64841 - RNA, 22 nt, Human
gcagauccaaauauaguucuug

SEQ ID NO: 64842 - RNA, 22 nt, Human
gcagcuuuggagguggaacucu

SEQ ID NO: 64843 - RNA, 20 nt, Human
gcagcugacccuagugcuug

SEQ ID NO: 64844 - RNA, 22 nt, Human
gcaggaagauugcagaaggcug

SEQ ID NO: 64845 - RNA, 22 nt, Human
gcaggcagauccagaagcacua

SEQ ID NO: 64846 - RNA, 22 nt, Human
gcaguauuguguguggucaugg

SEQ ID NO: 64847 - RNA, 22 nt, Human
gcaguaaggaggggaaggguuu

SEQ ID NO: 64848 - RNA, 22 nt, Human
gcuagaaacuguuuaaucucuu

SEQ ID NO: 64849 - RNA, 22 nt, Human
gcuagcugugcuuggaaguuug

SEQ ID NO: 64850 - RNA, 22 nt, Human
gcauagauauguaaugcaucau

SEQ ID NO: 64851 - RNA, 22 nt, Human
gcaucccagaagauucugauuu

SEQ ID NO: 64852 - RNA, 21 nt, Human
gcauccucguacucuucaggu

SEQ ID NO: 64853 - RNA, 22 nt, Human
gcauggaaaagggaugcuaacu

SEQ ID NO: 64854 - RNA, 18 nt, Human
gcugaaauucuaaacaaa

SEQ ID NO: 64855 - RNA, 20 nt, Human
gcucuucuccgggucugccu

SEQ ID NO: 64856 - RNA, 22 nt, Human
gcauucuugucaguggggucag

SEQ ID NO: 64857 - RNA, 22 nt, Human
gcauuccagaguugcuggaaaa

SEQ ID NO: 64858 - RNA, 22 nt, Human
gcauguucaaguuaguauauuu

SEQ ID NO: 64859 - RNA, 22 nt, Human
gcugacuuauuagaaaaggaca

SEQ ID NO: 64860 - RNA, 22 nt, Human
gcugagaguguaggauguuuac

SEQ ID NO: 64861 - RNA, 22 nt, Human
gcauuuaaauuugaacuucaga

SEQ ID NO: 64862 - RNA, 22 nt, Human
gcugguggcagagcuccgcggc

SEQ ID NO: 64863 - RNA, 22 nt, Human
gcugucauggacaugucuguuu

SEQ ID NO: 64864 - RNA, 22 nt, Human
gcuuacagauaaugaggagacu

SEQ ID NO: 64865 - RNA, 22 nt, Human
gcuguuggaggaguucagugcu

SEQ ID NO: 64866 - RNA, 22 nt, Human
gcuguugugaggaucagcauau

SEQ ID NO: 64867 - RNA, 22 nt, Human
gcuguggaaaaugggucuccaa

SEQ ID NO: 64868 - RNA, 22 nt, Human
gcuguggagaagcugccuaugg

SEQ ID NO: 64869 - RNA, 22 nt, Human
gcuuccuccaucuggggcuugc

SEQ ID NO: 64870 - RNA, 22 nt, Human
gcuuauugcuuauagauaggaa

SEQ ID NO: 64871 - RNA, 21 nt, Human
gccgaugugacucuacguagu

SEQ ID NO: 64872 - RNA, 22 nt, Human
gcuucuguuaggauguggcuua

SEQ ID NO: 64873 - RNA, 22 nt, Human
gcuucugugagugcagaugcug

SEQ ID NO: 64874 - RNA, 22 nt, Human
gcuucucauguuuauuuuuaca

SEQ ID NO: 64875 - RNA, 22 nt, Human
gccgcagauucugagacgugua

SEQ ID NO: 64876 - RNA, 22 nt, Human
gcuugcuuuguaaauaucugug

SEQ ID NO: 64877 - RNA, 22 nt, Human
gcuuguuagcaaugcagaaucu

SEQ ID NO: 64878 - RNA, 22 nt, Human
gcuuguauguguauauauacau

SEQ ID NO: 64879 - RNA, 18 nt, Human
gcuuggguggcuauguuu

SEQ ID NO: 64880 - RNA, 22 nt, Human
gcuuuucucccugcuuucuucc

SEQ ID NO: 64881 - RNA, 23 nt, Human
gcuuugaaaaugcuuucuuccag

SEQ ID NO: 64882 - RNA, 22 nt, Human
gcuuuuaaauuaucugacaaug

SEQ ID NO: 64883 - RNA, 22 nt, Human
gcuuuguucauuuaguuuuuuu

SEQ ID NO: 64884 - RNA, 22 nt, Human
gcuuuuuaauuugcuucccugg

SEQ ID NO: 64885 - RNA, 22 nt, Human
ggaaaaauggguggugauauga

SEQ ID NO: 64886 - RNA, 22 nt, Human
ggaaaaucaaaccauuuacagu

SEQ ID NO: 64887 - RNA, 22 nt, Human
gcuuccucaccucaaauuuccg

SEQ ID NO: 64888 - RNA, 22 nt, Human
gccucuuugcucuuugguuguu

SEQ ID NO: 64889 - RNA, 22 nt, Human
ggaaaaugcugaagcaucugaa

SEQ ID NO: 64890 - RNA, 18 nt, Human
gccucuguugacagaguu

SEQ ID NO: 64891 - RNA, 22 nt, Human
ggaaaggacuggagcccagcgc

SEQ ID NO: 64892 - RNA, 22 nt, Human
gccugaaaugaaccagaggacu

SEQ ID NO: 64893 - RNA, 22 nt, Human
ggaaaggaagggaaggagaugc

SEQ ID NO: 64894 - RNA, 22 nt, Human
ggaaagagaaacaugaacuaga

SEQ ID NO: 64895 - RNA, 22 nt, Human
ggaaagaggacaucuuacuucu

SEQ ID NO: 64896 - RNA, 22 nt, Human
gccugagauuggacauuauuua

SEQ ID NO: 64897 - RNA, 22 nt, Human
ggaaauguguguaagaaaguau

SEQ ID NO: 64898 - RNA, 17 nt, Human
ggaagaaaaggaucauc

SEQ ID NO: 64899 - RNA, 22 nt, Human
ggaacaguacucggaggccaga

SEQ ID NO: 64900 - RNA, 22 nt, Human
gccugcaggaaggugugccugu

SEQ ID NO: 64901 - RNA, 19 nt, Human
ggaacgcugggcuccccuc

SEQ ID NO: 64902 - RNA, 22 nt, Human
ggaagaagagggagcuguggga

SEQ ID NO: 64903 - RNA, 22 nt, Human
ggaagaggaagaugaggcagca

SEQ ID NO: 64904 - RNA, 22 nt, Human
ggaauauaaaucagaugcuccg

SEQ ID NO: 64905 - RNA, 22 nt, Human
gccugggauuggggauuuuuug

SEQ ID NO: 64906 - RNA, 22 nt, Human
ggaaugcuuggcaugagaaccu

SEQ ID NO: 64907 - RNA, 22 nt, Human
ggaauguuuuccagaccuagau

SEQ ID NO: 64908 - RNA, 22 nt, Human
gccuucauuggaaucuagcuuc

SEQ ID NO: 64909 - RNA, 22 nt, Human
ggagaagaggagcuggaagccu

SEQ ID NO: 64910 - RNA, 17 nt, Human
ggacuuucugccugucc

SEQ ID NO: 64911 - RNA, 22 nt, Human
ggaccagagcuaaugcgcgccc

SEQ ID NO: 64912 - RNA, 22 nt, Human
gcggaucuccuugagugggcaa

SEQ ID NO: 64913 - RNA, 22 nt, Human
ggagcucacuacgaaauaagcu

SEQ ID NO: 64914 - RNA, 22 nt, Human
ggagcucaggaguugauuauuu

SEQ ID NO: 64915 - RNA, 22 nt, Human
ggagagaacguaaucuaguauu

SEQ ID NO: 64916 - RNA, 22 nt, Human
ggagagagggaucuuuguggag

SEQ ID NO: 64917 - RNA, 22 nt, Human
ggagagcguggaugggcuucca

SEQ ID NO: 64918 - RNA, 23 nt, Human
ggagaaggaugucaucaaaagac

SEQ ID NO: 64919 - RNA, 22 nt, Human
ggagacagauggcgucucaguu

SEQ ID NO: 64920 - RNA, 22 nt, Human
ggagcugaacccuuaacuggcu

SEQ ID NO: 64921 - RNA, 22 nt, Human
ggaggaugaggguggugguguu

SEQ ID NO: 64922 - RNA, 22 nt, Human
ggaggagggaguucaggaguau

SEQ ID NO: 64923 - RNA, 22 nt, Human
ggaggggaguuugccucugggg

SEQ ID NO: 64924 - RNA, 22 nt, Human
ggagguaagaggcccugggccg

SEQ ID NO: 64925 - RNA, 22 nt, Human
ggaguuucugucaucccguccc

SEQ ID NO: 64926 - RNA, 19 nt, Human
ggaguugccaggagaagga

SEQ ID NO: 64927 - RNA, 22 nt, Human
ggcaauuacguauuagucaugu

SEQ ID NO: 64928 - RNA, 22 nt, Human
ggauaauugaugauuuauaaga

SEQ ID NO: 64929 - RNA, 22 nt, Human
ggcagcagaaccaacuguggcu

SEQ ID NO: 64930 - RNA, 22 nt, Human
gcuagagaagagcccacaccgg

SEQ ID NO: 64931 - RNA, 22 nt, Human
gcuagauugucacuugaguguc

SEQ ID NO: 64932 - RNA, 22 nt, Human
gcuagagaccagaggccuugaa

SEQ ID NO: 64933 - RNA, 22 nt, Human
gcuaguguuccacgaugugugu

SEQ ID NO: 64934 - RNA, 22 nt, Human
gcucuccuugaugcccucuguu

SEQ ID NO: 64935 - RNA, 22 nt, Human
gcucagagaugucugcugccuu

SEQ ID NO: 64936 - RNA, 22 nt, Human
gcucaacuucuaggacuucagg

SEQ ID NO: 64937 - RNA, 22 nt, Human
gcucucuggccugggaggagga

SEQ ID NO: 64938 - RNA, 23 nt, Human
gcugagcaccagccauaucuuuu

SEQ ID NO: 64939 - RNA, 22 nt, Human
ggcagucuuucccuugagcucu

SEQ ID NO: 64940 - RNA, 20 nt, Human
ggcaucugacaacuaguugc

SEQ ID NO: 64941 - RNA, 22 nt, Human
ggcaguguggauccuggagaag

SEQ ID NO: 64942 - RNA, 22 nt, Human
ggcauuccucucuguucaugga

SEQ ID NO: 64943 - RNA, 22 nt, Human
ggcuuuuguuauaaucaggccu

SEQ ID NO: 64944 - RNA, 22 nt, Human
gggaaaugugucuuggcauucu

SEQ ID NO: 64945 - RNA, 22 nt, Human
gggaaaucugcuuccuagggcu

SEQ ID NO: 64946 - RNA, 23 nt, Human
gggaaaucaaaagauauuucuuc

SEQ ID NO: 64947 - RNA, 22 nt, Human
ggcuuguccuucugguugucuu

SEQ ID NO: 64948 - RNA, 22 nt, Human
gggaaaaaggaguuagagauaa

SEQ ID NO: 64949 - RNA, 22 nt, Human
gcuguugcaaucaaggccaugg

SEQ ID NO: 64950 - RNA, 22 nt, Human
gcuguuuaaguggaauuuguuu

SEQ ID NO: 64951 - RNA, 22 nt, Human
gcuuccuuagcuuaccaaguau

SEQ ID NO: 64952 - RNA, 22 nt, Human
gcuucucacccuuacuaucucu

SEQ ID NO: 64953 - RNA, 22 nt, Human
gcuuauuagguuauuucaagga

SEQ ID NO: 64954 - RNA, 22 nt, Human
gcuucacucugagacuuggagc

SEQ ID NO: 64955 - RNA, 22 nt, Human
gggaagaacugauuucacacca

SEQ ID NO: 64956 - RNA, 22 nt, Human
gggaagaaccucugcuaccaau

SEQ ID NO: 64957 - RNA, 22 nt, Human
gggaagagggagcuggaaugau

SEQ ID NO: 64958 - RNA, 20 nt, Human
gggaauggauggauugcucc

SEQ ID NO: 64959 - RNA, 22 nt, Human
gggaauguuaaccuuucuauuu

SEQ ID NO: 64960 - RNA, 22 nt, Human
gcuuguuuagcauaggucacug

SEQ ID NO: 64961 - RNA, 22 nt, Human
gcuuggagaacguuuucuagaa

SEQ ID NO: 64962 - RNA, 22 nt, Human
gcuuucacugcaauagaugaau

SEQ ID NO: 64963 - RNA, 22 nt, Human
gcuuucagggucacugucaaca

SEQ ID NO: 64964 - RNA, 22 nt, Human
gcuuuccuggcccugucccugc

SEQ ID NO: 64965 - RNA, 19 nt, Human
gggagaaaaucuuuauccu

SEQ ID NO: 64966 - RNA, 22 nt, Human
gggagauuuguguaggaaaacu

SEQ ID NO: 64967 - RNA, 22 nt, Human
gcuuuugcaaagcuggagaauu

SEQ ID NO: 64968 - RNA, 22 nt, Human
gcuuuugagaaaguguuuuccc

SEQ ID NO: 64969 - RNA, 22 nt, Human
gggagcugagcuggaagagaau

SEQ ID NO: 64970 - RNA, 22 nt, Human
ggaaaagaauuguuaguuagug

SEQ ID NO: 64971 - RNA, 22 nt, Human
ggaaauauaagcaguuugugug

SEQ ID NO: 64972 - RNA, 22 nt, Human
ggaagacuuagaguagcaucag

SEQ ID NO: 64973 - RNA, 22 nt, Human
ggaagauagaaguucaaaaguu

SEQ ID NO: 64974 - RNA, 22 nt, Human
ggaagccugggcgcaggcaggg

SEQ ID NO: 64975 - RNA, 18 nt, Human
ggaauagcuuguuuccca

SEQ ID NO: 64976 - RNA, 22 nt, Human
ggaaucuucagccaugccaaga

SEQ ID NO: 64977 - RNA, 22 nt, Human
ggaauuaagaggcuggacaggg

SEQ ID NO: 64978 - RNA, 22 nt, Human
ggaauccugguguuuucugccu

SEQ ID NO: 64979 - RNA, 22 nt, Human
gggcuguuugcauauguuuaua

SEQ ID NO: 64980 - RNA, 22 nt, Human
ggacccagggcuuauucauguu

SEQ ID NO: 64981 - RNA, 19 nt, Human
ggacuuaggcagacuaauu

SEQ ID NO: 64982 - RNA, 22 nt, Human
ggacuucuggggacuguagauu

SEQ ID NO: 64983 - RNA, 22 nt, Human
ggacuccuguguuuuggcugag

SEQ ID NO: 64984 - RNA, 18 nt, Human
gggcuuuacagaguggag

SEQ ID NO: 64985 - RNA, 19 nt, Human
ggagcagauaaacauacuu

SEQ ID NO: 64986 - RNA, 22 nt, Human
gggggaaaguggagguucguga

SEQ ID NO: 64987 - RNA, 22 nt, Human
ggaggaaauccuuaguaaggca

SEQ ID NO: 64988 - RNA, 22 nt, Human
ggaggaagagaccagggggcuu

SEQ ID NO: 64989 - RNA, 22 nt, Human
ggaggaggggcggggaggggag

SEQ ID NO: 64990 - RNA, 22 nt, Human
ggagugauuugucuugucuggu

SEQ ID NO: 64991 - RNA, 22 nt, Human
ggguuccuuggaacacuguuug

SEQ ID NO: 64992 - RNA, 22 nt, Human
ggaugauacuuggagaaauauu

SEQ ID NO: 64993 - RNA, 22 nt, Human
ggaucaccagguuuguuguugg

SEQ ID NO: 64994 - RNA, 22 nt, Human
ggguuguuuguauuucucugaa

SEQ ID NO: 64995 - RNA, 23 nt, Human
ggauccugacauauaccaucacc

SEQ ID NO: 64996 - RNA, 22 nt, Human
ggaucguauuucaguuuuuugg

SEQ ID NO: 64997 - RNA, 22 nt, Human
ggaucuaaagccagaauauaug

SEQ ID NO: 64998 - RNA, 22 nt, Human
ggauggaugugaucugccuccu

SEQ ID NO: 64999 - RNA, 22 nt, Human
ggaugcagcagagaccuggagu

SEQ ID NO: 65000 - RNA, 22 nt, Human
ggaugauuuucaguuguguggg

SEQ ID NO: 65001 - RNA, 22 nt, Human
ggaugcugcuccacaucccaca

SEQ ID NO: 65002 - RNA, 22 nt, Human
ggucaaauaugaguaauuuccu

SEQ ID NO: 65003 - RNA, 22 nt, Human
ggcagagguagcuggaaccagg

SEQ ID NO: 65004 - RNA, 22 nt, Human
ggcagauaaacaauguuguaua

SEQ ID NO: 65005 - RNA, 20 nt, Human
ggcagcaaccauaugcuaca

SEQ ID NO: 65006 - RNA, 22 nt, Human
ggcagaaaacaauaaccauuuc

SEQ ID NO: 65007 - RNA, 20 nt, Human
ggcagagcuaugucuguugc

SEQ ID NO: 65008 - RNA, 22 nt, Human
ggugcuuuucacaagcauggga

SEQ ID NO: 65009 - RNA, 22 nt, Human
ggugucuuugauguugggcuga

SEQ ID NO: 65010 - RNA, 20 nt, Human
ggcauuuuuuaguugagcuu

SEQ ID NO: 65011 - RNA, 22 nt, Human
gguuaacaccacagcugggaca

SEQ ID NO: 65012 - RNA, 22 nt, Human
ggccaccuaagguugugcauca

SEQ ID NO: 65013 - RNA, 21 nt, Human
gguuucugcaaaccuuguaca

SEQ ID NO: 65014 - RNA, 22 nt, Human
gguuuauucccacaaaggaagu

SEQ ID NO: 65015 - RNA, 22 nt, Human
gguuugccagugcuggaaugca

SEQ ID NO: 65016 - RNA, 22 nt, Human
guauaaauaucuauauuguuac

SEQ ID NO: 65017 - RNA, 22 nt, Human
guauauuuaugagcauuagccu

SEQ ID NO: 65018 - RNA, 22 nt, Human
guaucuuuauuuuaauuaagau

SEQ ID NO: 65019 - RNA, 22 nt, Human
guauggaguuuuguugcacuuc

SEQ ID NO: 65020 - RNA, 22 nt, Human
ggcggagggcuguguccccggc

SEQ ID NO: 65021 - RNA, 22 nt, Human
gucacaaaugauuuagcaauca

SEQ ID NO: 65022 - RNA, 22 nt, Human
guauuuggacugccuguucauu

SEQ ID NO: 65023 - RNA, 22 nt, Human
guauuaagaaaugccugugaaa

SEQ ID NO: 65024 - RNA, 22 nt, Human
gucagaagauagaggaaguuug

SEQ ID NO: 65025 - RNA, 22 nt, Human
gucagauucuuucauuugcuga

SEQ ID NO: 65026 - RNA, 22 nt, Human
ggcggaggucacgcacccgcca

SEQ ID NO: 65027 - RNA, 23 nt, Human
ggcgugcugggcugacccuuggc

SEQ ID NO: 65028 - RNA, 22 nt, Human
ggcuagggagacagagggcaug

SEQ ID NO: 65029 - RNA, 23 nt, Human
gucauuacuguuaccuuauucuu

SEQ ID NO: 65030 - RNA, 22 nt, Human
guccagaguagucgaguauucu

SEQ ID NO: 65031 - RNA, 22 nt, Human
guccccugcguguucauccugg

SEQ ID NO: 65032 - RNA, 22 nt, Human
ggcuccugggcgucuucgaaca

SEQ ID NO: 65033 - RNA, 22 nt, Human
guccugaaaaaaaucccugagu

SEQ ID NO: 65034 - RNA, 22 nt, Human
guccuuuauuugaacaugacau

SEQ ID NO: 65035 - RNA, 22 nt, Human
ggcugcugcccaccccugcaug

SEQ ID NO: 65036 - RNA, 21 nt, Human
ggcugcucgugaugaacuuca

SEQ ID NO: 65037 - RNA, 22 nt, Human
gucuauucaucauucaucaaac

SEQ ID NO: 65038 - RNA, 22 nt, Human
ggcuggaacuucuucuggcauu

SEQ ID NO: 65039 - RNA, 22 nt, Human
gucgcuugaacccaggaagugg

SEQ ID NO: 65040 - RNA, 22 nt, Human
gucucuuuugauuuuucacuca

SEQ ID NO: 65041 - RNA, 22 nt, Human
gucuccuucauuuacuguuucc

SEQ ID NO: 65042 - RNA, 22 nt, Human
gucugcuuuuaucacaugucau

SEQ ID NO: 65043 - RNA, 22 nt, Human
gucuucugacacuguuaggagg

SEQ ID NO: 65044 - RNA, 19 nt, Human
gucuuauggauagcuccuc

SEQ ID NO: 65045 - RNA, 22 nt, Human
ggcugugaaguacguugaaggu

SEQ ID NO: 65046 - RNA, 22 nt, Human
ggcuggggccuguugaagaugc

SEQ ID NO: 65047 - RNA, 22 nt, Human
gugaaaauaguaaccuggcuag

SEQ ID NO: 65048 - RNA, 22 nt, Human
gucuugugaagacggcagaaag

SEQ ID NO: 65049 - RNA, 21 nt, Human
ggcuguuaauagugauuagaa

SEQ ID NO: 65050 - RNA, 22 nt, Human
ggcuuauauguauucccagaga

SEQ ID NO: 65051 - RNA, 22 nt, Human
ggcuuccuggugcagaguuaua

SEQ ID NO: 65052 - RNA, 22 nt, Human
gugaaauuguacacucaguacc

SEQ ID NO: 65053 - RNA, 23 nt, Human
gugaacaaugcuccaggagauac

SEQ ID NO: 65054 - RNA, 22 nt, Human
gugaagcaagggucaccugugg

SEQ ID NO: 65055 - RNA, 22 nt, Human
ggcuucuuaacauuuggacacc

SEQ ID NO: 65056 - RNA, 22 nt, Human
gugaagaugccucaggugaccc

SEQ ID NO: 65057 - RNA, 22 nt, Human
gggaaaauguuucugagacaaa

SEQ ID NO: 65058 - RNA, 22 nt, Human
gugaaggggaagcagggagagg

SEQ ID NO: 65059 - RNA, 22 nt, Human
gugaagcacaugggcguugggu

SEQ ID NO: 65060 - RNA, 22 nt, Human
ggcuuuuucccuaggguaagag

SEQ ID NO: 65061 - RNA, 22 nt, Human
gggaaaaaggaaccuuauuacu

SEQ ID NO: 65062 - RNA, 21 nt, Human
gggaagagaagagaaaggagg

SEQ ID NO: 65063 - RNA, 22 nt, Human
gggaagccugggugauccuaaa

SEQ ID NO: 65064 - RNA, 18 nt, Human
gggaagaugccacaguga

SEQ ID NO: 65065 - RNA, 19 nt, Human
gugauauuuauuauuuauu

SEQ ID NO: 65066 - RNA, 22 nt, Human
gggaagaagaaaagagguggga

SEQ ID NO: 65067 - RNA, 22 nt, Human
gggaaauagagcuggaaccuug

SEQ ID NO: 65068 - RNA, 22 nt, Human
gggaacuuugugagacuggaga

SEQ ID NO: 65069 - RNA, 22 nt, Human
gugagaggaggcagcuuuuaca

SEQ ID NO: 65070 - RNA, 22 nt, Human
gugaugaaggccugcaccuggu

SEQ ID NO: 65071 - RNA, 22 nt, Human
gggacucugaaucuagauuccu

SEQ ID NO: 65072 - RNA, 20 nt, Human
gggacugagccuuguuugug

SEQ ID NO: 65073 - RNA, 22 nt, Human
gggagaaccagccagugcaagg

SEQ ID NO: 65074 - RNA, 21 nt, Human
gggagaguagcgguagggagg

SEQ ID NO: 65075 - RNA, 22 nt, Human
gggagaguagcuggaagguucu

SEQ ID NO: 65076 - RNA, 21 nt, Human
gggaggagcuucccuuugccc

SEQ ID NO: 65077 - RNA, 22 nt, Human
gggagccucccacugggggaag

SEQ ID NO: 65078 - RNA, 21 nt, Human
gggagccucauuuucuucauc

SEQ ID NO: 65079 - RNA, 22 nt, Human
gugccuuuuucccaguucauug

SEQ ID NO: 65080 - RNA, 21 nt, Human
gggagugaguaaugauggggg

SEQ ID NO: 65081 - RNA, 22 nt, Human
gugcuaaguaaguauuuuggag

SEQ ID NO: 65082 - RNA, 22 nt, Human
gugcuacacaaauguuaguugu

SEQ ID NO: 65083 - RNA, 22 nt, Human
gugcucuagaaauugucagugg

SEQ ID NO: 65084 - RNA, 22 nt, Human
gggcaagaagcuggaagcauuc

SEQ ID NO: 65085 - RNA, 22 nt, Human
gggcaagagaggaagagauggc

SEQ ID NO: 65086 - RNA, 22 nt, Human
gugcuugaguaaaaauagucuu

SEQ ID NO: 65087 - RNA, 22 nt, Human
gugcugggaggcccaggaugga

SEQ ID NO: 65088 - RNA, 22 nt, Human
guuggaggaaggacaggaacag

SEQ ID NO: 65089 - RNA, 20 nt, Human
guugggagaagugucagcug

SEQ ID NO: 65090 - RNA, 22 nt, Human
guugggaauucggagagaaaua

SEQ ID NO: 65091 - RNA, 22 nt, Human
guuguugcuauguuauuguuau

SEQ ID NO: 65092 - RNA, 22 nt, Human
guuguuagccucacauuuagga

SEQ ID NO: 65093 - RNA, 22 nt, Human
guuuaaaagcaaccaacaggcu

SEQ ID NO: 65094 - RNA, 22 nt, Human
guuguugucauuagcuguuuaa

SEQ ID NO: 65095 - RNA, 22 nt, Human
ggucuuauaauuaauuuaggcu

SEQ ID NO: 65096 - RNA, 22 nt, Human
guuuacaacaucuuguccuuca

SEQ ID NO: 65097 - RNA, 22 nt, Human
guuuagauguagauucucuggu

SEQ ID NO: 65098 - RNA, 22 nt, Human
guuuaucagagagcagaggugg

SEQ ID NO: 65099 - RNA, 22 nt, Human
guuuauucuuuuauuugugaga

SEQ ID NO: 65100 - RNA, 22 nt, Human
ggugagagaaaagaaacacugu

SEQ ID NO: 65101 - RNA, 22 nt, Human
guuucuguggacucugcuuagg

SEQ ID NO: 65102 - RNA, 22 nt, Human
guuucucuuugguggguugaga

SEQ ID NO: 65103 - RNA, 22 nt, Human
guuuccuuuugugguuuuucua

SEQ ID NO: 65104 - RNA, 22 nt, Human
guuugcagacuauguaaacuuc

SEQ ID NO: 65105 - RNA, 22 nt, Human
guuugguucucauuguuuuucu

SEQ ID NO: 65106 - RNA, 22 nt, Human
guuuguuugccagcuuaguaaa

SEQ ID NO: 65107 - RNA, 21 nt, Human
uaaaagaugacaagacagcuc

SEQ ID NO: 65108 - RNA, 23 nt, Human
guuuuugcugcagcugaagaagg

SEQ ID NO: 65109 - RNA, 22 nt, Human
uaaaaaccuuguauuuaacucu

SEQ ID NO: 65110 - RNA, 22 nt, Human
ggugugaauagagccuggagca

SEQ ID NO: 65111 - RNA, 22 nt, Human
uaaaugaaaggguuuaauuuau

SEQ ID NO: 65112 - RNA, 22 nt, Human
gguuuucuuguucauuuuuuaa

SEQ ID NO: 65113 - RNA, 22 nt, Human
guaagaauauacccaggaguca

SEQ ID NO: 65114 - RNA, 22 nt, Human
uaaauuccuagucacaaacuuc

SEQ ID NO: 65115 - RNA, 22 nt, Human
uaaaaucaugacagauugacau

SEQ ID NO: 65116 - RNA, 22 nt, Human
uaaaauaccacauauggugcuc

SEQ ID NO: 65117 - RNA, 22 nt, Human
uaaaggaguguauaauuguagu

SEQ ID NO: 65118 - RNA, 22 nt, Human
gguuuuuggcucaauauuuugg

SEQ ID NO: 65119 - RNA, 22 nt, Human
gguuuguggagcuggaaacacu

SEQ ID NO: 65120 - RNA, 22 nt, Human
gguuucuuuccucucugugccu

SEQ ID NO: 65121 - RNA, 22 nt, Human
gguuugauauguuugugauucu

SEQ ID NO: 65122 - RNA, 22 nt, Human
uaagugcuagaauuccagguuu

SEQ ID NO: 65123 - RNA, 22 nt, Human
uaaggagagaauuuagagguuu

SEQ ID NO: 65124 - RNA, 22 nt, Human
uaagauggaagaaaaggcggau

SEQ ID NO: 65125 - RNA, 21 nt, Human
uaagaacauuaucuucuuccu

SEQ ID NO: 65126 - RNA, 22 nt, Human
uaagaauguuuguugaguaaau

SEQ ID NO: 65127 - RNA, 22 nt, Human
guaugucuuaggguucaguaac

SEQ ID NO: 65128 - RNA, 22 nt, Human
guagaacucuuuccugcguggg

SEQ ID NO: 65129 - RNA, 22 nt, Human
guagaauggggcucucaaagca

SEQ ID NO: 65130 - RNA, 22 nt, Human
guagaucaugaaaauucacugc

SEQ ID NO: 65131 - RNA, 22 nt, Human
guccccugcuguggaucugugg

SEQ ID NO: 65132 - RNA, 22 nt, Human
guccacauaggaacccagcuuc

SEQ ID NO: 65133 - RNA, 22 nt, Human
uaauauauuuuuuaagggaugu

SEQ ID NO: 65134 - RNA, 22 nt, Human
guccucgugucuuuuucucuaa

SEQ ID NO: 65135 - RNA, 22 nt, Human
uaauaucuuuacacauuuucaa

SEQ ID NO: 65136 - RNA, 22 nt, Human
guccucugggagccuugagccu

SEQ ID NO: 65137 - RNA, 22 nt, Human
uaaugcucauuuggcucugcaa

SEQ ID NO: 65138 - RNA, 22 nt, Human
uaauucuacagggaacucugga

SEQ ID NO: 65139 - RNA, 22 nt, Human
uaauucuagauugacauuuuga

SEQ ID NO: 65140 - RNA, 22 nt, Human
uaauugaacguucauuuuuaau

SEQ ID NO: 65141 - RNA, 22 nt, Human
gucgagaacauucauuaugcaa

SEQ ID NO: 65142 - RNA, 22 nt, Human
gucuggagccacugcugcugcu

SEQ ID NO: 65143 - RNA, 22 nt, Human
uaauuuugucacagugacaugc

SEQ ID NO: 65144 - RNA, 22 nt, Human
uacaaaauucaaauaauguuug

SEQ ID NO: 65145 - RNA, 22 nt, Human
gugaaaaauggccaucaggaca

SEQ ID NO: 65146 - RNA, 22 nt, Human
gucuuugagccucaguuuccuc

SEQ ID NO: 65147 - RNA, 22 nt, Human
gucuuuguaguuuuaauuugag

SEQ ID NO: 65148 - RNA, 22 nt, Human
gucuuucuuuuacauauuugug

SEQ ID NO: 65149 - RNA, 22 nt, Human
gucuucuauuuggcaugacaga

SEQ ID NO: 65150 - RNA, 22 nt, Human
uacagaccaguaguucucagcg

SEQ ID NO: 65151 - RNA, 22 nt, Human
uacagauggacacuguuucaag

SEQ ID NO: 65152 - RNA, 22 nt, Human
uacauaauucauuagcuccucu

SEQ ID NO: 65153 - RNA, 22 nt, Human
uacauccuuuugaaaucccaga

SEQ ID NO: 65154 - RNA, 22 nt, Human
uacaugggcguguucaguuagu

SEQ ID NO: 65155 - RNA, 22 nt, Human
uacauuguguuaaaacagaaga

SEQ ID NO: 65156 - RNA, 22 nt, Human
uaccaauuaaauagccaaucua

SEQ ID NO: 65157 - RNA, 22 nt, Human
gugaaacuggaugugaaaacaa

SEQ ID NO: 65158 - RNA, 22 nt, Human
uacugguguauuucuucuuauu

SEQ ID NO: 65159 - RNA, 22 nt, Human
gugaaaugaagugacuggauau

SEQ ID NO: 65160 - RNA, 22 nt, Human
uacuucauucaaguucgcuaua

SEQ ID NO: 65161 - RNA, 22 nt, Human
uacuucuuuuguaaaguauuga

SEQ ID NO: 65162 - RNA, 22 nt, Human
uaccuagaagagacuuuucugg

SEQ ID NO: 65163 - RNA, 22 nt, Human
uacgugucacugaugaaguuua

SEQ ID NO: 65164 - RNA, 23 nt, Human
gugagaccagagccuauucucag

SEQ ID NO: 65165 - RNA, 22 nt, Human
uacuuuggugaaauuggaaaua

SEQ ID NO: 65166 - RNA, 23 nt, Human
uacuuuggcuagaguugucucuu

SEQ ID NO: 65167 - RNA, 22 nt, Human
uacuugaacaucacuaagagaa

SEQ ID NO: 65168 - RNA, 22 nt, Human
uacuugucuuuauuuuaaugcu

SEQ ID NO: 65169 - RNA, 22 nt, Human
uacuuccuucugcccccucuga

SEQ ID NO: 65170 - RNA, 22 nt, Human
uagcguucuugcaugcuaaccu

SEQ ID NO: 65171 - RNA, 22 nt, Human
uagcuagacacucagggccuca

SEQ ID NO: 65172 - RNA, 20 nt, Human
uagcuucaccuagagauagc

SEQ ID NO: 65173 - RNA, 22 nt, Human
uagcuucacuuuuguugaugcg

SEQ ID NO: 65174 - RNA, 22 nt, Human
gugcucaucuucuguaacuguu

SEQ ID NO: 65175 - RNA, 22 nt, Human
uagccucauuauuuacucauga

SEQ ID NO: 65176 - RNA, 22 nt, Human
uagaaguagaaucauuagggcu

SEQ ID NO: 65177 - RNA, 22 nt, Human
uagccaaguguuuuucaugacc

SEQ ID NO: 65178 - RNA, 22 nt, Human
uagaagaacaugucaaacuaua

SEQ ID NO: 65179 - RNA, 22 nt, Human
uagaagagcaugucaaacuaua

SEQ ID NO: 65180 - RNA, 21 nt, Human
uagaagagggaauuugucuuu

SEQ ID NO: 65181 - RNA, 22 nt, Human
gugcuuccuguauugauuccau

SEQ ID NO: 65182 - RNA, 22 nt, Human
gugcuuuaccuuauuggucucg

SEQ ID NO: 65183 - RNA, 22 nt, Human
gugcuguuagcgguuuauaaca

SEQ ID NO: 65184 - RNA, 22 nt, Human
guggaaggaauuaacagacuag

SEQ ID NO: 65185 - RNA, 22 nt, Human
guggaagggaaaccgcacuggc

SEQ ID NO: 65186 - RNA, 22 nt, Human
gugcuuugcuaggaccgauugu

SEQ ID NO: 65187 - RNA, 22 nt, Human
guggauaaguuguuugaccuac

SEQ ID NO: 65188 - RNA, 22 nt, Human
guggagaaauauguucagcuuc

SEQ ID NO: 65189 - RNA, 22 nt, Human
uaggagcagauggcagcaggug

SEQ ID NO: 65190 - RNA, 22 nt, Human
uaggacuugaauucagccucca

SEQ ID NO: 65191 - RNA, 22 nt, Human
uaggauauuuuagaaugguaca

SEQ ID NO: 65192 - RNA, 22 nt, Human
uaggauugguguauguagguuu

SEQ ID NO: 65193 - RNA, 22 nt, Human
uaggcagauuccauauuuuggc

SEQ ID NO: 65194 - RNA, 22 nt, Human
uaggggaagcauagguuuagaa

SEQ ID NO: 65195 - RNA, 22 nt, Human
uagguaauacuuagaccugauu

SEQ ID NO: 65196 - RNA, 22 nt, Human
uagguaguuuccuguuguuggg

SEQ ID NO: 65197 - RNA, 22 nt, Human
uaggucaaggccacuucuugga

SEQ ID NO: 65198 - RNA, 22 nt, Human
guggcuggguggaacugagucu

SEQ ID NO: 65199 - RNA, 22 nt, Human
guggcuuucuaccauuaaauug

SEQ ID NO: 65200 - RNA, 22 nt, Human
guggcuuaauauuuauagcaga

SEQ ID NO: 65201 - RNA, 22 nt, Human
gugggaaacagccuugcuucua

SEQ ID NO: 65202 - RNA, 22 nt, Human
uaguauuguguuguuugacagu

SEQ ID NO: 65203 - RNA, 22 nt, Human
uagucuuuguggucuuuagcua

SEQ ID NO: 65204 - RNA, 22 nt, Human
uaguggaaccuucuaaaugacg

SEQ ID NO: 65205 - RNA, 22 nt, Human
uagugcuucauucuauugguuu

SEQ ID NO: 65206 - RNA, 22 nt, Human
uaucauuaggagugcugcucgg

SEQ ID NO: 65207 - RNA, 21 nt, Human
uaucauuuuuuccccugagau

SEQ ID NO: 65208 - RNA, 22 nt, Human
uauccaaaggaacaaucacagc

SEQ ID NO: 65209 - RNA, 22 nt, Human
uaucuucaauagcccagaugug

SEQ ID NO: 65210 - RNA, 22 nt, Human
uaucuuugccuuggguuuuguu

SEQ ID NO: 65211 - RNA, 22 nt, Human
uaugaaagguuuuuucuugaaa

SEQ ID NO: 65212 - RNA, 22 nt, Human
guguauaguggugucgguagaa

SEQ ID NO: 65213 - RNA, 22 nt, Human
uaugcuguauucuguauguuag

SEQ ID NO: 65214 - RNA, 22 nt, Human
uaugcuagauggaaaaauauug

SEQ ID NO: 65215 - RNA, 22 nt, Human
guguucucagcacccacuucau

SEQ ID NO: 65216 - RNA, 22 nt, Human
uaugccaccagucuggaacucu

SEQ ID NO: 65217 - RNA, 22 nt, Human
guuaaaaugauuugugauuuau

SEQ ID NO: 65218 - RNA, 22 nt, Human
guuaaaggaagccauauguucg

SEQ ID NO: 65219 - RNA, 22 nt, Human
uaugugaguaccugucaugugc

SEQ ID NO: 65220 - RNA, 22 nt, Human
uauguugucuuguucagccaua

SEQ ID NO: 65221 - RNA, 22 nt, Human
uauguuugcaguucuaggucuu

SEQ ID NO: 65222 - RNA, 22 nt, Human
uauguucaauaccagguucuuu

SEQ ID NO: 65223 - RNA, 22 nt, Human
guguuuauguuuuugcuaggga

SEQ ID NO: 65224 - RNA, 22 nt, Human
guguuuugagaggaugguuuua

SEQ ID NO: 65225 - RNA, 22 nt, Human
uauguauguauguauguauaug

SEQ ID NO: 65226 - RNA, 22 nt, Human
guguuguaguguguguuucuuu

SEQ ID NO: 65227 - RNA, 23 nt, Human
guguuguugauuuucgaaucuuu

SEQ ID NO: 65228 - RNA, 22 nt, Human
guguugaaaaguagcacugcuu

SEQ ID NO: 65229 - RNA, 22 nt, Human
guguucuuuaugguuguagugu

SEQ ID NO: 65230 - RNA, 22 nt, Human
uauucagugcugguucuuuuuc

SEQ ID NO: 65231 - RNA, 18 nt, Human
guucaagcauuuugcucu

SEQ ID NO: 65232 - RNA, 22 nt, Human
guucaaggagcagcuugcuaca

SEQ ID NO: 65233 - RNA, 22 nt, Human
guuauuaaauauuuuggugauu

SEQ ID NO: 65234 - RNA, 22 nt, Human
uauuaugguuguagguuaacaa

SEQ ID NO: 65235 - RNA, 22 nt, Human
guucuuuacuucgcaucugcua

SEQ ID NO: 65236 - RNA, 21 nt, Human
guucuuaguuauauucucaau

SEQ ID NO: 65237 - RNA, 22 nt, Human
uauuuuagaagauuuggagaaa

SEQ ID NO: 65238 - RNA, 22 nt, Human
guucuggaggagagccuggugu

SEQ ID NO: 65239 - RNA, 22 nt, Human
guucuguucuucacagguuugu

SEQ ID NO: 65240 - RNA, 22 nt, Human
guucucuccugcuggugaugga

SEQ ID NO: 65241 - RNA, 22 nt, Human
guucucuuaauccuaguuggua

SEQ ID NO: 65242 - RNA, 22 nt, Human
guuggaaauaucagucacguga

SEQ ID NO: 65243 - RNA, 22 nt, Human
guugcuaugaaauuaaaauuua

SEQ ID NO: 65244 - RNA, 21 nt, Human
guugcuccuucuuuuucuugc

SEQ ID NO: 65245 - RNA, 22 nt, Human
uauuuuuguuuaccaguuaaca

SEQ ID NO: 65246 - RNA, 22 nt, Human
uauuuuagccaacagaaugaug

SEQ ID NO: 65247 - RNA, 22 nt, Human
uauuuuauuuagguuuaguugu

SEQ ID NO: 65248 - RNA, 22 nt, Human
uauuuucucugccacacuucca

SEQ ID NO: 65249 - RNA, 22 nt, Human
ucaaagaucuuugcuuuugggg

SEQ ID NO: 65250 - RNA, 22 nt, Human
guugggcugaagugugugcuua

SEQ ID NO: 65251 - RNA, 18 nt, Human
ucagggaaacuuugccug

SEQ ID NO: 65252 - RNA, 20 nt, Human
ucaggguuucccauucuugg

SEQ ID NO: 65253 - RNA, 22 nt, Human
ucagguagugguuaaguucugu

SEQ ID NO: 65254 - RNA, 22 nt, Human
ucaggagaguguucaguggagg

SEQ ID NO: 65255 - RNA, 19 nt, Human
ucaggaggucgaccuggca

SEQ ID NO: 65256 - RNA, 22 nt, Human
ucaagcaaggaauccuuuugua

SEQ ID NO: 65257 - RNA, 22 nt, Human
guugucguucccccugcuuaaa

SEQ ID NO: 65258 - RNA, 22 nt, Human
uaaaugaaaugaagugaaagcu

SEQ ID NO: 65259 - RNA, 22 nt, Human
uaaaggcaaacucuccaaggau

SEQ ID NO: 65260 - RNA, 22 nt, Human
uaaagugaaguucagaauggcu

SEQ ID NO: 65261 - RNA, 22 nt, Human
uaaaguauucaaguagcuuucu

SEQ ID NO: 65262 - RNA, 22 nt, Human
uaaaguguacaagucauaagua

SEQ ID NO: 65263 - RNA, 22 nt, Human
ucaguagcauuuaauguucagu

SEQ ID NO: 65264 - RNA, 22 nt, Human
uaacuuuucuguucaauuuucc

SEQ ID NO: 65265 - RNA, 18 nt, Human
uaacugguuucuucccau

SEQ ID NO: 65266 - RNA, 22 nt, Human
uaacaguauacuacaucauauu

SEQ ID NO: 65267 - RNA, 22 nt, Human
uaacaguggucugugguaucug

SEQ ID NO: 65268 - RNA, 22 nt, Human
ucagucauacuuuaugauugaa

SEQ ID NO: 65269 - RNA, 22 nt, Human
uaaauuggaauaaugagaagug

SEQ ID NO: 65270 - RNA, 23 nt, Human
uaaauuuuauucugauaacacag

SEQ ID NO: 65271 - RNA, 22 nt, Human
uaacaacuuucugguguaacuu

SEQ ID NO: 65272 - RNA, 22 nt, Human
ucaucuauaaguagcaucuggg

SEQ ID NO: 65273 - RNA, 22 nt, Human
ucauaucauuuugaaagcugag

SEQ ID NO: 65274 - RNA, 22 nt, Human
ucaguugauggcaguuaauguc

SEQ ID NO: 65275 - RNA, 20 nt, Human
ucaguuucccuauuagguug

SEQ ID NO: 65276 - RNA, 22 nt, Human
ucauuauuuggaauaugggacu

SEQ ID NO: 65277 - RNA, 21 nt, Human
uaaggaagagcauuuuagguc

SEQ ID NO: 65278 - RNA, 22 nt, Human
ucaugccugcgauugucccugg

SEQ ID NO: 65279 - RNA, 20 nt, Human
ucauucagaaucaguaugca

SEQ ID NO: 65280 - RNA, 22 nt, Human
uaauccaaaacugaaucugugg

SEQ ID NO: 65281 - RNA, 22 nt, Human
uaauuuagugcauuuccuagua

SEQ ID NO: 65282 - RNA, 22 nt, Human
ucauuuuaucaggaauggaauc

SEQ ID NO: 65283 - RNA, 22 nt, Human
uacaaucacccaaagagccaga

SEQ ID NO: 65284 - RNA, 22 nt, Human
ucauuguuucugcuuuucauga

SEQ ID NO: 65285 - RNA, 22 nt, Human
ucauuuaauuuggaacucagag

SEQ ID NO: 65286 - RNA, 17 nt, Human
ucauuuauccucuuugg

SEQ ID NO: 65287 - RNA, 22 nt, Human
uccaagcgcuucuggagcuccu

SEQ ID NO: 65288 - RNA, 23 nt, Human
uacagccaugucgcugauuuaac

SEQ ID NO: 65289 - RNA, 18 nt, Human
uacagauguaugucuaca

SEQ ID NO: 65290 - RNA, 19 nt, Human
uccaaaauacuuguuacug

SEQ ID NO: 65291 - RNA, 22 nt, Human
uccaaggacucuugucagcugu

SEQ ID NO: 65292 - RNA, 22 nt, Human
ucauuugggauuuuuuauaauu

SEQ ID NO: 65293 - RNA, 22 nt, Human
uccacaaagucuaugagaguug

SEQ ID NO: 65294 - RNA, 22 nt, Human
uacagcgaaaauuuagcuugau

SEQ ID NO: 65295 - RNA, 21 nt, Human
uacagcucaucaauuacugcu

SEQ ID NO: 65296 - RNA, 22 nt, Human
uccaggagucagacagauggug

SEQ ID NO: 65297 - RNA, 22 nt, Human
uccaugcaguagaggcgcuggg

SEQ ID NO: 65298 - RNA, 22 nt, Human
uccaucauucagaaauuuuuga

SEQ ID NO: 65299 - RNA, 18 nt, Human
uccauccucugcucuuca

SEQ ID NO: 65300 - RNA, 22 nt, Human
uccaugaguuuuuuaguuucac

SEQ ID NO: 65301 - RNA, 22 nt, Human
uacguuuuauaucuuuuggaau

SEQ ID NO: 65302 - RNA, 22 nt, Human
uacuaaacugcauuucuaucua

SEQ ID NO: 65303 - RNA, 22 nt, Human
uacuaaagaaugaguuaaguuu

SEQ ID NO: 65304 - RNA, 19 nt, Human
uccccuacuccuuucccuc

SEQ ID NO: 65305 - RNA, 20 nt, Human
uccccuccacuuuccuccua

SEQ ID NO: 65306 - RNA, 22 nt, Human
uacugccauuauccugcugaaa

SEQ ID NO: 65307 - RNA, 22 nt, Human
uacugcaguuccugcugucucc

SEQ ID NO: 65308 - RNA, 22 nt, Human
uacuuuaauugcaaaaauaaau

SEQ ID NO: 65309 - RNA, 22 nt, Human
ucccuacuccucuggucccucu

SEQ ID NO: 65310 - RNA, 22 nt, Human
ucccugcagggccauugugcag

SEQ ID NO: 65311 - RNA, 22 nt, Human
ucccugccuuauuuucauaugc

SEQ ID NO: 65312 - RNA, 22 nt, Human
ucccugcugggcgaucuucucu

SEQ ID NO: 65313 - RNA, 22 nt, Human
uagaccuccagcggaggagauu

SEQ ID NO: 65314 - RNA, 22 nt, Human
uccgagggugacuaccgcuucc

SEQ ID NO: 65315 - RNA, 22 nt, Human
uccgugggucuugaagugucac

SEQ ID NO: 65316 - RNA, 22 nt, Human
uccuaaauuuguacuagcauuu

SEQ ID NO: 65317 - RNA, 22 nt, Human
uccguugaggcugccaggcgag

SEQ ID NO: 65318 - RNA, 22 nt, Human
uagaggcuagugguuaugaccu

SEQ ID NO: 65319 - RNA, 22 nt, Human
uagaguauuuguuuacuaaguu

SEQ ID NO: 65320 - RNA, 22 nt, Human
uagaguguaagcuccuugaggg

SEQ ID NO: 65321 - RNA, 23 nt, Human
uagauccuuccaacuacucuuac

SEQ ID NO: 65322 - RNA, 22 nt, Human
uagaaauaaacacugcuaccuu

SEQ ID NO: 65323 - RNA, 22 nt, Human
uagaacaaacagcauguuugau

SEQ ID NO: 65324 - RNA, 22 nt, Human
ucccuucccaccccugccuuuu

SEQ ID NO: 65325 - RNA, 22 nt, Human
uacuuuuuucacuucuagcccc

SEQ ID NO: 65326 - RNA, 22 nt, Human
uagaacuguaaauuaucucucc

SEQ ID NO: 65327 - RNA, 22 nt, Human
uagaacugcucucauacuugcu

SEQ ID NO: 65328 - RNA, 22 nt, Human
ucccuugacauuacuugggagg

SEQ ID NO: 65329 - RNA, 22 nt, Human
ucccuuuuuaauugugucccug

SEQ ID NO: 65330 - RNA, 22 nt, Human
uccuccuuccugccccuaacuu

SEQ ID NO: 65331 - RNA, 22 nt, Human
uccucccugcacucagugaagu

SEQ ID NO: 65332 - RNA, 21 nt, Human
uccuccucuccaaacgcccuc

SEQ ID NO: 65333 - RNA, 22 nt, Human
uccuccuggagacuuucucucu

SEQ ID NO: 65334 - RNA, 22 nt, Human
uagaucucugccuuguucagag

SEQ ID NO: 65335 - RNA, 22 nt, Human
uagaugguguccagaaagagaa

SEQ ID NO: 65336 - RNA, 20 nt, Human
uccugaaauuacgugauuca

SEQ ID NO: 65337 - RNA, 22 nt, Human
uccugaaggccugaguuccacc

SEQ ID NO: 65338 - RNA, 21 nt, Human
uccugccuuaguccagagcag

SEQ ID NO: 65339 - RNA, 22 nt, Human
uagcagaacaauagucaaugau

SEQ ID NO: 65340 - RNA, 22 nt, Human
uagccaaguuuucuuugaaagu

SEQ ID NO: 65341 - RNA, 22 nt, Human
uccugcuucaaucugcugcugg

SEQ ID NO: 65342 - RNA, 22 nt, Human
uccugcucucuccauuccuucc

SEQ ID NO: 65343 - RNA, 22 nt, Human
uagcucuuaccagugaaguuug

SEQ ID NO: 65344 - RNA, 22 nt, Human
uagcucuaaggagaaucccucu

SEQ ID NO: 65345 - RNA, 22 nt, Human
uccuuagccagggcagcucaaa

SEQ ID NO: 65346 - RNA, 22 nt, Human
uccuuccucuuucaaauuuguu

SEQ ID NO: 65347 - RNA, 22 nt, Human
uccuuaggaccuagagguagua

SEQ ID NO: 65348 - RNA, 22 nt, Human
uccuucuuuucgccggaguuga

SEQ ID NO: 65349 - RNA, 22 nt, Human
ucucaaagagcuacuggucuau

SEQ ID NO: 65350 - RNA, 22 nt, Human
ucucaaagguuuuccucuuuuu

SEQ ID NO: 65351 - RNA, 22 nt, Human
ucucacuuuucaauccccagca

SEQ ID NO: 65352 - RNA, 22 nt, Human
ucucagaaaugacaggagguac

SEQ ID NO: 65353 - RNA, 22 nt, Human
ucucagaagaaacaucugcugg

SEQ ID NO: 65354 - RNA, 22 nt, Human
ucucagcuggcugggagcccug

SEQ ID NO: 65355 - RNA, 22 nt, Human
uaguuggguagacaguucuaca

SEQ ID NO: 65356 - RNA, 20 nt, Human
ucuaggguuugguuaucauc

SEQ ID NO: 65357 - RNA, 22 nt, Human
ucuauauucuauguucuucuuu

SEQ ID NO: 65358 - RNA, 22 nt, Human
ucuauuguuauccuuuccauuu

SEQ ID NO: 65359 - RNA, 22 nt, Human
ucuaguguuaaggcaaaguaaa

SEQ ID NO: 65360 - RNA, 19 nt, Human
uagcuguucuugaguguga

SEQ ID NO: 65361 - RNA, 22 nt, Human
uagcugucauuggaucagaagg

SEQ ID NO: 65362 - RNA, 22 nt, Human
uaggaagagauuuucacauggc

SEQ ID NO: 65363 - RNA, 22 nt, Human
uaggaaugcagaugcauaauaa

SEQ ID NO: 65364 - RNA, 22 nt, Human
uaggagccagaauugcauuagu

SEQ ID NO: 65365 - RNA, 22 nt, Human
ucuaggaguugauaaaagggcu

SEQ ID NO: 65366 - RNA, 22 nt, Human
uagugucuuccaggacauggua

SEQ ID NO: 65367 - RNA, 22 nt, Human
uaguuagaucuccaguuugguu

SEQ ID NO: 65368 - RNA, 22 nt, Human
uaguuauuucugcacuuaauga

SEQ ID NO: 65369 - RNA, 22 nt, Human
uaguuaggauucccaggaaacc

SEQ ID NO: 65370 - RNA, 22 nt, Human
uauaaucuugcccauaguauuu

SEQ ID NO: 65371 - RNA, 22 nt, Human
uauaagaaaagucauuaucaaa

SEQ ID NO: 65372 - RNA, 22 nt, Human
uauacauauacaaaugcacaua

SEQ ID NO: 65373 - RNA, 22 nt, Human
ucucgcuguuccugcuucaggu

SEQ ID NO: 65374 - RNA, 22 nt, Human
ucuccuuuggggccucaggguu

SEQ ID NO: 65375 - RNA, 22 nt, Human
ucuccugacaccucuugugggg

SEQ ID NO: 65376 - RNA, 22 nt, Human
ucuccuuugaaaguuaggacug

SEQ ID NO: 65377 - RNA, 22 nt, Human
uauaggaugaugucauguugcu

SEQ ID NO: 65378 - RNA, 22 nt, Human
ucucccuggccagcccuuuccc

SEQ ID NO: 65379 - RNA, 22 nt, Human
uauaaagaccuuauccuucaua

SEQ ID NO: 65380 - RNA, 21 nt, Human
ucucauuuuaacacagaguug

SEQ ID NO: 65381 - RNA, 22 nt, Human
ucucauacguuuccagguguca

SEQ ID NO: 65382 - RNA, 22 nt, Human
uaguugguggagcgauuugucu

SEQ ID NO: 65383 - RNA, 21 nt, Human
ucucauacauaguaggaacca

SEQ ID NO: 65384 - RNA, 22 nt, Human
uaguuucuaauguugaaauuau

SEQ ID NO: 65385 - RNA, 22 nt, Human
uaguuuuaagcugacauuguuc

SEQ ID NO: 65386 - RNA, 22 nt, Human
uaguuucuucaacugucccagc

SEQ ID NO: 65387 - RNA, 22 nt, Human
ucucuguaguugggcagcugcu

SEQ ID NO: 65388 - RNA, 22 nt, Human
uauauuaaagugcuuugcagug

SEQ ID NO: 65389 - RNA, 22 nt, Human
uaucacauaaaugaggaauauu

SEQ ID NO: 65390 - RNA, 22 nt, Human
uaucauuuuacugugacauuuu

SEQ ID NO: 65391 - RNA, 22 nt, Human
uauauacacugauuaggauuuu

SEQ ID NO: 65392 - RNA, 22 nt, Human
ucuccuuuacuggcuccuuuug

SEQ ID NO: 65393 - RNA, 22 nt, Human
uauauacacgcacauauacaua

SEQ ID NO: 65394 - RNA, 22 nt, Human
uauauacuugaaaauugcugag

SEQ ID NO: 65395 - RNA, 20 nt, Human
ucucucacccuugcugugca

SEQ ID NO: 65396 - RNA, 21 nt, Human
ucucuaucguauaccagccgg

SEQ ID NO: 65397 - RNA, 22 nt, Human
ucucuagcuuccuuaggaacac

SEQ ID NO: 65398 - RNA, 22 nt, Human
uauagucuuaaguaguagacuc

SEQ ID NO: 65399 - RNA, 22 nt, Human
ucucuagaggaauuguucuagg

SEQ ID NO: 65400 - RNA, 22 nt, Human
ucucucguuuuuugcagauaaa

SEQ ID NO: 65401 - RNA, 22 nt, Human
ucucucucucuuccagcauguu

SEQ ID NO: 65402 - RNA, 22 nt, Human
ucucucugcuguccagcguuau

SEQ ID NO: 65403 - RNA, 22 nt, Human
ucucucgguacagcuggcugga

SEQ ID NO: 65404 - RNA, 22 nt, Human
ucugaauauguuuaucaucucu

SEQ ID NO: 65405 - RNA, 22 nt, Human
ucucuuuuuuuaaaacucuaug

SEQ ID NO: 65406 - RNA, 22 nt, Human
ucucuugcuauugcgaacaggu

SEQ ID NO: 65407 - RNA, 22 nt, Human
ucucuucggagagaccuuugga

SEQ ID NO: 65408 - RNA, 22 nt, Human
ucucugugaauggcgucaccug

SEQ ID NO: 65409 - RNA, 22 nt, Human
uauccaucuucuuugagaaugg

SEQ ID NO: 65410 - RNA, 22 nt, Human
uaucuagguacacaucuccucu

SEQ ID NO: 65411 - RNA, 22 nt, Human
uaucuguagucucaugguuccu

SEQ ID NO: 65412 - RNA, 22 nt, Human
ucugagcaggaaagagcagaga

SEQ ID NO: 65413 - RNA, 22 nt, Human
ucugaggacagugcugugccug

SEQ ID NO: 65414 - RNA, 19 nt, Human
uaugaaguugauaaaaguu

SEQ ID NO: 65415 - RNA, 22 nt, Human
uaugaauauaccacaauuuagg

SEQ ID NO: 65416 - RNA, 22 nt, Human
uaugaggagaacauuccugaac

SEQ ID NO: 65417 - RNA, 22 nt, Human
ucugauucauucugguaaaugg

SEQ ID NO: 65418 - RNA, 22 nt, Human
ucugauucucuuguugaccuag

SEQ ID NO: 65419 - RNA, 22 nt, Human
ucugaucagaagacaaaugagg

SEQ ID NO: 65420 - RNA, 22 nt, Human
ucugaucuuucauccuaaaugg

SEQ ID NO: 65421 - RNA, 22 nt, Human
uaugauuuucaugguagaguua

SEQ ID NO: 65422 - RNA, 21 nt, Human
ucugccaguuucucuuacuuu

SEQ ID NO: 65423 - RNA, 23 nt, Human
ucugccuccuaauuguugguguc

SEQ ID NO: 65424 - RNA, 22 nt, Human
ucugcuggugucauuuuugcua

SEQ ID NO: 65425 - RNA, 22 nt, Human
uauggacagcuuucuuuguguu

SEQ ID NO: 65426 - RNA, 22 nt, Human
uauggcucacaaauaauaaauu

SEQ ID NO: 65427 - RNA, 22 nt, Human
uauggcuaguguguuuguaaca

SEQ ID NO: 65428 - RNA, 22 nt, Human
ucugcuguugaucaugacuagc

SEQ ID NO: 65429 - RNA, 22 nt, Human
ucugcuuuucuuaaggggauca

SEQ ID NO: 65430 - RNA, 22 nt, Human
uaugugaaauggaauauagaaa

SEQ ID NO: 65431 - RNA, 22 nt, Human
uauguauaacuugauaggauga

SEQ ID NO: 65432 - RNA, 22 nt, Human
ucuggcaguugccgcuucaguc

SEQ ID NO: 65433 - RNA, 22 nt, Human
ucuggcucaggagcuguguuca

SEQ ID NO: 65434 - RNA, 17 nt, Human
ucuggguuucugauuua

SEQ ID NO: 65435 - RNA, 22 nt, Human
uauguuaaauguuugauguuua

SEQ ID NO: 65436 - RNA, 21 nt, Human
ucuggggacaagguccaggaa

SEQ ID NO: 65437 - RNA, 22 nt, Human
ucuggggaugagugaugucgua

SEQ ID NO: 65438 - RNA, 22 nt, Human
ucuguauuuuuuacacacaugc

SEQ ID NO: 65439 - RNA, 22 nt, Human
ucuguagcuaauucucuuuaaa

SEQ ID NO: 65440 - RNA, 22 nt, Human
ucugguuaggcuugugaggucc

SEQ ID NO: 65441 - RNA, 19 nt, Human
ucuguggagcucagaguag

SEQ ID NO: 65442 - RNA, 22 nt, Human
uauuagggaacugcaagacuaa

SEQ ID NO: 65443 - RNA, 17 nt, Human
ucuguguccgcucaguc

SEQ ID NO: 65444 - RNA, 20 nt, Human
ucugugugccaucaccuaac

SEQ ID NO: 65445 - RNA, 22 nt, Human
ucuguagucuuggagccgcaca

SEQ ID NO: 65446 - RNA, 22 nt, Human
ucugucaguguccucguguggu

SEQ ID NO: 65447 - RNA, 22 nt, Human
ucugucuaaccauauuuuccua

SEQ ID NO: 65448 - RNA, 22 nt, Human
ucugugcuccuuccuugucauc

SEQ ID NO: 65449 - RNA, 22 nt, Human
uauguuuugcaaauaucaaaca

SEQ ID NO: 65450 - RNA, 22 nt, Human
uauuaaaagagaaaaagccacc

SEQ ID NO: 65451 - RNA, 22 nt, Human
uauuacugccacaucauuaggu

SEQ ID NO: 65452 - RNA, 22 nt, Human
ucuucacagaugcauauacuuc

SEQ ID NO: 65453 - RNA, 22 nt, Human
ucuucacugaagcuuugcaucu

SEQ ID NO: 65454 - RNA, 22 nt, Human
ucuuauucuuuuaaacaacgca

SEQ ID NO: 65455 - RNA, 22 nt, Human
ucuuauugugaugaugaagaac

SEQ ID NO: 65456 - RNA, 22 nt, Human
ucuguuuugugcuuuguuuucu

SEQ ID NO: 65457 - RNA, 22 nt, Human
ucuuaaauaugaaaaggauuau

SEQ ID NO: 65458 - RNA, 22 nt, Human
ucuguucucuuguucugacggu

SEQ ID NO: 65459 - RNA, 22 nt, Human
ucuguucaugucuuuuuaagug

SEQ ID NO: 65460 - RNA, 22 nt, Human
uauuauggguuuuuguguaaau

SEQ ID NO: 65461 - RNA, 22 nt, Human
uauucauuuuuauuugugacug

SEQ ID NO: 65462 - RNA, 22 nt, Human
uauucccacuccucagcaauuu

SEQ ID NO: 65463 - RNA, 18 nt, Human
uauuccucuuccucuauc

SEQ ID NO: 65464 - RNA, 22 nt, Human
ucuguguguguggcuaaacaag

SEQ ID NO: 65465 - RNA, 22 nt, Human
ugagagguagaacuuguagugu

SEQ ID NO: 65466 - RNA, 22 nt, Human
ugagagaauuacuaaagggcuu

SEQ ID NO: 65467 - RNA, 22 nt, Human
ugagacuuggggggcugagggc

SEQ ID NO: 65468 - RNA, 22 nt, Human
ugagacuugaacuccagugcca

SEQ ID NO: 65469 - RNA, 22 nt, Human
ugagacucuccugugcagccuc

SEQ ID NO: 65470 - RNA, 22 nt, Human
ucuuccaaacaaaaaucugugu

SEQ ID NO: 65471 - RNA, 22 nt, Human
ucuucaguaaucgacauuccac

SEQ ID NO: 65472 - RNA, 22 nt, Human
ucuucaucucuaaaaugggaac

SEQ ID NO: 65473 - RNA, 23 nt, Human
ucagggaucgucagaaaaugaaa

SEQ ID NO: 65474 - RNA, 22 nt, Human
ugagaagaggucuuuugggaug

SEQ ID NO: 65475 - RNA, 22 nt, Human
ugagaauuuaacuugauuagga

SEQ ID NO: 65476 - RNA, 22 nt, Human
ucaggucacugauaaaguggaa

SEQ ID NO: 65477 - RNA, 22 nt, Human
ugagauuuagaacuggauuuca

SEQ ID NO: 65478 - RNA, 22 nt, Human
ucagugauccagauauuugagc

SEQ ID NO: 65479 - RNA, 22 nt, Human
ugagccugaguguguauugaac

SEQ ID NO: 65480 - RNA, 22 nt, Human
ugagcuuugguaccuucauuug

SEQ ID NO: 65481 - RNA, 22 nt, Human
ucauaaaaucaguguccauugu

SEQ ID NO: 65482 - RNA, 22 nt, Human
ucauaaaggugccacucaguuu

SEQ ID NO: 65483 - RNA, 22 nt, Human
ucaucauccuuuuuugaagagu

SEQ ID NO: 65484 - RNA, 22 nt, Human
ucaucgauggggagcucuacaa

SEQ ID NO: 65485 - RNA, 22 nt, Human
ucaugagcacaggugcagggac

SEQ ID NO: 65486 - RNA, 22 nt, Human
ucaucuuuauaaugcaaguuuu

SEQ ID NO: 65487 - RNA, 22 nt, Human
ucaugagagaaaacgugcuucu

SEQ ID NO: 65488 - RNA, 22 nt, Human
ucauguauucugggcaggagau

SEQ ID NO: 65489 - RNA, 22 nt, Human
ugauaugguaauaagauauucu

SEQ ID NO: 65490 - RNA, 20 nt, Human
ugauaugcgguacagagagg

SEQ ID NO: 65491 - RNA, 22 nt, Human
ugaucauugaacaucgaguuaa

SEQ ID NO: 65492 - RNA, 22 nt, Human
ugaugaugaagaaauauuauca

SEQ ID NO: 65493 - RNA, 22 nt, Human
ucauuuguauucuacaaagcac

SEQ ID NO: 65494 - RNA, 18 nt, Human
ugauggcuaagagccggg

SEQ ID NO: 65495 - RNA, 22 nt, Human
ugauugaauaauguuaugugaa

SEQ ID NO: 65496 - RNA, 22 nt, Human
ugauugcucagcuagccucuuu

SEQ ID NO: 65497 - RNA, 22 nt, Human
ugauuccugugcuuauuccagu

SEQ ID NO: 65498 - RNA, 20 nt, Human
ugauuauuccaacaagaaug

SEQ ID NO: 65499 - RNA, 22 nt, Human
ugauucacagacuucacaaggc

SEQ ID NO: 65500 - RNA, 22 nt, Human
ugauguauaaaaagagugaaau

SEQ ID NO: 65501 - RNA, 22 nt, Human
uccaaggacuaaauucuagauu

SEQ ID NO: 65502 - RNA, 22 nt, Human
uccagcuucugccugcugcugc

SEQ ID NO: 65503 - RNA, 22 nt, Human
ugauuucauaugacagcuuuuu

SEQ ID NO: 65504 - RNA, 22 nt, Human
ucccaaguguuuggcgaggaga

SEQ ID NO: 65505 - RNA, 22 nt, Human
ucccacacucaacacacaugua

SEQ ID NO: 65506 - RNA, 22 nt, Human
ugauuguauuuauccucuguuc

SEQ ID NO: 65507 - RNA, 22 nt, Human
ugcacacaguucucaggaaaga

SEQ ID NO: 65508 - RNA, 19 nt, Human
ugcacucauggagggucug

SEQ ID NO: 65509 - RNA, 22 nt, Human
ugcacugccuuucuuggcauga

SEQ ID NO: 65510 - RNA, 22 nt, Human
uccccucucugcgcucccaggu

SEQ ID NO: 65511 - RNA, 22 nt, Human
uccccugccccccauccucugg

SEQ ID NO: 65512 - RNA, 22 nt, Human
ucccucguuucgaucuuuagaa

SEQ ID NO: 65513 - RNA, 22 nt, Human
ucccucuccugucugcuucuuu

SEQ ID NO: 65514 - RNA, 23 nt, Human
ucccuguuucagggccagaacug

SEQ ID NO: 65515 - RNA, 22 nt, Human
ucccucugccugcaguccugcu

SEQ ID NO: 65516 - RNA, 22 nt, Human
ucccucuuccuacccucccuuu

SEQ ID NO: 65517 - RNA, 22 nt, Human
ugcaggagcccaggaauacuau

SEQ ID NO: 65518 - RNA, 18 nt, Human
ugcaggggaggggugaua

SEQ ID NO: 65519 - RNA, 20 nt, Human
uccgaaucaugacuuugcac

SEQ ID NO: 65520 - RNA, 22 nt, Human
ugcaggaacucgaaaacuauag

SEQ ID NO: 65521 - RNA, 22 nt, Human
ugcaggaagcucagcggggccg

SEQ ID NO: 65522 - RNA, 22 nt, Human
ugcaggagcaccagcucacccu

SEQ ID NO: 65523 - RNA, 22 nt, Human
ucccuguggauuaaggagaugu

SEQ ID NO: 65524 - RNA, 22 nt, Human
uccgcguugguuagagagggcu

SEQ ID NO: 65525 - RNA, 22 nt, Human
ugcaguugcguuugcauuccau

SEQ ID NO: 65526 - RNA, 22 nt, Human
ugcauaugcauguaccuguguu

SEQ ID NO: 65527 - RNA, 22 nt, Human
ugcauaaauauuguugggagua

SEQ ID NO: 65528 - RNA, 22 nt, Human
ugcauguuucuguauguuaaug

SEQ ID NO: 65529 - RNA, 22 nt, Human
ugcaucccugaggcauuauccu

SEQ ID NO: 65530 - RNA, 22 nt, Human
uccuacccccuucuccagcucc

SEQ ID NO: 65531 - RNA, 22 nt, Human
uccucagagacaaguugagagg

SEQ ID NO: 65532 - RNA, 22 nt, Human
uccucagcaaacacuucacucu

SEQ ID NO: 65533 - RNA, 23 nt, Human
uccuccccaccuuuguccccucc

SEQ ID NO: 65534 - RNA, 22 nt, Human
uccucaucuuaucaucccaaga

SEQ ID NO: 65535 - RNA, 22 nt, Human
uccucuccaggugagccgaaau

SEQ ID NO: 65536 - RNA, 22 nt, Human
ugcccacuuugucuccaugcug

SEQ ID NO: 65537 - RNA, 22 nt, Human
ugcccacuucaaaaucuucauu

SEQ ID NO: 65538 - RNA, 19 nt, Human
ugccccuucuucauccauc

SEQ ID NO: 65539 - RNA, 21 nt, Human
uccugccuggccuucugacua

SEQ ID NO: 65540 - RNA, 22 nt, Human
ugcccuagaucacauuacaggu

SEQ ID NO: 65541 - RNA, 22 nt, Human
ugccccuugccaggccucugcc

SEQ ID NO: 65542 - RNA, 22 nt, Human
uccuggaagggaugguugagga

SEQ ID NO: 65543 - RNA, 22 nt, Human
ugccucucucugucauuaugcu

SEQ ID NO: 65544 - RNA, 22 nt, Human
uccuugaccuccugacaguaac

SEQ ID NO: 65545 - RNA, 19 nt, Human
uccuugacuguauucagag

SEQ ID NO: 65546 - RNA, 22 nt, Human
uccuuguaccauuugcucacag

SEQ ID NO: 65547 - RNA, 17 nt, Human
ugccuucgucuucaguu

SEQ ID NO: 65548 - RNA, 22 nt, Human
uccuuucaaauuuauuugacau

SEQ ID NO: 65549 - RNA, 21 nt, Human
ucuauccuggcuuuccacuug

SEQ ID NO: 65550 - RNA, 22 nt, Human
ucuaugaagucuuccuuuccuc

SEQ ID NO: 65551 - RNA, 22 nt, Human
ucuagagaauuuggaaauuaag

SEQ ID NO: 65552 - RNA, 22 nt, Human
ugcggagggagcagucggcugu

SEQ ID NO: 65553 - RNA, 22 nt, Human
ucgcuauuauuuuagguucuca

SEQ ID NO: 65554 - RNA, 22 nt, Human
ucuauuauauuuacacgagagu

SEQ ID NO: 65555 - RNA, 22 nt, Human
ucuaugcuacguuccucugaaa

SEQ ID NO: 65556 - RNA, 23 nt, Human
ucucaccaggauaugacugucac

SEQ ID NO: 65557 - RNA, 21 nt, Human
ucucaagguaacauuuaagau

SEQ ID NO: 65558 - RNA, 22 nt, Human
ugcugcucaagcugcagcaaaa

SEQ ID NO: 65559 - RNA, 22 nt, Human
ugcugcuguuaucauuuuacca

SEQ ID NO: 65560 - RNA, 23 nt, Human
ugcugcuggaguaucuacaaugc

SEQ ID NO: 65561 - RNA, 22 nt, Human
ugcugcuguuuccuacaucuca

SEQ ID NO: 65562 - RNA, 22 nt, Human
ucucauaauuguuucccagcua

SEQ ID NO: 65563 - RNA, 22 nt, Human
ucucauugugcuuuuuguacug

SEQ ID NO: 65564 - RNA, 22 nt, Human
ucuccuaauuacauacuugauu

SEQ ID NO: 65565 - RNA, 22 nt, Human
ucucccuuuggauuuguuuugg

SEQ ID NO: 65566 - RNA, 23 nt, Human
ucuccccuccagcccucccuccu

SEQ ID NO: 65567 - RNA, 20 nt, Human
ugcugugugucuacuguggg

SEQ ID NO: 65568 - RNA, 22 nt, Human
ugcugugagaccauuuguugag

SEQ ID NO: 65569 - RNA, 22 nt, Human
ugcuuaaagcauuucucuuuaa

SEQ ID NO: 65570 - RNA, 22 nt, Human
ucuccucuauuucuguauguau

SEQ ID NO: 65571 - RNA, 22 nt, Human
ucuccucucugaucuugcuccg

SEQ ID NO: 65572 - RNA, 22 nt, Human
ucuccucuuaaugcacguuucc

SEQ ID NO: 65573 - RNA, 22 nt, Human
ugcuucuuuccuuggugacuuc

SEQ ID NO: 65574 - RNA, 22 nt, Human
ugcuuagcggugggggcuccau

SEQ ID NO: 65575 - RNA, 22 nt, Human
ugcuucucacuucuugguuucc

SEQ ID NO: 65576 - RNA, 22 nt, Human
ugcuucuuuaggauguaguuau

SEQ ID NO: 65577 - RNA, 22 nt, Human
ucucuccuccacaccgggugcu

SEQ ID NO: 65578 - RNA, 22 nt, Human
ugcuucuuugggggugaagaga

SEQ ID NO: 65579 - RNA, 22 nt, Human
ucucuacugcuucugugaguga

SEQ ID NO: 65580 - RNA, 22 nt, Human
ucucuacuuggcuuguguucac

SEQ ID NO: 65581 - RNA, 22 nt, Human
ugcuuacgcaaccuguguuugg

SEQ ID NO: 65582 - RNA, 22 nt, Human
ucucugaggacagaaaguuugu

SEQ ID NO: 65583 - RNA, 22 nt, Human
ugcuuggagaaucagucccagc

SEQ ID NO: 65584 - RNA, 22 nt, Human
ugcuuggauuuccaaaugguuu

SEQ ID NO: 65585 - RNA, 22 nt, Human
ugcuugugcacacacauguuau

SEQ ID NO: 65586 - RNA, 22 nt, Human
ucucuguacauagugaagcccg

SEQ ID NO: 65587 - RNA, 22 nt, Human
ucucugucucccguguguccgg

SEQ ID NO: 65588 - RNA, 22 nt, Human
ucucuucacuuguaugcuauca

SEQ ID NO: 65589 - RNA, 20 nt, Human
ucucuuuuucuucuuuucuc

SEQ ID NO: 65590 - RNA, 22 nt, Human
ugcuuuccuucccuauguugag

SEQ ID NO: 65591 - RNA, 22 nt, Human
ugcuuuauucgacaucugguag

SEQ ID NO: 65592 - RNA, 22 nt, Human
ucugaagagaacucuuaguguu

SEQ ID NO: 65593 - RNA, 18 nt, Human
ucugaaggaaugauucca

SEQ ID NO: 65594 - RNA, 21 nt, Human
ugcuuucugugcuuuuucugc

SEQ ID NO: 65595 - RNA, 21 nt, Human
ugcuuuuguugucagcugcug

SEQ ID NO: 65596 - RNA, 22 nt, Human
ugcuuuuguaucagaguauuca

SEQ ID NO: 65597 - RNA, 22 nt, Human
ucugaccaggcucuuguagccu

SEQ ID NO: 65598 - RNA, 22 nt, Human
uggaaaagaugucuuccugaau

SEQ ID NO: 65599 - RNA, 22 nt, Human
uggaaaauuuagaaagauuuau

SEQ ID NO: 65600 - RNA, 22 nt, Human
ucugagagcuguagaagccuau

SEQ ID NO: 65601 - RNA, 22 nt, Human
ucugaggaauaagaugucuaaa

SEQ ID NO: 65602 - RNA, 22 nt, Human
ucugaguagaaucauucauaaa

SEQ ID NO: 65603 - RNA, 22 nt, Human
ucugaguuaaaauuccagaggu

SEQ ID NO: 65604 - RNA, 23 nt, Human
uggaagaaaaugguuuggcugug

SEQ ID NO: 65605 - RNA, 17 nt, Human
ucugcagaggcaaaccu

SEQ ID NO: 65606 - RNA, 22 nt, Human
ucugaugaccacaugugggacu

SEQ ID NO: 65607 - RNA, 20 nt, Human
ucugcuugucuucagguucc

SEQ ID NO: 65608 - RNA, 22 nt, Human
uggaagcuggcugaucugacuu

SEQ ID NO: 65609 - RNA, 22 nt, Human
uggaagcuagggguuucuguug

SEQ ID NO: 65610 - RNA, 22 nt, Human
uggaagaaaugguugagccaug

SEQ ID NO: 65611 - RNA, 19 nt, Human
uggaagugauaguauagua

SEQ ID NO: 65612 - RNA, 22 nt, Human
uggaagggguuacgcagcagga

SEQ ID NO: 65613 - RNA, 22 nt, Human
ucuggcucuccagugcucuuag

SEQ ID NO: 65614 - RNA, 22 nt, Human
ucugguagauuauuuagaguac

SEQ ID NO: 65615 - RNA, 22 nt, Human
ucugugugugugcauaugcaug

SEQ ID NO: 65616 - RNA, 21 nt, Human
ucuguuguguguugaggacuu

SEQ ID NO: 65617 - RNA, 22 nt, Human
ucuguuuacaugucagcagcaa

SEQ ID NO: 65618 - RNA, 22 nt, Human
ucuguuucaggggucuggaaug

SEQ ID NO: 65619 - RNA, 22 nt, Human
ucuguuuuccaggaaucucaua

SEQ ID NO: 65620 - RNA, 22 nt, Human
ucuguuuuuaucuauucuguua

SEQ ID NO: 65621 - RNA, 22 nt, Human
ucuguuuuucagaccuuuuugg

SEQ ID NO: 65622 - RNA, 22 nt, Human
ucuguaguaugguacuuauuua

SEQ ID NO: 65623 - RNA, 22 nt, Human
ucuguaccuuauguucagagug

SEQ ID NO: 65624 - RNA, 22 nt, Human
ucuguagcuuuagaggacagga

SEQ ID NO: 65625 - RNA, 22 nt, Human
ucugggagaguagauaaaggaa

SEQ ID NO: 65626 - RNA, 23 nt, Human
uggaaguugagagucugcuuugu

SEQ ID NO: 65627 - RNA, 22 nt, Human
ucugucucugucaggcugcugc

SEQ ID NO: 65628 - RNA, 22 nt, Human
ucugugcuggacugauuucaua

SEQ ID NO: 65629 - RNA, 22 nt, Human
ucuucagacuguuguucuuuug

SEQ ID NO: 65630 - RNA, 22 nt, Human
ucuucaaauacagucauauuga

SEQ ID NO: 65631 - RNA, 22 nt, Human
ucuuauuucuuucuuuuccugu

SEQ ID NO: 65632 - RNA, 22 nt, Human
uggcaagcuguuggcagauagc

SEQ ID NO: 65633 - RNA, 22 nt, Human
uggcaacucaauuucuacaaga

SEQ ID NO: 65634 - RNA, 22 nt, Human
uggauuuuggaauguuucagua

SEQ ID NO: 65635 - RNA, 19 nt, Human
ucuuccaucuauccuccuc

SEQ ID NO: 65636 - RNA, 22 nt, Human
ucuuccagauacuuccugacuu

SEQ ID NO: 65637 - RNA, 22 nt, Human
ucuucauuucuggggaauuggc

SEQ ID NO: 65638 - RNA, 22 nt, Human
ucuucaugaaauugauugcuua

SEQ ID NO: 65639 - RNA, 22 nt, Human
ucuucuguguguagugguugug

SEQ ID NO: 65640 - RNA, 22 nt, Human
ucuucuuaggaaagucaggagg

SEQ ID NO: 65641 - RNA, 22 nt, Human
ucuucuauaucuacauaugcaa

SEQ ID NO: 65642 - RNA, 22 nt, Human
ucuuccuuguaagggcuuuaga

SEQ ID NO: 65643 - RNA, 22 nt, Human
ucuuccuuacucuggauguuau

SEQ ID NO: 65644 - RNA, 21 nt, Human
ucuucccaggccuuaaagggc

SEQ ID NO: 65645 - RNA, 22 nt, Human
uggcaucucggugcugguucuu

SEQ ID NO: 65646 - RNA, 22 nt, Human
ucuugcucuguucuaaaggauu

SEQ ID NO: 65647 - RNA, 22 nt, Human
uggccucauggccuuaucuggg

SEQ ID NO: 65648 - RNA, 22 nt, Human
ucuuuaucugugagcagucucc

SEQ ID NO: 65649 - RNA, 22 nt, Human
uggcgugaagcuggaaggcgga

SEQ ID NO: 65650 - RNA, 22 nt, Human
uggcucaggccuacgacgccuu

SEQ ID NO: 65651 - RNA, 22 nt, Human
ucuuuuucccugguuccuuuuu

SEQ ID NO: 65652 - RNA, 22 nt, Human
ugaaaaauauuuuuagaaauaa

SEQ ID NO: 65653 - RNA, 22 nt, Human
ugaaagccuacagcucacuguu

SEQ ID NO: 65654 - RNA, 22 nt, Human
uggcucaguaaucgagucuccu

SEQ ID NO: 65655 - RNA, 22 nt, Human
ugacguuugcgccgcgcacgac

SEQ ID NO: 65656 - RNA, 22 nt, Human
uggguauauauguugcuacaga

SEQ ID NO: 65657 - RNA, 22 nt, Human
ugagaaaacaguuuguaauaau

SEQ ID NO: 65658 - RNA, 22 nt, Human
ugagaaauauacaccagacaca

SEQ ID NO: 65659 - RNA, 22 nt, Human
ugagaacacuuuucucuuugcu

SEQ ID NO: 65660 - RNA, 20 nt, Human
uggguucaguuguuucuggc

SEQ ID NO: 65661 - RNA, 22 nt, Human
ugagaggaagggaaagaugauu

SEQ ID NO: 65662 - RNA, 22 nt, Human
ugagagaggugaaaugacuuuc

SEQ ID NO: 65663 - RNA, 22 nt, Human
ugagauguaauguaguacuuug

SEQ ID NO: 65664 - RNA, 19 nt, Human
ugagauuguaugaggagau

SEQ ID NO: 65665 - RNA, 22 nt, Human
ugagauucuguucagaaaaaug

SEQ ID NO: 65666 - RNA, 22 nt, Human
ugagcagagcacuugggaacga

SEQ ID NO: 65667 - RNA, 22 nt, Human
ugagcaaacacagauaggcuua

SEQ ID NO: 65668 - RNA, 22 nt, Human
uggugcuuuuguggaugcuaac

SEQ ID NO: 65669 - RNA, 22 nt, Human
ugagggaagguugauaauguuc

SEQ ID NO: 65670 - RNA, 22 nt, Human
ugaggaugagaaggaagagaag

SEQ ID NO: 65671 - RNA, 22 nt, Human
ugguuuguauauguuugugaga

SEQ ID NO: 65672 - RNA, 22 nt, Human
ugauauaaaagauucuuauuga

SEQ ID NO: 65673 - RNA, 22 nt, Human
ugaucaacagggcuggaaagag

SEQ ID NO: 65674 - RNA, 23 nt, Human
uguaaaacaccguuauugcaccu

SEQ ID NO: 65675 - RNA, 22 nt, Human
ugauagcaugcucucaguaaaa

SEQ ID NO: 65676 - RNA, 22 nt, Human
ugaucuuugcuuuuggcuuagu

SEQ ID NO: 65677 - RNA, 23 nt, Human
uguacugucuuucagguucuuau

SEQ ID NO: 65678 - RNA, 22 nt, Human
uguacuuguaauaucagugaaa

SEQ ID NO: 65679 - RNA, 22 nt, Human
uguagaaguuaauugaugagua

SEQ ID NO: 65680 - RNA, 22 nt, Human
ugucacaccuggcgauaauggg

SEQ ID NO: 65681 - RNA, 22 nt, Human
ugucacagugcacagcuaagaa

SEQ ID NO: 65682 - RNA, 22 nt, Human
ugauuuguuuaaauugcucguu

SEQ ID NO: 65683 - RNA, 22 nt, Human
ugauuugaaaccuuuggcaaga

SEQ ID NO: 65684 - RNA, 22 nt, Human
ugauuuggcaucaguguauccu

SEQ ID NO: 65685 - RNA, 22 nt, Human
ugauuugguauccaggauuuaa

SEQ ID NO: 65686 - RNA, 22 nt, Human
uguagacaugcuuuucugauga

SEQ ID NO: 65687 - RNA, 22 nt, Human
ugauugguauguauguuuguca

SEQ ID NO: 65688 - RNA, 22 nt, Human
uguaauucuaauccagagcugg

SEQ ID NO: 65689 - RNA, 22 nt, Human
ugcaacuacccccaggauuuua

SEQ ID NO: 65690 - RNA, 22 nt, Human
ugucacguaaaaacuagauuuc

SEQ ID NO: 65691 - RNA, 22 nt, Human
ugucacuuaagguuggugucuc

SEQ ID NO: 65692 - RNA, 20 nt, Human
ugucccuggagagcugcaga

SEQ ID NO: 65693 - RNA, 22 nt, Human
ugucugaauuguaauguugcgu

SEQ ID NO: 65694 - RNA, 22 nt, Human
ugucuagacauuagcuucagcu

SEQ ID NO: 65695 - RNA, 22 nt, Human
ugucucuagggcagauagagug

SEQ ID NO: 65696 - RNA, 21 nt, Human
ugcaaugcauugacagcagca

SEQ ID NO: 65697 - RNA, 16 nt, Human
ugucucuucccaguuc

SEQ ID NO: 65698 - RNA, 21 nt, Human
ugucugcaauuccagggaacc

SEQ ID NO: 65699 - RNA, 22 nt, Human
ugcaauggauaucugaacgugg

SEQ ID NO: 65700 - RNA, 22 nt, Human
ugcacagagggaggcauaaaau

SEQ ID NO: 65701 - RNA, 22 nt, Human
ugcagaauauucuggugacaau

SEQ ID NO: 65702 - RNA, 22 nt, Human
ugcagacuguuucuugacugaa

SEQ ID NO: 65703 - RNA, 22 nt, Human
ugcagaggagcuggaaggcugg

SEQ ID NO: 65704 - RNA, 22 nt, Human
ugcagagagccagcucucucgg

SEQ ID NO: 65705 - RNA, 22 nt, Human
ugucuuuagagugaacagaaga

SEQ ID NO: 65706 - RNA, 22 nt, Human
ugugaaugacuuuguucuuugc

SEQ ID NO: 65707 - RNA, 23 nt, Human
ugugaauggccuucuuuagaggu

SEQ ID NO: 65708 - RNA, 22 nt, Human
ugugaaugacuguguucuuugc

SEQ ID NO: 65709 - RNA, 22 nt, Human
ugugaaggaaaguaggagggac

SEQ ID NO: 65710 - RNA, 22 nt, Human
ugugaagaauuaaugugaauca

SEQ ID NO: 65711 - RNA, 22 nt, Human
ugucuuuuaaaaauguguaaaa

SEQ ID NO: 65712 - RNA, 22 nt, Human
ugcagccucacgcauccgcauu

SEQ ID NO: 65713 - RNA, 22 nt, Human
ugugagcugccacuucuaaucu

SEQ ID NO: 65714 - RNA, 19 nt, Human
ugcagcuguaugagcuuaa

SEQ ID NO: 65715 - RNA, 22 nt, Human
ugugauaauauuauuagagcuc

SEQ ID NO: 65716 - RNA, 22 nt, Human
ugcagcuucucugcaacaggag

SEQ ID NO: 65717 - RNA, 22 nt, Human
ugcagcuuuugguuucuagaug

SEQ ID NO: 65718 - RNA, 18 nt, Human
ugcagcuuugugauuggc

SEQ ID NO: 65719 - RNA, 22 nt, Human
ugcaucccaaacaugguuuccu

SEQ ID NO: 65720 - RNA, 22 nt, Human
ugcauguuauuguggcaagaau

SEQ ID NO: 65721 - RNA, 22 nt, Human
ugccagcuccgaggagcugcag

SEQ ID NO: 65722 - RNA, 22 nt, Human
ugccccuagaggcguugcagcu

SEQ ID NO: 65723 - RNA, 22 nt, Human
ugccgccccggggcccccagcc

SEQ ID NO: 65724 - RNA, 17 nt, Human
uguguauucuccaggug

SEQ ID NO: 65725 - RNA, 22 nt, Human
ugugucuuuggcgaugucugga

SEQ ID NO: 65726 - RNA, 22 nt, Human
uguguggccuccauaggguacu

SEQ ID NO: 65727 - RNA, 22 nt, Human
uguguggaggugggugaugucu

SEQ ID NO: 65728 - RNA, 22 nt, Human
ugccugucuaucuuugucaucu

SEQ ID NO: 65729 - RNA, 22 nt, Human
ugugucuccacugugcuauuuu

SEQ ID NO: 65730 - RNA, 22 nt, Human
uguuggauuuugugaaauauga

SEQ ID NO: 65731 - RNA, 21 nt, Human
uguuggccuucauucucuguc

SEQ ID NO: 65732 - RNA, 18 nt, Human
uguugguguucacucacu

SEQ ID NO: 65733 - RNA, 21 nt, Human
uguugguugugggaaggagga

SEQ ID NO: 65734 - RNA, 22 nt, Human
ugcucgauuauuucauuuugca

SEQ ID NO: 65735 - RNA, 22 nt, Human
ugcucuguucaguguaucuugu

SEQ ID NO: 65736 - RNA, 22 nt, Human
ugcucuguuuuaacucuuucaa

SEQ ID NO: 65737 - RNA, 22 nt, Human
ugcucugcuaggagaagaauga

SEQ ID NO: 65738 - RNA, 22 nt, Human
ugcucuuucaggcauagaccuu

SEQ ID NO: 65739 - RNA, 22 nt, Human
uguuguaaacagaggagccauu

SEQ ID NO: 65740 - RNA, 22 nt, Human
uguuguucuuuuucuucuuguu

SEQ ID NO: 65741 - RNA, 22 nt, Human
uguuguuguuguuguuguuguu

SEQ ID NO: 65742 - RNA, 22 nt, Human
uguuuccuguaccacagguuuu

SEQ ID NO: 65743 - RNA, 22 nt, Human
uguuugagaauuugcugauguu

SEQ ID NO: 65744 - RNA, 22 nt, Human
uguuuaagugguuaaaggauuc

SEQ ID NO: 65745 - RNA, 22 nt, Human
uguuuagcucugacuaugugau

SEQ ID NO: 65746 - RNA, 22 nt, Human
uguuuaucaguagacucaaguu

SEQ ID NO: 65747 - RNA, 22 nt, Human
ugcucuuuguagcugcuuugcu

SEQ ID NO: 65748 - RNA, 22 nt, Human
uguuuuucaagcauuuauuaau

SEQ ID NO: 65749 - RNA, 22 nt, Human
uguuuuguuuagguuuguuuuu

SEQ ID NO: 65750 - RNA, 22 nt, Human
uguuuuuagcuguuuuuuggau

SEQ ID NO: 65751 - RNA, 22 nt, Human
uguuuuuauucuuaauguuuca

SEQ ID NO: 65752 - RNA, 22 nt, Human
uguuuucuuuccccuucuuuuc

SEQ ID NO: 65753 - RNA, 22 nt, Human
uguuugaugugcacgugugugu

SEQ ID NO: 65754 - RNA, 22 nt, Human
uuaaagaguuuauuacuuguaa

SEQ ID NO: 65755 - RNA, 22 nt, Human
ugcuggaguggcacuguguggc

SEQ ID NO: 65756 - RNA, 22 nt, Human
uuaacgaauugugcauaauucc

SEQ ID NO: 65757 - RNA, 22 nt, Human
ugcuggugauuaaauccugaag

SEQ ID NO: 65758 - RNA, 22 nt, Human
uuaagagaagaguaucuagaac

SEQ ID NO: 65759 - RNA, 22 nt, Human
uuaauugggugcuuuguaaaua

SEQ ID NO: 65760 - RNA, 22 nt, Human
ugcuugacucagcaucggcaau

SEQ ID NO: 65761 - RNA, 22 nt, Human
ugcuugaacccaggaaguggag

SEQ ID NO: 65762 - RNA, 22 nt, Human
ugcuugaggcuugucaucuaac

SEQ ID NO: 65763 - RNA, 22 nt, Human
ugcuugcuaucuaaguguuuca

SEQ ID NO: 65764 - RNA, 22 nt, Human
ugcuugggucuguuuugcaaag

SEQ ID NO: 65765 - RNA, 21 nt, Human
uuaaugcuaugcagaaaaucu

SEQ ID NO: 65766 - RNA, 22 nt, Human
uuaauguugacacacuagcaca

SEQ ID NO: 65767 - RNA, 22 nt, Human
uuaauucuugagcugucuuucc

SEQ ID NO: 65768 - RNA, 22 nt, Human
ugcuguugacuuuguuguucuu

SEQ ID NO: 65769 - RNA, 22 nt, Human
ugcugugcuggcggcagaggcc

SEQ ID NO: 65770 - RNA, 22 nt, Human
uuaacauuguccuuagcagauu

SEQ ID NO: 65771 - RNA, 22 nt, Human
uuaauaaauugugguaccagag

SEQ ID NO: 65772 - RNA, 22 nt, Human
uuaaugcagguacuguuacaau

SEQ ID NO: 65773 - RNA, 22 nt, Human
ugcuuaucuccuuaguuuuugc

SEQ ID NO: 65774 - RNA, 22 nt, Human
ugcuucucucuaggaagacgcu

SEQ ID NO: 65775 - RNA, 22 nt, Human
ugcuuucagauaucuguuucaa

SEQ ID NO: 65776 - RNA, 22 nt, Human
uuaccuaagaaacucauuucgu

SEQ ID NO: 65777 - RNA, 22 nt, Human
ugcuuucaaaacucagaggaau

SEQ ID NO: 65778 - RNA, 22 nt, Human
ugcuuucaaugaauuguauacu

SEQ ID NO: 65779 - RNA, 22 nt, Human
ugcuuguuuuguggcuucagcu

SEQ ID NO: 65780 - RNA, 22 nt, Human
uuacaagaucuuugaaggcaag

SEQ ID NO: 65781 - RNA, 22 nt, Human
ugcuuguuuguuuucuuccauu

SEQ ID NO: 65782 - RNA, 22 nt, Human
uuacacaugaagguccaauguu

SEQ ID NO: 65783 - RNA, 22 nt, Human
uuacaucacuuuacuuaauaau

SEQ ID NO: 65784 - RNA, 19 nt, Human
uuacaugacauaugaagga

SEQ ID NO: 65785 - RNA, 22 nt, Human
uuacaugcuugugcagguuuug

SEQ ID NO: 65786 - RNA, 22 nt, Human
uuaccauaguacuaucaguuua

SEQ ID NO: 65787 - RNA, 22 nt, Human
ugcuuuggcccaacauugaugc

SEQ ID NO: 65788 - RNA, 22 nt, Human
ugcuuuuggcagcaguguuuau

SEQ ID NO: 65789 - RNA, 22 nt, Human
uuacucucugaggcacucaaaa

SEQ ID NO: 65790 - RNA, 22 nt, Human
uggaaaacgcaguuuaauuuuu

SEQ ID NO: 65791 - RNA, 20 nt, Human
uuacugagguauuuuuauca

SEQ ID NO: 65792 - RNA, 22 nt, Human
uuacuguguguaaaauaucuuu

SEQ ID NO: 65793 - RNA, 22 nt, Human
uggaaauacaagaaguauguca

SEQ ID NO: 65794 - RNA, 22 nt, Human
uggaaaguuggaagucucagga

SEQ ID NO: 65795 - RNA, 22 nt, Human
uuagacaucaagaagccaaugu

SEQ ID NO: 65796 - RNA, 22 nt, Human
uuagagaagcacuguaggugaa

SEQ ID NO: 65797 - RNA, 22 nt, Human
uuagaaauguccuacuaauaug

SEQ ID NO: 65798 - RNA, 22 nt, Human
uuacuuaucugaugugauuuuu

SEQ ID NO: 65799 - RNA, 22 nt, Human
uggaaauaguugugagucaggc

SEQ ID NO: 65800 - RNA, 22 nt, Human
uggaaaugcuuagaggugaucu

SEQ ID NO: 65801 - RNA, 22 nt, Human
uuagaugaaaaucggaacaugu

SEQ ID NO: 65802 - RNA, 22 nt, Human
uuagaugcugugauuuuucaaa

SEQ ID NO: 65803 - RNA, 22 nt, Human
uuaggaauugcuucauguuugg

SEQ ID NO: 65804 - RNA, 22 nt, Human
uuaggagugaguuacuuagggu

SEQ ID NO: 65805 - RNA, 22 nt, Human
uuaggcugcuuuggaaaacugu

SEQ ID NO: 65806 - RNA, 22 nt, Human
uggaagaagcuacaagcgguga

SEQ ID NO: 65807 - RNA, 22 nt, Human
uuaguauuuuuugaaugaugaa

SEQ ID NO: 65808 - RNA, 22 nt, Human
uggaagaucugguguagcuccu

SEQ ID NO: 65809 - RNA, 22 nt, Human
uggaagcccagaaggaagcaga

SEQ ID NO: 65810 - RNA, 20 nt, Human
uggaaggaaagguguaucuu

SEQ ID NO: 65811 - RNA, 22 nt, Human
uggaaggggccaggcgcggagu

SEQ ID NO: 65812 - RNA, 22 nt, Human
uggaaggugauucucugguuaa

SEQ ID NO: 65813 - RNA, 22 nt, Human
uggaaguggcaggggagacgua

SEQ ID NO: 65814 - RNA, 22 nt, Human
uuagugaagaagcaucuuuagu

SEQ ID NO: 65815 - RNA, 22 nt, Human
uuaguggguuccauuucuaugg

SEQ ID NO: 65816 - RNA, 22 nt, Human
uuaguuaauaaauauugagugu

SEQ ID NO: 65817 - RNA, 20 nt, Human
uuaguuacuuagugagaguc

SEQ ID NO: 65818 - RNA, 22 nt, Human
uuaguuauaggugaaucagaga

SEQ ID NO: 65819 - RNA, 22 nt, Human
uuauaaaccgcuaacagcacuu

SEQ ID NO: 65820 - RNA, 22 nt, Human
uggaaugaaagaaaaauuguag

SEQ ID NO: 65821 - RNA, 22 nt, Human
uggaaugccgggccaggcuccg

SEQ ID NO: 65822 - RNA, 18 nt, Human
uuauacaauuuuuuuuca

SEQ ID NO: 65823 - RNA, 22 nt, Human
uuauacugaaagucuuuuaaua

SEQ ID NO: 65824 - RNA, 22 nt, Human
uggagaugcacgagcaggugga

SEQ ID NO: 65825 - RNA, 22 nt, Human
uggagauauucuauauuuuaua

SEQ ID NO: 65826 - RNA, 22 nt, Human
uggagaaauaacauuuggauuc

SEQ ID NO: 65827 - RNA, 22 nt, Human
uggagagauagucauucuagag

SEQ ID NO: 65828 - RNA, 22 nt, Human
uggagagaaguucuauaaauca

SEQ ID NO: 65829 - RNA, 22 nt, Human
uggagagcaaugaggggcaggc

SEQ ID NO: 65830 - RNA, 22 nt, Human
uuaucaaaaaauaguacuuuga

SEQ ID NO: 65831 - RNA, 22 nt, Human
uggagcugaaguacucucacua

SEQ ID NO: 65832 - RNA, 22 nt, Human
uggagccuugugagaccacaau

SEQ ID NO: 65833 - RNA, 22 nt, Human
uuaugccuguuaggcagcaucu

SEQ ID NO: 65834 - RNA, 22 nt, Human
uuauggauuagaguuugauucu

SEQ ID NO: 65835 - RNA, 22 nt, Human
uuaugggguuaaauuucuccua

SEQ ID NO: 65836 - RNA, 22 nt, Human
uucauuuuauauuagagcuguu

SEQ ID NO: 65837 - RNA, 22 nt, Human
uuccaugccccucuuuggguac

SEQ ID NO: 65838 - RNA, 22 nt, Human
uuccacauucggaauuuucuga

SEQ ID NO: 65839 - RNA, 22 nt, Human
uuccaagcaccaugaaggccuc

SEQ ID NO: 65840 - RNA, 22 nt, Human
uuccacaugaucauuguaauaa

SEQ ID NO: 65841 - RNA, 22 nt, Human
uggcuuauggguccucccucuu

SEQ ID NO: 65842 - RNA, 22 nt, Human
ugggaagaguuagagacagcug

SEQ ID NO: 65843 - RNA, 22 nt, Human
ugggaaggggagcuggaaagga

SEQ ID NO: 65844 - RNA, 22 nt, Human
ugggaaaauagcuauuuugaaa

SEQ ID NO: 65845 - RNA, 22 nt, Human
ugggaagaggaggcagggggca

SEQ ID NO: 65846 - RNA, 21 nt, Human
uuccuccucuggagaagaaga

SEQ ID NO: 65847 - RNA, 22 nt, Human
uuccucuugaaucugucugacu

SEQ ID NO: 65848 - RNA, 21 nt, Human
uuccuaaaaugcuuuugugcc

SEQ ID NO: 65849 - RNA, 22 nt, Human
uuccuaagugcugguaugaggc

SEQ ID NO: 65850 - RNA, 22 nt, Human
uuccuaauguccaccuaguccu

SEQ ID NO: 65851 - RNA, 22 nt, Human
uucccugggggggccgcuuucc

SEQ ID NO: 65852 - RNA, 22 nt, Human
uucccuacuagccuuaauguuu

SEQ ID NO: 65853 - RNA, 22 nt, Human
uuccuggaguggagggagguga

SEQ ID NO: 65854 - RNA, 20 nt, Human
uuccuuucuuucuuuuuuuu

SEQ ID NO: 65855 - RNA, 22 nt, Human
uuccuuuucuucuaccacaugu

SEQ ID NO: 65856 - RNA, 22 nt, Human
uucuccucaaaccaucagacau

SEQ ID NO: 65857 - RNA, 22 nt, Human
uucuccugacuggccauucagu

SEQ ID NO: 65858 - RNA, 22 nt, Human
uggguagcucaauagagccaca

SEQ ID NO: 65859 - RNA, 22 nt, Human
uucucaauggcaacuuguugcu

SEQ ID NO: 65860 - RNA, 22 nt, Human
uggggcuccaguagagaaggca

SEQ ID NO: 65861 - RNA, 22 nt, Human
uggggcuggccaggaggagucu

SEQ ID NO: 65862 - RNA, 22 nt, Human
uggggcugguaccguaauauau

SEQ ID NO: 65863 - RNA, 21 nt, Human
uucuauauugagaauuggcua

SEQ ID NO: 65864 - RNA, 22 nt, Human
uggguucaaauccugguuccac

SEQ ID NO: 65865 - RNA, 23 nt, Human
uggguuucagugccaaugcugcc

SEQ ID NO: 65866 - RNA, 22 nt, Human
uggguuugcuuguucagguucu

SEQ ID NO: 65867 - RNA, 22 nt, Human
uucucgaacaaccuacagggug

SEQ ID NO: 65868 - RNA, 22 nt, Human
uucuggagucuauuuugaaaag

SEQ ID NO: 65869 - RNA, 22 nt, Human
ugguacaaaaaagauuuuggac

SEQ ID NO: 65870 - RNA, 22 nt, Human
ugguaaaguguacugaauauga

SEQ ID NO: 65871 - RNA, 22 nt, Human
ugguaacgguuuccuugccauu

SEQ ID NO: 65872 - RNA, 22 nt, Human
uucugcuagugguauauguuga

SEQ ID NO: 65873 - RNA, 20 nt, Human
uucugcucuagagucuagaa

SEQ ID NO: 65874 - RNA, 22 nt, Human
ugguauaaaaaaaugaguauaa

SEQ ID NO: 65875 - RNA, 22 nt, Human
uggucaaauccuagauccuuug

SEQ ID NO: 65876 - RNA, 22 nt, Human
ugguaugaaggaggccggcagc

SEQ ID NO: 65877 - RNA, 22 nt, Human
uggucccuagugugggagcuug

SEQ ID NO: 65878 - RNA, 22 nt, Human
uggucccugaagagagaccuug

SEQ ID NO: 65879 - RNA, 22 nt, Human
ugguauauuugaccauaugugu

SEQ ID NO: 65880 - RNA, 22 nt, Human
uugaaaucuucccuccugucug

SEQ ID NO: 65881 - RNA, 22 nt, Human
uguaggcacauguauauauccc

SEQ ID NO: 65882 - RNA, 22 nt, Human
uguagggaucugccucuuccuc

SEQ ID NO: 65883 - RNA, 22 nt, Human
uguagucucagggagcugcuuc

SEQ ID NO: 65884 - RNA, 22 nt, Human
uguacauacauagauauacaca

SEQ ID NO: 65885 - RNA, 17 nt, Human
uguaccgaguguguaua

SEQ ID NO: 65886 - RNA, 22 nt, Human
uugaaaaaugcccagcagacaa

SEQ ID NO: 65887 - RNA, 20 nt, Human
uguacuauaaaagguugagu

SEQ ID NO: 65888 - RNA, 22 nt, Human
ugguugauuaauuuugccaagc

SEQ ID NO: 65889 - RNA, 22 nt, Human
ugguuagucaugguacugcagc

SEQ ID NO: 65890 - RNA, 22 nt, Human
ugguuuuuuguaggauaaacau

SEQ ID NO: 65891 - RNA, 22 nt, Human
uggucuccucuuaauugccuac

SEQ ID NO: 65892 - RNA, 22 nt, Human
uucugugcugagaaauagagag

SEQ ID NO: 65893 - RNA, 22 nt, Human
uucugugacuccucagagauuu

SEQ ID NO: 65894 - RNA, 22 nt, Human
uggugccuuccgagagcuguga

SEQ ID NO: 65895 - RNA, 22 nt, Human
uucuguguauggaagaaugucc

SEQ ID NO: 65896 - RNA, 22 nt, Human
uucuugagaacaaauuccugga

SEQ ID NO: 65897 - RNA, 22 nt, Human
uucuugcgaaagaaugagcuga

SEQ ID NO: 65898 - RNA, 22 nt, Human
uucuugcuucucugucugccuc

SEQ ID NO: 65899 - RNA, 22 nt, Human
ugguuacagaugaagaucggcc

SEQ ID NO: 65900 - RNA, 22 nt, Human
ugguuauggaacuggcuauggc

SEQ ID NO: 65901 - RNA, 22 nt, Human
uucuuugcucaccugccgcucc

SEQ ID NO: 65902 - RNA, 22 nt, Human
uugaaucauauguaauugacuu

SEQ ID NO: 65903 - RNA, 22 nt, Human
uugaauggaauuggaaucuuau

SEQ ID NO: 65904 - RNA, 21 nt, Human
uguauacacacauuguaccaa

SEQ ID NO: 65905 - RNA, 22 nt, Human
uugaggaagggaggcaaaacug

SEQ ID NO: 65906 - RNA, 22 nt, Human
ugucauuuauucucuuauucua

SEQ ID NO: 65907 - RNA, 22 nt, Human
uugaugagucacuuucuguaaa

SEQ ID NO: 65908 - RNA, 23 nt, Human
uugaucuggaaaauacuuguuug

SEQ ID NO: 65909 - RNA, 22 nt, Human
ugucucuuccuccucuugguac

SEQ ID NO: 65910 - RNA, 22 nt, Human
uugauucauuuguucccauuuu

SEQ ID NO: 65911 - RNA, 21 nt, Human
uugauuuagcagaucuagcug

SEQ ID NO: 65912 - RNA, 22 nt, Human
uugauuuggcguuuuccuccug

SEQ ID NO: 65913 - RNA, 22 nt, Human
uugcaagauaguguauuuuuca

SEQ ID NO: 65914 - RNA, 22 nt, Human
uugcagugucaucuagacgugg

SEQ ID NO: 65915 - RNA, 22 nt, Human
uugcaucagcaggcauaauugg

SEQ ID NO: 65916 - RNA, 22 nt, Human
ugucuucuuuucccuuagcccu

SEQ ID NO: 65917 - RNA, 22 nt, Human
uuggauugugaaaguauucucu

SEQ ID NO: 65918 - RNA, 22 nt, Human
uguguuacaauaauggcaagua

SEQ ID NO: 65919 - RNA, 22 nt, Human
ugugucauuugagaggagacga

SEQ ID NO: 65920 - RNA, 22 nt, Human
ugugugcacguacauacuguau

SEQ ID NO: 65921 - RNA, 22 nt, Human
uguguguguauacauguauaua

SEQ ID NO: 65922 - RNA, 22 nt, Human
uugcguaauuugagauuguaaa

SEQ ID NO: 65923 - RNA, 22 nt, Human
uuggaagugucuaauacaggua

SEQ ID NO: 65924 - RNA, 22 nt, Human
uuggaauuugagaccaagaaaa

SEQ ID NO: 65925 - RNA, 19 nt, Human
uuggacuaugaaaaaucag

SEQ ID NO: 65926 - RNA, 22 nt, Human
uguguagagcaugggguugugg

SEQ ID NO: 65927 - RNA, 22 nt, Human
uuggcaaagagaugcauaagga

SEQ ID NO: 65928 - RNA, 22 nt, Human
uuggcacagagcugcagccugg

SEQ ID NO: 65929 - RNA, 22 nt, Human
uuggauguggggauggaguggg

SEQ ID NO: 65930 - RNA, 22 nt, Human
uuggcaaaagauuggguacuua

SEQ ID NO: 65931 - RNA, 22 nt, Human
uuggcagagaacagaaugauuu

SEQ ID NO: 65932 - RNA, 22 nt, Human
uguguucagaagaggcugccgg

SEQ ID NO: 65933 - RNA, 21 nt, Human
uguguuuauauguguuuauau

SEQ ID NO: 65934 - RNA, 22 nt, Human
uguguuccugucuuauucuuau

SEQ ID NO: 65935 - RNA, 22 nt, Human
uuggcaggcugcauguuuaugu

SEQ ID NO: 65936 - RNA, 22 nt, Human
uuggcauuccagaugcuuuucu

SEQ ID NO: 65937 - RNA, 21 nt, Human
uuggcuacugcuucagaggga

SEQ ID NO: 65938 - RNA, 22 nt, Human
uguucaguuugcuaucauaauc

SEQ ID NO: 65939 - RNA, 22 nt, Human
uugggagaaaguuaacuuucua

SEQ ID NO: 65940 - RNA, 22 nt, Human
uguucggaaaagggcaagcuau

SEQ ID NO: 65941 - RNA, 22 nt, Human
uguuccuuuuguuguuuuguuu

SEQ ID NO: 65942 - RNA, 22 nt, Human
uuguauuaauacacuccuuuuc

SEQ ID NO: 65943 - RNA, 22 nt, Human
uuguauguuucugugcacauga

SEQ ID NO: 65944 - RNA, 22 nt, Human
uuguaagacuguagaaugcaaa

SEQ ID NO: 65945 - RNA, 22 nt, Human
uugucagcuagugaugcuguuc

SEQ ID NO: 65946 - RNA, 22 nt, Human
uugucaggaacuaugauuaugc

SEQ ID NO: 65947 - RNA, 22 nt, Human
uguuuaaauagaacauacugca

SEQ ID NO: 65948 - RNA, 22 nt, Human
uguuucaguaugauuuucccuc

SEQ ID NO: 65949 - RNA, 22 nt, Human
uugguuuuuugguguaucuuau

SEQ ID NO: 65950 - RNA, 22 nt, Human
uuggggcugcguguuuccaugu

SEQ ID NO: 65951 - RNA, 22 nt, Human
uuggggaugccccuacgggcua

SEQ ID NO: 65952 - RNA, 22 nt, Human
uuggggauugggugcaagggac

SEQ ID NO: 65953 - RNA, 22 nt, Human
uugggagaaauaguugauccgc

SEQ ID NO: 65954 - RNA, 22 nt, Human
uuggggcugcguauuuccaugu

SEQ ID NO: 65955 - RNA, 22 nt, Human
uugguauuuguuuaaauuacac

SEQ ID NO: 65956 - RNA, 22 nt, Human
uugguuuacucuggggauaucu

SEQ ID NO: 65957 - RNA, 22 nt, Human
uugguuuuauucguauuuguau

SEQ ID NO: 65958 - RNA, 21 nt, Human
uguuuuguaauagauacuaug

SEQ ID NO: 65959 - RNA, 22 nt, Human
uugucaugauccuucuguuagg

SEQ ID NO: 65960 - RNA, 22 nt, Human
uguuuucuauuaccugagauug

SEQ ID NO: 65961 - RNA, 22 nt, Human
uguuuguuuuguauuuuuaauu

SEQ ID NO: 65962 - RNA, 19 nt, Human
uugucuuagcugcauaaga

SEQ ID NO: 65963 - RNA, 22 nt, Human
uugugaggaugugcuuuuuagu

SEQ ID NO: 65964 - RNA, 22 nt, Human
uguuuuuuagagugauacuuuu

SEQ ID NO: 65965 - RNA, 22 nt, Human
uuaaaagaauccuguuauccuc

SEQ ID NO: 65966 - RNA, 22 nt, Human
uugugcucaguuguggucuauu

SEQ ID NO: 65967 - RNA, 22 nt, Human
uuguggacgcaauucaaggaua

SEQ ID NO: 65968 - RNA, 22 nt, Human
uuguggagaggaagcaaggagg

SEQ ID NO: 65969 - RNA, 23 nt, Human
uugugguuauauuugcccauuuu

SEQ ID NO: 65970 - RNA, 22 nt, Human
uugucccuaugagugguaauca

SEQ ID NO: 65971 - RNA, 22 nt, Human
uugugauuaauaacuuuucucu

SEQ ID NO: 65972 - RNA, 18 nt, Human
uugugccugagaaggugg

SEQ ID NO: 65973 - RNA, 22 nt, Human
uuuaccugucuguagaacauaa

SEQ ID NO: 65974 - RNA, 23 nt, Human
uuacuaugaaaauuccagucacu

SEQ ID NO: 65975 - RNA, 22 nt, Human
uuacuuucugggauaucaaaug

SEQ ID NO: 65976 - RNA, 22 nt, Human
uuuacuuguuuugcucuuuucc

SEQ ID NO: 65977 - RNA, 22 nt, Human
uuuaacauaugaaagaauauuu

SEQ ID NO: 65978 - RNA, 22 nt, Human
uuaauuguuagauagauuauag

SEQ ID NO: 65979 - RNA, 22 nt, Human
uuacaguuuacauaagaauugu

SEQ ID NO: 65980 - RNA, 22 nt, Human
uuuaaucaguugguaauauuga

SEQ ID NO: 65981 - RNA, 22 nt, Human
uuuagacuacuaugcugccaga

SEQ ID NO: 65982 - RNA, 22 nt, Human
uuuagagguacaguaggcauga

SEQ ID NO: 65983 - RNA, 22 nt, Human
uuuagauguucccucuacccug

SEQ ID NO: 65984 - RNA, 22 nt, Human
uuuagcaaaaaagcucugcgua

SEQ ID NO: 65985 - RNA, 22 nt, Human
uuacuuuuuucccccuuagaug

SEQ ID NO: 65986 - RNA, 22 nt, Human
uuagaaaaaggcuguggucuua

SEQ ID NO: 65987 - RNA, 17 nt, Human
uuagagcuacauguuga

SEQ ID NO: 65988 - RNA, 20 nt, Human
uuagaggccaugucuuguuu

SEQ ID NO: 65989 - RNA, 22 nt, Human
uuagagguuuuuuuccucauuc

SEQ ID NO: 65990 - RNA, 22 nt, Human
uuagaguucaagcuuuaggaaa

SEQ ID NO: 65991 - RNA, 22 nt, Human
uuagaguacaggauuguuuuaa

SEQ ID NO: 65992 - RNA, 22 nt, Human
uuagauaaaucagcccugagua

SEQ ID NO: 65993 - RNA, 22 nt, Human
uuagauaguaaauagcacuaag

SEQ ID NO: 65994 - RNA, 22 nt, Human
uuuaguauaguaugugcucaaa

SEQ ID NO: 65995 - RNA, 22 nt, Human
uuuaguugcuuuaguugagcug

SEQ ID NO: 65996 - RNA, 22 nt, Human
uuuauaagccagacacugcguu

SEQ ID NO: 65997 - RNA, 22 nt, Human
uuagaugugaucagcuggcuua

SEQ ID NO: 65998 - RNA, 22 nt, Human
uuagguuuaugaggucugcauu

SEQ ID NO: 65999 - RNA, 22 nt, Human
uuaguauuuucaccauaugagg

SEQ ID NO: 66000 - RNA, 19 nt, Human
uuaggguccauuuuuuuau

SEQ ID NO: 66001 - RNA, 22 nt, Human
uuuaugguacaggaaugcuguu

SEQ ID NO: 66002 - RNA, 22 nt, Human
uuuaugucaaaaguaaaaugaa

SEQ ID NO: 66003 - RNA, 22 nt, Human
uuaaaauuguuaacuuugguga

SEQ ID NO: 66004 - RNA, 22 nt, Human
uugugugugcccaccuguggcc

SEQ ID NO: 66005 - RNA, 22 nt, Human
uuguuauaggaucagugucacu

SEQ ID NO: 66006 - RNA, 22 nt, Human
uuguuauuauuauuuucguucu

SEQ ID NO: 66007 - RNA, 22 nt, Human
uuaaaucaggcaucauuucagu

SEQ ID NO: 66008 - RNA, 22 nt, Human
uuaaggcauagcuuguguugac

SEQ ID NO: 66009 - RNA, 22 nt, Human
uuguuccuaguuguccaucaca

SEQ ID NO: 66010 - RNA, 22 nt, Human
uuaauaaggaccugugacaugc

SEQ ID NO: 66011 - RNA, 22 nt, Human
uuguucacuaugaagagguugg

SEQ ID NO: 66012 - RNA, 22 nt, Human
uuguuccagaaacccaggggaa

SEQ ID NO: 66013 - RNA, 22 nt, Human
uuguuucauggggacgacuggc

SEQ ID NO: 66014 - RNA, 22 nt, Human
uuguuucagcuuccuccuccau

SEQ ID NO: 66015 - RNA, 22 nt, Human
uuguugcaagccuggaaucugg

SEQ ID NO: 66016 - RNA, 22 nt, Human
uuguuguuguuguuauuuaguu

SEQ ID NO: 66017 - RNA, 22 nt, Human
uuguuuaaagaacuucugacuu

SEQ ID NO: 66018 - RNA, 22 nt, Human
uuguuuucuaguguuuugaaua

SEQ ID NO: 66019 - RNA, 22 nt, Human
uuaaucuauuucauauaaggga

SEQ ID NO: 66020 - RNA, 22 nt, Human
uuaauauuaagauauugagugg

SEQ ID NO: 66021 - RNA, 22 nt, Human
uuaaucagacauucucaaguuu

SEQ ID NO: 66022 - RNA, 22 nt, Human
uuuaaaauguuuuauuuauuua

SEQ ID NO: 66023 - RNA, 22 nt, Human
uuuaaaccuaucuaagaaauag

SEQ ID NO: 66024 - RNA, 22 nt, Human
uuuaaauaguugguuuuuuugc

SEQ ID NO: 66025 - RNA, 22 nt, Human
uuuaaauuucugaaucuugagg

SEQ ID NO: 66026 - RNA, 22 nt, Human
uuaaugcauguaaaugugcaaa

SEQ ID NO: 66027 - RNA, 22 nt, Human
uuaauguggaagaguuuggcua

SEQ ID NO: 66028 - RNA, 22 nt, Human
uuuaaaccuuggaagccacaua

SEQ ID NO: 66029 - RNA, 22 nt, Human
uuaguuacuugacucaagaccc

SEQ ID NO: 66030 - RNA, 20 nt, Human
uucacagaucucuaacugag

SEQ ID NO: 66031 - RNA, 22 nt, Human
uucaaugcaagggaggucugaa

SEQ ID NO: 66032 - RNA, 22 nt, Human
uuuauguugagcaaaauaccac

SEQ ID NO: 66033 - RNA, 22 nt, Human
uuuauuuggugguguuacuguu

SEQ ID NO: 66034 - RNA, 22 nt, Human
uuaguuaccacugcagaucuuu

SEQ ID NO: 66035 - RNA, 22 nt, Human
uucagaagguaggaaugucccu

SEQ ID NO: 66036 - RNA, 22 nt, Human
uucagaauguacugauagaaca

SEQ ID NO: 66037 - RNA, 22 nt, Human
uucagaacugucuguccuuuuc

SEQ ID NO: 66038 - RNA, 22 nt, Human
uucacugugauguuuaagagaa

SEQ ID NO: 66039 - RNA, 22 nt, Human
uuugcuuugacuuugggaguau

SEQ ID NO: 66040 - RNA, 22 nt, Human
uucacuguucuuagagaagacc

SEQ ID NO: 66041 - RNA, 23 nt, Human
uuugccuaaugaagacuauguca

SEQ ID NO: 66042 - RNA, 22 nt, Human
uuugcuccucuucauuuguauc

SEQ ID NO: 66043 - RNA, 22 nt, Human
uucauauuuaauuggucaucaa

SEQ ID NO: 66044 - RNA, 22 nt, Human
uucauagaagggaguuuuuccu

SEQ ID NO: 66045 - RNA, 22 nt, Human
uucaggaaacaaauuugcaguu

SEQ ID NO: 66046 - RNA, 22 nt, Human
uucaggacacauuauuuaugaa

SEQ ID NO: 66047 - RNA, 22 nt, Human
uuuggcuaccugggagggaaag

SEQ ID NO: 66048 - RNA, 22 nt, Human
uuuggcuacucuucauugguga

SEQ ID NO: 66049 - RNA, 22 nt, Human
uuuggcugucauuugaaaaugu

SEQ ID NO: 66050 - RNA, 22 nt, Human
uucccuauaauauggcucuucu

SEQ ID NO: 66051 - RNA, 19 nt, Human
uuuguuguaucagagcuuu

SEQ ID NO: 66052 - RNA, 22 nt, Human
uucccuagagagauuuuuauuc

SEQ ID NO: 66053 - RNA, 21 nt, Human
uuuguucacacacagggcagc

SEQ ID NO: 66054 - RNA, 22 nt, Human
uuuguucaguuuguugugggug

SEQ ID NO: 66055 - RNA, 21 nt, Human
uuuguucaggggcaaaguuaa

SEQ ID NO: 66056 - RNA, 22 nt, Human
uuuguguuacaguccuagaacu

SEQ ID NO: 66057 - RNA, 22 nt, Human
uuuguguuuucaggcacauggc

SEQ ID NO: 66058 - RNA, 21 nt, Human
uucauucauggcauaauauag

SEQ ID NO: 66059 - RNA, 22 nt, Human
uucauggauuugugaaauuuag

SEQ ID NO: 66060 - RNA, 20 nt, Human
uuugugaggccagagaacag

SEQ ID NO: 66061 - RNA, 22 nt, Human
uuccaaggcugcuauuuguuuc

SEQ ID NO: 66062 - RNA, 22 nt, Human
uuccagauguuuaaguucugcu

SEQ ID NO: 66063 - RNA, 22 nt, Human
uuccagaacaauguggacguau

SEQ ID NO: 66064 - RNA, 21 nt, Human
uucgaaugggucguugcugcc

SEQ ID NO: 66065 - RNA, 22 nt, Human
uuuuaaauaaacuacacugauu

SEQ ID NO: 66066 - RNA, 22 nt, Human
uuuuaaauggcuuuuacuuuuc

SEQ ID NO: 66067 - RNA, 21 nt, Human
uuccuggaggcagaaacguga

SEQ ID NO: 66068 - RNA, 20 nt, Human
uuccuuaucuguaaagugga

SEQ ID NO: 66069 - RNA, 22 nt, Human
uuccuuuaaccaagagcaguac

SEQ ID NO: 66070 - RNA, 22 nt, Human
uuccuuuuuaauuaaucuaauu

SEQ ID NO: 66071 - RNA, 22 nt, Human
uuccugcuggucaaaguugccu

SEQ ID NO: 66072 - RNA, 22 nt, Human
uuuguuuuggugucaugcguga

SEQ ID NO: 66073 - RNA, 22 nt, Human
uuuuaaaagguugcuguuauaa

SEQ ID NO: 66074 - RNA, 20 nt, Human
uuccucaaaagucugaugcu

SEQ ID NO: 66075 - RNA, 22 nt, Human
uuccucauucuggggcauguug

SEQ ID NO: 66076 - RNA, 22 nt, Human
uucggcagaaagucauuugucu

SEQ ID NO: 66077 - RNA, 22 nt, Human
uucgucaauaugcagccuguga

SEQ ID NO: 66078 - RNA, 18 nt, Human
uucgucauggggaucgua

SEQ ID NO: 66079 - RNA, 22 nt, Human
uuuuacaaugcaaauucuugcu

SEQ ID NO: 66080 - RNA, 22 nt, Human
uuuuagaagcauuuaugagauu

SEQ ID NO: 66081 - RNA, 22 nt, Human
uuuuagccagaguuuaucacag

SEQ ID NO: 66082 - RNA, 23 nt, Human
uuuuccaaaucgacucucuaguu

SEQ ID NO: 66083 - RNA, 22 nt, Human
uuuuccgaccuuaggaaggaac

SEQ ID NO: 66084 - RNA, 22 nt, Human
uuuucauagccagaaacugaaa

SEQ ID NO: 66085 - RNA, 22 nt, Human
uucuauaagagaugaauacagu

SEQ ID NO: 66086 - RNA, 22 nt, Human
uucuaguuacucuuaaaugcug

SEQ ID NO: 66087 - RNA, 22 nt, Human
uuuuauguuccugaagcuaucu

SEQ ID NO: 66088 - RNA, 22 nt, Human
uuuuaucagagcuugcagugug

SEQ ID NO: 66089 - RNA, 22 nt, Human
uuuuaucuuacauggaaucucc

SEQ ID NO: 66090 - RNA, 22 nt, Human
uuuucuucucauucugaccuca

SEQ ID NO: 66091 - RNA, 22 nt, Human
uucuggaguuugaagaucaggu

SEQ ID NO: 66092 - RNA, 22 nt, Human
uuuucuacaaucacucuggaag

SEQ ID NO: 66093 - RNA, 22 nt, Human
uuuucuaggcccuggauuaugu

SEQ ID NO: 66094 - RNA, 22 nt, Human
uuuucggggcgacuuagguucu

SEQ ID NO: 66095 - RNA, 22 nt, Human
uuuuccuucugauacuccauuu

SEQ ID NO: 66096 - RNA, 22 nt, Human
uuuuccuucuuccugccuugcc

SEQ ID NO: 66097 - RNA, 22 nt, Human
uuuugagucuggcaguuuuguu

SEQ ID NO: 66098 - RNA, 22 nt, Human
uucugugacgcaaagcugggaa

SEQ ID NO: 66099 - RNA, 22 nt, Human
uuuucuuggaguggcuguccuu

SEQ ID NO: 66100 - RNA, 22 nt, Human
uuuugaauaauucagaaacagc

SEQ ID NO: 66101 - RNA, 22 nt, Human
uuuugcaaauuacuaaauuucu

SEQ ID NO: 66102 - RNA, 22 nt, Human
uucuguuuaaccuggaaagugu

SEQ ID NO: 66103 - RNA, 22 nt, Human
uucuguuuauaauuugcaguug

SEQ ID NO: 66104 - RNA, 22 nt, Human
uucuguuuuuauucuaucucug

SEQ ID NO: 66105 - RNA, 22 nt, Human
uucuuaaugcauccuguguuca

SEQ ID NO: 66106 - RNA, 22 nt, Human
uuuugguuugaguauuuuuuuu

SEQ ID NO: 66107 - RNA, 22 nt, Human
uucuuuucuucccuguuuauua

SEQ ID NO: 66108 - RNA, 22 nt, Human
uucuuuuaauuucugucugcag

SEQ ID NO: 66109 - RNA, 22 nt, Human
uucuuuuuagcugguuguaaga

SEQ ID NO: 66110 - RNA, 22 nt, Human
uuuuugcccuaaagaagucauu

SEQ ID NO: 66111 - RNA, 22 nt, Human
uuuuucugccucucucccacau

SEQ ID NO: 66112 - RNA, 22 nt, Human
uuuuuggacccaucuucuuuuu

SEQ ID NO: 66113 - RNA, 22 nt, Human
uucuuuguccuagcauucuaca

SEQ ID NO: 66114 - RNA, 21 nt, Human
uucuuugcugcuguuuuugua

SEQ ID NO: 66115 - RNA, 22 nt, Human
uucuuuuaauagagauccugug

SEQ ID NO: 66116 - RNA, 22 nt, Human
uuuuucuuugcuuuccacuggc

SEQ ID NO: 66117 - RNA, 22 nt, Human
uuuuucuuugguaacucuuccu

SEQ ID NO: 66118 - RNA, 22 nt, Human
uucuugugugaauauaauuaca

SEQ ID NO: 66119 - RNA, 21 nt, Human
uucuuugaagacccauuugag

SEQ ID NO: 66120 - RNA, 22 nt, Human
uucuuguccacagaagagcuca

SEQ ID NO: 66121 - RNA, 22 nt, Human
uucuugcuuccggugcuccagg

SEQ ID NO: 66122 - RNA, 22 nt, Human
uucuucuucuuccucauccuca

SEQ ID NO: 66123 - RNA, 22 nt, Human
uuuugucuguggaaagcugcua

SEQ ID NO: 66124 - RNA, 22 nt, Human
uucuucuguuggcagagcauac

SEQ ID NO: 66125 - RNA, 22 nt, Human
uuuugguaguccagaguuuagu

SEQ ID NO: 66126 - RNA, 22 nt, Human
uucuucauucccuuacuuccga

SEQ ID NO: 66127 - RNA, 22 nt, Human
uugaauaaggcauaaagauacu

SEQ ID NO: 66128 - RNA, 22 nt, Human
uugaauaguuuuggauagcaua

SEQ ID NO: 66129 - RNA, 22 nt, Human
uuuuuuaaucaaguaggaaaca

SEQ ID NO: 66130 - RNA, 22 nt, Human
uugaaaaaauguguuuaaggag

SEQ ID NO: 66131 - RNA, 22 nt, Human
uuuuuguaaaugaaguuuuauu

SEQ ID NO: 66132 - RNA, 22 nt, Human
uugagauuuggagguaauuccc

SEQ ID NO: 66133 - RNA, 22 nt, Human
uuuuuuuccaguuauucauuuu

SEQ ID NO: 66134 - RNA, 22 nt, Human
uugauagauuuuagaggcaggc

SEQ ID NO: 66135 - RNA, 22 nt, Human
uugaugacuaaagaaagcugcu

SEQ ID NO: 66136 - RNA, 22 nt, Human
uugauuuccauuguccagcauu

SEQ ID NO: 66137 - RNA, 22 nt, Human
uugauuggguauaaugacagga

SEQ ID NO: 66138 - RNA, 20 nt, Human
uugauucacaaaaagcuuag

SEQ ID NO: 66139 - RNA, 22 nt, Human
uugauuccagcguuccaucagc

SEQ ID NO: 66140 - RNA, 22 nt, Human
uugauuuggaauuuuuagagcu

SEQ ID NO: 66141 - RNA, 22 nt, Human
uuggauguccucuguggaguau

SEQ ID NO: 66142 - RNA, 22 nt, Human
uuggcgcuauuauuaccacauu

SEQ ID NO: 66143 - RNA, 22 nt, Human
uugggacuguugucuaaaccau

SEQ ID NO: 66144 - RNA, 22 nt, Human
uugggaaauuugaaaauaaaag

SEQ ID NO: 66145 - RNA, 20 nt, Human
uugggaagccuacaccauuc

SEQ ID NO: 66146 - RNA, 22 nt, Human
uugggcauuucuuauguauuuu

SEQ ID NO: 66147 - RNA, 22 nt, Human
uugggagagaaaccuaaugccu

SEQ ID NO: 66148 - RNA, 22 nt, Human
uugggauuggugggguggguuu

SEQ ID NO: 66149 - RNA, 22 nt, Human
uuggggaauuuggggccguccg

SEQ ID NO: 66150 - RNA, 22 nt, Human
uugguugcugaugagcuuugag

SEQ ID NO: 66151 - RNA, 19 nt, Human
uugguuuguugcuuaggug

SEQ ID NO: 66152 - RNA, 22 nt, Human
uugguguuucacuuccuugucg

SEQ ID NO: 66153 - RNA, 22 nt, Human
uuggugauugggaauggauggg

SEQ ID NO: 66154 - RNA, 20 nt, Human
uuggggacaggagugugaug

SEQ ID NO: 66155 - RNA, 22 nt, Human
uugucauuuucuuaauguuccu

SEQ ID NO: 66156 - RNA, 22 nt, Human
uuguacaaauaggaaccucuga

SEQ ID NO: 66157 - RNA, 22 nt, Human
uugugcauuuuguuuuacuuau

SEQ ID NO: 66158 - RNA, 22 nt, Human
uuuauucuuugcuagguuccau

SEQ ID NO: 66159 - RNA, 22 nt, Human
uuuauugcuaugucuugauugu

SEQ ID NO: 66160 - RNA, 22 nt, Human
uuuauuuacuuucgguucugcu

SEQ ID NO: 66161 - RNA, 22 nt, Human
uuuauuugugguaguguaaucu

SEQ ID NO: 66162 - RNA, 22 nt, Human
uuucaaguagagggaucgcuag

SEQ ID NO: 66163 - RNA, 22 nt, Human
uuucacuucgaucagaguuuuu

SEQ ID NO: 66164 - RNA, 22 nt, Human
uuucagaaauggcacugaaauc

SEQ ID NO: 66165 - RNA, 20 nt, Human
uuuagucauuuccuaggaaa

SEQ ID NO: 66166 - RNA, 22 nt, Human
uuuauaaacacaagaugggcuc

SEQ ID NO: 66167 - RNA, 22 nt, Human
uuuauauauauguaggagcaca

SEQ ID NO: 66168 - RNA, 22 nt, Human
uuuaucucugcauagaagugau

SEQ ID NO: 66169 - RNA, 22 nt, Human
uuuaugauguagccuagagcug

SEQ ID NO: 66170 - RNA, 22 nt, Human
uuuauguuuguuuuugaaauaa

SEQ ID NO: 66171 - RNA, 22 nt, Human
uuguuccuucuuuuuguaucag

SEQ ID NO: 66172 - RNA, 22 nt, Human
uuguguugaagugguuagggcg

SEQ ID NO: 66173 - RNA, 22 nt, Human
uuguguuuaaucuguuccacua

SEQ ID NO: 66174 - RNA, 22 nt, Human
uuguuccuuucuucuguagucg

SEQ ID NO: 66175 - RNA, 22 nt, Human
uuuagugaagcuuugcauuuca

SEQ ID NO: 66176 - RNA, 22 nt, Human
uuuaggugucugcucauugaag

SEQ ID NO: 66177 - RNA, 22 nt, Human
uuuaggaauuugcugggcauga

SEQ ID NO: 66178 - RNA, 22 nt, Human
uuuaggauaacuccaguuuucc

SEQ ID NO: 66179 - RNA, 22 nt, Human
uuuaggucacuccaccgaagag

SEQ ID NO: 66180 - RNA, 22 nt, Human
uuuaccuuauguaaauaagagu

SEQ ID NO: 66181 - RNA, 18 nt, Human
uuuacgaacucacuugag

SEQ ID NO: 66182 - RNA, 22 nt, Human
uuuagcaaggagaaauaauccu

SEQ ID NO: 66183 - RNA, 22 nt, Human
uuucgcuuguucggagugcuuu

SEQ ID NO: 66184 - RNA, 22 nt, Human
uuuccuucccuccugggccuuc

SEQ ID NO: 66185 - RNA, 18 nt, Human
uuuccucauuugcagacu

SEQ ID NO: 66186 - RNA, 22 nt, Human
uuuccugacuucaccuuuuacc

SEQ ID NO: 66187 - RNA, 22 nt, Human
uuuccuguccugguacuuggca

SEQ ID NO: 66188 - RNA, 22 nt, Human
uuucguugcacucauaugguug

SEQ ID NO: 66189 - RNA, 22 nt, Human
uuucuaaaaccagaguuuauaa

SEQ ID NO: 66190 - RNA, 22 nt, Human
uuucuaaguuugaggcgaagca

SEQ ID NO: 66191 - RNA, 22 nt, Human
uuucuacacuucgugguguuuu

SEQ ID NO: 66192 - RNA, 22 nt, Human
uuucuaguauauaacuagaucu

SEQ ID NO: 66193 - RNA, 22 nt, Human
uuucuauauucaguuucauaaa

SEQ ID NO: 66194 - RNA, 22 nt, Human
uuuccacacucacugcacucau

SEQ ID NO: 66195 - RNA, 22 nt, Human
uuucauggaggccaggacagag

SEQ ID NO: 66196 - RNA, 22 nt, Human
uuuccaguaaguggcaaggagc

SEQ ID NO: 66197 - RNA, 22 nt, Human
uuuccaguuguucuagaaagcu

SEQ ID NO: 66198 - RNA, 22 nt, Human
uuuccccugggaacauugauuc

SEQ ID NO: 66199 - RNA, 22 nt, Human
uuucccuugcgcuugcucuccg

SEQ ID NO: 66200 - RNA, 22 nt, Human
uuucaucccugucagugaaggc

SEQ ID NO: 66201 - RNA, 22 nt, Human
uuucaugauuaacuuagugaau

SEQ ID NO: 66202 - RNA, 22 nt, Human
uuucagagaaagcccaaagacu

SEQ ID NO: 66203 - RNA, 22 nt, Human
uuucagugaaugaauggcuaac

SEQ ID NO: 66204 - RNA, 22 nt, Human
uuugaaaggagcuuuauccaga

SEQ ID NO: 66205 - RNA, 22 nt, Human
uuucuuuuucuacaccuuagcu

SEQ ID NO: 66206 - RNA, 22 nt, Human
uuucuugggaaaugucagaagu

SEQ ID NO: 66207 - RNA, 22 nt, Human
uuucuuugggcccuggcagucu

SEQ ID NO: 66208 - RNA, 22 nt, Human
uuucuuccaucuggcuuuauuu

SEQ ID NO: 66209 - RNA, 22 nt, Human
uuucuguucuguuggauucuuu

SEQ ID NO: 66210 - RNA, 22 nt, Human
uuucuguugugaccugacucuu

SEQ ID NO: 66211 - RNA, 22 nt, Human
uuucucagccuccuugcuggag

SEQ ID NO: 66212 - RNA, 22 nt, Human
uuucucagcauauugccuuuga

SEQ ID NO: 66213 - RNA, 22 nt, Human
uuucuccauuuuguguguucug

SEQ ID NO: 66214 - RNA, 19 nt, Human
uuucucacugagucguuug

SEQ ID NO: 66215 - RNA, 22 nt, Human
uuucuauuuacagugcuaggua

SEQ ID NO: 66216 - RNA, 22 nt, Human
uuucucuccucgaaauucuuau

SEQ ID NO: 66217 - RNA, 22 nt, Human
uuucucuuucaaucugcaguac

SEQ ID NO: 66218 - RNA, 22 nt, Human
uuucugagccacauauaauuug

SEQ ID NO: 66219 - RNA, 22 nt, Human
uuucuggauaagcagggucucu

SEQ ID NO: 66220 - RNA, 22 nt, Human
uuucugcuuucuaguugguguu

SEQ ID NO: 66221 - RNA, 17 nt, Human
uuucugcaugauuggac

SEQ ID NO: 66222 - RNA, 22 nt, Human
uuugaugauuuucuagagugua

SEQ ID NO: 66223 - RNA, 22 nt, Human
uuugagaagauaggggaauacu

SEQ ID NO: 66224 - RNA, 22 nt, Human
uuugagaaugucaaucacaaga

SEQ ID NO: 66225 - RNA, 22 nt, Human
uuugaguaagauguugauacug

SEQ ID NO: 66226 - RNA, 22 nt, Human
uuugaguacagcugccuuuuug

SEQ ID NO: 66227 - RNA, 22 nt, Human
uuugaagaccuuaucucuaaau

SEQ ID NO: 66228 - RNA, 22 nt, Human
uuugaagauaaauauggagaaa

SEQ ID NO: 66229 - RNA, 22 nt, Human
uuugaauauacuucaaacaaag

SEQ ID NO: 66230 - RNA, 22 nt, Human
uuugaauauuaugucccacuuu

SEQ ID NO: 66231 - RNA, 22 nt, Human
uuucuuaguuaaguagguaggc

SEQ ID NO: 66232 - RNA, 21 nt, Human
uuugacagaccagguauaguu

SEQ ID NO: 66233 - RNA, 22 nt, Human
uuugcauuaguuuagauuucaa

SEQ ID NO: 66234 - RNA, 22 nt, Human
uuugcacuuaaauuuacaacac

SEQ ID NO: 66235 - RNA, 22 nt, Human
uuugauauaaaggcuugggcug

SEQ ID NO: 66236 - RNA, 22 nt, Human
uuugauuaccuggggcccucug

SEQ ID NO: 66237 - RNA, 22 nt, Human
uuugauuuuuugagcaguguau

SEQ ID NO: 66238 - RNA, 22 nt, Human
uuugcauuugagagaggaaaca

SEQ ID NO: 66239 - RNA, 22 nt, Human
uuugcugaaaaaccacuugagu

SEQ ID NO: 66240 - RNA, 22 nt, Human
uuugcuguaaugcaugucagag

SEQ ID NO: 66241 - RNA, 22 nt, Human
uuuguaguuguggaugcugaag

SEQ ID NO: 66242 - RNA, 22 nt, Human
uuuguccuguuggcaugaaaau

SEQ ID NO: 66243 - RNA, 22 nt, Human
uuugucaucuuccauauuugca

SEQ ID NO: 66244 - RNA, 19 nt, Human
uuugguaggcuugagggaa

SEQ ID NO: 66245 - RNA, 22 nt, Human
uuuguacuuucuaauguauuua

SEQ ID NO: 66246 - RNA, 22 nt, Human
uuuggguuaguuuuccaaucuu

SEQ ID NO: 66247 - RNA, 22 nt, Human
uuugggcauuuuuaaggaucuu

SEQ ID NO: 66248 - RNA, 22 nt, Human
uuuggcuuugauccuaggauuc

SEQ ID NO: 66249 - RNA, 22 nt, Human
uuuggcuccccaggaucugaaa

SEQ ID NO: 66250 - RNA, 22 nt, Human
uuugcuguccaauauucagggu

SEQ ID NO: 66251 - RNA, 22 nt, Human
uuuggaugcugucauaugcugc

SEQ ID NO: 66252 - RNA, 22 nt, Human
uuuggcaagcagaugaagguag

SEQ ID NO: 66253 - RNA, 22 nt, Human
uuuggaggaaugaguuuaauau

SEQ ID NO: 66254 - RNA, 22 nt, Human
uuuggcaccuccaaggacucgc

SEQ ID NO: 66255 - RNA, 22 nt, Human
uuuggccauuuguaugcaugau

SEQ ID NO: 66256 - RNA, 22 nt, Human
uuugugauaaguggauucaagg

SEQ ID NO: 66257 - RNA, 22 nt, Human
gucugcccuuggccugggacuu

SEQ ID NO: 66258 - RNA, 22 nt, Human
ucuaaagcuccuuccacuaaaa

SEQ ID NO: 66259 - RNA, 22 nt, Human
ccuccuuuccuguuuuccugag

SEQ ID NO: 66260 - RNA, 22 nt, Human
aggggcugagaguuugaugugg

SEQ ID NO: 66261 - RNA, 22 nt, Human
cacaaggagaaauagauauuga

SEQ ID NO: 66262 - RNA, 22 nt, Human
ucuccuuuacuggcuccuuuug

SEQ ID NO: 66263 - RNA, 22 nt, Human
uucucuuguaaaauuccuuuuu

SEQ ID NO: 66264 - RNA, 22 nt, Human
aaggacaccaaacuaauuggga

SEQ ID NO: 66265 - RNA, 22 nt, Human
caugccucuguuuuaguuguug

SEQ ID NO: 66266 - RNA, 22 nt, Human
ugaauucaaacuuuuuaacaag

SEQ ID NO: 66267 - RNA, 22 nt, Human
uuuauuuagguaaacaugaguu

SEQ ID NO: 66268 - RNA, 22 nt, Human
cauaaucaagggguugugaugu

SEQ ID NO: 66269 - RNA, 22 nt, Human
aucuugaaacauauaugcauuu

SEQ ID NO: 66270 - RNA, 22 nt, Human
gucuuuguaguuuuaauuugag

SEQ ID NO: 66271 - RNA, 22 nt, Human
uuccuuuucuucuaccacaugu

SEQ ID NO: 66272 - RNA, 22 nt, Human
guuuugaugugauuucucaugu

SEQ ID NO: 66273 - RNA, 22 nt, Human
gcucagccuuuuguucuauuca

SEQ ID NO: 66274 - RNA, 22 nt, Human
aggguggaggacaggccaguga

SEQ ID NO: 66275 - RNA, 22 nt, Human
uauuuaaagucagcaacuuuuc

SEQ ID NO: 66276 - RNA, 22 nt, Human
gagaggugaagcuaauuaauuu

SEQ ID NO: 66277 - RNA, 22 nt, Human
gauuuuuaaaaguaguuuugaa

SEQ ID NO: 66278 - RNA, 22 nt, Human
uucucugcgcuccggcccaguu

SEQ ID NO: 66279 - RNA, 22 nt, Human
gaguagaacagauagucaagaa

SEQ ID NO: 66280 - RNA, 22 nt, Human
ggggaggugugcaggacaccuc

SEQ ID NO: 66281 - RNA, 22 nt, Human
ccucccuucccggcauggcucu

SEQ ID NO: 66282 - RNA, 22 nt, Human
gcucucuggccugggaggagga

SEQ ID NO: 66283 - RNA, 22 nt, Human
caguggacacuuccucuacaau

SEQ ID NO: 66284 - RNA, 22 nt, Human
aagggagagggagaagguggga

SEQ ID NO: 66285 - RNA, 22 nt, Human
cuccugcuuuuucuucuuccga

SEQ ID NO: 66286 - RNA, 22 nt, Human
ugaaaaaugcuuuaaugcaugu

SEQ ID NO: 66287 - RNA, 22 nt, Human
aggccccacaaacucgccuuug

SEQ ID NO: 66288 - RNA, 22 nt, Human
agcuuucuauauaugaguugcu

SEQ ID NO: 66289 - RNA, 20 nt, Human
cuggaguguagcaguggcug

SEQ ID NO: 66290 - RNA, 22 nt, Human
aggggaggcugcgggcugccgu

SEQ ID NO: 66291 - RNA, 22 nt, Human
uggacacugguggauauggaau

SEQ ID NO: 66292 - RNA, 22 nt, Human
gggggcagguuccaggccagcu

SEQ ID NO: 66293 - RNA, 22 nt, Human
cagcuccagcccaggcagcucc

SEQ ID NO: 66294 - RNA, 22 nt, Human
uuaucaaaaaauaguacuuuga

SEQ ID NO: 66295 - RNA, 22 nt, Human
uaguggaaccuucuaaaugacg

SEQ ID NO: 66296 - RNA, 21 nt, Human
auauuguugggguuuucuuuu

SEQ ID NO: 66297 - RNA, 22 nt, Human
ggcucagaggagcuggaacggu

SEQ ID NO: 66298 - RNA, 22 nt, Human
uuucuauauucaguuucauaaa

SEQ ID NO: 66299 - RNA, 22 nt, Human
aaauguaaacuguauuuauaaa

SEQ ID NO: 66300 - RNA, 22 nt, Human
cucuugugucaccauggauaaa

SEQ ID NO: 66301 - RNA, 19 nt, Human
uagcuguucuugaguguga

SEQ ID NO: 66302 - RNA, 22 nt, Human
uacauuccagaaaguuucugua

SEQ ID NO: 66303 - RNA, 22 nt, Human
ucccuucccaccccugccuuuu

SEQ ID NO: 66304 - RNA, 22 nt, Human
uuguuuucuaguguuuugaaua

SEQ ID NO: 66305 - RNA, 22 nt, Human
uuuacaaggcaguuauuuuccu

SEQ ID NO: 66306 - RNA, 22 nt, Human
gguagacugagcuccuugagga

SEQ ID NO: 66307 - RNA, 19 nt, Human
uuccuuucuauccugggua

SEQ ID NO: 66308 - RNA, 22 nt, Human
uccucccugcacucagugaagu

SEQ ID NO: 66309 - RNA, 23 nt, Human
uggguuucagugccaaugcugcc

SEQ ID NO: 66310 - RNA, 22 nt, Human
aaaacauuuaggguuuuuuuua

SEQ ID NO: 66311 - RNA, 22 nt, Human
gaaccauuuaauggagaugcuc

SEQ ID NO: 66312 - RNA, 22 nt, Human
auguguguaugacugaaucuau

SEQ ID NO: 66313 - RNA, 22 nt, Human
uuggugaugcccaccuuuucau

SEQ ID NO: 66314 - RNA, 22 nt, Human
uuuaaucaguugguaauauuga

SEQ ID NO: 66315 - RNA, 22 nt, Human
aauguaaauaauuguaaaauuu

SEQ ID NO: 66316 - RNA, 18 nt, Human
acaaaaauagugcuuugg

SEQ ID NO: 66317 - RNA, 23 nt, Human
ucagaccaaccucuugcuggaac

SEQ ID NO: 66318 - RNA, 22 nt, Human
ucagcucucucuuggugaucuc

SEQ ID NO: 66319 - RNA, 22 nt, Human
uggguucaaauccugguuccac

SEQ ID NO: 66320 - RNA, 22 nt, Human
gguuuucacgauccucccuuuu

SEQ ID NO: 66321 - RNA, 22 nt, Human
aaccaggcgagagagcggucag

SEQ ID NO: 66322 - RNA, 22 nt, Human
uccucagcaagacgcuggcagc

SEQ ID NO: 66323 - RNA, 22 nt, Human
cuggaagcgucggaggaagggc

SEQ ID NO: 66324 - RNA, 22 nt, Human
uuuaaaacagcauuuaaaaggu

SEQ ID NO: 66325 - RNA, 22 nt, Human
uucuccaccugcuccucccacc

SEQ ID NO: 66326 - RNA, 22 nt, Human
guuauuuugucuuguucaugaa

SEQ ID NO: 66327 - RNA, 22 nt, Human
auguacugacuguacuuuuaaa

SEQ ID NO: 66328 - RNA, 22 nt, Human
uggagcugguucuggggaagcu

SEQ ID NO: 66329 - RNA, 22 nt, Human
uuucacuucgaucagaguuuuu

SEQ ID NO: 66330 - RNA, 22 nt, Human
uggaagugggcaucaccaucca

SEQ ID NO: 66331 - RNA, 22 nt, Human
uuuugccuauuguaucaucgua

SEQ ID NO: 66332 - RNA, 22 nt, Human
gcugucccccaaagaugcuccu

SEQ ID NO: 66333 - RNA, 22 nt, Human
uucacugugauugggguggauu

SEQ ID NO: 66334 - RNA, 22 nt, Human
uuauuguuuggguauaauuuga

SEQ ID NO: 66335 - RNA, 22 nt, Human
uuuauguuuguuuuugaaauaa

SEQ ID NO: 66336 - RNA, 22 nt, Human
cuacuucucccuagaucagaaa

SEQ ID NO: 66337 - RNA, 22 nt, Human
ucuuugcugacacuuacacugu

SEQ ID NO: 66338 - RNA, 20 nt, Human
uucacagaucucuaacugag

SEQ ID NO: 66339 - RNA, 22 nt, Human
gaauaagaauccacuucuggca

SEQ ID NO: 66340 - RNA, 22 nt, Human
auuagugguguauuuggcacua

SEQ ID NO: 66341 - RNA, 22 nt, Human
aaauauuaaugaugaagguagu

SEQ ID NO: 66342 - RNA, 22 nt, Human
cuuuaaaaauguauuuuugugg

SEQ ID NO: 66343 - RNA, 22 nt, Human
agguuuuugucauuuucuggua

SEQ ID NO: 66344 - RNA, 22 nt, Human
augcaaaaucuuauuuuuucua

SEQ ID NO: 66345 - RNA, 22 nt, Human
ucauuauuuugauguauuuccu

SEQ ID NO: 66346 - RNA, 22 nt, Human
guauauuuaugagcauuagccu

SEQ ID NO: 66347 - RNA, 21 nt, Human
uuccuggaggcagaaacguga

SEQ ID NO: 66348 - RNA, 22 nt, Human
uaucauuuuacugugacauuuu

SEQ ID NO: 66349 - RNA, 22 nt, Human
uucaugucuuugauucugauaa

SEQ ID NO: 66350 - RNA, 22 nt, Human
uggccccauuuuucuggagccu

SEQ ID NO: 66351 - RNA, 22 nt, Human
aaaugcuuuaauugaguucaug

SEQ ID NO: 66352 - RNA, 22 nt, Human
aaaauacuaggaaaauaaauca

SEQ ID NO: 66353 - RNA, 22 nt, Human
auuuaaaaacugguacaacagg

SEQ ID NO: 66354 - RNA, 22 nt, Human
ggcuccaggguaccccuggaug

SEQ ID NO: 66355 - RNA, 22 nt, Human
gcagggcucagccgcucccacc

SEQ ID NO: 66356 - RNA, 22 nt, Human
gagccucaggguuuuguugaca

SEQ ID NO: 66357 - RNA, 22 nt, Human
aggauggaaguaacuggauaau

SEQ ID NO: 66358 - RNA, 22 nt, Human
auagagcuggggaagaagcugg

SEQ ID NO: 66359 - RNA, 22 nt, Human
ucuuuuucccugguuccuuuuu

SEQ ID NO: 66360 - RNA, 22 nt, Human
gaauuagguaauagaacuagua

SEQ ID NO: 66361 - RNA, 22 nt, Human
cguuuugaguagauagccauau

SEQ ID NO: 66362 - RNA, 22 nt, Human
ggagcucacuacgaaauaagcu

SEQ ID NO: 66363 - RNA, 22 nt, Human
aaauauauauaauauauauauu

SEQ ID NO: 66364 - RNA, 22 nt, Human
uuuuaggauuugaguugcugga

SEQ ID NO: 66365 - RNA, 22 nt, Human
caagggcagaggcagggccccg

SEQ ID NO: 66366 - RNA, 22 nt, Human
gaggaggcuggagaggccagga

SEQ ID NO: 66367 - RNA, 20 nt, Human
cagagacaagagggaaggga

SEQ ID NO: 66368 - RNA, 22 nt, Human
uuauuuuuguaacacuguauag

SEQ ID NO: 66369 - RNA, 22 nt, Human
ugucuuugaccuuaagaaguuu

SEQ ID NO: 66370 - RNA, 22 nt, Human
agaaccaauacuacagcaagua

SEQ ID NO: 66371 - RNA, 17 nt, Human
ugucuuuuuccuccucc

SEQ ID NO: 66372 - RNA, 22 nt, Human
aaucauaacaaaagcaauuaua

SEQ ID NO: 66373 - RNA, 22 nt, Human
uugccaggagacaucuggagcc

SEQ ID NO: 66374 - RNA, 19 nt, Human
acacaccagugccugugac

SEQ ID NO: 66375 - RNA, 20 nt, Human
gacaugagggagcaaagagc

SEQ ID NO: 66376 - RNA, 22 nt, Human
ggcucacuguaccugccgccgc

SEQ ID NO: 66377 - RNA, 22 nt, Human
auauauguauauaugugugugu

SEQ ID NO: 66378 - RNA, 22 nt, Human
gaggcucagagggacuuucaag

SEQ ID NO: 66379 - RNA, 22 nt, Human
cuguggcuaggaagcuguggga

SEQ ID NO: 66380 - RNA, 22 nt, Human
aguuuucugccucuggaugcgu

SEQ ID NO: 66381 - RNA, 22 nt, Human
cuuuuuaaaguaaauggcuaga

SEQ ID NO: 66382 - RNA, 22 nt, Human
uuguuguuguuguuauuuaguu

SEQ ID NO: 66383 - RNA, 22 nt, Human
uggggcauacgugaaauaauuu

SEQ ID NO: 66384 - RNA, 23 nt, Human
cuuauauaaucauuagaaaccau

SEQ ID NO: 66385 - RNA, 22 nt, Human
acaggcugcccgcuccccaccu

SEQ ID NO: 66386 - RNA, 22 nt, Human
uccucaaauccuagccucaucg

SEQ ID NO: 66387 - RNA, 22 nt, Human
agccccaauuacagcugugcug

SEQ ID NO: 66388 - RNA, 22 nt, Human
gcuguugugaggaucagcauau

SEQ ID NO: 66389 - RNA, 19 nt, Human
gauauugagcugagaauuc

SEQ ID NO: 66390 - RNA, 22 nt, Human
uacaggaggaugugcagccagg

SEQ ID NO: 66391 - RNA, 22 nt, Human
agguuaggaggggagugccaca

SEQ ID NO: 66392 - RNA, 22 nt, Human
uagacugugagcuccuugaggg

SEQ ID NO: 66393 - RNA, 22 nt, Human
uggcucaggccuacgacgccuu

SEQ ID NO: 66394 - RNA, 19 nt, Human
caggucuucuuggaggacu

SEQ ID NO: 66395 - RNA, 22 nt, Human
uacagaccaguaguucucagcg

SEQ ID NO: 66396 - RNA, 22 nt, Human
gucugcagcacugugcacgguc

SEQ ID NO: 66397 - RNA, 22 nt, Human
acucugcaguaaggaauuguuu

SEQ ID NO: 66398 - RNA, 22 nt, Human
agaguacagaagcauuucagau

SEQ ID NO: 66399 - RNA, 22 nt, Human
aauuauguugaaauaugagaac

SEQ ID NO: 66400 - RNA, 22 nt, Human
uucuagcucauggugacagauc

SEQ ID NO: 66401 - RNA, 22 nt, Human
gacuggggcauuagaguagcuu

SEQ ID NO: 66402 - RNA, 22 nt, Human
guaaauaucucacgaaugauuc

SEQ ID NO: 66403 - RNA, 22 nt, Human
uaauuccacacucccgcaagcg

SEQ ID NO: 66404 - RNA, 22 nt, Human
uauuuguauugucuuaucacuu

SEQ ID NO: 66405 - RNA, 23 nt, Human
uggaaguugagagucugcuuugu

SEQ ID NO: 66406 - RNA, 19 nt, Human
ggaggguguccucaguguc

SEQ ID NO: 66407 - RNA, 22 nt, Human
ggcaaggaagaaagcagaaguu

SEQ ID NO: 66408 - RNA, 22 nt, Human
uucacuuuuucucugcuugaga

SEQ ID NO: 66409 - RNA, 22 nt, Human
aggauagacuucagaaggcaua

SEQ ID NO: 66410 - RNA, 22 nt, Human
uuucauguuggauacuguuuca

SEQ ID NO: 66411 - RNA, 22 nt, Human
guuuauucuuuuauuugugaga

SEQ ID NO: 66412 - RNA, 22 nt, Human
cagguggauggcgagcccugca

SEQ ID NO: 66413 - RNA, 22 nt, Human
uguguuguuuggggauguccau

SEQ ID NO: 66414 - RNA, 22 nt, Human
ccauuucacaucccugacaugu

SEQ ID NO: 66415 - RNA, 22 nt, Human
gaaacauuuguugaguacuugc

SEQ ID NO: 66416 - RNA, 22 nt, Human
ugaguucugacugagcaugggg

SEQ ID NO: 66417 - RNA, 22 nt, Human
cuccccuuauuccucaacauga

SEQ ID NO: 66418 - RNA, 22 nt, Human
uaauauaacugccaguuaaggu

SEQ ID NO: 66419 - RNA, 22 nt, Human
uuuuucuccucucucuuucauu

SEQ ID NO: 66420 - RNA, 22 nt, Human
uacauaauagcaaggugcuguc

SEQ ID NO: 66421 - RNA, 22 nt, Human
uuauuuuauaaagagaagacuu

SEQ ID NO: 66422 - RNA, 22 nt, Human
uauuuuauuuagguuuaguugu

SEQ ID NO: 66423 - RNA, 22 nt, Human
uuguuuguaaggcucuuagaau

SEQ ID NO: 66424 - RNA, 22 nt, Human
auuaaauagcagaagaaagaug

SEQ ID NO: 66425 - RNA, 22 nt, Human
uuauuugcccauguuuagcaga

SEQ ID NO: 66426 - RNA, 22 nt, Human
guugcuaugaaauuaaaauuua

SEQ ID NO: 66427 - RNA, 22 nt, Human
cucagcgagggaaagaggccgc

SEQ ID NO: 66428 - RNA, 22 nt, Human
ucuugccccugcuuuggaacaa

SEQ ID NO: 66429 - RNA, 22 nt, Human
gaaggagaggauugugaggcug

SEQ ID NO: 66430 - RNA, 22 nt, Human
aaucaaauuucuugugguuguu

SEQ ID NO: 66431 - RNA, 22 nt, Human
auauaguacauguauauauaua

SEQ ID NO: 66432 - RNA, 22 nt, Human
agauuuucuuuuccaucuuugu

SEQ ID NO: 66433 - RNA, 20 nt, Human
aauaaauauaacccauaauu

SEQ ID NO: 66434 - RNA, 22 nt, Human
gcuguggacacagcucucuuca

SEQ ID NO: 66435 - RNA, 22 nt, Human
uggggagacauggaguaaaaga

SEQ ID NO: 66436 - RNA, 22 nt, Human
uugaauaguuuuggauagcaua

SEQ ID NO: 66437 - RNA, 22 nt, Human
uuaaagaguuuauuacuuguaa

SEQ ID NO: 66438 - RNA, 22 nt, Human
uccaugauauauaugugcacau

SEQ ID NO: 66439 - RNA, 22 nt, Human
uuuguuugcugagugaauucaa

SEQ ID NO: 66440 - RNA, 22 nt, Human
auguuccaugacuaugcaugaa

SEQ ID NO: 66441 - RNA, 22 nt, Human
guuuaaaagcaaccaacaggcu

SEQ ID NO: 66442 - RNA, 22 nt, Human
uuauaucagaaggugagauuga

SEQ ID NO: 66443 - RNA, 22 nt, Human
uuaagagaagaguaucuagaac

SEQ ID NO: 66444 - RNA, 22 nt, Human
cuccuuccuccgcccuuccucg

SEQ ID NO: 66445 - RNA, 22 nt, Human
aagaugcuucaugagaguuggg

SEQ ID NO: 66446 - RNA, 22 nt, Human
aacauuuccggccuuuuguucu

SEQ ID NO: 66447 - RNA, 20 nt, Human
ucugugugccaucaccuaac

SEQ ID NO: 66448 - RNA, 22 nt, Human
gcuggaaauaacuuguguagaa

SEQ ID NO: 66449 - RNA, 22 nt, Human
agagauacugcaggccauaaau

SEQ ID NO: 66450 - RNA, 22 nt, Human
cucaagugacucagccugguug

SEQ ID NO: 66451 - RNA, 22 nt, Human
cuaaauucuauauccuugcuuc

SEQ ID NO: 66452 - RNA, 22 nt, Human
aucuguuccccuaugcucucua

SEQ ID NO: 66453 - RNA, 18 nt, Human
ggccucagccuggccgga

SEQ ID NO: 66454 - RNA, 22 nt, Human
uucuaauauuaugauuucuaag

SEQ ID NO: 66455 - RNA, 22 nt, Human
gauuccuuucgccugccgagcu

SEQ ID NO: 66456 - RNA, 22 nt, Human
cugggggacagagagaggcggu

SEQ ID NO: 66457 - RNA, 22 nt, Human
uuuuauuuguauguugaaugua

SEQ ID NO: 66458 - RNA, 22 nt, Human
uguacauacauagauauacaca

SEQ ID NO: 66459 - RNA, 22 nt, Human
ggugucuuugauguugggcuga

SEQ ID NO: 66460 - RNA, 22 nt, Human
auauuugucuguuuuaguggca

SEQ ID NO: 66461 - RNA, 22 nt, Human
cggcugcagcggagcaggcugg

SEQ ID NO: 66462 - RNA, 22 nt, Human
uggucuuuccuucauuguccag

SEQ ID NO: 66463 - RNA, 22 nt, Human
ucagucucuggggcuucuguuu

SEQ ID NO: 66464 - RNA, 22 nt, Human
ggcugugaaguacguugaaggu

SEQ ID NO: 66465 - RNA, 22 nt, Human
cucugugucugauucugggaag

SEQ ID NO: 66466 - RNA, 22 nt, Human
ggcuagggagacagagggcaug

SEQ ID NO: 66467 - RNA, 22 nt, Human
uuauuucauguaaaauuuaugu

SEQ ID NO: 66468 - RNA, 22 nt, Human
cugguacuggaggaguucagag

SEQ ID NO: 66469 - RNA, 22 nt, Human
uucucagagaaagcuccucaug

SEQ ID NO: 66470 - RNA, 22 nt, Human
aagaaggaaggcaagagauggg

SEQ ID NO: 66471 - RNA, 22 nt, Human
uuucucuuguauuugaaucacu

SEQ ID NO: 66472 - RNA, 22 nt, Human
uuccacauucggaauuuucuga

SEQ ID NO: 66473 - RNA, 22 nt, Human
uuauauuuuauuuaauuaaaua

SEQ ID NO: 66474 - RNA, 22 nt, Human
uggaugccuugggggaggagga

SEQ ID NO: 66475 - RNA, 23 nt, Human
ucucacucauucuccucugucca

SEQ ID NO: 66476 - RNA, 22 nt, Human
cuaagguuggcaguggaauugg

SEQ ID NO: 66477 - RNA, 23 nt, Human
caggggacaggugaccugggcuc

SEQ ID NO: 66478 - RNA, 22 nt, Human
guuuucuuguuaauuuugaacg

SEQ ID NO: 66479 - RNA, 22 nt, Human
cauuccaagaaguaguucugca

SEQ ID NO: 66480 - RNA, 22 nt, Human
agauucucccuccuggcgcugu

SEQ ID NO: 66481 - RNA, 22 nt, Human
gugaucagaagaaccugccgaa

SEQ ID NO: 66482 - RNA, 18 nt, Human
uucuagaggucucaucca

SEQ ID NO: 66483 - RNA, 22 nt, Human
auuucacucuuaauugcuuccu

SEQ ID NO: 66484 - RNA, 22 nt, Human
agccagugucgugugacaugag

SEQ ID NO: 66485 - RNA, 22 nt, Human
uuuugcuucuaguauauuuuuu

SEQ ID NO: 66486 - RNA, 22 nt, Human
agacacagcaauaacuacuguu

SEQ ID NO: 66487 - RNA, 22 nt, Human
ugcuuggagaaucagucccagc

SEQ ID NO: 66488 - RNA, 22 nt, Human
cagacagagcucacaagucuuu

SEQ ID NO: 66489 - RNA, 22 nt, Human
uuuccuaggaaaugauugaagu

SEQ ID NO: 66490 - RNA, 22 nt, Human
ccagcugggucccugcuggggc

SEQ ID NO: 66491 - RNA, 22 nt, Human
uuuuugaauaagugcaucauca

SEQ ID NO: 66492 - RNA, 22 nt, Human
uuauuuaaguauuuauugaagu

SEQ ID NO: 66493 - RNA, 22 nt, Human
gaggggacugucuggcuccgag

SEQ ID NO: 66494 - RNA, 22 nt, Human
aauuuaauugguuuuuacuugu

SEQ ID NO: 66495 - RNA, 22 nt, Human
auucuuuauuuucuguacuugc

SEQ ID NO: 66496 - RNA, 22 nt, Human
guuuauuucuuaucaucacuau

SEQ ID NO: 66497 - RNA, 22 nt, Human
uaguauuuguaauuaucaaagc

SEQ ID NO: 66498 - RNA, 22 nt, Human
auccuccuggggcagucuuccc

SEQ ID NO: 66499 - RNA, 22 nt, Human
uucauaugaauuggguuuuuuu

SEQ ID NO: 66500 - RNA, 22 nt, Human
aaggugggacugagaggggaca

SEQ ID NO: 66501 - RNA, 22 nt, Human
auuguuuugugaaacauaguga

SEQ ID NO: 66502 - RNA, 22 nt, Human
cauuucaaacaguuacagcugc

SEQ ID NO: 66503 - RNA, 22 nt, Human
agaguucuauccagacucaugu

SEQ ID NO: 66504 - RNA, 22 nt, Human
ccucuagaauuaucacuuuuaa

SEQ ID NO: 66505 - RNA, 22 nt, Human
auuuauuuucccucaaguaccu

SEQ ID NO: 66506 - RNA, 22 nt, Human
aaacagcugcaguacacggccu

SEQ ID NO: 66507 - RNA, 22 nt, Human
cagggcagaguuaagaugcugg

SEQ ID NO: 66508 - RNA, 22 nt, Human
ccagcaggagacuagcaacaua

SEQ ID NO: 66509 - RNA, 22 nt, Human
ucacaucugugugauugucauu

SEQ ID NO: 66510 - RNA, 21 nt, Human
ugcuuucugugcuuuuucugc

SEQ ID NO: 66511 - RNA, 22 nt, Human
uggggggacagauggagaggac

SEQ ID NO: 66512 - RNA, 22 nt, Human
uuuuccuuagaaauacauugau

SEQ ID NO: 66513 - RNA, 22 nt, Human
ggggcaucguugauugcauggu

SEQ ID NO: 66514 - RNA, 22 nt, Human
ugaaauuuuuuggagauaauuu

SEQ ID NO: 66515 - RNA, 22 nt, Human
cagagcugucauuugccaguga

SEQ ID NO: 66516 - RNA, 22 nt, Human
cuguguguauaauguuugauaa

SEQ ID NO: 66517 - RNA, 22 nt, Human
augaggaacagcaagaauauuu

SEQ ID NO: 66518 - RNA, 22 nt, Human
uuccacaugaucauuguaauaa

SEQ ID NO: 66519 - RNA, 22 nt, Human
gaggcaggaagggaggguugug

SEQ ID NO: 66520 - RNA, 22 nt, Human
uuguuauuauuauuuucguucu

SEQ ID NO: 66521 - RNA, 22 nt, Human
ggagacagauggcgucucaguu

SEQ ID NO: 66522 - RNA, 22 nt, Human
gaggagcugggucagggagaca

SEQ ID NO: 66523 - RNA, 22 nt, Human
gggggcugugugcccgcucccc

SEQ ID NO: 66524 - RNA, 22 nt, Human
uuuauuuacuuucgguucugcu

SEQ ID NO: 66525 - RNA, 22 nt, Human
cauggcaggugcagauucugug

SEQ ID NO: 66526 - RNA, 22 nt, Human
cuucucuuggguguggugucuu

SEQ ID NO: 66527 - RNA, 22 nt, Human
gaguucuagauguauuauuaau

SEQ ID NO: 66528 - RNA, 22 nt, Human
ugcuguugacuuuguuguucuu

SEQ ID NO: 66529 - RNA, 22 nt, Human
aagugugugugcgcaugugcau

SEQ ID NO: 66530 - RNA, 22 nt, Human
ucucaaagguuuuccucuuuuu

SEQ ID NO: 66531 - RNA, 22 nt, Human
ggcagaggagcuggaaacaugg

SEQ ID NO: 66532 - RNA, 18 nt, Human
ggagaagaacagaugugg

SEQ ID NO: 66533 - RNA, 22 nt, Human
aaauguuucauucuauuuuuag

SEQ ID NO: 66534 - RNA, 22 nt, Human
auaaaacagaucaggagaauga

SEQ ID NO: 66535 - RNA, 22 nt, Human
agcugaggccccgcagcagggu

SEQ ID NO: 66536 - RNA, 22 nt, Human
aaaauauucuauaucaaagaua

SEQ ID NO: 66537 - RNA, 22 nt, Human
ccagaugggggcugugggaggg

SEQ ID NO: 66538 - RNA, 22 nt, Human
agaguguagugaaaagagauua

SEQ ID NO: 66539 - RNA, 22 nt, Human
guuuuucuuugauuuagaacca

SEQ ID NO: 66540 - RNA, 22 nt, Human
agucugugguccucuguaucuc

SEQ ID NO: 66541 - RNA, 22 nt, Human
acucacuguuuugaaauugaac

SEQ ID NO: 66542 - RNA, 22 nt, Human
cucacugucagcugcagggcuu

SEQ ID NO: 66543 - RNA, 22 nt, Human
uguuccucuuagucuuaugugu

SEQ ID NO: 66544 - RNA, 22 nt, Human
ugagggaggggaaugugugcag

SEQ ID NO: 66545 - RNA, 22 nt, Human
gaauuagacggcaucacauggg

SEQ ID NO: 66546 - RNA, 22 nt, Human
guuaaaaugauuugugauuuau

SEQ ID NO: 66547 - RNA, 22 nt, Human
aauauuuaaauagaauuacauc

SEQ ID NO: 66548 - RNA, 22 nt, Human
ucuucaugaaauugauugcuua

SEQ ID NO: 66549 - RNA, 22 nt, Human
ggagagcuagugagcuggaggu

SEQ ID NO: 66550 - RNA, 20 nt, Human
uaguggaccuugaaggccuc

SEQ ID NO: 66551 - RNA, 21 nt, Human
aaguuucucccuaauuguugc

SEQ ID NO: 66552 - RNA, 22 nt, Human
ugguuuuuuguaggauaaacau

SEQ ID NO: 66553 - RNA, 22 nt, Human
ccugccagaaaagagggaguuc

SEQ ID NO: 66554 - RNA, 22 nt, Human
gggcuguggggccugcagaagg

SEQ ID NO: 66555 - RNA, 22 nt, Human
uuuaauauuacacuuaccuugu

SEQ ID NO: 66556 - RNA, 22 nt, Human
gagggaggugacaaggacauag

SEQ ID NO: 66557 - RNA, 22 nt, Human
cuugcucugggaauaugaguuu

SEQ ID NO: 66558 - RNA, 22 nt, Human
aggcaguguggagggcuguugc

SEQ ID NO: 66559 - RNA, 22 nt, Human
aaauauagugacacuuauaguc

SEQ ID NO: 66560 - RNA, 22 nt, Human
accuccauggcccacaucuagu

SEQ ID NO: 66561 - RNA, 22 nt, Human
cuuuuuuucuccauauuucugg

SEQ ID NO: 66562 - RNA, 22 nt, Human
agguggucccaauggcugggca

SEQ ID NO: 66563 - RNA, 22 nt, Human
uugaaaaaaucugaggaggacc

SEQ ID NO: 66564 - RNA, 22 nt, Human
guugagaaucucuagcuuagga

SEQ ID NO: 66565 - RNA, 22 nt, Human
agagggagagaccuccgugccu

SEQ ID NO: 66566 - RNA, 22 nt, Human
uggcagccugcgugaaggagcu

SEQ ID NO: 66567 - RNA, 22 nt, Human
agcggccucgcugccugcucag

SEQ ID NO: 66568 - RNA, 20 nt, Human
ccuuguggaugucuuuuuug

SEQ ID NO: 66569 - RNA, 22 nt, Human
auuuuuuuggucauaugagaua

SEQ ID NO: 66570 - RNA, 20 nt, Human
ugauuauuccaacaagaaug

SEQ ID NO: 66571 - RNA, 22 nt, Human
uguugaagcaccucugucuuuc

SEQ ID NO: 66572 - RNA, 22 nt, Human
uuuaaauuucugaaucuugagg

SEQ ID NO: 66573 - RNA, 22 nt, Human
uucacuguucuuagagaagacc

SEQ ID NO: 66574 - RNA, 22 nt, Human
gccugggguuugcggggcugca

SEQ ID NO: 66575 - RNA, 22 nt, Human
gggcagagagcuggaacuccuu

SEQ ID NO: 66576 - RNA, 22 nt, Human
agggagucuggccgucggcugg

SEQ ID NO: 66577 - RNA, 22 nt, Human
agcaaaauuccaaaaugcuaau

SEQ ID NO: 66578 - RNA, 22 nt, Human
uuuaugucaaaaguaaaaugaa

SEQ ID NO: 66579 - RNA, 22 nt, Human
uuuucaauuuucauuugcaaga

SEQ ID NO: 66580 - RNA, 22 nt, Human
auuuuguugaaacccuuguugu

SEQ ID NO: 66581 - RNA, 21 nt, Human
ugagcccaaagcuguauuggu

SEQ ID NO: 66582 - RNA, 22 nt, Human
gugucccaaagauuagaaauca

SEQ ID NO: 66583 - RNA, 22 nt, Human
cuccuuugagcaaaucuuugau

SEQ ID NO: 66584 - RNA, 22 nt, Human
ccaaccaguuucuuggcuuuag

SEQ ID NO: 66585 - RNA, 22 nt, Human
acuggagcccguggaggcgcag

SEQ ID NO: 66586 - RNA, 18 nt, Human
uucucucuggauaguagu

SEQ ID NO: 66587 - RNA, 22 nt, Human
ugggggaggaggagacagacug

SEQ ID NO: 66588 - RNA, 22 nt, Human
ucucccaaaucuuucuagcaca

SEQ ID NO: 66589 - RNA, 22 nt, Human
uuuaaaauguuuuauuuauuua

SEQ ID NO: 66590 - RNA, 22 nt, Human
uucaaaaugcagaauaguuugg

SEQ ID NO: 66591 - RNA, 22 nt, Human
auacaucuuaacgcgcucuugg

SEQ ID NO: 66592 - RNA, 22 nt, Human
uuuucauagccagaaacugaaa

SEQ ID NO: 66593 - RNA, 19 nt, Human
uggugcgcuguuccugagc

SEQ ID NO: 66594 - RNA, 22 nt, Human
auuuccagcagcauauuugucu

SEQ ID NO: 66595 - RNA, 22 nt, Human
agggcaguuuuacugaaaggug

SEQ ID NO: 66596 - RNA, 22 nt, Human
aaauauuugaaugguguaagau

SEQ ID NO: 66597 - RNA, 21 nt, Human
gggagugaguaaugauggggg

SEQ ID NO: 66598 - RNA, 22 nt, Human
ugggcagggagcuggaaccaca

SEQ ID NO: 66599 - RNA, 22 nt, Human
uaaaugauaguauugaagguag

SEQ ID NO: 66600 - RNA, 22 nt, Human
ucauacuuuuuugacccuugug

SEQ ID NO: 66601 - RNA, 22 nt, Human
ugcucacugcuuguguucaguu

SEQ ID NO: 66602 - RNA, 20 nt, Human
agugauuuguuaguacauug

SEQ ID NO: 66603 - RNA, 22 nt, Human
uggaagcccagaaggaagcaga

SEQ ID NO: 66604 - RNA, 22 nt, Human
auuuauauauuuuguucuggua

SEQ ID NO: 66605 - RNA, 22 nt, Human
agcacagugccugacauauaug

SEQ ID NO: 66606 - RNA, 22 nt, Human
uucauuuccauuuuauagauaa

SEQ ID NO: 66607 - RNA, 22 nt, Human
aagaaauacagaaauggcagua

SEQ ID NO: 66608 - RNA, 22 nt, Human
aagccuccgugcugcuggaucu

SEQ ID NO: 66609 - RNA, 22 nt, Human
cagaccuggaaaacaggcuugc

SEQ ID NO: 66610 - RNA, 22 nt, Human
cccagagggcugaggauaugaa

SEQ ID NO: 66611 - RNA, 22 nt, Human
ugggggagggagaguugauggg

SEQ ID NO: 66612 - RNA, 22 nt, Human
uugauagauuuuagaggcaggc

SEQ ID NO: 66613 - RNA, 22 nt, Human
uuacuuaucugaugugauuuuu

SEQ ID NO: 66614 - RNA, 22 nt, Human
ugagagguagaacuuguagugu

SEQ ID NO: 66615 - RNA, 22 nt, Human
uauuuuagccaacagaaugaug

SEQ ID NO: 66616 - RNA, 22 nt, Human
uuucacugaguaggagagcacu

SEQ ID NO: 66617 - RNA, 22 nt, Human
uauauuaaagugcuuugcagug

SEQ ID NO: 66618 - RNA, 22 nt, Human
cagcuguggagauggggugcau

SEQ ID NO: 66619 - RNA, 22 nt, Human
uuucuugugauuuugaugaacu

SEQ ID NO: 66620 - RNA, 22 nt, Human
agaacauaucuguuuucuaacu

SEQ ID NO: 66621 - RNA, 20 nt, Human
ucuugucuggcagccuggag

SEQ ID NO: 66622 - RNA, 22 nt, Human
cccuguccuucccuccaucuga

SEQ ID NO: 66623 - RNA, 22 nt, Human
gagcagcucgagaaggaagcag

SEQ ID NO: 66624 - RNA, 22 nt, Human
ucucugaggaagcgaucuuuag

SEQ ID NO: 66625 - RNA, 22 nt, Human
aucuucuuucaucagccccuca

SEQ ID NO: 66626 - RNA, 22 nt, Human
ggcuguggcagcuggaaguggu

SEQ ID NO: 66627 - RNA, 22 nt, Human
gucagacucuggggccccaggc

SEQ ID NO: 66628 - RNA, 22 nt, Human
aauucuguugguuagaguugga

SEQ ID NO: 66629 - RNA, 22 nt, Human
caauaccucuuggugauugggc

SEQ ID NO: 66630 - RNA, 22 nt, Human
uggggcuccuccuggcaggagg

SEQ ID NO: 66631 - RNA, 17 nt, Human
ucuuuuacuuucucucc

SEQ ID NO: 66632 - RNA, 22 nt, Human
aguugggaaaugcugcaguagu

SEQ ID NO: 66633 - RNA, 22 nt, Human
auguucucagguuguauuuauu

SEQ ID NO: 66634 - RNA, 22 nt, Human
ugccagcuccgaggagcugcag

SEQ ID NO: 66635 - RNA, 22 nt, Human
aggcaggggagcuggaagggua

SEQ ID NO: 66636 - RNA, 21 nt, Human
cuccuguaaaucaccuccgca

SEQ ID NO: 66637 - RNA, 20 nt, Human
agaaggagagaugaggcaaa

SEQ ID NO: 66638 - RNA, 22 nt, Human
ucauuguuuacugucuuuuuuc

SEQ ID NO: 66639 - RNA, 22 nt, Human
gugguuuagccuucauuaaccu

SEQ ID NO: 66640 - RNA, 22 nt, Human
aaaauauuuaucuagcucuuaa

SEQ ID NO: 66641 - RNA, 22 nt, Human
uaauaaaaauuuaauucacauu

SEQ ID NO: 66642 - RNA, 22 nt, Human
gcuucucacccuuacuaucucu

SEQ ID NO: 66643 - RNA, 21 nt, Human
uccucucuaaguuccgccccg

SEQ ID NO: 66644 - RNA, 22 nt, Human
uugaauaaggcauaaagauacu

SEQ ID NO: 66645 - RNA, 22 nt, Human
aggcuccucugggggccccgga

SEQ ID NO: 66646 - RNA, 17 nt, Human
aaagccgaucagauguu

SEQ ID NO: 66647 - RNA, 22 nt, Human
uuuuuuaaucaaguaggaaaca

SEQ ID NO: 66648 - RNA, 22 nt, Human
cuguccauuuucgugccuccuu

SEQ ID NO: 66649 - RNA, 22 nt, Human
ucugagugacguccugacagga

SEQ ID NO: 66650 - RNA, 22 nt, Human
gggcugagagcuggaaucugag

SEQ ID NO: 66651 - RNA, 22 nt, Human
gucccagaggacagggucacau

SEQ ID NO: 66652 - RNA, 22 nt, Human
ggaggaagagaccagggggcuu

SEQ ID NO: 66653 - RNA, 22 nt, Human
gagggagugggcccgugggcac

SEQ ID NO: 66654 - RNA, 22 nt, Human
gaauucuaguucuguaucucug

SEQ ID NO: 66655 - RNA, 22 nt, Human
uguuuagcucugacuaugugau

SEQ ID NO: 66656 - RNA, 22 nt, Human
cuuuacauuaauuucuacugau

SEQ ID NO: 66657 - RNA, 22 nt, Human
auggaguguggccaggcaguaa

SEQ ID NO: 66658 - RNA, 22 nt, Human
uuuucucuuugcuucucuaaaa

SEQ ID NO: 66659 - RNA, 22 nt, Human
auuuucuugucucuguuguagg

SEQ ID NO: 66660 - RNA, 20 nt, Human
uucacagaggacucagguca

SEQ ID NO: 66661 - RNA, 22 nt, Human
uuccgcuuucaauggcuuggcu

SEQ ID NO: 66662 - RNA, 22 nt, Human
gcugcuuagaaccauauuuaaa

SEQ ID NO: 66663 - RNA, 22 nt, Human
cuuacauuuguuuaguguuucc

SEQ ID NO: 66664 - RNA, 22 nt, Human
uguguuguuggggauguuuuca

SEQ ID NO: 66665 - RNA, 22 nt, Human
uagggaggguuugggguggagg

SEQ ID NO: 66666 - RNA, 22 nt, Human
aaugaaaaucugucaguucaag

SEQ ID NO: 66667 - RNA, 23 nt, Human
aaggugaagccaccaggugagga

SEQ ID NO: 66668 - RNA, 22 nt, Human
acugucuuguuguaugugagcu

SEQ ID NO: 66669 - RNA, 22 nt, Human
uccuuccucuuucaaauuuguu

SEQ ID NO: 66670 - RNA, 22 nt, Human
uuuguuuuggugucaugcguga

SEQ ID NO: 66671 - RNA, 22 nt, Human
agggcaggguuggugcuggugc

SEQ ID NO: 66672 - RNA, 22 nt, Human
uuuuuguaaaugaaguuuuauu

SEQ ID NO: 66673 - RNA, 22 nt, Human
cugcaucacagcaggaggcaca

SEQ ID NO: 66674 - RNA, 22 nt, Human
ucccaaguguuuggcgaggaga

SEQ ID NO: 66675 - RNA, 22 nt, Human
augcugugccuggaaagcggcu

SEQ ID NO: 66676 - RNA, 22 nt, Human
uggaaggugauucucugguuaa

SEQ ID NO: 66677 - RNA, 22 nt, Human
ggcugggagguggcgaggaggc

SEQ ID NO: 66678 - RNA, 22 nt, Human
uggcaaggccacaggugcaguu

SEQ ID NO: 66679 - RNA, 22 nt, Human
aaauucuuccaggaggaaauac

SEQ ID NO: 66680 - RNA, 22 nt, Human
guguugaugugucuguauucua

SEQ ID NO: 66681 - RNA, 22 nt, Human
ucuuccuuguaagggcuuuaga

SEQ ID NO: 66682 - RNA, 22 nt, Human
auucuguaggcuuuuguuaaaa

SEQ ID NO: 66683 - RNA, 22 nt, Human
auuuuagagaaacaaacguagg

SEQ ID NO: 66684 - RNA, 20 nt, Human
ucucuuuuucuucuuuucuc

SEQ ID NO: 66685 - RNA, 22 nt, Human
uggcucaguaaucgagucuccu

SEQ ID NO: 66686 - RNA, 22 nt, Human
ucacuguuucaccgucugaagg

SEQ ID NO: 66687 - RNA, 22 nt, Human
uguauuuuuucccugaaauaaa

SEQ ID NO: 66688 - RNA, 22 nt, Human
aguuauuuuucacuauuaggcu

SEQ ID NO: 66689 - RNA, 17 nt, Human
auuguuuuuaauuugca

SEQ ID NO: 66690 - RNA, 22 nt, Human
uaguucugaauagcauugaaga

SEQ ID NO: 66691 - RNA, 22 nt, Human
aauuuauccuuuugcuaaagca

SEQ ID NO: 66692 - RNA, 18 nt, Human
uauuuacuguguguuacc

SEQ ID NO: 66693 - RNA, 22 nt, Human
cuccucccagcccaggcgccac

SEQ ID NO: 66694 - RNA, 22 nt, Human
ucagcucacaauguugagaaag

SEQ ID NO: 66695 - RNA, 22 nt, Human
ggcugggaggcggaggcugaga

SEQ ID NO: 66696 - RNA, 20 nt, Human
auggaaacacgcagccccaa

SEQ ID NO: 66697 - RNA, 22 nt, Human
ggggaggguuuggaugagaguc

SEQ ID NO: 66698 - RNA, 22 nt, Human
uguccuuucagagcuccuuuug

SEQ ID NO: 66699 - RNA, 22 nt, Human
guguucucagcacccacuucau

SEQ ID NO: 66700 - RNA, 22 nt, Human
gcuguggaaaaugggucuccaa

SEQ ID NO: 66701 - RNA, 22 nt, Human
ugguccaccgccucauucucug

SEQ ID NO: 66702 - RNA, 21 nt, Human
aggugaaggcgagggggacag

SEQ ID NO: 66703 - RNA, 22 nt, Human
cuguuucucugccugcacacau

SEQ ID NO: 66704 - RNA, 22 nt, Human
uuuuuguuauuuagguguagag

SEQ ID NO: 66705 - RNA, 22 nt, Human
aacgagcugggggggccggggg

SEQ ID NO: 66706 - RNA, 22 nt, Human
ggcuggggccuguugaagaugc

SEQ ID NO: 66707 - RNA, 22 nt, Human
aaagggagauaaaguaauuuua

SEQ ID NO: 66708 - RNA, 22 nt, Human
ccccauggaaaacccaccuagg

SEQ ID NO: 66709 - RNA, 22 nt, Human
guuuccaggcuuugguaugguu

SEQ ID NO: 66710 - RNA, 22 nt, Human
cacugguugccucuuucuguuc

SEQ ID NO: 66711 - RNA, 22 nt, Human
guuguuuuuguuaaaacaguga

SEQ ID NO: 66712 - RNA, 22 nt, Human
caaaucuguuaauuucaaguug

SEQ ID NO: 66713 - RNA, 22 nt, Human
caguggagaccugccugcugga

SEQ ID NO: 66714 - RNA, 19 nt, Human
ugccuggcaccagcuccac

SEQ ID NO: 66715 - RNA, 22 nt, Human
guucuucagcccucagguccua

SEQ ID NO: 66716 - RNA, 22 nt, Human
aauguugaaccuuuuuggccug

SEQ ID NO: 66717 - RNA, 22 nt, Human
gaggagggagcuggaagcucuu

SEQ ID NO: 66718 - RNA, 22 nt, Human
agagcuccaggguuuuguagug

SEQ ID NO: 66719 - RNA, 19 nt, Human
ccaguuuuuuaauauucaa

SEQ ID NO: 66720 - RNA, 22 nt, Human
ugcuuuauucgacaucugguag

SEQ ID NO: 66721 - RNA, 22 nt, Human
gagaacagauaugaugacuuca

SEQ ID NO: 66722 - RNA, 22 nt, Human
ucaccaugcccuucucugcucu

SEQ ID NO: 66723 - RNA, 22 nt, Human
uugccaggggacaucuggagcc

SEQ ID NO: 66724 - RNA, 22 nt, Human
ugcuuucagauaucuguuucaa

SEQ ID NO: 66725 - RNA, 22 nt, Human
uguuggaaucuucuagucuucc

SEQ ID NO: 66726 - RNA, 22 nt, Human
cuuggggauuuuaaagaccucu

SEQ ID NO: 66727 - RNA, 22 nt, Human
uucauagaagggaguuuuuccu

SEQ ID NO: 66728 - RNA, 22 nt, Human
uggggcuggccaggaggagucu

SEQ ID NO: 66729 - RNA, 22 nt, Human
gucacuuugcuugcgaugcucc

SEQ ID NO: 66730 - RNA, 22 nt, Human
gcuucuguuaggauguggcuua

SEQ ID NO: 66731 - RNA, 22 nt, Human
agggcugggcuuggcaggcugg

SEQ ID NO: 66732 - RNA, 22 nt, Human
uuuuuuccuguuugucuuuggg

SEQ ID NO: 66733 - RNA, 22 nt, Human
cucuguguguuugugugugugu

SEQ ID NO: 66734 - RNA, 23 nt, Human
uucuuuccuuaucccauuuacuu

SEQ ID NO: 66735 - RNA, 22 nt, Human
agagggagagauuggcaaucag

SEQ ID NO: 66736 - RNA, 22 nt, Human
auggauggaagcagccugaacu

SEQ ID NO: 66737 - RNA, 20 nt, Human
uuggagaucacguguccagg

SEQ ID NO: 66738 - RNA, 22 nt, Human
uguaaagugguauuuaauuuua

SEQ ID NO: 66739 - RNA, 22 nt, Human
guccccugcguguucauccugg

SEQ ID NO: 66740 - RNA, 22 nt, Human
uucuuuguccuagcauucuaca

SEQ ID NO: 66741 - RNA, 22 nt, Human
gcagggcucuggagucaggcug

SEQ ID NO: 66742 - RNA, 22 nt, Human
ugucuuuuaaaaauguguaaaa

SEQ ID NO: 66743 - RNA, 18 nt, Human
auucauuugcguuuggcu

SEQ ID NO: 66744 - RNA, 22 nt, Human
aguuuccacuggagacacugug

SEQ ID NO: 66745 - RNA, 22 nt, Human
ccuuuccucuucaugacuuucu

SEQ ID NO: 66746 - RNA, 22 nt, Human
ccuuuggaugucauucuuggca

SEQ ID NO: 66747 - RNA, 22 nt, Human
agcaaggguugguuuucugaca

SEQ ID NO: 66748 - RNA, 22 nt, Human
guucucuuaauccuaguuggua

SEQ ID NO: 66749 - RNA, 22 nt, Human
uuuccuuuguuuugguauaugu

SEQ ID NO: 66750 - RNA, 22 nt, Human
uacauuugauuuuugcuucuuu

SEQ ID NO: 66751 - RNA, 22 nt, Human
gcuuucacugcaauagaugaau

SEQ ID NO: 66752 - RNA, 19 nt, Human
agagucuccacuccacuug

SEQ ID NO: 66753 - RNA, 22 nt, Human
uuuuaaaguaauugaagcuugu

SEQ ID NO: 66754 - RNA, 21 nt, Human
ugccuggccuuugcuuuuccu

SEQ ID NO: 66755 - RNA, 20 nt, Human
aggggcuguaguuagaugac

SEQ ID NO: 66756 - RNA, 22 nt, Human
guccuguguaaguacuugcuca

SEQ ID NO: 66757 - RNA, 22 nt, Human
uguuuguuuuguauuuuuaauu

SEQ ID NO: 66758 - RNA, 22 nt, Human
cagcuggggagagacauggcag

SEQ ID NO: 66759 - RNA, 22 nt, Human
uuucuggacuaaagggagagau

SEQ ID NO: 66760 - RNA, 22 nt, Human
ucugaauauguuuaucaucucu

SEQ ID NO: 66761 - RNA, 22 nt, Human
aggggaggcugggcuggggggc

SEQ ID NO: 66762 - RNA, 22 nt, Human
cuuucuuuuugguuucccccca

SEQ ID NO: 66763 - RNA, 22 nt, Human
ugugucuuuggcgaugucugga

SEQ ID NO: 66764 - RNA, 20 nt, Human
uuguacuuaugugagaagga

SEQ ID NO: 66765 - RNA, 22 nt, Human
aaaucauagccaugaacauuug

SEQ ID NO: 66766 - RNA, 22 nt, Human
gggagggucugagagcugcacc

SEQ ID NO: 66767 - RNA, 17 nt, Human
uuagagcuacauguuga

SEQ ID NO: 66768 - RNA, 17 nt, Human
ucuguguccgcucaguc

SEQ ID NO: 66769 - RNA, 22 nt, Human
cugucucugauaagcucgaggg

SEQ ID NO: 66770 - RNA, 23 nt, Human
uuucugaguuuuuuaaaagucca

SEQ ID NO: 66771 - RNA, 22 nt, Human
cugcugugcagacagacucucu

SEQ ID NO: 66772 - RNA, 21 nt, Human
uccugccuuaguccagagcag

SEQ ID NO: 66773 - RNA, 22 nt, Human
cuccaugagccaggagggcuac

SEQ ID NO: 66774 - RNA, 22 nt, Human
auuauaauucauuaggcuuagu

SEQ ID NO: 66775 - RNA, 22 nt, Human
uauuucaugagugaauaucuag

SEQ ID NO: 66776 - RNA, 22 nt, Human
ugcuuucaaaacucagaggaau

SEQ ID NO: 66777 - RNA, 22 nt, Human
aaauauugaauuugaggaugua

SEQ ID NO: 66778 - RNA, 22 nt, Human
uucuuuuaauuucugucugcag

SEQ ID NO: 66779 - RNA, 22 nt, Human
uuaucuuuuaaaaacacuugug

SEQ ID NO: 66780 - RNA, 22 nt, Human
ucgcccagguuggagugcagug

SEQ ID NO: 66781 - RNA, 22 nt, Human
uaaaacuaugcaaccuacuacc

SEQ ID NO: 66782 - RNA, 22 nt, Human
agucacuguucugucaugucaa

SEQ ID NO: 66783 - RNA, 22 nt, Human
aucacuagaguuacauugccag

SEQ ID NO: 66784 - RNA, 22 nt, Human
uauuguuuuaagguguauuaau

SEQ ID NO: 66785 - RNA, 22 nt, Human
auucauucugaccucaagagaa

SEQ ID NO: 66786 - RNA, 22 nt, Human
ccuccuggaguuacuuccaaaa

SEQ ID NO: 66787 - RNA, 22 nt, Human
uugugugugcccaccuguggcc

SEQ ID NO: 66788 - RNA, 22 nt, Human
ugaggaagugguuguaugguuu

SEQ ID NO: 66789 - RNA, 22 nt, Human
ugguucuagaugagaugaugag

SEQ ID NO: 66790 - RNA, 22 nt, Human
uugcuuuuuuggguuuacuggg

SEQ ID NO: 66791 - RNA, 20 nt, Human
gaacauaaauaacucuuuac

SEQ ID NO: 66792 - RNA, 21 nt, Human
uuccuccucuggagaagaaga

SEQ ID NO: 66793 - RNA, 22 nt, Human
aucauguauauuuuugcuauua

SEQ ID NO: 66794 - RNA, 23 nt, Human
aaauaauaauuucucuguuggga

SEQ ID NO: 66795 - RNA, 22 nt, Human
ccuuuuaucgcgaagaacucca

SEQ ID NO: 66796 - RNA, 22 nt, Human
acucauuuggauuuuggaguuu

SEQ ID NO: 66797 - RNA, 22 nt, Human
ucugcaugccucaggaggccug

SEQ ID NO: 66798 - RNA, 22 nt, Human
acauuccugaagguaaugagaa

SEQ ID NO: 66799 - RNA, 22 nt, Human
agcagggagacagugcagcauu

SEQ ID NO: 66800 - RNA, 22 nt, Human
auaaaaauguuuuuguguggua

SEQ ID NO: 66801 - RNA, 22 nt, Human
uuguuauaggaucagugucacu

SEQ ID NO: 66802 - RNA, 21 nt, Human
guucuuaguuauauucucaau

SEQ ID NO: 66803 - RNA, 22 nt, Human
acgugugugugcacguguguau

SEQ ID NO: 66804 - RNA, 22 nt, Human
ucucucugcuguccagcguuau

SEQ ID NO: 66805 - RNA, 22 nt, Human
gggagccucccacugggggaag

SEQ ID NO: 66806 - RNA, 22 nt, Human
uuucuaaaaccagaguuuauaa

SEQ ID NO: 66807 - RNA, 22 nt, Human
uaccuggauaaauguacaaccg

SEQ ID NO: 66808 - RNA, 22 nt, Human
uaaaaucaugacagauugacau

SEQ ID NO: 66809 - RNA, 22 nt, Human
aucucacuucugucauguggca

SEQ ID NO: 66810 - RNA, 22 nt, Human
uucuuuuaauagagauccugug

SEQ ID NO: 66811 - RNA, 22 nt, Human
cuccuuuuccuacucauacuau

SEQ ID NO: 66812 - RNA, 22 nt, Human
cccagaggcugaguugggagca

SEQ ID NO: 66813 - RNA, 22 nt, Human
guucuucagauuccauuucagu

SEQ ID NO: 66814 - RNA, 22 nt, Human
aagacagugacagucacaauug

SEQ ID NO: 66815 - RNA, 22 nt, Human
cauuuugguaauguucguuugc

SEQ ID NO: 66816 - RNA, 22 nt, Human
ccucuccuugcuccccuuccuu

SEQ ID NO: 66817 - RNA, 23 nt, Human
acaaguguuuccaauauggcugg

SEQ ID NO: 66818 - RNA, 22 nt, Human
uucauuagcacauuuccuuggu

SEQ ID NO: 66819 - RNA, 22 nt, Human
caauggagccaagaggaggaaa

SEQ ID NO: 66820 - RNA, 21 nt, Human
uccugccuggccuucugacua

SEQ ID NO: 66821 - RNA, 19 nt, Human
uccuacaugagacagagag

SEQ ID NO: 66822 - RNA, 22 nt, Human
gcacuguauuuaaauauuuaaa

SEQ ID NO: 66823 - RNA, 22 nt, Human
auggugaugaugaugaugauaa

SEQ ID NO: 66824 - RNA, 22 nt, Human
cuauguuucagauauauauaua

SEQ ID NO: 66825 - RNA, 22 nt, Human
uuauuuaagaucuuaauauaua

SEQ ID NO: 66826 - RNA, 22 nt, Human
uuuuguuacugauuauuaaaau

SEQ ID NO: 66827 - RNA, 22 nt, Human
ucucucucucuuccagcauguu

SEQ ID NO: 66828 - RNA, 22 nt, Human
aguuucuugaagacugauguuu

SEQ ID NO: 66829 - RNA, 22 nt, Human
uccauguauugcuaacaaauag

SEQ ID NO: 66830 - RNA, 22 nt, Human
uugaaaauuaauagguguacaa

SEQ ID NO: 66831 - RNA, 22 nt, Human
gaggucagugugggggcaaggg

SEQ ID NO: 66832 - RNA, 22 nt, Human
uaguuucuucaacugucccagc

SEQ ID NO: 66833 - RNA, 22 nt, Human
aguuugauuugucuaucuucau

SEQ ID NO: 66834 - RNA, 22 nt, Human
cuucuuuuggggaugaaaaugg

SEQ ID NO: 66835 - RNA, 22 nt, Human
guucaaucucucaugcauuuuc

SEQ ID NO: 66836 - RNA, 22 nt, Human
guucuacaugacacucaacauu

SEQ ID NO: 66837 - RNA, 22 nt, Human
ugagguuacauuaggaauaacc

SEQ ID NO: 66838 - RNA, 22 nt, Human
uggaggcccagcugggggccgg

SEQ ID NO: 66839 - RNA, 22 nt, Human
uguuuuuuagagugauacuuuu

SEQ ID NO: 66840 - RNA, 22 nt, Human
uugcucuuaccauuauguguga

SEQ ID NO: 66841 - RNA, 22 nt, Human
uggaguuuuaaucuguacagaa

SEQ ID NO: 66842 - RNA, 22 nt, Human
aauauuuugggacugaggaauu

SEQ ID NO: 66843 - RNA, 22 nt, Human
aguaggaauucaaagagacaaa

SEQ ID NO: 66844 - RNA, 22 nt, Human
acuggguuguuugucucaugag

SEQ ID NO: 66845 - RNA, 22 nt, Human
ucucugaccuccaccccaggag

SEQ ID NO: 66846 - RNA, 22 nt, Human
caacuucugcuuucuuccuugc

SEQ ID NO: 66847 - RNA, 22 nt, Human
ugcauucugaacguaaauguga

SEQ ID NO: 66848 - RNA, 20 nt, Human
uucucugcagcaggcggccc

SEQ ID NO: 66849 - RNA, 22 nt, Human
uacuauuuugacaugaaauuga

SEQ ID NO: 66850 - RNA, 21 nt, Human
aggcuuggaucuagacaggcc

SEQ ID NO: 66851 - RNA, 22 nt, Human
aagagaggaaagggugugaggu

SEQ ID NO: 66852 - RNA, 22 nt, Human
caaaaaauccauagaaagaggu

SEQ ID NO: 66853 - RNA, 22 nt, Human
cucagaauugucaccucaaaaa

SEQ ID NO: 66854 - RNA, 22 nt, Human
ugcuuggauuuccaaaugguuu

SEQ ID NO: 66855 - RNA, 22 nt, Human
gcuuucagggucacugucaaca

SEQ ID NO: 66856 - RNA, 22 nt, Human
acuguugagggaagcagaugaa

SEQ ID NO: 66857 - RNA, 22 nt, Human
uuaacauuguccuuagcagauu

SEQ ID NO: 66858 - RNA, 22 nt, Human
aagagugaguagcuugguuggu

SEQ ID NO: 66859 - RNA, 20 nt, Human
uccaguuuuggagacauucu

SEQ ID NO: 66860 - RNA, 22 nt, Human
guuguugucauuagcuguuuaa

SEQ ID NO: 66861 - RNA, 22 nt, Human
gcccuagaguugagagcaccca

SEQ ID NO: 66862 - RNA, 22 nt, Human
uagcugucauuggaucagaagg

SEQ ID NO: 66863 - RNA, 22 nt, Human
uauuuuuacuguuugaugauuc

SEQ ID NO: 66864 - RNA, 22 nt, Human
ugguugauuaauuuugccaagc

SEQ ID NO: 66865 - RNA, 22 nt, Human
aauaucuugaguuauaaauuca

SEQ ID NO: 66866 - RNA, 22 nt, Human
cuggagaacucugugcuucacu

SEQ ID NO: 66867 - RNA, 22 nt, Human
uuuauaauuacguaaaauauuu

SEQ ID NO: 66868 - RNA, 22 nt, Human
uaugggcaagagauaggugguc

SEQ ID NO: 66869 - RNA, 22 nt, Human
ggggcucauuugcaggggggag

SEQ ID NO: 66870 - RNA, 22 nt, Human
augggagggugaggaggcagcu

SEQ ID NO: 66871 - RNA, 22 nt, Human
acuuccuuuuuuggggauagca

SEQ ID NO: 66872 - RNA, 22 nt, Human
ugaagacaguuuuacucaugag

SEQ ID NO: 66873 - RNA, 22 nt, Human
gugaaauuguacacucaguacc

SEQ ID NO: 66874 - RNA, 22 nt, Human
uauauacacgcacauauacaua

SEQ ID NO: 66875 - RNA, 22 nt, Human
cuuggcuccuucacagggagau

SEQ ID NO: 66876 - RNA, 22 nt, Human
aaugauuuucugcaaacaguga

SEQ ID NO: 66877 - RNA, 22 nt, Human
ggagccucuaaacaguuaucaa

SEQ ID NO: 66878 - RNA, 22 nt, Human
ggaggccgugcugugcugccag

SEQ ID NO: 66879 - RNA, 20 nt, Human
cuuauuuuggagaacuuuuc

SEQ ID NO: 66880 - RNA, 22 nt, Human
cuguggcugcgcccugggggag

SEQ ID NO: 66881 - RNA, 22 nt, Human
gcuuuggcuucuccuggcagga

SEQ ID NO: 66882 - RNA, 22 nt, Human
aguaaaugaaagcaauuuuaga

SEQ ID NO: 66883 - RNA, 22 nt, Human
caggccccagggacugggcgcu

SEQ ID NO: 66884 - RNA, 22 nt, Human
aaauuaaaguuuuauuuagagc

SEQ ID NO: 66885 - RNA, 19 nt, Human
uccaccgcgugcaccucua

SEQ ID NO: 66886 - RNA, 22 nt, Human
uggcucacuuccguggagaggu

SEQ ID NO: 66887 - RNA, 23 nt, Human
ucugccuccuaauuguugguguc

SEQ ID NO: 66888 - RNA, 22 nt, Human
uuuguuaugguuggaagcagga

SEQ ID NO: 66889 - RNA, 22 nt, Human
agaucugucaccauccuggagc

SEQ ID NO: 66890 - RNA, 22 nt, Human
uuccuaauugccaugaaguuau

SEQ ID NO: 66891 - RNA, 22 nt, Human
uuuucucaguuuuuuucaaaag

SEQ ID NO: 66892 - RNA, 22 nt, Human
gugggggugaggaauguucuau

SEQ ID NO: 66893 - RNA, 22 nt, Human
ggcuagggaucuagaccaggac

SEQ ID NO: 66894 - RNA, 22 nt, Human
cuucagagugacucagcaucuu

SEQ ID NO: 66895 - RNA, 22 nt, Human
uugcuuucuuuguagguuuucc

SEQ ID NO: 66896 - RNA, 22 nt, Human
gaggccagcacccagaugcaug

SEQ ID NO: 66897 - RNA, 22 nt, Human
gugucacuuucaggagcucuaa

SEQ ID NO: 66898 - RNA, 22 nt, Human
uguuaguauuggcaaauuuguu

SEQ ID NO: 66899 - RNA, 22 nt, Human
cauaaauuuuaccuuguaagug

SEQ ID NO: 66900 - RNA, 22 nt, Human
uuuuccuucuuccugccuugcc

SEQ ID NO: 66901 - RNA, 22 nt, Human
augcuuucucuucuauuucuca

SEQ ID NO: 66902 - RNA, 22 nt, Human
uuauuucaggcauuuguaaaug

SEQ ID NO: 66903 - RNA, 22 nt, Human
gcacaaaagguacuucauguag

SEQ ID NO: 66904 - RNA, 22 nt, Human
gauauuuugugaaaaaacaacu

SEQ ID NO: 66905 - RNA, 22 nt, Human
guacauauccuuuacguuuugu

SEQ ID NO: 66906 - RNA, 22 nt, Human
uccuuuauuuaugggcagugua

SEQ ID NO: 66907 - RNA, 22 nt, Human
ccagucuuggugucuguagcac

SEQ ID NO: 66908 - RNA, 22 nt, Human
uuuuaaauggcuuuuacuuuuc

SEQ ID NO: 66909 - RNA, 22 nt, Human
uugaccagaaaaguuaguaauu

SEQ ID NO: 66910 - RNA, 22 nt, Human
gagggggaaaagggcagcagag

SEQ ID NO: 66911 - RNA, 22 nt, Human
ugcccacuucaaaaucuucauu

SEQ ID NO: 66912 - RNA, 20 nt, Human
ugcugugugucuacuguggg

SEQ ID NO: 66913 - RNA, 22 nt, Human
uuuauuuuccaugucucuaggu

SEQ ID NO: 66914 - RNA, 22 nt, Human
auucuuuucucuaaaugaugaa

SEQ ID NO: 66915 - RNA, 22 nt, Human
uuuguugucuucauaauacuuu

SEQ ID NO: 66916 - RNA, 22 nt, Human
uucuucuuuccuauaauuaauu

SEQ ID NO: 66917 - RNA, 22 nt, Human
aucuuuguaaguaaucaaagcu

SEQ ID NO: 66918 - RNA, 21 nt, Human
acugggcuagccugacuucug

SEQ ID NO: 66919 - RNA, 19 nt, Human
agcaucuccacagaaaaag

SEQ ID NO: 66920 - RNA, 21 nt, Human
uggcaggcagcuggaagcuug

SEQ ID NO: 66921 - RNA, 22 nt, Human
guuuuaucuauguaauuauaaa

SEQ ID NO: 66922 - RNA, 22 nt, Human
uucugcuuuaaagcucauguuu

SEQ ID NO: 66923 - RNA, 20 nt, Human
uggguucaguuguuucuggc

SEQ ID NO: 66924 - RNA, 22 nt, Human
cugcagagaccuaggucagguu

SEQ ID NO: 66925 - RNA, 22 nt, Human
ugagguauuuggauuuauauuu

SEQ ID NO: 66926 - RNA, 22 nt, Human
uuuuagaagcauuuaugagauu

SEQ ID NO: 66927 - RNA, 22 nt, Human
cggggcuggcguuagggaggca

SEQ ID NO: 66928 - RNA, 22 nt, Human
ucacuuccuugcagcuguagaa

SEQ ID NO: 66929 - RNA, 22 nt, Human
ggagaggaaguuuaaagaauug

SEQ ID NO: 66930 - RNA, 20 nt, Human
cauuccaugcaucuuggucc

SEQ ID NO: 66931 - RNA, 22 nt, Human
ugcagcuuuugguuucuagaug

SEQ ID NO: 66932 - RNA, 22 nt, Human
gcuuauuagguuauuucaagga

SEQ ID NO: 66933 - RNA, 22 nt, Human
cucuugacagcuuuaguaucau

SEQ ID NO: 66934 - RNA, 22 nt, Human
auuuucauauggguuauuugua

SEQ ID NO: 66935 - RNA, 22 nt, Human
acuuccuuccagcaaauggcau

SEQ ID NO: 66936 - RNA, 22 nt, Human
uuuuuggacccaucuucuuuuu

SEQ ID NO: 66937 - RNA, 22 nt, Human
guuuuauguuuuauagacacaa

SEQ ID NO: 66938 - RNA, 22 nt, Human
gggucagggaggccccaccaug

SEQ ID NO: 66939 - RNA, 22 nt, Human
agggcugcugcuccgggcccag

SEQ ID NO: 66940 - RNA, 22 nt, Human
augggagggagcagugaguguu

SEQ ID NO: 66941 - RNA, 22 nt, Human
uaucugcuggagguaauuacuc

SEQ ID NO: 66942 - RNA, 22 nt, Human
uucauauuguggucuugcauuc

SEQ ID NO: 66943 - RNA, 22 nt, Human
uccuuucaaauuuauuugacau

SEQ ID NO: 66944 - RNA, 22 nt, Human
uuuaacauaugaaagaauauuu

SEQ ID NO: 66945 - RNA, 22 nt, Human
uauuuuaaaagcauuaauucuu

SEQ ID NO: 66946 - RNA, 22 nt, Human
ucuccucucugaucuugcuccg

SEQ ID NO: 66947 - RNA, 22 nt, Human
uugucuuucguauggaacacua

SEQ ID NO: 66948 - RNA, 22 nt, Human
guuauuguuauugcguugucga

SEQ ID NO: 66949 - RNA, 22 nt, Human
uuuuauaauacccuugacuaau

SEQ ID NO: 66950 - RNA, 22 nt, Human
gucuccuucauuuacuguuucc

SEQ ID NO: 66951 - RNA, 18 nt, Human
cccagaggaaugccugga

SEQ ID NO: 66952 - RNA, 20 nt, Human
ccugggcuccaggagccccg

SEQ ID NO: 66953 - RNA, 22 nt, Human
uguuuuuucccccccuucuaaa

SEQ ID NO: 66954 - RNA, 22 nt, Human
uuuguacuuucuaauguauuua

SEQ ID NO: 66955 - RNA, 22 nt, Human
ccuaggcuggcugucuucaggu

SEQ ID NO: 66956 - RNA, 22 nt, Human
cagacagaguuguuucuucucc

SEQ ID NO: 66957 - RNA, 22 nt, Human
gaggugauuccucccauguaau

SEQ ID NO: 66958 - RNA, 22 nt, Human
gcaggggguaaggggcagggcu

SEQ ID NO: 66959 - RNA, 20 nt, Human
aaaaacaguaaugcugaaga

SEQ ID NO: 66960 - RNA, 22 nt, Human
auaaaguaaugcauauaaugug

SEQ ID NO: 66961 - RNA, 22 nt, Human
ccaggcucaccuggagccccug

SEQ ID NO: 66962 - RNA, 22 nt, Human
ugaauuagagugaaggaaagcu

SEQ ID NO: 66963 - RNA, 23 nt, Human
gcccagaggccccuggccugagc

SEQ ID NO: 66964 - RNA, 22 nt, Human
gaggcaggcggggcccaggugg

SEQ ID NO: 66965 - RNA, 22 nt, Human
ggaagcucaauacuuuccucuu

SEQ ID NO: 66966 - RNA, 21 nt, Human
agaugaggauacugaggccua

SEQ ID NO: 66967 - RNA, 22 nt, Human
uuagaaauguccuacuaauaug

SEQ ID NO: 66968 - RNA, 22 nt, Human
uucuuaaugcauccuguguuca

SEQ ID NO: 66969 - RNA, 22 nt, Human
uuugauuuuguuuauagugccg

SEQ ID NO: 66970 - RNA, 22 nt, Human
cugguuuauuucauaguuuguu

SEQ ID NO: 66971 - RNA, 22 nt, Human
acaggcgucgccugcucuugcc

SEQ ID NO: 66972 - RNA, 22 nt, Human
cacagcuggggaagcugaggcc

SEQ ID NO: 66973 - RNA, 22 nt, Human
cucaaagcagacuuuucccuuu

SEQ ID NO: 66974 - RNA, 22 nt, Human
uguuuucuuuccccuucuuuuc

SEQ ID NO: 66975 - RNA, 22 nt, Human
aaugcuuuuugcgaaaugugca

SEQ ID NO: 66976 - RNA, 22 nt, Human
uuuuguuuacauuaaauuuuga

SEQ ID NO: 66977 - RNA, 22 nt, Human
uucacccuucucuggcuuucag

SEQ ID NO: 66978 - RNA, 21 nt, Human
cuauaaaaaugguucuuugcg

SEQ ID NO: 66979 - RNA, 22 nt, Human
caguagcuuuuugcagacaaga

SEQ ID NO: 66980 - RNA, 22 nt, Human
uuuacuauuaguauuucauuuu

SEQ ID NO: 66981 - RNA, 22 nt, Human
uugggauucugucagugugugu

SEQ ID NO: 66982 - RNA, 22 nt, Human
uccaugaguuuuuuaguuucac

SEQ ID NO: 66983 - RNA, 22 nt, Human
ggcucccccauggcugacagac

SEQ ID NO: 66984 - RNA, 22 nt, Human
ugugugcuaguuuugucaguau

SEQ ID NO: 66985 - RNA, 22 nt, Human
aggggcugugucauuuguccua

SEQ ID NO: 66986 - RNA, 22 nt, Human
gcuggccugcgagggcaggcug

SEQ ID NO: 66987 - RNA, 22 nt, Human
aagagaggcccaaguggcuggc

SEQ ID NO: 66988 - RNA, 22 nt, Human
cagacagaaggcuccuugaggu

SEQ ID NO: 66989 - RNA, 22 nt, Human
gcagagcugucuaagucacuuc

SEQ ID NO: 66990 - RNA, 22 nt, Human
ugcuuucaaugaauuguauacu

SEQ ID NO: 66991 - RNA, 22 nt, Human
agcgcucauuuuccuccugcuc

SEQ ID NO: 66992 - RNA, 22 nt, Human
aggaaauaggaccagacaaagc

SEQ ID NO: 66993 - RNA, 22 nt, Human
cuuucuuucaaguucugcuuua

SEQ ID NO: 66994 - RNA, 22 nt, Human
gcucccaauuccuuuuacaauu

SEQ ID NO: 66995 - RNA, 22 nt, Human
aguggcugugaaauacauggga

SEQ ID NO: 66996 - RNA, 22 nt, Human
acuugggaaaugaaaauacaga

SEQ ID NO: 66997 - RNA, 22 nt, Human
acauuucuccuacuuguuauuu

SEQ ID NO: 66998 - RNA, 22 nt, Human
gggagguaaugggggugcaggg

SEQ ID NO: 66999 - RNA, 22 nt, Human
uuuccuucccuccugggccuuc

SEQ ID NO: 67000 - RNA, 22 nt, Human
uuuauuugggauuucucaucug

SEQ ID NO: 67001 - RNA, 22 nt, Human
uacaagcucuuguagggggaaa

SEQ ID NO: 67002 - RNA, 22 nt, Human
ugaaaaauauuuuuagaaauaa

SEQ ID NO: 67003 - RNA, 22 nt, Human
agagacuguaaugagagguaca

SEQ ID NO: 67004 - RNA, 22 nt, Human
uggagucuugcuuugggagugc

SEQ ID NO: 67005 - RNA, 22 nt, Human
auccuccuuugcccugagauca

SEQ ID NO: 67006 - RNA, 22 nt, Human
agggaguuccgaucugugcacc

SEQ ID NO: 67007 - RNA, 22 nt, Human
uauuuucucugccacacuucca

SEQ ID NO: 67008 - RNA, 22 nt, Human
ccucaggaauuuauucuucugu

SEQ ID NO: 67009 - RNA, 22 nt, Human
auucuucauguugaagcuguca

SEQ ID NO: 67010 - RNA, 19 nt, Human
uuccucaggugugaguuag

SEQ ID NO: 67011 - RNA, 21 nt, Human
aaguuuuggcuguacaguugu

SEQ ID NO: 67012 - RNA, 22 nt, Human
ucucaaagagcuacuggucuau

SEQ ID NO: 67013 - RNA, 17 nt, Human
ucuccuggcucuaucag

SEQ ID NO: 67014 - RNA, 22 nt, Human
uucccugugcaguauguuccaa

SEQ ID NO: 67015 - RNA, 22 nt, Human
uagguuuugugucagaguagaa

SEQ ID NO: 67016 - RNA, 22 nt, Human
uucuuuucuucccuguuuauua

SEQ ID NO: 67017 - RNA, 22 nt, Human
cacuguugagcaauguacagug

SEQ ID NO: 67018 - RNA, 22 nt, Human
cuccuugguuccggcguuggag

SEQ ID NO: 67019 - RNA, 22 nt, Human
gcauaauauugagaaauuauua

SEQ ID NO: 67020 - RNA, 21 nt, Human
aucagaggacaucucagggcc

SEQ ID NO: 67021 - RNA, 22 nt, Human
auuuuucuuucacauuuucuua

SEQ ID NO: 67022 - RNA, 22 nt, Human
agcaagggucucucauggcuug

SEQ ID NO: 67023 - RNA, 22 nt, Human
uaugugaaauggaauauagaaa

SEQ ID NO: 67024 - RNA, 22 nt, Human
gucuugugaagacggcagaaag

SEQ ID NO: 67025 - RNA, 22 nt, Human
ccaaggcuguggggcugugcag

SEQ ID NO: 67026 - RNA, 22 nt, Human
cauggcggcgcucucccugccu

SEQ ID NO: 67027 - RNA, 22 nt, Human
guuuggguggcuagagaaagaa

SEQ ID NO: 67028 - RNA, 22 nt, Human
ucuugugguggaucccucauuu

SEQ ID NO: 67029 - RNA, 22 nt, Human
gugugugucuacuuucaucucu

SEQ ID NO: 67030 - RNA, 23 nt, Human
ucacugccaagaaaaguuacaga

SEQ ID NO: 67031 - RNA, 20 nt, Human
ugccagagagcucauacccu

SEQ ID NO: 67032 - RNA, 18 nt, Human
guucaagcauuuugcucu

SEQ ID NO: 67033 - RNA, 22 nt, Human
agauggaguccugaagccagaa

SEQ ID NO: 67034 - RNA, 22 nt, Human
agauggggccugaggacacugu

SEQ ID NO: 67035 - RNA, 22 nt, Human
gcuguggagaagcugccuaugg

SEQ ID NO: 67036 - RNA, 23 nt, Human
ccagcugugccuggcccaggagc

SEQ ID NO: 67037 - RNA, 22 nt, Human
ggcuggagcaggcugcacagug

SEQ ID NO: 67038 - RNA, 22 nt, Human
cuccacagccccuccaguggca

SEQ ID NO: 67039 - RNA, 19 nt, Human
acugggaugggcagugcca

SEQ ID NO: 67040 - RNA, 22 nt, Human
ggcugugguggacgcgggaaac

SEQ ID NO: 67041 - RNA, 22 nt, Human
acuuuuccuggguagcuccugg

SEQ ID NO: 67042 - RNA, 22 nt, Human
ucaguggaacacacagaguggg

SEQ ID NO: 67043 - RNA, 22 nt, Human
aaaauauaaaggauguggguuu

SEQ ID NO: 67044 - RNA, 22 nt, Human
uucacugugauguuuaagagaa

SEQ ID NO: 67045 - RNA, 20 nt, Human
acuagaaagucacugggggg

SEQ ID NO: 67046 - RNA, 22 nt, Human
auucuuuagaguccuucaaaua

SEQ ID NO: 67047 - RNA, 22 nt, Human
uugucaggaacuaugauuaugc

SEQ ID NO: 67048 - RNA, 22 nt, Human
uuuuuaagguuuguuuauauau

SEQ ID NO: 67049 - RNA, 22 nt, Human
aaauuuauaacuuaaagugaau

SEQ ID NO: 67050 - RNA, 22 nt, Human
uggguauauauguugcuacaga

SEQ ID NO: 67051 - RNA, 22 nt, Human
uucauggauuugugaaauuuag

SEQ ID NO: 67052 - RNA, 22 nt, Human
uacaaaugaucaucucuuugaa

SEQ ID NO: 67053 - RNA, 22 nt, Human
uauuuuuaccuaauuuaugaga

SEQ ID NO: 67054 - RNA, 22 nt, Human
aguggcuguuccaggugaggac

SEQ ID NO: 67055 - RNA, 22 nt, Human
uggcucagcgcggccuggucuu

SEQ ID NO: 67056 - RNA, 23 nt, Human
uugcuuuugccccaaaagaguua

SEQ ID NO: 67057 - RNA, 22 nt, Human
uccauuuacuauucucauaucg

SEQ ID NO: 67058 - RNA, 22 nt, Human
augaaaacggaccagagcuauu

SEQ ID NO: 67059 - RNA, 22 nt, Human
uuuuucuuugcuuuccacuggc

SEQ ID NO: 67060 - RNA, 19 nt, Human
acuggggcaggcugggcuu

SEQ ID NO: 67061 - RNA, 22 nt, Human
aagaacuagauagugguguaaa

SEQ ID NO: 67062 - RNA, 22 nt, Human
guucuguauauauccuagcaaa

SEQ ID NO: 67063 - RNA, 19 nt, Human
agugaacuccauaucaggu

SEQ ID NO: 67064 - RNA, 22 nt, Human
uuuuuugucuugaagaaauggu

SEQ ID NO: 67065 - RNA, 22 nt, Human
uuaggggcuuaggcagaguuug

SEQ ID NO: 67066 - RNA, 22 nt, Human
ucaccauguacaugaagggcgg

SEQ ID NO: 67067 - RNA, 22 nt, Human
cuucucuuccuucucauccuca

SEQ ID NO: 67068 - RNA, 22 nt, Human
uaagggagcagaagcugugaaa

SEQ ID NO: 67069 - RNA, 22 nt, Human
ccagggcuggaggaggucagga

SEQ ID NO: 67070 - RNA, 22 nt, Human
uugcaagcccugaagggcugga

SEQ ID NO: 67071 - RNA, 22 nt, Human
guggaaggaauuaacagacuag

SEQ ID NO: 67072 - RNA, 22 nt, Human
auuuuugguuucaccugcacgc

SEQ ID NO: 67073 - RNA, 18 nt, Human
uucaggcucuugcaugaa

SEQ ID NO: 67074 - RNA, 22 nt, Human
cacugcaaccuccaccucccgg

SEQ ID NO: 67075 - RNA, 22 nt, Human
aggcugggaaguguguccugag

SEQ ID NO: 67076 - RNA, 22 nt, Human
cugggaguugacgaggcuugua

SEQ ID NO: 67077 - RNA, 22 nt, Human
gaggagcuucagaggaaucuua

SEQ ID NO: 67078 - RNA, 22 nt, Human
agggcaguuaugaaugucucca

SEQ ID NO: 67079 - RNA, 22 nt, Human
uuauuuuguagcucugaucuuu

SEQ ID NO: 67080 - RNA, 22 nt, Human
uuacuuuuuucccccuuagaug

SEQ ID NO: 67081 - RNA, 22 nt, Human
aagcucagcugguggugauugc

SEQ ID NO: 67082 - RNA, 22 nt, Human
ugagagggagacagcucuagca

SEQ ID NO: 67083 - RNA, 22 nt, Human
gagggcugccacguugggcgag

SEQ ID NO: 67084 - RNA, 23 nt, Human
uccuccccaccuuuguccccucc

SEQ ID NO: 67085 - RNA, 22 nt, Human
ggcucccgugggaugguggagc

SEQ ID NO: 67086 - RNA, 22 nt, Human
uacugcaguuccugcugucucc

SEQ ID NO: 67087 - RNA, 22 nt, Human
cauaggcucuucagagaacuga

SEQ ID NO: 67088 - RNA, 22 nt, Human
ugccuuuggcuguucugugacc

SEQ ID NO: 67089 - RNA, 20 nt, Human
cuguucucuugccacaugag

SEQ ID NO: 67090 - RNA, 22 nt, Human
ucuuucugaugggaagggucaa

SEQ ID NO: 67091 - RNA, 22 nt, Human
ugaauuuuggcaauuuucugug

SEQ ID NO: 67092 - RNA, 22 nt, Human
augcagauguagauucugaaau

SEQ ID NO: 67093 - RNA, 22 nt, Human
ggcugcagggaacaggaugggu

SEQ ID NO: 67094 - RNA, 22 nt, Human
ucuucacagaugcauauacuuc

SEQ ID NO: 67095 - RNA, 22 nt, Human
uucucaauggcaacuuguugcu

SEQ ID NO: 67096 - RNA, 22 nt, Human
uuggugauguagcagcaauugu

SEQ ID NO: 67097 - RNA, 22 nt, Human
uguuuuuauucuuaauguuuca

SEQ ID NO: 67098 - RNA, 22 nt, Human
acauaaauagcacugugaauuu

SEQ ID NO: 67099 - RNA, 22 nt, Human
ggaggcccagaaggaagcccag

SEQ ID NO: 67100 - RNA, 22 nt, Human
ucugaggacagugcugugccug

SEQ ID NO: 67101 - RNA, 22 nt, Human
aaacucaucaguuuagaaaccu

SEQ ID NO: 67102 - RNA, 22 nt, Human
cuucuuucuuuucuucuucucu

SEQ ID NO: 67103 - RNA, 22 nt, Human
ucauuguuucugcuuuucauga

SEQ ID NO: 67104 - RNA, 22 nt, Human
uuuauguugagcaaaauaccac

SEQ ID NO: 67105 - RNA, 22 nt, Human
auuuuuauuugccuaugauaua

SEQ ID NO: 67106 - RNA, 22 nt, Human
gcagguggaagcagcagacuca

SEQ ID NO: 67107 - RNA, 22 nt, Human
uagcacauaguaggcacaggcu

SEQ ID NO: 67108 - RNA, 22 nt, Human
guuuguuugccagcuuaguaaa

SEQ ID NO: 67109 - RNA, 22 nt, Human
aggcaguguguagcuggaagag

SEQ ID NO: 67110 - RNA, 22 nt, Human
acagcucaggcccaucaacccc

SEQ ID NO: 67111 - RNA, 22 nt, Human
guguucuuuguagaggaucuug

SEQ ID NO: 67112 - RNA, 22 nt, Human
guggguauauauaugugugcug

SEQ ID NO: 67113 - RNA, 22 nt, Human
cucucugcugucuuucgggaaa

SEQ ID NO: 67114 - RNA, 22 nt, Human
cagccuuuucuuaaaaugcaag

SEQ ID NO: 67115 - RNA, 22 nt, Human
acagagcucccagccaucuccu

SEQ ID NO: 67116 - RNA, 22 nt, Human
gggggagcuacaggucccuugg

SEQ ID NO: 67117 - RNA, 22 nt, Human
uacuuuaauugcaaaaauaaau

SEQ ID NO: 67118 - RNA, 22 nt, Human
uuccuuuaaccaagagcaguac

SEQ ID NO: 67119 - RNA, 22 nt, Human
aggcucagcaucugauucauau

SEQ ID NO: 67120 - RNA, 22 nt, Human
auacauauaugcacauuaauau

SEQ ID NO: 67121 - RNA, 22 nt, Human
cucuuucauucuguccuuguuu

SEQ ID NO: 67122 - RNA, 16 nt, Human
gaauuccauugcucug

SEQ ID NO: 67123 - RNA, 22 nt, Human
ccagggcuggaccagugcuugg

SEQ ID NO: 67124 - RNA, 22 nt, Human
augaaaacgugugugugugugu

SEQ ID NO: 67125 - RNA, 22 nt, Human
agggggaauccugcuuauggau

SEQ ID NO: 67126 - RNA, 22 nt, Human
auuugcuuguucaccaguacuu

SEQ ID NO: 67127 - RNA, 22 nt, Human
uauaagaaaagucauuaucaaa

SEQ ID NO: 67128 - RNA, 22 nt, Human
uggggcugguaccguaauauau

SEQ ID NO: 67129 - RNA, 22 nt, Human
cacugcacuccagccugggcaa

SEQ ID NO: 67130 - RNA, 22 nt, Human
gugugucucaguugcuccgaag

SEQ ID NO: 67131 - RNA, 22 nt, Human
ugauucacagacuucacaaggc

SEQ ID NO: 67132 - RNA, 22 nt, Human
uucuucuucuuccucauccuca

SEQ ID NO: 67133 - RNA, 22 nt, Human
accuggcccugggucuccugac

SEQ ID NO: 67134 - RNA, 22 nt, Human
uuucuauuuacagugcuaggua

SEQ ID NO: 67135 - RNA, 22 nt, Human
ccagggaggucauagugcuggu

SEQ ID NO: 67136 - RNA, 22 nt, Human
uucugcuagugguauauguuga

SEQ ID NO: 67137 - RNA, 22 nt, Human
auccuagacuccuaugccccaa

SEQ ID NO: 67138 - RNA, 22 nt, Human
uuccugcuggucaaaguugccu

SEQ ID NO: 67139 - RNA, 22 nt, Human
gggauggggagcuggaaagggg

SEQ ID NO: 67140 - RNA, 22 nt, Human
uuauuuucgugugugugugugu

SEQ ID NO: 67141 - RNA, 22 nt, Human
auuaauaucaauauauuauaug

SEQ ID NO: 67142 - RNA, 22 nt, Human
uuuuaaauaaacuacacugauu

SEQ ID NO: 67143 - RNA, 22 nt, Human
ggccugcuaccagcugugaccu

SEQ ID NO: 67144 - RNA, 22 nt, Human
gugauggucgagcgcuuguugu

SEQ ID NO: 67145 - RNA, 20 nt, Human
ucaucuuucaaauuugugac

SEQ ID NO: 67146 - RNA, 22 nt, Human
uggagccugauggauaggaacg

SEQ ID NO: 67147 - RNA, 22 nt, Human
auaguugcugucauuauuugag

SEQ ID NO: 67148 - RNA, 20 nt, Human
acccagaguccuccccgcgc

SEQ ID NO: 67149 - RNA, 20 nt, Human
uuuuuuaaauagagcuguug

SEQ ID NO: 67150 - RNA, 22 nt, Human
cagcucugcugggaggaugcag

SEQ ID NO: 67151 - RNA, 22 nt, Human
uuuuuuuaaguuuugauuuuag

SEQ ID NO: 67152 - RNA, 22 nt, Human
gcuguguaugaugcaggcaccu

SEQ ID NO: 67153 - RNA, 22 nt, Human
ucaaauaugggccagaggaaau

SEQ ID NO: 67154 - RNA, 22 nt, Human
cagcuuguucugaccugugauu

SEQ ID NO: 67155 - RNA, 19 nt, Human
ucuuugcuuuucuaagagg

SEQ ID NO: 67156 - RNA, 22 nt, Human
cuucuuuucuacuggccuagaa

SEQ ID NO: 67157 - RNA, 22 nt, Human
caagaaaaaacaugaugagugu

SEQ ID NO: 67158 - RNA, 22 nt, Human
gugcucuagaaauugucagugg

SEQ ID NO: 67159 - RNA, 22 nt, Human
ugaauaaucuuggguauuaaua

SEQ ID NO: 67160 - RNA, 22 nt, Human
augcggcugugggggaauggga

SEQ ID NO: 67161 - RNA, 22 nt, Human
auauguuaugccauuuucaagg

SEQ ID NO: 67162 - RNA, 22 nt, Human
uuuguauuguuuauuucauuuu

SEQ ID NO: 67163 - RNA, 22 nt, Human
uguaaauucuauacacuuaaaa

SEQ ID NO: 67164 - RNA, 20 nt, Human
uugauucacaaaaagcuuag

SEQ ID NO: 67165 - RNA, 22 nt, Human
uuuacuuuugguaaggucauuu

SEQ ID NO: 67166 - RNA, 22 nt, Human
acauuuuaaaaacaguaccugg

SEQ ID NO: 67167 - RNA, 17 nt, Human
auucaugaacauguccu

SEQ ID NO: 67168 - RNA, 22 nt, Human
uuuuaauaguauaucuagacac

SEQ ID NO: 67169 - RNA, 22 nt, Human
auaucuuguuuuugauuucuug

SEQ ID NO: 67170 - RNA, 22 nt, Human
gcuggggaucgaaggcagagcc

SEQ ID NO: 67171 - RNA, 22 nt, Human
ccauuuggccauucaguuguuc

SEQ ID NO: 67172 - RNA, 22 nt, Human
gaauauuuaucucagcugcaga

SEQ ID NO: 67173 - RNA, 22 nt, Human
gccuggccaaucgccgucuagg

SEQ ID NO: 67174 - RNA, 22 nt, Human
auguaugagagauucuuuuauu

SEQ ID NO: 67175 - RNA, 22 nt, Human
augugugugcgagcgugugugu

SEQ ID NO: 67176 - RNA, 22 nt, Human
uucaaacaguguagaauauaug

SEQ ID NO: 67177 - RNA, 22 nt, Human
cagcuccaucuugcuuauacca

SEQ ID NO: 67178 - RNA, 22 nt, Human
auguuuaauuugaaauuuuauu

SEQ ID NO: 67179 - RNA, 22 nt, Human
aaucacuucuuugucuucuuca

SEQ ID NO: 67180 - RNA, 17 nt, Human
ccacuagauagguugug

SEQ ID NO: 67181 - RNA, 20 nt, Human
ucagugggaaagugagagug

SEQ ID NO: 67182 - RNA, 19 nt, Human
gcugggauaggauguauuu

SEQ ID NO: 67183 - RNA, 22 nt, Human
aaggucuucgaaccuuauguua

SEQ ID NO: 67184 - RNA, 22 nt, Human
uggcucacaggaggcagaggug

SEQ ID NO: 67185 - RNA, 22 nt, Human
caggggcuccaggugagccugg

SEQ ID NO: 67186 - RNA, 22 nt, Human
uucuucuguuggcagagcauac

SEQ ID NO: 67187 - RNA, 23 nt, Human
ucuuuccuuucauacagucagcu

SEQ ID NO: 67188 - RNA, 22 nt, Human
agugagaguauuaaugugaacu

SEQ ID NO: 67189 - RNA, 22 nt, Human
agggaggagggacagaaagagg

SEQ ID NO: 67190 - RNA, 19 nt, Human
ucaggaggucgaccuggca

SEQ ID NO: 67191 - RNA, 22 nt, Human
cagagaggagcacaaagugaag

SEQ ID NO: 67192 - RNA, 22 nt, Human
gccaguggucagugggagggug

SEQ ID NO: 67193 - RNA, 22 nt, Human
uaggauugguguauguagguuu

SEQ ID NO: 67194 - RNA, 22 nt, Human
ggaggaugaggguggugguguu

SEQ ID NO: 67195 - RNA, 22 nt, Human
gcccagccucagggcaucagcu

SEQ ID NO: 67196 - RNA, 22 nt, Human
ggaggccagagaagagccaggc

SEQ ID NO: 67197 - RNA, 22 nt, Human
agggcucacuacaacccuggga

SEQ ID NO: 67198 - RNA, 22 nt, Human
ggggaaggaaggggagggcacg

SEQ ID NO: 67199 - RNA, 22 nt, Human
agacuccuucuaagaccucauu

SEQ ID NO: 67200 - RNA, 22 nt, Human
ugugaagaauuaaugugaauca

SEQ ID NO: 67201 - RNA, 20 nt, Human
ucacuguaauugccuacauu

SEQ ID NO: 67202 - RNA, 22 nt, Human
caauccccaggucccagaacag

SEQ ID NO: 67203 - RNA, 22 nt, Human
auggagugggaggacaugaagg

SEQ ID NO: 67204 - RNA, 22 nt, Human
uucuugugugaauauaauuaca

SEQ ID NO: 67205 - RNA, 22 nt, Human
aucguuaugauagagaaagaga

SEQ ID NO: 67206 - RNA, 22 nt, Human
aggggaggggaguaucaggauu

SEQ ID NO: 67207 - RNA, 22 nt, Human
gcucagagaaaacuggggcuug

SEQ ID NO: 67208 - RNA, 22 nt, Human
ucuuuaucugugagcagucucc

SEQ ID NO: 67209 - RNA, 22 nt, Human
uuuuaaaacaugucaaaaugug

SEQ ID NO: 67210 - RNA, 22 nt, Human
ugucccaucacagaggagacua

SEQ ID NO: 67211 - RNA, 22 nt, Human
uugcuuuuugggguuuacuggg

SEQ ID NO: 67212 - RNA, 22 nt, Human
cuucuucaucuuuuggaggaac

SEQ ID NO: 67213 - RNA, 20 nt, Human
agagaacaguuuggucacag

SEQ ID NO: 67214 - RNA, 22 nt, Human
gcugcaggaggugguagggucu

SEQ ID NO: 67215 - RNA, 22 nt, Human
gucucacuucauuuucuuagcc

SEQ ID NO: 67216 - RNA, 22 nt, Human
uuuuuaaaagaugauuuaauga

SEQ ID NO: 67217 - RNA, 22 nt, Human
uuuaucaggccaucuuaugucu

SEQ ID NO: 67218 - RNA, 22 nt, Human
ucaucuuucuuuauggaaauac

SEQ ID NO: 67219 - RNA, 22 nt, Human
cccuguccugcuaggcccuggu

SEQ ID NO: 67220 - RNA, 21 nt, Human
gcagcucaggauauagacuug

SEQ ID NO: 67221 - RNA, 22 nt, Human
acauaaaccccccuuccccagg

SEQ ID NO: 67222 - RNA, 22 nt, Human
aaaauaauauuauaccacugcu

SEQ ID NO: 67223 - RNA, 22 nt, Human
cuuccuuucagaggaaggccug

SEQ ID NO: 67224 - RNA, 22 nt, Human
uuuuuuuuacuccggacagcuc

SEQ ID NO: 67225 - RNA, 22 nt, Human
uccagcugugcuccaggaggug

SEQ ID NO: 67226 - RNA, 22 nt, Human
aauaaugguuugauucucacau

SEQ ID NO: 67227 - RNA, 22 nt, Human
uuccuucccccuucuuugccuu

SEQ ID NO: 67228 - RNA, 22 nt, Human
aaauguauuagccuaugugaga

SEQ ID NO: 67229 - RNA, 22 nt, Human
aggcauauaguguuuaaaaaaa

SEQ ID NO: 67230 - RNA, 22 nt, Human
cuaaaccaauauauuuucuucc

SEQ ID NO: 67231 - RNA, 22 nt, Human
ugauauaaaagauucuuauuga

SEQ ID NO: 67232 - RNA, 16 nt, Human
aaguuuuaucuucuca

SEQ ID NO: 67233 - RNA, 22 nt, Human
uauuaauugugguuauuguauu

SEQ ID NO: 67234 - RNA, 22 nt, Human
cagggggacuuguuagguuuua

SEQ ID NO: 67235 - RNA, 22 nt, Human
uuauuuaaaauguagguuggga

SEQ ID NO: 67236 - RNA, 22 nt, Human
aagcucuuuccacuaaaccacu

SEQ ID NO: 67237 - RNA, 19 nt, Human
augaaauagcauuuucuga

SEQ ID NO: 67238 - RNA, 22 nt, Human
cuagcacagugcuuggcacaca

SEQ ID NO: 67239 - RNA, 22 nt, Human
gaauuccaggugagagaaggua

SEQ ID NO: 67240 - RNA, 22 nt, Human
uuucucuuucaaucugcaguac

SEQ ID NO: 67241 - RNA, 22 nt, Human
ucuucaaauacagucauauuga

SEQ ID NO: 67242 - RNA, 22 nt, Human
auauuuuacagcucucguugaa

SEQ ID NO: 67243 - RNA, 22 nt, Human
aaugaauaaauuuuaaagacag

SEQ ID NO: 67244 - RNA, 22 nt, Human
gaggcuugccacuguccauggc

SEQ ID NO: 67245 - RNA, 22 nt, Human
uuuuccuuccugucucuuuauu

SEQ ID NO: 67246 - RNA, 22 nt, Human
auccugugggguauugcugcau

SEQ ID NO: 67247 - RNA, 22 nt, Human
uaaguuguagaacguuuucuua

SEQ ID NO: 67248 - RNA, 22 nt, Human
cacauuuuccagaagaaucaga

SEQ ID NO: 67249 - RNA, 22 nt, Human
uauuuuuuuaacauuuauugua

SEQ ID NO: 67250 - RNA, 22 nt, Human
acauauaugugcauacaacuau

SEQ ID NO: 67251 - RNA, 22 nt, Human
uugguuuacucuggggauaucu

SEQ ID NO: 67252 - RNA, 22 nt, Human
gagggugguggcggccggcacc

SEQ ID NO: 67253 - RNA, 22 nt, Human
ucaccauguuuucauaggaaca

SEQ ID NO: 67254 - RNA, 22 nt, Human
uguuuucuauuaccugagauug

SEQ ID NO: 67255 - RNA, 22 nt, Human
agugccaucuuuaacuguccca

SEQ ID NO: 67256 - RNA, 22 nt, Human
gcagaggcugccgugggcagga

SEQ ID NO: 67257 - RNA, 22 nt, Human
uacagcuuccucuaugguggcc

SEQ ID NO: 67258 - RNA, 22 nt, Human
cagaccagaaggaagccgacaa

SEQ ID NO: 67259 - RNA, 22 nt, Human
uguugaaacagcuauugacuuu

SEQ ID NO: 67260 - RNA, 22 nt, Human
aauuagaagcuguuagcaaaau

SEQ ID NO: 67261 - RNA, 22 nt, Human
ucccuugacauuacuugggagg

SEQ ID NO: 67262 - RNA, 22 nt, Human
gaggggaacaggcauucuuaag

SEQ ID NO: 67263 - RNA, 22 nt, Human
uuauuuuuaggaauguagaggu

SEQ ID NO: 67264 - RNA, 22 nt, Human
cuguuaauugugaauuuuacau

SEQ ID NO: 67265 - RNA, 22 nt, Human
gagcagcugagcuggaaugaga

SEQ ID NO: 67266 - RNA, 22 nt, Human
gcuuccuuagcuuaccaaguau

SEQ ID NO: 67267 - RNA, 22 nt, Human
auuuuacuaugauaguugagaa

SEQ ID NO: 67268 - RNA, 23 nt, Human
uuuuccaaaucgacucucuaguu

SEQ ID NO: 67269 - RNA, 22 nt, Human
ggcagagguagcuggaaccagg

SEQ ID NO: 67270 - RNA, 22 nt, Human
aggugagaacguggaggggcgg

SEQ ID NO: 67271 - RNA, 22 nt, Human
aggcagagaggucuuccuggaa

SEQ ID NO: 67272 - RNA, 22 nt, Human
ucccugcugggcgaucuucucu

SEQ ID NO: 67273 - RNA, 22 nt, Human
aaggcuguuugagcacuggagc

SEQ ID NO: 67274 - RNA, 19 nt, Human
agcucaggcccaucguccc

SEQ ID NO: 67275 - RNA, 22 nt, Human
gcuugcuuuguaaauaucugug

SEQ ID NO: 67276 - RNA, 21 nt, Human
uccccugugccuggcauacag

SEQ ID NO: 67277 - RNA, 22 nt, Human
gucuuucuuuuacauauuugug

SEQ ID NO: 67278 - RNA, 19 nt, Human
uagaggagaauggcaaaga

SEQ ID NO: 67279 - RNA, 22 nt, Human
cagagagcguccauccggugcc

SEQ ID NO: 67280 - RNA, 22 nt, Human
ucgagcucagcagggaggugcg

SEQ ID NO: 67281 - RNA, 22 nt, Human
uuccuuuuuaauuaaucuaauu

SEQ ID NO: 67282 - RNA, 22 nt, Human
aaugagaauguaagugaagaga

SEQ ID NO: 67283 - RNA, 22 nt, Human
uauauaauacacaaauauguac

SEQ ID NO: 67284 - RNA, 22 nt, Human
gagguagaggaaaagauuauca

SEQ ID NO: 67285 - RNA, 22 nt, Human
gccagggcucgagcaggccagc

SEQ ID NO: 67286 - RNA, 22 nt, Human
gggggacagugugccuggugug

SEQ ID NO: 67287 - RNA, 22 nt, Human
auaaaucaagggcaguauuucc

SEQ ID NO: 67288 - RNA, 22 nt, Human
uuugcaggaaauguacugaaug

SEQ ID NO: 67289 - RNA, 22 nt, Human
ccuuuccuggaaaugguaaguu

SEQ ID NO: 67290 - RNA, 23 nt, Human
cagagaaaauagaauaugcugug

SEQ ID NO: 67291 - RNA, 22 nt, Human
ggcagucuuucccuugagcucu

SEQ ID NO: 67292 - RNA, 22 nt, Human
uuuucacugacuuggucuggaa

SEQ ID NO: 67293 - RNA, 22 nt, Human
ugggcagggauuuggggaaacu

SEQ ID NO: 67294 - RNA, 22 nt, Human
augaagguggacagauuuuuuu

SEQ ID NO: 67295 - RNA, 22 nt, Human
aucuaaaacuacgaauacuacc

SEQ ID NO: 67296 - RNA, 22 nt, Human
aagaggcuacagcccugugucu

SEQ ID NO: 67297 - RNA, 22 nt, Human
ccaggcuccccaggaggcccuu

SEQ ID NO: 67298 - RNA, 22 nt, Human
aguauuuuaaaauacauuaucc

SEQ ID NO: 67299 - RNA, 18 nt, Human
aggcuggggaucacaggg

SEQ ID NO: 67300 - RNA, 22 nt, Human
gcucagcuggagagggacgggu

SEQ ID NO: 67301 - RNA, 22 nt, Human
ucucuagaggaauuguucuagg

SEQ ID NO: 67302 - RNA, 22 nt, Human
agucccugauggacuggaugag

SEQ ID NO: 67303 - RNA, 22 nt, Human
gagaaaaauuucuuugcugcac

SEQ ID NO: 67304 - RNA, 22 nt, Human
gggcaagaagcuggaagcauuc

SEQ ID NO: 67305 - RNA, 22 nt, Human
gcagaaguauuguacgguggga

SEQ ID NO: 67306 - RNA, 22 nt, Human
aaauguuugguggauaaaagga

SEQ ID NO: 67307 - RNA, 22 nt, Human
ggagacagugacuuagagacug

SEQ ID NO: 67308 - RNA, 23 nt, Human
aaguggugacugugcuacugaga

SEQ ID NO: 67309 - RNA, 21 nt, Human
gggagaguagcgguagggagg

SEQ ID NO: 67310 - RNA, 22 nt, Human
uuugaagaaacagucuuaagag

SEQ ID NO: 67311 - RNA, 22 nt, Human
ggacggggagcuggaaagggga

SEQ ID NO: 67312 - RNA, 20 nt, Human
uuccuuucuuucuuuuuuuu

SEQ ID NO: 67313 - RNA, 22 nt, Human
auguuuucuugucuggagaagu

SEQ ID NO: 67314 - RNA, 20 nt, Human
cuccuccccucggccccacc

SEQ ID NO: 67315 - RNA, 22 nt, Human
cagcuucaugacaaacaguuuu

SEQ ID NO: 67316 - RNA, 18 nt, Human
aguuuuuuuggcaaaagg

SEQ ID NO: 67317 - RNA, 22 nt, Human
ggagugaguauguucugaugca

SEQ ID NO: 67318 - RNA, 23 nt, Human
aggcugcagaagaauagggucau

SEQ ID NO: 67319 - RNA, 22 nt, Human
agagacaggguuuugucguguu

SEQ ID NO: 67320 - RNA, 22 nt, Human
uuauuuuuguuuguuaagccua

SEQ ID NO: 67321 - RNA, 22 nt, Human
uggagccuugugagaccacaau

SEQ ID NO: 67322 - RNA, 22 nt, Human
uuuuuauaagagcagcagaguu

SEQ ID NO: 67323 - RNA, 22 nt, Human
uucacauucauuucuuauguuu

SEQ ID NO: 67324 - RNA, 22 nt, Human
uauuucuagggcaugaaaauaa

SEQ ID NO: 67325 - RNA, 19 nt, Human
ggaacgcugggcuccccuc

SEQ ID NO: 67326 - RNA, 22 nt, Human
uuaaaagaauccuguuauccuc

SEQ ID NO: 67327 - RNA, 22 nt, Human
uaaaauaccacauauggugcuc

SEQ ID NO: 67328 - RNA, 22 nt, Human
cucugcuuguaucacauuugcu

SEQ ID NO: 67329 - RNA, 22 nt, Human
cuccuagagcacaaaaggccau

SEQ ID NO: 67330 - RNA, 22 nt, Human
cgguuuuuaaaagucucuucua

SEQ ID NO: 67331 - RNA, 22 nt, Human
uaugaauauaccacaauuuagg

SEQ ID NO: 67332 - RNA, 22 nt, Human
uauaaagaccuuauccuucaua

SEQ ID NO: 67333 - RNA, 22 nt, Human
aggcaguggagcuggaauaggc

SEQ ID NO: 67334 - RNA, 22 nt, Human
uucuugucuuuguuauguagga

SEQ ID NO: 67335 - RNA, 22 nt, Human
ucccuguggauuaaggagaugu

SEQ ID NO: 67336 - RNA, 22 nt, Human
uguccuuuauauguuuuuuagu

SEQ ID NO: 67337 - RNA, 22 nt, Human
aauguuuuucaaguguggagca

SEQ ID NO: 67338 - RNA, 22 nt, Human
aguaggauguuuagcccuucuu

SEQ ID NO: 67339 - RNA, 22 nt, Human
aggcgaagggaccagacgguag

SEQ ID NO: 67340 - RNA, 22 nt, Human
auauucaaugaggucauauaag

SEQ ID NO: 67341 - RNA, 22 nt, Human
cuucuuaaaguugucacagcug

SEQ ID NO: 67342 - RNA, 20 nt, Human
ggcagagcuaugucuguugc

SEQ ID NO: 67343 - RNA, 22 nt, Human
uuucagaaauggcacugaaauc

SEQ ID NO: 67344 - RNA, 22 nt, Human
ugaaguuuagaaaaagugccuu

SEQ ID NO: 67345 - RNA, 22 nt, Human
aggauggauagcaaggaagccg

SEQ ID NO: 67346 - RNA, 22 nt, Human
uuuucauuguuaguuucuccuu

SEQ ID NO: 67347 - RNA, 22 nt, Human
agauggaggaaagcaguuagaa

SEQ ID NO: 67348 - RNA, 22 nt, Human
gaagaaggaagaucaugcuuga

SEQ ID NO: 67349 - RNA, 22 nt, Human
guuguuuucagcccagcauuag

SEQ ID NO: 67350 - RNA, 22 nt, Human
cuggguuuggcugugcuugaau

SEQ ID NO: 67351 - RNA, 22 nt, Human
ucacucuuuaucuuuuaugucu

SEQ ID NO: 67352 - RNA, 22 nt, Human
guuuuauaacuauagugagaau

SEQ ID NO: 67353 - RNA, 22 nt, Human
uccuuguuggaauauccuuacc

SEQ ID NO: 67354 - RNA, 22 nt, Human
gagugaucuguaggcagcaugg

SEQ ID NO: 67355 - RNA, 22 nt, Human
uggaaaauuuagaaagauuuau

SEQ ID NO: 67356 - RNA, 22 nt, Human
gacauuuauuggauuuuacgag

SEQ ID NO: 67357 - RNA, 22 nt, Human
uuuguuuccagccuuuugucuu

SEQ ID NO: 67358 - RNA, 22 nt, Human
agucaccuacagcucaugcuuc

SEQ ID NO: 67359 - RNA, 22 nt, Human
augauuauuugaaugaagagga

SEQ ID NO: 67360 - RNA, 22 nt, Human
auuuuauuuugggaucuuuuua

SEQ ID NO: 67361 - RNA, 23 nt, Human
aaugugaaauugaguuuuuguua

SEQ ID NO: 67362 - RNA, 22 nt, Human
gugcugggaggcccaggaugga

SEQ ID NO: 67363 - RNA, 22 nt, Human
uacuuacacugaagcaaagaua

SEQ ID NO: 67364 - RNA, 22 nt, Human
agugaggggagaaugaggugga

SEQ ID NO: 67365 - RNA, 22 nt, Human
ugagauguaauguaguacuuug

SEQ ID NO: 67366 - RNA, 22 nt, Human
cagcuucacuuaaaacaugcaa

SEQ ID NO: 67367 - RNA, 22 nt, Human
aacacuaaaggucaguuagaag

SEQ ID NO: 67368 - RNA, 22 nt, Human
uuuuacauuuuauucguuuauu

SEQ ID NO: 67369 - RNA, 22 nt, Human
auagggaggcggagggagcugg

SEQ ID NO: 67370 - RNA, 22 nt, Human
aauggaaaaagaacuguuuaaa

SEQ ID NO: 67371 - RNA, 22 nt, Human
auagaagugaaaagggaugacu

SEQ ID NO: 67372 - RNA, 22 nt, Human
cugccucucaugccugcuugcu

SEQ ID NO: 67373 - RNA, 22 nt, Human
auauuuuugcagaauuuuucgu

SEQ ID NO: 67374 - RNA, 22 nt, Human
auuuuuuuuccugucucuuuca

SEQ ID NO: 67375 - RNA, 22 nt, Human
cuguucuccacuccugacuucu

SEQ ID NO: 67376 - RNA, 22 nt, Human
ucuuuauuucccuaacuugcua

SEQ ID NO: 67377 - RNA, 22 nt, Human
uuaaacauuuccacuugccagu

SEQ ID NO: 67378 - RNA, 22 nt, Human
uuuucaaucaaguuuauuuaua

SEQ ID NO: 67379 - RNA, 23 nt, Human
agagggaagagcuuagaugggga

SEQ ID NO: 67380 - RNA, 22 nt, Human
uuuacuguuuacagcuaaugca

SEQ ID NO: 67381 - RNA, 22 nt, Human
uuuuuuuguagguguaugaaaa

SEQ ID NO: 67382 - RNA, 22 nt, Human
auuuucuucauuuugauuguau

SEQ ID NO: 67383 - RNA, 22 nt, Human
uagagaaauuacagcuuucuuu

SEQ ID NO: 67384 - RNA, 22 nt, Human
ugugucuccacugugcuauuuu

SEQ ID NO: 67385 - RNA, 22 nt, Human
caaauguuugguggcauuuugu

SEQ ID NO: 67386 - RNA, 22 nt, Human
auuaaaaaaagauaaugaguua

SEQ ID NO: 67387 - RNA, 22 nt, Human
ggaaggggagcuggaaagggua

SEQ ID NO: 67388 - RNA, 22 nt, Human
gccucucuggcaaagcggugau

SEQ ID NO: 67389 - RNA, 22 nt, Human
gauuuuaaaagauguauaaggu

SEQ ID NO: 67390 - RNA, 22 nt, Human
caaaacauucagagagcucacu

SEQ ID NO: 67391 - RNA, 22 nt, Human
auugaaauuaauuucugcuuuc

SEQ ID NO: 67392 - RNA, 22 nt, Human
uuuuacaaugcaaauucuugcu

SEQ ID NO: 67393 - RNA, 22 nt, Human
uuccagauguuuaaguucugcu

SEQ ID NO: 67394 - RNA, 22 nt, Human
uucucuugccuucucuuuuauc

SEQ ID NO: 67395 - RNA, 22 nt, Human
uuuugaauaauucagaaacagc

SEQ ID NO: 67396 - RNA, 21 nt, Human
uuucauuaguacaucaauuug

SEQ ID NO: 67397 - RNA, 22 nt, Human
uuuuaaaagguugcuguuauaa

SEQ ID NO: 67398 - RNA, 22 nt, Human
cagagguagaaguagauguuug

SEQ ID NO: 67399 - RNA, 22 nt, Human
guuuucuccugcuauacagugc

SEQ ID NO: 67400 - RNA, 22 nt, Human
aacugcauaagcuucgggaccu

SEQ ID NO: 67401 - RNA, 22 nt, Human
auagaaauagacaaugcaaaga

SEQ ID NO: 67402 - RNA, 22 nt, Human
ggugaguagaaguaguuggcuu

SEQ ID NO: 67403 - RNA, 22 nt, Human
guggggguaggggguuuccugg

SEQ ID NO: 67404 - RNA, 22 nt, Human
aagugauuuucccaccaucuac

SEQ ID NO: 67405 - RNA, 22 nt, Human
aacccugaacuuaguucuagga

SEQ ID NO: 67406 - RNA, 22 nt, Human
ggcagagcugugcgcccaccca

SEQ ID NO: 67407 - RNA, 22 nt, Human
uucugugacgcaaagcugggaa

SEQ ID NO: 67408 - RNA, 22 nt, Human
uuguuuuaguagaaguuacaug

SEQ ID NO: 67409 - RNA, 22 nt, Human
aagugaggagaccucuucuuca

SEQ ID NO: 67410 - RNA, 22 nt, Human
agggaaauaggagaagaaagga

SEQ ID NO: 67411 - RNA, 22 nt, Human
ucuucaucucuaaaaugggaac

SEQ ID NO: 67412 - RNA, 17 nt, Human
uuuguuucauacuucau

SEQ ID NO: 67413 - RNA, 22 nt, Human
ugagggaguguggauacaguag

SEQ ID NO: 67414 - RNA, 22 nt, Human
guggggguaggggguuuucugg

SEQ ID NO: 67415 - RNA, 21 nt, Human
caguucuaagugucaucuuuu

SEQ ID NO: 67416 - RNA, 22 nt, Human
aaauuuuguugaaaaauauuuu

SEQ ID NO: 67417 - RNA, 22 nt, Human
auauugcuuuauucuugaauau

SEQ ID NO: 67418 - RNA, 22 nt, Human
aguuaggaaauaaguugaguuu

SEQ ID NO: 67419 - RNA, 22 nt, Human
gauaaauaguguuuggggacau

SEQ ID NO: 67420 - RNA, 22 nt, Human
uauuaaaagagaaaaagccacc

SEQ ID NO: 67421 - RNA, 22 nt, Human
uuuuuaaaauuaggacggcacg

SEQ ID NO: 67422 - RNA, 22 nt, Human
acuuuauacuagugauaguuug

SEQ ID NO: 67423 - RNA, 22 nt, Human
aagccucaugccagauccaggu

SEQ ID NO: 67424 - RNA, 22 nt, Human
ggcagggagagcgccgccaugc

SEQ ID NO: 67425 - RNA, 22 nt, Human
uccuccuggagacuuucucucu

SEQ ID NO: 67426 - RNA, 22 nt, Human
ucuuuuaucuguuguguaacaa

SEQ ID NO: 67427 - RNA, 22 nt, Human
ccuucugcuggucaucccagug

SEQ ID NO: 67428 - RNA, 22 nt, Human
ggacauaguugcuauggagagu

SEQ ID NO: 67429 - RNA, 22 nt, Human
ugaauaaauaaacuuuuacuac

SEQ ID NO: 67430 - RNA, 20 nt, Human
cucuuucugcuuuaugccuc

SEQ ID NO: 67431 - RNA, 22 nt, Human
ucuuccuuacucuggauguuau

SEQ ID NO: 67432 - RNA, 22 nt, Human
gcccugucagcucucauggaca

SEQ ID NO: 67433 - RNA, 22 nt, Human
guuuuguagucuggagacuguc

SEQ ID NO: 67434 - RNA, 22 nt, Human
ucagccuugguuuugguguugg

SEQ ID NO: 67435 - RNA, 21 nt, Human
aucagaaucucuagauuugga

SEQ ID NO: 67436 - RNA, 22 nt, Human
auuuauuugaagagccauugca

SEQ ID NO: 67437 - RNA, 22 nt, Human
aacaguuaagaggaggcagaga

SEQ ID NO: 67438 - RNA, 22 nt, Chlamydophila pneumoniae AR39
uguagagauaugaauguuuccc

SEQ ID NO: 67439 - RNA, 21 nt, Chlamydophila pneumoniae AR39
caaaggcaaaggaaucucuau

SEQ ID NO: 67440 - RNA, 22 nt, Chlamydophila pneumoniae AR39
agcaaaggaacuuauauucgca

SEQ ID NO: 67441 - RNA, 22 nt, Chlamydophila pneumoniae AR39
uggaggagcagguucaucuuuu

SEQ ID NO: 67442 - RNA, 22 nt, Chlamydophila pneumoniae AR39
uuggagaguuuuuuaccaucug

SEQ ID NO: 67443 - RNA, 22 nt, Chlamydophila pneumoniae AR39
uaggauaguauagugaggagau

SEQ ID NO: 67444 - RNA, 22 nt, Chlamydophila pneumoniae AR39
ucuggagacaucuuuugaagcu

SEQ ID NO: 67445 - RNA, 22 nt, Chlamydophila pneumoniae AR39
uucuacaauuccuauagcucaa

SEQ ID NO: 67446 - RNA, 22 nt, Chlamydophila pneumoniae AR39
acgauaaaguguguguaggauu

SEQ ID NO: 67447 - RNA, 20 nt, Chlamydophila pneumoniae AR39
ccuuaucuaggaagagcuug

SEQ ID NO: 67448 - RNA, 22 nt, Chlamydophila pneumoniae AR39
gaagcucaggaucugucaguuc

SEQ ID NO: 67449 - RNA, 22 nt, Chlamydophila pneumoniae AR39
gcagguggugcauggacuccuc

SEQ ID NO: 67450 - RNA, 22 nt, Chlamydophila pneumoniae AR39
ucugaaguccuagcauugaaag

SEQ ID NO: 67451 - RNA, 22 nt, Chlamydophila pneumoniae AR39
ucccuuuggauccagaagcuaa

SEQ ID NO: 67452 - RNA, 23 nt, Chlamydophila pneumoniae AR39
ucagucucuagaggagcucuuug

SEQ ID NO: 67453 - RNA, 22 nt, Chlamydophila pneumoniae AR39
aggguucaauacuauggauuua

SEQ ID NO: 67454 - RNA, 21 nt, Chlamydophila pneumoniae AR39
auaguaaguucaugcuuguua

SEQ ID NO: 67455 - RNA, 22 nt, Chlamydophila pneumoniae AR39
aucugccuuguaaauaaguaug

SEQ ID NO: 67456 - RNA, 22 nt, Chlamydophila pneumoniae AR39
auuggggauuguuacgauagac

SEQ ID NO: 67457 - RNA, 22 nt, Chlamydophila pneumoniae AR39
cacaaccaaaacgugcgcaggg

SEQ ID NO: 67458 - RNA, 22 nt, Chlamydophila pneumoniae AR39
acuccucuaucguauuggggau

SEQ ID NO: 67459 - RNA, 22 nt, Chlamydophila pneumoniae AR39
accagcuguagagggauugggg

SEQ ID NO: 67460 - RNA, 22 nt, Chlamydophila pneumoniae AR39
aaggauggccaggauuuucagg

SEQ ID NO: 67461 - RNA, 19 nt, Chlamydophila pneumoniae AR39
uucuuucaggagcuccuca

SEQ ID NO: 67462 - RNA, 22 nt, Chlamydophila pneumoniae AR39
uugaccagaugcaugagaauag

SEQ ID NO: 67463 - RNA, 22 nt, Chlamydophila pneumoniae AR39
uugagacaaagaauccccccuu

SEQ ID NO: 67464 - RNA, 22 nt, Chlamydophila pneumoniae AR39
cauuuuuaaauacgauggucgu

SEQ ID NO: 67465 - RNA, 22 nt, Chlamydophila pneumoniae AR39
cugugcucuugaagauuguguc

SEQ ID NO: 67466 - RNA, 22 nt, Chlamydophila pneumoniae AR39
gagaggggaagaaaaauagcca

SEQ ID NO: 67467 - RNA, 22 nt, Chlamydophila pneumoniae AR39
uagaaguauuaagccaagauuu

SEQ ID NO: 67468 - RNA, 19 nt, Chlamydophila pneumoniae AR39
uagagccuucuggacguuc

SEQ ID NO: 67469 - RNA, 19 nt, Chlamydophila pneumoniae AR39
guucuaguaggacucgaga

SEQ ID NO: 67470 - RNA, 22 nt, Chlamydophila pneumoniae AR39
ugaagcauuugcucuuugggaa

SEQ ID NO: 67471 - RNA, 22 nt, Chlamydophila pneumoniae AR39
agaguucugcugcugcuagacc

SEQ ID NO: 67472 - RNA, 22 nt, Chlamydophila pneumoniae AR39
agagaaggugaaaaucggggaa

SEQ ID NO: 67473 - RNA, 22 nt, Chlamydophila pneumoniae AR39
aaucucugaacuuuugcuguug

SEQ ID NO: 67474 - RNA, 22 nt, Chlamydophila pneumoniae AR39
agcccgagguacuacaaggcga

SEQ ID NO: 67475 - RNA, 22 nt, Chlamydophila pneumoniae AR39
agcaggauuuuacuguauuucu

SEQ ID NO: 67476 - RNA, 22 nt, Chlamydophila pneumoniae AR39
aggcaaggcgcaugccaguaaa

SEQ ID NO: 67477 - RNA, 22 nt, Chlamydophila pneumoniae AR39
agcuuuuggauauccuuccuua

SEQ ID NO: 67478 - RNA, 22 nt, Chlamydophila pneumoniae AR39
aagaagaagaauccguggauga

SEQ ID NO: 67479 - RNA, 22 nt, Human
aaaacauuuuacugccaucuca

SEQ ID NO: 67480 - RNA, 22 nt, Human
aauguacucuguguuucucaug

SEQ ID NO: 67481 - RNA, 22 nt, Human
aaugauuuucugcaaacaguga

SEQ ID NO: 67482 - RNA, 22 nt, Human
aggagagaacaagaguauccug

SEQ ID NO: 67483 - RNA, 22 nt, Human
aggacauuugcuuuuuuucuuu

SEQ ID NO: 67484 - RNA, 22 nt, Human
aggaagagcuggaccagaggac

SEQ ID NO: 67485 - RNA, 22 nt, Human
acauuuuuggguugaugucuga

SEQ ID NO: 67486 - RNA, 22 nt, Human
acauuuuaaaaacaguaccugg

SEQ ID NO: 67487 - RNA, 22 nt, Human
cuugcucugggaauaugaguuu

SEQ ID NO: 67488 - RNA, 22 nt, Human
cugaaggacacgugaggagcca

SEQ ID NO: 67489 - RNA, 22 nt, Human
cuggagaacucugugcuucacu

SEQ ID NO: 67490 - RNA, 22 nt, Human
caggguaguaauuuaauacaag

SEQ ID NO: 67491 - RNA, 22 nt, Human
caauaauugcuuuccagaguua

SEQ ID NO: 67492 - RNA, 22 nt, Human
augaauuaucugguguuggaaa

SEQ ID NO: 67493 - RNA, 22 nt, Human
auccuaagacgugugguuugag

SEQ ID NO: 67494 - RNA, 22 nt, Human
aucauccuagaaggaagcuagg

SEQ ID NO: 67495 - RNA, 22 nt, Human
auauuauuaaaauagauggaua

SEQ ID NO: 67496 - RNA, 22 nt, Human
uuuucugauccuucuaacuuga

SEQ ID NO: 67497 - RNA, 22 nt, Human
uuuucuaggcccuggauuaugu

SEQ ID NO: 67498 - RNA, 22 nt, Human
uuuuacauuuuauucguuuauu

SEQ ID NO: 67499 - RNA, 20 nt, Human
uugcucucuuguguugaugu

SEQ ID NO: 67500 - RNA, 22 nt, Human
uucagguacuaagugcugauuc

SEQ ID NO: 67501 - RNA, 22 nt, Human
uuucugugguggguaguucaga

SEQ ID NO: 67502 - RNA, 22 nt, Human
uuucucagcauauugccuuuga

SEQ ID NO: 67503 - RNA, 22 nt, Human
uucugaaacauugcuauuuucc

SEQ ID NO: 67504 - RNA, 22 nt, Human
uucuaggagucugguuccugcc

SEQ ID NO: 67505 - RNA, 22 nt, Human
ugcaagauccagucuugagaag

SEQ ID NO: 67506 - RNA, 22 nt, Human
ugauugcucgacacucugcuug

SEQ ID NO: 67507 - RNA, 22 nt, Human
uggagagaaguucuauaaauca

SEQ ID NO: 67508 - RNA, 22 nt, Human
ucuaaucuacaaaaggaaauuc

SEQ ID NO: 67509 - RNA, 22 nt, Human
uccuucucagggagacuugaua

SEQ ID NO: 67510 - RNA, 18 nt, Human
ugcagcuuugugauuggc

SEQ ID NO: 67511 - RNA, 22 nt, Human
ugcaagagcccaaacuauauac

SEQ ID NO: 67512 - RNA, 22 nt, Human
ucagauaauccaauagagagga

SEQ ID NO: 67513 - RNA, 22 nt, Human
uagcauccugugugaauguauu

SEQ ID NO: 67514 - RNA, 22 nt, Human
uagagagaaaccaggguuuggg

SEQ ID NO: 67515 - RNA, 22 nt, Human
uagaugcugagcuuaagagaau

SEQ ID NO: 67516 - RNA, 22 nt, Human
uacaaaugaucaucucuuugaa

SEQ ID NO: 67517 - RNA, 22 nt, Human
uaacagugcuacaguuacuuuc

SEQ ID NO: 67518 - RNA, 22 nt, Human
gugggaaacagccuugcuucua

SEQ ID NO: 67519 - RNA, 22 nt, Human
guggaaauuuuaggaucaucuu

SEQ ID NO: 67520 - RNA, 22 nt, Human
guagagcagaaacauggagaaa

SEQ ID NO: 67521 - RNA, 22 nt, Human
gguuuucuuguucauuuuuuaa

SEQ ID NO: 67522 - RNA, 22 nt, Human
ggagagagggaucuuuguggag

SEQ ID NO: 67523 - RNA, 22 nt, Human
gauuuuaaaagauguauaaggu

SEQ ID NO: 67524 - RNA, 22 nt, Human
gcauuucuguuuuuuuaaauga

SEQ ID NO: 67525 - RNA, 22 nt, Human
gaggagagcuggccagguuucu

SEQ ID NO: 67526 - RNA, 22 nt, Human
gaugauuuuguaacuggggaca

SEQ ID NO: 67527 - RNA, 22 nt, Human
aaauauauccuucuguccugcc

SEQ ID NO: 67528 - RNA, 22 nt, Human
aaaauauuuaucuagcucuuaa

SEQ ID NO: 67529 - RNA, 22 nt, Human
aauauuuaaauagaauuacauc

SEQ ID NO: 67530 - RNA, 22 nt, Human
aagaugcuucaugagaguuggg

SEQ ID NO: 67531 - RNA, 22 nt, Human
aagcaaagucaucuagaguagu

SEQ ID NO: 67532 - RNA, 22 nt, Human
auaaaaucugaagcaagaauaa

SEQ ID NO: 67533 - RNA, 22 nt, Human
agugagcauuagugcuuauauu

SEQ ID NO: 67534 - RNA, 21 nt, Human
aggcauuuucuuggagauucu

SEQ ID NO: 67535 - RNA, 22 nt, Human
aggcauuuaaagauguaagacu

SEQ ID NO: 67536 - RNA, 22 nt, Human
aggcauuuaucaggaaauguuc

SEQ ID NO: 67537 - RNA, 22 nt, Human
agcaaggguugguuuucugaca

SEQ ID NO: 67538 - RNA, 22 nt, Human
agauaaacaacucuuagcuguu

SEQ ID NO: 67539 - RNA, 22 nt, Human
acuucaggagcagucucuggaa

SEQ ID NO: 67540 - RNA, 22 nt, Human
cuugguuugaaacauacucuac

SEQ ID NO: 67541 - RNA, 22 nt, Human
gaaaaucaugaaaguguguugu

SEQ ID NO: 67542 - RNA, 22 nt, Human
cugcagauaaguguuuugaaaa

SEQ ID NO: 67543 - RNA, 22 nt, Human
cugauaauaaccauuuuaaaau

SEQ ID NO: 67544 - RNA, 22 nt, Human
cuagaucuggcaggcacaaggu

SEQ ID NO: 67545 - RNA, 22 nt, Human
ccuuuccucuucaugacuuucu

SEQ ID NO: 67546 - RNA, 22 nt, Human
ccuugguuuagcaauuuuucuu

SEQ ID NO: 67547 - RNA, 17 nt, Human
ccuuucugaucaucuga

SEQ ID NO: 67548 - RNA, 22 nt, Human
caucuuuguuuuggauauaauc

SEQ ID NO: 67549 - RNA, 22 nt, Human
cauuuacauaacaguaacgcug

SEQ ID NO: 67550 - RNA, 22 nt, Human
cagcuucacuuaaaacaugcaa

SEQ ID NO: 67551 - RNA, 22 nt, Human
auuuuuauuugccuaugauaua

SEQ ID NO: 67552 - RNA, 22 nt, Human
auucuaauaagcguuuugucgc

SEQ ID NO: 67553 - RNA, 22 nt, Human
auuccuguggcuggguaaagua

SEQ ID NO: 67554 - RNA, 22 nt, Human
auucugaagcagaaaaggcaga

SEQ ID NO: 67555 - RNA, 22 nt, Human
uugguuccauuuuaccagcucu

SEQ ID NO: 67556 - RNA, 22 nt, Human
uuuuaauaguauaucuagacac

SEQ ID NO: 67557 - RNA, 22 nt, Human
uucuugagaacaaauuccugga

SEQ ID NO: 67558 - RNA, 22 nt, Human
uucuggaguuugaagaucaggu

SEQ ID NO: 67559 - RNA, 22 nt, Human
uucgcucuucacacagugcuga

SEQ ID NO: 67560 - RNA, 22 nt, Human
uuacuguguguaaaauaucuuu

SEQ ID NO: 67561 - RNA, 22 nt, Human
ugcaucccaaacaugguuuccu

SEQ ID NO: 67562 - RNA, 22 nt, Human
ugcaucccugaggcauuauccu

SEQ ID NO: 67563 - RNA, 22 nt, Human
ucuucaaauacagucauauuga

SEQ ID NO: 67564 - RNA, 22 nt, Human
ucuagagaauuuggaaauuaag

SEQ ID NO: 67565 - RNA, 22 nt, Human
ugcauuuucuaccacacccacu

SEQ ID NO: 67566 - RNA, 22 nt, Human
ucccucacacagcugggagaac

SEQ ID NO: 67567 - RNA, 22 nt, Human
ugauuugaaaccuuuggcaaga

SEQ ID NO: 67568 - RNA, 22 nt, Human
ugauugcucagcuagccucuuu

SEQ ID NO: 67569 - RNA, 22 nt, Human
uaugauuuucaugguagaguua

SEQ ID NO: 67570 - RNA, 22 nt, Human
uaacaguggucugugguaucug

SEQ ID NO: 67571 - RNA, 22 nt, Human
guuuacaacaucuuguccuuca

SEQ ID NO: 67572 - RNA, 22 nt, Human
ggcuuacgcgcuaacagugaau

SEQ ID NO: 67573 - RNA, 22 nt, Human
ggagcaucuaccauuucuagau

SEQ ID NO: 67574 - RNA, 22 nt, Human
ggaaagagaaacaugaacuaga

SEQ ID NO: 67575 - RNA, 22 nt, Human
ggaaaaucaaaccauuuacagu

SEQ ID NO: 67576 - RNA, 21 nt, Human
gcauccucguacucuucaggu

SEQ ID NO: 67577 - RNA, 22 nt, Human
gcaucccagaagauucugauuu

SEQ ID NO: 67578 - RNA, 22 nt, Human
uucauggauuugugaaauuuag

SEQ ID NO: 67579 - RNA, 23 nt, Human
aaguggugacugugcuacugaga

SEQ ID NO: 67580 - RNA, 22 nt, Human
uggcagccugcgugaaggagcu

SEQ ID NO: 67581 - RNA, 18 nt, Human
aggcuggggaucacaggg

SEQ ID NO: 67582 - RNA, 22 nt, Human
cagagagcguccauccggugcc

SEQ ID NO: 67583 - RNA, 18 nt, Human
ggccucagccuggccgga

SEQ ID NO: 67584 - RNA, 22 nt, Human
ugucccaucacagaggagacua

SEQ ID NO: 67585 - RNA, 22 nt, Human
uuuuccuuagaaauacauugau

SEQ ID NO: 67586 - RNA, 22 nt, Human
uucacugugauguuuaagagaa

SEQ ID NO: 67587 - RNA, 22 nt, Human
aggcucagcaucugauucauau

SEQ ID NO: 67588 - RNA, 22 nt, Human
auuugcuuguucaccaguacuu

SEQ ID NO: 67589 - RNA, 22 nt, Human
uuuguugucuucauaauacuuu

SEQ ID NO: 67590 - RNA, 22 nt, Human
aggggaggcugcgggcugccgu

SEQ ID NO: 67591 - RNA, 22 nt, Human
uuucacuucgaucagaguuuuu

SEQ ID NO: 67592 - RNA, 22 nt, Human
cuccacagccccuccaguggca

SEQ ID NO: 67593 - RNA, 22 nt, Human
uucucugcgcuccggcccaguu

SEQ ID NO: 67594 - RNA, 22 nt, Human
gcucagccuuuuguucuauuca

SEQ ID NO: 67595 - RNA, 22 nt, Human
agauggggccugaggacacugu

SEQ ID NO: 67596 - RNA, 20 nt, Human
uucacagaggacucagguca

SEQ ID NO: 67597 - RNA, 22 nt, Human
cuaaaccaauauauuuucuucc

SEQ ID NO: 67598 - RNA, 22 nt, Human
ugggggagggagaguugauggg

SEQ ID NO: 67599 - RNA, 21 nt, Human
agaugaggauacugaggccua

SEQ ID NO: 67600 - RNA, 20 nt, Human
ucagugggaaagugagagug

SEQ ID NO: 67601 - RNA, 22 nt, Human
uuccgcuuucaauggcuuggcu

SEQ ID NO: 67602 - RNA, 22 nt, Human
cuguggcuaggaagcuguggga

SEQ ID NO: 67603 - RNA, 22 nt, Human
uguguuguuuggggauguccau

SEQ ID NO: 67604 - RNA, 22 nt, Human
ucuuucugaugggaagggucaa

SEQ ID NO: 67605 - RNA, 22 nt, Human
ggcaaggaagaaagcagaaguu

SEQ ID NO: 67606 - RNA, 22 nt, Human
uuauuuaaguauuuauugaagu

SEQ ID NO: 67607 - RNA, 22 nt, Human
cagggcagaguuaagaugcugg

SEQ ID NO: 67608 - RNA, 22 nt, Human
ugcccacuucaaaaucuucauu

SEQ ID NO: 67609 - RNA, 22 nt, Human
aaggugggacugagaggggaca

SEQ ID NO: 67610 - RNA, 22 nt, Human
guugcuaugaaauuaaaauuua

SEQ ID NO: 67611 - RNA, 22 nt, Human
gcccagccucagggcaucagcu

SEQ ID NO: 67612 - RNA, 22 nt, Human
augcuuucucuucuauuucuca

SEQ ID NO: 67613 - RNA, 22 nt, Human
ucuuugcugacacuuacacugu

SEQ ID NO: 67614 - RNA, 22 nt, Human
ugugugcuaguuuugucaguau

SEQ ID NO: 67615 - RNA, 22 nt, Human
ggccugcuaccagcugugaccu

SEQ ID NO: 67616 - RNA, 22 nt, Human
uaauaaaaauuuaauucacauu

SEQ ID NO: 67617 - RNA, 22 nt, Human
acauaaaccccccuuccccagg

SEQ ID NO: 67618 - RNA, 22 nt, Human
gcuguguaugaugcaggcaccu

SEQ ID NO: 67619 - RNA, 22 nt, Human
caguagcuuuuugcagacaaga

SEQ ID NO: 67620 - RNA, 22 nt, Human
cucuugugucaccauggauaaa

SEQ ID NO: 67621 - RNA, 21 nt, Human
uggcaggcagcuggaagcuug

SEQ ID NO: 67622 - RNA, 22 nt, Human
gcccugucagcucucauggaca

SEQ ID NO: 67623 - RNA, 22 nt, Human
uccucccugcacucagugaagu

SEQ ID NO: 67624 - RNA, 22 nt, Human
ugagggaguguggauacaguag

SEQ ID NO: 67625 - RNA, 22 nt, Human
gcuggggaucgaaggcagagcc

SEQ ID NO: 67626 - RNA, 22 nt, Human
auuuucuugucucuguuguagg

SEQ ID NO: 67627 - RNA, 22 nt, Human
uuuuuuaaucaaguaggaaaca

SEQ ID NO: 67628 - RNA, 20 nt, Human
ccuuguggaugucuuuuuug

SEQ ID NO: 67629 - RNA, 22 nt, Human
cagcucugcugggaggaugcag

SEQ ID NO: 67630 - RNA, 22 nt, Human
uugcuuuuugggguuuacuggg

SEQ ID NO: 67631 - RNA, 22 nt, Human
cugcagagaccuaggucagguu

SEQ ID NO: 67632 - RNA, 22 nt, Human
uucaugucuuugauucugauaa

SEQ ID NO: 67633 - RNA, 22 nt, Human
agggcugcugcuccgggcccag

SEQ ID NO: 67634 - RNA, 20 nt, Human
cuggaguguagcaguggcug

SEQ ID NO: 67635 - RNA, 22 nt, Human
caagaaaaaacaugaugagugu

SEQ ID NO: 67636 - RNA, 22 nt, Human
uggguauauauguugcuacaga

SEQ ID NO: 67637 - RNA, 22 nt, Human
ggcuccaggguaccccuggaug

SEQ ID NO: 67638 - RNA, 22 nt, Human
uggggcuccuccuggcaggagg

SEQ ID NO: 67639 - RNA, 22 nt, Human
acuggagcccguggaggcgcag

SEQ ID NO: 67640 - RNA, 22 nt, Human
ccucccuucccggcauggcucu

SEQ ID NO: 67641 - RNA, 22 nt, Human
ggcugggagguggcgaggaggc

SEQ ID NO: 67642 - RNA, 22 nt, Human
aggggaggcugggcuggggggc

SEQ ID NO: 67643 - RNA, 22 nt, Human
aggcgaagggaccagacgguag

SEQ ID NO: 67644 - RNA, 22 nt, Human
ugauucacagacuucacaaggc

SEQ ID NO: 67645 - RNA, 22 nt, Human
gcagguggaagcagcagacuca

SEQ ID NO: 67646 - RNA, 22 nt, Human
gugguuuagccuucauuaaccu

SEQ ID NO: 67647 - RNA, 22 nt, Human
gaauucuaguucuguaucucug

SEQ ID NO: 67648 - RNA, 22 nt, Human
guuuuauaacuauagugagaau

SEQ ID NO: 67649 - RNA, 23 nt, Human
aaggugaagccaccaggugagga

SEQ ID NO: 67650 - RNA, 22 nt, Human
uucuugucuuuguuauguagga

SEQ ID NO: 67651 - RNA, 22 nt, Human
ugagagggagacagcucuagca

SEQ ID NO: 67652 - RNA, 22 nt, Human
uguuaguauuggcaaauuuguu

SEQ ID NO: 67653 - RNA, 22 nt, Human
gggcugagagcuggaaucugag

SEQ ID NO: 67654 - RNA, 22 nt, Human
uuggugauguagcagcaauugu

SEQ ID NO: 67655 - RNA, 22 nt, Human
cuguccauuuucgugccuccuu

SEQ ID NO: 67656 - RNA, 22 nt, Human
cuuggggauuuuaaagaccucu

SEQ ID NO: 67657 - RNA, 22 nt, Human
cagggggacuuguuagguuuua

SEQ ID NO: 67658 - RNA, 22 nt, Human
auuuuuuuuccugucucuuuca

SEQ ID NO: 67659 - RNA, 22 nt, Human
augugugugcgagcgugugugu

SEQ ID NO: 67660 - RNA, 22 nt, Human
aaagggagauaaaguaauuuua

SEQ ID NO: 67661 - RNA, 22 nt, Human
cucucugcugucuuucgggaaa

SEQ ID NO: 67662 - RNA, 22 nt, Human
auggauggaagcagccugaacu

SEQ ID NO: 67663 - RNA, 22 nt, Human
uggaagcccagaaggaagcaga

SEQ ID NO: 67664 - RNA, 22 nt, Human
uugcuuuuuuggguuuacuggg

SEQ ID NO: 67665 - RNA, 22 nt, Human
uuucuugugauuuugaugaacu

SEQ ID NO: 67666 - RNA, 22 nt, Human
aggcaggggagcuggaagggua

SEQ ID NO: 67667 - RNA, 22 nt, Human
cacugguugccucuuucuguuc

SEQ ID NO: 67668 - RNA, 22 nt, Human
guuuggguggcuagagaaagaa

SEQ ID NO: 67669 - RNA, 22 nt, Human
ucuugugguggaucccucauuu

SEQ ID NO: 67670 - RNA, 22 nt, Human
agagggagagauuggcaaucag

SEQ ID NO: 67671 - RNA, 22 nt, Human
uaucauuuuacugugacauuuu

SEQ ID NO: 67672 - RNA, 20 nt, Human
agaaggagagaugaggcaaa

SEQ ID NO: 67673 - RNA, 22 nt, Human
gugauggucgagcgcuuguugu

SEQ ID NO: 67674 - RNA, 22 nt, Human
uuuuuuuuacuccggacagcuc

SEQ ID NO: 67675 - RNA, 22 nt, Human
ggagccucuaaacaguuaucaa

SEQ ID NO: 67676 - RNA, 19 nt, Human
agcucaggcccaucguccc

SEQ ID NO: 67677 - RNA, 22 nt, Human
gaggagggagcuggaagcucuu

SEQ ID NO: 67678 - RNA, 17 nt, Human
uuagagcuacauguuga

SEQ ID NO: 67679 - RNA, 22 nt, Human
ccuuuggaugucauucuuggca

SEQ ID NO: 67680 - RNA, 22 nt, Human
uguugaagcaccucugucuuuc

SEQ ID NO: 67681 - RNA, 22 nt, Human
ucacuguuucaccgucugaagg

SEQ ID NO: 67682 - RNA, 22 nt, Human
gccaguggucagugggagggug

SEQ ID NO: 67683 - RNA, 22 nt, Human
acuguugagggaagcagaugaa

SEQ ID NO: 67684 - RNA, 22 nt, Human
gaaggagaggauugugaggcug

SEQ ID NO: 67685 - RNA, 22 nt, Human
gcuguggaaaaugggucuccaa

SEQ ID NO: 67686 - RNA, 22 nt, Human
auccugugggguauugcugcau

SEQ ID NO: 67687 - RNA, 22 nt, Human
gaggagcugggucagggagaca

SEQ ID NO: 67688 - RNA, 22 nt, Human
aaggucuucgaaccuuauguua

SEQ ID NO: 67689 - RNA, 22 nt, Human
uauuuuuacuguuugaugauuc

SEQ ID NO: 67690 - RNA, 22 nt, Human
aaaucauagccaugaacauuug

SEQ ID NO: 67691 - RNA, 22 nt, Human
ggggaaggaaggggagggcacg

SEQ ID NO: 67692 - RNA, 23 nt, Human
agagggaagagcuuagaugggga

SEQ ID NO: 67693 - RNA, 22 nt, Human
aagaacuagauagugguguaaa

SEQ ID NO: 67694 - RNA, 19 nt, Human
gauauugagcugagaauuc

SEQ ID NO: 67695 - RNA, 22 nt, Human
uuugaagaaacagucuuaagag

SEQ ID NO: 67696 - RNA, 22 nt, Human
ucucugaccuccaccccaggag

SEQ ID NO: 67697 - RNA, 22 nt, Human
agggaguuccgaucugugcacc

SEQ ID NO: 67698 - RNA, 22 nt, Human
aagggagagggagaagguggga

SEQ ID NO: 67699 - RNA, 20 nt, Human
uuggagaucacguguccagg

SEQ ID NO: 67700 - RNA, 22 nt, Human
uucuagcucauggugacagauc

SEQ ID NO: 67701 - RNA, 22 nt, Human
gggcagagagcuggaacuccuu

SEQ ID NO: 67702 - RNA, 22 nt, Human
uuguuauuauuauuuucguucu

SEQ ID NO: 67703 - RNA, 22 nt, Human
agccccaauuacagcugugcug

SEQ ID NO: 67704 - RNA, 22 nt, Human
uccagcugugcuccaggaggug

SEQ ID NO: 67705 - RNA, 21 nt, Human
gggagaguagcgguagggagg

SEQ ID NO: 67706 - RNA, 22 nt, Human
uugcucuuaccauuauguguga

SEQ ID NO: 67707 - RNA, 22 nt, Human
aggggaggggaguaucaggauu

SEQ ID NO: 67708 - RNA, 22 nt, Human
acauuccugaagguaaugagaa

SEQ ID NO: 67709 - RNA, 22 nt, Human
uauuuuuaccuaauuuaugaga

SEQ ID NO: 67710 - RNA, 22 nt, Human
guuuuucuuugauuuagaacca

SEQ ID NO: 67711 - RNA, 22 nt, Human
uuuguacuuucuaauguauuua

SEQ ID NO: 67712 - RNA, 22 nt, Human
gaggcuugccacuguccauggc

SEQ ID NO: 67713 - RNA, 22 nt, Human
uguuuguuuuguauuuuuaauu

SEQ ID NO: 67714 - RNA, 22 nt, Human
auauugcuuuauucuugaauau

SEQ ID NO: 67715 - RNA, 22 nt, Human
auagaaauagacaaugcaaaga

SEQ ID NO: 67716 - RNA, 22 nt, Human
guguucuuuguagaggaucuug

SEQ ID NO: 67717 - RNA, 22 nt, Human
ccaaggcuguggggcugugcag

SEQ ID NO: 67718 - RNA, 22 nt, Human
uugguuuacucuggggauaucu

SEQ ID NO: 67719 - RNA, 22 nt, Human
gcuuucagggucacugucaaca

SEQ ID NO: 67720 - RNA, 22 nt, Human
gccucucuggcaaagcggugau

SEQ ID NO: 67721 - RNA, 23 nt, Human
ucucacucauucuccucugucca

SEQ ID NO: 67722 - RNA, 22 nt, Human
auguuuaauuugaaauuuuauu

SEQ ID NO: 67723 - RNA, 22 nt, Human
uacaagcucuuguagggggaaa

SEQ ID NO: 67724 - RNA, 19 nt, Human
agagucuccacuccacuug

SEQ ID NO: 67725 - RNA, 22 nt, Human
cuucuuucuuuucuucuucucu

SEQ ID NO: 67726 - RNA, 22 nt, Human
uucauauuguggucuugcauuc

SEQ ID NO: 67727 - RNA, 22 nt, Human
uggggcauacgugaaauaauuu

SEQ ID NO: 67728 - RNA, 22 nt, Human
agcgcucauuuuccuccugcuc

SEQ ID NO: 67729 - RNA, 21 nt, Human
aaguuucucccuaauuguugc

SEQ ID NO: 67730 - RNA, 22 nt, Human
guggaaggaauuaacagacuag

SEQ ID NO: 67731 - RNA, 22 nt, Human
agagacuguaaugagagguaca

SEQ ID NO: 67732 - RNA, 22 nt, Human
uuuaaauuucugaaucuugagg

SEQ ID NO: 67733 - RNA, 17 nt, Human
aaagccgaucagauguu

SEQ ID NO: 67734 - RNA, 22 nt, Human
gagggugguggcggccggcacc

SEQ ID NO: 67735 - RNA, 22 nt, Human
aagaaggaaggcaagagauggg

SEQ ID NO: 67736 - RNA, 20 nt, Human
cuccuccccucggccccacc

SEQ ID NO: 67737 - RNA, 22 nt, Human
agggcaguuuuacugaaaggug

SEQ ID NO: 67738 - RNA, 22 nt, Human
uuuucaaucaaguuuauuuaua

SEQ ID NO: 67739 - RNA, 22 nt, Human
ccaggcuccccaggaggcccuu

SEQ ID NO: 67740 - RNA, 22 nt, Human
uuauuuaagaucuuaauauaua

SEQ ID NO: 67741 - RNA, 22 nt, Human
gccugggguuugcggggcugca

SEQ ID NO: 67742 - RNA, 22 nt, Human
uucacauucauuucuuauguuu

SEQ ID NO: 67743 - RNA, 22 nt, Human
cggcugcagcggagcaggcugg

SEQ ID NO: 67744 - RNA, 22 nt, Human
uggcaaggccacaggugcaguu

SEQ ID NO: 67745 - RNA, 22 nt, Human
gaguucuagauguauuauuaau

SEQ ID NO: 67746 - RNA, 22 nt, Human
auggagugggaggacaugaagg

SEQ ID NO: 67747 - RNA, 22 nt, Human
cuguuucucugccugcacacau

SEQ ID NO: 67748 - RNA, 22 nt, Human
agcagggagacagugcagcauu

SEQ ID NO: 67749 - RNA, 22 nt, Human
ugaaguuuagaaaaagugccuu

SEQ ID NO: 67750 - RNA, 22 nt, Human
ucugcaugccucaggaggccug

SEQ ID NO: 67751 - RNA, 22 nt, Human
ggcuguggcagcuggaaguggu

SEQ ID NO: 67752 - RNA, 22 nt, Human
ggcugugguggacgcgggaaac

SEQ ID NO: 67753 - RNA, 22 nt, Human
ggcugugaaguacguugaaggu

SEQ ID NO: 67754 - RNA, 22 nt, Human
auauucaaugaggucauauaag

SEQ ID NO: 67755 - RNA, 18 nt, Human
ggagaagaacagaugugg

SEQ ID NO: 67756 - RNA, 22 nt, Human
uggagccuugugagaccacaau

SEQ ID NO: 67757 - RNA, 22 nt, Human
uauuaaaagagaaaaagccacc

SEQ ID NO: 67758 - RNA, 22 nt, Human
aagugauuuucccaccaucuac

SEQ ID NO: 67759 - RNA, 22 nt, Human
ugucuuugaccuuaagaaguuu

SEQ ID NO: 67760 - RNA, 22 nt, Human
agauuuucuuuuccaucuuugu

SEQ ID NO: 67761 - RNA, 22 nt, Human
ucucucugcuguccagcguuau

SEQ ID NO: 67762 - RNA, 21 nt, Human
uuucauuaguacaucaauuug

SEQ ID NO: 67763 - RNA, 21 nt, Human
caguucuaagugucaucuuuu

SEQ ID NO: 67764 - RNA, 22 nt, Human
uguaaauucuauacacuuaaaa

SEQ ID NO: 67765 - RNA, 22 nt, Human
cguuuugaguagauagccauau

SEQ ID NO: 67766 - RNA, 22 nt, Human
cacuguugagcaauguacagug

SEQ ID NO: 67767 - RNA, 22 nt, Human
ugcucacugcuuguguucaguu

SEQ ID NO: 67768 - RNA, 22 nt, Human
ccagcaggagacuagcaacaua

SEQ ID NO: 67769 - RNA, 22 nt, Human
caagggcagaggcagggccccg

SEQ ID NO: 67770 - RNA, 22 nt, Human
cucugcuuguaucacauuugcu

SEQ ID NO: 67771 - RNA, 19 nt, Human
uccuacaugagacagagag

SEQ ID NO: 67772 - RNA, 20 nt, Human
uuuuuuaaauagagcuguug

SEQ ID NO: 67773 - RNA, 22 nt, Human
uuuauguuuguuuuugaaauaa

SEQ ID NO: 67774 - RNA, 22 nt, Human
aucucacuucugucauguggca

SEQ ID NO: 67775 - RNA, 21 nt, Human
gggagugaguaaugauggggg

SEQ ID NO: 67776 - RNA, 22 nt, Human
auaaaaauguuuuuguguggua

SEQ ID NO: 67777 - RNA, 22 nt, Human
ggaggccgugcugugcugccag

SEQ ID NO: 67778 - RNA, 22 nt, Human
cagagcugucauuugccaguga

SEQ ID NO: 67779 - RNA, 22 nt, Human
gaggagcuucagaggaaucuua

SEQ ID NO: 67780 - RNA, 22 nt, Human
guucaaucucucaugcauuuuc

SEQ ID NO: 67781 - RNA, 20 nt, Human
uggguucaguuguuucuggc

SEQ ID NO: 67782 - RNA, 22 nt, Human
ucagccuugguuuugguguugg

SEQ ID NO: 67783 - RNA, 22 nt, Human
gggcuguggggccugcagaagg

SEQ ID NO: 67784 - RNA, 22 nt, Human
ccagcugggucccugcuggggc

SEQ ID NO: 67785 - RNA, 22 nt, Human
gcugcaggaggugguagggucu

SEQ ID NO: 67786 - RNA, 22 nt, Human
ggagagcuagugagcuggaggu

SEQ ID NO: 67787 - RNA, 22 nt, Human
ucacaucugugugauugucauu

SEQ ID NO: 67788 - RNA, 20 nt, Human
ugccagagagcucauacccu

SEQ ID NO: 67789 - RNA, 22 nt, Human
cuccucccagcccaggcgccac

SEQ ID NO: 67790 - RNA, 19 nt, Human
agcaucuccacagaaaaag

SEQ ID NO: 67791 - RNA, 22 nt, Human
uuguuuuaguagaaguuacaug

SEQ ID NO: 67792 - RNA, 22 nt, Human
uuuuuaaaagaugauuuaauga

SEQ ID NO: 67793 - RNA, 19 nt, Human
uagcuguucuugaguguga

SEQ ID NO: 67794 - RNA, 22 nt, Human
cuguguguauaauguuugauaa

SEQ ID NO: 67795 - RNA, 23 nt, Human
ucagaccaaccucuugcuggaac

SEQ ID NO: 67796 - RNA, 22 nt, Human
uucauuuccauuuuauagauaa

SEQ ID NO: 67797 - RNA, 22 nt, Human
ucaguggaacacacagaguggg

SEQ ID NO: 67798 - RNA, 22 nt, Human
agguggucccaauggcugggca

SEQ ID NO: 67799 - RNA, 22 nt, Human
cucuuucauucuguccuuguuu

SEQ ID NO: 67800 - RNA, 22 nt, Human
uugauagauuuuagaggcaggc

SEQ ID NO: 67801 - RNA, 22 nt, Human
cauggcggcgcucucccugccu

SEQ ID NO: 67802 - RNA, 22 nt, Human
uucuccaccugcuccucccacc

SEQ ID NO: 67803 - RNA, 22 nt, Human
gguuuucacgauccucccuuuu

SEQ ID NO: 67804 - RNA, 22 nt, Human
ggggcucauuugcaggggggag

SEQ ID NO: 67805 - RNA, 22 nt, Human
ggcuggagcaggcugcacagug

SEQ ID NO: 67806 - RNA, 22 nt, Human
uggacacugguggauauggaau

SEQ ID NO: 67807 - RNA, 22 nt, Human
auagggaggcggagggagcugg

SEQ ID NO: 67808 - RNA, 22 nt, Human
cuacuucucccuagaucagaaa

SEQ ID NO: 67809 - RNA, 22 nt, Human
gugaaauuguacacucaguacc

SEQ ID NO: 67810 - RNA, 22 nt, Human
gaggcucagagggacuuucaag

SEQ ID NO: 67811 - RNA, 22 nt, Human
gauuuuuaaaaguaguuuugaa

SEQ ID NO: 67812 - RNA, 22 nt, Human
cuguuaauugugaauuuuacau

SEQ ID NO: 67813 - RNA, 22 nt, Human
gccagggcucgagcaggccagc

SEQ ID NO: 67814 - RNA, 22 nt, Human
uguugaaacagcuauugacuuu

SEQ ID NO: 67815 - RNA, 22 nt, Human
aagccucaugccagauccaggu

SEQ ID NO: 67816 - RNA, 20 nt, Human
ucugugugccaucaccuaac

SEQ ID NO: 67817 - RNA, 22 nt, Human
acuuuauacuagugauaguuug

SEQ ID NO: 67818 - RNA, 22 nt, Human
auguacugacuguacuuuuaaa

SEQ ID NO: 67819 - RNA, 22 nt, Human
uucuucuucuuccucauccuca

SEQ ID NO: 67820 - RNA, 22 nt, Human
ucagcucucucuuggugaucuc

SEQ ID NO: 67821 - RNA, 22 nt, Human
agugagaguauuaaugugaacu

SEQ ID NO: 67822 - RNA, 22 nt, Human
aggauggauagcaaggaagccg

SEQ ID NO: 67823 - RNA, 22 nt, Human
gcuugcuuuguaaauaucugug

SEQ ID NO: 67824 - RNA, 22 nt, Human
gaguagaacagauagucaagaa

SEQ ID NO: 67825 - RNA, 22 nt, Human
gaggggaacaggcauucuuaag

SEQ ID NO: 67826 - RNA, 22 nt, Human
aguaggauguuuagcccuucuu

SEQ ID NO: 67827 - RNA, 22 nt, Human
gaggcaggaagggaggguugug

SEQ ID NO: 67828 - RNA, 22 nt, Human
auaguugcugucauuauuugag

SEQ ID NO: 67829 - RNA, 22 nt, Human
gaggcaggcggggcccaggugg

SEQ ID NO: 67830 - RNA, 22 nt, Human
cugguuuauuucauaguuuguu

SEQ ID NO: 67831 - RNA, 22 nt, Human
aagagaggcccaaguggcuggc

SEQ ID NO: 67832 - RNA, 22 nt, Human
gugucacuuucaggagcucuaa

SEQ ID NO: 67833 - RNA, 22 nt, Human
cacauuuuccagaagaaucaga

SEQ ID NO: 67834 - RNA, 22 nt, Human
cugcugugcagacagacucucu

SEQ ID NO: 67835 - RNA, 23 nt, Human
aggcugcagaagaauagggucau

SEQ ID NO: 67836 - RNA, 22 nt, Human
ucccugcugggcgaucuucucu

SEQ ID NO: 67837 - RNA, 22 nt, Human
augggagggagcagugaguguu

SEQ ID NO: 67838 - RNA, 22 nt, Human
agcaaggguugguuuucugaca

SEQ ID NO: 67839 - RNA, 22 nt, Human
uuguuguuguuguuauuuaguu

SEQ ID NO: 67840 - RNA, 22 nt, Human
caggccccagggacugggcgcu

SEQ ID NO: 67841 - RNA, 22 nt, Human
ugaauucaaacuuuuuaacaag

SEQ ID NO: 67842 - RNA, 22 nt, Human
cuguggcugcgcccugggggag

SEQ ID NO: 67843 - RNA, 22 nt, Human
aggccccacaaacucgccuuug

SEQ ID NO: 67844 - RNA, 22 nt, Human
uuguuuguaaggcucuuagaau

SEQ ID NO: 67845 - RNA, 22 nt, Human
gacuggggcauuagaguagcuu

SEQ ID NO: 67846 - RNA, 22 nt, Human
uacagaccaguaguucucagcg

SEQ ID NO: 67847 - RNA, 22 nt, Human
ugguugauuaauuuugccaagc

SEQ ID NO: 67848 - RNA, 22 nt, Human
ccuccuuuccuguuuuccugag

SEQ ID NO: 67849 - RNA, 22 nt, Human
uucccugugcaguauguuccaa

SEQ ID NO: 67850 - RNA, 22 nt, Human
augaggaacagcaagaauauuu

SEQ ID NO: 67851 - RNA, 22 nt, Human
gaauuagguaauagaacuagua

SEQ ID NO: 67852 - RNA, 22 nt, Human
aucauguauauuuuugcuauua

SEQ ID NO: 67853 - RNA, 20 nt, Human
ggcagagcuaugucuguugc

SEQ ID NO: 67854 - RNA, 22 nt, Human
uucugcuuuaaagcucauguuu

SEQ ID NO: 67855 - RNA, 22 nt, Human
agcaagggucucucauggcuug

SEQ ID NO: 67856 - RNA, 22 nt, Human
uugcuuucuuuguagguuuucc

SEQ ID NO: 67857 - RNA, 22 nt, Human
agaucugucaccauccuggagc

SEQ ID NO: 67858 - RNA, 22 nt, Human
gugcugggaggcccaggaugga

SEQ ID NO: 67859 - RNA, 22 nt, Human
ggcucacuguaccugccgccgc

SEQ ID NO: 67860 - RNA, 22 nt, Human
cagguggauggcgagcccugca

SEQ ID NO: 67861 - RNA, 20 nt, Human
gacaugagggagcaaagagc

SEQ ID NO: 67862 - RNA, 22 nt, Human
gcagggcucuggagucaggcug

SEQ ID NO: 67863 - RNA, 21 nt, Human
acugggcuagccugacuucug

SEQ ID NO: 67864 - RNA, 22 nt, Human
aagaaauacagaaauggcagua

SEQ ID NO: 67865 - RNA, 22 nt, Human
uggcucaguaaucgagucuccu

SEQ ID NO: 67866 - RNA, 22 nt, Human
gucucacuucauuuucuuagcc

SEQ ID NO: 67867 - RNA, 22 nt, Human
aggauggaaguaacuggauaau

SEQ ID NO: 67868 - RNA, 22 nt, Human
ggcucagaggagcuggaacggu

SEQ ID NO: 67869 - RNA, 22 nt, Human
gcucagcuggagagggacgggu

SEQ ID NO: 67870 - RNA, 22 nt, Human
uaggauugguguauguagguuu

SEQ ID NO: 67871 - RNA, 22 nt, Human
agauggaguccugaagccagaa

SEQ ID NO: 67872 - RNA, 22 nt, Human
gaaccauuuaauggagaugcuc

SEQ ID NO: 67873 - RNA, 22 nt, Human
gcagggcucagccgcucccacc

SEQ ID NO: 67874 - RNA, 22 nt, Human
ggagcucacuacgaaauaagcu

SEQ ID NO: 67875 - RNA, 22 nt, Human
caguggacacuuccucuacaau

SEQ ID NO: 67876 - RNA, 22 nt, Human
agucacuguucugucaugucaa

SEQ ID NO: 67877 - RNA, 22 nt, Human
ggggaggugugcaggacaccuc

SEQ ID NO: 67878 - RNA, 22 nt, Human
gucuuucuuuuacauauuugug

SEQ ID NO: 67879 - RNA, 22 nt, Human
agcuuucuauauaugaguugcu

SEQ ID NO: 67880 - RNA, 22 nt, Human
guucuacaugacacucaacauu

SEQ ID NO: 67881 - RNA, 22 nt, Human
ugcuguugacuuuguuguucuu

SEQ ID NO: 67882 - RNA, 22 nt, Human
ggaggcccagaaggaagcccag

SEQ ID NO: 67883 - RNA, 22 nt, Human
uggcucaggccuacgacgccuu

SEQ ID NO: 67884 - RNA, 22 nt, Human
cggggcuggcguuagggaggca

SEQ ID NO: 67885 - RNA, 22 nt, Human
uuuuuaagguuuguuuauauau

SEQ ID NO: 67886 - RNA, 20 nt, Human
uaguggaccuugaaggccuc

SEQ ID NO: 67887 - RNA, 22 nt, Human
aggugagaacguggaggggcgg

SEQ ID NO: 67888 - RNA, 22 nt, Human
uuuuaggauuugaguugcugga

SEQ ID NO: 67889 - RNA, 22 nt, Human
aggguggaggacaggccaguga

SEQ ID NO: 67890 - RNA, 22 nt, Human
cugucucugauaagcucgaggg

SEQ ID NO: 67891 - RNA, 18 nt, Human
guucaagcauuuugcucu

SEQ ID NO: 67892 - RNA, 17 nt, Human
ucuguguccgcucaguc

SEQ ID NO: 67893 - RNA, 20 nt, Human
gaacauaaauaacucuuuac

SEQ ID NO: 67894 - RNA, 22 nt, Human
uuauuugcccauguuuagcaga

SEQ ID NO: 67895 - RNA, 22 nt, Human
ggcuggggccuguugaagaugc

SEQ ID NO: 67896 - RNA, 22 nt, Human
auguguguaugacugaaucuau

SEQ ID NO: 67897 - RNA, 22 nt, Human
uaguggaaccuucuaaaugacg

SEQ ID NO: 67898 - RNA, 22 nt, Human
ugagggaggggaaugugugcag

SEQ ID NO: 67899 - RNA, 22 nt, Human
aagaugcuucaugagaguuggg

SEQ ID NO: 67900 - RNA, 22 nt, Human
agagggagagaccuccgugccu

SEQ ID NO: 67901 - RNA, 22 nt, Human
uuaggggcuuaggcagaguuug

SEQ ID NO: 67902 - RNA, 21 nt, Human
guucuuaguuauauucucaau

SEQ ID NO: 67903 - RNA, 22 nt, Human
guacauauccuuuacguuuugu

SEQ ID NO: 67904 - RNA, 22 nt, Human
uaucugcuggagguaauuacuc

SEQ ID NO: 67905 - RNA, 18 nt, Human
auucauuugcguuuggcu

SEQ ID NO: 67906 - RNA, 22 nt, Human
cucagcgagggaaagaggccgc

SEQ ID NO: 67907 - RNA, 22 nt, Human
gcagagcugucuaagucacuuc

SEQ ID NO: 67908 - RNA, 18 nt, Human
uucaggcucuugcaugaa

SEQ ID NO: 67909 - RNA, 20 nt, Human
ugcugugugucuacuguggg

SEQ ID NO: 67910 - RNA, 22 nt, Human
uacauaauagcaaggugcuguc

SEQ ID NO: 67911 - RNA, 22 nt, Human
ggaaggggagcuggaaagggua

SEQ ID NO: 67912 - RNA, 22 nt, Human
uggggcuggccaggaggagucu

SEQ ID NO: 67913 - RNA, 22 nt, Human
agagacaggguuuugucguguu

SEQ ID NO: 67914 - RNA, 22 nt, Human
cuccugcuuuuucuucuuccga

SEQ ID NO: 67915 - RNA, 22 nt, Human
ggacggggagcuggaaagggga

SEQ ID NO: 67916 - RNA, 22 nt, Human
aggauagacuucagaaggcaua

SEQ ID NO: 67917 - RNA, 22 nt, Human
cuccuuugagcaaaucuuugau

SEQ ID NO: 67918 - RNA, 22 nt, Human
gcucucuggccugggaggagga

SEQ ID NO: 67919 - RNA, 22 nt, Human
uuuuguuacugauuauuaaaau

SEQ ID NO: 67920 - RNA, 22 nt, Human
gggggcagguuccaggccagcu

SEQ ID NO: 67921 - RNA, 22 nt, Human
aagcucuuuccacuaaaccacu

SEQ ID NO: 67922 - RNA, 20 nt, Human
ccugggcuccaggagccccg

SEQ ID NO: 67923 - RNA, 22 nt, Human
uuauauuuuauuuaauuaaaua

SEQ ID NO: 67924 - RNA, 22 nt, Human
aggggcugagaguuugaugugg

SEQ ID NO: 67925 - RNA, 22 nt, Human
gugucccaaagauuagaaauca

SEQ ID NO: 67926 - RNA, 22 nt, Human
gcagaaguauuguacgguggga

SEQ ID NO: 67927 - RNA, 22 nt, Human
agggcaguuaugaaugucucca

SEQ ID NO: 67928 - RNA, 22 nt, Human
aucuguuccccuaugcucucua

SEQ ID NO: 67929 - RNA, 22 nt, Human
uuuuauuuguauguugaaugua

SEQ ID NO: 67930 - RNA, 22 nt, Human
auggugaugaugaugaugauaa

SEQ ID NO: 67931 - RNA, 22 nt, Human
ggagugaguauguucugaugca

SEQ ID NO: 67932 - RNA, 22 nt, Human
cuggaagcgucggaggaagggc

SEQ ID NO: 67933 - RNA, 22 nt, Human
ucagucucuggggcuucuguuu

SEQ ID NO: 67934 - RNA, 22 nt, Human
agucccugauggacuggaugag

SEQ ID NO: 67935 - RNA, 22 nt, Human
ugggcagggauuuggggaaacu

SEQ ID NO: 67936 - RNA, 22 nt, Human
cccagaggcugaguugggagca

SEQ ID NO: 67937 - RNA, 22 nt, Human
gcaggggguaaggggcagggcu

SEQ ID NO: 67938 - RNA, 22 nt, Human
uucacugugauugggguggauu

SEQ ID NO: 67939 - RNA, 22 nt, Human
auuagugguguauuuggcacua

SEQ ID NO: 67940 - RNA, 22 nt, Human
gagcagcucgagaaggaagcag

SEQ ID NO: 67941 - RNA, 22 nt, Human
aggggcugugucauuuguccua

SEQ ID NO: 67942 - RNA, 22 nt, Human
cuccuugguuccggcguuggag

SEQ ID NO: 67943 - RNA, 22 nt, Human
ccuucugcuggucaucccagug

SEQ ID NO: 67944 - RNA, 22 nt, Human
uugaauaguuuuggauagcaua

SEQ ID NO: 67945 - RNA, 22 nt, Human
auaucuuguuuuugauuucuug

SEQ ID NO: 67946 - RNA, 22 nt, Human
ucccuguggauuaaggagaugu

SEQ ID NO: 67947 - RNA, 22 nt, Human
ggcucccgugggaugguggagc

SEQ ID NO: 67948 - RNA, 23 nt, Human
aaauaauaauuucucuguuggga

SEQ ID NO: 67949 - RNA, 22 nt, Human
gagggaggugacaaggacauag

SEQ ID NO: 67950 - RNA, 22 nt, Human
gcuguggacacagcucucuuca

SEQ ID NO: 67951 - RNA, 22 nt, Human
uuuaacauaugaaagaauauuu

SEQ ID NO: 67952 - RNA, 22 nt, Human
cauggcaggugcagauucugug

SEQ ID NO: 67953 - RNA, 22 nt, Human
cauuuugguaauguucguuugc

SEQ ID NO: 67954 - RNA, 22 nt, Human
ucuuuauuucccuaacuugcua

SEQ ID NO: 67955 - RNA, 23 nt, Human
uugcuuuugccccaaaagaguua

SEQ ID NO: 67956 - RNA, 22 nt, Human
acucacuguuuugaaauugaac

SEQ ID NO: 67957 - RNA, 22 nt, Human
cuugcucugggaauaugaguuu

SEQ ID NO: 67958 - RNA, 22 nt, Human
uggggggacagauggagaggac

SEQ ID NO: 67959 - RNA, 22 nt, Human
ucgcccagguuggagugcagug

SEQ ID NO: 67960 - RNA, 22 nt, Human
ccucaggaauuuauucuucugu

SEQ ID NO: 67961 - RNA, 22 nt, Human
uuuuuuuaaguuuugauuuuag

SEQ ID NO: 67962 - RNA, 22 nt, Human
gugugucucaguugcuccgaag

SEQ ID NO: 67963 - RNA, 22 nt, Human
ggaggccagagaagagccaggc

SEQ ID NO: 67964 - RNA, 22 nt, Human
cugccucucaugccugcuugcu

SEQ ID NO: 67965 - RNA, 22 nt, Human
ggagacagauggcgucucaguu

SEQ ID NO: 67966 - RNA, 22 nt, Human
gucuugugaagacggcagaaag

SEQ ID NO: 67967 - RNA, 22 nt, Human
aaaauauaaaggauguggguuu

SEQ ID NO: 67968 - RNA, 22 nt, Human
gagggggaaaagggcagcagag

SEQ ID NO: 67969 - RNA, 22 nt, Human
caguggagaccugccugcugga

SEQ ID NO: 67970 - RNA, 22 nt, Human
ggcugcagggaacaggaugggu

SEQ ID NO: 67971 - RNA, 22 nt, Human
gggggagcuacaggucccuugg

SEQ ID NO: 67972 - RNA, 20 nt, Human
aggggcuguaguuagaugac

SEQ ID NO: 67973 - RNA, 22 nt, Human
ggacauaguugcuauggagagu

SEQ ID NO: 67974 - RNA, 22 nt, Human
cauaaauuuuaccuuguaagug

SEQ ID NO: 67975 - RNA, 22 nt, Human
uuuugaauaauucagaaacagc

SEQ ID NO: 67976 - RNA, 22 nt, Human
ucccuucccaccccugccuuuu

SEQ ID NO: 67977 - RNA, 22 nt, Human
augcagauguagauucugaaau

SEQ ID NO: 67978 - RNA, 22 nt, Human
uaagggagcagaagcugugaaa

SEQ ID NO: 67979 - RNA, 22 nt, Human
guggguauauauaugugugcug

SEQ ID NO: 67980 - RNA, 22 nt, Human
uacugcaguuccugcugucucc

SEQ ID NO: 67981 - RNA, 22 nt, Human
uuuauaauuacguaaaauauuu

SEQ ID NO: 67982 - RNA, 22 nt, Human
auucuuuagaguccuucaaaua

SEQ ID NO: 67983 - RNA, 22 nt, Human
aagcucagcugguggugauugc

SEQ ID NO: 67984 - RNA, 22 nt, Human
uuggugaugcccaccuuuucau

SEQ ID NO: 67985 - RNA, 20 nt, Human
ucacuguaauugccuacauu

SEQ ID NO: 67986 - RNA, 21 nt, Human
ugcuuucugugcuuuuucugc

SEQ ID NO: 67987 - RNA, 22 nt, Human
ggugaguagaaguaguuggcuu

SEQ ID NO: 67988 - RNA, 23 nt, Human
ccagcugugccuggcccaggagc

SEQ ID NO: 67989 - RNA, 22 nt, Human
acugucuuguuguaugugagcu

SEQ ID NO: 67990 - RNA, 22 nt, Human
auggaguguggccaggcaguaa

SEQ ID NO: 67991 - RNA, 22 nt, Human
agggagucuggccgucggcugg

SEQ ID NO: 67992 - RNA, 22 nt, Human
guuguugucauuagcuguuuaa

SEQ ID NO: 67993 - RNA, 22 nt, Human
uuuuaauaguauaucuagacac

SEQ ID NO: 67994 - RNA, 22 nt, Human
gaggaggcuggagaggccagga

SEQ ID NO: 67995 - RNA, 23 nt, Human
ucugccuccuaauuguugguguc

SEQ ID NO: 67996 - RNA, 22 nt, Human
guauauuuaugagcauuagccu

SEQ ID NO: 67997 - RNA, 22 nt, Human
augcggcugugggggaauggga

SEQ ID NO: 67998 - RNA, 22 nt, Human
aguugggaaaugcugcaguagu

SEQ ID NO: 67999 - RNA, 22 nt, Human
caauaccucuuggugauugggc

SEQ ID NO: 68000 - RNA, 22 nt, Human
agcggccucgcugccugcucag

SEQ ID NO: 68001 - RNA, 22 nt, Human
agcugaggccccgcagcagggu

SEQ ID NO: 68002 - RNA, 22 nt, Human
uaugggcaagagauaggugguc

SEQ ID NO: 68003 - RNA, 22 nt, Human
ccugccagaaaagagggaguuc

SEQ ID NO: 68004 - RNA, 22 nt, Human
auucauucugaccucaagagaa

SEQ ID NO: 68005 - RNA, 22 nt, Human
acagagcucccagccaucuccu

SEQ ID NO: 68006 - RNA, 22 nt, Human
uucuugugugaauauaauuaca

SEQ ID NO: 68007 - RNA, 22 nt, Human
ucacuuccuugcagcuguagaa

SEQ ID NO: 68008 - RNA, 22 nt, Human
acgugugugugcacguguguau

SEQ ID NO: 68009 - RNA, 22 nt, Human
agggcucacuacaacccuggga

SEQ ID NO: 68010 - RNA, 22 nt, Human
gcucagagaaaacuggggcuug

SEQ ID NO: 68011 - RNA, 22 nt, Human
gagggagugggcccgugggcac

SEQ ID NO: 68012 - RNA, 22 nt, Human
agggaggagggacagaaagagg

SEQ ID NO: 68013 - RNA, 22 nt, Human
gcugcuuagaaccauauuuaaa

SEQ ID NO: 68014 - RNA, 22 nt, Human
ugaggaagugguuguaugguuu

SEQ ID NO: 68015 - RNA, 22 nt, Human
gagggcugccacguugggcgag

SEQ ID NO: 68016 - RNA, 22 nt, Human
ggggcaucguugauugcauggu

SEQ ID NO: 68017 - RNA, 22 nt, Human
agggcaggguuggugcuggugc

SEQ ID NO: 68018 - RNA, 22 nt, Human
ugugucuuuggcgaugucugga

SEQ ID NO: 68019 - RNA, 22 nt, Human
cccagagggcugaggauaugaa

SEQ ID NO: 68020 - RNA, 22 nt, Human
uguuuagcucugacuaugugau

SEQ ID NO: 68021 - RNA, 22 nt, Human
cauaggcucuucagagaacuga

SEQ ID NO: 68022 - RNA, 22 nt, Human
cagcuggggagagacauggcag

SEQ ID NO: 68023 - RNA, 22 nt, Human
agucaccuacagcucaugcuuc

SEQ ID NO: 68024 - RNA, 19 nt, Human
ggaggguguccucaguguc

SEQ ID NO: 68025 - RNA, 21 nt, Human
gcagcucaggauauagacuug

SEQ ID NO: 68026 - RNA, 22 nt, Human
uggggcugguaccguaauauau

SEQ ID NO: 68027 - RNA, 22 nt, Human
cagcuguggagauggggugcau

SEQ ID NO: 68028 - RNA, 22 nt, Human
uggagccugauggauaggaacg

SEQ ID NO: 68029 - RNA, 22 nt, Human
agggcugggcuuggcaggcugg

SEQ ID NO: 68030 - RNA, 22 nt, Human
ggcuagggaucuagaccaggac

SEQ ID NO: 68031 - RNA, 22 nt, Human
ugguucuagaugagaugaugag

SEQ ID NO: 68032 - RNA, 22 nt, Human
ggcucccccauggcugacagac

SEQ ID NO: 68033 - RNA, 22 nt, Human
uacauuugauuuuugcuucuuu

SEQ ID NO: 68034 - RNA, 22 nt, Human
agugccaucuuuaacuguccca

SEQ ID NO: 68035 - RNA, 22 nt, Human
ugcuuuauucgacaucugguag

SEQ ID NO: 68036 - RNA, 19 nt, Human
ucaggaggucgaccuggca

SEQ ID NO: 68037 - RNA, 22 nt, Human
caauccccaggucccagaacag

SEQ ID NO: 68038 - RNA, 20 nt, Human
uuguacuuaugugagaagga

SEQ ID NO: 68039 - RNA, 22 nt, Human
uagggaggguuugggguggagg

SEQ ID NO: 68040 - RNA, 22 nt, Human
gggagccucccacugggggaag

SEQ ID NO: 68041 - RNA, 22 nt, Human
gggggcugugugcccgcucccc

SEQ ID NO: 68042 - RNA, 22 nt, Human
ggcagggagagcgccgccaugc

SEQ ID NO: 68043 - RNA, 22 nt, Human
ucccuugacauuacuugggagg

SEQ ID NO: 68044 - RNA, 22 nt, Human
gucacuuugcuugcgaugcucc

SEQ ID NO: 68045 - RNA, 22 nt, Human
agauggaggaaagcaguuagaa

SEQ ID NO: 68046 - RNA, 22 nt, Human
uucacuguucuuagagaagacc

SEQ ID NO: 68047 - RNA, 22 nt, Human
cugggggacagagagaggcggu

SEQ ID NO: 68048 - RNA, 22 nt, Human
ugaguucugacugagcaugggg

SEQ ID NO: 68049 - RNA, 20 nt, Human
uucucugcagcaggcggccc

SEQ ID NO: 68050 - RNA, 22 nt, Human
ggggaggguuuggaugagaguc

SEQ ID NO: 68051 - RNA, 22 nt, Human
aggcagagaggucuuccuggaa

SEQ ID NO: 68052 - RNA, 22 nt, Human
agugaggggagaaugaggugga

SEQ ID NO: 68053 - RNA, 22 nt, Human
cucuguguguuugugugugugu

SEQ ID NO: 68054 - RNA, 22 nt, Human
cuuuuuaaaguaaauggcuaga

SEQ ID NO: 68055 - RNA, 22 nt, Human
uggaggcccagcugggggccgg

SEQ ID NO: 68056 - RNA, 22 nt, Human
aguaggaauucaaagagacaaa

SEQ ID NO: 68057 - RNA, 22 nt, Human
gaggugauuccucccauguaau

SEQ ID NO: 68058 - RNA, 22 nt, Human
uggaugccuugggggaggagga

SEQ ID NO: 68059 - RNA, 22 nt, Human
uuugcaggaaauguacugaaug

SEQ ID NO: 68060 - RNA, 22 nt, Human
uggguucaaauccugguuccac

SEQ ID NO: 68061 - RNA, 22 nt, Human
uuuaucaggccaucuuaugucu

SEQ ID NO: 68062 - RNA, 22 nt, Human
caauggagccaagaggaggaaa

SEQ ID NO: 68063 - RNA, 22 nt, Human
gggcaagaagcuggaagcauuc

SEQ ID NO: 68064 - RNA, 22 nt, Human
ggcuagggagacagagggcaug

SEQ ID NO: 68065 - RNA, 22 nt, Human
gagcagcugagcuggaaugaga

SEQ ID NO: 68066 - RNA, 22 nt, Human
ccaggcucaccuggagccccug

SEQ ID NO: 68067 - RNA, 22 nt, Human
uuccuuuaaccaagagcaguac

SEQ ID NO: 68068 - RNA, 22 nt, Human
ggcagagcugugcgcccaccca

SEQ ID NO: 68069 - RNA, 22 nt, Human
aguuaggaaauaaguugaguuu

SEQ ID NO: 68070 - RNA, 22 nt, Human
aagagaggaaagggugugaggu

SEQ ID NO: 68071 - RNA, 22 nt, Human
gcuguugugaggaucagcauau

SEQ ID NO: 68072 - RNA, 22 nt, Human
cccuguccuucccuccaucuga

SEQ ID NO: 68073 - RNA, 23 nt, Human
uccuccccaccuuuguccccucc

SEQ ID NO: 68074 - RNA, 22 nt, Human
gcagaggcugccgugggcagga

SEQ ID NO: 68075 - RNA, 22 nt, Human
cacagcuggggaagcugaggcc

SEQ ID NO: 68076 - RNA, 22 nt, Human
ucugagugacguccugacagga

SEQ ID NO: 68077 - RNA, 22 nt, Human
guuuauucuuuuauuugugaga

SEQ ID NO: 68078 - RNA, 22 nt, Human
auuuuuuuggucauaugagaua

SEQ ID NO: 68079 - RNA, 22 nt, Human
cacugcaaccuccaccucccgg

SEQ ID NO: 68080 - RNA, 22 nt, Human
guccuguguaaguacuugcuca

SEQ ID NO: 68081 - RNA, 18 nt, Human
uucucucuggauaguagu

SEQ ID NO: 68082 - RNA, 22 nt, Human
guuuuguagucuggagacuguc

SEQ ID NO: 68083 - RNA, 22 nt, Human
uuuguauuguuuauuucauuuu

SEQ ID NO: 68084 - RNA, 22 nt, Human
auuuauauauuuuguucuggua

SEQ ID NO: 68085 - RNA, 22 nt, Human
ugggggaggaggagacagacug

SEQ ID NO: 68086 - RNA, 22 nt, Human
uuuugcuucuaguauauuuuuu

SEQ ID NO: 68087 - RNA, 22 nt, Human
uggccccauuuuucuggagccu

SEQ ID NO: 68088 - RNA, 22 nt, Human
gggggacagugugccuggugug

SEQ ID NO: 68089 - RNA, 22 nt, Human
uuucuauuuacagugcuaggua

SEQ ID NO: 68090 - RNA, 22 nt, Human
agauucucccuccuggcgcugu

SEQ ID NO: 68091 - RNA, 22 nt, Human
gcuguggagaagcugccuaugg

SEQ ID NO: 68092 - RNA, 22 nt, Human
uugcaagcccugaagggcugga

SEQ ID NO: 68093 - RNA, 22 nt, Human
uuuacuauuaguauuucauuuu

SEQ ID NO: 68094 - RNA, 22 nt, Human
ccagaugggggcugugggaggg

SEQ ID NO: 68095 - RNA, 22 nt, Human
uuuaauauuacacuuaccuugu

SEQ ID NO: 68096 - RNA, 22 nt, Human
ccagggcuggaggaggucagga

SEQ ID NO: 68097 - RNA, 23 nt, Human
caggggacaggugaccugggcuc

SEQ ID NO: 68098 - RNA, 22 nt, Human
gggauggggagcuggaaagggg

SEQ ID NO: 68099 - RNA, 22 nt, Human
uggaagugggcaucaccaucca

SEQ ID NO: 68100 - RNA, 22 nt, Human
cagaccagaaggaagccgacaa

SEQ ID NO: 68101 - RNA, 22 nt, Human
gucugcagcacugugcacgguc

SEQ ID NO: 68102 - RNA, 22 nt, Human
aaugagaauguaagugaagaga

SEQ ID NO: 68103 - RNA, 22 nt, Human
uggcucagcgcggccuggucuu

SEQ ID NO: 68104 - RNA, 19 nt, Human
acuggggcaggcugggcuu

SEQ ID NO: 68105 - RNA, 22 nt, Human
gggagggucugagagcugcacc

SEQ ID NO: 68106 - RNA, 22 nt, Human
cugguacuggaggaguucagag

SEQ ID NO: 68107 - RNA, 21 nt, Human
ugagcccaaagcuguauuggu

SEQ ID NO: 68108 - RNA, 21 nt, Human
cuauaaaaaugguucuuugcg

SEQ ID NO: 68109 - RNA, 22 nt, Human
cucacugucagcugcagggcuu

SEQ ID NO: 68110 - RNA, 22 nt, Human
ccauuuggccauucaguuguuc

SEQ ID NO: 68111 - RNA, 22 nt, Human
ggugucuuugauguugggcuga

SEQ ID NO: 68112 - RNA, 22 nt, Human
guguugaugugucuguauucua

SEQ ID NO: 68113 - RNA, 22 nt, Human
ggaggaugaggguggugguguu

SEQ ID NO: 68114 - RNA, 22 nt, Human
ugggcagggagcuggaaccaca

SEQ ID NO: 68115 - RNA, 22 nt, Human
gcuggccugcgagggcaggcug

SEQ ID NO: 68116 - RNA, 22 nt, Human
cacugcacuccagccugggcaa

SEQ ID NO: 68117 - RNA, 22 nt, Human
uugucaggaacuaugauuaugc

SEQ ID NO: 68118 - RNA, 22 nt, Human
agggggaauccugcuuauggau

SEQ ID NO: 68119 - RNA, 22 nt, Human
ucuccucucugaucuugcuccg

SEQ ID NO: 68120 - RNA, 22 nt, Human
ggaggaagagaccagggggcuu

SEQ ID NO: 68121 - RNA, 22 nt, Human
uguuuucuuuccccuucuuuuc

SEQ ID NO: 68122 - RNA, 22 nt, Human
uccuuuauuuaugggcagugua

SEQ ID NO: 68123 - RNA, 22 nt, Human
ucccaaguguuuggcgaggaga

SEQ ID NO: 68124 - RNA, 22 nt, Human
acucugcaguaaggaauuguuu

SEQ ID NO: 68125 - RNA, 22 nt, Human
augggagggugaggaggcagcu

SEQ ID NO: 68126 - RNA, 22 nt, Human
gagccucaggguuuuguugaca

SEQ ID NO: 68127 - RNA, 22 nt, Human
cucugugucugauucugggaag

SEQ ID NO: 68128 - RNA, 22 nt, Human
gaggccagcacccagaugcaug

SEQ ID NO: 68129 - RNA, 18 nt, Human
cccagaggaaugccugga

SEQ ID NO: 68130 - RNA, 22 nt, Human
ccagggaggucauagugcuggu

SEQ ID NO: 68131 - RNA, 22 nt, Human
cccuguccugcuaggcccuggu

SEQ ID NO: 68132 - RNA, 20 nt, Human
uucacagaucucuaacugag

SEQ ID NO: 68133 - RNA, 22 nt, Human
uuccugcuggucaaaguugccu

SEQ ID NO: 68134 - RNA, 22 nt, Human
ugccagcuccgaggagcugcag

SEQ ID NO: 68135 - RNA, 22 nt, Human
aaauauuaaugaugaagguagu

SEQ ID NO: 68136 - RNA, 22 nt, Human
gcugucccccaaagaugcuccu

SEQ ID NO: 68137 - RNA, 22 nt, Human
ugugaagaauuaaugugaauca

SEQ ID NO: 68138 - RNA, 22 nt, Human
uguguuguuggggauguuuuca

SEQ ID NO: 68139 - RNA, 22 nt, Human
gugaucagaagaaccugccgaa

SEQ ID NO: 68140 - RNA, 22 nt, Human
augcugugccuggaaagcggcu

SEQ ID NO: 68141 - RNA, 22 nt, Human
caaaucuguuaauuucaaguug

SEQ ID NO: 68142 - RNA, 22 nt, Human
gggagguaaugggggugcaggg

SEQ ID NO: 68143 - RNA, 22 nt, Human
uggagcugguucuggggaagcu

SEQ ID NO: 68144 - RNA, 22 nt, Human
gaggggacugucuggcuccgag

SEQ ID NO: 68145 - RNA, 22 nt, Human
aggcuccucugggggccccgga

SEQ ID NO: 68146 - RNA, 22 nt, Human
uuucucuuguauuugaaucacu

SEQ ID NO: 68147 - RNA, 21 nt, Human
aggugaaggcgagggggacag

SEQ ID NO: 68148 - RNA, 22 nt, Chlamydophila pneumoniae CWL029
ccugcagauguguaugcaagau

SEQ ID NO: 68149 - RNA, 22 nt, Chlamydophila pneumoniae CWL029
uucuccagcaggagcccagaaa

SEQ ID NO: 68150 - RNA, 22 nt, Chlamydophila pneumoniae CWL029
agauucucuaugauauacuaug

SEQ ID NO: 68151 - RNA, 22 nt, Chlamydophila pneumoniae CWL029
ugauuuugcuucgcagcuugaa

SEQ ID NO: 68152 - RNA, 22 nt, Chlamydophila pneumoniae CWL029
aguaagaacuucguuucagcac

SEQ ID NO: 68153 - RNA, 22 nt, Chlamydophila pneumoniae CWL029
ucucugaugguugauguacaga

SEQ ID NO: 68154 - RNA, 22 nt, Chlamydophila pneumoniae CWL029
gauguaugcgagcaaugaccuc

SEQ ID NO: 68155 - RNA, 22 nt, Chlamydophila pneumoniae CWL029
guucuuuauuauacuccugaca

SEQ ID NO: 68156 - RNA, 22 nt, Chlamydophila pneumoniae CWL029
ucaggagaacaucaaagcgaau

SEQ ID NO: 68157 - RNA, 18 nt, Chlamydophila pneumoniae CWL029
acaggaaucggaaugggc

SEQ ID NO: 68158 - RNA, 22 nt, Chlamydophila pneumoniae CWL029
gagcaauugcugauuccgggac

SEQ ID NO: 68159 - RNA, 22 nt, Chlamydophila pneumoniae CWL029
aagucucuggauaguaauaccc

SEQ ID NO: 68160 - RNA, 22 nt, Chlamydophila pneumoniae CWL029
gauuuggaucaccaaagaaaau

SEQ ID NO: 68161 - RNA, 22 nt, Chlamydophila pneumoniae CWL029
uugcugagacuauaucgguaac

SEQ ID NO: 68162 - RNA, 22 nt, Chlamydophila pneumoniae CWL029
cucuucaggaucggcauuauuu

SEQ ID NO: 68163 - RNA, 22 nt, Chlamydophila pneumoniae CWL029
cauuuuuaaauacgauggucgu

SEQ ID NO: 68164 - RNA, 18 nt, Chlamydophila pneumoniae CWL029
aucuaagugacucacaga

SEQ ID NO: 68165 - RNA, 22 nt, Chlamydophila pneumoniae CWL029
cgagaucuugauuuugguuaug

SEQ ID NO: 68166 - RNA, 16 nt, Chlamydophila pneumoniae CWL029
ugggauugaaguuagg

SEQ ID NO: 68167 - RNA, 22 nt, Chlamydophila pneumoniae CWL029
ugccgcuacccaucaagauucu

SEQ ID NO: 68168 - RNA, 22 nt, Chlamydophila pneumoniae CWL029
uggacgauacguuuuuaaugua

SEQ ID NO: 68169 - RNA, 22 nt, Chlamydophila pneumoniae CWL029
uguguagcaaaggcgugucgua

SEQ ID NO: 68170 - RNA, 22 nt, Chlamydophila pneumoniae CWL029
aucuugccuacgauccuguaug

SEQ ID NO: 68171 - RNA, 22 nt, Chlamydophila pneumoniae CWL029
ugcaugcuaaccuuccagagga

SEQ ID NO: 68172 - RNA, 21 nt, Chlamydophila pneumoniae CWL029
acaguucauucgauuucucuc

SEQ ID NO: 68173 - RNA, 22 nt, Chlamydophila pneumoniae CWL029
gcauuccauuuccaagcuuaua

SEQ ID NO: 68174 - RNA, 22 nt, Chlamydophila pneumoniae CWL029
uccuauuuucaugagaaagggg

SEQ ID NO: 68175 - RNA, 19 nt, Chlamydophila pneumoniae CWL029
uagaaaaagaucuaagucg

SEQ ID NO: 68176 - RNA, 22 nt, Chlamydophila pneumoniae CWL029
ugcuuuuagguaggacgucacu

SEQ ID NO: 68177 - RNA, 22 nt, Chlamydophila pneumoniae CWL029
auguuccaagagaagaaagagu

SEQ ID NO: 68178 - RNA, 22 nt, Chlamydophila pneumoniae CWL029
aacaauaccuugaguuacaaac

SEQ ID NO: 68179 - RNA, 22 nt, Chlamydophila pneumoniae CWL029
uaggaucuuagaauguuguagg

SEQ ID NO: 68180 - RNA, 22 nt, Chlamydophila pneumoniae CWL029
agcuucucgaauuucuaauguu

SEQ ID NO: 68181 - RNA, 22 nt, Chlamydophila pneumoniae CWL029
gaggaugucguccugucggucu

SEQ ID NO: 68182 - RNA, 22 nt, Chlamydophila pneumoniae CWL029
aagcuucgugaucagaaaauga

SEQ ID NO: 68183 - RNA, 22 nt, Chlamydophila pneumoniae CWL029
ggcaaaucuuugacucuaccgc

SEQ ID NO: 68184 - RNA, 23 nt, Chlamydophila pneumoniae CWL029
gcuuaugcauuaggaaggagagc

SEQ ID NO: 68185 - RNA, 22 nt, Chlamydophila pneumoniae CWL029
aggcaaugagcuugugugugga

SEQ ID NO: 68186 - RNA, 22 nt, Chlamydophila pneumoniae CWL029
guuugcucuuaagauguauugc

SEQ ID NO: 68187 - RNA, 22 nt, Chlamydophila pneumoniae CWL029
aacgucacgucucuccagaaca

SEQ ID NO: 68188 - RNA, 22 nt, Chlamydophila pneumoniae CWL029
aagauuugccgaugaaccagua

SEQ ID NO: 68189 - RNA, 22 nt, Chlamydophila pneumoniae CWL029
cccugcauuguuaaacucaauu

SEQ ID NO: 68190 - RNA, 22 nt, Chlamydophila pneumoniae CWL029
uuugauuauugaugggaagauc

SEQ ID NO: 68191 - RNA, 22 nt, Chlamydophila pneumoniae CWL029
cggagagauauucugaucuaca

SEQ ID NO: 68192 - RNA, 19 nt, Chlamydophila pneumoniae CWL029
augauuguagaaggaguga

SEQ ID NO: 68193 - RNA, 22 nt, Chlamydophila pneumoniae CWL029
acuauacaccaagaacaauaag

SEQ ID NO: 68194 - RNA, 22 nt, Chlamydophila pneumoniae CWL029
cuguuuuuucauaguauccuua

SEQ ID NO: 68195 - RNA, 22 nt, Chlamydophila pneumoniae CWL029
uacagauucaccaagaacaaua

SEQ ID NO: 68196 - RNA, 22 nt, Chlamydophila pneumoniae CWL029
ggcauuaaagauuuggcugaag

SEQ ID NO: 68197 - RNA, 22 nt, Chlamydophila pneumoniae CWL029
uccuugauuugugaagaaauug

SEQ ID NO: 68198 - RNA, 22 nt, Chlamydophila pneumoniae CWL029
cacauuaucuaggucguugugu

SEQ ID NO: 68199 - RNA, 21 nt, Chlamydophila pneumoniae CWL029
auugaucucaucacuaguuuc

SEQ ID NO: 68200 - RNA, 22 nt, Chlamydophila pneumoniae CWL029
uaguuucugcagggcacucuca

SEQ ID NO: 68201 - RNA, 22 nt, Chlamydophila pneumoniae CWL029
agauuuuuagggacuauaauuu

SEQ ID NO: 68202 - RNA, 22 nt, Chlamydophila pneumoniae CWL029
ggucucaugucuccuaaguuaa

SEQ ID NO: 68203 - RNA, 22 nt, Chlamydophila pneumoniae CWL029
uucuuuuucuaugaugaugagu

SEQ ID NO: 68204 - RNA, 22 nt, Chlamydophila pneumoniae CWL029
aguuuuuagaugcucgugcuca

SEQ ID NO: 68205 - RNA, 22 nt, Chlamydophila pneumoniae CWL029
ucuaaagcugcauagcuuuccu

SEQ ID NO: 68206 - RNA, 22 nt, Chlamydophila pneumoniae CWL029
cuguuacuucacgcaggaucac

SEQ ID NO: 68207 - RNA, 22 nt, Chlamydophila pneumoniae CWL029
gaauuauuggaaagggaggcau

SEQ ID NO: 68208 - RNA, 22 nt, Chlamydophila pneumoniae CWL029
uuucucuguagucacuggggug

SEQ ID NO: 68209 - RNA, 22 nt, Chlamydophila pneumoniae CWL029
gauauguauguaaaggcucuuc

SEQ ID NO: 68210 - RNA, 22 nt, Chlamydophila pneumoniae CWL029
uccaagagauacguaggaagag

SEQ ID NO: 68211 - RNA, 22 nt, Chlamydophila pneumoniae CWL029
uauguuaggaaauaguguugga

SEQ ID NO: 68212 - RNA, 22 nt, Chlamydophila pneumoniae CWL029
ugucccauguggucuaguauag

SEQ ID NO: 68213 - RNA, 22 nt, Chlamydophila pneumoniae CWL029
agcagcuucgggaccaagcagu

SEQ ID NO: 68214 - RNA, 22 nt, Chlamydophila pneumoniae CWL029
caaacuaaagagcuugaguuug

SEQ ID NO: 68215 - RNA, 22 nt, Chlamydophila pneumoniae CWL029
uuccggaugauccuuuugcuau

SEQ ID NO: 68216 - RNA, 22 nt, Chlamydophila pneumoniae CWL029
ucugaaacgacuuguuuccaug

SEQ ID NO: 68217 - RNA, 22 nt, Chlamydophila pneumoniae CWL029
uccuuucucuuauugaaagauu

SEQ ID NO: 68218 - RNA, 22 nt, Chlamydophila pneumoniae CWL029
uuauuguucuuggugaaucugu

SEQ ID NO: 68219 - RNA, 22 nt, Chlamydophila pneumoniae CWL029
uacgguauccguauaauuugau

SEQ ID NO: 68220 - RNA, 22 nt, Chlamydophila pneumoniae CWL029
ucuuaucugcugggggagcuag

SEQ ID NO: 68221 - RNA, 22 nt, Chlamydophila pneumoniae CWL029
uagguucuucucugauccuuug

SEQ ID NO: 68222 - RNA, 22 nt, Chlamydophila pneumoniae CWL029
ugagaaaagaggucuuuacaga

SEQ ID NO: 68223 - RNA, 22 nt, Chlamydophila pneumoniae CWL029
agcacuauuggagaaucuggag

SEQ ID NO: 68224 - RNA, 22 nt, Chlamydophila pneumoniae CWL029
uacuucaacucguugauuguga

SEQ ID NO: 68225 - RNA, 22 nt, Chlamydophila pneumoniae CWL029
aagaguuuuuuaugacucaugc

SEQ ID NO: 68226 - RNA, 22 nt, Chlamydophila pneumoniae CWL029
aggcuucuugguuauuuaggua

SEQ ID NO: 68227 - RNA, 22 nt, Chlamydophila pneumoniae CWL029
agcugcucccguaauuacugcg

SEQ ID NO: 68228 - RNA, 22 nt, Chlamydophila pneumoniae CWL029
aauguguauggaauugugaggu

SEQ ID NO: 68229 - RNA, 22 nt, Chlamydophila pneumoniae CWL029
aaguuguauauaugcgcuaauu

SEQ ID NO: 68230 - RNA, 20 nt, Chlamydophila pneumoniae CWL029
auguaauacagaagaacauu

SEQ ID NO: 68231 - RNA, 22 nt, Chlamydophila pneumoniae CWL029
agaagguuugaugacaacaguu

SEQ ID NO: 68232 - RNA, 22 nt, Chlamydophila pneumoniae CWL029
ucugguggucccuuauguuggg

SEQ ID NO: 68233 - RNA, 22 nt, Chlamydophila pneumoniae CWL029
aagaagaagaauccguggauga

SEQ ID NO: 68234 - RNA, 21 nt, Chlamydophila pneumoniae CWL029
cuuacgaguuuccuggaguuu

SEQ ID NO: 68235 - RNA, 22 nt, Chlamydophila pneumoniae CWL029
uucgaguaguuauaggagagca

SEQ ID NO: 68236 - RNA, 22 nt, Chlamydophila pneumoniae CWL029
ccuagaauuuaauccuaaugau

SEQ ID NO: 68237 - RNA, 22 nt, Chlamydophila pneumoniae CWL029
uucauuuaaagaguccgaagcc

SEQ ID NO: 68238 - RNA, 22 nt, Chlamydophila pneumoniae CWL029
auuucugaaaagcuugcgauga

SEQ ID NO: 68239 - RNA, 22 nt, Chlamydophila pneumoniae CWL029
uauucgacuguugcugcucuaa

SEQ ID NO: 68240 - RNA, 22 nt, Chlamydophila pneumoniae CWL029
acuuuauugcugaaggguugga

SEQ ID NO: 68241 - RNA, 22 nt, Chlamydophila pneumoniae CWL029
ugaaaauaugagcaacuucuau

SEQ ID NO: 68242 - RNA, 22 nt, Chlamydophila pneumoniae CWL029
guuguaaaauuauucaguaggg

SEQ ID NO: 68243 - RNA, 22 nt, Chlamydophila pneumoniae CWL029
cuuuuagaugguggauuuucaa

SEQ ID NO: 68244 - RNA, 22 nt, Chlamydophila pneumoniae CWL029
aggaaggaauggaagcucugcu

SEQ ID NO: 68245 - RNA, 22 nt, Chlamydophila pneumoniae CWL029
cucuauuaaaagaugcucaaga

SEQ ID NO: 68246 - RNA, 22 nt, Chlamydophila pneumoniae CWL029
uucuuuagucguauauucacga

SEQ ID NO: 68247 - RNA, 23 nt, Chlamydophila pneumoniae CWL029
uucucaaagcaacgcgacucccu

SEQ ID NO: 68248 - RNA, 22 nt, Chlamydophila pneumoniae CWL029
uacaggaaaaacuuuaagaauu

SEQ ID NO: 68249 - RNA, 22 nt, Chlamydophila pneumoniae CWL029
uguagauguuuuaucgcuaucu

SEQ ID NO: 68250 - RNA, 22 nt, Chlamydophila pneumoniae CWL029
auaggaauccuuagcuucuuga

SEQ ID NO: 68251 - RNA, 21 nt, Chlamydophila pneumoniae CWL029
uccugaguuuccuaaggaacu

SEQ ID NO: 68252 - RNA, 22 nt, Chlamydophila pneumoniae CWL029
uggcuauucucuuugguauagg

SEQ ID NO: 68253 - RNA, 22 nt, Chlamydophila pneumoniae CWL029
uaaugagggggaguguuuugga

SEQ ID NO: 68254 - RNA, 22 nt, Chlamydophila pneumoniae CWL029
guuaaagucuacguugccucua

SEQ ID NO: 68255 - RNA, 22 nt, Chlamydophila pneumoniae CWL029
uuguaggguuauuguccucugu

SEQ ID NO: 68256 - RNA, 22 nt, Chlamydophila pneumoniae CWL029
ggacuucuugaaagaauacccu

SEQ ID NO: 68257 - RNA, 22 nt, Chlamydophila pneumoniae CWL029
gaaccauauacugagcuuccuc

SEQ ID NO: 68258 - RNA, 22 nt, Chlamydophila pneumoniae CWL029
aguuuuaccuuuaagugugauu

SEQ ID NO: 68259 - RNA, 22 nt, Chlamydophila pneumoniae CWL029
aucaaacuauagaggaugcugc

SEQ ID NO: 68260 - RNA, 20 nt, Chlamydophila pneumoniae CWL029
uuguggacuccuaaauaucu

SEQ ID NO: 68261 - RNA, 22 nt, Chlamydophila pneumoniae CWL029
cucuauacaaauccaacagugc

SEQ ID NO: 68262 - RNA, 22 nt, Chlamydophila pneumoniae CWL029
aucuuuucuuaggcgggaauag

SEQ ID NO: 68263 - RNA, 22 nt, Chlamydophila pneumoniae CWL029
ucagcuuuuaaagcaucugcua

SEQ ID NO: 68264 - RNA, 22 nt, Chlamydophila pneumoniae CWL029
uuguccguauguuagagcaaga

SEQ ID NO: 68265 - RNA, 22 nt, Chlamydophila pneumoniae CWL029
guugccuuuagaauauaaggcg

SEQ ID NO: 68266 - RNA, 22 nt, Chlamydophila pneumoniae CWL029
ucuggaauucuuuaugcuguaa

SEQ ID NO: 68267 - RNA, 22 nt, Chlamydophila pneumoniae CWL029
uucuucaugcaucaaucuagag

SEQ ID NO: 68268 - RNA, 23 nt, Chlamydophila pneumoniae CWL029
cuacauagauuuagauaaagacc

SEQ ID NO: 68269 - RNA, 22 nt, Chlamydophila pneumoniae CWL029
ugauaggaauuuuucaaucuga

SEQ ID NO: 68270 - RNA, 22 nt, Chlamydophila pneumoniae CWL029
uuucuucggauuuguuuacaga

SEQ ID NO: 68271 - RNA, 22 nt, Chlamydophila pneumoniae CWL029
agaaucuugauggguagcggca

SEQ ID NO: 68272 - RNA, 22 nt, Chlamydophila pneumoniae CWL029
uuggagaguuuuuuaccaucug

SEQ ID NO: 68273 - RNA, 22 nt, Chlamydophila pneumoniae CWL029
agugucuuuuguaucgcguaac

SEQ ID NO: 68274 - RNA, 22 nt, Chlamydophila pneumoniae CWL029
augaaguuugaugcgacagaaa

SEQ ID NO: 68275 - RNA, 22 nt, Chlamydophila pneumoniae CWL029
ugagugagguucugauugaauc

SEQ ID NO: 68276 - RNA, 22 nt, Chlamydophila pneumoniae CWL029
uucagacuuuagaaacuucuuc

SEQ ID NO: 68277 - RNA, 22 nt, Chlamydophila pneumoniae CWL029
agcuuuuggauauccuuccuua

SEQ ID NO: 68278 - RNA, 22 nt, Chlamydophila pneumoniae CWL029
cugugcucuugaagauuguguc

SEQ ID NO: 68279 - RNA, 22 nt, Chlamydophila pneumoniae CWL029
cgcugcucaugcuuuuccaaua

SEQ ID NO: 68280 - RNA, 22 nt, Chlamydophila pneumoniae CWL029
cugguaaaagucucauuccugg

SEQ ID NO: 68281 - RNA, 22 nt, Chlamydophila pneumoniae CWL029
aacauuuuccacugagaaguug

SEQ ID NO: 68282 - RNA, 22 nt, Chlamydophila pneumoniae CWL029
ggauuauucgugcauuuggugg

SEQ ID NO: 68283 - RNA, 19 nt, Chlamydophila pneumoniae CWL029
gaggaaaaggguccugaau

SEQ ID NO: 68284 - RNA, 22 nt, Chlamydophila pneumoniae CWL029
ucuuaggaaguuuacucuugau

SEQ ID NO: 68285 - RNA, 22 nt, Chlamydophila pneumoniae CWL029
ccuggauuuucaagucuuuuga

SEQ ID NO: 68286 - RNA, 22 nt, Chlamydophila pneumoniae CWL029
uuagcgaaguuauucagaauug

SEQ ID NO: 68287 - RNA, 22 nt, Chlamydophila pneumoniae CWL029
uaggauaguauagugaggagau

SEQ ID NO: 68288 - RNA, 22 nt, Chlamydophila pneumoniae CWL029
accagcuucccaagcugaaaga

SEQ ID NO: 68289 - RNA, 17 nt, Chlamydophila pneumoniae CWL029
gucuccucuuggaagga

SEQ ID NO: 68290 - RNA, 21 nt, Chlamydophila pneumoniae CWL029
ugugggugcguugcuaaaguu

SEQ ID NO: 68291 - RNA, 22 nt, Chlamydophila pneumoniae CWL029
ucaccuccagggaugauucgua

SEQ ID NO: 68292 - RNA, 22 nt, Chlamydophila pneumoniae CWL029
cauucuuuaaccaagggaaucu

SEQ ID NO: 68293 - RNA, 22 nt, Chlamydophila pneumoniae CWL029
gcucuggcuuuuucaacucaaa

SEQ ID NO: 68294 - RNA, 22 nt, Chlamydophila pneumoniae CWL029
gaagauucuuuuaguggauugg

SEQ ID NO: 68295 - RNA, 22 nt, Chlamydophila pneumoniae CWL029
gugagagcgaucucuggaacaa

SEQ ID NO: 68296 - RNA, 22 nt, Chlamydophila pneumoniae CWL029
uaucgguguggauaaguuucuc

SEQ ID NO: 68297 - RNA, 20 nt, Chlamydophila pneumoniae CWL029
agccaucuggagauacuagg

SEQ ID NO: 68298 - RNA, 22 nt, Chlamydophila pneumoniae CWL029
cuaguuuugacguaggaagagg

SEQ ID NO: 68299 - RNA, 22 nt, Chlamydophila pneumoniae CWL029
agagaaggugaaaaucggggaa

SEQ ID NO: 68300 - RNA, 22 nt, Chlamydophila pneumoniae CWL029
ggcuguuuuuguaaguagauug

SEQ ID NO: 68301 - RNA, 22 nt, Chlamydophila pneumoniae CWL029
aggagauuuucucacuuacagc

SEQ ID NO: 68302 - RNA, 22 nt, Chlamydophila pneumoniae CWL029
uagggaaaucgcugcaaaggcu

SEQ ID NO: 68303 - RNA, 22 nt, Chlamydophila pneumoniae CWL029
aaaucgaacuccaagcaucguu

SEQ ID NO: 68304 - RNA, 22 nt, Chlamydophila pneumoniae CWL029
uuuaggauggggaugaaaauug

SEQ ID NO: 68305 - RNA, 22 nt, Chlamydophila pneumoniae CWL029
agaguuacaggcuguaguagcu

SEQ ID NO: 68306 - RNA, 22 nt, Chlamydophila pneumoniae CWL029
aucuaugcagcagauuucuuca

SEQ ID NO: 68307 - RNA, 22 nt, Chlamydophila pneumoniae CWL029
auaccaaaaugugauuuugagg

SEQ ID NO: 68308 - RNA, 22 nt, Chlamydophila pneumoniae CWL029
uucuuuagagcacucggggaga

SEQ ID NO: 68309 - RNA, 22 nt, Chlamydophila pneumoniae CWL029
gagugcccuuaagaagcuuucu

SEQ ID NO: 68310 - RNA, 22 nt, Chlamydophila pneumoniae CWL029
aacucgggcagacguacugcau

SEQ ID NO: 68311 - RNA, 22 nt, Chlamydophila pneumoniae CWL029
uugagcaaucaacuagggguaa

SEQ ID NO: 68312 - RNA, 22 nt, Chlamydophila pneumoniae CWL029
uggguuauuaucuuaugaagaa

SEQ ID NO: 68313 - RNA, 22 nt, Chlamydophila pneumoniae CWL029
uuuagaggaucggguaucggaa

SEQ ID NO: 68314 - RNA, 22 nt, Chlamydophila pneumoniae CWL029
uguuucuggaagagcuucuuau

SEQ ID NO: 68315 - RNA, 18 nt, Chlamydophila pneumoniae CWL029
uuuuccaugguguaaaug

SEQ ID NO: 68316 - RNA, 22 nt, Chlamydophila pneumoniae CWL029
uauuccaaaggacugauggucu

SEQ ID NO: 68317 - RNA, 19 nt, Chlamydophila pneumoniae CWL029
uaauuuagacgacguagau

SEQ ID NO: 68318 - RNA, 22 nt, Chlamydophila pneumoniae CWL029
auccugaagauauucaggcaau

SEQ ID NO: 68319 - RNA, 22 nt, Chlamydophila pneumoniae CWL029
augccuauguguaacucuauag

SEQ ID NO: 68320 - RNA, 22 nt, Chlamydophila pneumoniae CWL029
auagccaauaaggagaucguca

SEQ ID NO: 68321 - RNA, 22 nt, Chlamydophila pneumoniae CWL029
agagggcgaagaauuccuuccu

SEQ ID NO: 68322 - RNA, 22 nt, Chlamydophila pneumoniae CWL029
uuugugaucggaaguuauaauu

SEQ ID NO: 68323 - RNA, 22 nt, Chlamydophila pneumoniae CWL029
uagaaguauuaagccaagauuu

SEQ ID NO: 68324 - RNA, 22 nt, Chlamydophila pneumoniae CWL029
gccuuucucaacuagauuacga

SEQ ID NO: 68325 - RNA, 22 nt, Chlamydophila pneumoniae CWL029
aauuggauaggguuucuugagg

SEQ ID NO: 68326 - RNA, 22 nt, Chlamydophila pneumoniae CWL029
gggguuuugcugguaacaagac

SEQ ID NO: 68327 - RNA, 22 nt, Chlamydophila pneumoniae CWL029
ucuccucccagcaauuucucgu

SEQ ID NO: 68328 - RNA, 22 nt, Chlamydophila pneumoniae CWL029
ggugagauacccuucaaaauag

SEQ ID NO: 68329 - RNA, 22 nt, Chlamydophila pneumoniae CWL029
uggcauuacgaaaugcaggacg

SEQ ID NO: 68330 - RNA, 23 nt, Chlamydophila pneumoniae CWL029
uucuccuguauuuauaaagaaug

SEQ ID NO: 68331 - RNA, 22 nt, Chlamydophila pneumoniae CWL029
uccuguagagccuauuuaugau

SEQ ID NO: 68332 - RNA, 22 nt, Chlamydophila pneumoniae CWL029
aggagauccuacaauugccauu

SEQ ID NO: 68333 - RNA, 22 nt, Chlamydophila pneumoniae CWL029
ugagugucaggagcuuuugaaa

SEQ ID NO: 68334 - RNA, 22 nt, Chlamydophila pneumoniae CWL029
ugagggagaugcagauuuagau

SEQ ID NO: 68335 - RNA, 22 nt, Chlamydophila pneumoniae CWL029
uagagcucuuaagcaggagauc

SEQ ID NO: 68336 - RNA, 22 nt, Chlamydophila pneumoniae CWL029
uauggaagugauucaagaugaa

SEQ ID NO: 68337 - RNA, 22 nt, Chlamydophila pneumoniae CWL029
uugguuuugagacucuccuaca

SEQ ID NO: 68338 - RNA, 22 nt, Chlamydophila pneumoniae CWL029
ccauucaguauaagauugagca

SEQ ID NO: 68339 - RNA, 22 nt, Chlamydophila pneumoniae CWL029
guucccuagggaagacugagga

SEQ ID NO: 68340 - RNA, 22 nt, Chlamydophila pneumoniae CWL029
agugcuucgauguagcgagaaa

SEQ ID NO: 68341 - RNA, 22 nt, Chlamydophila pneumoniae CWL029
cucagcuuguugcaguagcaac

SEQ ID NO: 68342 - RNA, 22 nt, Chlamydophila pneumoniae CWL029
cuggaggugcugcuaaagcaau

SEQ ID NO: 68343 - RNA, 22 nt, Chlamydophila pneumoniae CWL029
auuuggaucagcuguuguaugg

SEQ ID NO: 68344 - RNA, 22 nt, Chlamydophila pneumoniae CWL029
uuucuaauuauuguuuuggaag

SEQ ID NO: 68345 - RNA, 22 nt, Chlamydophila pneumoniae CWL029
agcaaaggaacuuauauucgca

SEQ ID NO: 68346 - RNA, 22 nt, Chlamydophila pneumoniae CWL029
auucugaucauaucuccgggau

SEQ ID NO: 68347 - RNA, 17 nt, Chlamydophila pneumoniae CWL029
ucuugagcaucuuuuaa

SEQ ID NO: 68348 - RNA, 22 nt, Chlamydophila pneumoniae CWL029
aaccaggaugcgucucugucca

SEQ ID NO: 68349 - RNA, 22 nt, Chlamydophila pneumoniae CWL029
gaaauauuguugggacuuuggu

SEQ ID NO: 68350 - RNA, 22 nt, Chlamydophila pneumoniae CWL029
ggagacaguuugcuuuaucucu

SEQ ID NO: 68351 - RNA, 22 nt, Chlamydophila pneumoniae CWL029
aggacggaucuuuuuacuuagc

SEQ ID NO: 68352 - RNA, 22 nt, Chlamydophila pneumoniae CWL029
cuuuaugaauuaggccuugugu

SEQ ID NO: 68353 - RNA, 22 nt, Chlamydophila pneumoniae CWL029
augcaaggugcuaaucuccaca

SEQ ID NO: 68354 - RNA, 22 nt, Chlamydophila pneumoniae CWL029
gaaacgacgagcagccugaggg

SEQ ID NO: 68355 - RNA, 22 nt, Chlamydophila pneumoniae CWL029
uuucugauguaacgaaccgucu

SEQ ID NO: 68356 - RNA, 22 nt, Chlamydophila pneumoniae CWL029
cuggagacgcuuggaaagaagc

SEQ ID NO: 68357 - RNA, 22 nt, Chlamydophila pneumoniae CWL029
auucuucacaauaggagaaagu

SEQ ID NO: 68358 - RNA, 22 nt, Chlamydophila pneumoniae CWL029
ugccugcuucucaagauacucg

SEQ ID NO: 68359 - RNA, 22 nt, Chlamydophila pneumoniae CWL029
ucccuuuggauccagaagcuaa

SEQ ID NO: 68360 - RNA, 22 nt, Chlamydophila pneumoniae CWL029
ugugauuaucuguggagaccag

SEQ ID NO: 68361 - RNA, 22 nt, Chlamydophila pneumoniae CWL029
aucacgguuccuggaguaugga

SEQ ID NO: 68362 - RNA, 22 nt, Chlamydophila pneumoniae CWL029
agucuguuauuaucacgauauc

SEQ ID NO: 68363 - RNA, 21 nt, Chlamydophila pneumoniae CWL029
ucacugcugggggcaaaguua

SEQ ID NO: 68364 - RNA, 22 nt, Chlamydophila pneumoniae CWL029
uuccuacagaucguauuuuccg

SEQ ID NO: 68365 - RNA, 22 nt, Chlamydophila pneumoniae CWL029
ugccuuuaagagaggaacauga

SEQ ID NO: 68366 - RNA, 22 nt, Chlamydophila pneumoniae CWL029
ugaagcauuugcucuuugggaa

SEQ ID NO: 68367 - RNA, 22 nt, Chlamydophila pneumoniae CWL029
aucaucuuauauaauggagugg

SEQ ID NO: 68368 - RNA, 23 nt, Chlamydophila pneumoniae CWL029
acaagaaucacaguucuaucaag

SEQ ID NO: 68369 - RNA, 22 nt, Chlamydophila pneumoniae CWL029
ugaugcuacgaucacuuaagaa

SEQ ID NO: 68370 - RNA, 22 nt, Chlamydophila pneumoniae CWL029
uaggagcuauuugugucauugc

SEQ ID NO: 68371 - RNA, 22 nt, Chlamydophila pneumoniae CWL029
aaaucaagaauacaucgcagau

SEQ ID NO: 68372 - RNA, 22 nt, Chlamydophila pneumoniae CWL029
aucccacucauaggaauucccu

SEQ ID NO: 68373 - RNA, 22 nt, Chlamydophila pneumoniae CWL029
uuccuucaguauaacagacucu

SEQ ID NO: 68374 - RNA, 22 nt, Chlamydophila pneumoniae CWL029
caugucuuuuuuacagaaagau

SEQ ID NO: 68375 - RNA, 22 nt, Chlamydophila pneumoniae CWL029
aagcucuuccagaaacaagauc

SEQ ID NO: 68376 - RNA, 22 nt, Chlamydophila pneumoniae CWL029
auagcagcuacuaagagaagug

SEQ ID NO: 68377 - RNA, 22 nt, Chlamydophila pneumoniae CWL029
uaucuuggacuaucuuauugua

SEQ ID NO: 68378 - RNA, 20 nt, Chlamydophila pneumoniae CWL029
aauuucugaucacgaaguuu

SEQ ID NO: 68379 - RNA, 22 nt, Chlamydophila pneumoniae CWL029
agguguagagggaugacauuca

SEQ ID NO: 68380 - RNA, 22 nt, Chlamydophila pneumoniae CWL029
uaaugacaacuuaguuucuuuu

SEQ ID NO: 68381 - RNA, 22 nt, Chlamydophila pneumoniae CWL029
uaaacuuagagcaaguagcaua

SEQ ID NO: 68382 - RNA, 22 nt, Chlamydophila pneumoniae CWL029
uccaggauuuuucguccuuaca

SEQ ID NO: 68383 - RNA, 22 nt, Chlamydophila pneumoniae CWL029
uguagagauaugaauguuuccc

SEQ ID NO: 68384 - RNA, 22 nt, Chlamydophila pneumoniae CWL029
auugagauuuuccccauaucca

SEQ ID NO: 68385 - RNA, 21 nt, Chlamydophila pneumoniae CWL029
ucuaagauuuuggguagagcu

SEQ ID NO: 68386 - RNA, 22 nt, Chlamydophila pneumoniae CWL029
auugugaaugcuauuuuguaaa

SEQ ID NO: 68387 - RNA, 22 nt, Chlamydophila pneumoniae CWL029
uauuugugcugaaggucacggu

SEQ ID NO: 68388 - RNA, 21 nt, Chlamydophila pneumoniae CWL029
caaaggcaaaggaaucucuau

SEQ ID NO: 68389 - RNA, 22 nt, Chlamydophila pneumoniae CWL029
cagcuuugggauguagauuucu

SEQ ID NO: 68390 - RNA, 22 nt, Chlamydophila pneumoniae CWL029
agguaagggauaugugacuucu

SEQ ID NO: 68391 - RNA, 22 nt, Chlamydophila pneumoniae CWL029
uucgugaucaagggaaaacugu

SEQ ID NO: 68392 - RNA, 22 nt, Chlamydophila pneumoniae CWL029
uagaauccucucgaaguauguc

SEQ ID NO: 68393 - RNA, 23 nt, Chlamydophila pneumoniae CWL029
ucuugaguaucuucguaguuuca

SEQ ID NO: 68394 - RNA, 20 nt, Chlamydophila pneumoniae CWL029
uggcgugcuuccuaugagua

SEQ ID NO: 68395 - RNA, 22 nt, Chlamydophila pneumoniae CWL029
uccugaugaaaacggaggaguu

SEQ ID NO: 68396 - RNA, 19 nt, Chlamydophila pneumoniae CWL029
uccuauuaccaaagcggcu

SEQ ID NO: 68397 - RNA, 22 nt, Chlamydophila pneumoniae CWL029
ggcauuuuggaaagaguuuacc

SEQ ID NO: 68398 - RNA, 22 nt, Chlamydophila pneumoniae CWL029
ugcaggaagaaagauuucuucu

SEQ ID NO: 68399 - RNA, 22 nt, Chlamydophila pneumoniae CWL029
auucuagaugguguaacuuuuu

SEQ ID NO: 68400 - RNA, 22 nt, Chlamydophila pneumoniae CWL029
ugcuuacaguaugacgaggucu

SEQ ID NO: 68401 - RNA, 22 nt, Chlamydophila pneumoniae CWL029
cgaguauuuuuucauguccgca

SEQ ID NO: 68402 - RNA, 22 nt, Chlamydophila pneumoniae CWL029
cucuggguucugcuggggauug

SEQ ID NO: 68403 - RNA, 22 nt, Chlamydophila pneumoniae CWL029
cuugauagaacugugauucuug

SEQ ID NO: 68404 - RNA, 22 nt, Chlamydophila pneumoniae CWL029
auaguccaagaugaaaucauug

SEQ ID NO: 68405 - RNA, 22 nt, Chlamydophila pneumoniae CWL029
cuucacaaggucuaugaguauc

SEQ ID NO: 68406 - RNA, 22 nt, Chlamydophila pneumoniae CWL029
auaacgcaaaugaggucgacuu

SEQ ID NO: 68407 - RNA, 22 nt, Chlamydophila pneumoniae CWL029
uagcucuacccaaaaucuuaga

SEQ ID NO: 68408 - RNA, 22 nt, Chlamydophila pneumoniae CWL029
agccauuccaagcuauaguaug

SEQ ID NO: 68409 - RNA, 22 nt, Chlamydophila pneumoniae CWL029
aaagagaaucgcuacagauccc

SEQ ID NO: 68410 - RNA, 22 nt, Chlamydophila pneumoniae CWL029
gaugguaaaauuguuauaggaa

SEQ ID NO: 68411 - RNA, 22 nt, Chlamydophila pneumoniae CWL029
ggucggauuuagauuaaagaga

SEQ ID NO: 68412 - RNA, 22 nt, Chlamydophila pneumoniae CWL029
caauauuugcuuuagaacaugc

SEQ ID NO: 68413 - RNA, 22 nt, Chlamydophila pneumoniae CWL029
uuauuguucuugguguauagua

SEQ ID NO: 68414 - RNA, 22 nt, Chlamydophila pneumoniae CWL029
aaggcuaucgauuugauagaug

SEQ ID NO: 68415 - RNA, 22 nt, Chlamydophila pneumoniae CWL029
uuuuauacucucacagugauuu

SEQ ID NO: 68416 - RNA, 22 nt, Chlamydophila pneumoniae CWL029
uaucuuagagcgaugcugaccg

SEQ ID NO: 68417 - RNA, 22 nt, Chlamydophila pneumoniae CWL029
ucuagauguaaaaaaagaucgu

SEQ ID NO: 68418 - RNA, 22 nt, Chlamydophila pneumoniae CWL029
ucuggagacaucuuuugaagcu

SEQ ID NO: 68419 - RNA, 23 nt, Chlamydophila pneumoniae CWL029
ucugcuauccguucaggagaaau

SEQ ID NO: 68420 - RNA, 22 nt, Chlamydophila pneumoniae CWL029
ucuauuccucaugaaguucuug

SEQ ID NO: 68421 - RNA, 23 nt, Chlamydophila pneumoniae CWL029
aucugccuuguaaauaaguaugg

SEQ ID NO: 68422 - RNA, 22 nt, Chlamydophila pneumoniae CWL029
acauggaugccgaacugcuccg

SEQ ID NO: 68423 - RNA, 22 nt, Chlamydophila pneumoniae CWL029
auccugauggaacuuuuguuuc

SEQ ID NO: 68424 - RNA, 22 nt, Chlamydophila pneumoniae CWL029
augggaaucuugaagaguuguu

SEQ ID NO: 68425 - RNA, 22 nt, Chlamydophila pneumoniae CWL029
ucguggacuuguuggggaagau

SEQ ID NO: 68426 - RNA, 22 nt, Chlamydophila pneumoniae CWL029
guugucuuuccaacuccagaac

SEQ ID NO: 68427 - RNA, 22 nt, Chlamydophila pneumoniae CWL029
cauuuaucucggaguucuugcg

SEQ ID NO: 68428 - RNA, 22 nt, Chlamydophila pneumoniae CWL029
gaacaauagcuuugacaacagg

SEQ ID NO: 68429 - RNA, 22 nt, Chlamydophila pneumoniae CWL029
ugggauuucagauccguauaaa

SEQ ID NO: 68430 - RNA, 22 nt, Chlamydophila pneumoniae CWL029
gccuuuuuugaugcucuugucc

SEQ ID NO: 68431 - RNA, 22 nt, Chlamydophila pneumoniae CWL029
gaucgcucgaaucaugaaagcc

SEQ ID NO: 68432 - RNA, 22 nt, Chlamydophila pneumoniae CWL029
ucuaugauuuuaguggguagag

SEQ ID NO: 68433 - RNA, 22 nt, Chlamydophila pneumoniae CWL029
agaaaucugcugcauagauauc

SEQ ID NO: 68434 - RNA, 20 nt, Chlamydophila pneumoniae CWL029
guuuugcuggaagagccucu

SEQ ID NO: 68435 - RNA, 22 nt, Chlamydophila pneumoniae CWL029
auauaguucuucagcaaagaua

SEQ ID NO: 68436 - RNA, 22 nt, Chlamydophila pneumoniae CWL029
uagagcuuccguaguucccgau

SEQ ID NO: 68437 - RNA, 23 nt, Chlamydophila pneumoniae CWL029
uccucagucuucccuagggaacu

SEQ ID NO: 68438 - RNA, 20 nt, Chlamydophila pneumoniae CWL029
ugcuaugcaaaauaagcgag

SEQ ID NO: 68439 - RNA, 22 nt, Chlamydophila pneumoniae CWL029
agugaugccuuugauuacgaaa

SEQ ID NO: 68440 - RNA, 22 nt, Chlamydophila pneumoniae CWL029
uuaaaaaugcucaagauuugcg

SEQ ID NO: 68441 - RNA, 22 nt, Chlamydophila pneumoniae CWL029
cugcucuaucucagaaaucaau

SEQ ID NO: 68442 - RNA, 22 nt, Chlamydophila pneumoniae CWL029
uauuuucuuuguagcuaccaau

SEQ ID NO: 68443 - RNA, 21 nt, Chlamydophila pneumoniae CWL029
aguuguauguguuuugggaaa

SEQ ID NO: 68444 - RNA, 22 nt, Chlamydophila pneumoniae CWL029
aggaaaagucgcgaagcguuau

SEQ ID NO: 68445 - RNA, 22 nt, Chlamydophila pneumoniae CWL029
uuaggaucggcagaauuaccaa

SEQ ID NO: 68446 - RNA, 19 nt, Chlamydophila pneumoniae CWL029
uucuuucaggagcuccuca

SEQ ID NO: 68447 - RNA, 19 nt, Chlamydophila pneumoniae CWL029
aaggagguccuugccaauu

SEQ ID NO: 68448 - RNA, 22 nt, Chlamydophila pneumoniae CWL029
uuguuauugaaucagaacugca

SEQ ID NO: 68449 - RNA, 22 nt, Chlamydophila pneumoniae CWL029
gagaggggaagaaaaauagcca

SEQ ID NO: 68450 - RNA, 22 nt, Chlamydophila pneumoniae CWL029
ggcuuuguuuuucagaaauaga

SEQ ID NO: 68451 - RNA, 22 nt, Chlamydophila pneumoniae CWL029
aaucugugauugaugaguuuuu

SEQ ID NO: 68452 - RNA, 23 nt, Chlamydophila pneumoniae CWL029
ucagucucuagaggagcucuuug

SEQ ID NO: 68453 - RNA, 22 nt, Chlamydophila pneumoniae CWL029
ugguuagaccuauuucuuguuu

SEQ ID NO: 68454 - RNA, 22 nt, Chlamydophila pneumoniae CWL029
cauuuaaaccaaucggaagaga

SEQ ID NO: 68455 - RNA, 22 nt, Chlamydophila pneumoniae CWL029
auuaaaagaacgcucguaucca

SEQ ID NO: 68456 - RNA, 22 nt, Chlamydophila pneumoniae CWL029
uggaugaugauaucauuucuca

SEQ ID NO: 68457 - RNA, 22 nt, Chlamydophila pneumoniae CWL029
aaacuucaggaacuuucugagu

SEQ ID NO: 68458 - RNA, 22 nt, Chlamydophila pneumoniae CWL029
gccuaggagauaagcaauguuu

SEQ ID NO: 68459 - RNA, 22 nt, Chlamydophila pneumoniae CWL029
aaugucucucagguuuauuccu

SEQ ID NO: 68460 - RNA, 22 nt, Chlamydophila pneumoniae CWL029
ccauaccaaagaagugguuccu

SEQ ID NO: 68461 - RNA, 22 nt, Chlamydophila pneumoniae CWL029
auaauucaaugauuugauugug

SEQ ID NO: 68462 - RNA, 20 nt, Chlamydophila pneumoniae CWL029
uuugugcgauuuucuugaac

SEQ ID NO: 68463 - RNA, 22 nt, Chlamydophila pneumoniae CWL029
aaggauggccaggauuuucagg

SEQ ID NO: 68464 - RNA, 18 nt, Chlamydophila pneumoniae CWL029
cguugucuuaaugaucau

SEQ ID NO: 68465 - RNA, 22 nt, Chlamydophila pneumoniae CWL029
cucuauaauagggugcguauag

SEQ ID NO: 68466 - RNA, 22 nt, Chlamydophila pneumoniae CWL029
guuaggauauuucggagauuca

SEQ ID NO: 68467 - RNA, 22 nt, Chlamydophila pneumoniae CWL029
gaaggacaacuacguuaucauu

SEQ ID NO: 68468 - RNA, 22 nt, Chlamydophila pneumoniae CWL029
agaaaauuguaugacagcuugu

SEQ ID NO: 68469 - RNA, 22 nt, Chlamydophila pneumoniae CWL029
uugaagauguuuccucaguuga

SEQ ID NO: 68470 - RNA, 22 nt, Chlamydophila pneumoniae CWL029
uagaggcucuuccagcaaaaca

SEQ ID NO: 68471 - RNA, 22 nt, Chlamydophila pneumoniae CWL029
gauggucaguuuucugaagaaa

SEQ ID NO: 68472 - RNA, 22 nt, Chlamydophila pneumoniae CWL029
aaauuuggaggagaaucuauag

SEQ ID NO: 68473 - RNA, 22 nt, Chlamydophila pneumoniae CWL029
aauucguggagccguuuuuuua

SEQ ID NO: 68474 - RNA, 22 nt, Chlamydophila pneumoniae CWL029
ucuugggcaaugauggagaggu

SEQ ID NO: 68475 - RNA, 22 nt, Chlamydophila pneumoniae CWL029
uuuuaaugucggaagguacguu

SEQ ID NO: 68476 - RNA, 22 nt, Chlamydophila pneumoniae CWL029
ugaagagaucgaagcgauacuu

SEQ ID NO: 68477 - RNA, 22 nt, Chlamydophila pneumoniae CWL029
ggaaggaucuuuaucggaauau

SEQ ID NO: 68478 - RNA, 22 nt, Chlamydophila pneumoniae CWL029
ucuugcagucauuuagguaggu

SEQ ID NO: 68479 - RNA, 22 nt, Chlamydophila pneumoniae CWL029
agagcgcacgccuauugguuau

SEQ ID NO: 68480 - RNA, 22 nt, Chlamydophila pneumoniae CWL029
uggaugaagaagcuggaaaucc

SEQ ID NO: 68481 - RNA, 22 nt, Chlamydophila pneumoniae CWL029
uacauuuuggacauauugcagg

SEQ ID NO: 68482 - RNA, 22 nt, Chlamydophila pneumoniae CWL029
uaauuugugggaaugagggaag

SEQ ID NO: 68483 - RNA, 22 nt, Chlamydophila pneumoniae CWL029
cgcuuucuucagacaguucaag

SEQ ID NO: 68484 - RNA, 21 nt, Chlamydophila pneumoniae CWL029
uacuacagguucuuguagaag

SEQ ID NO: 68485 - RNA, 22 nt, Chlamydophila pneumoniae CWL029
aguauagcgaaauaugcaaucu

SEQ ID NO: 68486 - RNA, 22 nt, Chlamydophila pneumoniae CWL029
aagaucaugucuccucugugcg

SEQ ID NO: 68487 - RNA, 22 nt, Chlamydophila pneumoniae CWL029
uuccuuuucguguuuuacagga

SEQ ID NO: 68488 - RNA, 22 nt, Chlamydophila pneumoniae CWL029
agcucaauuggauagaguaccu

SEQ ID NO: 68489 - RNA, 22 nt, Chlamydophila pneumoniae CWL029
uuucccuguuguaggaacggua

SEQ ID NO: 68490 - RNA, 22 nt, Chlamydophila pneumoniae CWL029
ucuugagcauuuuuaaaaguca

SEQ ID NO: 68491 - RNA, 22 nt, Chlamydophila pneumoniae CWL029
aaauagucucuagguucuauag

SEQ ID NO: 68492 - RNA, 22 nt, Chlamydophila pneumoniae CWL029
aaacuaaggagugucaaugaag

SEQ ID NO: 68493 - RNA, 22 nt, Chlamydophila pneumoniae CWL029
aaaauauaugcagaguuauggu

SEQ ID NO: 68494 - RNA, 22 nt, Chlamydophila pneumoniae CWL029
uggucuugauuuuuauagaaaa

SEQ ID NO: 68495 - RNA, 22 nt, Chlamydophila pneumoniae CWL029
aucugucuguuucuugcaggac

SEQ ID NO: 68496 - RNA, 22 nt, Chlamydophila pneumoniae CWL029
aggaguguagccuaaagaguau

SEQ ID NO: 68497 - RNA, 22 nt, Chlamydophila pneumoniae CWL029
uuguaggggcuuguaucggauu

SEQ ID NO: 68498 - RNA, 22 nt, Chlamydophila pneumoniae CWL029
aauaaugugagagcauaguucu

SEQ ID NO: 68499 - RNA, 22 nt, Chlamydophila pneumoniae CWL029
ucuguauugucccagacaacca

SEQ ID NO: 68500 - RNA, 22 nt, Chlamydophila pneumoniae CWL029
uuguuuaagagccucgcuuguu

SEQ ID NO: 68501 - RNA, 22 nt, Chlamydophila pneumoniae CWL029
aaugguuucuagaaccacggag

SEQ ID NO: 68502 - RNA, 22 nt, Chlamydophila pneumoniae CWL029
agagaguuuuaccgggugaggg

SEQ ID NO: 68503 - RNA, 22 nt, Chlamydophila pneumoniae CWL029
ucuaaagauucccugugucuuu

SEQ ID NO: 68504 - RNA, 20 nt, Chlamydophila pneumoniae CWL029
ugucucugaaaaagagagcc

SEQ ID NO: 68505 - RNA, 22 nt, Chlamydophila pneumoniae CWL029
cuccauauagccgcauuggaau

SEQ ID NO: 68506 - RNA, 22 nt, Chlamydophila pneumoniae CWL029
aaggaguuaugacaauuagagu

SEQ ID NO: 68507 - RNA, 22 nt, Chlamydophila pneumoniae CWL029
gagaguauagggguguuucgga

SEQ ID NO: 68508 - RNA, 22 nt, Chlamydophila pneumoniae CWL029
ggucgcaccccggaaggguaga

SEQ ID NO: 68509 - RNA, 22 nt, Chlamydophila pneumoniae CWL029
agauauucuuaaaguuucggau

SEQ ID NO: 68510 - RNA, 22 nt, Chlamydophila pneumoniae CWL029
aaggaggcgaagucaaaaguga

SEQ ID NO: 68511 - RNA, 22 nt, Chlamydophila pneumoniae CWL029
aggugguuggagguucgagccc

SEQ ID NO: 68512 - RNA, 22 nt, Chlamydophila pneumoniae CWL029
uuucccuauguauggauucuca

SEQ ID NO: 68513 - RNA, 22 nt, Chlamydophila pneumoniae CWL029
uauuucagcuuaugucaaaggu

SEQ ID NO: 68514 - RNA, 22 nt, Chlamydophila pneumoniae CWL029
auacauuucugcgauguugugg

SEQ ID NO: 68515 - RNA, 22 nt, Chlamydophila pneumoniae CWL029
uuuucgcuucucuugaagaaau

SEQ ID NO: 68516 - RNA, 22 nt, Chlamydophila pneumoniae CWL029
cgacuuagaucuuuucuacuuc

SEQ ID NO: 68517 - RNA, 21 nt, Chlamydophila pneumoniae CWL029
aauuccucacuuccuuuaccu

SEQ ID NO: 68518 - RNA, 22 nt, Chlamydophila pneumoniae CWL029
auaaaguuuugcugcgggcucc

SEQ ID NO: 68519 - RNA, 22 nt, Chlamydophila pneumoniae CWL029
gcuuuuggcucaccuauuccaa

SEQ ID NO: 68520 - RNA, 22 nt, Chlamydophila pneumoniae CWL029
ugagugucgacagacaauagca

SEQ ID NO: 68521 - RNA, 22 nt, Chlamydophila pneumoniae CWL029
aggguuugaaucuuuagaagau

SEQ ID NO: 68522 - RNA, 22 nt, Chlamydophila pneumoniae CWL029
acgauaaaguguguguaggauu

SEQ ID NO: 68523 - RNA, 22 nt, Chlamydophila pneumoniae CWL029
uuucucuuaagaugcgugguau

SEQ ID NO: 68524 - RNA, 22 nt, Chlamydophila pneumoniae CWL029
cuguaucuucgacaacaugguu

SEQ ID NO: 68525 - RNA, 22 nt, Chlamydophila pneumoniae CWL029
aagcuuuucgcagauacuucuu

SEQ ID NO: 68526 - RNA, 22 nt, Chlamydophila pneumoniae CWL029
uagaacgugcguucucuuaugu

SEQ ID NO: 68527 - RNA, 22 nt, Chlamydophila pneumoniae CWL029
uuggcguugagauuauuccuga

SEQ ID NO: 68528 - RNA, 22 nt, Chlamydophila pneumoniae CWL029
ucuguugcagaaauuauaggau

SEQ ID NO: 68529 - RNA, 16 nt, Chlamydophila pneumoniae CWL029
ccucuauuguuccucc

SEQ ID NO: 68530 - RNA, 22 nt, Chlamydophila pneumoniae CWL029
ugaggaggaagaaucggaaugc

SEQ ID NO: 68531 - RNA, 22 nt, Chlamydophila pneumoniae CWL029
auuuuaucuauagcacuuugcu

SEQ ID NO: 68532 - RNA, 22 nt, Chlamydophila pneumoniae CWL029
gcggugauacaaaagagagugu

SEQ ID NO: 68533 - RNA, 22 nt, Chlamydophila pneumoniae CWL029
gauuaaagaauaguucugaauu

SEQ ID NO: 68534 - RNA, 22 nt, Chlamydophila pneumoniae CWL029
uuagaguugacuguaguuacag

SEQ ID NO: 68535 - RNA, 22 nt, Chlamydophila pneumoniae CWL029
auaaaucuguacaagauccucu

SEQ ID NO: 68536 - RNA, 22 nt, Chlamydophila pneumoniae CWL029
uuccauucagaacggaagccua

SEQ ID NO: 68537 - RNA, 22 nt, Chlamydophila pneumoniae CWL029
agcaaggcuuuguaaaacguuc

SEQ ID NO: 68538 - RNA, 22 nt, Chlamydophila pneumoniae CWL029
gagucuucacuucccgcaguuu

SEQ ID NO: 68539 - RNA, 22 nt, Chlamydophila pneumoniae CWL029
uggaggagcagguucaucuuuu

SEQ ID NO: 68540 - RNA, 22 nt, Chlamydophila pneumoniae CWL029
aaagucuucaauuucugcgaua

SEQ ID NO: 68541 - RNA, 22 nt, Chlamydophila pneumoniae CWL029
ugcaugauucucccuacguggc

SEQ ID NO: 68542 - RNA, 22 nt, Chlamydophila pneumoniae CWL029
aaggugaacaagaucuucuggu

SEQ ID NO: 68543 - RNA, 22 nt, Chlamydophila pneumoniae CWL029
auacgauaucagauccuuuaga

SEQ ID NO: 68544 - RNA, 22 nt, Chlamydophila pneumoniae CWL029
gugaaucauucgaugaaggaag

SEQ ID NO: 68545 - RNA, 22 nt, Chlamydophila pneumoniae CWL029
ucuuuaauuuucugaaagauua

SEQ ID NO: 68546 - RNA, 22 nt, Chlamydophila pneumoniae CWL029
aaucucugaacuuuugcuguug

SEQ ID NO: 68547 - RNA, 22 nt, Chlamydophila pneumoniae CWL029
acuuugcucuucuuguuggaag

SEQ ID NO: 68548 - RNA, 22 nt, Chlamydophila pneumoniae CWL029
ucauucacuacagacaugaaag

SEQ ID NO: 68549 - RNA, 22 nt, Chlamydophila pneumoniae CWL029
ucgaaagaccgugucuuuugcc

SEQ ID NO: 68550 - RNA, 22 nt, Chlamydophila pneumoniae CWL029
gcaaucuuaaugacgaucuccu

SEQ ID NO: 68551 - RNA, 22 nt, Chlamydophila pneumoniae CWL029
gaagcucaggaucugucaguuc

SEQ ID NO: 68552 - RNA, 22 nt, Chlamydophila pneumoniae CWL029
uaagacuucaccuguugcaguc

SEQ ID NO: 68553 - RNA, 22 nt, Chlamydophila pneumoniae CWL029
aagguguuucuuuaggaaaaau

SEQ ID NO: 68554 - RNA, 22 nt, Chlamydophila pneumoniae CWL029
agcaggauuuuacuguauuucu

SEQ ID NO: 68555 - RNA, 18 nt, Chlamydophila pneumoniae CWL029
ucuuggucugugaccauu

SEQ ID NO: 68556 - RNA, 22 nt, Chlamydophila pneumoniae CWL029
acuuucuuuuaaagaacaucac

SEQ ID NO: 68557 - RNA, 22 nt, Chlamydophila pneumoniae CWL029
auauagauagaauuuuacagga

SEQ ID NO: 68558 - RNA, 22 nt, Chlamydophila pneumoniae CWL029
gcgauucuaagauuccuacgau

SEQ ID NO: 68559 - RNA, 22 nt, Chlamydophila pneumoniae CWL029
cuuauggaauuacucaugucgu

SEQ ID NO: 68560 - RNA, 22 nt, Chlamydophila pneumoniae CWL029
agagaaaugagggagucuucug

SEQ ID NO: 68561 - RNA, 22 nt, Chlamydophila pneumoniae CWL029
cgcaugaggaauaagauaguaa

SEQ ID NO: 68562 - RNA, 22 nt, Chlamydophila pneumoniae CWL029
uucuauggcugcucagaauauc

SEQ ID NO: 68563 - RNA, 22 nt, Chlamydophila pneumoniae CWL029
auuggcaugggugaagcuguug

SEQ ID NO: 68564 - RNA, 22 nt, Chlamydophila pneumoniae CWL029
ucgucuacaggguucuucgcuu

SEQ ID NO: 68565 - RNA, 22 nt, Chlamydophila pneumoniae CWL029
uaguugaaacagauggaagagu

SEQ ID NO: 68566 - RNA, 22 nt, Chlamydophila pneumoniae CWL029
uauugauuuaagaguuucaggg

SEQ ID NO: 68567 - RNA, 22 nt, Chlamydophila pneumoniae CWL029
gaggaauuuuugcguaauguuc

SEQ ID NO: 68568 - RNA, 22 nt, Chlamydophila pneumoniae CWL029
gggggaaagccaagaagaugua

SEQ ID NO: 68569 - RNA, 22 nt, Chlamydophila pneumoniae CWL029
agcuaucaauaaagcuaaagaa

SEQ ID NO: 68570 - RNA, 22 nt, Chlamydophila pneumoniae CWL029
cuauguaguugccuggauugau

SEQ ID NO: 68571 - RNA, 22 nt, Chlamydophila pneumoniae CWL029
ugcucaguuugauucucuuucu

SEQ ID NO: 68572 - RNA, 22 nt, Chlamydophila pneumoniae CWL029
gaaagaugacgaccgcccuuua

SEQ ID NO: 68573 - RNA, 22 nt, Chlamydophila pneumoniae CWL029
gaaggauaguuucucuaugaua

SEQ ID NO: 68574 - RNA, 22 nt, Chlamydophila pneumoniae CWL029
uugugauuccucgagcgagacg

SEQ ID NO: 68575 - RNA, 22 nt, Chlamydophila pneumoniae CWL029
uuuuccaaaagcauauaacuuu

SEQ ID NO: 68576 - RNA, 22 nt, Chlamydophila pneumoniae CWL029
cugcaagagucuaagcaagguu

SEQ ID NO: 68577 - RNA, 22 nt, Chlamydophila pneumoniae CWL029
ucucuuguaggaauugacgggc

SEQ ID NO: 68578 - RNA, 22 nt, Chlamydophila pneumoniae CWL029
aucugcaauguguucuuuauuu

SEQ ID NO: 68579 - RNA, 22 nt, Chlamydophila pneumoniae CWL029
uaggguagaugucaaaagacaa

SEQ ID NO: 68580 - RNA, 22 nt, Chlamydophila pneumoniae CWL029
aaaaucagcaacuaacauagcu

SEQ ID NO: 68581 - RNA, 23 nt, Chlamydophila pneumoniae CWL029
uuaguuggagaaguugaaguugg

SEQ ID NO: 68582 - RNA, 22 nt, Chlamydophila pneumoniae CWL029
uagaggaagagguugaccugca

SEQ ID NO: 68583 - RNA, 22 nt, Chlamydophila pneumoniae CWL029
ggucuucaagccaaaugaucag

SEQ ID NO: 68584 - RNA, 23 nt, Chlamydophila pneumoniae CWL029
cuaaagacuccacaaugauuaca

SEQ ID NO: 68585 - RNA, 22 nt, Chlamydophila pneumoniae CWL029
uuugucguagcguuccauaaga

SEQ ID NO: 68586 - RNA, 22 nt, Chlamydophila pneumoniae CWL029
aauuuucuguucuuuaccgcug

SEQ ID NO: 68587 - RNA, 22 nt, Chlamydophila pneumoniae CWL029
cuaagauuccucuauuuccugc

SEQ ID NO: 68588 - RNA, 23 nt, Chlamydophila pneumoniae CWL029
uugauuacacucaaggaugcugc

SEQ ID NO: 68589 - RNA, 22 nt, Chlamydophila pneumoniae CWL029
cuuuuugcuauuaaggaguauu

SEQ ID NO: 68590 - RNA, 22 nt, Chlamydophila pneumoniae CWL029
gagaagaguuaaaauaaugacg

SEQ ID NO: 68591 - RNA, 22 nt, Chlamydophila pneumoniae CWL029
gauucuguggaguaugcaucca

SEQ ID NO: 68592 - RNA, 22 nt, Chlamydophila pneumoniae CWL029
aacaggaaggaaaaaaucuaca

SEQ ID NO: 68593 - RNA, 22 nt, Chlamydophila pneumoniae CWL029
aaugacgcguaggucugccuua

SEQ ID NO: 68594 - RNA, 22 nt, Chlamydophila pneumoniae CWL029
auuaaauaaacuuggaguaucu

SEQ ID NO: 68595 - RNA, 22 nt, Chlamydophila pneumoniae CWL029
gcauguucuagagcauaugguc

SEQ ID NO: 68596 - RNA, 21 nt, Chlamydophila pneumoniae CWL029
uaacucucgucgacuuuuccu

SEQ ID NO: 68597 - RNA, 22 nt, Chlamydophila pneumoniae CWL029
augcuugcuuaggaucguuguu

SEQ ID NO: 68598 - RNA, 22 nt, Chlamydophila pneumoniae CWL029
agcuggaaguuagauucccugu

SEQ ID NO: 68599 - RNA, 22 nt, Chlamydophila pneumoniae CWL029
gcuagcaauuucaaugagaagu

SEQ ID NO: 68600 - RNA, 22 nt, Chlamydophila pneumoniae CWL029
auauucgugauauugaagacau

SEQ ID NO: 68601 - RNA, 22 nt, Chlamydophila pneumoniae CWL029
agcaugauuucuauuucuucga

SEQ ID NO: 68602 - RNA, 22 nt, Chlamydophila pneumoniae CWL029
uauuuuuuauugaagugguagc

SEQ ID NO: 68603 - RNA, 21 nt, Chlamydophila pneumoniae CWL029
agaacgcacguucuauacaag

SEQ ID NO: 68604 - RNA, 22 nt, Chlamydophila pneumoniae CWL029
aagcuguuuucuaugaaaguaa

SEQ ID NO: 68605 - RNA, 19 nt, Chlamydophila pneumoniae CWL029
aggagaaccaagaacauuu

SEQ ID NO: 68606 - RNA, 22 nt, Chlamydophila pneumoniae CWL029
uucuacaauuccuauagcucaa

SEQ ID NO: 68607 - RNA, 22 nt, Chlamydophila pneumoniae CWL029
uuacgagaaaaguuagaauuua

SEQ ID NO: 68608 - RNA, 22 nt, Chlamydophila pneumoniae CWL029
uucuggaguggcuuuaacgaua

SEQ ID NO: 68609 - RNA, 22 nt, Chlamydophila pneumoniae CWL029
aaauuaucggucaaaagcuaag

SEQ ID NO: 68610 - RNA, 22 nt, Chlamydophila pneumoniae CWL029
aaggauggccaggauuuucagg

SEQ ID NO: 68611 - RNA, 22 nt, Chlamydophila pneumoniae CWL029
aagcucuuccagaaacaagauc

SEQ ID NO: 68612 - RNA, 22 nt, Chlamydophila pneumoniae CWL029
aaggcagguaucuccuugauaa

SEQ ID NO: 68613 - RNA, 22 nt, Chlamydophila pneumoniae CWL029
aagguguuucuuuaggaaaaau

SEQ ID NO: 68614 - RNA, 22 nt, Chlamydophila pneumoniae CWL029
aacaauaccuugaguuacaaac

SEQ ID NO: 68615 - RNA, 22 nt, Chlamydophila pneumoniae CWL029
aacaauacuuggaguucgauga

SEQ ID NO: 68616 - RNA, 22 nt, Chlamydophila pneumoniae CWL029
aacauacaguucugcaauggcu

SEQ ID NO: 68617 - RNA, 22 nt, Chlamydophila pneumoniae CWL029
aagcuuuucgcagauacuucuu

SEQ ID NO: 68618 - RNA, 22 nt, Chlamydophila pneumoniae CWL029
accagcuguagagggauugggg

SEQ ID NO: 68619 - RNA, 22 nt, Chlamydophila pneumoniae CWL029
acuccucuaucguauuggggau

SEQ ID NO: 68620 - RNA, 22 nt, Chlamydophila pneumoniae CWL029
acucauuguucuauuggcugcg

SEQ ID NO: 68621 - RNA, 22 nt, Chlamydophila pneumoniae CWL029
aauuuucuguucuuuaccgcug

SEQ ID NO: 68622 - RNA, 22 nt, Chlamydophila pneumoniae CWL029
cacaaccaaaacgugcgcaggg

SEQ ID NO: 68623 - RNA, 22 nt, Chlamydophila pneumoniae CWL029
caauauuugcuuuagaacaugc

SEQ ID NO: 68624 - RNA, 22 nt, Chlamydophila pneumoniae CWL029
auucuucacaauaggagaaagu

SEQ ID NO: 68625 - RNA, 22 nt, Chlamydophila pneumoniae CWL029
auuuuaucuauagcacuuugcu

SEQ ID NO: 68626 - RNA, 22 nt, Chlamydophila pneumoniae CWL029
caaacuaaagagcuugaguuug

SEQ ID NO: 68627 - RNA, 20 nt, Chlamydophila pneumoniae CWL029
auguaauacagaagaacauu

SEQ ID NO: 68628 - RNA, 23 nt, Chlamydophila pneumoniae CWL029
aucugccuuguaaauaaguaugg

SEQ ID NO: 68629 - RNA, 22 nt, Chlamydophila pneumoniae CWL029
aucugcaauguguucuuuauuu

SEQ ID NO: 68630 - RNA, 22 nt, Chlamydophila pneumoniae CWL029
auaauucaaugauuugauugug

SEQ ID NO: 68631 - RNA, 22 nt, Chlamydophila pneumoniae CWL029
auauaguucuucagcaaagaua

SEQ ID NO: 68632 - RNA, 22 nt, Chlamydophila pneumoniae CWL029
aggguucaauacuauggauuua

SEQ ID NO: 68633 - RNA, 22 nt, Chlamydophila pneumoniae CWL029
agguaagggauaugugacuucu

SEQ ID NO: 68634 - RNA, 22 nt, Chlamydophila pneumoniae CWL029
acuuucuuuuaaagaacaucac

SEQ ID NO: 68635 - RNA, 22 nt, Chlamydophila pneumoniae CWL029
auaaaucuguacaagauccucu

SEQ ID NO: 68636 - RNA, 22 nt, Chlamydophila pneumoniae CWL029
agucgagacuaugaccuuguca

SEQ ID NO: 68637 - RNA, 23 nt, Chlamydophila pneumoniae CWL029
ucagucucuagaggagcucuuug

SEQ ID NO: 68638 - RNA, 22 nt, Chlamydophila pneumoniae CWL029
ucauucacuacagacaugaaag

SEQ ID NO: 68639 - RNA, 22 nt, Chlamydophila pneumoniae CWL029
ucccuuuggauccagaagcuaa

SEQ ID NO: 68640 - RNA, 19 nt, Chlamydophila pneumoniae CWL029
uccuuauuuguucuuucug

SEQ ID NO: 68641 - RNA, 22 nt, Chlamydophila pneumoniae CWL029
ucucuuguaggaauugacgggc

SEQ ID NO: 68642 - RNA, 22 nt, Chlamydophila pneumoniae CWL029
ugucccauguggucuaguauag

SEQ ID NO: 68643 - RNA, 22 nt, Chlamydophila pneumoniae CWL029
uaacugcacugagcgugcagau

SEQ ID NO: 68644 - RNA, 22 nt, Chlamydophila pneumoniae CWL029
uaaugacaacuuaguuucuuuu

SEQ ID NO: 68645 - RNA, 22 nt, Chlamydophila pneumoniae CWL029
gugcaggucaugagcuugccgg

SEQ ID NO: 68646 - RNA, 22 nt, Chlamydophila pneumoniae CWL029
ggcuguggaaacuguugagcug

SEQ ID NO: 68647 - RNA, 22 nt, Chlamydophila pneumoniae CWL029
gcagguggugcauggacuccuc

SEQ ID NO: 68648 - RNA, 22 nt, Chlamydophila pneumoniae CWL029
gccaaggcucuugcggauguua

SEQ ID NO: 68649 - RNA, 22 nt, Chlamydophila pneumoniae CWL029
gcccaagucggagaaagcuuau

SEQ ID NO: 68650 - RNA, 22 nt, Chlamydophila pneumoniae CWL029
gcagggcuugauagagcgucuc

SEQ ID NO: 68651 - RNA, 22 nt, Chlamydophila pneumoniae CWL029
ggauuauucgugcauuuggugg

SEQ ID NO: 68652 - RNA, 22 nt, Chlamydophila pneumoniae CWL029
gaagcucaggaucugucaguuc

SEQ ID NO: 68653 - RNA, 22 nt, Chlamydophila pneumoniae CWL029
cuguuuuuucauaguauccuua

SEQ ID NO: 68654 - RNA, 22 nt, Chlamydophila pneumoniae CWL029
cucuucaggaucggcauuauuu

SEQ ID NO: 68655 - RNA, 22 nt, Chlamydophila pneumoniae CWL029
cuccauauagccgcauuggaau

SEQ ID NO: 68656 - RNA, 22 nt, Chlamydophila pneumoniae CWL029
uuaaaaaugcucaagauuugcg

SEQ ID NO: 68657 - RNA, 22 nt, Chlamydophila pneumoniae CWL029
uuagaguugacuguaguuacag

SEQ ID NO: 68658 - RNA, 22 nt, Chlamydophila pneumoniae CWL029
ugugauuaucuguggagaccag

SEQ ID NO: 68659 - RNA, 22 nt, Chlamydophila pneumoniae CWL029
aagaagaagaauccguggauga

SEQ ID NO: 68660 - RNA, 22 nt, Chlamydophila pneumoniae CWL029
aaaaucagcaacuaacauagcu

SEQ ID NO: 68661 - RNA, 22 nt, Chlamydophila pneumoniae CWL029
aaaauauaugcagaguuauggu

SEQ ID NO: 68662 - RNA, 22 nt, Chlamydophila pneumoniae CWL029
agcuuuuggauauccuuccuua

SEQ ID NO: 68663 - RNA, 22 nt, Chlamydophila pneumoniae CWL029
aggaaaagucgcgaagcguuau

SEQ ID NO: 68664 - RNA, 22 nt, Chlamydophila pneumoniae CWL029
agcaggauuuuacuguauuucu

SEQ ID NO: 68665 - RNA, 22 nt, Chlamydophila pneumoniae CWL029
agcccgagguacuacaaggcga

SEQ ID NO: 68666 - RNA, 22 nt, Chlamydophila pneumoniae CWL029
aaucucugaacuuuugcuguug

SEQ ID NO: 68667 - RNA, 22 nt, Chlamydophila pneumoniae CWL029
agagaaggugaaaaucggggaa

SEQ ID NO: 68668 - RNA, 22 nt, Chlamydophila pneumoniae CWL029
acuauacaccaagaacaauaag

SEQ ID NO: 68669 - RNA, 22 nt, Chlamydophila pneumoniae CWL029
agagggcgaagaauuccuuccu

SEQ ID NO: 68670 - RNA, 22 nt, Chlamydophila pneumoniae CWL029
uuuuccaaaagcauauaacuuu

SEQ ID NO: 68671 - RNA, 22 nt, Chlamydophila pneumoniae CWL029
uugaccagaugcaugagaauag

SEQ ID NO: 68672 - RNA, 19 nt, Chlamydophila pneumoniae CWL029
uucuuucaggagcuccuca

SEQ ID NO: 68673 - RNA, 22 nt, Chlamydophila pneumoniae CWL029
uuguuauugaaucagaacugca

SEQ ID NO: 68674 - RNA, 22 nt, Chlamydophila pneumoniae CWL029
uugugauuccucgagcgagacg

SEQ ID NO: 68675 - RNA, 22 nt, Chlamydophila pneumoniae CWL029
uuauuguucuuggugaaucugu

SEQ ID NO: 68676 - RNA, 22 nt, Chlamydophila pneumoniae CWL029
uuauuguucuugguguauagua

SEQ ID NO: 68677 - RNA, 22 nt, Chlamydophila pneumoniae CWL029
ugaagcauuugcucuuugggaa

SEQ ID NO: 68678 - RNA, 22 nt, Chlamydophila pneumoniae CWL029
ugaaaauaugagcaacuucuau

SEQ ID NO: 68679 - RNA, 22 nt, Chlamydophila pneumoniae CWL029
ucuuuaauuuucugaaagauua

SEQ ID NO: 68680 - RNA, 22 nt, Chlamydophila pneumoniae CWL029
uauuuucuuuguagcuaccaau

SEQ ID NO: 68681 - RNA, 22 nt, Chlamydophila pneumoniae CWL029
guccccuuucucaugaaaauag

SEQ ID NO: 68682 - RNA, 22 nt, Chlamydophila pneumoniae CWL029
uagaaguauuaagccaagauuu

SEQ ID NO: 68683 - RNA, 19 nt, Chlamydophila pneumoniae CWL029
uagaaaaagaucuaagucg

SEQ ID NO: 68684 - RNA, 22 nt, Chlamydophila pneumoniae CWL029
guuguaaaauuauucaguaggg

SEQ ID NO: 68685 - RNA, 22 nt, Chlamydophila pneumoniae CWL029
gcuuuuggcucaccuauuccaa

SEQ ID NO: 68686 - RNA, 22 nt, Chlamydophila pneumoniae CWL029
ggagacaguuugcuuuaucucu

SEQ ID NO: 68687 - RNA, 22 nt, Chlamydophila pneumoniae CWL029
gagaggggaagaaaaauagcca

SEQ ID NO: 68688 - RNA, 22 nt, Chlamydophila pneumoniae CWL029
gacuuuuauuuagaucguguug

SEQ ID NO: 68689 - RNA, 22 nt, Chlamydophila pneumoniae CWL029
cugugcucuugaagauuguguc

SEQ ID NO: 68690 - RNA, 22 nt, Chlamydophila pneumoniae CWL029
cuggagacgcuuggaaagaagc

SEQ ID NO: 68691 - RNA, 22 nt, Chlamydophila pneumoniae CWL029
cuggaggugcugcuaaagcaau

SEQ ID NO: 68692 - RNA, 22 nt, Chlamydophila pneumoniae CWL029
gauucuguggaguaugcaucca

SEQ ID NO: 68693 - RNA, 22 nt, Chlamydophila pneumoniae CWL029
cauuuuuaaauacgauggucgu

SEQ ID NO: 68694 - RNA, 22 nt, Chlamydophila pneumoniae CWL029
cauuuaaaccaaucggaagaga

SEQ ID NO: 68695 - RNA, 22 nt, Chlamydophila pneumoniae CWL029
cauuuaucucggaguucuugcg

SEQ ID NO: 68696 - RNA, 22 nt, Chlamydophila pneumoniae CWL029
ccauaccaaagaagugguuccu

SEQ ID NO: 68697 - RNA, 22 nt, Chlamydophila pneumoniae CWL029
ccuagcauuuauuauuacuuca

SEQ ID NO: 68698 - RNA, 22 nt, Chlamydophila pneumoniae CWL029
cgcuuucuucagacaguucaag

SEQ ID NO: 68699 - RNA, 22 nt, Human
aaaaaggagaaagagagggaga

SEQ ID NO: 68700 - RNA, 22 nt, Human
aaaaaguaccacuuggacacuu

SEQ ID NO: 68701 - RNA, 20 nt, Human
aaaaacaguaaugcugaaga

SEQ ID NO: 68702 - RNA, 22 nt, Human
aaaaaauugcuggcagagcugu

SEQ ID NO: 68703 - RNA, 22 nt, Human
aaaaaaacuaauuuuaaaugug

SEQ ID NO: 68704 - RNA, 20 nt, Human
aaaaauguguuuauggagau

SEQ ID NO: 68705 - RNA, 22 nt, Human
aaaagauguaaacauauauuaa

SEQ ID NO: 68706 - RNA, 22 nt, Human
aaaaacuuaccccagggcaagg

SEQ ID NO: 68707 - RNA, 22 nt, Human
aaacuuuaggcacauggaucua

SEQ ID NO: 68708 - RNA, 22 nt, Human
aaagacucaauuguucccuaau

SEQ ID NO: 68709 - RNA, 22 nt, Human
aaacugugcagucacauaagga

SEQ ID NO: 68710 - RNA, 22 nt, Human
aaagaacguuucugggaaucag

SEQ ID NO: 68711 - RNA, 21 nt, Human
aaagaagagcucagagguaga

SEQ ID NO: 68712 - RNA, 22 nt, Human
aaagagcugccaagguuacagu

SEQ ID NO: 68713 - RNA, 22 nt, Human
aaacucaucaguuuagaaaccu

SEQ ID NO: 68714 - RNA, 22 nt, Human
aaacuagaacagagagagaagc

SEQ ID NO: 68715 - RNA, 20 nt, Human
aaacucuuuucuuacauuuu

SEQ ID NO: 68716 - RNA, 22 nt, Human
aaacugcuuucucugccuuucc

SEQ ID NO: 68717 - RNA, 22 nt, Human
aaacucuaagacuaaaauugaa

SEQ ID NO: 68718 - RNA, 22 nt, Human
aaacucaugccagagaacuuaa

SEQ ID NO: 68719 - RNA, 21 nt, Human
aaagaaguuaguucagugguu

SEQ ID NO: 68720 - RNA, 22 nt, Human
aaaaggaacaauaugguauuuu

SEQ ID NO: 68721 - RNA, 22 nt, Human
aaaagcucucuucuucggcuuu

SEQ ID NO: 68722 - RNA, 22 nt, Human
aaaagcgaagagaacugaaguu

SEQ ID NO: 68723 - RNA, 22 nt, Human
aaaauaaccuucauuugcauug

SEQ ID NO: 68724 - RNA, 22 nt, Human
aaacaauaauaauuaggaagga

SEQ ID NO: 68725 - RNA, 22 nt, Human
aaaauauguugagauacugaaa

SEQ ID NO: 68726 - RNA, 22 nt, Human
aaaauauaaaggauguggguuu

SEQ ID NO: 68727 - RNA, 22 nt, Human
aaaccagaguucauaguauuca

SEQ ID NO: 68728 - RNA, 21 nt, Human
aaacaugcagccugccaauuc

SEQ ID NO: 68729 - RNA, 18 nt, Human
aaacauggcuuaaaggcu

SEQ ID NO: 68730 - RNA, 22 nt, Human
aaacccuagcguuguuuauuga

SEQ ID NO: 68731 - RNA, 22 nt, Human
aaacagguuugaacuucuuaac

SEQ ID NO: 68732 - RNA, 22 nt, Human
aaaauacuaggaaaauaaauca

SEQ ID NO: 68733 - RNA, 23 nt, Human
aaugaguugggcagcauacaggc

SEQ ID NO: 68734 - RNA, 22 nt, Human
aaugaguuuguucuauuauuug

SEQ ID NO: 68735 - RNA, 22 nt, Human
aaugaguucaucugaauucugg

SEQ ID NO: 68736 - RNA, 22 nt, Human
aaugagauaagaaaaccuuugc

SEQ ID NO: 68737 - RNA, 22 nt, Human
aaugcauacguguuuguggcaa

SEQ ID NO: 68738 - RNA, 22 nt, Human
aaugauuuucugcaaacaguga

SEQ ID NO: 68739 - RNA, 22 nt, Human
aaugcagaugugucuuuaauuu

SEQ ID NO: 68740 - RNA, 22 nt, Human
aaugaaaaucugucaguucaag

SEQ ID NO: 68741 - RNA, 22 nt, Human
aaugacagccuauacugucugc

SEQ ID NO: 68742 - RNA, 22 nt, Human
aaugaacuuugaagauggugaa

SEQ ID NO: 68743 - RNA, 22 nt, Human
aaugacaguggcacagucacuu

SEQ ID NO: 68744 - RNA, 22 nt, Human
aaugagaauguaagugaagaga

SEQ ID NO: 68745 - RNA, 22 nt, Human
aaugagauggaggacucuuaau

SEQ ID NO: 68746 - RNA, 22 nt, Human
aaugaacuuucaguucagagag

SEQ ID NO: 68747 - RNA, 22 nt, Human
aaucuuuuugaaggaggagaga

SEQ ID NO: 68748 - RNA, 22 nt, Human
aaucuuguucaacauuaucugu

SEQ ID NO: 68749 - RNA, 22 nt, Human
aaucuguugucaggaauccaca

SEQ ID NO: 68750 - RNA, 22 nt, Human
aaucugugugugagaaauggca

SEQ ID NO: 68751 - RNA, 22 nt, Human
aaucucuugggaagagugagug

SEQ ID NO: 68752 - RNA, 22 nt, Human
aaucugugaggaauaaugaguu

SEQ ID NO: 68753 - RNA, 22 nt, Human
aaucaaagccugcaaguugacu

SEQ ID NO: 68754 - RNA, 22 nt, Human
aaucuacaaugaaaaaauguuu

SEQ ID NO: 68755 - RNA, 22 nt, Human
aaucuagagaacuguggggcag

SEQ ID NO: 68756 - RNA, 22 nt, Human
aaucucguuaugaagaugguug

SEQ ID NO: 68757 - RNA, 22 nt, Human
aauguaguuuacugugagugca

SEQ ID NO: 68758 - RNA, 22 nt, Human
aauguucucuaaucuuucucuu

SEQ ID NO: 68759 - RNA, 22 nt, Human
aauguuguaaauauucuuugag

SEQ ID NO: 68760 - RNA, 23 nt, Human
aauguugaggguggguuuuuaac

SEQ ID NO: 68761 - RNA, 22 nt, Human
aauguugaaccuuuuuggccug

SEQ ID NO: 68762 - RNA, 22 nt, Human
aauguuugaacuuugcauauuu

SEQ ID NO: 68763 - RNA, 22 nt, Human
aauguuuaagcuuuuauuuaca

SEQ ID NO: 68764 - RNA, 22 nt, Human
aauguuuaguuuuauuuuagua

SEQ ID NO: 68765 - RNA, 22 nt, Human
aauuagaagcuguuagcaaaau

SEQ ID NO: 68766 - RNA, 22 nt, Human
aauuauguuugcuuuagaugga

SEQ ID NO: 68767 - RNA, 22 nt, Human
aauucaacagucaguuaucuca

SEQ ID NO: 68768 - RNA, 22 nt, Human
aauucaggacaaauguuuucaa

SEQ ID NO: 68769 - RNA, 21 nt, Human
aauucccagaaacagcacaag

SEQ ID NO: 68770 - RNA, 21 nt, Human
aauuauuugcauuuuucuugu

SEQ ID NO: 68771 - RNA, 22 nt, Human
aauggaaaggagccugacuaua

SEQ ID NO: 68772 - RNA, 22 nt, Human
aauggaccuuaaauugcuucag

SEQ ID NO: 68773 - RNA, 22 nt, Human
aauggacuucucugagccuguu

SEQ ID NO: 68774 - RNA, 22 nt, Human
aaugcuaaagaagaaggaguag

SEQ ID NO: 68775 - RNA, 22 nt, Human
aauggagaaaagacaauguuga

SEQ ID NO: 68776 - RNA, 22 nt, Human
aauggcaaaaguuucggaaauu

SEQ ID NO: 68777 - RNA, 22 nt, Human
aauggcaagccacaugcuuuuc

SEQ ID NO: 68778 - RNA, 22 nt, Human
aauguacucgaaugauguuaag

SEQ ID NO: 68779 - RNA, 22 nt, Human
aauguacucuguguuucucaug

SEQ ID NO: 68780 - RNA, 22 nt, Human
aauguauuuuuaggcagaauau

SEQ ID NO: 68781 - RNA, 22 nt, Human
aauguaaauaauuguaaaauuu

SEQ ID NO: 68782 - RNA, 22 nt, Human
aaugggauaggucuucaggaau

SEQ ID NO: 68783 - RNA, 22 nt, Human
aauggcuagcauguaaaauauc

SEQ ID NO: 68784 - RNA, 22 nt, Human
aaugguagaguauuuuaauccu

SEQ ID NO: 68785 - RNA, 22 nt, Human
aauaauuuuuuugugauuaugu

SEQ ID NO: 68786 - RNA, 22 nt, Human
aauacagauggcaugugaagau

SEQ ID NO: 68787 - RNA, 21 nt, Human
aaguuucucccuaauuguugc

SEQ ID NO: 68788 - RNA, 22 nt, Human
aauaagagaauaaaaucuguua

SEQ ID NO: 68789 - RNA, 22 nt, Human
aauaacuuacucuaugcuuagu

SEQ ID NO: 68790 - RNA, 22 nt, Human
aauagaguccuguacugaauga

SEQ ID NO: 68791 - RNA, 22 nt, Human
aauagguaaaugaguaagaaau

SEQ ID NO: 68792 - RNA, 22 nt, Human
aauaggaaggaaauguuuaccu

SEQ ID NO: 68793 - RNA, 22 nt, Human
aauaucuagccuuuagcagcuu

SEQ ID NO: 68794 - RNA, 22 nt, Human
aauaucuugaguuauaaauuca

SEQ ID NO: 68795 - RNA, 22 nt, Human
aauauagagcagaucuggcucu

SEQ ID NO: 68796 - RNA, 21 nt, Human
aaguccaauaccuaaggcucc

SEQ ID NO: 68797 - RNA, 22 nt, Human
aagucauuaucucuucuaaucu

SEQ ID NO: 68798 - RNA, 22 nt, Human
aaguauuccccaaguauucugg

SEQ ID NO: 68799 - RNA, 22 nt, Human
aaguagaaaaccgcacuggacu

SEQ ID NO: 68800 - RNA, 22 nt, Human
aaguucuuauguucugaugugc

SEQ ID NO: 68801 - RNA, 22 nt, Human
aaguguucucuguuuuaucuac

SEQ ID NO: 68802 - RNA, 22 nt, Human
aaguuaauugcuucuaguuaau

SEQ ID NO: 68803 - RNA, 20 nt, Human
aaguugaaguuacuucaugg

SEQ ID NO: 68804 - RNA, 22 nt, Human
aaguugaaugucuugcugaaug

SEQ ID NO: 68805 - RNA, 22 nt, Human
aagugguuuauuguaugguuuu

SEQ ID NO: 68806 - RNA, 22 nt, Human
aaguguggguaagcauuucuug

SEQ ID NO: 68807 - RNA, 22 nt, Human
aagugugugugcgcaugugcau

SEQ ID NO: 68808 - RNA, 22 nt, Human
aagguuuuguaugaaaucucug

SEQ ID NO: 68809 - RNA, 22 nt, Human
aagguggugaucaucuugaagg

SEQ ID NO: 68810 - RNA, 22 nt, Human
aaguaauuugugaaggcauguu

SEQ ID NO: 68811 - RNA, 22 nt, Human
aaguaacuggggagggagggug

SEQ ID NO: 68812 - RNA, 22 nt, Human
aagguauaaauaacucgggagg

SEQ ID NO: 68813 - RNA, 22 nt, Human
aagggaauagagcagcaaaaau

SEQ ID NO: 68814 - RNA, 22 nt, Human
aagggaaaagcugaaugagaug

SEQ ID NO: 68815 - RNA, 22 nt, Human
aagggaaacagccaggcccugu

SEQ ID NO: 68816 - RNA, 22 nt, Human
aagggaccucagcaaucaggga

SEQ ID NO: 68817 - RNA, 22 nt, Human
aaggcuuugugcugaguugucg

SEQ ID NO: 68818 - RNA, 19 nt, Human
aaggcuuucugagugaaaa

SEQ ID NO: 68819 - RNA, 22 nt, Human
aaggcacauauuuuagagucac

SEQ ID NO: 68820 - RNA, 22 nt, Human
aaggcacuugcccagagcugca

SEQ ID NO: 68821 - RNA, 22 nt, Human
aaggauguuuaaacuacuuucc

SEQ ID NO: 68822 - RNA, 22 nt, Human
aaggaggugauucaccuuuugg

SEQ ID NO: 68823 - RNA, 22 nt, Human
aaggaguggugaagucagaugu

SEQ ID NO: 68824 - RNA, 22 nt, Human
aaggaucuuucuuuuuaccauu

SEQ ID NO: 68825 - RNA, 22 nt, Human
aagccuuagauuggcgaugucg

SEQ ID NO: 68826 - RNA, 22 nt, Human
aagccucaugccagauccaggu

SEQ ID NO: 68827 - RNA, 22 nt, Human
aagccuguugacagcugucagu

SEQ ID NO: 68828 - RNA, 22 nt, Human
aagcaggaaaugaaaugcuugc

SEQ ID NO: 68829 - RNA, 22 nt, Human
aagcauaucaaguuuuaugugc

SEQ ID NO: 68830 - RNA, 22 nt, Human
aagcaguuuagucaucgggauu

SEQ ID NO: 68831 - RNA, 22 nt, Human
aagauuugaaaguggugcauuu

SEQ ID NO: 68832 - RNA, 22 nt, Human
aagcauuuuagauaaagcauca

SEQ ID NO: 68833 - RNA, 22 nt, Human
aagcccucagagccucuuugac

SEQ ID NO: 68834 - RNA, 22 nt, Human
aagcagaacuguuuuguuuucu

SEQ ID NO: 68835 - RNA, 22 nt, Human
aagcagcauaugacagcaucca

SEQ ID NO: 68836 - RNA, 22 nt, Human
aagcaauucacaguucacuuaa

SEQ ID NO: 68837 - RNA, 22 nt, Human
aagauguuguagauuagugaga

SEQ ID NO: 68838 - RNA, 22 nt, Human
aagaugcuucaugagaguuggg

SEQ ID NO: 68839 - RNA, 22 nt, Human
aagcagaaaaacugagcuccaa

SEQ ID NO: 68840 - RNA, 22 nt, Human
aagaggaggacgguucccagaa

SEQ ID NO: 68841 - RNA, 22 nt, Human
aagaggaggcuggaauccuaaa

SEQ ID NO: 68842 - RNA, 22 nt, Human
aagaggaauaauaaaaauugca

SEQ ID NO: 68843 - RNA, 22 nt, Human
aagagcuuguuaugcugcucuu

SEQ ID NO: 68844 - RNA, 22 nt, Human
aagagaaaugcuuuaacuuuau

SEQ ID NO: 68845 - RNA, 22 nt, Human
aagagaggaaagggugugaggu

SEQ ID NO: 68846 - RNA, 22 nt, Human
aagauuuaccacuuuauucaag

SEQ ID NO: 68847 - RNA, 22 nt, Human
aagagaaaaaucuuaaucuagu

SEQ ID NO: 68848 - RNA, 22 nt, Human
aagagugaguagcuugguuggu

SEQ ID NO: 68849 - RNA, 22 nt, Human
aagacccuaccccuggagagga

SEQ ID NO: 68850 - RNA, 22 nt, Human
aagaccacaggaaucaaacagg

SEQ ID NO: 68851 - RNA, 22 nt, Human
aagaaaagaaacauggguaugc

SEQ ID NO: 68852 - RNA, 23 nt, Human
aagaaugcuucugaagagcugcc

SEQ ID NO: 68853 - RNA, 22 nt, Human
aagacacuuucuaaauagaagu

SEQ ID NO: 68854 - RNA, 22 nt, Human
aagaagagaauauauuuacguc

SEQ ID NO: 68855 - RNA, 22 nt, Human
aagaacaugggugugggcauuc

SEQ ID NO: 68856 - RNA, 22 nt, Human
aagaaggaaggcaagagauggg

SEQ ID NO: 68857 - RNA, 22 nt, Human
aagaagguugaaugacuacuuu

SEQ ID NO: 68858 - RNA, 22 nt, Human
aacuucuggaaacuuccaugug

SEQ ID NO: 68859 - RNA, 22 nt, Human
aacuuuacagacuagagcuuuc

SEQ ID NO: 68860 - RNA, 22 nt, Human
aagaaaggagauauucuuuuag

SEQ ID NO: 68861 - RNA, 22 nt, Human
aagaaaccauauuaguuccugg

SEQ ID NO: 68862 - RNA, 19 nt, Human
aagaacaguucuaauuuca

SEQ ID NO: 68863 - RNA, 22 nt, Human
aacuuuuaugaaggaaaucaua

SEQ ID NO: 68864 - RNA, 22 nt, Human
aacuuucagaauccuaugcauu

SEQ ID NO: 68865 - RNA, 22 nt, Human
aacuuucugaaaagcuugauca

SEQ ID NO: 68866 - RNA, 20 nt, Human
aacuuugagugcaugacuuu

SEQ ID NO: 68867 - RNA, 22 nt, Human
aacuuuuucuuaggggaaagca

SEQ ID NO: 68868 - RNA, 22 nt, Human
aacuuucuuugcaucuaaguuu

SEQ ID NO: 68869 - RNA, 21 nt, Human
aacuuucccaauccagauuug

SEQ ID NO: 68870 - RNA, 22 nt, Human
aacucugacgcugucaaauaca

SEQ ID NO: 68871 - RNA, 22 nt, Human
aacuuaaacaagcucccaaguu

SEQ ID NO: 68872 - RNA, 22 nt, Human
aacugggugauucaggcuguuu

SEQ ID NO: 68873 - RNA, 22 nt, Human
aagaaaagcaucuuuguaguag

SEQ ID NO: 68874 - RNA, 22 nt, Human
aacuuauacccagggcagaaau

SEQ ID NO: 68875 - RNA, 22 nt, Human
aacucaggagagaguaacaggg

SEQ ID NO: 68876 - RNA, 22 nt, Human
aacuguugucacgaauguggcu

SEQ ID NO: 68877 - RNA, 19 nt, Human
aacucugccgaggcaagcc

SEQ ID NO: 68878 - RNA, 23 nt, Human
aacucuggcuagcauagaauaga

SEQ ID NO: 68879 - RNA, 22 nt, Human
aacuuguaaugaaaggcaauag

SEQ ID NO: 68880 - RNA, 22 nt, Human
aacucccucaacuuccuucucu

SEQ ID NO: 68881 - RNA, 22 nt, Human
aacucgaugcaauucacuuugu

SEQ ID NO: 68882 - RNA, 22 nt, Human
aacucugagaaacuugcaguug

SEQ ID NO: 68883 - RNA, 22 nt, Human
aacucugcaaugaaaucauguu

SEQ ID NO: 68884 - RNA, 21 nt, Human
aacuaaugacugcagcaggaa

SEQ ID NO: 68885 - RNA, 22 nt, Human
aacugagugcuacauugugauu

SEQ ID NO: 68886 - RNA, 22 nt, Human
aacgcagagaguaaugcugaac

SEQ ID NO: 68887 - RNA, 22 nt, Human
aacgugcuuuacaaaugaccuu

SEQ ID NO: 68888 - RNA, 19 nt, Human
aacuacagcgcacuguccu

SEQ ID NO: 68889 - RNA, 22 nt, Human
aaccuggguguacauuaugguc

SEQ ID NO: 68890 - RNA, 22 nt, Human
aaccucuuugugaaugucauga

SEQ ID NO: 68891 - RNA, 21 nt, Human
aacuauuaauaccauuagcaa

SEQ ID NO: 68892 - RNA, 22 nt, Human
aacuacucugggguggcagguu

SEQ ID NO: 68893 - RNA, 22 nt, Human
aaccuuauuguguaucaccaua

SEQ ID NO: 68894 - RNA, 22 nt, Human
aacgauuugaguuaguuuuuag

SEQ ID NO: 68895 - RNA, 22 nt, Human
aacgcaacaacuggagcuguag

SEQ ID NO: 68896 - RNA, 22 nt, Human
aaccuagaggaagaugggucag

SEQ ID NO: 68897 - RNA, 22 nt, Human
aaccuggaggaccuuaugcuaa

SEQ ID NO: 68898 - RNA, 22 nt, Human
aaccauauugauuauguuuuau

SEQ ID NO: 68899 - RNA, 22 nt, Human
aaccaauaagaggaugccauuu

SEQ ID NO: 68900 - RNA, 20 nt, Human
aaccuauuguaauauucuaa

SEQ ID NO: 68901 - RNA, 22 nt, Human
aaccaaucaaauuggaauugaa

SEQ ID NO: 68902 - RNA, 22 nt, Human
aacaucaaaggaagaaugauau

SEQ ID NO: 68903 - RNA, 22 nt, Human
aacagguucaucuuggaagcag

SEQ ID NO: 68904 - RNA, 22 nt, Human
aacaguacaucaugaggucauc

SEQ ID NO: 68905 - RNA, 22 nt, Human
aacccacuaugauuguccucau

SEQ ID NO: 68906 - RNA, 22 nt, Human
aacauuguggacaagggcaggu

SEQ ID NO: 68907 - RNA, 22 nt, Human
aacccugaacuuaguucuagga

SEQ ID NO: 68908 - RNA, 22 nt, Human
aacacuaaaggucaguuagaag

SEQ ID NO: 68909 - RNA, 22 nt, Human
aacagagauucuucccuucuuu

SEQ ID NO: 68910 - RNA, 22 nt, Human
aaccagaagucaucagagcuga

SEQ ID NO: 68911 - RNA, 22 nt, Human
aacaggaagaauccagauggug

SEQ ID NO: 68912 - RNA, 22 nt, Human
aacagaaaucauuuagggcucu

SEQ ID NO: 68913 - RNA, 22 nt, Human
aacagaauaucaaaagauuaug

SEQ ID NO: 68914 - RNA, 21 nt, Human
aacaaaagggaagaacagcug

SEQ ID NO: 68915 - RNA, 22 nt, Human
aaauuuuguugaaaaauauuuu

SEQ ID NO: 68916 - RNA, 22 nt, Human
aaauugcauuuuaaagguagau

SEQ ID NO: 68917 - RNA, 22 nt, Human
aacaaguagaauagguuuuuuu

SEQ ID NO: 68918 - RNA, 21 nt, Human
aaauuucauauggccaaccua

SEQ ID NO: 68919 - RNA, 22 nt, Human
aacacaucagcacacuaacgga

SEQ ID NO: 68920 - RNA, 22 nt, Human
aacacaguuucucuaugagagu

SEQ ID NO: 68921 - RNA, 22 nt, Human
aacacuguaucagucuucaaua

SEQ ID NO: 68922 - RNA, 22 nt, Human
aaauguuugguggauaaaagga

SEQ ID NO: 68923 - RNA, 22 nt, Human
aaauguuucauucuauuuuuag

SEQ ID NO: 68924 - RNA, 22 nt, Human
aaauucuuccaggaggaaauac

SEQ ID NO: 68925 - RNA, 20 nt, Human
aaauucgacuaaaaccagaa

SEQ ID NO: 68926 - RNA, 22 nt, Human
aaauucagcagguuucaaaagc

SEQ ID NO: 68927 - RNA, 22 nt, Human
aaauucagauggcuuucuuuuc

SEQ ID NO: 68928 - RNA, 22 nt, Human
aaagaccuucacuuucuggcug

SEQ ID NO: 68929 - RNA, 22 nt, Human
aaagacuaaccaguugucaaaa

SEQ ID NO: 68930 - RNA, 23 nt, Human
aaagaggugaauccaggacaagc

SEQ ID NO: 68931 - RNA, 22 nt, Human
aaagaggacgugcuauuuuuua

SEQ ID NO: 68932 - RNA, 23 nt, Human
aaagacuagaagccguggcugca

SEQ ID NO: 68933 - RNA, 22 nt, Human
aaagaccaagagccccaaguuu

SEQ ID NO: 68934 - RNA, 20 nt, Human
aaagauacuuuuuguaaugg

SEQ ID NO: 68935 - RNA, 22 nt, Human
aaagagacaacaacaacuucua

SEQ ID NO: 68936 - RNA, 22 nt, Human
aaagaucaguuaacgccaucaa

SEQ ID NO: 68937 - RNA, 22 nt, Human
aaaugcuuuaauugaguucaug

SEQ ID NO: 68938 - RNA, 22 nt, Human
aaauggaaguuuguucucagcc

SEQ ID NO: 68939 - RNA, 22 nt, Human
aaagaugaaguucagcgaagaa

SEQ ID NO: 68940 - RNA, 22 nt, Human
aaaucugaaggaaacagcuuca

SEQ ID NO: 68941 - RNA, 22 nt, Human
acauuuguuucucuagaguagg

SEQ ID NO: 68942 - RNA, 22 nt, Human
acauuuuaccaucuguggauga

SEQ ID NO: 68943 - RNA, 22 nt, Human
acauuuccaaagaugccaguca

SEQ ID NO: 68944 - RNA, 22 nt, Human
accaccacugacaccagcucgg

SEQ ID NO: 68945 - RNA, 22 nt, Human
acauuguuauuccucaggaguu

SEQ ID NO: 68946 - RNA, 22 nt, Human
accaauguucaaccuugacugc

SEQ ID NO: 68947 - RNA, 22 nt, Human
accaauaaaagcaauucacagu

SEQ ID NO: 68948 - RNA, 22 nt, Human
acauuagaugacucuuucuuuc

SEQ ID NO: 68949 - RNA, 22 nt, Human
acauuccugaagguaaugagaa

SEQ ID NO: 68950 - RNA, 22 nt, Human
acauuuuuggguugaugucuga

SEQ ID NO: 68951 - RNA, 22 nt, Human
accaacuuuccaaagugccugg

SEQ ID NO: 68952 - RNA, 22 nt, Human
accaagaguccaagugagguug

SEQ ID NO: 68953 - RNA, 22 nt, Human
accauccaaaagcuuuucauca

SEQ ID NO: 68954 - RNA, 22 nt, Human
acauuuuguuuauggaaaagau

SEQ ID NO: 68955 - RNA, 22 nt, Human
accaguuaaagaauaugaggcc

SEQ ID NO: 68956 - RNA, 22 nt, Human
accccuacugaaauuuccuggu

SEQ ID NO: 68957 - RNA, 22 nt, Human
accaccacauaguaggcacuua

SEQ ID NO: 68958 - RNA, 22 nt, Human
acauuuuaaaaacaguaccugg

SEQ ID NO: 68959 - RNA, 22 nt, Human
acauggacugguccauuaugac

SEQ ID NO: 68960 - RNA, 22 nt, Human
acauuugauauggaguugugua

SEQ ID NO: 68961 - RNA, 22 nt, Human
acauuuugggagaaaguuguua

SEQ ID NO: 68962 - RNA, 22 nt, Human
acauuguuuuugugacuucuau

SEQ ID NO: 68963 - RNA, 22 nt, Human
acauuucuccuacuuguuauuu

SEQ ID NO: 68964 - RNA, 22 nt, Human
acaugcuuucuagguccuucug

SEQ ID NO: 68965 - RNA, 22 nt, Human
acaugaguuacuuccgauuccc

SEQ ID NO: 68966 - RNA, 22 nt, Human
acaucuucuauggagguucgga

SEQ ID NO: 68967 - RNA, 22 nt, Human
acauucucuuuuagaaagcugu

SEQ ID NO: 68968 - RNA, 22 nt, Human
acauguuuacaaaccucaagcc

SEQ ID NO: 68969 - RNA, 23 nt, Human
acauuacacgcaguaauugcccc

SEQ ID NO: 68970 - RNA, 22 nt, Human
acaucuaugucugaggccuugg

SEQ ID NO: 68971 - RNA, 22 nt, Human
acauccaguaucagaagcauca

SEQ ID NO: 68972 - RNA, 22 nt, Human
acaucccccuacuuguguccug

SEQ ID NO: 68973 - RNA, 19 nt, Human
acaguucuguggccuguuc

SEQ ID NO: 68974 - RNA, 22 nt, Human
acaguuuuccuugguauagaac

SEQ ID NO: 68975 - RNA, 22 nt, Human
acaguuuucugagaaucacagg

SEQ ID NO: 68976 - RNA, 22 nt, Human
acauggcaugaauaauguguac

SEQ ID NO: 68977 - RNA, 16 nt, Human
acauggcacacaguuu

SEQ ID NO: 68978 - RNA, 22 nt, Human
aauucuuuguuccucugccaag

SEQ ID NO: 68979 - RNA, 22 nt, Human
aauugauauuagauuugucuca

SEQ ID NO: 68980 - RNA, 22 nt, Human
acaugcacagcaagggugagag

SEQ ID NO: 68981 - RNA, 22 nt, Human
acagugugcaagaaauggggga

SEQ ID NO: 68982 - RNA, 22 nt, Human
acaguguuacuugauaguguau

SEQ ID NO: 68983 - RNA, 22 nt, Human
acaguuagguccuaaaauucug

SEQ ID NO: 68984 - RNA, 22 nt, Human
aauucuaaugaguucuuaucua

SEQ ID NO: 68985 - RNA, 22 nt, Human
aauucugcagucguacuauaau

SEQ ID NO: 68986 - RNA, 22 nt, Human
aauucgcugcauuccaucuagg

SEQ ID NO: 68987 - RNA, 22 nt, Human
aauucagguuauauuugcaacu

SEQ ID NO: 68988 - RNA, 22 nt, Human
aauucugaggccauuuauuucc

SEQ ID NO: 68989 - RNA, 22 nt, Human
acuaaguagaggagugaugauu

SEQ ID NO: 68990 - RNA, 22 nt, Human
acuaauuguuuaaggauaggaa

SEQ ID NO: 68991 - RNA, 22 nt, Human
acuaaacauaucacugcuuuac

SEQ ID NO: 68992 - RNA, 22 nt, Human
acgucaucguugucaucgucau

SEQ ID NO: 68993 - RNA, 22 nt, Human
acgguuuugugagguaguacuu

SEQ ID NO: 68994 - RNA, 22 nt, Human
acgggggagucuuuuacaucau

SEQ ID NO: 68995 - RNA, 22 nt, Human
accuuggauauucuuacucggu

SEQ ID NO: 68996 - RNA, 19 nt, Human
accuguucaaccucgugcu

SEQ ID NO: 68997 - RNA, 22 nt, Human
accuuaaacagauggcggcugg

SEQ ID NO: 68998 - RNA, 22 nt, Human
accuggacucugaucacuuuug

SEQ ID NO: 68999 - RNA, 22 nt, Human
accuuaagugauuaugacauau

SEQ ID NO: 69000 - RNA, 20 nt, Human
accuucuuugguagacggaa

SEQ ID NO: 69001 - RNA, 22 nt, Human
accuucugaccucucggacuuc

SEQ ID NO: 69002 - RNA, 22 nt, Human
acgaggauuuccuuagaugaaa

SEQ ID NO: 69003 - RNA, 22 nt, Human
acgauaacaauaguagcaugua

SEQ ID NO: 69004 - RNA, 22 nt, Human
accucuuuuugaauauagcauu

SEQ ID NO: 69005 - RNA, 22 nt, Human
accucuuucuauggauuuuuug

SEQ ID NO: 69006 - RNA, 22 nt, Human
accuccauggcucagguuccaa

SEQ ID NO: 69007 - RNA, 22 nt, Human
accgauguggaaaauuucauuu

SEQ ID NO: 69008 - RNA, 22 nt, Human
accucauucugcauagaacuuu

SEQ ID NO: 69009 - RNA, 22 nt, Human
accuaucugcuggauuuguugu

SEQ ID NO: 69010 - RNA, 22 nt, Human
acccuucugugaccugccuguc

SEQ ID NO: 69011 - RNA, 22 nt, Human
accccuauugcuugugauuaug

SEQ ID NO: 69012 - RNA, 21 nt, Human
acccagaauggagccaagccu

SEQ ID NO: 69013 - RNA, 22 nt, Human
accauaguuauaacaaaguguu

SEQ ID NO: 69014 - RNA, 22 nt, Human
accauaugaagaucacacuauc

SEQ ID NO: 69015 - RNA, 23 nt, Human
agauaaggaagcauuugagccag

SEQ ID NO: 69016 - RNA, 22 nt, Human
agaguguaauuaguauuuauau

SEQ ID NO: 69017 - RNA, 19 nt, Human
agagucuccacuccacuug

SEQ ID NO: 69018 - RNA, 22 nt, Human
agaguguggaaauguucagagu

SEQ ID NO: 69019 - RNA, 21 nt, Human
agaguaacucagugaaaaaua

SEQ ID NO: 69020 - RNA, 22 nt, Human
agaguagucuuuacucuuccaa

SEQ ID NO: 69021 - RNA, 22 nt, Human
agagugagauaugugguuggua

SEQ ID NO: 69022 - RNA, 22 nt, Human
agaguaauguggaguuugugcu

SEQ ID NO: 69023 - RNA, 23 nt, Human
agagggaagagcuuagaugggga

SEQ ID NO: 69024 - RNA, 22 nt, Human
agaggcuuuccuaagauugguu

SEQ ID NO: 69025 - RNA, 22 nt, Human
agaggcaugaacucccguagcc

SEQ ID NO: 69026 - RNA, 22 nt, Human
agaggcaggcagcagagaagau

SEQ ID NO: 69027 - RNA, 22 nt, Human
agagcuuagaggaccuucgugc

SEQ ID NO: 69028 - RNA, 22 nt, Human
agaggaauuauugaguuagauu

SEQ ID NO: 69029 - RNA, 22 nt, Human
agagcagcaaucuuugaaauua

SEQ ID NO: 69030 - RNA, 22 nt, Human
agaggagaauguaaauuuguca

SEQ ID NO: 69031 - RNA, 22 nt, Human
agagcuuuggaguaaguuuuga

SEQ ID NO: 69032 - RNA, 22 nt, Human
agacuucucuaacuugaggacc

SEQ ID NO: 69033 - RNA, 22 nt, Human
agagaguacuuucaucagggaa

SEQ ID NO: 69034 - RNA, 22 nt, Human
agagauuagagaagaugauaaa

SEQ ID NO: 69035 - RNA, 22 nt, Human
agagauugagcucagaagaccu

SEQ ID NO: 69036 - RNA, 22 nt, Human
agagauggugaugaggaaaaau

SEQ ID NO: 69037 - RNA, 22 nt, Human
agagauuuacaacuugggcuuu

SEQ ID NO: 69038 - RNA, 22 nt, Human
agagcaauggugcuuuaauucu

SEQ ID NO: 69039 - RNA, 23 nt, Human
agagccuaauaucuaaucuuugu

SEQ ID NO: 69040 - RNA, 22 nt, Human
agagccuaguauggacucuuag

SEQ ID NO: 69041 - RNA, 22 nt, Human
agagccggagucuucuuguuug

SEQ ID NO: 69042 - RNA, 22 nt, Human
agagccaugcuugugcauauau

SEQ ID NO: 69043 - RNA, 22 nt, Human
agagcagauggagcuggaagag

SEQ ID NO: 69044 - RNA, 22 nt, Human
agagacaggguuuugucguguu

SEQ ID NO: 69045 - RNA, 22 nt, Human
agagaaccauggcauccaggua

SEQ ID NO: 69046 - RNA, 22 nt, Human
agagaauuugggaauauaaauc

SEQ ID NO: 69047 - RNA, 22 nt, Human
agagacauagcacaguuuuucg

SEQ ID NO: 69048 - RNA, 22 nt, Human
agagaccugaaugaguugaaca

SEQ ID NO: 69049 - RNA, 22 nt, Human
agacuauuuugugauaacuaau

SEQ ID NO: 69050 - RNA, 22 nt, Human
agagaacauuuucaggguuuca

SEQ ID NO: 69051 - RNA, 20 nt, Human
agagaacaguuuggucacag

SEQ ID NO: 69052 - RNA, 22 nt, Human
agacuccuucuaagaccucauu

SEQ ID NO: 69053 - RNA, 22 nt, Human
agagacuguaaugagagguaca

SEQ ID NO: 69054 - RNA, 22 nt, Human
agagagggaugguguccagaga

SEQ ID NO: 69055 - RNA, 22 nt, Human
agagacugauggaucaccaaau

SEQ ID NO: 69056 - RNA, 21 nt, Human
agagaccuaagcugagauucc

SEQ ID NO: 69057 - RNA, 22 nt, Human
agagacaagggaccucuggaga

SEQ ID NO: 69058 - RNA, 22 nt, Human
agagaagaauccccugguggag

SEQ ID NO: 69059 - RNA, 22 nt, Human
agacuuuggcagggccaguggu

SEQ ID NO: 69060 - RNA, 22 nt, Human
agagaaacauuaauugaugagg

SEQ ID NO: 69061 - RNA, 22 nt, Human
agagaacaggcagcuggugccg

SEQ ID NO: 69062 - RNA, 22 nt, Human
agagaaauguacuagucuaacu

SEQ ID NO: 69063 - RNA, 22 nt, Human
agacuaauaucccauuucugac

SEQ ID NO: 69064 - RNA, 21 nt, Human
agacuucuacuaucuuaugac

SEQ ID NO: 69065 - RNA, 22 nt, Human
agacgacucuuaaggcagaauu

SEQ ID NO: 69066 - RNA, 22 nt, Human
agacgggacagacuuuugagug

SEQ ID NO: 69067 - RNA, 22 nt, Human
agacuugguaacuagugaagaa

SEQ ID NO: 69068 - RNA, 22 nt, Human
agacuucucuuggcuauauuau

SEQ ID NO: 69069 - RNA, 22 nt, Human
agacuguuuucccaucucuugg

SEQ ID NO: 69070 - RNA, 22 nt, Human
agaccguguguggguugcggug

SEQ ID NO: 69071 - RNA, 22 nt, Human
agacauauuggcuugcuuuaau

SEQ ID NO: 69072 - RNA, 22 nt, Human
agacucuggcaugcuaacuagu

SEQ ID NO: 69073 - RNA, 22 nt, Human
agacuguuccgucagacucagu

SEQ ID NO: 69074 - RNA, 21 nt, Human
agacugaugggaagacucugu

SEQ ID NO: 69075 - RNA, 22 nt, Human
agacauuuggugugaagggagg

SEQ ID NO: 69076 - RNA, 21 nt, Human
agaaugaagaagaggucuuug

SEQ ID NO: 69077 - RNA, 22 nt, Human
agaacaagaaacccgaaaagug

SEQ ID NO: 69078 - RNA, 20 nt, Human
agaaggagagaugaggcaaa

SEQ ID NO: 69079 - RNA, 22 nt, Human
agaacaggaggaagccagcucc

SEQ ID NO: 69080 - RNA, 22 nt, Human
agaaucucuagaaaugggucuc

SEQ ID NO: 69081 - RNA, 22 nt, Human
agaauccugagggaaauuuggc

SEQ ID NO: 69082 - RNA, 22 nt, Human
agaaggcagaaaagcuuuacaa

SEQ ID NO: 69083 - RNA, 22 nt, Human
agacagaaaaguugucaaucau

SEQ ID NO: 69084 - RNA, 22 nt, Human
agacagaacauaauuaguacug

SEQ ID NO: 69085 - RNA, 20 nt, Human
agaaaggaguaaagaagaga

SEQ ID NO: 69086 - RNA, 22 nt, Human
agaaagcacccugcacuuucug

SEQ ID NO: 69087 - RNA, 22 nt, Human
agaagaucccugugguuacgac

SEQ ID NO: 69088 - RNA, 22 nt, Human
agaagcagaaggaagcagggcc

SEQ ID NO: 69089 - RNA, 22 nt, Human
agaagcauaagggcuuugccag

SEQ ID NO: 69090 - RNA, 22 nt, Human
agaaauggggugaagcaaaugg

SEQ ID NO: 69091 - RNA, 22 nt, Human
agaagcaaagcaaacacauucu

SEQ ID NO: 69092 - RNA, 22 nt, Human
acuuugagaauuuuacuugugu

SEQ ID NO: 69093 - RNA, 23 nt, Human
acuuugaggagaagaaugucagu

SEQ ID NO: 69094 - RNA, 22 nt, Human
acuuugccuucuuacuguguug

SEQ ID NO: 69095 - RNA, 22 nt, Human
acuuuuccuggguagcuccugg

SEQ ID NO: 69096 - RNA, 22 nt, Human
acuuuuaauaguagauuuuuaa

SEQ ID NO: 69097 - RNA, 22 nt, Human
agaaaagaggcuuucuaagcau

SEQ ID NO: 69098 - RNA, 22 nt, Human
acuuuugaguuacauaccugaa

SEQ ID NO: 69099 - RNA, 22 nt, Human
acuugauggaguuucacuguau

SEQ ID NO: 69100 - RNA, 22 nt, Human
acuugcauuguguaguguuuuu

SEQ ID NO: 69101 - RNA, 22 nt, Human
acuugaagcaugaaaauaagcc

SEQ ID NO: 69102 - RNA, 22 nt, Human
acuuuuaaggggccuugauuua

SEQ ID NO: 69103 - RNA, 22 nt, Human
acuuuuagccuucccacaacag

SEQ ID NO: 69104 - RNA, 22 nt, Human
acuuuuuugccaucccuccagc

SEQ ID NO: 69105 - RNA, 22 nt, Human
acugugauuuguuuuuguguuu

SEQ ID NO: 69106 - RNA, 22 nt, Human
acugucuuguuguaugugagcu

SEQ ID NO: 69107 - RNA, 22 nt, Human
acuguuauugguguauguggca

SEQ ID NO: 69108 - RNA, 17 nt, Human
acuuaagacaguggaaa

SEQ ID NO: 69109 - RNA, 22 nt, Human
acuuauaaauuuaguacacugu

SEQ ID NO: 69110 - RNA, 22 nt, Human
acuucaggacggcaguggaggg

SEQ ID NO: 69111 - RNA, 22 nt, Human
acugucauuaaugaauguaaua

SEQ ID NO: 69112 - RNA, 22 nt, Human
acugucaggauugagucucugg

SEQ ID NO: 69113 - RNA, 22 nt, Human
acuggggcaggaaaguaugcug

SEQ ID NO: 69114 - RNA, 22 nt, Human
acuggcuuggaaauggguauuu

SEQ ID NO: 69115 - RNA, 22 nt, Human
acuguccucgaaguaccugugc

SEQ ID NO: 69116 - RNA, 22 nt, Human
acuggggauugguucuucaaca

SEQ ID NO: 69117 - RNA, 19 nt, Human
acuggggcaggcugggcuu

SEQ ID NO: 69118 - RNA, 22 nt, Human
acuggguuguuugucucaugag

SEQ ID NO: 69119 - RNA, 22 nt, Human
acugugauguaaagaaauaggc

SEQ ID NO: 69120 - RNA, 22 nt, Human
acuacuguaauuuauuguuaca

SEQ ID NO: 69121 - RNA, 20 nt, Human
acugcaagagacagaugaaa

SEQ ID NO: 69122 - RNA, 22 nt, Human
acugaucuguguaauauguuac

SEQ ID NO: 69123 - RNA, 22 nt, Human
aggaagagcuggaccagaggac

SEQ ID NO: 69124 - RNA, 20 nt, Human
aggaagauccuuucuuuuaa

SEQ ID NO: 69125 - RNA, 22 nt, Human
agcuugaugaaagugggugcuc

SEQ ID NO: 69126 - RNA, 22 nt, Human
agcuugauggauugcugaggca

SEQ ID NO: 69127 - RNA, 22 nt, Human
agcuuucuauauaugaguugcu

SEQ ID NO: 69128 - RNA, 22 nt, Human
agcuuugcccaaugaguuaugu

SEQ ID NO: 69129 - RNA, 22 nt, Human
agcuuccaaagaccaggauuga

SEQ ID NO: 69130 - RNA, 22 nt, Human
agcuucuucugccuugucccug

SEQ ID NO: 69131 - RNA, 22 nt, Human
agcuguugaccuucccuuucag

SEQ ID NO: 69132 - RNA, 22 nt, Human
agcugugaccuucaagagcuac

SEQ ID NO: 69133 - RNA, 22 nt, Human
aggaaauaggaccagacaaagc

SEQ ID NO: 69134 - RNA, 22 nt, Human
agcuggaaucucggcaaagcgu

SEQ ID NO: 69135 - RNA, 22 nt, Human
aggaaauaguuuagucccaaaa

SEQ ID NO: 69136 - RNA, 22 nt, Human
aggacauuugcuuuuuuucuuu

SEQ ID NO: 69137 - RNA, 22 nt, Human
aggacagagggaccagagccca

SEQ ID NO: 69138 - RNA, 22 nt, Human
aggacguaacccaggacagccu

SEQ ID NO: 69139 - RNA, 20 nt, Human
aggaaggagaaucugagcaa

SEQ ID NO: 69140 - RNA, 22 nt, Human
aggaaaguugagcugucuguag

SEQ ID NO: 69141 - RNA, 22 nt, Human
aggaaauaagggcacuucagau

SEQ ID NO: 69142 - RNA, 22 nt, Human
aggaaaauggaccagaguuguu

SEQ ID NO: 69143 - RNA, 22 nt, Human
aggaaagacgcauuucuguagg

SEQ ID NO: 69144 - RNA, 22 nt, Human
aggaaaguugcuuguagugcug

SEQ ID NO: 69145 - RNA, 22 nt, Human
aggagaaagaccagccugccga

SEQ ID NO: 69146 - RNA, 22 nt, Human
aggauaaaggucauuauuccca

SEQ ID NO: 69147 - RNA, 22 nt, Human
aggagaccugguugugugugug

SEQ ID NO: 69148 - RNA, 22 nt, Human
aggaguuugaaaacuuaacuaa

SEQ ID NO: 69149 - RNA, 23 nt, Human
aggaagucugacacuacagcguu

SEQ ID NO: 69150 - RNA, 19 nt, Human
aggagacuacuucuugcug

SEQ ID NO: 69151 - RNA, 22 nt, Human
aggaauguugagacauggcuaa

SEQ ID NO: 69152 - RNA, 22 nt, Human
aggacacuuccugaguggacaa

SEQ ID NO: 69153 - RNA, 22 nt, Human
aggacuguauacucuaggugaa

SEQ ID NO: 69154 - RNA, 22 nt, Human
aggagacaguuuggacguguag

SEQ ID NO: 69155 - RNA, 22 nt, Human
aggagagaacaagaguauccug

SEQ ID NO: 69156 - RNA, 19 nt, Human
agcugcugauugguggagg

SEQ ID NO: 69157 - RNA, 22 nt, Human
agcugcuaagcugcauaacuua

SEQ ID NO: 69158 - RNA, 20 nt, Human
agcuuucaccaguacuucca

SEQ ID NO: 69159 - RNA, 22 nt, Human
aggaaaaagaagaaaagaauca

SEQ ID NO: 69160 - RNA, 19 nt, Human
agcuuauuuacugcaggac

SEQ ID NO: 69161 - RNA, 22 nt, Human
agcuugaaccuaaaacaauaau

SEQ ID NO: 69162 - RNA, 22 nt, Human
agcugugaccaguuacgaaauu

SEQ ID NO: 69163 - RNA, 22 nt, Human
agcuguaacagguuaauaugga

SEQ ID NO: 69164 - RNA, 22 nt, Human
agcuggauuaaucacagugacu

SEQ ID NO: 69165 - RNA, 22 nt, Human
agcugcuuuacuggucggcugg

SEQ ID NO: 69166 - RNA, 22 nt, Human
agcugagccagacagguaagca

SEQ ID NO: 69167 - RNA, 22 nt, Human
agcugcugcaaguggugcuaac

SEQ ID NO: 69168 - RNA, 22 nt, Human
agcugcuggcggauguuggacu

SEQ ID NO: 69169 - RNA, 22 nt, Human
agcugaugucucaccuguuaga

SEQ ID NO: 69170 - RNA, 20 nt, Human
agcugaauaguuuugugaaa

SEQ ID NO: 69171 - RNA, 22 nt, Human
agcucuguugcggucacaggag

SEQ ID NO: 69172 - RNA, 22 nt, Human
agcucuccuacucucuuucuag

SEQ ID NO: 69173 - RNA, 19 nt, Human
agcuccucaccucucgcgg

SEQ ID NO: 69174 - RNA, 22 nt, Human
agcucugauccuuuaaaggaga

SEQ ID NO: 69175 - RNA, 22 nt, Human
agcucugcuucuugggaagaug

SEQ ID NO: 69176 - RNA, 22 nt, Human
agcuccauauggcacaccauuu

SEQ ID NO: 69177 - RNA, 22 nt, Human
agcucuucugacucuaggcuca

SEQ ID NO: 69178 - RNA, 22 nt, Human
agcucuuccuccauucuggcca

SEQ ID NO: 69179 - RNA, 22 nt, Human
agcugaccugauugcuuuucag

SEQ ID NO: 69180 - RNA, 22 nt, Human
agcucugugcaggcagaggcau

SEQ ID NO: 69181 - RNA, 22 nt, Human
agcucucaccauagugcuuaaa

SEQ ID NO: 69182 - RNA, 22 nt, Human
agcuccugcgcacggugcacac

SEQ ID NO: 69183 - RNA, 22 nt, Human
agcguucuguuccaugcuaaca

SEQ ID NO: 69184 - RNA, 19 nt, Human
agcucaggcccaucguccc

SEQ ID NO: 69185 - RNA, 22 nt, Human
agcucagugugucuaugaggua

SEQ ID NO: 69186 - RNA, 22 nt, Human
agcucccaauugacuugaacua

SEQ ID NO: 69187 - RNA, 22 nt, Human
agcuccucagauuuggguggcg

SEQ ID NO: 69188 - RNA, 22 nt, Human
agcuaaauauuuuuccugacac

SEQ ID NO: 69189 - RNA, 22 nt, Human
agcguaugaauauuugaagaga

SEQ ID NO: 69190 - RNA, 22 nt, Human
agcgagccugugcacuucuaac

SEQ ID NO: 69191 - RNA, 22 nt, Human
agcgcaguuaccgcgcggggcu

SEQ ID NO: 69192 - RNA, 22 nt, Human
agcgcucauuuuccuccugcuc

SEQ ID NO: 69193 - RNA, 22 nt, Human
agccugugcuguguuugcucca

SEQ ID NO: 69194 - RNA, 22 nt, Human
agccgcugaauuugaaacaagc

SEQ ID NO: 69195 - RNA, 22 nt, Human
agccuguacuuagagggauuaa

SEQ ID NO: 69196 - RNA, 22 nt, Human
agcccgggagggcugucuggga

SEQ ID NO: 69197 - RNA, 22 nt, Human
agcccuauacuuagauuuauuc

SEQ ID NO: 69198 - RNA, 22 nt, Human
agcauuuuaaaacuaguuacca

SEQ ID NO: 69199 - RNA, 22 nt, Human
agcauuugcuguucuagaaagu

SEQ ID NO: 69200 - RNA, 22 nt, Human
agccuggagcaggcucugcucu

SEQ ID NO: 69201 - RNA, 22 nt, Human
agccugggucgagagacgagaa

SEQ ID NO: 69202 - RNA, 20 nt, Human
agcauucaacuuucuauguu

SEQ ID NO: 69203 - RNA, 22 nt, Human
agcauucccuuugcagugucau

SEQ ID NO: 69204 - RNA, 22 nt, Human
agcauucuguggucuucuaugg

SEQ ID NO: 69205 - RNA, 22 nt, Human
agcauuucuacugugucagaaa

SEQ ID NO: 69206 - RNA, 22 nt, Human
agcaggaggagagccuggcggu

SEQ ID NO: 69207 - RNA, 22 nt, Human
agcauauaugcaugagugugca

SEQ ID NO: 69208 - RNA, 22 nt, Human
agcaucuaucuucaaugugugu

SEQ ID NO: 69209 - RNA, 19 nt, Human
agcaucuccacagaaaaag

SEQ ID NO: 69210 - RNA, 21 nt, Human
agcaucugaggcaguuuccua

SEQ ID NO: 69211 - RNA, 22 nt, Human
agcagcugagccccagcuguga

SEQ ID NO: 69212 - RNA, 22 nt, Human
agcaggaggguuuuguagaguc

SEQ ID NO: 69213 - RNA, 22 nt, Human
agcaggguggcaagucuuucug

SEQ ID NO: 69214 - RNA, 22 nt, Human
agcagggugugggugugagugu

SEQ ID NO: 69215 - RNA, 22 nt, Human
agcaguugcuuuguauauuaaa

SEQ ID NO: 69216 - RNA, 22 nt, Human
agcaguuuauccucauaaugga

SEQ ID NO: 69217 - RNA, 21 nt, Human
agcagucugcggccggugcgg

SEQ ID NO: 69218 - RNA, 22 nt, Human
agauaagaacauuaguaagccg

SEQ ID NO: 69219 - RNA, 22 nt, Human
agauacaaaagauaagauuuag

SEQ ID NO: 69220 - RNA, 22 nt, Human
agauagaaggauugugacacau

SEQ ID NO: 69221 - RNA, 22 nt, Human
agcagcaggcugggaugagucu

SEQ ID NO: 69222 - RNA, 22 nt, Human
agcagcaggugaccucgaugcc

SEQ ID NO: 69223 - RNA, 22 nt, Human
agcacguucuucauuacuucac

SEQ ID NO: 69224 - RNA, 22 nt, Human
aggagcauuuugguggguuuug

SEQ ID NO: 69225 - RNA, 22 nt, Human
aggagcccggucgucaugguaa

SEQ ID NO: 69226 - RNA, 22 nt, Human
aggagcugccggauggggcaug

SEQ ID NO: 69227 - RNA, 22 nt, Human
aggauauguccuuuuuuucccc

SEQ ID NO: 69228 - RNA, 22 nt, Human
aggauggaaguaacuggauaau

SEQ ID NO: 69229 - RNA, 22 nt, Human
aggauggauagcaaggaagccg

SEQ ID NO: 69230 - RNA, 20 nt, Human
aggcuccuccaggaugugug

SEQ ID NO: 69231 - RNA, 22 nt, Human
aggcucucccacauucauuaca

SEQ ID NO: 69232 - RNA, 22 nt, Human
aggcguggcuucugcuggguug

SEQ ID NO: 69233 - RNA, 22 nt, Human
aggcuaagugauuagugacaua

SEQ ID NO: 69234 - RNA, 19 nt, Human
agggagagucccaagagaa

SEQ ID NO: 69235 - RNA, 22 nt, Human
agggaaauuaaugugagcaaug

SEQ ID NO: 69236 - RNA, 22 nt, Human
agggaaauaggagaagaaagga

SEQ ID NO: 69237 - RNA, 22 nt, Human
agggaggagggacagaaagagg

SEQ ID NO: 69238 - RNA, 22 nt, Human
agggaguuccgaucugugcacc

SEQ ID NO: 69239 - RNA, 22 nt, Human
agggaucccaaggggucucugc

SEQ ID NO: 69240 - RNA, 22 nt, Human
aggcuuagaugaguucccacau

SEQ ID NO: 69241 - RNA, 22 nt, Human
agggaagaggaccagagucucu

SEQ ID NO: 69242 - RNA, 22 nt, Human
agggaagcaggaaguaugggaa

SEQ ID NO: 69243 - RNA, 22 nt, Human
agggaagccggagcgacggggg

SEQ ID NO: 69244 - RNA, 22 nt, Human
aggcgguuggcuuugucugggu

SEQ ID NO: 69245 - RNA, 22 nt, Human
agggaagagaaacaaagauuca

SEQ ID NO: 69246 - RNA, 22 nt, Human
agguauaguuauuucugcuccc

SEQ ID NO: 69247 - RNA, 22 nt, Human
agguccugucuuaucucuguaa

SEQ ID NO: 69248 - RNA, 22 nt, Human
aggucuacaugcuuaauauauc

SEQ ID NO: 69249 - RNA, 22 nt, Human
agguagaaggaccagaauuuau

SEQ ID NO: 69250 - RNA, 22 nt, Human
agguaagaagugagcaaguuua

SEQ ID NO: 69251 - RNA, 22 nt, Human
aggguuugugaagacuuggcca

SEQ ID NO: 69252 - RNA, 22 nt, Human
aggguguuugggagcagaggau

SEQ ID NO: 69253 - RNA, 22 nt, Human
aggguggcacucugggggcucc

SEQ ID NO: 69254 - RNA, 21 nt, Human
agguagauagccccaggaagg

SEQ ID NO: 69255 - RNA, 22 nt, Human
aggggcaagucuggccauuucu

SEQ ID NO: 69256 - RNA, 22 nt, Human
aggggauggagcuggaaggcag

SEQ ID NO: 69257 - RNA, 22 nt, Human
agggggaauccugcuuauggau

SEQ ID NO: 69258 - RNA, 22 nt, Human
agggcucuuucauuguuaagaa

SEQ ID NO: 69259 - RNA, 22 nt, Human
agggcuucugcugcagagaccu

SEQ ID NO: 69260 - RNA, 22 nt, Human
aggggagaguuaaugugaaugu

SEQ ID NO: 69261 - RNA, 22 nt, Human
aggggagggcuggccuuuggau

SEQ ID NO: 69262 - RNA, 22 nt, Human
aggggaagagugagguuuuggu

SEQ ID NO: 69263 - RNA, 22 nt, Human
agggcugggcuuggcaggcugg

SEQ ID NO: 69264 - RNA, 22 nt, Human
agggagcugcucugcuuccgug

SEQ ID NO: 69265 - RNA, 22 nt, Human
agggaccacauccccucugugg

SEQ ID NO: 69266 - RNA, 22 nt, Human
agggacuugugucuguguuuuu

SEQ ID NO: 69267 - RNA, 22 nt, Human
agugaagauagagccaggucug

SEQ ID NO: 69268 - RNA, 21 nt, Human
agugaagagugggcuugauca

SEQ ID NO: 69269 - RNA, 22 nt, Human
agucucuagagucugucccucu

SEQ ID NO: 69270 - RNA, 22 nt, Human
agucuuuguuccugggaccuga

SEQ ID NO: 69271 - RNA, 20 nt, Human
agucuuaucugcauuuagaa

SEQ ID NO: 69272 - RNA, 22 nt, Human
agucucccauaggcuaaguauu

SEQ ID NO: 69273 - RNA, 22 nt, Human
agucuauacuucccaguugaca

SEQ ID NO: 69274 - RNA, 22 nt, Human
agucugaaccagauggcaaggu

SEQ ID NO: 69275 - RNA, 22 nt, Human
agucuauguuuuuguucuuauu

SEQ ID NO: 69276 - RNA, 22 nt, Human
agucugaguaucucugagccag

SEQ ID NO: 69277 - RNA, 22 nt, Human
aguccucagauauggagaucug

SEQ ID NO: 69278 - RNA, 22 nt, Human
agucuaaguuuuguaugcuaac

SEQ ID NO: 69279 - RNA, 22 nt, Human
agucuagagcuuuuaucaggcc

SEQ ID NO: 69280 - RNA, 22 nt, Human
agucggauuucccagguuauug

SEQ ID NO: 69281 - RNA, 22 nt, Human
agucauuugaggcaugauuaug

SEQ ID NO: 69282 - RNA, 22 nt, Human
agucauuguguucaguaaaauc

SEQ ID NO: 69283 - RNA, 22 nt, Human
agucauuugucauuuuuuugag

SEQ ID NO: 69284 - RNA, 22 nt, Human
agucaggacagauuuucugggg

SEQ ID NO: 69285 - RNA, 20 nt, Human
agucacagacccucagguag

SEQ ID NO: 69286 - RNA, 22 nt, Human
agucaccuacagcucaugcuuc

SEQ ID NO: 69287 - RNA, 22 nt, Human
agucagaaggugucagaucuug

SEQ ID NO: 69288 - RNA, 22 nt, Human
agucaacauuugagaugcaaug

SEQ ID NO: 69289 - RNA, 22 nt, Human
aguauuuucuuuaguuuguuag

SEQ ID NO: 69290 - RNA, 22 nt, Human
aguauuuaguauucuauauuag

SEQ ID NO: 69291 - RNA, 23 nt, Human
aguauuguucaucuucaagacag

SEQ ID NO: 69292 - RNA, 22 nt, Human
agucaaaaaaccuagaaacacc

SEQ ID NO: 69293 - RNA, 22 nt, Human
aguauuuuaaaauacauuaucc

SEQ ID NO: 69294 - RNA, 22 nt, Human
aguauugguaaguguagcaaau

SEQ ID NO: 69295 - RNA, 22 nt, Human
aguauuggauauaaucuaggaa

SEQ ID NO: 69296 - RNA, 22 nt, Human
agguuaugcacugcacaacccu

SEQ ID NO: 69297 - RNA, 22 nt, Human
agguuuuagaagcugaagccaa

SEQ ID NO: 69298 - RNA, 22 nt, Human
aguaacagguguacagacuauc

SEQ ID NO: 69299 - RNA, 21 nt, Human
aggugguuccaauaaguaggu

SEQ ID NO: 69300 - RNA, 22 nt, Human
aggugcuugcauacugcuugac

SEQ ID NO: 69301 - RNA, 21 nt, Human
aguagucgauucaggagaagu

SEQ ID NO: 69302 - RNA, 22 nt, Human
aguauagacaucaaacugaaga

SEQ ID NO: 69303 - RNA, 22 nt, Human
aguaggagugacaagcagguca

SEQ ID NO: 69304 - RNA, 22 nt, Human
aguaggaauucaaagagacaaa

SEQ ID NO: 69305 - RNA, 22 nt, Human
aguagagacgggguuuuaguag

SEQ ID NO: 69306 - RNA, 22 nt, Human
aguacuuugacuagaggcagcu

SEQ ID NO: 69307 - RNA, 22 nt, Human
aguagaauuacagguuuucucu

SEQ ID NO: 69308 - RNA, 22 nt, Human
aguacuuuuuguucaauugugc

SEQ ID NO: 69309 - RNA, 22 nt, Human
aguaaucgugaucgagagauca

SEQ ID NO: 69310 - RNA, 22 nt, Human
aguaagaaagaaugauaggccu

SEQ ID NO: 69311 - RNA, 22 nt, Human
aguaacuuaagcaauuguguau

SEQ ID NO: 69312 - RNA, 22 nt, Human
aguaugcuggcaccuuugagug

SEQ ID NO: 69313 - RNA, 22 nt, Human
aguaucuuccucaugaacacgu

SEQ ID NO: 69314 - RNA, 23 nt, Human
aguaucuugguguggugcagaga

SEQ ID NO: 69315 - RNA, 22 nt, Human
aguaucuauaucaaaaauggcu

SEQ ID NO: 69316 - RNA, 22 nt, Human
aguauccauccugcuguuucua

SEQ ID NO: 69317 - RNA, 22 nt, Human
aguaucgcuuuguaucaugagg

SEQ ID NO: 69318 - RNA, 22 nt, Human
aguauucaguuagugagcuaag

SEQ ID NO: 69319 - RNA, 22 nt, Human
aguauggaauuuuuaaugacag

SEQ ID NO: 69320 - RNA, 22 nt, Human
auauuauuaaaauagauggaua

SEQ ID NO: 69321 - RNA, 22 nt, Human
auauucaaugaggucauauaag

SEQ ID NO: 69322 - RNA, 22 nt, Human
auauguuaugccauuuucaagg

SEQ ID NO: 69323 - RNA, 22 nt, Human
auaucuaggcugaauguaaaau

SEQ ID NO: 69324 - RNA, 22 nt, Human
auaucuuguuuuugauuucuug

SEQ ID NO: 69325 - RNA, 22 nt, Human
auaugaagaaugaucugaagua

SEQ ID NO: 69326 - RNA, 21 nt, Human
auauggauauuauuuuguguc

SEQ ID NO: 69327 - RNA, 22 nt, Human
auauuucuacaggcugauuuua

SEQ ID NO: 69328 - RNA, 23 nt, Human
auaugucaugcaccagcacuuua

SEQ ID NO: 69329 - RNA, 22 nt, Human
auauuuguuuggcagaguucag

SEQ ID NO: 69330 - RNA, 22 nt, Human
auaggcauaacacugauguccu

SEQ ID NO: 69331 - RNA, 22 nt, Human
auaguccuucuuuaacuuagau

SEQ ID NO: 69332 - RNA, 22 nt, Human
auaguuaucuguggauaagguu

SEQ ID NO: 69333 - RNA, 22 nt, Human
auaucugaugacgugacuaugu

SEQ ID NO: 69334 - RNA, 22 nt, Human
auaguuuuagauacugagaaaa

SEQ ID NO: 69335 - RNA, 22 nt, Human
auaguugcugucauuauuugag

SEQ ID NO: 69336 - RNA, 22 nt, Human
auaugagaggaggagcaucagu

SEQ ID NO: 69337 - RNA, 22 nt, Human
auauaguuggguuucauucuac

SEQ ID NO: 69338 - RNA, 22 nt, Human
auagauuuuaucagauuuuauc

SEQ ID NO: 69339 - RNA, 22 nt, Human
auagaugacaguuaggaagcug

SEQ ID NO: 69340 - RNA, 22 nt, Human
auauaugcaacaagaaagcaua

SEQ ID NO: 69341 - RNA, 22 nt, Human
auauaaugugugcuuuauugaa

SEQ ID NO: 69342 - RNA, 22 nt, Human
auauaagucacauuaaggaggu

SEQ ID NO: 69343 - RNA, 20 nt, Human
auagaguggugugucacauu

SEQ ID NO: 69344 - RNA, 22 nt, Human
auauaagauaauaacuuuuuua

SEQ ID NO: 69345 - RNA, 23 nt, Human
auagucuuaaaccagacuucacc

SEQ ID NO: 69346 - RNA, 22 nt, Human
auaguguguaaagugcagugau

SEQ ID NO: 69347 - RNA, 22 nt, Human
auagaagguaaugccccaaggg

SEQ ID NO: 69348 - RNA, 22 nt, Human
auagaauggcaccagcaucuac

SEQ ID NO: 69349 - RNA, 22 nt, Human
auagacacagcuaugauuugag

SEQ ID NO: 69350 - RNA, 22 nt, Human
auagagaggaacagcaagaacu

SEQ ID NO: 69351 - RNA, 22 nt, Human
auagacuagccaaagacuucug

SEQ ID NO: 69352 - RNA, 23 nt, Human
auacuuuuuuucuacguuaucuc

SEQ ID NO: 69353 - RNA, 22 nt, Human
auacuagguggauauacaaaga

SEQ ID NO: 69354 - RNA, 22 nt, Human
auacuagauaccucuucuaccu

SEQ ID NO: 69355 - RNA, 22 nt, Human
auacuacaucacagccaagaag

SEQ ID NO: 69356 - RNA, 22 nt, Human
auagauagaagggacguggugc

SEQ ID NO: 69357 - RNA, 22 nt, Human
auaccaguagaggacugcccaa

SEQ ID NO: 69358 - RNA, 19 nt, Human
auagcagaagucauuuuca

SEQ ID NO: 69359 - RNA, 22 nt, Human
auagcuauuauuauuucuguua

SEQ ID NO: 69360 - RNA, 20 nt, Human
auacuuguuuucaggcuuuu

SEQ ID NO: 69361 - RNA, 22 nt, Human
auagcaucaugcuaucccccuu

SEQ ID NO: 69362 - RNA, 22 nt, Human
auaggacuguacagaauacaag

SEQ ID NO: 69363 - RNA, 22 nt, Human
auaggagcaagauuauagcagg

SEQ ID NO: 69364 - RNA, 22 nt, Human
auaggacuuuguaucaggauga

SEQ ID NO: 69365 - RNA, 22 nt, Human
auagaugaggaaauucaggugc

SEQ ID NO: 69366 - RNA, 22 nt, Human
auagauugcucauauauuacuu

SEQ ID NO: 69367 - RNA, 22 nt, Human
auagaguucucuuuggaggagu

SEQ ID NO: 69368 - RNA, 22 nt, Human
auaccaaugaaucccugagaau

SEQ ID NO: 69369 - RNA, 22 nt, Human
auacaugacucacacauucugc

SEQ ID NO: 69370 - RNA, 22 nt, Human
auagagcuggggaagaagcugg

SEQ ID NO: 69371 - RNA, 22 nt, Human
auacaggcaguaagauucucag

SEQ ID NO: 69372 - RNA, 22 nt, Human
auacaucuuaacgcgcucuugg

SEQ ID NO: 69373 - RNA, 18 nt, Human
auagacaggaaaaaugga

SEQ ID NO: 69374 - RNA, 22 nt, Human
auagacauuuauagagaaugac

SEQ ID NO: 69375 - RNA, 22 nt, Human
auagaagugaaaagggaugacu

SEQ ID NO: 69376 - RNA, 22 nt, Human
auagaaauagacaaugcaaaga

SEQ ID NO: 69377 - RNA, 22 nt, Human
agugacuguccuacuuuguaga

SEQ ID NO: 69378 - RNA, 22 nt, Human
agugagcauuagugcuuauauu

SEQ ID NO: 69379 - RNA, 22 nt, Human
agugagcuuuuaaaauuuacca

SEQ ID NO: 69380 - RNA, 22 nt, Human
agugacauuauuuuguguacua

SEQ ID NO: 69381 - RNA, 22 nt, Human
agugaaaacugaaucaccuucc

SEQ ID NO: 69382 - RNA, 22 nt, Human
agugaaauaugcccauugcugu

SEQ ID NO: 69383 - RNA, 21 nt, Human
agugagauuuaugccugguuc

SEQ ID NO: 69384 - RNA, 22 nt, Human
aucauccuagaaggaagcuagg

SEQ ID NO: 69385 - RNA, 22 nt, Human
auccagaaguauuuuggguacu

SEQ ID NO: 69386 - RNA, 22 nt, Human
aucaugcugacacaguuuaucu

SEQ ID NO: 69387 - RNA, 22 nt, Human
auccaggggucugaauggauau

SEQ ID NO: 69388 - RNA, 22 nt, Human
aucauaccaguuuccaucagga

SEQ ID NO: 69389 - RNA, 22 nt, Human
aucauugcuaguaaggaucuug

SEQ ID NO: 69390 - RNA, 23 nt, Human
aucauuucuuagugagucccugc

SEQ ID NO: 69391 - RNA, 22 nt, Human
aucauuugaacagaauuuguuu

SEQ ID NO: 69392 - RNA, 22 nt, Human
auccuagacuccuaugccccaa

SEQ ID NO: 69393 - RNA, 22 nt, Human
auccuccuuugcccugagauca

SEQ ID NO: 69394 - RNA, 22 nt, Human
auccucaaggaauuaaauaggg

SEQ ID NO: 69395 - RNA, 22 nt, Human
auccuaagacgugugguuugag

SEQ ID NO: 69396 - RNA, 22 nt, Human
aucauguauaugcagcguuugu

SEQ ID NO: 69397 - RNA, 22 nt, Human
aucauugaaaauuuaugcauuu

SEQ ID NO: 69398 - RNA, 22 nt, Human
auccugauggaaacugguauga

SEQ ID NO: 69399 - RNA, 22 nt, Human
aucuacuuugggaguuucucuu

SEQ ID NO: 69400 - RNA, 22 nt, Human
auccucucuuaugaacaacugu

SEQ ID NO: 69401 - RNA, 19 nt, Human
auccucucuagaaguggga

SEQ ID NO: 69402 - RNA, 22 nt, Human
aucuaauguggcaaguugcuga

SEQ ID NO: 69403 - RNA, 23 nt, Human
auccacauucuaguccuuuaugc

SEQ ID NO: 69404 - RNA, 22 nt, Human
auccuccuggggcagucuuccc

SEQ ID NO: 69405 - RNA, 18 nt, Human
auccuuugaucaucuguc

SEQ ID NO: 69406 - RNA, 22 nt, Human
auccuucaaaaggaauagcagg

SEQ ID NO: 69407 - RNA, 22 nt, Human
auccuugacuguagugauauua

SEQ ID NO: 69408 - RNA, 22 nt, Human
aucauuuggaaauuuggccuaa

SEQ ID NO: 69409 - RNA, 20 nt, Human
auccuggucuuuggaagcuu

SEQ ID NO: 69410 - RNA, 22 nt, Human
aucauguuauguacaaauauga

SEQ ID NO: 69411 - RNA, 22 nt, Human
aucauguauauuuuugcuauua

SEQ ID NO: 69412 - RNA, 21 nt, Human
aucagaggacaucucagggcc

SEQ ID NO: 69413 - RNA, 22 nt, Human
aucagcucuugaugccuuucuu

SEQ ID NO: 69414 - RNA, 22 nt, Human
aucagaagaaauggaugugacu

SEQ ID NO: 69415 - RNA, 21 nt, Human
aucagaaucucuagauuugga

SEQ ID NO: 69416 - RNA, 22 nt, Human
aucauaugugauaccauaauga

SEQ ID NO: 69417 - RNA, 22 nt, Human
aucaaguuauuaaguagcuuuc

SEQ ID NO: 69418 - RNA, 19 nt, Human
aucagcaguuuugccugga

SEQ ID NO: 69419 - RNA, 20 nt, Human
aucaggagucgcggggagag

SEQ ID NO: 69420 - RNA, 22 nt, Human
aucaaugggucaaagagaaggu

SEQ ID NO: 69421 - RNA, 22 nt, Human
aucacaaauggaaucaccuccc

SEQ ID NO: 69422 - RNA, 22 nt, Human
auauuuuugcagaauuuuucgu

SEQ ID NO: 69423 - RNA, 22 nt, Human
auauuuuacagcucucguugaa

SEQ ID NO: 69424 - RNA, 22 nt, Human
aucaaaauguguagucuugauc

SEQ ID NO: 69425 - RNA, 22 nt, Human
aucaaaauuuucagauacuaca

SEQ ID NO: 69426 - RNA, 22 nt, Human
aucaagacaaaggaaaggcuaa

SEQ ID NO: 69427 - RNA, 22 nt, Human
auauuguagcaucacugucuug

SEQ ID NO: 69428 - RNA, 21 nt, Human
auauugguaucuuuuuaaauc

SEQ ID NO: 69429 - RNA, 22 nt, Human
auauugcuuuauucuugaauau

SEQ ID NO: 69430 - RNA, 22 nt, Human
auauguuuuaguagaaucccaa

SEQ ID NO: 69431 - RNA, 22 nt, Human
aucaacacuguuggcggggacc

SEQ ID NO: 69432 - RNA, 22 nt, Human
augaauuaucugguguuggaaa

SEQ ID NO: 69433 - RNA, 22 nt, Human
augacagcuaaggaauguguag

SEQ ID NO: 69434 - RNA, 22 nt, Human
augaccauccagaaguccagcu

SEQ ID NO: 69435 - RNA, 22 nt, Human
augaaugccggucucgggggaa

SEQ ID NO: 69436 - RNA, 22 nt, Human
augcagaaucucuuuccugagg

SEQ ID NO: 69437 - RNA, 22 nt, Human
augcacuccucagcuguucugg

SEQ ID NO: 69438 - RNA, 22 nt, Human
augauaucuuguuuuucaugca

SEQ ID NO: 69439 - RNA, 22 nt, Human
augcacuaugaugagcuagucu

SEQ ID NO: 69440 - RNA, 22 nt, Human
augaggaacagcaagaauauuu

SEQ ID NO: 69441 - RNA, 22 nt, Human
augagaguuagccugcauaguu

SEQ ID NO: 69442 - RNA, 22 nt, Human
augacuauaaauaggagauugu

SEQ ID NO: 69443 - RNA, 22 nt, Human
augacugaugcugacucauggg

SEQ ID NO: 69444 - RNA, 22 nt, Human
augauuauuugaaugaagagga

SEQ ID NO: 69445 - RNA, 22 nt, Human
aucuucuauguguaggcauuuu

SEQ ID NO: 69446 - RNA, 22 nt, Human
augagaaauaauuguguacuga

SEQ ID NO: 69447 - RNA, 22 nt, Human
aucuucuuucaucagccccuca

SEQ ID NO: 69448 - RNA, 20 nt, Human
aucuuaucuaucuuuuguuc

SEQ ID NO: 69449 - RNA, 22 nt, Human
aucuucaaggacgccaagaucc

SEQ ID NO: 69450 - RNA, 22 nt, Human
aucuucaggggcaauggagaua

SEQ ID NO: 69451 - RNA, 22 nt, Human
aucugcugcuccuucuucuugc

SEQ ID NO: 69452 - RNA, 22 nt, Human
auccucugcucaugagaaaugu

SEQ ID NO: 69453 - RNA, 21 nt, Human
aucucaguccugggaaugauu

SEQ ID NO: 69454 - RNA, 22 nt, Human
augcugcuccuuuucaggcauu

SEQ ID NO: 69455 - RNA, 22 nt, Human
augcuuuauuggagacagucau

SEQ ID NO: 69456 - RNA, 22 nt, Human
augcugugccuggaaagcggcu

SEQ ID NO: 69457 - RNA, 22 nt, Human
augcuugaaaguuauuucauuu

SEQ ID NO: 69458 - RNA, 22 nt, Human
augcucuuaauugcuagauaag

SEQ ID NO: 69459 - RNA, 22 nt, Human
augcuacuugugaaaacccagg

SEQ ID NO: 69460 - RNA, 22 nt, Human
augcuagaaaauuucauauuau

SEQ ID NO: 69461 - RNA, 22 nt, Human
augcgcugugcacacucuuaac

SEQ ID NO: 69462 - RNA, 22 nt, Human
augccucuugagagccagugcu

SEQ ID NO: 69463 - RNA, 22 nt, Human
augcugcuuguccauuuauuug

SEQ ID NO: 69464 - RNA, 22 nt, Human
augcuucuguugcuuaggaggu

SEQ ID NO: 69465 - RNA, 22 nt, Human
augcagagacugugggaaagca

SEQ ID NO: 69466 - RNA, 22 nt, Human
augcacuugacucuauuccaca

SEQ ID NO: 69467 - RNA, 22 nt, Human
augcagauguagauucugaaau

SEQ ID NO: 69468 - RNA, 22 nt, Human
augaugaugguuuaacuucagg

SEQ ID NO: 69469 - RNA, 22 nt, Human
augaugauuauucauuuucugu

SEQ ID NO: 69470 - RNA, 22 nt, Human
augauggagaacaaagaaaauc

SEQ ID NO: 69471 - RNA, 22 nt, Human
augcaccugucuuuuaaggaua

SEQ ID NO: 69472 - RNA, 22 nt, Human
augccccuuuauauguuaaguc

SEQ ID NO: 69473 - RNA, 22 nt, Human
auuaugaauuguguuacgaaga

SEQ ID NO: 69474 - RNA, 23 nt, Human
auuaugaagaagacucgccuguu

SEQ ID NO: 69475 - RNA, 22 nt, Human
auuaucugacugaguagucugu

SEQ ID NO: 69476 - RNA, 22 nt, Human
auuaaaaaaagauaaugaguua

SEQ ID NO: 69477 - RNA, 22 nt, Human
auguuuuuugaaaauguauuuu

SEQ ID NO: 69478 - RNA, 22 nt, Human
auuauacauuaggagauugauu

SEQ ID NO: 69479 - RNA, 22 nt, Human
auguuuuauacacauguaucac

SEQ ID NO: 69480 - RNA, 22 nt, Human
auguuccuuaaugugcuuguag

SEQ ID NO: 69481 - RNA, 22 nt, Human
auguuccuuuaaaauauagauu

SEQ ID NO: 69482 - RNA, 22 nt, Human
auuaagacugcccauguuuuua

SEQ ID NO: 69483 - RNA, 22 nt, Human
auuaaguuauuaagcuaaauau

SEQ ID NO: 69484 - RNA, 22 nt, Human
auuacugaggcaaaguaguuuu

SEQ ID NO: 69485 - RNA, 22 nt, Human
auuagaaaugacaugugggaau

SEQ ID NO: 69486 - RNA, 22 nt, Human
auuaaagcuaguugagauuuaa

SEQ ID NO: 69487 - RNA, 22 nt, Human
auuaaacuaaauuaugaauugg

SEQ ID NO: 69488 - RNA, 20 nt, Human
auuauuucuucugcccaaag

SEQ ID NO: 69489 - RNA, 22 nt, Human
auucaagagcccauguuuccug

SEQ ID NO: 69490 - RNA, 22 nt, Human
auucauauagcgcuuacagccu

SEQ ID NO: 69491 - RNA, 22 nt, Human
auucauuuuuacaucaccaaua

SEQ ID NO: 69492 - RNA, 18 nt, Human
auucauuugcguuuggcu

SEQ ID NO: 69493 - RNA, 17 nt, Human
auucaugaacauguccu

SEQ ID NO: 69494 - RNA, 22 nt, Human
auucccagucccucccaccccu

SEQ ID NO: 69495 - RNA, 19 nt, Human
auguucugaauuacuguaa

SEQ ID NO: 69496 - RNA, 22 nt, Human
auguucucagguuguauuuauu

SEQ ID NO: 69497 - RNA, 22 nt, Human
auguggaaagcuugucuuagag

SEQ ID NO: 69498 - RNA, 22 nt, Human
auguguuuccaacagagaggga

SEQ ID NO: 69499 - RNA, 22 nt, Human
auguguguaugacugaaucuau

SEQ ID NO: 69500 - RNA, 22 nt, Human
augguuuugugaaaaugcuuug

SEQ ID NO: 69501 - RNA, 22 nt, Human
augguuuuguccucuuugguuc

SEQ ID NO: 69502 - RNA, 22 nt, Human
auguuagcaucuggcacuaugg

SEQ ID NO: 69503 - RNA, 18 nt, Human
auguuccugcaguuauuu

SEQ ID NO: 69504 - RNA, 22 nt, Human
auguaaauauuuauauaugcau

SEQ ID NO: 69505 - RNA, 22 nt, Human
auguaaugucaaucuucagugg

SEQ ID NO: 69506 - RNA, 22 nt, Human
augugaaauuugggcucuggga

SEQ ID NO: 69507 - RNA, 23 nt, Human
auguagcugcucccgaugcccuc

SEQ ID NO: 69508 - RNA, 22 nt, Human
augugaacuccagcugccaacc

SEQ ID NO: 69509 - RNA, 22 nt, Human
auguauuuauguauguguuaua

SEQ ID NO: 69510 - RNA, 22 nt, Human
augguugccugagauaagacug

SEQ ID NO: 69511 - RNA, 22 nt, Human
augguugugaaagagcaaagac

SEQ ID NO: 69512 - RNA, 22 nt, Human
auggcuguguuguuccucugaa

SEQ ID NO: 69513 - RNA, 18 nt, Human
auggcuccagugucuucc

SEQ ID NO: 69514 - RNA, 22 nt, Human
auggcuucugucuuggaaauuu

SEQ ID NO: 69515 - RNA, 22 nt, Human
augcuuucucuucuauuucuca

SEQ ID NO: 69516 - RNA, 22 nt, Human
caauaauugcuuuccagaguua

SEQ ID NO: 69517 - RNA, 22 nt, Human
caauaccucuuggugauugggc

SEQ ID NO: 69518 - RNA, 22 nt, Human
caaaggaauuacauguuucgga

SEQ ID NO: 69519 - RNA, 22 nt, Human
caaggaguuuggggaccaagga

SEQ ID NO: 69520 - RNA, 22 nt, Human
caagaaguugacagccagguga

SEQ ID NO: 69521 - RNA, 22 nt, Human
caacuucugcuuucuuccuugc

SEQ ID NO: 69522 - RNA, 22 nt, Human
caagaaccuagcgaucagguaa

SEQ ID NO: 69523 - RNA, 22 nt, Human
caaaacauucagagagcucacu

SEQ ID NO: 69524 - RNA, 22 nt, Human
caaagaagagauuuacagagcu

SEQ ID NO: 69525 - RNA, 22 nt, Human
caagcacaauuucuacauguua

SEQ ID NO: 69526 - RNA, 22 nt, Human
cacacaccagaaagccugggac

SEQ ID NO: 69527 - RNA, 22 nt, Human
cacaacaaaaaauaaguaugag

SEQ ID NO: 69528 - RNA, 22 nt, Human
caauugcuuccuucuguaagua

SEQ ID NO: 69529 - RNA, 22 nt, Human
caacaagcgcucagagcaaagc

SEQ ID NO: 69530 - RNA, 22 nt, Human
caauguuuuuccuuccuuaaua

SEQ ID NO: 69531 - RNA, 22 nt, Human
caaaucuguuaauuucaaguug

SEQ ID NO: 69532 - RNA, 22 nt, Human
caaaucagaucagagacaggcu

SEQ ID NO: 69533 - RNA, 22 nt, Human
caauggaguccucuuccucuuu

SEQ ID NO: 69534 - RNA, 22 nt, Human
caaugccaggaaccugggggaa

SEQ ID NO: 69535 - RNA, 22 nt, Human
caaucuucucuagaguauucua

SEQ ID NO: 69536 - RNA, 22 nt, Human
caaugaaaauuuaaguugcagc

SEQ ID NO: 69537 - RNA, 22 nt, Human
caccugcaaauuccagauuucu

SEQ ID NO: 69538 - RNA, 22 nt, Human
caaguugcaugugcuugaaaua

SEQ ID NO: 69539 - RNA, 22 nt, Human
caauagcuauguaaccugaaga

SEQ ID NO: 69540 - RNA, 22 nt, Human
caaggcuaagcuuuggcuuucu

SEQ ID NO: 69541 - RNA, 22 nt, Human
caaggaagguugguugaaggua

SEQ ID NO: 69542 - RNA, 22 nt, Human
caccaaaauaucccuuuguaca

SEQ ID NO: 69543 - RNA, 22 nt, Human
caaggaaaugucagaaaggcaa

SEQ ID NO: 69544 - RNA, 22 nt, Human
cacauuucagcacucagggcau

SEQ ID NO: 69545 - RNA, 22 nt, Human
cacauuguuuggucagagcaua

SEQ ID NO: 69546 - RNA, 22 nt, Human
cacauugguagaauuuagaaga

SEQ ID NO: 69547 - RNA, 22 nt, Human
caagauauguccuguuacuaag

SEQ ID NO: 69548 - RNA, 22 nt, Human
caagagcuuuagaaaugcucau

SEQ ID NO: 69549 - RNA, 22 nt, Human
cacauaguuuaucuucauuuuc

SEQ ID NO: 69550 - RNA, 22 nt, Human
cacaucucagggcuacaggcag

SEQ ID NO: 69551 - RNA, 23 nt, Human
cacaggcagaaaucaagacggua

SEQ ID NO: 69552 - RNA, 22 nt, Human
caaggaaaacagaugaucaaca

SEQ ID NO: 69553 - RNA, 22 nt, Human
caagaugcaagaccagucaggc

SEQ ID NO: 69554 - RNA, 22 nt, Human
cacagcagcaucauuuaucugg

SEQ ID NO: 69555 - RNA, 22 nt, Human
cacagaauuaagggagaaauau

SEQ ID NO: 69556 - RNA, 22 nt, Human
caagagcucccagaccugggca

SEQ ID NO: 69557 - RNA, 22 nt, Human
caagagcgugugcagggcaagu

SEQ ID NO: 69558 - RNA, 22 nt, Human
caagaaaaaacaugaugagugu

SEQ ID NO: 69559 - RNA, 19 nt, Human
caagagcaaagucuuauga

SEQ ID NO: 69560 - RNA, 22 nt, Human
caaagcuucaucuguuguuuug

SEQ ID NO: 69561 - RNA, 20 nt, Human
caacacugcccauuguuugc

SEQ ID NO: 69562 - RNA, 22 nt, Human
caacauuucaaggucuuuagga

SEQ ID NO: 69563 - RNA, 22 nt, Human
caacacaucaguucagucuuga

SEQ ID NO: 69564 - RNA, 22 nt, Human
caaccucuaucggucaggaagc

SEQ ID NO: 69565 - RNA, 22 nt, Human
caacuucuauucagucugcagu

SEQ ID NO: 69566 - RNA, 23 nt, Human
auuuuuccacacacagacucagu

SEQ ID NO: 69567 - RNA, 22 nt, Human
caaauacaaauacgggcagcuu

SEQ ID NO: 69568 - RNA, 22 nt, Human
auuuuucucucaugugcaacua

SEQ ID NO: 69569 - RNA, 22 nt, Human
auuuuucuuucacauuuucuua

SEQ ID NO: 69570 - RNA, 22 nt, Human
auuuuuuuggucauaugagaua

SEQ ID NO: 69571 - RNA, 22 nt, Human
caaaaaauccauagaaagaggu

SEQ ID NO: 69572 - RNA, 22 nt, Human
caaaaauacuugccuguaucug

SEQ ID NO: 69573 - RNA, 22 nt, Human
auuuugcaguuuauugccaauc

SEQ ID NO: 69574 - RNA, 19 nt, Human
auuuugguucuuuccauuc

SEQ ID NO: 69575 - RNA, 22 nt, Human
caaagagaugcaccauauuucu

SEQ ID NO: 69576 - RNA, 22 nt, Human
caaagaugccaaaaggaagaca

SEQ ID NO: 69577 - RNA, 22 nt, Human
caaagccuggggagaguaagga

SEQ ID NO: 69578 - RNA, 18 nt, Human
auuuguggggguuauaga

SEQ ID NO: 69579 - RNA, 22 nt, Human
auuuggaaacaugcugaccaug

SEQ ID NO: 69580 - RNA, 22 nt, Human
auuuuugugucacaucuaggaa

SEQ ID NO: 69581 - RNA, 22 nt, Human
auuuuugguuauaaaauaguuu

SEQ ID NO: 69582 - RNA, 22 nt, Human
auuuucuucauuuugauuguau

SEQ ID NO: 69583 - RNA, 22 nt, Human
auuuccagcagcauauuugucu

SEQ ID NO: 69584 - RNA, 23 nt, Human
auuugcugaucguagaugacuag

SEQ ID NO: 69585 - RNA, 22 nt, Human
auuugcauguuuauuucuuaga

SEQ ID NO: 69586 - RNA, 22 nt, Human
auuugaaguauaaguaauugcu

SEQ ID NO: 69587 - RNA, 22 nt, Human
auuucagaguagaucguuauuu

SEQ ID NO: 69588 - RNA, 21 nt, Human
auuuguggugcaauuguggua

SEQ ID NO: 69589 - RNA, 22 nt, Human
auuuuaccauuaguuuguaaua

SEQ ID NO: 69590 - RNA, 22 nt, Human
auuuuagagaaacaaacguagg

SEQ ID NO: 69591 - RNA, 22 nt, Human
auuuaagacuguggugcaguuu

SEQ ID NO: 69592 - RNA, 22 nt, Human
auuauaguuuugcccuuaagaa

SEQ ID NO: 69593 - RNA, 21 nt, Human
auuauagugacuaaauugaua

SEQ ID NO: 69594 - RNA, 22 nt, Human
auuagugguguauuuggcacua

SEQ ID NO: 69595 - RNA, 22 nt, Human
auuacagauuauaaauuugagc

SEQ ID NO: 69596 - RNA, 22 nt, Human
auuaauaucaauauauuauaug

SEQ ID NO: 69597 - RNA, 20 nt, Human
auuaauuuuuagggcucacc

SEQ ID NO: 69598 - RNA, 22 nt, Human
auuacagaagauaugcucaaca

SEQ ID NO: 69599 - RNA, 22 nt, Human
auuuauccuugggguagagcca

SEQ ID NO: 69600 - RNA, 22 nt, Human
auuuagacaacaagccuucucc

SEQ ID NO: 69601 - RNA, 22 nt, Human
auugacuuucccuucuccucau

SEQ ID NO: 69602 - RNA, 22 nt, Human
auuuaaguuacuucucuuuccu

SEQ ID NO: 69603 - RNA, 22 nt, Human
auugacuucccaucaggugagu

SEQ ID NO: 69604 - RNA, 22 nt, Human
auuuaaaaacugguacaacagg

SEQ ID NO: 69605 - RNA, 22 nt, Human
auuuaaagaguaauacaaucca

SEQ ID NO: 69606 - RNA, 22 nt, Human
auugaaauuugcuuccucacug

SEQ ID NO: 69607 - RNA, 22 nt, Human
auuuauuugaagagccauugca

SEQ ID NO: 69608 - RNA, 22 nt, Human
auuucagaaugaaaggaaaaau

SEQ ID NO: 69609 - RNA, 22 nt, Human
auuuccacaaauuaagauugca

SEQ ID NO: 69610 - RNA, 22 nt, Human
auuucaguuugcaguuucucuc

SEQ ID NO: 69611 - RNA, 22 nt, Human
auuucuguaauucugaggagug

SEQ ID NO: 69612 - RNA, 22 nt, Human
auuugaaaaucuaugaugugca

SEQ ID NO: 69613 - RNA, 22 nt, Human
auuuggaaggcguuucucugua

SEQ ID NO: 69614 - RNA, 22 nt, Human
auuuaaaggaagugggugauaa

SEQ ID NO: 69615 - RNA, 22 nt, Human
auuuauuuucccucaaguaccu

SEQ ID NO: 69616 - RNA, 22 nt, Human
caggguugaugaauugucugua

SEQ ID NO: 69617 - RNA, 22 nt, Human
caguuuuucaaaauuacaugau

SEQ ID NO: 69618 - RNA, 22 nt, Human
caggugauuuuguuuucaaaug

SEQ ID NO: 69619 - RNA, 19 nt, Human
caggucuucuuggaggacu

SEQ ID NO: 69620 - RNA, 22 nt, Human
cauagacauugauagguuauau

SEQ ID NO: 69621 - RNA, 22 nt, Human
caggucauaacuaugcaugaac

SEQ ID NO: 69622 - RNA, 22 nt, Human
caguaucucccauucacagugu

SEQ ID NO: 69623 - RNA, 22 nt, Human
cauccagggguacccuggagcc

SEQ ID NO: 69624 - RNA, 22 nt, Human
caguagcuuuuugcagacaaga

SEQ ID NO: 69625 - RNA, 22 nt, Human
caguaguucucauaacucauga

SEQ ID NO: 69626 - RNA, 22 nt, Human
caguacugucuuccugauggca

SEQ ID NO: 69627 - RNA, 22 nt, Human
caucaaaugcaagagcguucuu

SEQ ID NO: 69628 - RNA, 22 nt, Human
caguuuuggaagaaacaaggaa

SEQ ID NO: 69629 - RNA, 22 nt, Human
cagggacugcaggaggacaggu

SEQ ID NO: 69630 - RNA, 22 nt, Human
caggcgcauggugagcagauga

SEQ ID NO: 69631 - RNA, 22 nt, Human
caguccaugaugacuuuugcuc

SEQ ID NO: 69632 - RNA, 22 nt, Human
caguaucucuaaaauuacucuu

SEQ ID NO: 69633 - RNA, 22 nt, Human
cauguauguuaguggcugcuuu

SEQ ID NO: 69634 - RNA, 22 nt, Human
caugggaauaaaguuauuucaa

SEQ ID NO: 69635 - RNA, 22 nt, Human
caugguaccuagccucauggau

SEQ ID NO: 69636 - RNA, 22 nt, Human
cauggccaaagaauuauauuuu

SEQ ID NO: 69637 - RNA, 22 nt, Human
caugggaaauauaagaauuuuc

SEQ ID NO: 69638 - RNA, 21 nt, Human
caugguaaguacaaagaugac

SEQ ID NO: 69639 - RNA, 22 nt, Human
cauaccuugguaagagugauca

SEQ ID NO: 69640 - RNA, 22 nt, Human
cauggcggcgcucucccugccu

SEQ ID NO: 69641 - RNA, 22 nt, Human
cauggcacagaagaugucguuu

SEQ ID NO: 69642 - RNA, 22 nt, Human
cauaagaauauuuaguggcagc

SEQ ID NO: 69643 - RNA, 22 nt, Human
caugccaguagccggcuugacu

SEQ ID NO: 69644 - RNA, 22 nt, Human
caugccugaucagcggccagca

SEQ ID NO: 69645 - RNA, 22 nt, Human
caguugcuauugagagaacaca

SEQ ID NO: 69646 - RNA, 22 nt, Human
caguuuuauacacugcagcucc

SEQ ID NO: 69647 - RNA, 17 nt, Human
cagugcuguuuuagaaa

SEQ ID NO: 69648 - RNA, 22 nt, Human
caguggggcuuccagacgcuga

SEQ ID NO: 69649 - RNA, 22 nt, Human
caguguuuagcacagugcuugg

SEQ ID NO: 69650 - RNA, 20 nt, Human
caugaugcaaacaguaacgu

SEQ ID NO: 69651 - RNA, 22 nt, Human
caugaugagaguaauaacacag

SEQ ID NO: 69652 - RNA, 22 nt, Human
caugaugaacugugcuguuagg

SEQ ID NO: 69653 - RNA, 22 nt, Human
caugauaacacuucuguuuaau

SEQ ID NO: 69654 - RNA, 22 nt, Human
cagucucuugcuucauuaguug

SEQ ID NO: 69655 - RNA, 22 nt, Human
cagucaaauuugaaaacuuuga

SEQ ID NO: 69656 - RNA, 22 nt, Human
cauccuauuacugaggcucccc

SEQ ID NO: 69657 - RNA, 22 nt, Human
caucuaaaauaagccuuauaau

SEQ ID NO: 69658 - RNA, 22 nt, Human
caggguaguaauuuaauacaag

SEQ ID NO: 69659 - RNA, 22 nt, Human
cagggguaccuggguuaccugu

SEQ ID NO: 69660 - RNA, 22 nt, Human
caggaagucugaauucugagag

SEQ ID NO: 69661 - RNA, 22 nt, Human
cagcuauuguucuguauaauga

SEQ ID NO: 69662 - RNA, 22 nt, Human
cagcuccagcccaggcagcucc

SEQ ID NO: 69663 - RNA, 22 nt, Human
caggagagucucugucuguacu

SEQ ID NO: 69664 - RNA, 22 nt, Human
cagcucugcugggaggaugcag

SEQ ID NO: 69665 - RNA, 22 nt, Human
cagcucuccacccuccugguuc

SEQ ID NO: 69666 - RNA, 22 nt, Human
caggcagggcugccuucugcuu

SEQ ID NO: 69667 - RNA, 22 nt, Human
caggaagagaacugcucagccu

SEQ ID NO: 69668 - RNA, 22 nt, Human
cagccuggccucuggauauuug

SEQ ID NO: 69669 - RNA, 22 nt, Human
cagcuucuccauucuucuggcu

SEQ ID NO: 69670 - RNA, 22 nt, Human
cagcuuuugcagacuucuugcc

SEQ ID NO: 69671 - RNA, 22 nt, Human
cagcuuguucugaccugugauu

SEQ ID NO: 69672 - RNA, 22 nt, Human
cagcuucaaaggcccugauggu

SEQ ID NO: 69673 - RNA, 22 nt, Human
cagcuguacgugaucuacaugg

SEQ ID NO: 69674 - RNA, 22 nt, Human
cagcuuaccucccacagcucuc

SEQ ID NO: 69675 - RNA, 21 nt, Human
cagcagaugccagggucucug

SEQ ID NO: 69676 - RNA, 21 nt, Human
cagcagaaaugagaggagaaa

SEQ ID NO: 69677 - RNA, 22 nt, Human
cagcagaggagguggcagcacc

SEQ ID NO: 69678 - RNA, 22 nt, Human
cagauuuagcacugauaggacu

SEQ ID NO: 69679 - RNA, 20 nt, Human
cagaucuuauguuuuucugu

SEQ ID NO: 69680 - RNA, 22 nt, Human
cagauguuugaaugcuuaccac

SEQ ID NO: 69681 - RNA, 22 nt, Human
cagcugcgcagcgccgggccug

SEQ ID NO: 69682 - RNA, 22 nt, Human
cagcugcugguguaucgggucc

SEQ ID NO: 69683 - RNA, 22 nt, Human
cagcucuggcuauugaggacca

SEQ ID NO: 69684 - RNA, 22 nt, Human
cagauaagcuauaaguaguacc

SEQ ID NO: 69685 - RNA, 22 nt, Human
cagaggaugucuacaccuugag

SEQ ID NO: 69686 - RNA, 22 nt, Human
cagaggcugagcugcgggauga

SEQ ID NO: 69687 - RNA, 22 nt, Human
cagacugugagcuccuugaggg

SEQ ID NO: 69688 - RNA, 22 nt, Human
cagagaagaggucuugaccccu

SEQ ID NO: 69689 - RNA, 22 nt, Human
cagaguccuguaguauugcugg

SEQ ID NO: 69690 - RNA, 22 nt, Human
cagacugagaaagugccacagg

SEQ ID NO: 69691 - RNA, 22 nt, Human
cagaaaacauuguguguauaag

SEQ ID NO: 69692 - RNA, 22 nt, Human
cagaaacacuguauuuagggaa

SEQ ID NO: 69693 - RNA, 22 nt, Human
cagcaugcaaguccagaugugg

SEQ ID NO: 69694 - RNA, 22 nt, Human
cagaggauggaaaugagaacaa

SEQ ID NO: 69695 - RNA, 22 nt, Human
cagaggagcgaguuggacgcca

SEQ ID NO: 69696 - RNA, 22 nt, Human
cagauacaacagcaggaaugaa

SEQ ID NO: 69697 - RNA, 22 nt, Human
cagauuuaauaaaaaaugcauc

SEQ ID NO: 69698 - RNA, 19 nt, Human
cagcaaacacuguaaaugg

SEQ ID NO: 69699 - RNA, 22 nt, Human
cagaugccauagguauaguaua

SEQ ID NO: 69700 - RNA, 22 nt, Human
cagaucacucugggcggcggga

SEQ ID NO: 69701 - RNA, 22 nt, Human
cagagcugagucuucaagguug

SEQ ID NO: 69702 - RNA, 22 nt, Human
cagagcagaaaccugggugauu

SEQ ID NO: 69703 - RNA, 22 nt, Human
cuggagaacucugugcuucacu

SEQ ID NO: 69704 - RNA, 22 nt, Human
cuggagaucaguuggacaacag

SEQ ID NO: 69705 - RNA, 22 nt, Human
cuggagaagagguaguauguag

SEQ ID NO: 69706 - RNA, 22 nt, Human
cuggaaauggcagaguugcauu

SEQ ID NO: 69707 - RNA, 22 nt, Human
cuggaagcgucggaggaagggc

SEQ ID NO: 69708 - RNA, 22 nt, Human
cugagaaauacccaagucuggu

SEQ ID NO: 69709 - RNA, 22 nt, Human
cuggaaaaauggauccugucuu

SEQ ID NO: 69710 - RNA, 22 nt, Human
cuggagcucugggcaucucagg

SEQ ID NO: 69711 - RNA, 22 nt, Human
cuggauagaccccuuauugcau

SEQ ID NO: 69712 - RNA, 22 nt, Human
cuggauuaaacaguuugauacu

SEQ ID NO: 69713 - RNA, 22 nt, Human
cucauugacagagcagcucuac

SEQ ID NO: 69714 - RNA, 22 nt, Human
cucucacucccuccuucccucu

SEQ ID NO: 69715 - RNA, 22 nt, Human
cucuccagucauauucucaguc

SEQ ID NO: 69716 - RNA, 22 nt, Human
cucuauucuaauggauucuggg

SEQ ID NO: 69717 - RNA, 22 nt, Human
cugggggacagagagaggcggu

SEQ ID NO: 69718 - RNA, 22 nt, Human
cugggagaggaaccucgagggu

SEQ ID NO: 69719 - RNA, 22 nt, Human
cuccugcuuuuucuucuuccga

SEQ ID NO: 69720 - RNA, 22 nt, Human
cuccuuaaagggagcagcagcu

SEQ ID NO: 69721 - RNA, 22 nt, Human
cuccuuugagcaaaucuuugau

SEQ ID NO: 69722 - RNA, 22 nt, Human
cuccuauugaucaguacuauuu

SEQ ID NO: 69723 - RNA, 22 nt, Human
cuggcuuucauggcgcaguuga

SEQ ID NO: 69724 - RNA, 21 nt, Human
cugggaacccgaccaaggccu

SEQ ID NO: 69725 - RNA, 22 nt, Human
cucccaauaauaacaagcaggu

SEQ ID NO: 69726 - RNA, 22 nt, Human
cucccaucacaauucagggccu

SEQ ID NO: 69727 - RNA, 22 nt, Human
cuccaucccccugugugucaau

SEQ ID NO: 69728 - RNA, 22 nt, Human
cuccaugagccaggagggcuac

SEQ ID NO: 69729 - RNA, 22 nt, Human
cuccccauuuucaugggcaggu

SEQ ID NO: 69730 - RNA, 22 nt, Human
cuccccacucaacucccagacc

SEQ ID NO: 69731 - RNA, 22 nt, Human
cuccagcucgcgagcucugcuc

SEQ ID NO: 69732 - RNA, 22 nt, Human
cuccaguugugucuuguaagaa

SEQ ID NO: 69733 - RNA, 22 nt, Human
cugaaggacacgugaggagcca

SEQ ID NO: 69734 - RNA, 22 nt, Human
cugaaucugccuccgaggguuu

SEQ ID NO: 69735 - RNA, 22 nt, Human
cugaauucuuguugucggagca

SEQ ID NO: 69736 - RNA, 22 nt, Human
cugaguuuuucaaaucugaauu

SEQ ID NO: 69737 - RNA, 22 nt, Human
cugaggaguaguucuggaggac

SEQ ID NO: 69738 - RNA, 22 nt, Human
cugaggcuaauagaauuuucug

SEQ ID NO: 69739 - RNA, 22 nt, Human
cugagggagacagugcggacua

SEQ ID NO: 69740 - RNA, 22 nt, Human
cugagcuauauauuaugcauag

SEQ ID NO: 69741 - RNA, 23 nt, Human
cuuauauaaucauuagaaaccau

SEQ ID NO: 69742 - RNA, 22 nt, Human
cugacugaggaucaguucauca

SEQ ID NO: 69743 - RNA, 22 nt, Human
cucuuuucaaaccuguuuaugg

SEQ ID NO: 69744 - RNA, 22 nt, Human
cucuuuuuccuaugaaaucuau

SEQ ID NO: 69745 - RNA, 22 nt, Human
cugugguuuuauuuauuugaag

SEQ ID NO: 69746 - RNA, 22 nt, Human
cuguggcugcgcccugggggag

SEQ ID NO: 69747 - RNA, 22 nt, Human
cuguggaaugcaguugcgagca

SEQ ID NO: 69748 - RNA, 22 nt, Human
cucugucuggggaggggagagg

SEQ ID NO: 69749 - RNA, 22 nt, Human
cucuucugugggugcuauguca

SEQ ID NO: 69750 - RNA, 22 nt, Human
cucugcuuagacaggcuuuaag

SEQ ID NO: 69751 - RNA, 22 nt, Human
cuguauggaggaggugcuagcc

SEQ ID NO: 69752 - RNA, 22 nt, Human
cucucuccuuuuugauauuuag

SEQ ID NO: 69753 - RNA, 22 nt, Human
cucucuaacuagagacaggagu

SEQ ID NO: 69754 - RNA, 22 nt, Human
cucuccaguuauagcugauuug

SEQ ID NO: 69755 - RNA, 22 nt, Human
cucucuguuaugcuuucaugaa

SEQ ID NO: 69756 - RNA, 22 nt, Human
cucugauuuuucuaauacuuca

SEQ ID NO: 69757 - RNA, 22 nt, Human
cucucuuuuuuucccuuguuaa

SEQ ID NO: 69758 - RNA, 22 nt, Human
cucugcuagaaggucaaucucu

SEQ ID NO: 69759 - RNA, 22 nt, Human
cuugcucugggaauaugaguuu

SEQ ID NO: 69760 - RNA, 22 nt, Human
cugcuauaacacuaacaucuaa

SEQ ID NO: 69761 - RNA, 22 nt, Human
cugcgcagaucugcuguucucu

SEQ ID NO: 69762 - RNA, 22 nt, Human
cuuggagauacagaggacauuu

SEQ ID NO: 69763 - RNA, 22 nt, Human
cuugcuuuaucugguuucucau

SEQ ID NO: 69764 - RNA, 22 nt, Human
cugcuucacccugccugagaac

SEQ ID NO: 69765 - RNA, 22 nt, Human
cuugucuaguuccuggugaugu

SEQ ID NO: 69766 - RNA, 22 nt, Human
cuugguuugaaacauacucuac

SEQ ID NO: 69767 - RNA, 22 nt, Human
cuugggacucccuguagcagug

SEQ ID NO: 69768 - RNA, 22 nt, Human
cuuggggauuuuaaagaccucu

SEQ ID NO: 69769 - RNA, 22 nt, Human
cugcugcuugauugcaggaagu

SEQ ID NO: 69770 - RNA, 22 nt, Human
cugcugugcagacagacucucu

SEQ ID NO: 69771 - RNA, 22 nt, Human
cuuugauuucucugguccaauc

SEQ ID NO: 69772 - RNA, 18 nt, Human
cuuucugcccccauuagc

SEQ ID NO: 69773 - RNA, 22 nt, Human
cuuucuccagagugaagauccu

SEQ ID NO: 69774 - RNA, 22 nt, Human
cuuucucucaaacacacauaca

SEQ ID NO: 69775 - RNA, 22 nt, Human
cuggagaacagagcuguuuaga

SEQ ID NO: 69776 - RNA, 22 nt, Human
cuuuaaaaauguauuuuugugg

SEQ ID NO: 69777 - RNA, 22 nt, Human
cuuuacauuaauuucuacugau

SEQ ID NO: 69778 - RNA, 22 nt, Human
cuuuaguaaaacguauuuagga

SEQ ID NO: 69779 - RNA, 22 nt, Human
cuuuauguuggggugucuuagu

SEQ ID NO: 69780 - RNA, 22 nt, Human
cuuguuuuaaacuguuguggcu

SEQ ID NO: 69781 - RNA, 22 nt, Human
cuuguuaacaauugguaucuuu

SEQ ID NO: 69782 - RNA, 22 nt, Human
cuggaauugcuugagcuaggaa

SEQ ID NO: 69783 - RNA, 23 nt, Human
cuggacauucgcaaaguucaucu

SEQ ID NO: 69784 - RNA, 22 nt, Human
cuugugagaagaccuuccgcau

SEQ ID NO: 69785 - RNA, 22 nt, Human
cugccuuggcccuaguucaugg

SEQ ID NO: 69786 - RNA, 22 nt, Human
cuugccuuugaaagcauuucuc

SEQ ID NO: 69787 - RNA, 22 nt, Human
cugccuucaaaguaauauuuua

SEQ ID NO: 69788 - RNA, 22 nt, Human
cuucuucuagaagauggggaag

SEQ ID NO: 69789 - RNA, 22 nt, Human
cuucuuugacucacugguacgc

SEQ ID NO: 69790 - RNA, 22 nt, Human
cuugagcugaguuugcagcucu

SEQ ID NO: 69791 - RNA, 22 nt, Human
cuucuucaucuuuuggaggaac

SEQ ID NO: 69792 - RNA, 22 nt, Human
cuucuuaaaguugucacagcug

SEQ ID NO: 69793 - RNA, 22 nt, Human
cuucucuuugacaguugggugu

SEQ ID NO: 69794 - RNA, 22 nt, Human
cuucuggaggcucuagaggaga

SEQ ID NO: 69795 - RNA, 22 nt, Human
cuucuggaggcugcagaaaaga

SEQ ID NO: 69796 - RNA, 21 nt, Human
cuucgcuguuccagcucuugg

SEQ ID NO: 69797 - RNA, 22 nt, Human
cuucucuuggguguggugucuu

SEQ ID NO: 69798 - RNA, 22 nt, Human
cuucucuuccuucucauccuca

SEQ ID NO: 69799 - RNA, 22 nt, Human
cuucuagucaaaauggauaagc

SEQ ID NO: 69800 - RNA, 22 nt, Human
cugcaucacagcaggaggcaca

SEQ ID NO: 69801 - RNA, 22 nt, Human
cugcaguaacuauuuucaauaa

SEQ ID NO: 69802 - RNA, 22 nt, Human
cuuccuaaucuuggguuauuuu

SEQ ID NO: 69803 - RNA, 22 nt, Human
cugcagauaaguguuuugaaaa

SEQ ID NO: 69804 - RNA, 22 nt, Human
cuucaguuaguuucaugugagc

SEQ ID NO: 69805 - RNA, 22 nt, Human
cuucaggaccugaagcccaucu

SEQ ID NO: 69806 - RNA, 22 nt, Human
cugaucccuuuucauuugcagg

SEQ ID NO: 69807 - RNA, 22 nt, Human
cuucauaagauuguugugagga

SEQ ID NO: 69808 - RNA, 22 nt, Human
cugaugucaaauuuaucaaagc

SEQ ID NO: 69809 - RNA, 20 nt, Human
cugauguucgugcuuccugg

SEQ ID NO: 69810 - RNA, 22 nt, Human
cugauguuuaucucaagaguuc

SEQ ID NO: 69811 - RNA, 22 nt, Human
cuucccaucaagcuggaggaug

SEQ ID NO: 69812 - RNA, 22 nt, Human
cugcacagucauuuccucucaa

SEQ ID NO: 69813 - RNA, 22 nt, Human
cuucauguucaugcuaacauuu

SEQ ID NO: 69814 - RNA, 22 nt, Human
gaagaugacaucggaucugucu

SEQ ID NO: 69815 - RNA, 22 nt, Human
gaagaugcugcuuguucacggg

SEQ ID NO: 69816 - RNA, 22 nt, Human
gagcagcugagcuggaaugaga

SEQ ID NO: 69817 - RNA, 22 nt, Human
gaacuugagugugcuauuucuu

SEQ ID NO: 69818 - RNA, 22 nt, Human
gaaccauuuaauggagaugcuc

SEQ ID NO: 69819 - RNA, 22 nt, Human
gaacugaauguguaauguuggc

SEQ ID NO: 69820 - RNA, 22 nt, Human
gaacauuucugcagaugucuga

SEQ ID NO: 69821 - RNA, 22 nt, Human
gagcagcaggccagguugcagg

SEQ ID NO: 69822 - RNA, 22 nt, Human
gagcagcacagaccaaacagaa

SEQ ID NO: 69823 - RNA, 22 nt, Human
gagcaacacauugaaugaggau

SEQ ID NO: 69824 - RNA, 22 nt, Human
gagcacuucagcauaaaucaca

SEQ ID NO: 69825 - RNA, 22 nt, Human
gagcacugagcuggaauuggag

SEQ ID NO: 69826 - RNA, 22 nt, Human
gagauuugaguuccuacugagu

SEQ ID NO: 69827 - RNA, 22 nt, Human
gaacauauuuagcaccuaauau

SEQ ID NO: 69828 - RNA, 22 nt, Human
gagaguuggaggguauguuagu

SEQ ID NO: 69829 - RNA, 22 nt, Human
gagauggauuuuuuugccaguc

SEQ ID NO: 69830 - RNA, 22 nt, Human
gaacaaaagauagcccaaacau

SEQ ID NO: 69831 - RNA, 22 nt, Human
gaaauaggcccuuacauggaaa

SEQ ID NO: 69832 - RNA, 22 nt, Human
gaaaugaaacacacaugcagcu

SEQ ID NO: 69833 - RNA, 22 nt, Human
gagaggaagugccugcucccag

SEQ ID NO: 69834 - RNA, 22 nt, Human
gaaagugaauguaacauguuau

SEQ ID NO: 69835 - RNA, 22 nt, Human
gagaagucaggaguggagaaca

SEQ ID NO: 69836 - RNA, 22 nt, Human
gacuugaagcucucugguuuug

SEQ ID NO: 69837 - RNA, 20 nt, Human
gagaaugucauuccuuuuuu

SEQ ID NO: 69838 - RNA, 22 nt, Human
gaaagagaugucguuugucuuc

SEQ ID NO: 69839 - RNA, 22 nt, Human
gaaaggagacugcacuggagcc

SEQ ID NO: 69840 - RNA, 22 nt, Human
gaaagcuuggaaacgacuuuau

SEQ ID NO: 69841 - RNA, 22 nt, Human
gagaagugggggucugggauga

SEQ ID NO: 69842 - RNA, 22 nt, Human
gaaagaggcugucagggaaugg

SEQ ID NO: 69843 - RNA, 22 nt, Human
gacuguuggcagauguuugagu

SEQ ID NO: 69844 - RNA, 22 nt, Human
gaaaaagucuuaaaguaaggca

SEQ ID NO: 69845 - RNA, 22 nt, Human
gacuucuuaaagaggugaggaa

SEQ ID NO: 69846 - RNA, 22 nt, Human
gaaaagcucuuuagaagagguu

SEQ ID NO: 69847 - RNA, 22 nt, Human
gaaaagaaaggaugguaugugu

SEQ ID NO: 69848 - RNA, 19 nt, Human
gacuccugagaugugaaac

SEQ ID NO: 69849 - RNA, 22 nt, Human
gacucuucucucccaaaugccc

SEQ ID NO: 69850 - RNA, 22 nt, Human
cuuuuucuugugguuaauaucu

SEQ ID NO: 69851 - RNA, 19 nt, Human
cuuuuagagggagaggacu

SEQ ID NO: 69852 - RNA, 22 nt, Human
cuuuuccuccaggaagccaagc

SEQ ID NO: 69853 - RNA, 22 nt, Human
cuuuucuuuucuucucuuccca

SEQ ID NO: 69854 - RNA, 22 nt, Human
gacauugaauugaauccagauu

SEQ ID NO: 69855 - RNA, 22 nt, Human
gacauuuauuggauuuuacgag

SEQ ID NO: 69856 - RNA, 20 nt, Human
cuuguuaaauaugcagguag

SEQ ID NO: 69857 - RNA, 19 nt, Human
gaauugcacgagcagaggc

SEQ ID NO: 69858 - RNA, 22 nt, Human
cuuguuuggccauaggugcugg

SEQ ID NO: 69859 - RNA, 22 nt, Human
cuuuaagugaaaggggauuaaa

SEQ ID NO: 69860 - RNA, 22 nt, Human
gaauggagaacccuggacacug

SEQ ID NO: 69861 - RNA, 22 nt, Human
gaauucuaguucuguaucucug

SEQ ID NO: 69862 - RNA, 20 nt, Human
gaauucugaagauaauuugg

SEQ ID NO: 69863 - RNA, 21 nt, Human
cuuggagacucuuggccacau

SEQ ID NO: 69864 - RNA, 22 nt, Human
cuuggcaaaguggcaaaauuag

SEQ ID NO: 69865 - RNA, 22 nt, Human
cuuggcacauuuuguucuucug

SEQ ID NO: 69866 - RNA, 22 nt, Human
cuuggcauguucaucugcuugg

SEQ ID NO: 69867 - RNA, 22 nt, Human
cuucuugucagugauuucuucc

SEQ ID NO: 69868 - RNA, 22 nt, Human
cuucuugggaggggcggagcuc

SEQ ID NO: 69869 - RNA, 22 nt, Human
cuucuuucuuuucuucuucucu

SEQ ID NO: 69870 - RNA, 22 nt, Human
cuucuuuucuacuggccuagaa

SEQ ID NO: 69871 - RNA, 22 nt, Human
cuucuuuccauguguuuugguu

SEQ ID NO: 69872 - RNA, 22 nt, Human
gaauagauuagaaagaguaugu

SEQ ID NO: 69873 - RNA, 22 nt, Human
gaauacaaauaauaccaaggug

SEQ ID NO: 69874 - RNA, 22 nt, Human
gaaucucuuugucccugaguuu

SEQ ID NO: 69875 - RNA, 22 nt, Human
gaagcucaguugcuuagaucuc

SEQ ID NO: 69876 - RNA, 22 nt, Human
gaagcgucaugaaagaaaggcu

SEQ ID NO: 69877 - RNA, 22 nt, Human
gaaggaaaagacgugcuaagua

SEQ ID NO: 69878 - RNA, 22 nt, Human
cuucauuucaggcugaagaaua

SEQ ID NO: 69879 - RNA, 22 nt, Human
cuuccagugcauagguagauca

SEQ ID NO: 69880 - RNA, 22 nt, Human
cuucccuaagggacuggcauag

SEQ ID NO: 69881 - RNA, 22 nt, Human
cuucccuacuucagugcucccu

SEQ ID NO: 69882 - RNA, 22 nt, Human
cuuccguuacugacaaaauguu

SEQ ID NO: 69883 - RNA, 22 nt, Human
gaaggaagcugucuggaugugu

SEQ ID NO: 69884 - RNA, 22 nt, Human
gaaggagaggauugugaggcug

SEQ ID NO: 69885 - RNA, 22 nt, Human
cuucucuugugauguuagcgga

SEQ ID NO: 69886 - RNA, 22 nt, Human
cuucuguggcugagaaggcagc

SEQ ID NO: 69887 - RNA, 22 nt, Human
cuucuguggaauagguuugaca

SEQ ID NO: 69888 - RNA, 22 nt, Human
cuucugaugugugcucuuaguu

SEQ ID NO: 69889 - RNA, 22 nt, Human
cuucuuagugauuuaacaugua

SEQ ID NO: 69890 - RNA, 22 nt, Human
cuucacuccuggagugaguuuc

SEQ ID NO: 69891 - RNA, 23 nt, Human
cuucagaccucagaaggucuguu

SEQ ID NO: 69892 - RNA, 22 nt, Human
gaagccaugauaaccagugugg

SEQ ID NO: 69893 - RNA, 22 nt, Human
cuucagagugacucagcaucuu

SEQ ID NO: 69894 - RNA, 20 nt, Human
cuuauuuuggagaacuuuuc

SEQ ID NO: 69895 - RNA, 22 nt, Human
cuuauuugcccauguuucuuua

SEQ ID NO: 69896 - RNA, 22 nt, Human
cuuaagacaggcucaaagauua

SEQ ID NO: 69897 - RNA, 22 nt, Human
cuuauaucaacuggaaaaauua

SEQ ID NO: 69898 - RNA, 20 nt, Human
cuguuugcuaucaugagcug

SEQ ID NO: 69899 - RNA, 22 nt, Human
cuguuucuuugcugucagagag

SEQ ID NO: 69900 - RNA, 22 nt, Human
gaaauuucuuuguuaucuuggu

SEQ ID NO: 69901 - RNA, 22 nt, Human
cuguuccuccaccucaacaaac

SEQ ID NO: 69902 - RNA, 22 nt, Human
gaaauagagacaguaagugucu

SEQ ID NO: 69903 - RNA, 22 nt, Human
gaaaugucaagauauguuugga

SEQ ID NO: 69904 - RNA, 22 nt, Human
cuguggaguccuggggaaugga

SEQ ID NO: 69905 - RNA, 22 nt, Human
cuggcaguguccagcucgugau

SEQ ID NO: 69906 - RNA, 22 nt, Human
cuggcagcucugagucccuucu

SEQ ID NO: 69907 - RNA, 22 nt, Human
cugaagcugggcacuuccuuuu

SEQ ID NO: 69908 - RNA, 22 nt, Human
cugacagaucuggaucugaacu

SEQ ID NO: 69909 - RNA, 22 nt, Human
cugaaagacgaggggaagucgg

SEQ ID NO: 69910 - RNA, 22 nt, Human
cugaaagcaaaguaauucuuaa

SEQ ID NO: 69911 - RNA, 22 nt, Human
cggcuucucgggucggauuccg

SEQ ID NO: 69912 - RNA, 22 nt, Human
cucuuuuuuugucuuaagaacc

SEQ ID NO: 69913 - RNA, 20 nt, Human
cucuuuaugagaccacuguc

SEQ ID NO: 69914 - RNA, 22 nt, Human
cucuugugucaccauggauaaa

SEQ ID NO: 69915 - RNA, 22 nt, Human
cucuucauguuggugcagaagc

SEQ ID NO: 69916 - RNA, 22 nt, Human
cucuuagucugcuuuuuuucca

SEQ ID NO: 69917 - RNA, 22 nt, Human
cucuguugucaguggaagcagc

SEQ ID NO: 69918 - RNA, 22 nt, Human
cucuguauauugagugcuuacu

SEQ ID NO: 69919 - RNA, 22 nt, Human
cucugguuucgcaggaaauaga

SEQ ID NO: 69920 - RNA, 22 nt, Human
cucuguggucugaagccuguga

SEQ ID NO: 69921 - RNA, 22 nt, Human
cucuggagggaggcugagcugg

SEQ ID NO: 69922 - RNA, 22 nt, Human
cucuaaauguggucugcagaua

SEQ ID NO: 69923 - RNA, 22 nt, Human
cucguccugguuuaaguguccu

SEQ ID NO: 69924 - RNA, 22 nt, Human
cucuauuuuuucaucuuucagg

SEQ ID NO: 69925 - RNA, 22 nt, Human
cuccuuuuuauaucuuucucug

SEQ ID NO: 69926 - RNA, 22 nt, Human
cuccuuuuugggaccgugcagc

SEQ ID NO: 69927 - RNA, 22 nt, Human
cuccuuuuuuuaaagauggauu

SEQ ID NO: 69928 - RNA, 21 nt, Human
cuccuguaaaucaccuccgca

SEQ ID NO: 69929 - RNA, 22 nt, Human
cuccuugagaaugaacaaagga

SEQ ID NO: 69930 - RNA, 22 nt, Human
cuccuugguuccggcguuggag

SEQ ID NO: 69931 - RNA, 22 nt, Human
cuccuuuacaauugugggaaaa

SEQ ID NO: 69932 - RNA, 22 nt, Human
cuccuuuuccuacucauacuau

SEQ ID NO: 69933 - RNA, 22 nt, Human
cuccccuuauuccucaacauga

SEQ ID NO: 69934 - RNA, 22 nt, Human
cucauguucuaagcuuucuuca

SEQ ID NO: 69935 - RNA, 22 nt, Human
cucaugcugcaaauggcuguuu

SEQ ID NO: 69936 - RNA, 22 nt, Human
cgcuuugacuuuagaaggccaa

SEQ ID NO: 69937 - RNA, 22 nt, Human
cgcucugccugcccuaacuucc

SEQ ID NO: 69938 - RNA, 22 nt, Human
cucaggaaaauauugaagaagu

SEQ ID NO: 69939 - RNA, 22 nt, Human
cuauugguaucacacugauuuc

SEQ ID NO: 69940 - RNA, 22 nt, Human
cuauuuucccauaugguugaca

SEQ ID NO: 69941 - RNA, 22 nt, Human
cuauuauuauugucguuuuaca

SEQ ID NO: 69942 - RNA, 22 nt, Human
cucacgguuugcaucaagagug

SEQ ID NO: 69943 - RNA, 22 nt, Human
cucagaagaacaaaggcucuac

SEQ ID NO: 69944 - RNA, 22 nt, Human
cuauguuuugcuagugaugggu

SEQ ID NO: 69945 - RNA, 22 nt, Human
cuauacuuagaacuccauuuuc

SEQ ID NO: 69946 - RNA, 22 nt, Human
cuaugaaucaauuucugcaguu

SEQ ID NO: 69947 - RNA, 22 nt, Human
cuauauucuggaauguccauuu

SEQ ID NO: 69948 - RNA, 22 nt, Human
cuaguuuucacaaaggaagggc

SEQ ID NO: 69949 - RNA, 22 nt, Human
cuauaagguguuucuauugguc

SEQ ID NO: 69950 - RNA, 22 nt, Human
cgaccccugaaaauggcagcca

SEQ ID NO: 69951 - RNA, 18 nt, Human
cuaagaggucguuucuca

SEQ ID NO: 69952 - RNA, 22 nt, Human
cgacaagagaaaugcuuuguuu

SEQ ID NO: 69953 - RNA, 22 nt, Human
ccuuuuguuucccuuuauguuc

SEQ ID NO: 69954 - RNA, 20 nt, Human
ccuuuuguugcuguuuggau

SEQ ID NO: 69955 - RNA, 17 nt, Human
cguuccagaacaaauga

SEQ ID NO: 69956 - RNA, 22 nt, Human
ccuuuuaucgcgaagaacucca

SEQ ID NO: 69957 - RNA, 19 nt, Human
cgguaugaauguacuaugg

SEQ ID NO: 69958 - RNA, 22 nt, Human
ccuuccaguucuugguuguaau

SEQ ID NO: 69959 - RNA, 22 nt, Human
ccuuagaaaaucauggaauauu

SEQ ID NO: 69960 - RNA, 22 nt, Human
cggggcuggcguuagggaggca

SEQ ID NO: 69961 - RNA, 22 nt, Human
ccuguguucguccucaccuugc

SEQ ID NO: 69962 - RNA, 22 nt, Human
ccugcuggagucuaguuggucu

SEQ ID NO: 69963 - RNA, 22 nt, Human
ccugcucuaauucauucaugcu

SEQ ID NO: 69964 - RNA, 21 nt, Human
ccugcacuucccuccucaagu

SEQ ID NO: 69965 - RNA, 22 nt, Human
ccugcaguuuuuccaugauaca

SEQ ID NO: 69966 - RNA, 22 nt, Human
ccucuuuugaaccaguucuuca

SEQ ID NO: 69967 - RNA, 22 nt, Human
ccugcaguagagguugguaggg

SEQ ID NO: 69968 - RNA, 22 nt, Human
ccucauagccuuuccuacuuua

SEQ ID NO: 69969 - RNA, 22 nt, Human
ccucuaugcccuucuggggguc

SEQ ID NO: 69970 - RNA, 22 nt, Human
ccucuccucugugcagacugcc

SEQ ID NO: 69971 - RNA, 22 nt, Human
cgagaccaggcuuuuuuuagga

SEQ ID NO: 69972 - RNA, 22 nt, Human
cgcagcuucagggccaggaggg

SEQ ID NO: 69973 - RNA, 22 nt, Human
ccucacuucuuucucuucacuu

SEQ ID NO: 69974 - RNA, 22 nt, Human
ccucaggaauuuauucuucugu

SEQ ID NO: 69975 - RNA, 22 nt, Human
ccucacaaagaaugucuagaca

SEQ ID NO: 69976 - RNA, 22 nt, Human
cgacagauuauuuugugacugc

SEQ ID NO: 69977 - RNA, 19 nt, Human
ccugcugaagugaugcagc

SEQ ID NO: 69978 - RNA, 22 nt, Human
ccugcccaucccaccccagcau

SEQ ID NO: 69979 - RNA, 22 nt, Human
cccuugagccuggaggagcucu

SEQ ID NO: 69980 - RNA, 22 nt, Human
ccugagacucuccugugcagcc

SEQ ID NO: 69981 - RNA, 22 nt, Human
ccugaguucuuauuuccaguca

SEQ ID NO: 69982 - RNA, 22 nt, Human
ccugauauggugucauuuaaac

SEQ ID NO: 69983 - RNA, 22 nt, Human
ccugcacuaccuggggcugcug

SEQ ID NO: 69984 - RNA, 22 nt, Human
ccugaauuuaucugaauggugg

SEQ ID NO: 69985 - RNA, 22 nt, Human
ccucucugcgaaugcugauagu

SEQ ID NO: 69986 - RNA, 20 nt, Human
ccucucugcaugcucccuga

SEQ ID NO: 69987 - RNA, 22 nt, Human
ccucuuugcccucuuuccuucc

SEQ ID NO: 69988 - RNA, 22 nt, Human
ccugaaaugaguucugcucacu

SEQ ID NO: 69989 - RNA, 22 nt, Human
ccugaagaugguugauccccuu

SEQ ID NO: 69990 - RNA, 22 nt, Human
cccucucaaucuuuaaaauaca

SEQ ID NO: 69991 - RNA, 22 nt, Human
cccuccuuggccccagacccgc

SEQ ID NO: 69992 - RNA, 22 nt, Human
cccuaaucuuggaaaugccauu

SEQ ID NO: 69993 - RNA, 22 nt, Human
ccuccugggccuugcucuguga

SEQ ID NO: 69994 - RNA, 22 nt, Human
ccuccuggaguuacuuccaaaa

SEQ ID NO: 69995 - RNA, 22 nt, Human
ccuccuuucaggaaguaggugg

SEQ ID NO: 69996 - RNA, 22 nt, Human
ccucuagaauuaucacuuuuaa

SEQ ID NO: 69997 - RNA, 19 nt, Human
ccuccgcauccucaucugu

SEQ ID NO: 69998 - RNA, 19 nt, Human
cccgauggagacuuagcag

SEQ ID NO: 69999 - RNA, 22 nt, Human
ccuauauaaaugacauauagga

SEQ ID NO: 70000 - RNA, 22 nt, Human
ccuagcauagcuuuugccuccc

SEQ ID NO: 70001 - RNA, 22 nt, Human
ccuaggcuggcugucuucaggu

SEQ ID NO: 70002 - RNA, 22 nt, Human
ccucaguguguggauguuagag

SEQ ID NO: 70003 - RNA, 22 nt, Human
ccgggcuuccuuagagcaagau

SEQ ID NO: 70004 - RNA, 22 nt, Human
ccgauuuaugucucugacuuga

SEQ ID NO: 70005 - RNA, 22 nt, Human
ccaugaggcaaagacugauaua

SEQ ID NO: 70006 - RNA, 22 nt, Human
ccauaaaguaggaaacacuaca

SEQ ID NO: 70007 - RNA, 22 nt, Human
cccuucuguaucuucugaguuu

SEQ ID NO: 70008 - RNA, 22 nt, Human
cccuggucucugacuugauccu

SEQ ID NO: 70009 - RNA, 22 nt, Human
ccagucuuggugucuguagcac

SEQ ID NO: 70010 - RNA, 22 nt, Human
cccugauaaaucagcaccucag

SEQ ID NO: 70011 - RNA, 22 nt, Human
ccagggcuggaggaggucagga

SEQ ID NO: 70012 - RNA, 22 nt, Human
ccccuuuguagcccagcaguug

SEQ ID NO: 70013 - RNA, 23 nt, Human
cccgggaagugcugcuuaucugg

SEQ ID NO: 70014 - RNA, 22 nt, Human
ccagcuuuucagaaucugccug

SEQ ID NO: 70015 - RNA, 22 nt, Human
ccccuauaugccugcagugauu

SEQ ID NO: 70016 - RNA, 22 nt, Human
cccauuaguuguuaaucaucaa

SEQ ID NO: 70017 - RNA, 22 nt, Human
cccauggacuagcuaugagcag

SEQ ID NO: 70018 - RNA, 22 nt, Human
ccagcagaagcucccgcugggu

SEQ ID NO: 70019 - RNA, 22 nt, Human
ccagaggcuuaugcagcugcug

SEQ ID NO: 70020 - RNA, 22 nt, Human
ccagaugggggcugugggaggg

SEQ ID NO: 70021 - RNA, 23 nt, Human
cauguacacacagcuguacagug

SEQ ID NO: 70022 - RNA, 23 nt, Human
cauauucagaaacaccuaguggu

SEQ ID NO: 70023 - RNA, 22 nt, Human
cauuacaagaaauagcauaaug

SEQ ID NO: 70024 - RNA, 22 nt, Human
cauuagugaggggcugccugcu

SEQ ID NO: 70025 - RNA, 22 nt, Human
uuuuuuuguagguguaugaaaa

SEQ ID NO: 70026 - RNA, 22 nt, Human
uuuuuuuuacuccggacagcuc

SEQ ID NO: 70027 - RNA, 22 nt, Human
uuuuucuuugguaacucuuccu

SEQ ID NO: 70028 - RNA, 22 nt, Human
uuuuucuuugcuuuccacuggc

SEQ ID NO: 70029 - RNA, 22 nt, Human
uuuuucuccauuccaggugccu

SEQ ID NO: 70030 - RNA, 21 nt, Human
uuuuucuccagaguuuccacu

SEQ ID NO: 70031 - RNA, 22 nt, Human
uuuuucuccucucucuuucauu

SEQ ID NO: 70032 - RNA, 21 nt, Human
uuuuuggagggguggggagga

SEQ ID NO: 70033 - RNA, 22 nt, Human
uuuuuggacccaucuucuuuuu

SEQ ID NO: 70034 - RNA, 22 nt, Human
uuuuugcuuuuuugucaucuaa

SEQ ID NO: 70035 - RNA, 22 nt, Human
uuuuugggaagaauucugauau

SEQ ID NO: 70036 - RNA, 22 nt, Human
uuuuuguauaugcuucgaggau

SEQ ID NO: 70037 - RNA, 22 nt, Human
uuuuuguuauuuagguguagag

SEQ ID NO: 70038 - RNA, 22 nt, Human
uuuuuuccuguuugucuuuggg

SEQ ID NO: 70039 - RNA, 22 nt, Human
uuuuuuccagcuucuagaggcc

SEQ ID NO: 70040 - RNA, 22 nt, Human
uuuuuucuucucuaucuuaaua

SEQ ID NO: 70041 - RNA, 22 nt, Human
uuuuuuccugguuacagauugu

SEQ ID NO: 70042 - RNA, 18 nt, Human
uuuuuuguucuguuuugu

SEQ ID NO: 70043 - RNA, 22 nt, Human
uuuuaaucagguauuugaguau

SEQ ID NO: 70044 - RNA, 22 nt, Human
uuuuaauucaacauuugcuuuu

SEQ ID NO: 70045 - RNA, 22 nt, Human
uuuuaaaguaauugaagcuugu

SEQ ID NO: 70046 - RNA, 22 nt, Human
uuuuaaaagguugcuguuauaa

SEQ ID NO: 70047 - RNA, 22 nt, Human
uuuuauaaaaccuguuugaccu

SEQ ID NO: 70048 - RNA, 22 nt, Human
uuuuaguaauacuuuggccuuu

SEQ ID NO: 70049 - RNA, 22 nt, Human
uuuuagccagcaucugggucga

SEQ ID NO: 70050 - RNA, 22 nt, Human
uuuuagaagcauuuaugagauu

SEQ ID NO: 70051 - RNA, 22 nt, Human
uuuuauguuccugaagcuaucu

SEQ ID NO: 70052 - RNA, 22 nt, Human
uuuacuuuugguaaggucauuu

SEQ ID NO: 70053 - RNA, 22 nt, Human
uuuacuuguuuugcucuuuucc

SEQ ID NO: 70054 - RNA, 22 nt, Human
uuuacuguuuacagcuaaugca

SEQ ID NO: 70055 - RNA, 19 nt, Human
uuuacuuaggccacagaau

SEQ ID NO: 70056 - RNA, 19 nt, Human
uuuaaugugugcugcaauc

SEQ ID NO: 70057 - RNA, 22 nt, Human
uuuaaugucuuuggccuuuaau

SEQ ID NO: 70058 - RNA, 22 nt, Human
uuuagagauaaaugcucuccca

SEQ ID NO: 70059 - RNA, 22 nt, Human
uuguaggguauagcaggagaac

SEQ ID NO: 70060 - RNA, 22 nt, Human
uuuguguuggaagaaaugcuac

SEQ ID NO: 70061 - RNA, 22 nt, Human
uuuguguuuugaggucuugcaa

SEQ ID NO: 70062 - RNA, 22 nt, Human
uuuagaugcuguauguuauuuc

SEQ ID NO: 70063 - RNA, 22 nt, Human
uuuguguuuucaggcacauggc

SEQ ID NO: 70064 - RNA, 22 nt, Human
uuuguucuagauaacugguaau

SEQ ID NO: 70065 - RNA, 21 nt, Human
uuuguucaggggcaaaguuaa

SEQ ID NO: 70066 - RNA, 19 nt, Human
uuuguuguaucagagcuuu

SEQ ID NO: 70067 - RNA, 17 nt, Human
uuuguuucauacuucau

SEQ ID NO: 70068 - RNA, 22 nt, Human
uuuguuugcugagugaauucaa

SEQ ID NO: 70069 - RNA, 22 nt, Human
uuuguuuuggugucaugcguga

SEQ ID NO: 70070 - RNA, 22 nt, Human
uuuucucaguuuuuuucaaaag

SEQ ID NO: 70071 - RNA, 22 nt, Human
uuuucauagccagaaacugaaa

SEQ ID NO: 70072 - RNA, 22 nt, Human
uuuuccaaaaguggagaggaau

SEQ ID NO: 70073 - RNA, 22 nt, Human
uuuuccuuccugucucuuuauu

SEQ ID NO: 70074 - RNA, 22 nt, Human
uuuuccuucugauacuccauuu

SEQ ID NO: 70075 - RNA, 22 nt, Human
uuuuccuuagaaauacauugau

SEQ ID NO: 70076 - RNA, 22 nt, Human
uuuuccuuaacagagggagaaa

SEQ ID NO: 70077 - RNA, 22 nt, Human
uuuuccuguccuugggucugca

SEQ ID NO: 70078 - RNA, 22 nt, Human
uuuucugauccuucuaacuuga

SEQ ID NO: 70079 - RNA, 22 nt, Human
uuuucuucucauucugaccuca

SEQ ID NO: 70080 - RNA, 22 nt, Human
uuuucuguuuaugaaauugugu

SEQ ID NO: 70081 - RNA, 22 nt, Human
uuuucucucacuucacauauuu

SEQ ID NO: 70082 - RNA, 22 nt, Human
uuuugauacaaguuguaaaaaa

SEQ ID NO: 70083 - RNA, 22 nt, Human
uuuugagucuggcaguuuuguu

SEQ ID NO: 70084 - RNA, 22 nt, Human
uuuucuuggaguggcuguccuu

SEQ ID NO: 70085 - RNA, 22 nt, Human
uuuugcuagaaaucaccaauac

SEQ ID NO: 70086 - RNA, 22 nt, Human
uuuugccuauuguaucaucgua

SEQ ID NO: 70087 - RNA, 22 nt, Human
uuuugguauggcuugauagagu

SEQ ID NO: 70088 - RNA, 22 nt, Human
uuuuggauugcuaacucagggu

SEQ ID NO: 70089 - RNA, 22 nt, Human
uuuugcuucuaguauauuuuuu

SEQ ID NO: 70090 - RNA, 22 nt, Human
uuuuggaaaaaccaguauggaa

SEQ ID NO: 70091 - RNA, 18 nt, Human
uuuuguguuuauucugca

SEQ ID NO: 70092 - RNA, 21 nt, Human
uuuuguguugcgcacuuugag

SEQ ID NO: 70093 - RNA, 22 nt, Human
uuuuguggacugauccgaggac

SEQ ID NO: 70094 - RNA, 22 nt, Human
uuuuguagauagggaaacagag

SEQ ID NO: 70095 - RNA, 22 nt, Human
uuuuuaauuuuaagcuauuugu

SEQ ID NO: 70096 - RNA, 22 nt, Human
uuuuuagcauaugucaaaucag

SEQ ID NO: 70097 - RNA, 22 nt, Human
uuuuuaaaauuaggacggcacg

SEQ ID NO: 70098 - RNA, 22 nt, Human
uuuuuauaagagcagcagaguu

SEQ ID NO: 70099 - RNA, 22 nt, Human
uuuuuagggauuaguguuugag

SEQ ID NO: 70100 - RNA, 22 nt, Human
uuuuuagcuguuauuguggaag

SEQ ID NO: 70101 - RNA, 22 nt, Human
uuuuuauguaaaauauuaaaag

SEQ ID NO: 70102 - RNA, 22 nt, Human
gaugauuuuguaacuggggaca

SEQ ID NO: 70103 - RNA, 22 nt, Human
gaugauuccuuuguucauugug

SEQ ID NO: 70104 - RNA, 22 nt, Human
gagagaaggaagugaauuuccc

SEQ ID NO: 70105 - RNA, 23 nt, Human
gaugauggcaacuacauccggug

SEQ ID NO: 70106 - RNA, 22 nt, Human
gagaccuuaagagaugucagcu

SEQ ID NO: 70107 - RNA, 20 nt, Human
gagaauuccagguuucugug

SEQ ID NO: 70108 - RNA, 22 nt, Human
gagccaugagauaagagcaccu

SEQ ID NO: 70109 - RNA, 22 nt, Human
gagagaguaucugcugguucac

SEQ ID NO: 70110 - RNA, 22 nt, Human
gagagcaaaccuguguuuggag

SEQ ID NO: 70111 - RNA, 22 nt, Human
gagagucuuaaguuacagaacu

SEQ ID NO: 70112 - RNA, 22 nt, Human
gaugccuccaggaaagaggacg

SEQ ID NO: 70113 - RNA, 22 nt, Human
gaugcucuugauuggaccaggg

SEQ ID NO: 70114 - RNA, 22 nt, Human
gauguuaauauguuucaccaaa

SEQ ID NO: 70115 - RNA, 22 nt, Human
gagcagcucgagaaggaagcag

SEQ ID NO: 70116 - RNA, 22 nt, Human
gagcagccugaggauucugcuc

SEQ ID NO: 70117 - RNA, 22 nt, Human
gauguaucugagcugcuuaggu

SEQ ID NO: 70118 - RNA, 22 nt, Human
gaugguuuuacauuuuaauguu

SEQ ID NO: 70119 - RNA, 22 nt, Human
gaugguggaggaaucgcugaag

SEQ ID NO: 70120 - RNA, 22 nt, Human
gagauuuccauauuuuguaaca

SEQ ID NO: 70121 - RNA, 22 nt, Human
gagauuguggcagcagcuguuu

SEQ ID NO: 70122 - RNA, 22 nt, Human
gagauuucauuugugaggcuca

SEQ ID NO: 70123 - RNA, 22 nt, Human
gagauuaauuaaaaccuuuaug

SEQ ID NO: 70124 - RNA, 22 nt, Human
gagaucuguguuugcugaagcu

SEQ ID NO: 70125 - RNA, 22 nt, Human
gagauccccagugugucucggc

SEQ ID NO: 70126 - RNA, 22 nt, Human
gagcuuuguuccgugguggcac

SEQ ID NO: 70127 - RNA, 22 nt, Human
gaggaaaauggaguguaauuaa

SEQ ID NO: 70128 - RNA, 22 nt, Human
gagcucucgggcuggggcguug

SEQ ID NO: 70129 - RNA, 21 nt, Human
gauuuuagggcagccaaacac

SEQ ID NO: 70130 - RNA, 22 nt, Human
gauuucuucauuuaaaaauauu

SEQ ID NO: 70131 - RNA, 22 nt, Human
gauuuucauuauagcuaguuuc

SEQ ID NO: 70132 - RNA, 22 nt, Human
gagcgcacagaaggaagcagcc

SEQ ID NO: 70133 - RNA, 22 nt, Human
gagccuaggguucagacuuucc

SEQ ID NO: 70134 - RNA, 22 nt, Human
gagccuguuaggcaccuguguu

SEQ ID NO: 70135 - RNA, 22 nt, Human
gauuucauaaaacgagaaacuc

SEQ ID NO: 70136 - RNA, 22 nt, Human
gauugggagugugacauuguau

SEQ ID NO: 70137 - RNA, 22 nt, Human
gauuggucacacaauaguauau

SEQ ID NO: 70138 - RNA, 22 nt, Human
gauuccuuucgccugccgagcu

SEQ ID NO: 70139 - RNA, 22 nt, Human
gauugcugccagcguguccgug

SEQ ID NO: 70140 - RNA, 22 nt, Human
gauugcaucaauauuuagagua

SEQ ID NO: 70141 - RNA, 22 nt, Human
gauugauguaggugauaaaucu

SEQ ID NO: 70142 - RNA, 22 nt, Human
gauucugaaauuaacagacugg

SEQ ID NO: 70143 - RNA, 22 nt, Human
gauucuaucauucuguauauua

SEQ ID NO: 70144 - RNA, 22 nt, Human
gagccauggaggaugugcagca

SEQ ID NO: 70145 - RNA, 22 nt, Human
gauucagagcugcaacaaagaa

SEQ ID NO: 70146 - RNA, 19 nt, Human
gagcaugacuggccuugca

SEQ ID NO: 70147 - RNA, 22 nt, Human
gauuaagauuacauauuuaagu

SEQ ID NO: 70148 - RNA, 22 nt, Human
gagcaggucuuugguaaugcuu

SEQ ID NO: 70149 - RNA, 22 nt, Human
gagcagguuauuagaaauggaa

SEQ ID NO: 70150 - RNA, 22 nt, Human
gauguuuugaaagaagaauaca

SEQ ID NO: 70151 - RNA, 22 nt, Human
gaggagagcuggccagguuucu

SEQ ID NO: 70152 - RNA, 22 nt, Human
gaggagcaggcaggaucugguc

SEQ ID NO: 70153 - RNA, 22 nt, Human
gcaauuguauugucaagacaug

SEQ ID NO: 70154 - RNA, 22 nt, Human
gcaaggaggguaaccacauuuc

SEQ ID NO: 70155 - RNA, 22 nt, Human
gcaauuggaaugaauucuauuu

SEQ ID NO: 70156 - RNA, 22 nt, Human
gaggacugguugggaaugugaa

SEQ ID NO: 70157 - RNA, 22 nt, Human
gaggacuucaggccuggccagg

SEQ ID NO: 70158 - RNA, 22 nt, Human
gaggauaaugaaucugaaucau

SEQ ID NO: 70159 - RNA, 22 nt, Human
gaggaggagaagcggcggcgga

SEQ ID NO: 70160 - RNA, 22 nt, Human
gaggaggacauuggaaagaacu

SEQ ID NO: 70161 - RNA, 21 nt, Human
gcagaaagugauuugcuauuc

SEQ ID NO: 70162 - RNA, 22 nt, Human
gagggaaaggggccaugauugg

SEQ ID NO: 70163 - RNA, 22 nt, Human
gagggagagaugcuggaccggg

SEQ ID NO: 70164 - RNA, 22 nt, Human
gcacucugggucaucugcugcc

SEQ ID NO: 70165 - RNA, 22 nt, Human
gaggcucagagggacuuucaag

SEQ ID NO: 70166 - RNA, 22 nt, Human
gcacauauuuagaucuugaugu

SEQ ID NO: 70167 - RNA, 22 nt, Human
gcacagucaacacuuauucacc

SEQ ID NO: 70168 - RNA, 22 nt, Human
gaggauuugagggucacuccac

SEQ ID NO: 70169 - RNA, 22 nt, Human
gaggcauaaguagaagagauug

SEQ ID NO: 70170 - RNA, 21 nt, Human
gcacucagucacuacucaaga

SEQ ID NO: 70171 - RNA, 22 nt, Human
gcaggaagauugcagaaggcug

SEQ ID NO: 70172 - RNA, 22 nt, Human
gcaggacuucuguuuaaccagu

SEQ ID NO: 70173 - RNA, 20 nt, Human
gcagcugacccuagugcuug

SEQ ID NO: 70174 - RNA, 22 nt, Human
gaggucuugagugacuuagcag

SEQ ID NO: 70175 - RNA, 22 nt, Human
gaggucauuaaagaaaagaguc

SEQ ID NO: 70176 - RNA, 22 nt, Human
gcagauuggguacauaaacagu

SEQ ID NO: 70177 - RNA, 22 nt, Human
gaggggaauguuccugagcugg

SEQ ID NO: 70178 - RNA, 22 nt, Human
gcagagcugucuaagucacuuc

SEQ ID NO: 70179 - RNA, 22 nt, Human
gcagaggcaaagucuggaugac

SEQ ID NO: 70180 - RNA, 22 nt, Human
gagggcauugucuucuuaguuu

SEQ ID NO: 70181 - RNA, 22 nt, Human
gagggaggugacaaggacauag

SEQ ID NO: 70182 - RNA, 22 nt, Human
gcauuucuguuuuuuuaaauga

SEQ ID NO: 70183 - RNA, 23 nt, Human
gcauuugcaggaaacuggaaaag

SEQ ID NO: 70184 - RNA, 22 nt, Human
gauauucauaggcagguauuua

SEQ ID NO: 70185 - RNA, 19 nt, Human
gauauugagcugagaauuc

SEQ ID NO: 70186 - RNA, 22 nt, Human
gaugauaacagcauuucaacug

SEQ ID NO: 70187 - RNA, 22 nt, Human
gaucauauccagucaccacuau

SEQ ID NO: 70188 - RNA, 22 nt, Human
gaucauuuucauuaauguugca

SEQ ID NO: 70189 - RNA, 22 nt, Human
gcccagaagguagcgaguaguc

SEQ ID NO: 70190 - RNA, 22 nt, Human
gccauguuuugguaaauaccau

SEQ ID NO: 70191 - RNA, 22 nt, Human
gauggcauucacaaacuuaacu

SEQ ID NO: 70192 - RNA, 22 nt, Human
gauggcaaugcuagaaauuuag

SEQ ID NO: 70193 - RNA, 22 nt, Human
gaugcuaauuaaugaagaggag

SEQ ID NO: 70194 - RNA, 22 nt, Human
gauagaaagagaaucagaacuu

SEQ ID NO: 70195 - RNA, 22 nt, Human
gcauuccagaguugcuggaaaa

SEQ ID NO: 70196 - RNA, 22 nt, Human
gcauucuugucaguggggucag

SEQ ID NO: 70197 - RNA, 22 nt, Human
gcauuuaaauuugaacuucaga

SEQ ID NO: 70198 - RNA, 22 nt, Human
gcaugcuguuuggaaacgauaa

SEQ ID NO: 70199 - RNA, 22 nt, Human
gauaaugcuuuggucagacaug

SEQ ID NO: 70200 - RNA, 22 nt, Human
gaguugucggaggaagggggcg

SEQ ID NO: 70201 - RNA, 22 nt, Human
gagguuauucuucuaucaguau

SEQ ID NO: 70202 - RNA, 22 nt, Human
gcagcuuuggagguggaacucu

SEQ ID NO: 70203 - RNA, 19 nt, Human
gaguaaaacuagagagaaa

SEQ ID NO: 70204 - RNA, 22 nt, Human
gauuuuaaaagauguauaaggu

SEQ ID NO: 70205 - RNA, 22 nt, Human
gccuagggacuuugguuuagau

SEQ ID NO: 70206 - RNA, 22 nt, Human
gccuagaagaaugagcgcaggg

SEQ ID NO: 70207 - RNA, 20 nt, Human
gccuccuccaaguuucauca

SEQ ID NO: 70208 - RNA, 22 nt, Human
gccuccuuccgaccucaguccu

SEQ ID NO: 70209 - RNA, 22 nt, Human
gccucucagagcuguucaguuu

SEQ ID NO: 70210 - RNA, 22 nt, Human
gccucaaaaguguuguagaggg

SEQ ID NO: 70211 - RNA, 22 nt, Human
gcaacccugggucaugguugac

SEQ ID NO: 70212 - RNA, 22 nt, Human
gcaaagaauugauucauuuugc

SEQ ID NO: 70213 - RNA, 22 nt, Human
gcaacuccuaggcgaggccuuc

SEQ ID NO: 70214 - RNA, 22 nt, Human
gcaacguauauggguaaggaua

SEQ ID NO: 70215 - RNA, 22 nt, Human
gcaagagaagaaagaauaguuu

SEQ ID NO: 70216 - RNA, 22 nt, Human
gcacagaguguaaaaguuucau

SEQ ID NO: 70217 - RNA, 22 nt, Human
gccuggaaugcaaugugacgaa

SEQ ID NO: 70218 - RNA, 22 nt, Human
gccugcuugaaagcacuuucug

SEQ ID NO: 70219 - RNA, 22 nt, Human
gccuucccuccucugcucucag

SEQ ID NO: 70220 - RNA, 22 nt, Human
gauugcauaugcauucugauac

SEQ ID NO: 70221 - RNA, 22 nt, Human
gauugauuuaauaugagaggau

SEQ ID NO: 70222 - RNA, 22 nt, Human
gcccuagaguugagagcaccca

SEQ ID NO: 70223 - RNA, 22 nt, Human
gaugguggggggcagcugggag

SEQ ID NO: 70224 - RNA, 22 nt, Human
gccaucugcuuagauugcuggg

SEQ ID NO: 70225 - RNA, 22 nt, Human
gcugcuggcuuccugcuguuuu

SEQ ID NO: 70226 - RNA, 20 nt, Human
gccaaggaggagaaacaggc

SEQ ID NO: 70227 - RNA, 21 nt, Human
gccacugcugcucauucucug

SEQ ID NO: 70228 - RNA, 22 nt, Human
gccagcuuagaucccccagccc

SEQ ID NO: 70229 - RNA, 22 nt, Human
gcauuuuaauuggggcaguuag

SEQ ID NO: 70230 - RNA, 22 nt, Human
gcugauucuucugcuuuuucuc

SEQ ID NO: 70231 - RNA, 22 nt, Human
gcucuucuaaguuuacccuucc

SEQ ID NO: 70232 - RNA, 22 nt, Human
gcucuggcugccuuaguuuugu

SEQ ID NO: 70233 - RNA, 22 nt, Human
gcugagcaaugcacugccgcau

SEQ ID NO: 70234 - RNA, 22 nt, Human
gcucugaacugucaugaauugg

SEQ ID NO: 70235 - RNA, 22 nt, Human
gcucuccuugaugcccucuguu

SEQ ID NO: 70236 - RNA, 22 nt, Human
gcucucucuucugcaggccuua

SEQ ID NO: 70237 - RNA, 22 nt, Human
gcucugcuccaucuguuuccuc

SEQ ID NO: 70238 - RNA, 19 nt, Human
gcuccugcagcuagagugc

SEQ ID NO: 70239 - RNA, 22 nt, Human
gcucgauugucaguguuaggga

SEQ ID NO: 70240 - RNA, 22 nt, Human
gcaucuguuagagugugcaugc

SEQ ID NO: 70241 - RNA, 22 nt, Human
gcuccuuaugguccugacccua

SEQ ID NO: 70242 - RNA, 22 nt, Human
gcucaacucaacgucauuugaa

SEQ ID NO: 70243 - RNA, 22 nt, Human
gcauaaaggacuauaaggauca

SEQ ID NO: 70244 - RNA, 22 nt, Human
gcauaacaacagacucuguguu

SEQ ID NO: 70245 - RNA, 22 nt, Human
gcuacaaauaaaaugggugacu

SEQ ID NO: 70246 - RNA, 22 nt, Human
gcuacaggggucaguccuuugc

SEQ ID NO: 70247 - RNA, 19 nt, Human
gcaguuccucuuaagagaa

SEQ ID NO: 70248 - RNA, 22 nt, Human
gcguguauuccagaccuuaacg

SEQ ID NO: 70249 - RNA, 22 nt, Human
gcgugcauggccguguguaugc

SEQ ID NO: 70250 - RNA, 22 nt, Human
gcguggaugauuuugagucggu

SEQ ID NO: 70251 - RNA, 22 nt, Human
gcaggacugauggagcauaugu

SEQ ID NO: 70252 - RNA, 22 nt, Human
gcgguguuuuaacacucccucg

SEQ ID NO: 70253 - RNA, 22 nt, Human
gcagcucagcacgcacagguaa

SEQ ID NO: 70254 - RNA, 22 nt, Human
gcagcgcugagaugauuuguug

SEQ ID NO: 70255 - RNA, 22 nt, Human
ggagagagggaucuuuguggag

SEQ ID NO: 70256 - RNA, 22 nt, Human
ggagaucucauugauacugaua

SEQ ID NO: 70257 - RNA, 22 nt, Human
ggggcggggagcaugagcuggg

SEQ ID NO: 70258 - RNA, 22 nt, Human
ggagaugaaugugguaaaacug

SEQ ID NO: 70259 - RNA, 22 nt, Human
ggauaaaugaaggcauacagau

SEQ ID NO: 70260 - RNA, 22 nt, Human
ggaguuucugucaucccguccc

SEQ ID NO: 70261 - RNA, 22 nt, Human
ggaguucacagcaauggaacag

SEQ ID NO: 70262 - RNA, 19 nt, Human
ggaguugccaggagaagga

SEQ ID NO: 70263 - RNA, 22 nt, Human
ggguauuugacaaacugacacu

SEQ ID NO: 70264 - RNA, 22 nt, Human
ggguggugauacugcuucugcc

SEQ ID NO: 70265 - RNA, 22 nt, Human
ggagaggaaguuuaaagaauug

SEQ ID NO: 70266 - RNA, 22 nt, Human
ggagagaacguaaucuaguauu

SEQ ID NO: 70267 - RNA, 22 nt, Human
ggagauaugugaaaaagacagc

SEQ ID NO: 70268 - RNA, 22 nt, Human
ggggauuucccaaugcgaagca

SEQ ID NO: 70269 - RNA, 22 nt, Human
ggagacagugacuuagagacug

SEQ ID NO: 70270 - RNA, 17 nt, Human
ggacuuucugccugucc

SEQ ID NO: 70271 - RNA, 22 nt, Human
ggagaagaggagcuggaagccu

SEQ ID NO: 70272 - RNA, 22 nt, Human
ggggacuugguuuuaaugagcu

SEQ ID NO: 70273 - RNA, 22 nt, Human
ggggaggaagcuggaacacggg

SEQ ID NO: 70274 - RNA, 22 nt, Human
ggggacugccgacagucucaaa

SEQ ID NO: 70275 - RNA, 22 nt, Human
ggggaauuaaaugagaagccuu

SEQ ID NO: 70276 - RNA, 22 nt, Human
ggggaauaaacacuuugucacu

SEQ ID NO: 70277 - RNA, 22 nt, Human
ggacuugaaguaguuauggccu

SEQ ID NO: 70278 - RNA, 22 nt, Human
ggacuuggcagugucaaauuua

SEQ ID NO: 70279 - RNA, 22 nt, Human
ggacauggaaagugugugauuu

SEQ ID NO: 70280 - RNA, 22 nt, Human
ggacauuguuguuggauccuug

SEQ ID NO: 70281 - RNA, 22 nt, Human
gggcuguggggccugcagaagg

SEQ ID NO: 70282 - RNA, 22 nt, Human
ggacauagaucuagacuuuaaa

SEQ ID NO: 70283 - RNA, 22 nt, Human
gggcucuuaauuuuuuucucua

SEQ ID NO: 70284 - RNA, 20 nt, Human
gggcucugcauccaucagcc

SEQ ID NO: 70285 - RNA, 22 nt, Human
gggcuacagaugggagggauga

SEQ ID NO: 70286 - RNA, 22 nt, Human
ggaagugagcucauuacuuuag

SEQ ID NO: 70287 - RNA, 18 nt, Human
ggaaggugcuggagugca

SEQ ID NO: 70288 - RNA, 22 nt, Human
ggaagucuacucuuccgaaaac

SEQ ID NO: 70289 - RNA, 22 nt, Human
ggaaagagaaacaugaacuaga

SEQ ID NO: 70290 - RNA, 17 nt, Human
ggaagaaaaggaucauc

SEQ ID NO: 70291 - RNA, 22 nt, Human
ggaagcuguugugagugcagca

SEQ ID NO: 70292 - RNA, 22 nt, Human
gggcaagagaggaagagauggc

SEQ ID NO: 70293 - RNA, 22 nt, Human
gggauuuaaugggaaaaauaug

SEQ ID NO: 70294 - RNA, 22 nt, Human
ggaaaaugcugaagcaucugaa

SEQ ID NO: 70295 - RNA, 22 nt, Human
ggaaagaggacaucuuacuucu

SEQ ID NO: 70296 - RNA, 22 nt, Human
ggaaaaucaaaccauuuacagu

SEQ ID NO: 70297 - RNA, 22 nt, Human
gggauuaaaaaucaccaaagua

SEQ ID NO: 70298 - RNA, 22 nt, Human
gcuuuucucccugcuuucuucc

SEQ ID NO: 70299 - RNA, 22 nt, Human
gcuuuucaaguuacaauuagcu

SEQ ID NO: 70300 - RNA, 22 nt, Human
gcuuuuaaauuaucugacaaug

SEQ ID NO: 70301 - RNA, 22 nt, Human
gcuguggaaaaugggucuccaa

SEQ ID NO: 70302 - RNA, 22 nt, Human
gguuuucuuguucauuuuuuaa

SEQ ID NO: 70303 - RNA, 22 nt, Human
guaaauaucucacgaaugauuc

SEQ ID NO: 70304 - RNA, 22 nt, Human
guaagaauauacccaggaguca

SEQ ID NO: 70305 - RNA, 22 nt, Human
guacuacagguuugguaguggg

SEQ ID NO: 70306 - RNA, 22 nt, Human
guaauucugugugaaucuauua

SEQ ID NO: 70307 - RNA, 22 nt, Human
guaaugcuuuuauuucggggaa

SEQ ID NO: 70308 - RNA, 22 nt, Human
guaaggcaggagucuuaaaccu

SEQ ID NO: 70309 - RNA, 22 nt, Human
gguguagagaaaauaguuguau

SEQ ID NO: 70310 - RNA, 22 nt, Human
gguuccagacaguuauaugggc

SEQ ID NO: 70311 - RNA, 22 nt, Human
gguugccuguggcucccuguua

SEQ ID NO: 70312 - RNA, 22 nt, Human
ggcccucucuacauguuagacg

SEQ ID NO: 70313 - RNA, 22 nt, Human
guagagagugucuuccagaaau

SEQ ID NO: 70314 - RNA, 22 nt, Human
guagaaaauagauugucucuug

SEQ ID NO: 70315 - RNA, 22 nt, Human
guagucuuaggaaugauuuugu

SEQ ID NO: 70316 - RNA, 22 nt, Human
guaguauuuucugaggacuggu

SEQ ID NO: 70317 - RNA, 22 nt, Human
guaggaaaugaauaagguaccu

SEQ ID NO: 70318 - RNA, 18 nt, Human
ggccucagccuggccgga

SEQ ID NO: 70319 - RNA, 22 nt, Human
guaguuuuugagcuguaaucuu

SEQ ID NO: 70320 - RNA, 22 nt, Human
ggcagucaucacuuauucauca

SEQ ID NO: 70321 - RNA, 22 nt, Human
ggcagugguaggagcccaggag

SEQ ID NO: 70322 - RNA, 19 nt, Human
ggugggacaggugagauau

SEQ ID NO: 70323 - RNA, 22 nt, Human
ggugccugggcacggaaagcau

SEQ ID NO: 70324 - RNA, 22 nt, Human
ggucuuccuugggggacuugaa

SEQ ID NO: 70325 - RNA, 22 nt, Human
ggucuucauucuaccagacuuu

SEQ ID NO: 70326 - RNA, 22 nt, Human
ggucuucauaugccacagaguc

SEQ ID NO: 70327 - RNA, 20 nt, Human
ggauugaacuauuucucagc

SEQ ID NO: 70328 - RNA, 22 nt, Human
gguagagagugaggaggggcuc

SEQ ID NO: 70329 - RNA, 22 nt, Human
gguagauacaaaaagauugugg

SEQ ID NO: 70330 - RNA, 21 nt, Human
gguagggaagguguuccucau

SEQ ID NO: 70331 - RNA, 23 nt, Human
gguagguggggagauuaaagucu

SEQ ID NO: 70332 - RNA, 22 nt, Human
ggguguuuuuggugacagggag

SEQ ID NO: 70333 - RNA, 19 nt, Human
ggauaagguuggagugauc

SEQ ID NO: 70334 - RNA, 22 nt, Human
ggauaauugaugauuuauaaga

SEQ ID NO: 70335 - RNA, 22 nt, Human
ggcuuauauguauucccagaga

SEQ ID NO: 70336 - RNA, 22 nt, Human
ggcuucucuuggccaugguccc

SEQ ID NO: 70337 - RNA, 22 nt, Human
gcugguuucucucauugucagu

SEQ ID NO: 70338 - RNA, 22 nt, Human
ggcugcugcccaccccugcaug

SEQ ID NO: 70339 - RNA, 22 nt, Human
ggcugcuggaguugggucucuc

SEQ ID NO: 70340 - RNA, 21 nt, Human
ggcugcucgugaugaacuuca

SEQ ID NO: 70341 - RNA, 22 nt, Human
ggcugcagggaacaggaugggu

SEQ ID NO: 70342 - RNA, 22 nt, Human
ggcuggaacuucuucuggcauu

SEQ ID NO: 70343 - RNA, 21 nt, Human
gcuggcugucucuuacacggu

SEQ ID NO: 70344 - RNA, 22 nt, Human
gcugcuuagaaccauauuuaaa

SEQ ID NO: 70345 - RNA, 22 nt, Human
gcuggaaauaacuuguguagaa

SEQ ID NO: 70346 - RNA, 22 nt, Human
gcuggaagggccagcuuucagg

SEQ ID NO: 70347 - RNA, 22 nt, Human
ggcucccccauggcugacagac

SEQ ID NO: 70348 - RNA, 22 nt, Human
ggcgcaguguucgcccucucgc

SEQ ID NO: 70349 - RNA, 22 nt, Human
ggcgccuuguggaaugagagcu

SEQ ID NO: 70350 - RNA, 22 nt, Human
ggcuauuguuuuaaaaaaugag

SEQ ID NO: 70351 - RNA, 22 nt, Human
ggcgucuugcgggcgguagcgc

SEQ ID NO: 70352 - RNA, 22 nt, Human
gcugcuggcggagcuggcgcug

SEQ ID NO: 70353 - RNA, 22 nt, Human
ggccuucuuuucaugucuuucg

SEQ ID NO: 70354 - RNA, 23 nt, Human
ggccuuuuuaaccgcgagcgaca

SEQ ID NO: 70355 - RNA, 22 nt, Human
gcugccucacuagauagguaug

SEQ ID NO: 70356 - RNA, 22 nt, Human
ggccagcuuugagcugcaggaa

SEQ ID NO: 70357 - RNA, 22 nt, Human
gcugcagggagcuggaaggcuc

SEQ ID NO: 70358 - RNA, 18 nt, Human
gcugaaauucuaaacaaa

SEQ ID NO: 70359 - RNA, 22 nt, Human
gcucuggcuacuguggcuaccg

SEQ ID NO: 70360 - RNA, 20 nt, Human
gcucaguggagaaaugcacc

SEQ ID NO: 70361 - RNA, 22 nt, Human
gcuccagcuccauaaacauaag

SEQ ID NO: 70362 - RNA, 22 nt, Human
ggcaggauggagcagggcuaaa

SEQ ID NO: 70363 - RNA, 22 nt, Human
gcuacauuagcuucaauggcua

SEQ ID NO: 70364 - RNA, 22 nt, Human
gcuaaccaaaccuguuguuugg

SEQ ID NO: 70365 - RNA, 22 nt, Human
gcuacaacugugucuguggggc

SEQ ID NO: 70366 - RNA, 22 nt, Human
gcuacaaaaccagggcaaagga

SEQ ID NO: 70367 - RNA, 22 nt, Human
ggcaggaaguaaggaugcuaca

SEQ ID NO: 70368 - RNA, 20 nt, Human
ggcagcaaccauaugcuaca

SEQ ID NO: 70369 - RNA, 22 nt, Human
ggcaagcacugggugucuuagc

SEQ ID NO: 70370 - RNA, 22 nt, Human
ggauuucuucucauaacugaga

SEQ ID NO: 70371 - RNA, 22 nt, Human
ggauugaagggaaccucagaau

SEQ ID NO: 70372 - RNA, 22 nt, Human
ggcaaagaguacaucguccugg

SEQ ID NO: 70373 - RNA, 22 nt, Human
ggauuugaugagacuaucuacu

SEQ ID NO: 70374 - RNA, 22 nt, Human
ggaugauacuuggagaaauauu

SEQ ID NO: 70375 - RNA, 22 nt, Human
ggaugauuuucaguuguguggg

SEQ ID NO: 70376 - RNA, 22 nt, Human
ggauggaugugaucugccuccu

SEQ ID NO: 70377 - RNA, 22 nt, Human
ggagaggaggugagaggaagua

SEQ ID NO: 70378 - RNA, 18 nt, Human
ggagaagaacagaugugg

SEQ ID NO: 70379 - RNA, 22 nt, Human
gcgcagugagguuaagaaugca

SEQ ID NO: 70380 - RNA, 22 nt, Human
ggagcagaggaaagaguagcau

SEQ ID NO: 70381 - RNA, 22 nt, Human
ggagaucugggcuguuucuggc

SEQ ID NO: 70382 - RNA, 22 nt, Human
ggagaugacaucccagcccggc

SEQ ID NO: 70383 - RNA, 21 nt, Human
ggacccucagauggcagugag

SEQ ID NO: 70384 - RNA, 22 nt, Human
ggacucuaccuggagcagccuc

SEQ ID NO: 70385 - RNA, 22 nt, Human
ggacugggagaauggaggcaag

SEQ ID NO: 70386 - RNA, 22 nt, Human
gccuuuauauuacauuuggaag

SEQ ID NO: 70387 - RNA, 22 nt, Human
gccuuucuugguuugucaggca

SEQ ID NO: 70388 - RNA, 22 nt, Human
ggacagagcaacccuacgcagc

SEQ ID NO: 70389 - RNA, 23 nt, Human
ggaauuucagaugugaaauaaaa

SEQ ID NO: 70390 - RNA, 20 nt, Human
ggaaguauccacaaauuccu

SEQ ID NO: 70391 - RNA, 22 nt, Human
ggaaggugagugcugugugauu

SEQ ID NO: 70392 - RNA, 22 nt, Human
ggaagcugucugcccggcgcuc

SEQ ID NO: 70393 - RNA, 22 nt, Human
ggaagauagaaguucaaaaguu

SEQ ID NO: 70394 - RNA, 22 nt, Human
guggaagauauuucugguccag

SEQ ID NO: 70395 - RNA, 22 nt, Human
guggaaggaauuaacagacuag

SEQ ID NO: 70396 - RNA, 22 nt, Human
gugcuuugcuaggaccgauugu

SEQ ID NO: 70397 - RNA, 22 nt, Human
ggccuugguggcuuugcugaug

SEQ ID NO: 70398 - RNA, 22 nt, Human
gugcuuuaccuuauuggucucg

SEQ ID NO: 70399 - RNA, 22 nt, Human
gggcagagggcgagcugggaga

SEQ ID NO: 70400 - RNA, 22 nt, Human
gggcaggcuggguggugguccc

SEQ ID NO: 70401 - RNA, 22 nt, Human
guggagaaagcuggaaucugag

SEQ ID NO: 70402 - RNA, 22 nt, Human
guggagaaauauguucagcuuc

SEQ ID NO: 70403 - RNA, 22 nt, Human
guggacuuuggucugugccauc

SEQ ID NO: 70404 - RNA, 22 nt, Human
gggcaugcagcaauucuguggu

SEQ ID NO: 70405 - RNA, 22 nt, Human
guggagaugagauauaccccuu

SEQ ID NO: 70406 - RNA, 22 nt, Human
guggaggaagaucuuugaugau

SEQ ID NO: 70407 - RNA, 22 nt, Human
gugggaaacagccuugcuucua

SEQ ID NO: 70408 - RNA, 22 nt, Human
gugggauaaccugagauaacau

SEQ ID NO: 70409 - RNA, 22 nt, Human
gugggccaguuccucacaggua

SEQ ID NO: 70410 - RNA, 22 nt, Human
gugggggugaggaauguucuau

SEQ ID NO: 70411 - RNA, 22 nt, Human
guggauggagcuggaagccauu

SEQ ID NO: 70412 - RNA, 22 nt, Human
guggcaaguuuucugacaagga

SEQ ID NO: 70413 - RNA, 22 nt, Human
guggcuuauguccagcagauau

SEQ ID NO: 70414 - RNA, 22 nt, Human
ggggaagagagaagaaugaucu

SEQ ID NO: 70415 - RNA, 19 nt, Human
guguucuguuauacaguug

SEQ ID NO: 70416 - RNA, 22 nt, Human
ggggaaauauuucugaccugug

SEQ ID NO: 70417 - RNA, 22 nt, Human
guguucuuuguagaggaucuug

SEQ ID NO: 70418 - RNA, 22 nt, Human
guguucuucacuguuagaaggu

SEQ ID NO: 70419 - RNA, 22 nt, Human
guguucuuuaugguuguagugu

SEQ ID NO: 70420 - RNA, 22 nt, Human
gugugucucaguugcuccgaag

SEQ ID NO: 70421 - RNA, 22 nt, Human
gggcuuguuaacuuggcuucca

SEQ ID NO: 70422 - RNA, 22 nt, Human
guguccaaagguaggaggaggg

SEQ ID NO: 70423 - RNA, 22 nt, Human
gggcuguaggagcuggaauggg

SEQ ID NO: 70424 - RNA, 22 nt, Human
guguggcgacucagagcugccu

SEQ ID NO: 70425 - RNA, 22 nt, Human
guguauuucuagaagaaaugaa

SEQ ID NO: 70426 - RNA, 22 nt, Human
guguagauuuguucaccuauua

SEQ ID NO: 70427 - RNA, 22 nt, Human
gggcucaaccauagcacaaaga

SEQ ID NO: 70428 - RNA, 22 nt, Human
gggcuacugagcuggaacuggg

SEQ ID NO: 70429 - RNA, 22 nt, Human
gugguggggaguuggauggaag

SEQ ID NO: 70430 - RNA, 22 nt, Human
ggguuuugugauugccucugaa

SEQ ID NO: 70431 - RNA, 22 nt, Human
guugagacugaaguucugaaag

SEQ ID NO: 70432 - RNA, 22 nt, Human
gguagaggaugaggagguugga

SEQ ID NO: 70433 - RNA, 22 nt, Human
gguaauguucugaugaauuugu

SEQ ID NO: 70434 - RNA, 22 nt, Human
guugauuuaaccucaccuuuga

SEQ ID NO: 70435 - RNA, 22 nt, Human
guugauuuaggguuuugguuuu

SEQ ID NO: 70436 - RNA, 22 nt, Human
guucuuagguacucauauuuaa

SEQ ID NO: 70437 - RNA, 22 nt, Human
guucuguucuucacagguuugu

SEQ ID NO: 70438 - RNA, 22 nt, Human
guucuaguauuugccuuaggau

SEQ ID NO: 70439 - RNA, 22 nt, Human
guucucuuaauccuaguuggua

SEQ ID NO: 70440 - RNA, 22 nt, Human
guucucuccugcuggugaugga

SEQ ID NO: 70441 - RNA, 22 nt, Human
guucuggaggagagccuggugu

SEQ ID NO: 70442 - RNA, 22 nt, Human
guuccugugcccuguucuuucc

SEQ ID NO: 70443 - RNA, 22 nt, Human
guuccuaaauuugaaggacuuu

SEQ ID NO: 70444 - RNA, 22 nt, Human
guuccgcugcaaggccaggaaa

SEQ ID NO: 70445 - RNA, 17 nt, Human
guucucaaacugacuga

SEQ ID NO: 70446 - RNA, 22 nt, Human
gggugcuuaagcuuguuuguaa

SEQ ID NO: 70447 - RNA, 22 nt, Human
gggguauuugguagacauuuug

SEQ ID NO: 70448 - RNA, 22 nt, Human
guuauacuuaugugcaaaaaua

SEQ ID NO: 70449 - RNA, 22 nt, Human
ggggcuuccagcgcccgccggu

SEQ ID NO: 70450 - RNA, 22 nt, Human
guuauuuugucuuguucaugaa

SEQ ID NO: 70451 - RNA, 22 nt, Human
guuauuguuauugcguugucga

SEQ ID NO: 70452 - RNA, 23 nt, Human
guuauugcuggugcuggccagcc

SEQ ID NO: 70453 - RNA, 22 nt, Human
guuaucauccucagaggcaguu

SEQ ID NO: 70454 - RNA, 22 nt, Human
gggucauugcgugacgcgagca

SEQ ID NO: 70455 - RNA, 22 nt, Human
gggguuggaugccuuggaaauu

SEQ ID NO: 70456 - RNA, 22 nt, Human
guuagaauggacaaagcugaaa

SEQ ID NO: 70457 - RNA, 22 nt, Human
guuaaaugcagauucugacuca

SEQ ID NO: 70458 - RNA, 22 nt, Human
guuaaaaugauuugugauuuau

SEQ ID NO: 70459 - RNA, 22 nt, Human
ggggacaagggugucaguaggc

SEQ ID NO: 70460 - RNA, 22 nt, Human
ggggagaugauaagugcauuug

SEQ ID NO: 70461 - RNA, 22 nt, Human
guguugcaggaagauauagcug

SEQ ID NO: 70462 - RNA, 22 nt, Human
guguuuauguuuuugcuaggga

SEQ ID NO: 70463 - RNA, 22 nt, Human
uaacacauagauauuuuaacuu

SEQ ID NO: 70464 - RNA, 22 nt, Human
uaacaacuuucugguguaacuu

SEQ ID NO: 70465 - RNA, 22 nt, Human
uaacauuucggugacaguggga

SEQ ID NO: 70466 - RNA, 22 nt, Human
uaacaguggucugugguaucug

SEQ ID NO: 70467 - RNA, 22 nt, Human
guagugauuguuccucaggggu

SEQ ID NO: 70468 - RNA, 22 nt, Human
guaguuagaguugugcuggaga

SEQ ID NO: 70469 - RNA, 22 nt, Human
guaguucuccaggggcuguuca

SEQ ID NO: 70470 - RNA, 22 nt, Human
guaguggaauuuagaguauaau

SEQ ID NO: 70471 - RNA, 22 nt, Human
guauauccaauaggugaugaaa

SEQ ID NO: 70472 - RNA, 22 nt, Human
guauauuuaugagcauuagccu

SEQ ID NO: 70473 - RNA, 22 nt, Human
gucacuuuuaagggccuuuucu

SEQ ID NO: 70474 - RNA, 22 nt, Human
gucagaagauagaggaaguuug

SEQ ID NO: 70475 - RNA, 21 nt, Human
uaaggaagagcauuuuagguc

SEQ ID NO: 70476 - RNA, 22 nt, Human
gucacuuugcuugcgaugcucc

SEQ ID NO: 70477 - RNA, 22 nt, Human
uaaggaaaugcaaauuuaagaa

SEQ ID NO: 70478 - RNA, 21 nt, Human
uaagccaccaugugaaaccag

SEQ ID NO: 70479 - RNA, 22 nt, Human
guauuaagaaaugccugugaaa

SEQ ID NO: 70480 - RNA, 22 nt, Human
uaagagcagacacaaccugaga

SEQ ID NO: 70481 - RNA, 22 nt, Human
uaagauauugagugguaauuug

SEQ ID NO: 70482 - RNA, 22 nt, Human
guaucugaaaaagaauucugac

SEQ ID NO: 70483 - RNA, 22 nt, Human
guaucuuuauuuuaauuaagau

SEQ ID NO: 70484 - RNA, 22 nt, Human
uaagaaaggggaaguuccucuu

SEQ ID NO: 70485 - RNA, 22 nt, Human
guaucaggugugagcauuuuaa

SEQ ID NO: 70486 - RNA, 22 nt, Human
gguuauuucugauuauaugaua

SEQ ID NO: 70487 - RNA, 22 nt, Human
guuuuuacuuccaaugcuauga

SEQ ID NO: 70488 - RNA, 22 nt, Human
guuuuuaguuuaaguuuuugca

SEQ ID NO: 70489 - RNA, 22 nt, Human
guuuuucuuugauuuagaacca

SEQ ID NO: 70490 - RNA, 22 nt, Human
guuuuucuagaaaucuccuccu

SEQ ID NO: 70491 - RNA, 22 nt, Human
uaaagacaauuucgagcuguag

SEQ ID NO: 70492 - RNA, 23 nt, Human
uaaagauaguuuaaaggugaguu

SEQ ID NO: 70493 - RNA, 22 nt, Human
uaaagcacucaaaauuguagcu

SEQ ID NO: 70494 - RNA, 22 nt, Human
gguuuauucccacaaaggaagu

SEQ ID NO: 70495 - RNA, 22 nt, Human
uaaaugauaguauugaagguag

SEQ ID NO: 70496 - RNA, 22 nt, Human
uaaaugaaaugaagugaaagcu

SEQ ID NO: 70497 - RNA, 22 nt, Human
uaaaggaccuguacuagguuua

SEQ ID NO: 70498 - RNA, 22 nt, Human
guuuuauguuuuauagacacaa

SEQ ID NO: 70499 - RNA, 22 nt, Human
gguggcuugcugguaggugugc

SEQ ID NO: 70500 - RNA, 22 nt, Human
ggugcuuuucacaagcauggga

SEQ ID NO: 70501 - RNA, 22 nt, Human
guuuuguucaugaacauugggu

SEQ ID NO: 70502 - RNA, 22 nt, Human
guuuugaugugauuucucaugu

SEQ ID NO: 70503 - RNA, 22 nt, Human
gguauagacaaauuauauaucc

SEQ ID NO: 70504 - RNA, 22 nt, Human
ggucaaucaugggucauugucu

SEQ ID NO: 70505 - RNA, 22 nt, Human
gguggagacucagauuuguugc

SEQ ID NO: 70506 - RNA, 22 nt, Human
guuuuauaacuauagugagaau

SEQ ID NO: 70507 - RNA, 22 nt, Human
guuuuaucuauguaauuauaaa

SEQ ID NO: 70508 - RNA, 22 nt, Human
uacaacuuacuugaauggcuuu

SEQ ID NO: 70509 - RNA, 22 nt, Human
uacaaauguuucuucuccuuuu

SEQ ID NO: 70510 - RNA, 22 nt, Human
uacaaauugccugacggcaggu

SEQ ID NO: 70511 - RNA, 22 nt, Human
gucaggaugagggaugaggagu

SEQ ID NO: 70512 - RNA, 22 nt, Human
uaauaaaaauuuaauucacauu

SEQ ID NO: 70513 - RNA, 22 nt, Human
uaauaauuaacagugauggguc

SEQ ID NO: 70514 - RNA, 21 nt, Human
uaauaauugggggcagggugg

SEQ ID NO: 70515 - RNA, 22 nt, Human
gucugaaauaucuuuugucuug

SEQ ID NO: 70516 - RNA, 22 nt, Human
gucuccuucauuuacuguuucc

SEQ ID NO: 70517 - RNA, 22 nt, Human
gucucacuucauuuucuuagcc

SEQ ID NO: 70518 - RNA, 22 nt, Human
gucugaggagaggcagcauaac

SEQ ID NO: 70519 - RNA, 22 nt, Human
gucucuuuugauuuuucacuca

SEQ ID NO: 70520 - RNA, 20 nt, Human
uacaaggauguucaucagag

SEQ ID NO: 70521 - RNA, 22 nt, Human
gucugcacgugccagggagggg

SEQ ID NO: 70522 - RNA, 22 nt, Human
uacaauguucgcauucucucug

SEQ ID NO: 70523 - RNA, 22 nt, Human
uacaagcucuuguagggggaaa

SEQ ID NO: 70524 - RNA, 22 nt, Human
uacaaucacccaaagagccaga

SEQ ID NO: 70525 - RNA, 22 nt, Human
uacugccauuauccugcugaaa

SEQ ID NO: 70526 - RNA, 22 nt, Human
uacugauggagauaggcuauca

SEQ ID NO: 70527 - RNA, 22 nt, Human
uacuaaagaaugaguuaaguuu

SEQ ID NO: 70528 - RNA, 22 nt, Human
uacaguauuuuuuaagaaaaaa

SEQ ID NO: 70529 - RNA, 22 nt, Human
uacagcuuccucuaugguggcc

SEQ ID NO: 70530 - RNA, 22 nt, Human
uacagcgaaaauuuagcuugau

SEQ ID NO: 70531 - RNA, 22 nt, Human
uagaugcugagcuuaagagaau

SEQ ID NO: 70532 - RNA, 22 nt, Human
uagaugguguccagaaagagaa

SEQ ID NO: 70533 - RNA, 22 nt, Human
uagaugaacagaaagccacugu

SEQ ID NO: 70534 - RNA, 22 nt, Human
uagaucccauugguugguuggu

SEQ ID NO: 70535 - RNA, 22 nt, Human
uagaucucugccuuguucagag

SEQ ID NO: 70536 - RNA, 22 nt, Human
uagauuccaaaauaguuugguu

SEQ ID NO: 70537 - RNA, 22 nt, Human
gugccgaugaggccuggcauuc

SEQ ID NO: 70538 - RNA, 22 nt, Human
uagaguauuuguuuacuaaguu

SEQ ID NO: 70539 - RNA, 22 nt, Human
uagaggcuagugguuaugaccu

SEQ ID NO: 70540 - RNA, 22 nt, Human
uagcagaacaauagucaaugau

SEQ ID NO: 70541 - RNA, 22 nt, Human
uagcaggaggcaguuccucgcu

SEQ ID NO: 70542 - RNA, 22 nt, Human
gugccuuuuucccaguucauug

SEQ ID NO: 70543 - RNA, 22 nt, Human
uagauuuaaaaagggugggaug

SEQ ID NO: 70544 - RNA, 22 nt, Human
uagcaaucugugaugugugugu

SEQ ID NO: 70545 - RNA, 22 nt, Human
uagaaguuaaaggaauacagaa

SEQ ID NO: 70546 - RNA, 22 nt, Human
uacuuaucuuagggaugcuugc

SEQ ID NO: 70547 - RNA, 22 nt, Human
gugaguugugugaguaagcaga

SEQ ID NO: 70548 - RNA, 22 nt, Human
uagacauuuacuuugaaaaaau

SEQ ID NO: 70549 - RNA, 19 nt, Human
uagacagauuuguguuacu

SEQ ID NO: 70550 - RNA, 21 nt, Human
uagaccagcugugcuccucgg

SEQ ID NO: 70551 - RNA, 22 nt, Human
uagaacaaacagcauguuugau

SEQ ID NO: 70552 - RNA, 22 nt, Human
gugaugaaggccugcaccuggu

SEQ ID NO: 70553 - RNA, 22 nt, Human
uagagaaauauuuguagugcug

SEQ ID NO: 70554 - RNA, 22 nt, Human
gugaugugugaaggucugcagg

SEQ ID NO: 70555 - RNA, 22 nt, Human
uagagagaaaccaggguuuggg

SEQ ID NO: 70556 - RNA, 19 nt, Human
gugaugaugccacuccaac

SEQ ID NO: 70557 - RNA, 22 nt, Human
uagaggauucuaaaggaagcug

SEQ ID NO: 70558 - RNA, 22 nt, Human
gugauuucagguuuuucauacu

SEQ ID NO: 70559 - RNA, 19 nt, Human
uagaggagaauggcaaaga

SEQ ID NO: 70560 - RNA, 22 nt, Human
uagagauagccaaguccuucaa

SEQ ID NO: 70561 - RNA, 22 nt, Human
uagaggaccacagggugcagag

SEQ ID NO: 70562 - RNA, 19 nt, Human
uagagcagcuucagauucc

SEQ ID NO: 70563 - RNA, 22 nt, Human
uagacugagcuccuugaggaca

SEQ ID NO: 70564 - RNA, 22 nt, Human
uagagcucaagaagcaaaagcu

SEQ ID NO: 70565 - RNA, 22 nt, Human
uagagaaauuacagcuuucuuu

SEQ ID NO: 70566 - RNA, 22 nt, Human
uccucaaauccuagccucaucg

SEQ ID NO: 70567 - RNA, 20 nt, Human
uccuaugagcuguuaaauug

SEQ ID NO: 70568 - RNA, 19 nt, Human
uccuacaugagacagagag

SEQ ID NO: 70569 - RNA, 22 nt, Human
uccuaguucugaccucgcucac

SEQ ID NO: 70570 - RNA, 17 nt, Human
uccuacaggugugcuga

SEQ ID NO: 70571 - RNA, 22 nt, Human
uagaaugggaggggaaucaucc

SEQ ID NO: 70572 - RNA, 22 nt, Human
uacuuaauuuuaaaagcuagau

SEQ ID NO: 70573 - RNA, 22 nt, Human
uacuuacacugaagcaaagaua

SEQ ID NO: 70574 - RNA, 22 nt, Human
uacuuagagucgggaugcacaa

SEQ ID NO: 70575 - RNA, 22 nt, Human
uagcauccugugugaauguauu

SEQ ID NO: 70576 - RNA, 22 nt, Human
uagcauaaaguuucuguguggu

SEQ ID NO: 70577 - RNA, 22 nt, Human
uccugcaugcuagugagugcuu

SEQ ID NO: 70578 - RNA, 22 nt, Human
uagcauacagauauuuaacucu

SEQ ID NO: 70579 - RNA, 22 nt, Human
uagcauuucacugaucuucacu

SEQ ID NO: 70580 - RNA, 22 nt, Human
uagccaaguguuuuucaugacc

SEQ ID NO: 70581 - RNA, 22 nt, Human
uccugagaagcacuuaauacac

SEQ ID NO: 70582 - RNA, 20 nt, Human
uagcacagacuuuugcuuac

SEQ ID NO: 70583 - RNA, 22 nt, Human
uagauuguaagcuccuugaggg

SEQ ID NO: 70584 - RNA, 22 nt, Human
uccuuguuggaauauccuuacc

SEQ ID NO: 70585 - RNA, 22 nt, Human
uccuuggagaaucuuguuuuac

SEQ ID NO: 70586 - RNA, 21 nt, Human
uagcuugaucauuuuauuucc

SEQ ID NO: 70587 - RNA, 22 nt, Human
uccuuucaaauuuauuugacau

SEQ ID NO: 70588 - RNA, 22 nt, Human
uccugcccuguccuugccucug

SEQ ID NO: 70589 - RNA, 22 nt, Human
ucuaauagauuuggaguggaaa

SEQ ID NO: 70590 - RNA, 22 nt, Human
ucguuucuuuuucuucccugga

SEQ ID NO: 70591 - RNA, 22 nt, Human
uaguagcuguuguuuuuuaaac

SEQ ID NO: 70592 - RNA, 22 nt, Human
ucgugaagaaauguggacuuca

SEQ ID NO: 70593 - RNA, 22 nt, Human
uagucaauuagaaagaggccuu

SEQ ID NO: 70594 - RNA, 22 nt, Human
uagguuuugugucagaguagaa

SEQ ID NO: 70595 - RNA, 22 nt, Human
uagguuguaagaggucuuuugu

SEQ ID NO: 70596 - RNA, 22 nt, Human
uaguacguuccaaaucacugga

SEQ ID NO: 70597 - RNA, 22 nt, Human
ucgcuguguccuuuucacuuau

SEQ ID NO: 70598 - RNA, 22 nt, Human
ucgcuucugaguuggugacccc

SEQ ID NO: 70599 - RNA, 22 nt, Human
ucgcuuuaauggucuucacagc

SEQ ID NO: 70600 - RNA, 22 nt, Human
uaggguuucaugcugguuucca

SEQ ID NO: 70601 - RNA, 22 nt, Human
uaggcaauauuagacuuugucu

SEQ ID NO: 70602 - RNA, 22 nt, Human
uaggccugcugaagagcaagcu

SEQ ID NO: 70603 - RNA, 22 nt, Human
ucgcuauuauuuuagguucuca

SEQ ID NO: 70604 - RNA, 22 nt, Human
uaggauugguguauguagguuu

SEQ ID NO: 70605 - RNA, 22 nt, Human
ucccaaguguuuggcgaggaga

SEQ ID NO: 70606 - RNA, 22 nt, Human
uacuuaaaacacauuuagcauu

SEQ ID NO: 70607 - RNA, 22 nt, Human
ucccagaacggguucuucccag

SEQ ID NO: 70608 - RNA, 22 nt, Human
ucccagaaccuuuuagcuucac

SEQ ID NO: 70609 - RNA, 22 nt, Human
ucccagaaauccaggcuuaaau

SEQ ID NO: 70610 - RNA, 22 nt, Human
ucccagcaggcaccgcuucugc

SEQ ID NO: 70611 - RNA, 22 nt, Human
ucccaaaacuugaagcaagccu

SEQ ID NO: 70612 - RNA, 22 nt, Human
uacugaaagagugguggacucu

SEQ ID NO: 70613 - RNA, 21 nt, Human
uccauucuuggugguucugca

SEQ ID NO: 70614 - RNA, 22 nt, Human
uacucucuuccauacaaucugu

SEQ ID NO: 70615 - RNA, 22 nt, Human
uacuauuuugacaugaaauuga

SEQ ID NO: 70616 - RNA, 22 nt, Human
uccacuaucugagcuuaguugc

SEQ ID NO: 70617 - RNA, 23 nt, Human
uaccagacccugaaagaaagugu

SEQ ID NO: 70618 - RNA, 21 nt, Human
uaccacugaaauugaucguuc

SEQ ID NO: 70619 - RNA, 22 nt, Human
uacauggauguuauccuuacug

SEQ ID NO: 70620 - RNA, 22 nt, Human
uacauguggagauaacugaagc

SEQ ID NO: 70621 - RNA, 22 nt, Human
uacauuugauuuuugcuucuuu

SEQ ID NO: 70622 - RNA, 22 nt, Human
uccagaaagccguugacuuauu

SEQ ID NO: 70623 - RNA, 22 nt, Human
uccagaaaucucuguugauugu

SEQ ID NO: 70624 - RNA, 22 nt, Human
uccagagcuguccuacugugag

SEQ ID NO: 70625 - RNA, 22 nt, Human
uccagacucaaaaaccagaugg

SEQ ID NO: 70626 - RNA, 22 nt, Human
uacauaauagcaaggugcuguc

SEQ ID NO: 70627 - RNA, 22 nt, Human
uacagucauaagguuucucucc

SEQ ID NO: 70628 - RNA, 22 nt, Human
uacaccuuaagccgcggcuccc

SEQ ID NO: 70629 - RNA, 22 nt, Human
uacagauggacacuguuucaag

SEQ ID NO: 70630 - RNA, 22 nt, Human
uccaccaccaucacagucagac

SEQ ID NO: 70631 - RNA, 22 nt, Human
uccacagugguggaauuguuca

SEQ ID NO: 70632 - RNA, 22 nt, Human
uccaccacgaaacugcagcugc

SEQ ID NO: 70633 - RNA, 22 nt, Human
uccaccugucccugcuuccugc

SEQ ID NO: 70634 - RNA, 22 nt, Human
uaagggaagucuucaggagaca

SEQ ID NO: 70635 - RNA, 22 nt, Human
ucaucuuucuuuauggaaauac

SEQ ID NO: 70636 - RNA, 22 nt, Human
uaagcgagccaguggaaaaagc

SEQ ID NO: 70637 - RNA, 22 nt, Human
uaacuuuuuauccuguuaaaug

SEQ ID NO: 70638 - RNA, 22 nt, Human
uaagaaacauuuuuaugacagu

SEQ ID NO: 70639 - RNA, 22 nt, Human
ucaggacacuuaauaggaacag

SEQ ID NO: 70640 - RNA, 22 nt, Human
uaagaggucugaaacgguggga

SEQ ID NO: 70641 - RNA, 22 nt, Human
uaagauuuuuacaaauagagug

SEQ ID NO: 70642 - RNA, 19 nt, Human
uaagaaucaccaggggugu

SEQ ID NO: 70643 - RNA, 22 nt, Human
uaaguuguagaacguuuucuua

SEQ ID NO: 70644 - RNA, 20 nt, Human
ucaucuuucaaauuugugac

SEQ ID NO: 70645 - RNA, 22 nt, Human
uaauagauagggagaguugcug

SEQ ID NO: 70646 - RNA, 22 nt, Human
ucauucucucguauucgcgaau

SEQ ID NO: 70647 - RNA, 22 nt, Human
ucauuggagcauaugaugguua

SEQ ID NO: 70648 - RNA, 22 nt, Human
uaauccaaaccaggaauucccu

SEQ ID NO: 70649 - RNA, 22 nt, Human
uaauucuagauugacauuuuga

SEQ ID NO: 70650 - RNA, 22 nt, Human
uaauuccacacucccgcaagcg

SEQ ID NO: 70651 - RNA, 22 nt, Human
uaauucuacagggaacucugga

SEQ ID NO: 70652 - RNA, 22 nt, Human
uaauuauuaauuuuagguugcu

SEQ ID NO: 70653 - RNA, 22 nt, Human
uacaaauuguuuugccacaaag

SEQ ID NO: 70654 - RNA, 20 nt, Human
uacaauauucccacuuugcu

SEQ ID NO: 70655 - RNA, 22 nt, Human
ucagcuucaucuugagcccaca

SEQ ID NO: 70656 - RNA, 21 nt, Human
ucaggaagagccaguucaugc

SEQ ID NO: 70657 - RNA, 22 nt, Human
ucagcugggagaaaguuuuagg

SEQ ID NO: 70658 - RNA, 22 nt, Human
uaaagaagaaaaggcuucaggc

SEQ ID NO: 70659 - RNA, 22 nt, Human
uaaaaucaugacagauugacau

SEQ ID NO: 70660 - RNA, 22 nt, Human
uaaaaugcucagauaaauauau

SEQ ID NO: 70661 - RNA, 22 nt, Human
uaaaauaccacauauggugcuc

SEQ ID NO: 70662 - RNA, 22 nt, Human
uaaaacuaugcaaccuacuacc

SEQ ID NO: 70663 - RNA, 21 nt, Human
uaaaagaugacaagacagcuc

SEQ ID NO: 70664 - RNA, 22 nt, Human
uaaaaaccuuguauuuaacucu

SEQ ID NO: 70665 - RNA, 22 nt, Human
ucagcaggugcuuuguuuacuc

SEQ ID NO: 70666 - RNA, 22 nt, Human
ucagauagcaagggauaccugu

SEQ ID NO: 70667 - RNA, 22 nt, Human
guuuucuaaaacacauauaagu

SEQ ID NO: 70668 - RNA, 22 nt, Human
guuuucuccugcuauacagugc

SEQ ID NO: 70669 - RNA, 22 nt, Human
ucagaaugaaauuucuuucaga

SEQ ID NO: 70670 - RNA, 21 nt, Human
ucagaaucguuccagguagau

SEQ ID NO: 70671 - RNA, 22 nt, Human
guuuguuugccagcuuaguaaa

SEQ ID NO: 70672 - RNA, 22 nt, Human
guuuuaaucuccuuauuccuaa

SEQ ID NO: 70673 - RNA, 22 nt, Human
guuuugauggaguguguuaaau

SEQ ID NO: 70674 - RNA, 22 nt, Human
guuuucuuguuaauuuugaacg

SEQ ID NO: 70675 - RNA, 22 nt, Human
guuuugaagagaagcaagucug

SEQ ID NO: 70676 - RNA, 22 nt, Human
guuuuggagauguccauuuucc

SEQ ID NO: 70677 - RNA, 22 nt, Human
ucagagccagacacacagcaga

SEQ ID NO: 70678 - RNA, 18 nt, Human
ucagaggagauaccuaaa

SEQ ID NO: 70679 - RNA, 22 nt, Human
ucacugaauuucaagcuagugg

SEQ ID NO: 70680 - RNA, 22 nt, Human
ucaccuuuugaauugcuguugu

SEQ ID NO: 70681 - RNA, 22 nt, Human
ucacuuccuugcagcuguagaa

SEQ ID NO: 70682 - RNA, 22 nt, Human
ucacugaacucucauagagaaa

SEQ ID NO: 70683 - RNA, 22 nt, Human
ucacuggauucauguuucuuua

SEQ ID NO: 70684 - RNA, 22 nt, Human
ucacuucugcuccuuggaugcc

SEQ ID NO: 70685 - RNA, 22 nt, Human
guuuggguggcuagagaaagaa

SEQ ID NO: 70686 - RNA, 22 nt, Human
ucacuuuacaucuguaaaagga

SEQ ID NO: 70687 - RNA, 22 nt, Human
guuuccuuuugugguuuuucua

SEQ ID NO: 70688 - RNA, 22 nt, Human
guuuccaggcuuugguaugguu

SEQ ID NO: 70689 - RNA, 22 nt, Human
guuucucuuugguggguugaga

SEQ ID NO: 70690 - RNA, 22 nt, Human
ucaauuggcuacaaauaaugua

SEQ ID NO: 70691 - RNA, 22 nt, Human
ucaauuuauguggcuauucauu

SEQ ID NO: 70692 - RNA, 23 nt, Human
ucacaaggcuauguuauauguac

SEQ ID NO: 70693 - RNA, 22 nt, Human
ucacaucugugugauugucauu

SEQ ID NO: 70694 - RNA, 22 nt, Human
guuuaaaagcaaccaacaggcu

SEQ ID NO: 70695 - RNA, 22 nt, Human
guuuagauguagauucucuggu

SEQ ID NO: 70696 - RNA, 22 nt, Human
uauuuuucacagauuggugcuu

SEQ ID NO: 70697 - RNA, 22 nt, Human
uauuuuuacuguuugaugauuc

SEQ ID NO: 70698 - RNA, 22 nt, Human
guugcaaaugggaagaugguua

SEQ ID NO: 70699 - RNA, 22 nt, Human
guugauauggaaacucuagguu

SEQ ID NO: 70700 - RNA, 22 nt, Human
uauuuuuaccuaauuuaugaga

SEQ ID NO: 70701 - RNA, 21 nt, Human
ucaaguccuggcuuugcucuu

SEQ ID NO: 70702 - RNA, 22 nt, Human
ucaagguauuauuuuuguggug

SEQ ID NO: 70703 - RNA, 19 nt, Human
guuguguuugguucuuuug

SEQ ID NO: 70704 - RNA, 22 nt, Human
guuguuaagugcugguuguuag

SEQ ID NO: 70705 - RNA, 22 nt, Human
uauucuucaacuuuucuccucu

SEQ ID NO: 70706 - RNA, 21 nt, Human
uauucgcauuucugucuuuac

SEQ ID NO: 70707 - RNA, 18 nt, Human
uauuccucuuccucuauc

SEQ ID NO: 70708 - RNA, 22 nt, Human
guucacauccuugugaggauuu

SEQ ID NO: 70709 - RNA, 22 nt, Human
guuauugggagagggaauggga

SEQ ID NO: 70710 - RNA, 18 nt, Human
uaugugucuguuacaacu

SEQ ID NO: 70711 - RNA, 22 nt, Human
uauguguaauuaaauacuauag

SEQ ID NO: 70712 - RNA, 22 nt, Human
uaugugugaguauauaugcaca

SEQ ID NO: 70713 - RNA, 22 nt, Human
uauguuaaauguuugauguuua

SEQ ID NO: 70714 - RNA, 22 nt, Human
uaugguuucuccugcagauuug

SEQ ID NO: 70715 - RNA, 22 nt, Human
uauguaacaccauuuacaaagu

SEQ ID NO: 70716 - RNA, 22 nt, Human
guguuaaucauuuuugauuuug

SEQ ID NO: 70717 - RNA, 22 nt, Human
guguuagagucuugugcucauu

SEQ ID NO: 70718 - RNA, 22 nt, Human
uaugggaaggauuugucuuuca

SEQ ID NO: 70719 - RNA, 22 nt, Human
guuccucugaaggauuuucaga

SEQ ID NO: 70720 - RNA, 22 nt, Human
guuccuauauagccuuaaggau

SEQ ID NO: 70721 - RNA, 22 nt, Human
uauugaucuuugaaaccuuggu

SEQ ID NO: 70722 - RNA, 22 nt, Human
uauucuucagcauaaaaauucu

SEQ ID NO: 70723 - RNA, 22 nt, Human
uauuuacuguguucaucccucu

SEQ ID NO: 70724 - RNA, 20 nt, Human
uauuucaaugugccaaguuu

SEQ ID NO: 70725 - RNA, 22 nt, Human
uauuucaguuaagaugagguca

SEQ ID NO: 70726 - RNA, 18 nt, Human
uauuugugugugugugug

SEQ ID NO: 70727 - RNA, 22 nt, Human
uauuuguauugucuuaucacuu

SEQ ID NO: 70728 - RNA, 22 nt, Human
uauuucaugagugaauaucuag

SEQ ID NO: 70729 - RNA, 22 nt, Human
uauuuccugcguuucugugagc

SEQ ID NO: 70730 - RNA, 22 nt, Human
guugagaaucucuagcuuagga

SEQ ID NO: 70731 - RNA, 22 nt, Human
guugagaagaccauuuuguuca

SEQ ID NO: 70732 - RNA, 22 nt, Human
guugaacagucacccugggagu

SEQ ID NO: 70733 - RNA, 22 nt, Human
uauuuuggcuccugagcucuga

SEQ ID NO: 70734 - RNA, 22 nt, Human
uauuuugaggugaaagaguuug

SEQ ID NO: 70735 - RNA, 22 nt, Human
uaugcagauaguuugccauuca

SEQ ID NO: 70736 - RNA, 22 nt, Human
gugugguguuaagcaaauuaau

SEQ ID NO: 70737 - RNA, 22 nt, Human
uaugaguauagugcaccauggu

SEQ ID NO: 70738 - RNA, 22 nt, Human
uaugagugccaaguuaccuggg

SEQ ID NO: 70739 - RNA, 22 nt, Human
uaugauuuucaugguagaguua

SEQ ID NO: 70740 - RNA, 22 nt, Human
uaugcacacguguccaugugca

SEQ ID NO: 70741 - RNA, 22 nt, Human
uaugaccuuaggaagcaagaag

SEQ ID NO: 70742 - RNA, 19 nt, Human
uaugacaaguacuaguucu

SEQ ID NO: 70743 - RNA, 22 nt, Human
gugucuuggaacuggaauugag

SEQ ID NO: 70744 - RNA, 22 nt, Human
uaugaauauaccacaauuuagg

SEQ ID NO: 70745 - RNA, 22 nt, Human
uaucuguauuguagaacuguug

SEQ ID NO: 70746 - RNA, 22 nt, Human
uaucuagguacacaucuccucu

SEQ ID NO: 70747 - RNA, 22 nt, Human
uauccuaaaggguaguguggga

SEQ ID NO: 70748 - RNA, 23 nt, Human
uaucccauacagagagugguaca

SEQ ID NO: 70749 - RNA, 22 nt, Human
uauaugcagauuuucaucaucg

SEQ ID NO: 70750 - RNA, 22 nt, Human
uaucacauaaaugaggaauauu

SEQ ID NO: 70751 - RNA, 22 nt, Human
uaucaguccaggguuuugugac

SEQ ID NO: 70752 - RNA, 22 nt, Human
uauaaagaccuuauccuucaua

SEQ ID NO: 70753 - RNA, 22 nt, Human
uauacauauacaaaugcacaua

SEQ ID NO: 70754 - RNA, 22 nt, Human
uauaaucuugcccauaguauuu

SEQ ID NO: 70755 - RNA, 22 nt, Human
uauagcaagagaaccauuacca

SEQ ID NO: 70756 - RNA, 22 nt, Human
uaguuacuuuugcucuucauua

SEQ ID NO: 70757 - RNA, 22 nt, Human
uaguuauuucugcacuuaauga

SEQ ID NO: 70758 - RNA, 22 nt, Human
uagcauuuauugggcuagcaaa

SEQ ID NO: 70759 - RNA, 22 nt, Human
gugcucaagacauuaggaauau

SEQ ID NO: 70760 - RNA, 22 nt, Human
gugcuaugugcugaacucaggu

SEQ ID NO: 70761 - RNA, 22 nt, Human
uagcauuuagaacaccuugaga

SEQ ID NO: 70762 - RNA, 22 nt, Human
uaguuuucuuuuguguuauucu

SEQ ID NO: 70763 - RNA, 22 nt, Human
uaguuucuucaacugucccagc

SEQ ID NO: 70764 - RNA, 23 nt, Human
uaguuucaucuccacccugcccu

SEQ ID NO: 70765 - RNA, 22 nt, Human
ucagauaauccaauagagagga

SEQ ID NO: 70766 - RNA, 22 nt, Human
ucagcaaugggauucaggcuuu

SEQ ID NO: 70767 - RNA, 19 nt, Human
ucagcagauuuugcaaaca

SEQ ID NO: 70768 - RNA, 22 nt, Human
ugacauuugagagagauauaca

SEQ ID NO: 70769 - RNA, 22 nt, Human
ugaccucaagcaugcggagggc

SEQ ID NO: 70770 - RNA, 22 nt, Human
ugaccuuuuuaaauuauuuuua

SEQ ID NO: 70771 - RNA, 22 nt, Human
ugacuaauacagaaacuacaag

SEQ ID NO: 70772 - RNA, 22 nt, Human
ucagcucucucuuggugaucuc

SEQ ID NO: 70773 - RNA, 22 nt, Human
ucagcuauccauucuccuauga

SEQ ID NO: 70774 - RNA, 22 nt, Human
ucagcguuaguuuuucaucuaa

SEQ ID NO: 70775 - RNA, 22 nt, Human
ugacaucagacugugagaagag

SEQ ID NO: 70776 - RNA, 22 nt, Human
ugacagugugcccggagguuag

SEQ ID NO: 70777 - RNA, 22 nt, Human
ucagaagguacugaagacaugg

SEQ ID NO: 70778 - RNA, 22 nt, Human
ucagaaggagagacagcgugga

SEQ ID NO: 70779 - RNA, 20 nt, Human
ucagaaugugacccccaugg

SEQ ID NO: 70780 - RNA, 22 nt, Human
ucagagaaguaggcuaauggug

SEQ ID NO: 70781 - RNA, 22 nt, Human
ugaauuuuggcaauuuucugug

SEQ ID NO: 70782 - RNA, 22 nt, Human
ugaauuucuuuuuaaaauauua

SEQ ID NO: 70783 - RNA, 22 nt, Human
ucacuucuaugaucugucucuu

SEQ ID NO: 70784 - RNA, 23 nt, Human
ucacuucucuuacccucucucug

SEQ ID NO: 70785 - RNA, 22 nt, Human
ucacuaugcccagaauacaguu

SEQ ID NO: 70786 - RNA, 22 nt, Human
ucacucagucugagcaauugcu

SEQ ID NO: 70787 - RNA, 22 nt, Human
ucacuggaaaacaaauguuuua

SEQ ID NO: 70788 - RNA, 22 nt, Human
ucacuguaggaaucucuaaauu

SEQ ID NO: 70789 - RNA, 22 nt, Human
ucacucuuuaucuuuuaugucu

SEQ ID NO: 70790 - RNA, 22 nt, Human
ucacaggagucaaggaauagua

SEQ ID NO: 70791 - RNA, 22 nt, Human
ucacaguucaacuaguucagau

SEQ ID NO: 70792 - RNA, 22 nt, Human
ucacagguuuaguccagcaguc

SEQ ID NO: 70793 - RNA, 22 nt, Human
ugaauuauaugguauugaacau

SEQ ID NO: 70794 - RNA, 22 nt, Human
ugaauuacacugggaucagggc

SEQ ID NO: 70795 - RNA, 22 nt, Human
ugaauuagagugaaggaaagcu

SEQ ID NO: 70796 - RNA, 22 nt, Human
ugaauguguacacgauuguuug

SEQ ID NO: 70797 - RNA, 22 nt, Human
ucacaagaagaaauuaaacugu

SEQ ID NO: 70798 - RNA, 22 nt, Human
ucaagucaauagguuaguaggu

SEQ ID NO: 70799 - RNA, 22 nt, Human
ugaauaaucuuggguauuaaua

SEQ ID NO: 70800 - RNA, 22 nt, Human
ugaauagcaccuugaguaauga

SEQ ID NO: 70801 - RNA, 22 nt, Human
ugaaucaaugaauugcacuuca

SEQ ID NO: 70802 - RNA, 22 nt, Human
ugaaucugagccugcgcaaagu

SEQ ID NO: 70803 - RNA, 22 nt, Human
ugaaugaagcacuguaauucuc

SEQ ID NO: 70804 - RNA, 22 nt, Human
ugaaucuuguuuacugauuccu

SEQ ID NO: 70805 - RNA, 22 nt, Human
ucaagggaccaagcauucauua

SEQ ID NO: 70806 - RNA, 22 nt, Human
ucaaggaagggguaggaauaau

SEQ ID NO: 70807 - RNA, 22 nt, Human
ucaaccucccugcucaccccuc

SEQ ID NO: 70808 - RNA, 23 nt, Human
ugaagugaaauuucacaagggac

SEQ ID NO: 70809 - RNA, 22 nt, Human
ugaauaaauaaacuuuuacuac

SEQ ID NO: 70810 - RNA, 22 nt, Human
ucaagcacugugcaaugagcuu

SEQ ID NO: 70811 - RNA, 22 nt, Human
ucaagcuggaaaugaagaaucu

SEQ ID NO: 70812 - RNA, 22 nt, Human
ucaaaucuuuuuuccuucccug

SEQ ID NO: 70813 - RNA, 22 nt, Human
ucaaaggcuugugguucuggga

SEQ ID NO: 70814 - RNA, 22 nt, Human
ucaaaaauaagauauucuggac

SEQ ID NO: 70815 - RNA, 22 nt, Human
ugaagacaguuuuacucaugag

SEQ ID NO: 70816 - RNA, 22 nt, Human
uauuuuuguuuaccaguuaaca

SEQ ID NO: 70817 - RNA, 22 nt, Human
ugaagaauuccauggcuuccau

SEQ ID NO: 70818 - RNA, 22 nt, Human
ugaacuuacauugaggaauucu

SEQ ID NO: 70819 - RNA, 22 nt, Human
ugaaccuaacauuucuggcagu

SEQ ID NO: 70820 - RNA, 22 nt, Human
ugaacauuuuugcuugcagcuu

SEQ ID NO: 70821 - RNA, 22 nt, Human
ugaaagccuacagcucacuguu

SEQ ID NO: 70822 - RNA, 22 nt, Human
ugaaagcuggcucugcagagug

SEQ ID NO: 70823 - RNA, 22 nt, Human
ugaaauugaguaccucuuuaua

SEQ ID NO: 70824 - RNA, 22 nt, Human
ugaaaggaauuuaaauguuguu

SEQ ID NO: 70825 - RNA, 22 nt, Human
ugaaaaauauuuuuagaaauaa

SEQ ID NO: 70826 - RNA, 22 nt, Human
uauuuuggaugcauugagaugc

SEQ ID NO: 70827 - RNA, 22 nt, Human
uauuugauggaacucuugcuuu

SEQ ID NO: 70828 - RNA, 22 nt, Human
uauuuuaaaagcauuaauucuu

SEQ ID NO: 70829 - RNA, 22 nt, Human
uauuuguuucuaguggcagcaa

SEQ ID NO: 70830 - RNA, 22 nt, Human
uauuucaucugaacuucccaac

SEQ ID NO: 70831 - RNA, 22 nt, Human
ucuuuuaucuguuguguaacaa

SEQ ID NO: 70832 - RNA, 22 nt, Human
ucuuuucagccagcugguagga

SEQ ID NO: 70833 - RNA, 22 nt, Human
uauuuaaagucagcaacuuuuc

SEQ ID NO: 70834 - RNA, 22 nt, Human
uauugugaaggccaugugcuaa

SEQ ID NO: 70835 - RNA, 22 nt, Human
uauuguuuuaagguguauuaau

SEQ ID NO: 70836 - RNA, 22 nt, Human
uauuuacuuugaggaaguuguu

SEQ ID NO: 70837 - RNA, 18 nt, Human
uauuuacuguguguuacc

SEQ ID NO: 70838 - RNA, 22 nt, Human
uauuuaugcaucacuuuuuucc

SEQ ID NO: 70839 - RNA, 22 nt, Human
uauuuaggcagaaagugauauu

SEQ ID NO: 70840 - RNA, 19 nt, Human
ucuuugcuuuucuaagagg

SEQ ID NO: 70841 - RNA, 22 nt, Human
ucuuuguuagucagaauugauc

SEQ ID NO: 70842 - RNA, 22 nt, Human
ucuuucugaugggaagggucaa

SEQ ID NO: 70843 - RNA, 23 nt, Human
ucuuuccuuucauacagucagcu

SEQ ID NO: 70844 - RNA, 22 nt, Human
ucuuuaagugugugccuccagg

SEQ ID NO: 70845 - RNA, 22 nt, Human
ucuuuaaggggccuuuguguca

SEQ ID NO: 70846 - RNA, 22 nt, Human
ucuuuaaauucuuaugagugaa

SEQ ID NO: 70847 - RNA, 22 nt, Human
ucuugcuguggcagaucuggag

SEQ ID NO: 70848 - RNA, 22 nt, Human
ucuuggggagacuaguguuugg

SEQ ID NO: 70849 - RNA, 22 nt, Human
uauugguagauggagagagaca

SEQ ID NO: 70850 - RNA, 22 nt, Human
uauuguauuagcucuuggagau

SEQ ID NO: 70851 - RNA, 22 nt, Human
uauuggcucagucagaaguuuu

SEQ ID NO: 70852 - RNA, 22 nt, Human
uauugauuuuguugcuaccugg

SEQ ID NO: 70853 - RNA, 22 nt, Human
ucuucuuaggaaagucaggagg

SEQ ID NO: 70854 - RNA, 22 nt, Human
ucuucuguguguagugguugug

SEQ ID NO: 70855 - RNA, 22 nt, Human
ucuugcuggagucaaggcuaca

SEQ ID NO: 70856 - RNA, 22 nt, Human
ucuugcuguagcuguuucuucu

SEQ ID NO: 70857 - RNA, 19 nt, Human
ucuugcaucuuccuacugu

SEQ ID NO: 70858 - RNA, 19 nt, Human
ucuugaggaaaguaaggca

SEQ ID NO: 70859 - RNA, 22 nt, Human
ucuugccuuuucuagcuucuag

SEQ ID NO: 70860 - RNA, 22 nt, Human
ucuugccccugcuuuggaacaa

SEQ ID NO: 70861 - RNA, 22 nt, Human
uauugucuuuuucuuccaccug

SEQ ID NO: 70862 - RNA, 22 nt, Human
ucuuccuuguaagggcuuuaga

SEQ ID NO: 70863 - RNA, 22 nt, Human
ucuagagaauuuggaaauuaag

SEQ ID NO: 70864 - RNA, 22 nt, Human
ucuuccagauacuuccugacuu

SEQ ID NO: 70865 - RNA, 22 nt, Human
ucuacugagugcugagauuuug

SEQ ID NO: 70866 - RNA, 22 nt, Human
uagugggguccacuuccuucac

SEQ ID NO: 70867 - RNA, 22 nt, Human
ucuaaucuacaaaaggaaauuc

SEQ ID NO: 70868 - RNA, 20 nt, Human
ucuaaugaagugagcuuagc

SEQ ID NO: 70869 - RNA, 22 nt, Human
ucuaaugcuuccucucauccca

SEQ ID NO: 70870 - RNA, 22 nt, Human
uagugggauuuugaacaaaacc

SEQ ID NO: 70871 - RNA, 22 nt, Human
ugcaagauccagucuugagaag

SEQ ID NO: 70872 - RNA, 22 nt, Human
uccauguugauaaucuugugaa

SEQ ID NO: 70873 - RNA, 22 nt, Human
uccauguagggagggcuuucaa

SEQ ID NO: 70874 - RNA, 17 nt, Human
uccauugagacaagaag

SEQ ID NO: 70875 - RNA, 22 nt, Human
uccauucccugacagccucuuu

SEQ ID NO: 70876 - RNA, 22 nt, Human
ugcaaugagcuucuuugauaaa

SEQ ID NO: 70877 - RNA, 18 nt, Human
ugcagcuuugugauuggc

SEQ ID NO: 70878 - RNA, 20 nt, Human
ugcagcucccccgcaguuuc

SEQ ID NO: 70879 - RNA, 22 nt, Human
ugcagcagaauauggcugcagg

SEQ ID NO: 70880 - RNA, 22 nt, Human
ugcagccucacgcauccgcauu

SEQ ID NO: 70881 - RNA, 22 nt, Human
ugcagaggagcuggaaggcugg

SEQ ID NO: 70882 - RNA, 22 nt, Human
ugcagagagccagcucucucgg

SEQ ID NO: 70883 - RNA, 22 nt, Human
ugcaaaaguuuuauacacagau

SEQ ID NO: 70884 - RNA, 23 nt, Human
ugcaaaauuugcagaguucgaug

SEQ ID NO: 70885 - RNA, 22 nt, Human
uccaugauauauaugugcacau

SEQ ID NO: 70886 - RNA, 22 nt, Human
uccaucauucagaaauuuuuga

SEQ ID NO: 70887 - RNA, 18 nt, Human
uccauccucugcucuuca

SEQ ID NO: 70888 - RNA, 22 nt, Human
uccagugaacaucauggcucca

SEQ ID NO: 70889 - RNA, 22 nt, Human
ugauuuggcaucaguguauccu

SEQ ID NO: 70890 - RNA, 22 nt, Human
uccacuaucagaccuguagucu

SEQ ID NO: 70891 - RNA, 20 nt, Human
uccacugagcgucacggcag

SEQ ID NO: 70892 - RNA, 23 nt, Human
uccaagagagauuuuaaauuucu

SEQ ID NO: 70893 - RNA, 22 nt, Human
ugauggaguauaauaaaaugac

SEQ ID NO: 70894 - RNA, 22 nt, Human
uccacaaagucuaugagaguug

SEQ ID NO: 70895 - RNA, 17 nt, Human
ucauuucaguaaaucca

SEQ ID NO: 70896 - RNA, 22 nt, Human
ucauuuaucgcugccuuuuaaa

SEQ ID NO: 70897 - RNA, 22 nt, Human
ugaugaaguuggaaggaaaguu

SEQ ID NO: 70898 - RNA, 19 nt, Human
ugaucuccaguacagacau

SEQ ID NO: 70899 - RNA, 23 nt, Human
ucauugcucaagauaaugguuga

SEQ ID NO: 70900 - RNA, 20 nt, Human
ucauucagaaucaguaugca

SEQ ID NO: 70901 - RNA, 22 nt, Human
ucauuguuuacugucuuuuuuc

SEQ ID NO: 70902 - RNA, 22 nt, Human
ucauuguuucugcuuuucauga

SEQ ID NO: 70903 - RNA, 22 nt, Human
ucauaucauuuugaaagcugag

SEQ ID NO: 70904 - RNA, 22 nt, Human
ugagugacuguugucaagaugg

SEQ ID NO: 70905 - RNA, 22 nt, Human
ucauccugaagaaccugcuucc

SEQ ID NO: 70906 - RNA, 22 nt, Human
ugaguuuaggccaggauauggu

SEQ ID NO: 70907 - RNA, 22 nt, Human
ugaguuuuggaagauguuacag

SEQ ID NO: 70908 - RNA, 20 nt, Human
ugagucagcugcaugggugg

SEQ ID NO: 70909 - RNA, 19 nt, Human
ugaguacuaaugagauuga

SEQ ID NO: 70910 - RNA, 22 nt, Human
uccuucucagggagacuugaua

SEQ ID NO: 70911 - RNA, 22 nt, Human
uccuucuuuucgccggaguuga

SEQ ID NO: 70912 - RNA, 22 nt, Human
uccuucuguuguuuauuuuaaa

SEQ ID NO: 70913 - RNA, 22 nt, Human
uccuuuggaaacuggaugucuu

SEQ ID NO: 70914 - RNA, 22 nt, Human
uccuuuuuagguuauuguacau

SEQ ID NO: 70915 - RNA, 22 nt, Human
uccuuuucuuugaggaaggugu

SEQ ID NO: 70916 - RNA, 22 nt, Human
ucgacguuguuuuuucucuguc

SEQ ID NO: 70917 - RNA, 22 nt, Human
uccuuaggaccuagagguagua

SEQ ID NO: 70918 - RNA, 22 nt, Human
uccuuccucuuucaaauuuguu

SEQ ID NO: 70919 - RNA, 22 nt, Human
uccugaaugguguaauagguuu

SEQ ID NO: 70920 - RNA, 22 nt, Human
uccugguaaagaguaucagauu

SEQ ID NO: 70921 - RNA, 22 nt, Human
uccucuucucuagagccggaau

SEQ ID NO: 70922 - RNA, 22 nt, Human
uccucuucaaaauagcucugaa

SEQ ID NO: 70923 - RNA, 22 nt, Human
ugccaugguuguacaguagcag

SEQ ID NO: 70924 - RNA, 16 nt, Human
ugccaagggguuaaug

SEQ ID NO: 70925 - RNA, 22 nt, Human
ugcauucugggucgcagagugg

SEQ ID NO: 70926 - RNA, 22 nt, Human
ugcauugccucuauucauuaua

SEQ ID NO: 70927 - RNA, 22 nt, Human
ugcauguuuuaagugaagcuga

SEQ ID NO: 70928 - RNA, 22 nt, Human
ugcauucugaacguaaauguga

SEQ ID NO: 70929 - RNA, 22 nt, Human
uccuaagaaacagacugaaaag

SEQ ID NO: 70930 - RNA, 22 nt, Human
ugcaugaucucacuuacaggug

SEQ ID NO: 70931 - RNA, 22 nt, Human
ugcaugacugaucuguuuguca

SEQ ID NO: 70932 - RNA, 22 nt, Human
ugcagcuucucugcaacaggag

SEQ ID NO: 70933 - RNA, 22 nt, Human
ucguggaugaagaauagaggcc

SEQ ID NO: 70934 - RNA, 22 nt, Human
ucuaaaugaccuccuugcccag

SEQ ID NO: 70935 - RNA, 22 nt, Human
ucuaaagcuccuuccacuaaaa

SEQ ID NO: 70936 - RNA, 22 nt, Human
ucuaaaaauuagaaauuagguc

SEQ ID NO: 70937 - RNA, 22 nt, Human
ucguauaguugcugcagauggu

SEQ ID NO: 70938 - RNA, 22 nt, Human
ugcucuuguauccaaaagugau

SEQ ID NO: 70939 - RNA, 22 nt, Human
ugcuccucugcaugucugcggc

SEQ ID NO: 70940 - RNA, 22 nt, Human
ugcuauuuuguuuucaguccau

SEQ ID NO: 70941 - RNA, 20 nt, Human
ugcuaucugcucucccuucu

SEQ ID NO: 70942 - RNA, 22 nt, Human
ugcuauuaagagaaagugaaca

SEQ ID NO: 70943 - RNA, 22 nt, Human
ugcuauucuuggagcugaugga

SEQ ID NO: 70944 - RNA, 23 nt, Human
ugcuaaaggcagaauauucaccu

SEQ ID NO: 70945 - RNA, 18 nt, Human
uccuuucaccccuucucu

SEQ ID NO: 70946 - RNA, 22 nt, Human
ucgaugcuggcgcagguuucac

SEQ ID NO: 70947 - RNA, 21 nt, Human
uggaauuggaaaccauucuau

SEQ ID NO: 70948 - RNA, 22 nt, Human
uggaaugccgggccaggcuccg

SEQ ID NO: 70949 - RNA, 22 nt, Human
uggaaugaaagaaaaauuguag

SEQ ID NO: 70950 - RNA, 22 nt, Human
uggaagaucugguguagcuccu

SEQ ID NO: 70951 - RNA, 22 nt, Human
uggagcuggcuuguggaaguug

SEQ ID NO: 70952 - RNA, 22 nt, Human
uggaggaggagaacuuggcacu

SEQ ID NO: 70953 - RNA, 22 nt, Human
uggaggauaacacaagaaguga

SEQ ID NO: 70954 - RNA, 22 nt, Human
uggaggaugacagagaugggcu

SEQ ID NO: 70955 - RNA, 22 nt, Human
ucuguaaaugcaaguuuuccuc

SEQ ID NO: 70956 - RNA, 22 nt, Human
uggagccuugugagaccacaau

SEQ ID NO: 70957 - RNA, 22 nt, Human
uggagagcaggugaaggaaaga

SEQ ID NO: 70958 - RNA, 22 nt, Human
uggagauauucuauauuuuaua

SEQ ID NO: 70959 - RNA, 22 nt, Human
uggagagcaaugaggggcaggc

SEQ ID NO: 70960 - RNA, 21 nt, Human
uggagcagggaggauuugggg

SEQ ID NO: 70961 - RNA, 22 nt, Human
ucuggaaauggaaguaacuaug

SEQ ID NO: 70962 - RNA, 22 nt, Human
uggaagaagcuacaagcgguga

SEQ ID NO: 70963 - RNA, 22 nt, Human
uggaacugguuugcuucagacu

SEQ ID NO: 70964 - RNA, 22 nt, Human
uggaaaugcuuagaggugaucu

SEQ ID NO: 70965 - RNA, 22 nt, Human
uggaaauagauguaggaaauug

SEQ ID NO: 70966 - RNA, 22 nt, Human
uggaaaggaguucuguuuauuu

SEQ ID NO: 70967 - RNA, 22 nt, Human
uggaaaguuggaagucucagga

SEQ ID NO: 70968 - RNA, 19 nt, Human
ugcugcaggaauucucaag

SEQ ID NO: 70969 - RNA, 22 nt, Human
ucuacgugacagaacagacuga

SEQ ID NO: 70970 - RNA, 22 nt, Human
uggaaagauuuaaaauaacgag

SEQ ID NO: 70971 - RNA, 22 nt, Human
ucuuuauuucccuaacuugcua

SEQ ID NO: 70972 - RNA, 19 nt, Human
ucuuucauuucuagcucug

SEQ ID NO: 70973 - RNA, 22 nt, Human
ucuuuccagaccagccccagcu

SEQ ID NO: 70974 - RNA, 22 nt, Human
ucuuucucauccaaacuaguug

SEQ ID NO: 70975 - RNA, 22 nt, Human
ucuugugagcugagauaaagcc

SEQ ID NO: 70976 - RNA, 20 nt, Human
ucuugucuggcagccuggag

SEQ ID NO: 70977 - RNA, 22 nt, Human
ucuuguuaaagguuaaagguga

SEQ ID NO: 70978 - RNA, 22 nt, Human
ucuuggcaguucuugugcuuuu

SEQ ID NO: 70979 - RNA, 22 nt, Human
uggccauuuacucuguaagagu

SEQ ID NO: 70980 - RNA, 22 nt, Human
ucuugauggugauguuguguca

SEQ ID NO: 70981 - RNA, 22 nt, Human
ucuucuuugugguugcccaagg

SEQ ID NO: 70982 - RNA, 22 nt, Human
ucuucuuuccuuuugugcauuu

SEQ ID NO: 70983 - RNA, 22 nt, Human
uggcaugugaauuguuacauug

SEQ ID NO: 70984 - RNA, 18 nt, Human
uggcaugcuuugauacau

SEQ ID NO: 70985 - RNA, 22 nt, Human
uggcagcucauuuggaaaugga

SEQ ID NO: 70986 - RNA, 22 nt, Human
ucuuccauuccccuccuacgcc

SEQ ID NO: 70987 - RNA, 22 nt, Human
uggauuguuuacaucaugucug

SEQ ID NO: 70988 - RNA, 22 nt, Human
ucuuagacagagaagacuauug

SEQ ID NO: 70989 - RNA, 22 nt, Human
ucuuauucuuuuaaacaacgca

SEQ ID NO: 70990 - RNA, 22 nt, Human
ucuuacuguccucuguuuuucu

SEQ ID NO: 70991 - RNA, 21 nt, Human
ucuuauacagcaauagaucug

SEQ ID NO: 70992 - RNA, 18 nt, Human
uggcaaugccaaaggcuu

SEQ ID NO: 70993 - RNA, 22 nt, Human
ucuuaaauaugaaaaggauuau

SEQ ID NO: 70994 - RNA, 22 nt, Human
uggaugcuccaaguagaccuua

SEQ ID NO: 70995 - RNA, 22 nt, Human
uggaguuuuaaucuguacagaa

SEQ ID NO: 70996 - RNA, 22 nt, Human
uggauaugaaacaaaacaagag

SEQ ID NO: 70997 - RNA, 22 nt, Human
uggaugagugaauggauaaauc

SEQ ID NO: 70998 - RNA, 22 nt, Human
uggagucuugcuuugggagugc

SEQ ID NO: 70999 - RNA, 22 nt, Human
ugaauguggucaggaaauuguu

SEQ ID NO: 71000 - RNA, 22 nt, Human
ugaauuuuaacauucugcugga

SEQ ID NO: 71001 - RNA, 22 nt, Human
ugaauuuguaggaauucuccau

SEQ ID NO: 71002 - RNA, 22 nt, Human
ugaauucaaacuuuuuaacaag

SEQ ID NO: 71003 - RNA, 22 nt, Human
ugacaagagaccccuccgcagg

SEQ ID NO: 71004 - RNA, 22 nt, Human
ugacagaggagcuggaaugauu

SEQ ID NO: 71005 - RNA, 22 nt, Human
uggggcuuggcucacagaagcu

SEQ ID NO: 71006 - RNA, 18 nt, Human
ugggggacgcuuuuuuuc

SEQ ID NO: 71007 - RNA, 22 nt, Human
ugaaugcuacccugcuggcucu

SEQ ID NO: 71008 - RNA, 22 nt, Human
ugaaugaacugaugaacuuaac

SEQ ID NO: 71009 - RNA, 22 nt, Human
ugaaucagaccuucauugggua

SEQ ID NO: 71010 - RNA, 22 nt, Human
ugaaguuuagaaaaagugccuu

SEQ ID NO: 71011 - RNA, 22 nt, Human
ugggcccaucauugcugugggc

SEQ ID NO: 71012 - RNA, 22 nt, Human
ugggcacacugaaucugcuauu

SEQ ID NO: 71013 - RNA, 22 nt, Human
ugaagguggcuugcagcuaguc

SEQ ID NO: 71014 - RNA, 22 nt, Human
ugaagcuaguauuaacucagau

SEQ ID NO: 71015 - RNA, 22 nt, Human
ugggauggacuuuagagaaucg

SEQ ID NO: 71016 - RNA, 22 nt, Human
ugaagcuagguucaugaggucg

SEQ ID NO: 71017 - RNA, 22 nt, Human
ugaaggaggugaauccaugcau

SEQ ID NO: 71018 - RNA, 22 nt, Human
ugggagagaaauuuaaguuuuu

SEQ ID NO: 71019 - RNA, 22 nt, Human
ugggaagccaguaucagacuaa

SEQ ID NO: 71020 - RNA, 22 nt, Human
ugggagagaagcugaggcaggg

SEQ ID NO: 71021 - RNA, 23 nt, Human
ugggagcuauguuuggaaugggg

SEQ ID NO: 71022 - RNA, 22 nt, Human
ugaacuucccauguacagacug

SEQ ID NO: 71023 - RNA, 22 nt, Human
ugaagccacacuagcuuguccu

SEQ ID NO: 71024 - RNA, 22 nt, Human
ugaagacuucuuuuggucacca

SEQ ID NO: 71025 - RNA, 21 nt, Human
ugaagcccugugaggugcuua

SEQ ID NO: 71026 - RNA, 22 nt, Human
ugaacuguccuuguugucuaga

SEQ ID NO: 71027 - RNA, 22 nt, Human
ugaacuaauguuguguccuaau

SEQ ID NO: 71028 - RNA, 22 nt, Human
ugggaagcugagccucgaugug

SEQ ID NO: 71029 - RNA, 22 nt, Human
ugggaagaguuagagacagcug

SEQ ID NO: 71030 - RNA, 22 nt, Human
ugggaaaauugugauucuuucu

SEQ ID NO: 71031 - RNA, 22 nt, Human
ugggaaaauagcuauuuugaaa

SEQ ID NO: 71032 - RNA, 22 nt, Human
uggcucuucucaagcauuggcu

SEQ ID NO: 71033 - RNA, 22 nt, Human
ucuuuugaacauccaggauguc

SEQ ID NO: 71034 - RNA, 23 nt, Human
uggcucugagcuuccugguggcc

SEQ ID NO: 71035 - RNA, 22 nt, Human
ucuuugcauggacauguguuuu

SEQ ID NO: 71036 - RNA, 22 nt, Human
ucuuugcugacacuuacacugu

SEQ ID NO: 71037 - RNA, 17 nt, Human
ucuuuuacuuucucucc

SEQ ID NO: 71038 - RNA, 22 nt, Human
uggcuugacaucaauacuuauu

SEQ ID NO: 71039 - RNA, 22 nt, Human
uggcuucuggccaggcacagga

SEQ ID NO: 71040 - RNA, 22 nt, Human
uggcuucagacuucugcuacgu

SEQ ID NO: 71041 - RNA, 22 nt, Human
ugaaauuuuuuggagauaauuu

SEQ ID NO: 71042 - RNA, 22 nt, Human
ugaaauguggagaugguaagua

SEQ ID NO: 71043 - RNA, 18 nt, Human
uguauuguucacuucugu

SEQ ID NO: 71044 - RNA, 19 nt, Human
uguauuuauauuucugugc

SEQ ID NO: 71045 - RNA, 22 nt, Human
ugauugauaaugaagacaguca

SEQ ID NO: 71046 - RNA, 22 nt, Human
ugauucuuugaccaaaaaauug

SEQ ID NO: 71047 - RNA, 22 nt, Human
ugcaaaaagagcgaggagcccu

SEQ ID NO: 71048 - RNA, 19 nt, Human
ugcaagcuuuuucuuguua

SEQ ID NO: 71049 - RNA, 22 nt, Human
ugcaagagcccaaacuauauac

SEQ ID NO: 71050 - RNA, 21 nt, Human
ugcaacugaaaggaauauggu

SEQ ID NO: 71051 - RNA, 22 nt, Human
ugcaaauucuuuacucugugau

SEQ ID NO: 71052 - RNA, 22 nt, Human
ugucuguauuugaggacauugu

SEQ ID NO: 71053 - RNA, 22 nt, Human
ugcacauuucucacaauguaca

SEQ ID NO: 71054 - RNA, 22 nt, Human
ugcaaggcacccacucugcuuu

SEQ ID NO: 71055 - RNA, 22 nt, Human
ugcacagagggaggcauaaaau

SEQ ID NO: 71056 - RNA, 22 nt, Human
uguaucuguguguauguguuua

SEQ ID NO: 71057 - RNA, 22 nt, Human
uguaucucugacacagucucac

SEQ ID NO: 71058 - RNA, 20 nt, Human
ugauuauuccaacaagaaug

SEQ ID NO: 71059 - RNA, 22 nt, Human
ugauguuucugaagggguuacu

SEQ ID NO: 71060 - RNA, 22 nt, Human
uguauaugucugugagcuauua

SEQ ID NO: 71061 - RNA, 22 nt, Human
uguagggaucugccucuuccuc

SEQ ID NO: 71062 - RNA, 22 nt, Human
ugauguaaaauaggaaguucua

SEQ ID NO: 71063 - RNA, 22 nt, Human
ugauggaucuguuggcggguuu

SEQ ID NO: 71064 - RNA, 18 nt, Human
ugauggcuaagagccggg

SEQ ID NO: 71065 - RNA, 22 nt, Human
uguacauuuacaaaagcuuuau

SEQ ID NO: 71066 - RNA, 22 nt, Human
uguacagauaucaggagugagg

SEQ ID NO: 71067 - RNA, 22 nt, Human
uguacauacauagauauacaca

SEQ ID NO: 71068 - RNA, 22 nt, Human
ugaugaugaagaaauauuauca

SEQ ID NO: 71069 - RNA, 22 nt, Human
ugaguugucacaacgucacaag

SEQ ID NO: 71070 - RNA, 22 nt, Human
ugaguucugacugagcaugggg

SEQ ID NO: 71071 - RNA, 22 nt, Human
ugaguguuguaaccauaugauu

SEQ ID NO: 71072 - RNA, 23 nt, Human
ugaggucuuggaaguucuguuug

SEQ ID NO: 71073 - RNA, 22 nt, Human
ugagggucgcaagcaccaggcc

SEQ ID NO: 71074 - RNA, 19 nt, Human
ugaggauugagguccagua

SEQ ID NO: 71075 - RNA, 19 nt, Human
ugguggaggugcaccugac

SEQ ID NO: 71076 - RNA, 22 nt, Human
ugagggaugccucuccuuccgg

SEQ ID NO: 71077 - RNA, 22 nt, Human
ugguggagucugggggaggcuu

SEQ ID NO: 71078 - RNA, 22 nt, Human
ugaggcuuucacuuggcaaaga

SEQ ID NO: 71079 - RNA, 22 nt, Human
ugguggaggugggggguauuuu

SEQ ID NO: 71080 - RNA, 22 nt, Human
ugagcuauuucaccauauagau

SEQ ID NO: 71081 - RNA, 22 nt, Human
ugaggagggcuagagucuccug

SEQ ID NO: 71082 - RNA, 22 nt, Human
uggugcaggauuuauuuaacua

SEQ ID NO: 71083 - RNA, 22 nt, Human
ugggggauucaucucagagcgu

SEQ ID NO: 71084 - RNA, 22 nt, Human
ugggggcacccagccgaugagg

SEQ ID NO: 71085 - RNA, 22 nt, Human
uggucuuuccuucauuguccag

SEQ ID NO: 71086 - RNA, 22 nt, Human
ugaccuacauuuauagcuguca

SEQ ID NO: 71087 - RNA, 22 nt, Human
uggugaggacccagauuuuccu

SEQ ID NO: 71088 - RNA, 22 nt, Human
ugacaucuagauaaaugggaca

SEQ ID NO: 71089 - RNA, 23 nt, Human
ugaccauauauccaucagauaua

SEQ ID NO: 71090 - RNA, 22 nt, Human
uguucuucaaacucaguuccac

SEQ ID NO: 71091 - RNA, 22 nt, Human
uguucugauggauuacaugucu

SEQ ID NO: 71092 - RNA, 23 nt, Human
uguuccugaugccucguccuguc

SEQ ID NO: 71093 - RNA, 22 nt, Human
ugcuaaugaauggaggaucuga

SEQ ID NO: 71094 - RNA, 22 nt, Human
ugcuaaugagugcugugugaag

SEQ ID NO: 71095 - RNA, 22 nt, Human
uguugaugaccacaauuuaugc

SEQ ID NO: 71096 - RNA, 21 nt, Human
uguugcuugucugagacuaug

SEQ ID NO: 71097 - RNA, 22 nt, Human
uguuacugaaugucucugcuuu

SEQ ID NO: 71098 - RNA, 22 nt, Human
uguucaguuugcuaucauaauc

SEQ ID NO: 71099 - RNA, 22 nt, Human
ugcgccuccugcugccugcccu

SEQ ID NO: 71100 - RNA, 22 nt, Human
uguuccucuuagucuuaugugu

SEQ ID NO: 71101 - RNA, 22 nt, Human
ugccuuuggcuguucugugacc

SEQ ID NO: 71102 - RNA, 22 nt, Human
ugccuuuuguguuuggcuaauc

SEQ ID NO: 71103 - RNA, 22 nt, Human
uguguuucucugaggggucccu

SEQ ID NO: 71104 - RNA, 22 nt, Human
uguguuuaaacuauaugccugc

SEQ ID NO: 71105 - RNA, 22 nt, Human
uguguuccugucuuauucuuau

SEQ ID NO: 71106 - RNA, 22 nt, Human
uguguucuuugcuuaauuaaag

SEQ ID NO: 71107 - RNA, 22 nt, Human
ugccuacuuuaguacuuuaaag

SEQ ID NO: 71108 - RNA, 22 nt, Human
ugccuaguuuaaaucauuuucu

SEQ ID NO: 71109 - RNA, 22 nt, Human
ugccucucuggaucugcuguga

SEQ ID NO: 71110 - RNA, 22 nt, Human
ugugguagagcuuaaaugaggu

SEQ ID NO: 71111 - RNA, 22 nt, Human
uguggucuccucucugucuucc

SEQ ID NO: 71112 - RNA, 22 nt, Human
ugccaacaggcuugccugaugu

SEQ ID NO: 71113 - RNA, 22 nt, Human
ugcauuguuuauggaauaaaau

SEQ ID NO: 71114 - RNA, 22 nt, Human
ugccauuggucuuaaggcuagc

SEQ ID NO: 71115 - RNA, 22 nt, Human
ugccaucuuugccccuauuuua

SEQ ID NO: 71116 - RNA, 22 nt, Human
ugugggaucauggaucagggcc

SEQ ID NO: 71117 - RNA, 22 nt, Human
ugcccagagccucuuaccucca

SEQ ID NO: 71118 - RNA, 22 nt, Human
ugcauugccauagcagggggau

SEQ ID NO: 71119 - RNA, 22 nt, Human
ugcauuccagcucccuucuggc

SEQ ID NO: 71120 - RNA, 22 nt, Human
ugcauaagguuaaauuagcaga

SEQ ID NO: 71121 - RNA, 22 nt, Human
ugcauuaguaaagagaggaggg

SEQ ID NO: 71122 - RNA, 22 nt, Human
ugcaucauuaagguacaguugg

SEQ ID NO: 71123 - RNA, 22 nt, Human
uguggcuuaggugagcauguga

SEQ ID NO: 71124 - RNA, 22 nt, Human
uguggcucugaugucauaaagg

SEQ ID NO: 71125 - RNA, 21 nt, Human
uguggccauuugaaaacaggg

SEQ ID NO: 71126 - RNA, 22 nt, Human
ugcagugaugcuucuggcucag

SEQ ID NO: 71127 - RNA, 22 nt, Human
ugcaggucuggacccccacuuu

SEQ ID NO: 71128 - RNA, 22 nt, Human
ugcaggagcccaggaauacuau

SEQ ID NO: 71129 - RNA, 22 nt, Human
ugugcagaaggagguucuccgg

SEQ ID NO: 71130 - RNA, 22 nt, Human
ugugccuuucacuaugucauuc

SEQ ID NO: 71131 - RNA, 22 nt, Human
ugugcaguauugaaauauaugu

SEQ ID NO: 71132 - RNA, 22 nt, Human
ugcagaacacaguagacagaac

SEQ ID NO: 71133 - RNA, 22 nt, Human
ugucuuaaaauuuuagggcuau

SEQ ID NO: 71134 - RNA, 22 nt, Human
ugucuucagguuccucaccacu

SEQ ID NO: 71135 - RNA, 22 nt, Human
ugucuucauuccccaugaaguc

SEQ ID NO: 71136 - RNA, 22 nt, Human
uucuagcucauggugacagauc

SEQ ID NO: 71137 - RNA, 18 nt, Human
uucuagaggucucaucca

SEQ ID NO: 71138 - RNA, 22 nt, Human
uucuagacaauugaaaacuguu

SEQ ID NO: 71139 - RNA, 22 nt, Human
uucucuugccuucucuuuuauc

SEQ ID NO: 71140 - RNA, 22 nt, Human
uucucuggggacugucucuauu

SEQ ID NO: 71141 - RNA, 18 nt, Human
uucucucuggauaguagu

SEQ ID NO: 71142 - RNA, 22 nt, Human
uucucaauggcaacuuguugcu

SEQ ID NO: 71143 - RNA, 22 nt, Human
uucucagagaaagcuccucaug

SEQ ID NO: 71144 - RNA, 22 nt, Human
uucuccacguucuucucggccu

SEQ ID NO: 71145 - RNA, 22 nt, Human
uucuacauugugaaguucuuua

SEQ ID NO: 71146 - RNA, 22 nt, Human
uucuaauauuaugauuucuaag

SEQ ID NO: 71147 - RNA, 22 nt, Human
uucguugaagcaacgacuuugg

SEQ ID NO: 71148 - RNA, 18 nt, Human
uucuaaauucuguuuuua

SEQ ID NO: 71149 - RNA, 22 nt, Human
uucuaagaaauggaaaacgauu

SEQ ID NO: 71150 - RNA, 22 nt, Human
uggggagucccaacgguggaag

SEQ ID NO: 71151 - RNA, 21 nt, Human
uggggaugcauugcagaggca

SEQ ID NO: 71152 - RNA, 22 nt, Human
uggggacucacugacuaucuug

SEQ ID NO: 71153 - RNA, 22 nt, Human
uggggaagaacuugccauuuca

SEQ ID NO: 71154 - RNA, 22 nt, Human
ugggauucugaaaauggauuac

SEQ ID NO: 71155 - RNA, 20 nt, Human
uuccucaaaagucugaugcu

SEQ ID NO: 71156 - RNA, 22 nt, Human
ugggcagagggugaggaaggcg

SEQ ID NO: 71157 - RNA, 19 nt, Human
uuccucaggugugaguuag

SEQ ID NO: 71158 - RNA, 22 nt, Human
ugggcaguccagcuggaaacgg

SEQ ID NO: 71159 - RNA, 22 nt, Human
ugggauauagaauuggcagagu

SEQ ID NO: 71160 - RNA, 22 nt, Human
ugggaugagcuauauagaaagu

SEQ ID NO: 71161 - RNA, 22 nt, Human
uuccccaugugaugcuauugcu

SEQ ID NO: 71162 - RNA, 22 nt, Human
uuccccagaaaaguaaacaagg

SEQ ID NO: 71163 - RNA, 18 nt, Human
uuccauuuuucagucuuc

SEQ ID NO: 71164 - RNA, 22 nt, Human
uucccauuccagcucgaucaau

SEQ ID NO: 71165 - RNA, 22 nt, Human
uggcuucugguuuauccuuaua

SEQ ID NO: 71166 - RNA, 22 nt, Human
uuccaggacuggguguuugaag

SEQ ID NO: 71167 - RNA, 22 nt, Human
uuccagaacaauguggacguau

SEQ ID NO: 71168 - RNA, 22 nt, Human
uggcgacuggaauuaaucuuuu

SEQ ID NO: 71169 - RNA, 22 nt, Human
uucauugauuuccuuggaauaa

SEQ ID NO: 71170 - RNA, 22 nt, Human
uucauugcagaauuuggccuca

SEQ ID NO: 71171 - RNA, 22 nt, Human
uucauugcuacuuaaaauacca

SEQ ID NO: 71172 - RNA, 22 nt, Human
uucauuauuaauaauagcagcu

SEQ ID NO: 71173 - RNA, 22 nt, Human
uucaugucuuugauucugauaa

SEQ ID NO: 71174 - RNA, 22 nt, Human
uucauccucuuuaucuaccugu

SEQ ID NO: 71175 - RNA, 20 nt, Human
uucaugcagugguugcugug

SEQ ID NO: 71176 - RNA, 22 nt, Human
uucaucuucaaaccccagugcc

SEQ ID NO: 71177 - RNA, 22 nt, Human
uucaucauuuuccauuccucuu

SEQ ID NO: 71178 - RNA, 22 nt, Human
uucauauuguggucuugcauuc

SEQ ID NO: 71179 - RNA, 22 nt, Human
uucagguuuuaugguaaugcuu

SEQ ID NO: 71180 - RNA, 22 nt, Human
uucagguuuuuaaguucugccu

SEQ ID NO: 71181 - RNA, 22 nt, Human
uggcauuuuguagcuguguauc

SEQ ID NO: 71182 - RNA, 22 nt, Human
uggccaaauuggccugauguau

SEQ ID NO: 71183 - RNA, 22 nt, Human
uucaguuugaauucuguagaac

SEQ ID NO: 71184 - RNA, 22 nt, Human
uucauagaagggaguuuuuccu

SEQ ID NO: 71185 - RNA, 22 nt, Human
uucaggggcaaauacauuuuga

SEQ ID NO: 71186 - RNA, 19 nt, Human
uucaggcuuuucauuuuuc

SEQ ID NO: 71187 - RNA, 22 nt, Human
uucagcugcuugccugaaguca

SEQ ID NO: 71188 - RNA, 22 nt, Human
uucagcacuggacagcgagucu

SEQ ID NO: 71189 - RNA, 22 nt, Human
uggcaucuggugauauggacua

SEQ ID NO: 71190 - RNA, 22 nt, Human
uggcaucucggugcugguucuu

SEQ ID NO: 71191 - RNA, 22 nt, Human
uggcagugggaagcuggaaguc

SEQ ID NO: 71192 - RNA, 22 nt, Human
uggcagugagauuucucuucug

SEQ ID NO: 71193 - RNA, 22 nt, Human
uucagaauguacugauagaaca

SEQ ID NO: 71194 - RNA, 22 nt, Human
uucagaagguaggaaugucccu

SEQ ID NO: 71195 - RNA, 22 nt, Human
uucagaacugucuguccuuuuc

SEQ ID NO: 71196 - RNA, 22 nt, Human
uucacuuuuucucugcuugaga

SEQ ID NO: 71197 - RNA, 22 nt, Human
uucacguuguugaagaaaauac

SEQ ID NO: 71198 - RNA, 22 nt, Human
uucacugugauguuuaagagaa

SEQ ID NO: 71199 - RNA, 22 nt, Human
uucagaaagugaaucuuguuau

SEQ ID NO: 71200 - RNA, 22 nt, Human
uggcagcauuuuuuccagaaca

SEQ ID NO: 71201 - RNA, 22 nt, Human
uggauuagugcugaaaugaugg

SEQ ID NO: 71202 - RNA, 22 nt, Human
uggauucucuguagccugguuc

SEQ ID NO: 71203 - RNA, 22 nt, Human
uggauuuuggaauguuucagua

SEQ ID NO: 71204 - RNA, 22 nt, Human
uggcaagcuguuggcagauagc

SEQ ID NO: 71205 - RNA, 22 nt, Human
uuauuuuuguuuguuaagccua

SEQ ID NO: 71206 - RNA, 21 nt, Human
uggaggcguaaucacuguuga

SEQ ID NO: 71207 - RNA, 22 nt, Human
uggaguagaagggcuccuggaa

SEQ ID NO: 71208 - RNA, 22 nt, Human
uggagggaagcaaacacuagau

SEQ ID NO: 71209 - RNA, 22 nt, Human
uucaaacaguguagaauauaug

SEQ ID NO: 71210 - RNA, 22 nt, Human
uggaguuuauuugaauucuugg

SEQ ID NO: 71211 - RNA, 22 nt, Human
uucaaccuucagcuugaguugg

SEQ ID NO: 71212 - RNA, 21 nt, Human
uucaaccagcaauuggcagaa

SEQ ID NO: 71213 - RNA, 22 nt, Human
uucaaaccuaucuaagaaauag

SEQ ID NO: 71214 - RNA, 22 nt, Human
uucaacaacuugguucaaaugg

SEQ ID NO: 71215 - RNA, 22 nt, Human
uggauauuuuguaugugcguuu

SEQ ID NO: 71216 - RNA, 22 nt, Human
uggaucuugaugcuccaagagu

SEQ ID NO: 71217 - RNA, 22 nt, Human
uggauauagcugaggugucuug

SEQ ID NO: 71218 - RNA, 20 nt, Human
uucacagaggacucagguca

SEQ ID NO: 71219 - RNA, 22 nt, Human
uucacaauuuuaaaaaguggaa

SEQ ID NO: 71220 - RNA, 22 nt, Human
uucaauuacaucagaaucuaaa

SEQ ID NO: 71221 - RNA, 22 nt, Human
uucacauucauuucuuauguuu

SEQ ID NO: 71222 - RNA, 23 nt, Human
uucaccaaugcuguccaaguacc

SEQ ID NO: 71223 - RNA, 22 nt, Human
uuauuuucgugugugugugugu

SEQ ID NO: 71224 - RNA, 22 nt, Human
uuauuugcccauguuuagcaga

SEQ ID NO: 71225 - RNA, 22 nt, Human
uuauuucaggcauuuguaaaug

SEQ ID NO: 71226 - RNA, 22 nt, Human
uuauuucauguaaaauuuaugu

SEQ ID NO: 71227 - RNA, 22 nt, Human
uggaggaggaugcauuuguugu

SEQ ID NO: 71228 - RNA, 22 nt, Human
uggagcuuuguguauuuuuaau

SEQ ID NO: 71229 - RNA, 22 nt, Human
uggaggauggaaggaaagcugg

SEQ ID NO: 71230 - RNA, 22 nt, Human
uuauuguagcacuuuggcagug

SEQ ID NO: 71231 - RNA, 22 nt, Human
uggaggagaacugauuuggcuu

SEQ ID NO: 71232 - RNA, 22 nt, Human
uuauuaauacaugcaccugcau

SEQ ID NO: 71233 - RNA, 22 nt, Human
uuauuccauagaagucaaggaa

SEQ ID NO: 71234 - RNA, 22 nt, Human
uuaugugcuuuuugagcucuaa

SEQ ID NO: 71235 - RNA, 22 nt, Human
ugcuaguuuuugauacuuuugc

SEQ ID NO: 71236 - RNA, 22 nt, Human
uucugaaacauugcuauuuucc

SEQ ID NO: 71237 - RNA, 22 nt, Human
uucucuuguaaaauuccuuuuu

SEQ ID NO: 71238 - RNA, 22 nt, Human
uucugaaggcaggggcuaucuu

SEQ ID NO: 71239 - RNA, 22 nt, Human
uucugaugccuggguugcuucu

SEQ ID NO: 71240 - RNA, 23 nt, Human
uucugaggucacgguggaccugg

SEQ ID NO: 71241 - RNA, 22 nt, Human
uucuguuuauaauuugcaguug

SEQ ID NO: 71242 - RNA, 22 nt, Human
uucugcauaggcuauauuuguu

SEQ ID NO: 71243 - RNA, 22 nt, Human
uucuguucugcuuucuccaucc

SEQ ID NO: 71244 - RNA, 22 nt, Human
uucuugugugaauauaauuaca

SEQ ID NO: 71245 - RNA, 22 nt, Human
uucuuagauuuuauuucuucug

SEQ ID NO: 71246 - RNA, 22 nt, Human
uucuuauuuuucguaaauccug

SEQ ID NO: 71247 - RNA, 22 nt, Human
uucuucauucccuuacuuccga

SEQ ID NO: 71248 - RNA, 22 nt, Human
uucuucgacuguauaaaaguau

SEQ ID NO: 71249 - RNA, 22 nt, Human
uucuucuguuggcagagcauac

SEQ ID NO: 71250 - RNA, 22 nt, Human
uguaauuugguuagauuucuuu

SEQ ID NO: 71251 - RNA, 22 nt, Human
uugaaagaacaauucugugaug

SEQ ID NO: 71252 - RNA, 19 nt, Human
uucuuuccccaccccuacc

SEQ ID NO: 71253 - RNA, 22 nt, Human
uguaaagugguauuuaauuuua

SEQ ID NO: 71254 - RNA, 22 nt, Human
uguagcaauauaucagugcaca

SEQ ID NO: 71255 - RNA, 22 nt, Human
uugaagaagucaaaagcugcag

SEQ ID NO: 71256 - RNA, 22 nt, Human
uguauagcaggguucuuccucc

SEQ ID NO: 71257 - RNA, 22 nt, Human
uugaacaguuuugucagguuca

SEQ ID NO: 71258 - RNA, 22 nt, Human
uugaacucagcuacugguuggu

SEQ ID NO: 71259 - RNA, 22 nt, Human
uucuuucgaacaagagaaguuc

SEQ ID NO: 71260 - RNA, 21 nt, Human
uucuuugaagacccauuugag

SEQ ID NO: 71261 - RNA, 22 nt, Human
ugguugugcuucuuugccucag

SEQ ID NO: 71262 - RNA, 22 nt, Human
uguaaagaaagacgcagaguua

SEQ ID NO: 71263 - RNA, 22 nt, Human
uguaaagguuuuagagcagaga

SEQ ID NO: 71264 - RNA, 22 nt, Human
uugaaaaaaucugaggaggacc

SEQ ID NO: 71265 - RNA, 23 nt, Human
uguaaaacaccguuauugcaccu

SEQ ID NO: 71266 - RNA, 22 nt, Human
uucuuuuuagcugguuguaaga

SEQ ID NO: 71267 - RNA, 22 nt, Human
ugguuuguauauguuugugaga

SEQ ID NO: 71268 - RNA, 22 nt, Human
uugcagagaacuaaagggagua

SEQ ID NO: 71269 - RNA, 22 nt, Human
ugucuaaggaaaaagucuauuu

SEQ ID NO: 71270 - RNA, 22 nt, Human
ugucuagacauuagcuucagcu

SEQ ID NO: 71271 - RNA, 22 nt, Human
ugugaagaauuaaugugaauca

SEQ ID NO: 71272 - RNA, 17 nt, Human
ugucuuuuuccuccucc

SEQ ID NO: 71273 - RNA, 22 nt, Human
ugucuuuuaaaaauguguaaaa

SEQ ID NO: 71274 - RNA, 22 nt, Human
ugucuuguaaacaagaggggcu

SEQ ID NO: 71275 - RNA, 22 nt, Human
ugugaaugacuuuguucuuugc

SEQ ID NO: 71276 - RNA, 22 nt, Human
ugugagauuuuauuugauaugc

SEQ ID NO: 71277 - RNA, 22 nt, Human
ugugagccuuuauuaaccucau

SEQ ID NO: 71278 - RNA, 23 nt, Human
ugugaauggccuucuuuagaggu

SEQ ID NO: 71279 - RNA, 22 nt, Human
ugucuucuuuucccuuagcccu

SEQ ID NO: 71280 - RNA, 22 nt, Human
ugugaagugaugggugaccgag

SEQ ID NO: 71281 - RNA, 22 nt, Human
ugugagcugccacuucuaaucu

SEQ ID NO: 71282 - RNA, 22 nt, Human
ugugauugcauugcagauuacu

SEQ ID NO: 71283 - RNA, 22 nt, Human
ugugaugagaugaacuguagac

SEQ ID NO: 71284 - RNA, 22 nt, Human
ugucauuggugaucugaugccu

SEQ ID NO: 71285 - RNA, 22 nt, Human
uugauuuccauuguccagcauu

SEQ ID NO: 71286 - RNA, 22 nt, Human
uugauuaauugaugaaccucuc

SEQ ID NO: 71287 - RNA, 22 nt, Human
uugauggaggaaaaguuggaau

SEQ ID NO: 71288 - RNA, 23 nt, Human
ugucacuuguggucacuaggcug

SEQ ID NO: 71289 - RNA, 22 nt, Human
uguauugugggugucagagugc

SEQ ID NO: 71290 - RNA, 22 nt, Human
uguauugaggauucauuuuugu

SEQ ID NO: 71291 - RNA, 22 nt, Human
uguauggguaggaaacagcugg

SEQ ID NO: 71292 - RNA, 22 nt, Human
uguauauuuucuguauaaaaua

SEQ ID NO: 71293 - RNA, 22 nt, Human
uguauuuauuuuucaacuacca

SEQ ID NO: 71294 - RNA, 22 nt, Human
uguagaccaaaccuucuaaacu

SEQ ID NO: 71295 - RNA, 22 nt, Human
uguauuuuuucccugaaauaaa

SEQ ID NO: 71296 - RNA, 22 nt, Human
uguauuugaagaaagagcuucu

SEQ ID NO: 71297 - RNA, 22 nt, Human
uugauaacuuagcugggcugcu

SEQ ID NO: 71298 - RNA, 22 nt, Human
uuggugauguagcagcaauugu

SEQ ID NO: 71299 - RNA, 22 nt, Human
uuggugaugaaagugcugcgcu

SEQ ID NO: 71300 - RNA, 22 nt, Human
uguugcauguggcuguuugcca

SEQ ID NO: 71301 - RNA, 19 nt, Human
uguugcagcuugaucggua

SEQ ID NO: 71302 - RNA, 22 nt, Human
uguuggaauaagugcuugaagg

SEQ ID NO: 71303 - RNA, 22 nt, Human
uuguacuuaaauaugcaaauag

SEQ ID NO: 71304 - RNA, 22 nt, Human
uugguugaaauguguucaugcu

SEQ ID NO: 71305 - RNA, 22 nt, Human
uugguuccauuuuaccagcucu

SEQ ID NO: 71306 - RNA, 22 nt, Human
uguuuccuaagugucucugaag
